United States Patent 10,900,036 (RNA INTERACTOME OF POLYCOMB REPRESSIVE COMPLEX 1 (PRC1)) - sequence listing, part 12

SEQ ID NO: 23915 - DNA, 1250 bp, Mus musculus
cttctaagtttttagggttaaaggataacttgatttttttaattattattatttttaaagatttatttatgtatgtgagtacactgtagctctagagatggttgtgagccttcatgtggttgttgggaattgaatttttagggtctctgctagctctggttggcccctcacactccagtcaactctgatcgctcgctcagtccctgcttgctccggcccaaagatttatttattattatacataagtacactgtagctgatttcagacacaccagaagagggtgtcagatctaattacgggtgattgtgagccaccatgtggttcctgggatttgaactcaggacctttggaagagcagtcagtgctcttaccagctgagccatctctccagcctggataacttgatttttattactgtcaattctgaggacacggctttacaaatatataacaaaatatatattacatattatatattacaaatatataacaaaagggcagaagtatgtttagggttatttttttttttttttaagatttatttatttacctggttgatcctgccagtagcatatgcttgtctcaaagattaagccatgcatgtctaagtacgcacggccggtacagtgaaactgcgaatggctcattaaatcagttatggttcctttggtcgctcgctcctctccatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaa

SEQ ID NO: 23916 - DNA, 1196 bp, Mus musculus
tcgaggccgcggggctcgtggaggtaaagctgaagacaaggagtggatccccgttaccaagctgggccgccttgttaaggacatgaagatcaagtccttggaggagatctacctgttctccctgcctattaaggagtctgagatcattgacttcttcctgggtgcgtccctaaaggatgaggttctgaaaatcatgccagtgcagaagcagactaggactggccagcggaccaggttcaaggctttcgtcgctattggggactacaatggtcacattggtcttggtgttaagtgctccaaggaggttgccactgccatccgaggggccatcatcttggccaagctttccatcgtccctgtgcggagaggctactgggggaacaagattggcaagcccccacactgttccatgcaaggtgacaggccgctgtggctctgtgctggtgcgtctcatccctgtccccagaggcactggcattgtctctgctcctgtgcccaagaagctcctgatgatggctggtatagatgactgctacacttcagccagaggctgcactgccaccctgggcaactttgctaaggccacgtttgatgccatctccaagacttacagctacctgacccccgacctctggaaagagactatgttcaccaagtctccttatcaggaattcactgatcatcttgtgaaaacccacaccagagtctctgttcagaggacccaggctccagctgtggctaccacataagggtttttatacaagaaaaataaaagaattaagtctgctttaaaaaaaaaaaaaaaggaccatgtggcagtgagtagttagttcactctggtctcccggtgggtcacacgtgctctgcacctgcccaaaagctatagattcacgaatgaaacacacacatacacacacacacacaccctttatattttgatatgccttgactagctcaatggcagggcacttccaaacctccctgcagctcacacacattcccctccagtattcttgaaagtaatacttgttaaatctatactttatctctgctgctccagacttaatcaggggagtggcccctgggacactgaaaatgttttttgttttttgttcttgttgttgtttttgtttgtttgtttgtttgttttgttttttgttttttgagtaacacaattagcattagaacacaagcca

SEQ ID NO: 23917 - DNA, 1577 bp, Mus musculus
tcgggacagcaagcttctatgaccaacatgttcctgtcactgggcatgggagtcaggggagctgccttagaagcagaagggaacttagtccaaggtgttaggcattagttataagttactcatcctgctgcagattgcattctgcacagcagctgtgtctggaatgcagccacccaagtgtgacatgtatttctagaatacatatgttagaccctaggctttcctggttcatttcttagaggctcgcacttagctgggcatagagcataactgtaatctcagtgattgggaagttgaagcaagaggatccaggagctcagagtcaggctttgctaaatgagaactatcttaaaagaagacaagaaaggaagaaaagaagagaaggaaggaagggagggagggaggaaggaaggaaggaaggaaggaaggaaggaaggaaaggaaggaaggaagaaaggaaggtaggttgatcggtcggtcggtccccttgaggggtctcaatagggcagagatcagctgtgctgtgagactgtgtaagctgggctgctggatcattgccagacactcttgactactgaacttattccgctctagtattctgggtggcctgagacaaagaccagggtgcttcccggcccaactgcaatctcttggcacctttaatgtcccttaggctgacacagtgttgtaagttttccaggcttggagtagatgtcagtagacttttaacatctccatgaaaccttcctacatcctttatcagatacagttcagctttcatcgtgctcatactccagtgtgacttacagacaggagaataggctggcagcctcagcaggatttgttttatccacaaatatttaggtatatgaaatttaaaacatagctttactctatcttcaaagccactacggttttggtgaaaggtaatgggataataagtttggaagaggaggcaagtttagcaaggacttgacaaaaggacaagcagaacctgcttttaattagccatagacagctacagcctaagcctggcctgggaaaagccaagaggcagtttggtgtagatcccagagttcgaggtcacctgaaactggattccaaggatgatttggcgggaatggcccctcccccttcttcataacccagtgtcttggaatagtaaaattgaaccttggtcagactgaaaaaaaaaaaaaaaaagatcccagagttctcagaaggcacctttggaaatgacagaatacctattacaatgtgtttagagcctcagcacctttcccacactatattgtgcctctgcaaccccaggaaaaaggcctcatggaaggtcccaagcctaggaccacactttattatcacactagataataaagtctgttgtagcctttggtaattggctgctatttgacctcagacagtagcagccaggcttgcttattgctcttgaagatcagagcttacacaagaaagaaggcctaaatatactgttaaacagcaggatttctaaggagtgttcccttctagtaaagatacagaaaactcataggtctgagctagaggtgaagctcagctct

SEQ ID NO: 23918 - DNA, 1196 bp, Mus musculus
agacgctctccctctcttccccacccagtgtcctcactcccaggctaggcgggtaactagctccacactctccaggtctgctgttgctgaggcttagcgggttttgcatggctgaaggcagagactgaacatagttgtgcatgcttataattgcggcactcgggaggtggagacaacaatctcagaattgaaggtcatacatagtgatcttgagaccagcctgggctacttgagaccctgtctaaaacatgtccaaagaacacaaaataaaactgctgaagtaagatgaccggtgtgtgctaaaacagaacagttgccaaggagtgtggtatagaagcagctgagcctgtgtgtaccatgtgctcccatgtgttcctctcttcagaagagtgttgaggaagagggtgatataggtgccatgcagcagtactaagagccctaggatccagtggtgaaacagtaagtgaccaagtctcatttgtacagcgatccctctgtgagagcgagcaggttcgggtccaggctgctcagaagcacaccttggtatgggccttgaggcaaaggccccctacggactggaacctccctctaccacaggagaaggacaagtgataagcaactgcaaccctacccttgacctagactttgactggctcttacttgacctggaacacagagcaaagcatttccagccctaattgcctgctgcccactggatctgggcatttcatcactgtaatactctgaaagacacctgtgtgcacatgctggaagccaagcactgaggcaggtgtctgtgagcactcaggtgggtccattctgtccatgccatctcccctgagaacatcaacaccagatgtggcagccgagagttgtgaaaatctcaagtacacagtggcagccccaacctgtgtggatccagggcacagtagttagaataaggttgctagactaccttattttgattatgaatgaccctccttggccatgagagatggactgcaatgtcttgtctagtgattatcgtggtatgcaagtgcggagctcatgcttgctcagcttccctggagacacggaagagcatgctcagtgggtaggcaacttgtcctctgcaccagcaccttttactggttttgcagactttgaaagaaagagagagagagagagagagagagagagagagagagagagaactg

SEQ ID NO: 23919 - DNA, 1660 bp, Mus musculus
gcggccatctcagctgaaaccatccagcagttgtggggtaccaaacacagttttacaagagagtagcttttcttcttacatatttaaaattatgagagattgtacagtttggtatagtgttacagttaataactagtaaaatattgttagagctgggcatggtggcatatgcctttagtcccagcattaagaagcagaggcaggttgatctctgggtttgaagccagcctggtccacaaagggtgttccaggacagccagggctctacacatcctctgaggatcttgagcccatttttctcactggctaaaacacatcaaccattgtgtggatttaagtcattttggttccttctgaagctactactggcatgtgtggggacacttgtttcagctttaggagggggcagttttagagactggtatagcattgactacagatctgaatgaggtgactcagtcacattgtgtcttcagcattaacttccagtttaactcacttaaaagacccctaaatgttggtcgtcttgaactgtgagcctctgggggctgtctaggaggctcgcctcacaattgctgaggtaccttccaggctacaaatatctgcgcctgctgcagataagatttggggtaagagttagcagctgtggctccagcttgtacccttgttactgttcctctgggtcttgtgtggcccccacatgtgttagcttatgctggcctgcatgatgtagccgtttcttcagttttcttttgccttggtggaggtgaaatacggggctcttctgcttgcatttaggagtgggattagttaagttagactgctcaggtcccttcgggtccattcaatcggccattacaacttatgtttctatgtggtggctattttctttttcttatagataacacctgttcatattttattttattttattttccttcacagaaattcttgcaactctgagaggtcattctggcttagtaaaaggtttgacttgggatcccgttggtaaatatattgcctctcaagctgatgatcgaagtttgaaggtatggaggacgctggactggcagctagagactagcatcaccaagccttttgatgaggtaacggaaacagtctagagcttggcctctacccctgctatacttcttgaacagtgagggaactagccgtggtgcaggccctgcggcatgcagtttaggggtctctagttttatgagttaggtgataaaatcttttctttccgatgaggtgttcatggtcaactttgaaatgaaaaatattttattatatttttatttttagtatttttaagtagcatatagtcttttagggttcattatagcattttgaaacatgatttattgtttttgctcttcctcctacctcatccctgaattccattccctctctcatatcctcctccgttggtaacctccttcccacttgccatgttgtatgctttgacgagtgctgcacttcctcaactgttctcttcctgtcttgtgatccctttctagtctcatgacctacacacactcacacccgcacaccctaagccaggagacaatgtgtacaacttttgagtgtagcttaccttggtgagtatagtaatttctagatctagcaattttcctggtaatttcaaaattttgat

SEQ ID NO: 23920 - DNA, 1948 bp, Mus musculus
gaagaggcgtctgttccctggaactgaaattatagttgttagtttccatgtgggtgctggaaaccaatcttgtgtgttctctaagacattaattgctcttaaccactgagccatttctccagaccccttctccctttttatgtgtatatctgtacgtgtgagtttgtgtatgtggacacacacaagcaagtgtgagcacaccatgccagaagaaagtggtggatctcctgggaactggagttagaggtggttgtgaactgcctgatgtgggtgctagaactgaactcaggtcctctggaagaatagcagagttctcttgactcttgctgagtcatctctccagctttcatttgtgtttggactaagagaaatttatactggtgtgtgtttgggacctatctgacacacaggagtgagcctgagtgacttatgtaactatttgcaggagccttgagtaatgtggaccagaggtcagtgcctagagaaagtgagctgggttctttctgagaccatctcatcctgctccgtagatctctgcttttgcaattgctgaacgaatacaaagctgttcccctgccagactttagcttcttcagtgtgtgaatttctgtcaggccttggtctccccagcttgtggttttggcagttgtatctcgattgagttgactatgccttgtatgttagtggagatcatcaaagctcctgggcttataaagatggttaaatttagtgcacagactggttctcagtgatttcattaatttcaacttttttccccttgtagctcacatgtttgaaacggcctctggttgtcatccatgaactgtttgacaagtccatcatggatatttcctggtaagatggattcttactacactgcattggctactccaacctgagacctcttggctactttacagccatgcagcctggtcactttcctctggcaaaccccaaggtgcagtttgcactctactcaggtagcaacatctctgccttgctcctgtgtgaattttacaccatctctgcctgttcctgtgagagtgtcatcacgagtagggtttgttacagggaaatgtctgcttggacaaactgggcattctgtaggtttatagcagaaaacagaaattgaaaactaagaaaatttggtaagattctctgcacgtacctagctctaaagggcaccaaaggctgcccctatctttaggtcacagaagggagctttaggtttctagcatccatcagagtattctttgagcctccccatgtggcaacttcaggtacattgtccacctaggctcctgacagctgtctctttcaggactctgaatgggttgggtatcctggtgtgctccatggacggctctgtggcgttccttgatttctctcaggatgaactcggagaccccctgagtgaggaggaaaaggtaggcttgtggcctatgtgctatgatactggctctgagaacctattcaattgggtcctcttcttgtggaagacatttcttaactattctaaatagtttgctttttatagattatgttaatcctttttgaaaaagaatagattaataataaatactcatgtcagaaataagtattggagcaaagaataaattgggcatctgtgcttgctgagagagcactggctataaggaagtttcacccctgggagagagttggagtcacttccatggggttcttatttatgtcatgtccttcatcctcttgtttcatgctagcatagcagcagttatgtgacagttaatactggtcactgttagccactgtggcaggtccttgcccacgtacaggttttgcacatatttatcatttaaacttcatataattactgggtgcagtggcatatacctttaatcccaaagaggctgaagagaatttagggtcagcttgggctacatagtaagactggtttaaaatgaataaa

SEQ ID NO: 23921 - DNA, 1181 bp, Mus musculus
aattggggtaggtttgagcaggaggaaagctagataagctgttccagaaagtgcgaagactttgccattattccagtgagcaatgggtgaacccacttaggaccaaggggactagactgaagatgaagggcaggaaggatgaggtcatgacttcaagacctagtgagggcttccactatagttcaccgtggaagtggcagagcccgtgttagtatcacttgagtggacatgctgtgttgaggttatggagacccagtatattgtctaaccctcaaaattgttcaaaaaacacaaaagggaaaatgtgaatacatttgcccttgaacttctcagactttcagaatcttaatgcatgaacattaaaaaacaaacaaacaaacaaacaaacaaaaaacaccccaaaacagtagactatattttggagttttcttgtatccgtagaaagaaggttgatacttctttagatgagctccaagttatgtaagtcctagaccatcaggtgctttgttgcttgtgtttgacgaatctcccatctttcccccagtatgaatgctacctctactcctgctgcatcgtcaccctctgtgttaacaaccccatccaagattgaacccatgaaagcatttgattcccggttcacagaacggtccaaagccacaccaggtgctccttccttgaccagtgtgattccaacagctgttgaaaggtaggtggtagctactgtatctcctcgggacttcaccatgcatcctgcctcctttaggagagcaaggctccaggggcttctgtgactgaaagaaacagtgcctgctgaaagtggagaggtggctggaaggtgctgtggggagggtgctgtggtctgaggatacaaagggaagaggcacaagagctgacattctagccacctgccaagaatactctccaactctggatctcagagtttgctgagaaatggagcaaatgtgtggttgggaaaatagaaggctctgctgttgttacactgagtctgctgagaggtgaccgaagacacagggcatttaagttaggtcttggtaggacacatggccctctaaactctgcagacttgatgcaacataactatttcttctatcttcttaacatatagagtagacactaggccagccagggccgcagaggactacccctgtctccaaacaagc

SEQ ID NO: 23922 - DNA, 1151 bp, Mus musculus
aatacattctttcttatgtttctttttaatttattttattttcattttatgtatatggatattttacctgtacctatgcatgcataccacatgcattgttgccctcagaggtcagaagaaagcattgagtcctccggacttgaagttacacatggttgtgagctgcaatgtgggtgctaggaattgaaccaggtcctctgtaagagcaacacgtgctttaaaccactgagccatctttgtagtcccaagagtagagtcttagaaccataaaattattcagtgttagactaaataatcccttatatgcaagtgcccagcatctgtgcccatgcttctcccattatgaggacttttcactcaactatcatttcactgcacacctctgcatcttgcttggtgcatctctttagatagcctttgtggactctgtatatatcgttttcttctggccatatggtgtgagaggcctgagctggtgttggggtgcttgagggtagacaccatctcttccagccataagtgtgtgtggatcatgctgaggaagggttgggcagcttgaagggaagagtagcactcacgtggtggtttgctcatgtgtgcatgtgcgtgtgtgtccccaggtgtcttcaactctcagtaccacatggagccatccttggtttctggtgtctagagagaatggagctccttgcttttaaccaacctcctctctagttcaccacttgcactcatgaaaagttgtcaactgttctgtttgggtttccatacagaaacctagcttctacagatcagatctgtagatatgtataagactgaatccatttcatgccaggcattgaactagacatgataatgtgagttatgtaatgccatagtattacatagggaagtttgttaatgtggagagcacattgtggggttttttttttttttttttttatactttcctctcttatcaaatatagcagtctttggtaatctttcaagtctgaggcttactcccaagtccaaggctgtattcttgggcatgttacaactctgtgagatgacatcccccaggccctgttacccttctctggtggccagtgagctagtctgcctctttgctgtctttgccccacctcagagctcaggttgtcatacagttcctg

SEQ ID NO: 23923 - DNA, 1364 bp, Mus musculus
aatggagcctacctagtaatggcagttgcagactgtcagcaggagcaggggaagaaatacaggcagaacaccagaaaccaccactgtccctatgtgccttattgacccaggattgccctacaggattaccctgcctggaataggaaaatatttctctgcagccttccccaccctacaaggttaaatctctaagaatcctacctggaaagttttgtggtgactcttagcaaatgtaggtctggacagagcctggtctttcctccttccctgcactacattgtctcttctagccactctttcttcatatgcactcacctggtcctgccttttagctttgcacttaagttgcagagtttctgccaagccagaaaaggccccagagtctggacctccctggaatatatccctcaactgtagcttttgtgttcacagggtctgcggaaaagggagctgctgaaggaactgttgccagtcattgggcagaatcttcgattccagcgcctctttactgagtgccaggaacaactggacatcctgagagacaagtagtctgtcctggcttgcctcagctgctgcaagggcaggaccacactattgccactggcaggttgcccagggctagccccacctgtcagggcggtagtaggaagagagaccttggcagaagatgtgttgtcctgcaccagcactagcccagttccctgggtggacatggactatatcccaagcctccatgactccaaaagggggcagcttgtccctccatgtaggcccagctgtggacttggggctgggactggggctctgccttgctgccagcagggatctcttgagcctgtctccagcttgaccccaaggtagacactggcatctgccactgcaggtgctgtgctgcttcagctgtaacgaatgagccatttgtgagagcaggagccggggagtgttagggatgatgcagtcggcagacggacccgaagcctgtgtgaatgctaagctgttctgacacatggactatttttgtactagaatttgctaacttggaatatggagtttctgttggttgatcaggatatccctataagttacttggacattggtcacttgtaggaaatttaaactctaattatgacagctacactgaaaaaaaaataattgtactgaaattaacttgtctatcttcatttggtttaatttttaaatgtttgtaaaaagagacactttgtgtggggggtggggtgggacagaggggagggcaatttcttttctaagtgtaaaataaatgaacatgcattggataccaaaccatttgccttccctgccttttccttctcatgccctctcctccctcaacctgagtctttttc

SEQ ID NO: 23924 - DNA, 1230 bp, Mus musculus
tcttttatatgctaagctacttctttagaaattgaataccagtttaatcatgtactccaggttcacttttgatcattccttgaatcaatattttattaccttagccccttgactcttagaaatagaatctgaaatacagaacacaattgaggcaaataaaccagacaccaaatacattttgtgacatagcaagtcctatgtattattggctgtcaacttgactaatctcgaataaactacagtccagaattggagggctcacctgtgatccaggacttgaagttggaagacagatgtttctgacctgaatcttgtcatggagatcttgaagcatagtggctttgaaaagcttaggctcaggcatggtagtacatgcctttaatctcaggcactaaggcaaggagatctctgagttcaaggtcagtttgggacaaagcaagtactagatccaggccaggtggtgcacatctttaatctggcacacaccttctgctggagaactacaacaagacattggaagaaggaagattctctctttttcacctgatttcatttactttccagaatatctattggcacctacttctacaaaagaccagctgaaacatctaacctggtgggactgagcaactactagattcttcgacttcccattcacaggtgaacattattggggtggttggactacagactttaagacatcacaataaattccctcaatattaagtgaccttccataacttctgtgactctagagaaatctgactaataaaaaaaatgtactgtgagtggttctagaagagcagaagtataaggatggttctttttaaagtctggaattagcttaataatttgtcagcaccttctaattcaccagcaccttctaattcactgaaacttctgcatatattctctctcctgggagttcagagaatattgaaggcctgtggtagaaactatatttcaaattaaagaatctagtgcctttaattttcttgatccatcaattataactggcaacgtataggatggcccagtgtacacaactttctacagtttgtggggaaatatgaaaatgattttgcttgtttgttgcttttagtatctctggaaaaattgatgaaggaaaataatgagctatgtgatagaattgattggctccagatgcaaataagcaatctaaagttttctaaatgtgcccttgaagaaaatattctctacagcagaaaa

SEQ ID NO: 23925 - DNA, 1201 bp, Mus musculus
aaaattttttaaaaagtacccaaaacgcaagtgactttgttttataaaaagaactaattagatccccctcatataataaaaagaactccaattactagagccccgacattttacaatgatgcaaataaatcaagaaaggtagggtattgaattggagatttctgatttctttggagattcagttgtgtcatataatatttttctggaaactgtcctatgggaggatgctttgctgaggcagacacaggagagcatgttttactgagaacagacacatggtgtttttctggaaactgcctggaaagggggcatgtgatgtttctctagagggtacattttagagaacacatggataacctaacagacagtggatgatgctgtggtattggtttgccttgccaatctttgctggtcttcattaggctatgctgacattggtcttctctgacagcactgtggttttggttcactttgccttctttgctattcattacttgttatgatttcatagagagaaatgcaccaaagagcttctcattatattccagtgacttctggctgtttccactgacttgggctgattgacagagactcttctgtttgttctggatgaactgccattgctgattcatagagagaatctacaagtgacttgaggtactgctgctgatctgtgtgaactgaactgcaaatattttgacaagattggaattgccccaaataaatgtttctaaataggtccacatcttcctttgttctgctaaccttttctttccactacctctggtgagtgatgagctataaggaaggttaaagttataagtataatacttgtaagttcttataattcagtttaaaaatcagaattatatgcaatacttatgatgttactagaatttcaagactctcttaatatagtaactaactctcaattttcagaaagagttggcttgcatatagaaactgctgaaataattcaggatgattcttaattgacttcactgtttatttaactgcaaaaagttattagaatcgtccattatatatccattatatatctcagacctcatacaggtctaccaggccctatagcacaaggtaatgatcaaatttatcagctattgataggaagtgtgctggcagcctcagagtttcataaaaaacaccatgttaatagtaagggttaaagaaagaattctct

SEQ ID NO: 23926 - DNA, 1175 bp, Mus musculus
tcccgtgggactctgttattcgtgggtatgagggggaccacaaacctgggagaaaatgggaggaagagaaaaaggagctggagaccaagtagatttttcctatcaaggtctcagtttactaggctgaaatgctgagttttaaagcatacatttatgggaatagggaggggttgagggggaattaacaaagaacaaagaagtgggcatctgctgacatgagggccgaagtcaggctccaggcagcaggcactctgcatcttatctctggaacatagatcctccttaacagccttgggtgtcaggccgggctcagtgcataactcatgtccttggaagtcatgggagccagaaagagatagggaagaggggactataattcagtttttacagcctcaggtgccaggaagggaacagggagaagggagtgacgaccgactcctagcacaaggccatttggcttgtcagggtgggagactgtgaaaggctttttctcaagatatggtctccaacattcctccatcttctcaatttagttttttagatattaggtgccatgtcatccaggctggtgatgaatgtgtcatgtaatcaaagatgaccttaaactcctccttctattttagtctccttaatattacaggtgtgtgtctcaatacctgtttttgttatatttctttatgcttgtttgttctaaaactgggtctcactgtaaagtccaggcttagaaatcctggcaacctcctacctccacttcccacaatccagaaatatatgtctatggcaccatgcctgactggttttgcaatactttcttacctagtaattttttgctgatatgatcttcccctgggagtgaggaaagctgcctaattttacaaagatgaggtttagtatggaatacagctacaatgcataatgtatacattgtttatatgtttctgtagcactttggcagaattgaccagttgtgacaacataactgccaaggttggaatgtttagcaccttaccctttgagaacacatttgctaataatccctgttccatttgcccctatgtactattgctgacacttctgaaatcctgattctcaaactcatagtgcctgttctcaacacaaaataaaaatttagagtctgtcactctatacttgcatattaataccatgaaatttgg

SEQ ID NO: 23927 - DNA, 1124 bp, Mus musculus
ttgctctctttgtttgaggatgagggaaacttaaataaactgtgctcttttccttttttctacttttttttaattctatggaatattctttcttgcagcaaagaaaagaattaggatccaaagtaatcttcttcttcttcttcttcttcttcttcttcttcttcttcttcttcttcttcttcttcttcttcttcttcttcttcttcttcttcttcttcttctacttcttcttcttcttcttcttcttcttctacttcttcttcttcttcttcttcttcttcttcttcttcttcttcttctacttcttcttctttttttgtctgtgattaacgtgtatcaaacaggctcttctgccaaaaagctcttaaccctggctaaaattaaaacaaagaataaacaaacagcagtttaaggagtcttggatcaggcaaagaagttggcattcgaagtgccaggttcctaaagagaatggaaaaaaaggtgctaaaatttttaaatttgccatgcttttggttttttgttttgttttgatttggtttttccattctagacatgtaaagttcccaggttaggacaaagaagctgaacaaaatgtactgtaacgtaaatattttccagattcactaggatagaaatggcaaactattaactgacatgggtaccaaggcaataagatacttaaggtgccaacttgagtaagaaaagggtcagagaaatcaagtaatgaagttacacctaatatacattgaacctctgcatttttccaactcctatcacttgcctgaattgaaaattaattaataaaaaacattcaggcaatttggaaagaaatttaaaatcaacaaaactaaatgttggttttatagatctaagttaaaggaataaaaatcaattccttctatccaccaaaatgaaaaatatttaaaggacttctcatttaaggccactgaaaacatatcctgtaactataagaaccaagtcagaagagatcatctatgccaaagcctaaagccatccaaaagatttgaaccaaattggatcaaggcaatctgtttataaaacatatacttaatagttgaataaattacctctgggcaaaggcaaaattactaaaactatatttt

SEQ ID NO: 23928 - DNA, 2638 bp, Mus musculus
aaatatactgcaggttaattaagatagttcttctctgcagactgacttacaggaattcatacccttgttgggctgcatttgcttagtagtacatgaatgctgtactgtgttaagtgtcactgagccaaacttgaatggaaaataataatctgtaaatgtttctctctaccctaagtcaaatgaattgaaagcaaagagattcatttcaaaacccagtcaaactggtcagtgtaactccaaattaaactgcagcttaatttcatttcaaggaattcatattctaaacgacttagatcatgagcaagggtaaagtaagaatttcaagttctcatttggttctacacatgtatttaaggtatggagaacacctgagaagccttgatatcaaaataatagtttggggaagatacctgagaaatatataatatagcatttctaaaaaattaatacctcttagaacaagcaatcccaattatcttattaaagagttctaggtagaggtggagggaggcaggtgatgcagaaggaacgtgatgaaaggttcatccgaatgaggacatatgtggaaaatgtatataatttcttatagttaagtcgtttaacattggcattcctacagccagttacctaggcagttctggaatcatttaagatatatttgtttcattttctcaaatttaatttttagtgtaaaaactttagaaagtggtcagctctaccctaataaaaactatatgtacgctttctctaaagttataaaacaagaatagttcctggcccctggaggaccttctttaaagataaatcactatcaactccaataagcttgttttaatttaatgaattattcaatggcttttaaaacactagatattggcctctgtttaaggtagttgtttggatgcagcttacaatgaggagtataataacagaagagacttaaaggaaagatagaactaggggtatagctcagcatccaaaagggaagacaaagaagcaataaaagtctcttttccttgtaattgtaacatcagcttggagtccagaccatggcactcaatactcaaatgccgcttccaataaggtcttgtaggacacagattttgttccaagtgaagacttttagcttgaaagtttttaatatagtaccacgtctaaaataatccattatttgactcaatagctatcagaggttatcttttaaatatttcaaacatgggagcaaaataagagtgctagagaaactgaccaaatgagattagaaatgttggtaaatctgcatgttctttgtaatcagaggcttggcagatctaataaattaaattacatttattttacaaaataggattaaaacatgtggctggtatgcaaacagtgcaccagcacagaaaggactaaggggtattcatcgattaaggacctgtaatgcaggtcaaaacacgatttcagcaaatgaagatggatgcttaacaaccctcagacagatgcatataatagggaaagtttagctactattattagggtggttttggaaacaatgcaaaaaaatctaaaaatacacaactaaatgatatctgtgttttcacaggtagattttttttaaaaaaatgtttacagaaatctttgtgaagttttttattatgagatatgaagcttgtttatcctactcgggtagtttcctactaatttcaagactagtgttaaacattctaaggtagttatcttagggtagattcaaggttttagatgactaacagttcagattttctgatcaattttttaaacactagagaataaaagtgtactagagaataaaagcagcttcatagttaattctcaccaattggccctttgctagctgctggctttaggtacacataggataatatgtgtccacgtttctacttggaactggtaaaagttgtcactggctggaaaatggtatctctctcttgtatacaagatggtccattgacactggtactttatgaagcagttctttgtttgtttgattgagctctcttgaaccttgttcatcttttagtttttgcttagaatagaatggaactggtttgaagttaaaggaaatattcattttgaaacttgttcattttgaaaggaaatgcaagtttcaaaatgaaaaataaaatgaaaaaggaaataaattattgtcccagatggtcacttgagttttaaaaaatggctgcacacagtaaaactgctaaaaacaaaaacttacctcattattggtttgcatcttttttcagctactaattttataccaaaatgttaaatatttatattgtttgagtttcaatcttgtatggaaaaaaataattagtaggtctaaaaatgccatgctttccaataaagaagttaaaaaaatcatcagtaatgtgaatttaaaatcctgtgtgggcatcattctgtgtatcgtcacctgctgtcttataccagaagaacctgcactacccatccattgtcctatgtgtgctcaccctgctgctgtgctcactggtgggctgtcatggagctacttaaggagctatgctgtgactgtgggaaatgctgtttgtccagaatgccatgacaaaaagctcttgcagttttagtgtattaagatgccatctaaagaggt

SEQ ID NO: 23929 - DNA, 1198 bp, Mus musculus
tcatttttaaataaaaatgcagtgagtgtattgggggtggggggagctacaaaatgacattgtttccatgtcaggtctagtgaagagcataagtcaagcaaagccttttcagtcagtaaaaatgccaaccctacagtgtctaaaattgaatttggatctagcatttgctaccctagtgtcagacagtagtaggactctcattggctttgggccttactaactactgataaagaatacttacttaggtaggactaaccatcacctgacttaccaagacccaatattcttcatcaagtgtacagataaattattctgcctaatgaaagtaaagaaatgtacaagatagtattcatgtcctaatcttagcttactctgattgtggtattttgggttttttgttttaagttggttactcatatttgtttttaatatcgacttttgaatctgcgtaaacttgagaatgtacaagttctcttaatggatgattggatcagaacagcagttaaatataattgctattctatgtactactctaaatcctggtatgtacttttaagcattcttctctatctcctacacacaaacacacacacacacacatccagatacgcacaatagctcacaaaaattgtgctgaattagttgtgtggacattgtaaggttcagtaaagcagaagaattatgtattaaagttacttgataagcttggaggttctatataaaaaggtatataataaaagcttaaattaaaactaggtgaggttttttttttcttttaactcttgagacttttctcaaattgattccatagttacatgtagtacagagtgaataaactgtttactcttgacatatttggctttgatatcaactttgaatctgcctaaacttaagacatcaactcttagagtaacttaattctatcgaatttgaatgcaatgtaagtttgtaagcatccttcaaatattcaaagtggaattatcacaggatatacttttcttcatctcaccatcaaatttagcttactgctttcataaatagtaaaagaaatttgaatatcattgaatataaaattaatttcctttaagagagtgttacttttaatgatctgtatgaaactgaactttaaattaaaaagttgtaatttactaagaactgttttcagcatattactaatgtacttgagctgatagcatct

SEQ ID NO: 23930 - DNA, 1099 bp, Mus musculus
tgtgatgccttgtgagtgcctctccgctgccttgtgagcagttattagcctaggagagttgtctaattccttaatatcctacagcagtggggcctctcacttgtaactctgaccagcagcagttccggtctccagagagaaatctcttatttgggagagctcttttatttgtataaaatactgatcatcattttcagatttctattaaatttttccctctaggttttttacctccattttgtaaagcttagcagtttgcaaagggaaatgtgaaatttttcttagacacataagtgaatacagcaggaattagcacaactaattattgtaacttccagtgccctgggctgcagcaggtgacttgctgtgtaacttcccagtctctcactataatatactccttgtcaatgacaatggtgtcaatcgatttctgttcaaattcaggcagttatcagaaacctagcattggcaaacaactttttcctcatcttaggataatacaaatgtattttaagagtcatgcttagttggaatctaaattctgagaaaaatgctaaaaaatacacttaggaaatggttttcaagtcataaattataagtgatatagctatagaaacaatgcagaaaatcatctgtcaggtgagcaacagatgtatgtaaaactgagggtatgtgtactgtaattttatagtaagtatctgcattatgcttttgttagagaatggaaattgtttagttcagaaattcttaacagttaagtgtgtgaacaaaagtgttttataaatgcttaggattctacaaatgataattgttattctcatgtatatttgtaagatcatgtccattcataaatatatataaaagacttggtcaaagtaaatttgtattttagtatttttgtctgttgtaaaagtattatctacttgtatcttataatgtttatctttcatatattctcatgtttattgcagtaaattggaaaaaatcctgaaaatcagaatttgttcaaacaaattaatttttatgttacaaattatattaaaagttaccagaaagtacctgaatcctagaaaattaacttttaaaagctacccaattg

SEQ ID NO: 23931 - DNA, 1139 bp, Mus musculus
taatagtggtaagccctggtttaaaaaataataattttgccgggcagtggtggcacacgcctttaataccagcacttgaggggcagaggcaggcaaatttctgagttccaggacagccagggctacacagagaaactatgtcctgaaaaaaataattaattttagggtataataaatgtattaaaagggctatatcaaccatcctagagtcagactatcttcattctgttatcccataattggcagactttcttttgataggtgatgtttatatgagcctctaagttaggatgtgtgtgtgtttatatgtagatagtatgatgtgtacatatatcacaaacacccaatggtttttgcagtttaattatcagaaatttgtataaattaaaaaattagttgatcatagacaatttgattacataagactaaatttgaacatttctagagtactctttattgttgagacaggatctctgtagcctgtgctagcctcaaactcttagcaattctttgccttctgagagctgcagttagaagaggaagccaggaccattttctaaaataagcatttcatctgaaagtgcagatctggtcttaaggatctgtgcacctgtgtaactacagcgttacaaggccaggaagcagacctggagatctgtgtaacgacagtgttacaaggtcagaaagcagacctggagatctgtgtaacgacagtgttacaaggccaggaagcagacctggagatctgtgtaacgacagtgttacaaggccaggaagcagacctggagatctgtgtaacgacagtgttacaaggccaggaagcagacctggagagaagcgtgcaaacaccgcttgtggctgttcagttggaaaggtcatatgttttgtgaatcaacaggaaattacagttggtttttgtgtacattttcatgaacttgaatcctcctccaagtcttctccatgtactccacaaggtggcctgacttcctccctgtctgctgtactctcccacactgactgactgacaggaattgggttctccacagccgtttgtcatagatgggcggttgggatccaggtgtttactccattggaatcaggttttaaacgaccaaatgctcagggagggcattggcttg

SEQ ID NO: 23932 - DNA, 1662 bp, Mus musculus
actactctctggcctctacaggcacacatgatgcatatacatgatatgcaaactgtcatagtacaggcaaaacatacacataaaaataagtatcacgggctggtgagatggctcagtgggtaagagcacccgactgctcttctgaaggtccggagttcaaatcccagcaaccacatggtggctcacaaccatctgtaacgagatctgactccctcttctggagtgtctgaggacagctacagtgtacttacatataaccaataaataaatctttaaaaaaaaataagtatcactaaaatgttgtatgtgagccttttacatgtgtgtggttgccttaaatatcaaacttatacagtgctaaaggtgatagaacatagaaagtgaagtcataacttcatatattgttccaaagaagttttgttttaatgtttgtgccttaagctacccagtgccattttagtctgataaacctcagtattggtttttgagggtctagttttgttttattttttgagtccgggcgatatagatccaaggcttgcctaaaactctgttttgctgaaaatgatcttgaactccaatcattctgtcatagctcccaagtgcttggatgatagcttgtgccaccatgcttggctgtgtgggtttctgtggtctgggtgggttgtttggttggttcttcaattggttgatttaatgtagccctggctaacctggaactcagtatatgaccaggttgaccttgagctagtggcaattctcctgcctctgtctgtgagtgctgatgcttttgtgaataccagctgcctgctaggcagaaagagaatgttaactgaggttgttgcttggagttttacatttttaacttttggtacctaggtgctttgtaaaatactcagataaatacccactgagctatttggaatagtgaagagtatgcgtagttatttctgtttgtcattatattagtagtgctgctccaggcttttccttgagaaaacacttcctcttcatcgctcccgctcctgcagtgtgagtctccagagctatcgaaggctttcagaaccgaacaagtgtgcgtgcttttctgtaacttccacacagccattgcctagagtgaatgctcacagtgaagaaaggagtgttctccatgtccttgttctccgttcagcagtagtacagtaatgtagtacagtaatgcttacagttttgtttaattgcacttcctccatagtttaaatttttaaaagttgtatctaatgtcttttaaacattacttgactatatggttacattaaattttgtttaccaaaaatctgatgagttttaagtttggttttttttttaatatacctaaatgattgtgcaaaaaaggggcaagggggaaatcagatgtttatatttaccagaataaccataaaataattcagaacataaacaagaaactaaaatagtaacttgagaaaaggaaaggtggccaacaagaatactaatgttagtgtgtgttgagtgtggccctggtgtgatggctggtgttaaaatggagctgttcagatgaagcagaagaaaggtgataaaggcatgttaatacagcttatctgtgaggtgtaagggaataaagacatgttaatacagctcatctgtgaggtgtaagggaataaa

SEQ ID NO: 23933 - DNA, 1174 bp, Mus musculus
tacatgtcagctccatttataattaactccccgtcttggtttattgctgtgataagataccataagataccagcaggcaggcaggcttggctctagagcagtagctgagagctcacgtctgatccataagcataaggcagagagagctaactggggataggtctggcttttgacactgaaaggcccacacccaatgacacacaggccacacctcctaatcattcccagagttttaccaactgagaaccatggagttaaatctatgagtctgctgcactcctttttcaaacctccacaccacccaacttggagtggggtgttgtcctcaccaccactaagtccagtttgtgctgcccagctagcctggggagtgggagcccattggccagcaagtcaaaatggtaaccaatacccattactgggtgatttattagctagtaaggtctctagttgggatattgtgcccctattggttgataaatccattaagcctctttatttatatacagtatatactttacagtatatctacagtagtgtttccatgagcttttaaagaaggcctttagtgttcgctgtctccccatagttcttctgtaccccactcttatggctcccatcccaatttagcgcttcctatttcattattctcttttaatgatttatctctgtgtccttgctcccctccctggatacttcactctggtgctttagactgctcagctaccccgacactgctcatcatcaccattcttacagtcttaactctgtgtgtgtgtgtgtgtgtgtgtgtgtgtgtgtgtgtgtgtgtgtgtcctagtgaggacaggtactggaggaagatagaggcctctaatcctcctagagctggtgttcctggtagttattagcctctgagctatctctccagccccccccccttactttttaatgattcaaagctgtcactaaaatgttgaaaatatatagtcagtatctatctatctatctatctatctatctatctatctatctatctatcaatcagatataagtaataaatgccttctgctccatgtttgtatatgcatatttactttagggtagttcttttttcctccaaatgaagtccattttgttcttcctagaaattactttgttcataatttttaaaaatctttatttttgttttatg

SEQ ID NO: 23934 - DNA, 1585 bp, Mus musculus
gctggtgtgagtcagctacagagaaggtaatacgccatgtgggaggccaaggaggctgcagtgagactcttccacggaaccatgacgctagtgcagtgacagcctgtgtcacggccgtgttgaggggtcccagcagaggcctgtgtcgtgtaacccagggactacaagtgtcagtgtgggtatcaacctcaaagtcaggcacttgagccatgtgtggtcctcctccatctgggattcagaagcccctgccactgcctcaggtcaaggggagggaggcagcctcagtgcagactttataggattgtcctcttggtggaccggagtcctgtccttctctgccaaagagttttaccaagatgaaaagggttgaaacacctgtgagtgccttacatgggaagaactgctctaacccactgtgctaatgttcagaagcagagccctcagtgagagctgcacacacgagcctctagcatcactacacagtgtgcacacactggggactccccagtcctcctgactattatggggacacaggaaagacctcagcctcagttgtaaacctgctctttgtctgctcaaaggaaacttgaaatatctgagtaaaagtcaaagaaacccagctaagtaagcaacataaagcctgttgtgtcaggtcctgcaggtcgatgtgtgagtcaggaaacactgcagggaaatagacctttccttccgtacctgagagctgcaggtaccaagggatctaccgtgcagggactgggcaagcacagcttactgctataattgggtatataaggcttaagaatttggtctatgccaggcgtggtggcgcatgcctttaatcccagcactcgggaggcagaggcaggcggatttttgagttcaagggcagcctggtctacaaagtgagttccaggacagccagggctacacagaggaaccctgtctcaaaaaaacaaaaaaaaaataaaaacaagaatttggtctaagaccatacagcagattgatatgctggcacagatttgttcagaagtggacagagacttacaaggtagagtatcccaatgagagcagattcatttgttgtgataaaaaacctaaagaaattacttttttgctaaaaaaaaaaaaatcaaatgatttaacagtttctgtgtatgttaaactttcaagtgtttttttaaatcataatgtgtaataattgtgtatcattttgtctacaataaaacgtttagtatttgcaatgggttttctgagctggaagcaccgtacttagatgggctcattgagagaggtggttgtggtatgagtctttgtaagtttaaattgatatctctacttccctaaaaaaaaaagaaagaaagaaaaagaagatgcaaccatgcaatataaaaggaccacagttacattcaggtcacttacaaaaccgtgagcataattatttcatacaagcaatttggggtaaaggaaaatgaataaatgggttcagtttctcaaaaaagcagactctttgtctaacaagctagtttatctggtgaaataaagttggtctgtgctaagctctgaatcactcccaggatgcaagtct

SEQ ID NO: 23935 - DNA, 1180 bp, Mus musculus
cacgaggatagaagggagctggaagcatgtctggagagcatctcctatagggctttaggctccccaactctggttagctacttactaccctgctgaggggataactcatcctgtctttggaaaactgaggggataactcatcctgtctttggaaaactcatctccataaattccagccagcacgtctgtgtggaacaagcccattcccctttgcacaccccttcaagcgctggaaagagcctgagaggtttagcagtgtctggtaagaactataaggacttccttgtggttcttttcttcccaggctctccccacgggagcatctaggtctgatggtgtttcaaagccatggctgaggaagcagctcagacctcccacacagcatcccctcagaggtgctagcaggcccagcctccctcttaccaaccatatgcatacgccaaggatcctgtccctctaggtctgtcagcttgcatgctcagtgttcctaagagggaaacgattgcctgctgggcagattaacaatttactaaaatgcaaaaatgtgctgcagcaacttgttataaacacaggcatattctttcccatccctgtagcctcccaaaaatggccgtaatatagtgtagcttcgctaatatccttgaactccaaacccttcttgctcagagctgcagatgcttccagtgttgcaggtgttaccttctttccacttcagctctcctgcatacttaagtgggaaaaggggccatctgtgccactgctgcttcctcactggcagggacagtgagcactccacttctgcacctgaaagtgagactgctattacctataccctgctggcttgttaggacatcctccggaaagccagccaagcatggctccccaatagtcctttccactttaactcttccaggtaccttttggtcctgctgtagccactggcatgccccagctaaaagcctccagctgtacactgctagtgaccgcaccacatgtccagcaaccccaccccctgcattcactcttggtgtagagatgcatgacctcagcagtgtgccacaaagctcttctcaccagtcctcctgaggaatgaaaccctgcccttaggaagtccctcctcattgcagatctgagtatggtcacatggttccacgaacaaccaagaagccaccaaggccaa

SEQ ID NO: 23936 - DNA, 1114 bp, Mus musculus
gtagaccaggctggcctcgaactcagaaatccgcctgcctctgcctcccgagtgctgggattaaaggcgtgcaccaccacgcccggctattttatgtgtatcttgagtgtatgtgtgagcaccatgtgtgtgcaagagctcgtgtatgtcagtcagaagaggacagttacaggcagttatgagccaccatgtgagtgccaggaaccaaacctagagcttatagatttactttctttcctgggattattaatgttctgatgggtatatgtgtggtatttattttcatttttgtgtttttaaagaagttgacaaattctggcctagagatttttaagctgtctgagacctttggcttgtgttcctgacacacgggagcaggagatagaagcaccggtacgctcaaggtttatgactgaaagcaggctcttgggttggcaggatgtcagataaggcaagtctagacagtgagttgtttgcaaagtatttgccttctgaattcagagaagtttctctgtgctgctttaatcctagatgtagacaggagcagatggcgaggaagctgcactgtgtcccatgtctagaggtagagagtctgtgttggagaaggactcgtctcaggctgttcttgaaaagccactttttaagggtagggtagaaagcaagctccttttacatgttttgtttgctttggaatgtatcgttgttgttattgttattattttaaatagggtcttatgatgcagcgtaggctgcctggaacgtgtggctgttgtcctgcacctgactcccaagagctgggattgtgtgtgaaataccatacctctttggaagttttcttgctcttattcagaaatatttccctagacttcaagttgcttagggaaaaaagtgtgtgcatatatgtatgtatgtatgtacgtgtatacatatatgtatgtgtgtggggggggcgagacagaggttgacgtcaaacctcttgctcagttgttctccacctgaagacaggttctctcactggagatcactgtcctgtcttctgtctccatccatccatgagggatcataggtgcgcaccaccttcttatgctcttttcttttaaacatgattctaagg

SEQ ID NO: 23937 - DNA, 1889 bp, Mus musculus
cccacaatcacaccctgacacgtctcctcctttgcaggtggtggagtttgacaccccatcggtccttctgtctaatgacagttcaagattctatgccatgtttgctgctgcagagaacaaggtggctgtcaagggctgagtcctcccgtcctcgaagtctcttcctcagagcattgccattctcttcctggtttgggcccctcatcctgtcctgctgaaacttcgcctttcccagttttatctctcacacaaccattcaggattagctgtgtgtttcacttttaaggaaagtcatattttgattattgtatttattccctattcacttaaatgaaatttagtttttgttcttaattgcactcttaagaggttcagggaaccattactataaatgttatcagtggcctataatgaagctttatatgtgtagctatgtctatatataattctgtacatagcctatatttacagtaaaatgtaagcggtttattttctattaaagtgagcactgtgctaacagcagtgcacactcatttctatcgtttttgtacagctgactgcactacaggtcattttgctcttagctgtagcaaaggcagattccgtctctagctggtcgtttcacggtgctgggctctctaggcgtccaggggagacacgcggcagcagtgggccctccatggcctgccccttgggctccccagtgggaacccagtatagtgggctgcaggaggccttgcagagcaccgtgaattctcagggctcctgctttcctgtcttggtgtcagctgctgtttatgttagagcagtgggcaaagccagcccccaccccacccccattccctctcaggaatgagaacctctgcattcctcagagggagagcttctttctgccttccttcttctgctgccatttctaagcaagatccagtctgctcccagtgttccatgcttcaggttcctgaggctggtcgccacagagttgtcgagttccctggccagctggttcccagccccagggtccactgctgctgttgtaggtggcattttcatttgcctgaccccaaggctccagagctcagcaacagggctcaggatggtggggtccgttcttcctcactttagtctcctctgcaaagtctgcacccacccctcagcagctcttgctaatcagtgtctcacactggtgtagaagttttttgtactgtaaagagacctacctcaggttgctgattgctgtgtggtttggtgcgctcttgcagacccccttgtgctctggggctcgtagcttgggtgggtgtggttgccactgtcaccagtcgagtggtcagcgtcgcatgtcgtgaccaactagacattctgtcgccttagcatgtttgctaaataccttataaaagcaaaaatatgaaaaagtgaataaaattattttggatttgtaaagctcttgttgtataaaacagttgtctggggagggtgtgaggtacttctgaatgtctttgtagtactggagccctggatcctaatatctgatgatgaaatctcatctgcaaaagggttgtttgcaaaggccaaggggccccggatacccaattctgtgtgatgggtcttagttcccacagcctgcactcctccacttacctaccagatgaggtacccacgctgctgtaagaggttagagagcatgaagagtgagtgagccaaggtggggagtggtgtgtatacttaaatcaagttactattgaaggcttgcagagactatcactgtcttttcatctgcttcactcaggttaacccaacaagtgttagtgtcttttcagaagggtatttactcatcctaaatcttttatattgtattgaattcagtcaaaaatgggtttgaattgctagtt

SEQ ID NO: 23938 - DNA, 1123 bp, Mus musculus
gcttgctcagcttgctttcttgtagaacccaagactaccagccaggggctggcaccacccagtgggctaggccctcccttcttgatcactaattgagaaactgccttacagctggatctcatttcctcaagggagactcttttctctgtgataactccaggttgtgtcaagttgacacacaaaaccagccagtacaaaaaattatatttttagaaccaaacctaaggacccactatccaataggatcttacctttctgagatattttcatgggatggaaactaacagaattacatattgcaaacaggccgagagcacatgcactgcagtgactcacacacaagtatagagtagctatacacttggtatgtagtaggttatatgaattctaagcaaagggcattttcacgtccatgtgaaacagtacatcgtacaggatttaaatactgaaatgcttcttaggaaactgaggaggacaagaatgcttggggaagtaactggatctgtctgtcctctgctccctggcagattctgattttagatgaagctacagccgctatggacacagagacagacttactgatccaggagaccatccgggaagcatttgcggactgcaccatgctgaccattgcccatcgcctgcacacagttctgggctctgacaggatcatggtgctggcccagggacaggtattacgttcctcaggagctctcactcggcatggggcatggtgtgggaggaaaggaagctggggaggggctacctgtcatcttcatgttcccgggcattcaccaagcagccatagcaacttagttctggtatgtgatgatctatatatccctatgccccagggatgctcttactctcctgtggcacatgagcagtgacacaggccgagagcacatgcactgcagtgactcacacacaagagttgcccagaggccgggcgtggtggcacatgcctttaattccagctgaggcaggtggatttctgagttcaaggccagcctggtctacagagtgagttccaggtcagccagggctatacagagaaaccctgtctcgaaaaacaaaaacaaaacaaaacaaaaaaaaaaagagtacacaaatataaaggcaa

SEQ ID NO: 23939 - DNA, 1234 bp, Mus musculus
tccagagtgctgggattaaaggttgtatgcactaccaccacctgactttatcaggtttttctttctttctttcttttttaagatttatttatttatttatttatttttatgtgagtgcactgtagctgtacagctggttgtgggccttcatgtggttgttgggaattgaatttttaggacctctgcttgctccagttggccccacttgctccagtcatctctgttctctcagtctctgcttgctcccgcccaaaaagatttatttattattgtaaataagtaaactgtagctgtcttctgacataccagaagagggtatcagatctcattatggatggttgtgagccaccatgtggttgctgggatttgaactcaggaccttcggaagagcagtcagtgcttttacgcactgagccatctctccagtcccagctgtttctgaaacttaacaaatgattattctcataaaaagttcaggtagctttgtgatgtacctgataacagctgttctgcatgttcagctggtgcgactttgtgcagtgttgtggtctgtgctgagcacacgtgtataatgtaacactgaggaacattgctcttgatgagtcttttgctggaagagagcaggatactagctagacagtggagggagagtggacgctgctcaaacagtgattgttttgaagattgctttcctgatgccagtctgcaacccagattcctatcccagcacagtcattccattcctctacacacacacaaactcagtacacacactcacacgtacacattcatgcacactcacacatacacattcaggacacacacagactcagacatacacactcacacacaaacacacacactcacatgcatactcccttgtgcttttcaccttagtggtatgaagtcaatgactatttgccagagaagttttaaaacactgagggatgactgctaaaaccaatcacacaggacgttctaacagccttttaatgtaggcatgcgttcccagggccagtcctgcacagtttggaaatgaggaactaaaaagcagaaatggcttgagtgggttgcaatgccatgcgtagcgggtacagcaggtcataatgctatgggtggtacgtgtgggtcacatggccatgggtggcaaagctagaattgcagtctgtagttcttagattggccaacatatttagatgttcaataaatgttaaataccttacttcagttttaa

SEQ ID NO: 23940 - DNA, 1154 bp, Mus musculus
cccacagcggatcttgatgaaagagacagtctgtggttctaaacagtttattggctgttcatggtggaaaatggatgcatactgtatcatactcacttctcagggtgggcctgagatcaaataccttttacagagaggaatgtctgggaagggaagcttatgggcaaagccctctgggcctctaggtacctcattagcatggagaactctgttttgggcctatgtcaccacaggacatacttcttttatgtaaggagcatggcacatgttctaggcagggagtggggagttgcctcaatctcaggtgtgtacctaccgagtctctgggcctctgcacgctctatcttaccaacaaaggtggaaacaaagggactgtgatcagcgcttcatttctccatcttaacagccttctgtctggaatggtgcagtgaatgcctggtgactggctaatagacgcacaccgccaccatttgttccctgtgcctcttctcattcaggaagtagggaagtagttactggatgtgtgtggcaggtgtgctaagaaaggaagcagcagggatgagagggatgatccaacaccccacactgtagattctgacgcgtactctcgcttgatcttcagcctaaaccctgagactgttacttcttcagggagttcatgtccagaagagactcagtgatctagatacacaagtgtatcatgaaacagcaagagaaaagtgtagcactgtgagagagtgaggggaaagagtaagcacagattccttgagtgtgtagaacccagtcatcagaaaagagtaggtgccagcatacaagatttcaaacaccttgactttgatgcagatgaagatgggcatgcagttggcgccacttcttgccaggtgccgccttctgaactgttggggacagtgggacctgtgttttgaagacagtttccttgtcctgtttggtaccagccattgtagtgtactgtagtcctcctagagcacaggactgcgttctgctttatgctatgctatggtccgtgggcccagctctgggtctgtaaaaagcaagagcctaacaggtggtttctcataatcagccagatttgagggccagttatgaagctggggctcttgggagtatgaaggtcatctttcacagcacttctg

SEQ ID NO: 23941 - DNA, 1121 bp, Mus musculus
aaagctgccatcctgatgcattgtactccagactctggaagcagatatggctctgccatgcatttcctctactgtgtatagttgcaagtgggaggccagcccatctgtgtgatggctatccccgttcggctctgtatgttcccaccaaatgttcctgatgcccctgctaatgtacagtgtttgtgagatgctctttgaacatggtatctttaaatatatatttcattttcaataaaagtacactgcttcccacttcctggtatttactgctgttgctgaatgtgcctgtgtgagtgtgtgctccggcgttgcaggacctcagagctggaggtgacactcgtggtttctgggggctggctgtcttccctccctgcaggtggtgttagacataagctacctgaggtaacatgtttttgtttttgagagggagtgggcgtggggagggccagagggagggtctctggagtttggtagcttgtattgtttgctctcttctgtcctattaaactgcccctgtttgtttgcagggatgttttgcacttcccactcttccgtacaactgtaggtacactgttcctttttatcgaataagcacgtgtgaaagggtacagagaaaggtctcggtttcatgtaaagagaggtagccatgtgtgaagatgctggagtaaggtcaatatatacctttggatgaccatgcgtttagaatgcattgcagctcatgggcaggtttatgttacattagaaagagtagtggtcacgatggcgcccttcagaagaaaagcaagtgaccccgctgtccttcacctgggggcagattgccgggaatatttggtccaacaacacagtttctctttgcttacacactgatcactgtccgtggagcagcctgctctttctaacctaacataacactgtggctttgtgtggggttaccgtgggcgatgttgactgtggtgtgtgtttctccctgtaggccttcgtggtgaagcacctcttggagtacacccaggcaacagagtctaacctgcagtacagcttgctgttagtgttaggcctactcctgacagaagttgtacgctcctggtcacttgcactgacttgggcattgaattatcgaactg

SEQ ID NO: 23942 - DNA, 1085 bp, Mus musculus
tctacaaagtgaggtccaggacagccaggactatacagagaaaccctgtctcaaaaaaccacaaaaaaaaaaaaaaaaaaaaaagaattcctaaggctaacgactgttcatttttgacaagtgtttgaatgatttctgtgactcttagtggcaatagaacaatagaaggaaattctatgaagaagaccttagtgcttagagttctagagctatgacttagggccaacatttgtccttaatgccagcactgggctcctagaacatgtttgtgtctgataccatgcctactaggctcaaattccagagccttagactgacccttagagcctgtttgctttagaataaaaggataaagtcgattatagtgtctgcaaaccaaagtataccaaagtataatcctgacttgaagatctcagactttttctttcctgccctataggtcctcttgcccctggccaacgttgcgctaattgactatactctggagttcctgactgccacgggtgtacaggaaacatttgtcttttgctgctggaaagctgctcagatcaaagaacacttacagtaaggcttcataatttttcctttccaggattctccgtcttttttcagttcttccaggatagagttgatgtgaggaggagaacactgaatctgttctgagctcctgtgaggtttagtgttctcgtcacgtgtcccgaggtaaactgctgcagcttcctttgccttgaggtcccagggaccaaaattaaaggcttgcctgtgattttgagtctttctttctttttttaatatatattttttattacgtattttcctcaattacatttccaatgctatcccaaaagtcctccataccctgccccccacttccctacccacccactcccactttttggccctggcgttcccctgtactggggcatataaagtttgcaagtccaatgggcctctctttccagtgatagccaactaggccatcttttgataatttctgagtctttcaaagtttgttcctgtgagttttgctttttgtttgatggctccagagtgtatgttattggaagggcatctttatttttcca

SEQ ID NO: 23943 - DNA, 1791 bp, Mus musculus
atcacatcagagctataccgatcactaggagacgtcctccgtgacgtcgatgccaaggccttggtgcgctctgactttctcttgatatatggagatgtcatctcaaatatcaatatctgcagagccctggaggaacacaggtcaggctggggaagactgcaggacaagacttagggaccagcagagtcctaagactaactgtgcctctggttcttaataggttaagaaggaagctagaaaaaaatgtctctgtgatgacaatggtcttcaaagagtcgtcacccagccaccctacacgctgccatgaggacaacgtggtgatggctgtggacagcgccaccaacagggttcttcacttccagaagacccaaggcctccggcgcttttcctttccattggtaactgggtgtctggggaaggaactcgggtaggagaaggcggagctgcgaggagagaggtgagctcaagcctctgcctgccacttctcccttcagagcctgttccagggcagtggagacggagtggagattcgatatgatttgttggactgtcacatcagcatctgctctcctcaggtgaactctccagaacagggctgtgtagccagagtagagctctcgggggtctgtaattgctccctttcaaggccagggtatgcatcttttccctctttttctgacttgttgtatagtagagaggtaccattacctgactcccagtatgctgggaaccaaatctagggttttgtcccacagccatttctgggtttcatagctctctgggcttgttacttgtaaagtacttaaccttagcgtgctctgttttcctcacaggtagctcagctcttcacagacaattttgactaccaaactcgagatgattttgtacgaggcatattaatgaatgaggaggtgagaagagcttccgaaacctctagtagaaagggtttatcttactctggtagcctttggttcccttttgtgtttcattaagcctgagaacgaaagctctggtcgtttgactatgtcagtgagaggcgctgaaaaggcttagaaaggtgacatgcttggggttcgtcttcctgcctcgcttgattgggtaaccaccccttctcatttaggtcctaggaaaccagattcacttgcatgtgacaactagggaatatggtgcccgggtctccaacctacacatgtactcagctgtttgtgctgacgtcatccgccgatgggtctaccctctcactccagaagtaaacttcactgacagcaccacccagagctacactcattcccgacacaacatctaccgagggcctgaagtcagcctgggccatggcagcgtcctggaggaaaatgtgcttttgggagctggcactgtcatcggcagcaactgctccatcaccaacagtgtcatcggccctaactgccatattggtgagcacaggtggggaacccagcagcggtcctatagatacggggctgcagtgtgtctccagaagctagggaggatgccgagggacaatcctatgaacaggaaactagagtggctatcataaggaaggagcagaggcatggagaggtggttcagtgtgcattgctcttgcagaggactcagattctgttcccaggattcatagctcataactcaagtgcaggaggagccagtgacctcttctgacctcctcaggcaccaaacatgtgctttgtgtgcatacataatttgggcaaaacactcacacacataacgttaaattgactaaatcttgggccaaaggaacaagaaaaagaaaga

SEQ ID NO: 23944 - DNA, 1221 bp, Mus musculus
ctctcttgtctgtcttgaagaggcttcttcatatgtggtaggaagatgataaggtcgtctcttacattatccatcatccttgcttagatagagggatcctgagactcccctttgctgactctgtaggtcctgatggctttctaccagctggagatcttggctgaggaaacaatcttgagctggttcagccaaagagacacaactgacgaaggccagcagttacggaagaatcaacaggtacgctgccctctgctccctggatcccgagtcctccactggaaactctaggactctgtggccagaactgtttatctgctaacaggaacagtgggaatgcgtggttctctcctagcagctgtcccctctgcttccttgcagctgcagaggttcatccagtggctgagagaggcagaagaagagtcatccgaagatgactgatggtgactgccagatccgtgcatctcattggctgtcctcgtaacaagagagctgacagaaagctagctacagaagcatgagtggccacggcagactgagaattattggaacggaagttgcaactacagtattcttcctactgctggcagccatgtgctgctcgtcctgactgaagttaggatgagggaagttagactgcgttaggggaactctagacagaccctgcagttgggggtgggccagagtaagtactttgtgttccagctttcccttggggaacagtaaagagcagctggtcctctctgttgtttgtacttgttaatattacaaaggggagtggactgggcttctccttgtggtcagccaggtaagaaagtacacgcactcacttagctgcttttagccaacccctggaggagagggagaagggttgaggtggccacaaggtggtgccatgctacctaattgattccattcccctggctcatgggacatgaatggctgagctgccttcccatgctccataggccagtctgacctgtgaccctgcagtggtaggccagagcctatttctgtagcttttcctggcctgaacattcttctaccggagggcgaggtgccaggtatatttgaagccatctgctactccccttgccttttccagttgacccacttctggttctgttagacactgggccacattcatcttaaaggataaggagatccacccagtgtggtggtacacacctttaatctcagtaccccggaggcagaagtaggcag

SEQ ID NO: 23945 - DNA, 1368 bp, Mus musculus
ctctctctctctctccgtacacatagatatatacacacacgtgagtctctctctctctctctctctctctctctctctctctctctctcacacacacacacacacacacacacacacacacacacacacacacacacacacacacacacacacacgcctcagggctggtccctgaccggagggctggacccttcttccaagtcatccctagatatggggctggtccgtgactgccctctcctcttcctgctagcccttacgcttcccatacatgttcccaatgtctttgtacttggataaagcccaaaagatgggctccacagagggctgtccaggtgactgacaggccattctctacttccctcctacacccccaccccacccccatatccttataactgttctgttttcatcttctccatgagacctgggaacacaggccagttggagcttaagcagacaactgggacttccaaacagctccagttattttgaaaattgttttctaccttaaatcacaaatttctctttaaaactctgctatataaactctgacttatccagactcttaactcttcagggcaagggtgtcagctgggaacatagctctgtagtgtctgcctagcatgccccagcaaatgtctccccccatcaggatgtccttagtccaggtttgggggcaacttgaagtagggctgttttgccattcattcatccgtttaacaccttttctgggattttaatgaacaaagggctatgttagaagcatgatttgatcttagctgtcttcggttctctctaactctgccttttcctgtgatcttgagaatccctcgtcagtgctcacttgtgcgctggacgccagtacccttgtcatcctgtctttggctcacatctcctcctttcccactcccatgatagtgtcagccattctcttcttaagctgttgatatgctggccacttctaaatctggatctccaaccccagcttcccctctctttagacctgtttttattacccactggacatctccacaggcatgtccataatagtcaagcattattcctcttgaattcctgtcctggtgaccttcgttacaagctacacctacatggtattagtcagcatcacacacccttctactcttgacactctgaagttcagctgttcctctccctttcttaatttacagagcatgggatttggagtcaagttggtttgggcttgaattccagctctcatttttggttgtgtaaaagagttatttaacctctctggagcctcagtcctcccatatgtaaaatgatgataataatacctacctcacagggttgttgtgaggaattagatattgtacgaaaagtgcc

SEQ ID NO: 23946 - DNA, 1144 bp, Mus musculus
tgctgtcaatctcctccttgctgacgtcatttctctcatcccatctcattggctgatgtagcaataggtaagcagcctgtgaagctgccgctcaggtacagggggtcctgcccccccaaattgttttccttcatcatttttcatccccttcagaagtcagaccttagaaaagaagtgggtggcacagtctatagcccctctcaccctttagagtagactcttccaaggtcatactagttttattcaactccctgaagagttagctttccccactgatggacccaacagagatctctttctctgcaggcctggaacttcctggaaagctagagtggggacagctggggtgtatctgggaaagcaagtcaggcccaggagtcagtttattaacactacaggcactcttcccgttattatcatttgagttcccctttaggtagcaagccagtgcagaaccttctcccaggaccctgcaggtggtataagaagggagccctagtggtttaggccttgacttatgaatatatgtcagatttcagtggtgtggagggtggggcagccagcatctgtaggtgatcctcagggggtgaggtctgcctaaatactgaattgcctctttgcatcttttcccttaggaggaatgctgtggatgcctttcgggtcaatgtcattcatgcacggcagcaggtgcgcagccctgtcacaaacatcgctcgcaccagcttcttccatgttaagcggtccaacatctggctggccgcagtcaccaagcagaatgtcaatgctgccatggtcttcgaattcctctacaagatgtgtgatgtaatggctgcttactttggcaaaatcagcgaggagaacatcaagaacaattttgtgctcatatacgagctgctggatggtgagacattggaggattaaatgccactgtggggaggggcctaactgagagggtcttgttttagagtagaatatgaaaataggccagcacgaagttttagtctttgctggggctaggaacctgactgtggggtttggtggccaagccacctgtattagcctaaaatcttcacaaactgaactcaactcttatctcaacactccctcagagcctggagaagaggaagtcctgtaggtcccttgg

SEQ ID NO: 23947 - DNA, 1200 bp, Mus musculus
acagcgaccatgatgtcatcaaatgggtgcgatacattggccgcagtggcatttatgaaacccgctgctagctgcctagttgcagctggcccacctccctacccacccttcccacaggtccaagtacccctagtgaccactcaccagtgtcgttcctccgtcctgctctgctgcctttcctttccaatagcccctgagtataagtctgaaccagccacaccacagtggaactggtcaggtagtgcctggcttcctgggagggtggtttttgaggcttctcttccgtctgtctgtcctggcttagcgccaggccctgagttttgtgaccaaagccaggtgctctcctcttctctctacccctgtggccacacctctgcagtgggaaggttgactacccctcacctcagagcttccccaaaggccagtaacagatccccagtctttagtccccactctgctttgggatagtatgagcttcgttttgtacacgtgtgactttgtccagttacaaacccaataaacaatagagtggagttgctggctaaatgttaatggggcccgcagagggtctgacgggactattattactccatgcagttctggctgtcctggaacctgtgtgtaggctcaggagatctacttcctgagtgctgagattaaagtgtacaccaccatgccagactttgttttgtttgggtcttgctgcttgtagctctggctgacctagaaatcactatgtagaccagactgcccgtaaattttaggtgatccctgtgcctctgcttctcaagtgctgatactgcagatatgtgctttgagatgggtttcattgtgtgagctgaggtggctggactcagggtcctcccgcctccatctctcaagtgcagtgttgtaagtgtgcaggtttcccagttagtacaaagaggcaagatttgtattagttttgttttgttttgtttttttaaggatttatatcagtacactgtagctgttttcagacacaccaaaagagggcatcagatccctttagaggtggttgtgagccactatgtggctgctggaaaatgaactcaggacctctggaagaacagtcagtgctctttaactgctgagccatctctccaagatcttgtattagttcttgcaggaaagatattttccccatgcatcttatcaaaccctggcaaaaacctccattct

SEQ ID NO: 23948 - DNA, 1204 bp, Mus musculus
aaagcatggggaggagcagccgctgcctgctgtggggctcaccaatcaccagcttttcttcgtgggatttgctcaggtatggccccttgggagaactccctccaaaggaaggatgcctttagaagaagttggggtcatgcaggaaaggtgttggggaagtgtactgagagaaagcgtggtgtccagagcccatgaaggtagacttgaggacaggggaattttctataggattttacttgaaagagaaggactgctggcttgagtggaatggatggggaaaaaagcattgattccctcctgttactatggaggaatgtggagaaagaaactatagctggggaatgcaaaacggcttgttaagggttacccaggaataaaataggtagcagagttagcacccaggcagggcctctaagtactttacaccacagaaagcagccttaaagggctcaggcttttcccacagccttgcccatgctgggttacccacgtgcactttaaaggcttcaagggtctgaggaggcatgttcctctctcttggagctggctaagtctcctgcaatggccccgacaactcctgaactcaccagctgggcagtggtggttcctgaccaagatggctctgctgtagctgaagctatggcctagctccgctccacactagacaccatatgtccccatgtctgtcctggcccgcaggtgtggtgctcggtccgcacaccagagagctctcacgaggggctggtgaccgacccccacagccctgcccgtttccgagtgctgggcactctctccaactcccgagacttccttcggcacttcggctgccctgtcggctcccccatgaacccagggcagctatgtgaggtgtggtagacctgggtggggaaagaaatgggcaactgtggccagggactggggcttccaagttaggagagagtgaagatcagctggtatggttgtctctccacactgcaagtgagatcaatctagaccccaccaccaccaccacattgtgcctctgctttaggggtgcctgagcctctagcagagattccaccattcactgtgacatcctttcatgtgtcaccctggagggagtctaggcagaagtgtcagttcccacagagatgagtctgtctcttttggactccaagcttactcagtttaggggatcaagaggatatgcctggggcatggccat

SEQ ID NO: 23949 - DNA, 1042 bp, Mus musculus
gaggtggccaaggagtggcaggagctggatgatgcagagaaagcacagcgggaaccactgcttaccttggtaaaggaaatcgtcccctacaacatggctcacaatgcagagcacgaggcttgtgacctgctcatggaaattgagcaggtggacatgctagagaaggacattgatgagaacgcctacgccaaggtctgcctctatctcaccaggtgagtgagtacaggagagcaggtagcactcgtcttccagggagtcttagggttcctcttgaaggaagagactttgtgactccttagtaatcctagaacatgctacattgccttctgtatagtaggcattcagtgtgtatacttgggaagggatttaaataagttacatgagttgcacgtcctgaaattgtactacttttgactttgtagttgtgtgaattatgtaccagaacctgagaactctgccctcctgcgctgcgccttgggcgtgttccgaaagtttagccgtttccctgaagctctgagattggcactgatgctcaatgacatggaactggtagaagacattttcacttcctgcaaagatgtgtatgtagagaaattggcaaaaggaaagatgagtctgtgtatgtgctttgtgtaaaaatcagagacgtagcagtttctgatgcgacacagaggcttttctgtctcatagtggctaagagtgagcaggtgtgaccgcttcccccacagggtggtccagaagcagatggcattcatgctgggtcggcatggagtgttcctggagctgagtgaagatgtagaggaatatgaagacctcacagaaatcatgtccaatgtccagctcaacagcaacttcttggctttagctcgggaggtgagggtctcctcttggtcctgaagggttttggccgaagttctgtcattctacctccctgactaatacctttcaatagactccctggttaaagttgctattcagtgggagaacagaagggacagctaggtaggggagtactggggaagcagttgtgaccctctggctt

SEQ ID NO: 23950 - DNA, 2067 bp, Mus musculus
ggagacatagattaatttaaagttggagactgggctagcaagatggctcagtggttaagagcgccgactgctcttccaaagatcccgagttcaaattccagcaaccacatggtggctcacaaccatccgtaacgaaatctgatgccctcttttggagtatctgaggacagctacagtatacttatatataataaataaataaatcttttttttttttaattaaaaaaaataaaaataaagtcagagactgacctgggtggtagagggcacacccttttgatcccaacacttggcagaggcagaggcgagtagatctttaaatttgaggccagcctggtctacaaagcaagttctagtacagctagggctacacagaaaaaccctatcttaaaaacaaaaaacaattttttaaaattttattttattttttaaatcagagactttctcccatgctgtgttcctttcatgtcctagctcaactgccttccctctcttatacagggtttggtggcagtggctctcaagtggattctgcacgaatgaacctagcctcctcttttgtaaatggctttgtgaatgcagcctttggtcaagataaactactgactgatgatggcaacaaatggctttacaagaacaaggaccatggtatagtttcattcgccctcccttcctccctccccacccccctctttttctttccttgtttatttgtcatatagtcagatgttacctgagaggcatccacagtacagtttccagaggagccctttataagtttctttggggtggacccttctaaagctgacagtcttccttgtcgtagggatgctaagtgctgctgcgtctcttggcatgattctgctgtgggatgtggatggtggcctcacccagattgacaagtatctgtactcctctgaggactacatcaaggttagtctgggcaaagcttattcatcggggactttttcttctcatgtcctagtacctcctttttattaatgaggtgtcttagttactttctgttgctgtgaagaggcaccgtgacaaggcagcttaaacaaaaattatttaatttgaggcttctatacagcttcagggggtagtccatgaccatcatggtggggaacatggcagcaggcaggcatggtgctggagcaaaacctgagagctccaatctgcaagttagaggcagagacagagactgggcctcaaagcccacccctaatgacacactttctccaataaggcctaatctcctaatcatacacagaaggaccaagaattcaaatatatgtgcttatgggaaccgttctcattcaaaccatcacaggaggcatgcccagtttcttactccagatacagtgccacagaaaggcccatagtgtacttggtagttaagagggtaggtagcttaaagagcctgcttgctctttgcagtcaggagctctccttgcctgtggtatcgtgaattctggagtccggaatgagtgtgatcctgccctggcactgctttcagactatgttctccataacagcaataccatgagacttggctccatctttgggtaaggcttcccactgttctttgtttgttgattttgtttttttctgagacaaggtttttctgtgtagccttggctgttttagacctcactctatagaccgggtctctgacctagaactcagagattggcccactgccctgtttgcttatttatttatttttaaaatcttattttctccgagattgcttctctttttgttaatacctatcttataaactctggagtagatattgccaaagactgtcatgtgctgttgagtaatctggctcctggtgaatgtgttagtgactcgttctgtttttgttcttcctttcttgctgtgttcctgagtatatgtgggggactttatcttctgactttttaggctaggtttggcctatgctggctctaatcgggaagatgttctaacactgctgctacctgtaatgggagattccaagtccagcatggaggtgagttgttgatgtctaatggaaaaggtaggggtggtgtgttgggg

SEQ ID NO: 23951 - DNA, 1978 bp, Mus musculus
ttaggagcacgcaaagccaggactgttgaggttgcaatcaagcctccatgctggcaggacagagtcctttacctttacctgtgtgctgtgtgtgtttgcgtgctaaataagtaatgtaataacactttaaaagagtatgcaaattggttagcacagtgcctgacatatgcaagtactcactgattttacagaaattaattgcctgtaaggaagtataacttacagtgcatcagaagaattaggtttatgaatgaagttacctaagtaagcattttaatatcttaaccgtggttgggtatggtggcacacactttgaatccagcacccaaaagcaaaggtaggcagatctctgatttccaggctaatctagactacatagtgagagcctgtctcaaacagaaaggaaaatgtcagtgtgtgtaatgttgactttcttatttctaggtggcaggtgtgacggctctagcttgtgggatgatagcagtggggtcctgcaatggagatgtcacttccaccatccttcagaccatcatggagaaatctgagactgagctcaaggatacctatgctcgttggcttcctcttggcctgggcctcaatcacttgggtgagaaatgtttatcaaaggcctgacagaattggatacaattggagggtttacgtatcatgctgagctggatacaagccaatgtcctttgactctttactctctattagggaaaggcgaagctattgaggccatcctggctgccttggaggtggtgtcagagccattccgcagttttgccaataccctggtggatgtatgtgcctatgcaggtctgtgccttactatccagcaactctacttctctgttggttctttttttctcaggttgtttcttttttgtctttcattctgctcttcggagttttaaggcttcttgtatttacagagtaagttttttcttgatgctttctcgttttctttccttgctctcgctgtcccactgcaggctctgggaatgtgctgaaggttcagcagctcctccacatctgtagtgagcactttgactctaaggaaaaggaggaagacaaagacaagaaggaaaagaaggacaaggacaagaaggaagcccctgctgacatgggagcacatcaggtgtgggccagcaggcactctgaaaaagatagcatgttgatatgagaggcagaacaaagttgagctttgtttttggcctctgctcctcccctgagtactgctacaagttagaatagcaggactgagttttgtccatgagggacaaggagttccctgcaggatagctcttcttagatgagccttgggtgactcggtttttgttctggagcttactgtagttttgtgcctcttgaattgcagggagtagctgttctgggcattgcacttattgctatgggggaagagattggtgcagagatggcattgcgaacttttggtcacttggtgagtagcccagagtagactggaatatgggggtagtaggtgctgggggttaaacctagggccttatgcatacatggaagtgattcaccaccacactacactttagtcctgcctaattctggttttggtggctattatttgccatacgtgcttgtgtgtaaatgcatagaggtgtcagtcttcaccttctgccttctctgaaacagggtctctgtcttaatcaacactcttgctgtgaagaaacaccatgaccaaagcaacacttttttatttattttatgtatgagtacactcactgaagacagtgacagtgtctggtgagaagagggcatttgatcccattatagatagttgtgagccaccatgtggttgctgggaattgaactcaggaagaagagtctgtgctcttaaccatggagccatctctctctccataaggcagctcttatgaaggagaacatgtaattggggctggcttacagttcagaggtttagtccgttgtcatgggagaa

SEQ ID NO: 23952 - DNA, 1099 bp, Mus musculus
gctacttcataactataattttgctactgttctgaattataatataaatgtctaatgttttctgatggccttaggggactcctatgaaagggtttttcaactcccagaaagggttgagacccaaaggttgagaaccactatgctagccaactgacagttctgtgtccagacctgcgggaagcagtcaggcagtaggcctaggtttggcttctgatactccaaagcccatccctagtgacacacttccttcaacaaggccatacctcaacatccttttcaaataatgccattccctaataaccaagctttatgggggctatttctgttcaaaccaccatagtctcttatatttctcctgattagctggtccgagagcttccagagcactaggactgcagatgacctcatgtttgcacagcggacagttttacccagtgaactatctctgcccaaacttgtttctacctcttttcccaaactattttatttatttttatcaccagctgagatatggggagcctaccctccgtcgcgctgtacctttagcactggcactaatttctgtttcaaatccacgactcaacatcctggatacgctaagcaaattctctcatgatgctgatccagaagtttcctataactccatctttgctatgggcatggtgggcagtggtaagtacttgaaaaagatgttgaacagactagaagattcaaggttctttttctaagcctctgtaatgtttcttgtttctaggtaccaataatgcccgtctggctgcaatgttgcgccagttagctcaatatcatgccaaggaccccaataacctcttcatggtgcgcttggcacaggtaaagaataggtgtctcctttttcaagtgtggcagtagaaatatatgtggtggtgtaggagggcctaggagagatacgactgggtatgggatttttgtttgcctgagaaggaacatgtctcctcagatatgacttcttgtttattaacacttctggtttgtttgtttgttttgttttgcagggcttgacacatttagggaagggcacacttaccctctgcccctatcacagtgatcggcagctcatgag

SEQ ID NO: 23953 - DNA, 1584 bp, Mus musculus
gcaaacttataacgctttgtgtcctgcagacgggaggcagtctggagcctcaacccaatggggagtcgcctcaggttgctgtcattatccggccaggtaaggaaggcagtggcacaacctttacgggggaagtggggagtgtgaggatttacacttgaaggagtgattcaaactgagtaccagagaatgacttaggtgtcctgtagtgggtttgaagttgcactgtttggatgaggggtgagaacagccaaggtgggagaaggttgggatgtgttttgttaaattggaagtaagcttcactaagaggaagaacaagaacagtgaaggacttgctgtcatgcatccattcttcctgcagatgaccggtcgcagggagcagccattggggggcggccaggactgcctggcccagagcatagccctggcacagaatctcagccttcgtcgccttctccaaccccatcaccacccccaattttggagccggggtctgagtctaatcttggagtcctctctattcctggggacactatgacaacagggatgataccaatgtctgtagaagaatcgacccctatctcttgtgaaactggggagccgtattgcctctctccagaacccactcttgccgaacccatactggaagtagaagtgacactcagcaaacccattccagaatctgagttctcttccagtcctctccaggtttccacggccctggtgcctcacaaggttgaaactcatgagcccaatggcgtgatcccatctgaggatctggaaccagaggtggagtcaagcacagagccagctcctccccctctatcaccttgtgcttctgaatcgctcgtgcccattgctccaactgcccagcctgaggaactgctcaacggagccccctcaccaccagctgtggatttaagcccagtcagtgagccagaggaacaggccaagaaggtttcatcagcagcactggccagcattctctctcctgctccacctgtggctccttcagatacttctcctgctcaggaggaagaaatggaagaagatgacgatgacgaagaaggtggagaagctgagagtgagaagggaggagaggacgtcccccttgacagtactcctgtcccagcccagctgtctcagaatttagaggtggcagcagctacccagggtaaggaggtgtggctggatgattgacgttgctcattctggagatgctctctcttcactgacttcccacttggcacctcttaatgttttgctttgttttgagattggatcttgatgtagtctggctgcctgcttctgcctcccgagtgctaggattaaaggtgtgcaccatcgttttgggaacagcctcacaaaataggctggcattgtggcctagtgtgttagaccctaagtagagttgaggactcaagcttttgtgtgtgtgtgtgtgtgtgtgtgtgtgtgtgtgtgtgtgtgtgtgtgtgtgtggtttttcgagacagggtttctctgtgtagccctggctgtcctggaactcactttgtaaaccaggctggcctcggactcagaaattcacctgcttctgcctcccaa

SEQ ID NO: 23954 - DNA, 1811 bp, Mus musculus
gtgtacatgaagacagctacagtgtactcatataaataacaaatcttttaaaaaaaaaaaaagaaaggtgtgatatagtatatagagtatgtacaatttgggttcaggttaacagcactggcagttctttcgaggtcctgagttcaagtcccaggaaccatctgcaatgatcgtgggctggtgctcttttctggcctacatgcagacagaacagtatattcatagtaaacctttttttaaaaagtatatagaacttgaattttactgtctatgggtaattacttgatatgacaagttattcctttatgttaacactattttcacattataataacaatgagtagtagccataggctgtggattgtaaagccctaaaatatttactctcttgactgtttagtcaaagcttgcctcacctgtcatttgtgctaagggcttaagttaggtaagacatacgagtctgctgtctttcctttggcagcctggttccattgattctaacaaccagctttttgcacctggaggacgactgagttggggcaagggcagcagtgggggctcaggagccaagccctcagacacaggtatggaggccactgtagggatttgggtacttgctattctcagcttccttgagttcgtctttcctatacagaataagtaattagggaataaatgtaggagttatacatgatgccaaggcctgaattacttgtgaccaagagtcctaaacaataatgggatgcataaagtagtaagggtgtgtggtgtactctagctcttggaaggtagaaatgggttcatgaagtttgctttctgcccttcctagcatcggaagctactcgtccagctaccttgaatcgcttttctgctcttcaacaaacattacccgcagagaacacagataacagacgtgttgtacagaggtgagtttctgggggtggagttgttagagaatactgtgattgggttttagttgtcacagcatagggatctctcctttattgcctggacatgtccttgatgacaagaatgagaccccgaggttgccctgaatattggatagtcaacataaaatgcttgagtggtacaggtgagaaaccatgtgttttgtcttccaggagtagcttgagccgggaacgaggtgagaaagctggggaccggggagaccgactagagcggagtgagcggggaggtgaccgtggggaccgacttgatcgtgccagaacacctgccaccaagcgaagttttagcaaagaagtggaggagcgaagtagagagcggccatcccagcctgagggactccgcaaggcagctagcctcacagaggatcgtggtcgggatcctggtgagaaggaagggaaggcttgtagaggaatggggggaaaggctattgggtgatatgggactgagtactccccaactttcttgagaaactctggattcttttaagccgagtcactgaaaagctcttcccctgtagtgaagcgggaagccactctacctccagtgagccctccaaaggctgcgctgtctgtggatgaggtggagaagaaatctaaggccatcattgaggaatatctccatctcaatgacatgaaggttggcactggggagggactagtgattgcttgtaagggttggggaaggggaggcatgctgactggcatggtctatattggctggggacccggcaatgatggttttcttcttcatatgtactgcctcaggaggcagtacagtgtgtccaggagctggcttcaccctccttgctcttcatcttcgtacggcttggtatcgagtccacgctg

SEQ ID NO: 23955 - DNA, 1413 bp, Mus musculus
attttggcttttttttttttttttttttttttttttttttttttttagtatagcctcaatctgtagacccaggctggatatatcattatacccagccttctgtctctttgttctcttgagacatggtctcacttgtgtagaactagctggcctagaaaattttattgcagaccaggctcctctcaaactcttcctcctgagcaatgagattaaaggtttgtgccaccacacctggcctctgtttttccccttttcagttttgctaagctgccagagttggctttgagctactatcttgatctgcctcagtcttccaaatatttgtttctaaggattgctagtctgtcatgagattagcattctgtcgctgagcaccaggatggtagatcacggttgtgtttagcagtgtctttttgggagggatctccgggtgtagactgctaacgctttggctagtcacctaattgatgtccttgtggcttgcagacctgcttcggatgttctttgatgctctatatgatgaggacgtggtgaaggaagacgccttctacagctgggagagcagcaaggatcctgctgaacagcagggcaagggtgtggcccttaaatctgtcacagcattcttcaattggcttcgtgaggctgaggacgaggagtctgatcacaactgatggcgggtggggcaggggacttggagccatggacacgtggatggcccagccagccagccgcctggactgcaggggggcggcagcagcagtggcggcagtggcagtgggtgcctgtagtgcgatgtgtcttgagctaataaagtggctgatgaggcaggatggcttggggctgcctgggccccccccccctccaggatgctgccaagtgtctctctcctccccccagggcacagagatatatataaagtcttgaaatttggtgtgtctttgcggggggaagggcactaccgcctgcctctagggtccttttttattttctgaaatcactcttgggactgccgtcctcgctgctgggggcatatgccccagcccctgcaccacccctgctgctgcctgggcaggggaaaggggggggcacggtgcctgtaattattaaacatgaattcaattaagtttattgcctctttactgacctatggatcatctttcttaccagatctggccactgtatcattgatacttgcttgtttacctgtcagaaaattttggggacctggggaattgcttttctggagggttgagatctttggatcagcttgacacagtgatgagtgctgtagtgtacttttgctcctaccagattgatccgagctctgagcttgagacccttgtagaagccctaaatgagatgtcctatgtaaaatgactgcatggtctaccggcttctgtcagtatcgctccg

SEQ ID NO: 23956 - DNA, 1172 bp, Mus musculus
gattcacccagatcctggccccacaggctgtcggtaggataggaggagctgggggaggctcaagcttcccgaatggaatggcgtgtgtaatcagacaatgctcctgggaacatgtatctctgcagggtctggcatccccgaaatgaaaaccatccttcggggagtggtgctgaaagaatacctcaccctcaagacctttgtagctaaggtcattgggctaacctgtgccctgggcagtgggatgccccttggcaaagaggtaattgcaggttggggaatgaaggagtccctcccattggaagaaaaggccaggcgaaggtccagaaagtcccgtccctactcactaccgacccctacctccagggaccctttgtgcacattgccagcatgtgtgccgcccttctcagcaagttcctctccctctttgggggtatctatgaggtaagaggaaagccctaagatctaggggacgggagggtggtctgctgagcccaagctgacactgcctcccatccttgccagcatgagtcccggaacacggagatgctagctgctgcatgcgcagtaggagtgggctgctgctttgccgcaccaatcggaggtaggcagggctccattcagcacagcctagccctacatgtggcctctcctcctctacctctcttcccctgggagttaagtccataggtcagaccctggcctcaagggtgatgtcctctgccccctgcaggggtcctattcagcattgaagtcacctccaccttcttcgctgttaggaactactggcggggcttctttgcggccaccttcagtgccttcatctttcgggtcttggcagtgtggaaccgtgatgaaggtgggaatcttaggggagggggatctaaggtaatttaaatgggacacagttagacctgcccccctacttctcctcgttagaaaccatcacagctctcttcaaaactcggttccgactcgacttcccatttgacctgcaagagctgccagcctttgctgtcattgggtaaggagttaaagggagggcgtaggtcaggaaggaggcttccatgaaaaggcatgtacttctcatggaaaccctacccctgtacttctttcttctctagcattgctagtggcttcgggggagccctctttgtctacctgaaccggaagat

SEQ ID NO: 23957 - DNA, 1199 bp, Mus musculus
tgagacaaggtagcctggactgggactgacccaggctgcctttggactcaggagatccactttattgcctcctgctgctgggattaaaggcatgagccgttctcttggctccttagcattttcaaaaatgtatttattgtatgtgtgtgtgtatcatgtgcaggcatgagtccaccaaggtcagaagaggaattaaagtggttatgagatgctgtgtggtgctgggaagtgaacccaggttttctgcattttgcaagaacacctagtgatcttccggttgagccatctctgcagctcctacctaaacagtctagtagctgtataacgttgcagagaatggtgacatcttcatttgtatgtctcctagctctggacttaatgcacatgtctacatgcattcatttctctcctaatctttggttcccggtgacagaatactaggcctttttaaaccatgggtgggagctgctgggaagcagctgctgtagagtttaggctcaggacaagggccttctctttcagctctgcgtacgtgtcctatgggggcctgctcatgaggcttcagggtgatgccaacaacctgcatggatttgaggtggactccagagtttatctgctgatgaagaagctggccttctgaacttcgtgggaaaccagacttgctgcttagtcactcatgtcatggacactgttcaaggctgtgtagaagctgtcggtgttagcctgtaaaaggggcggaactctgtccactgtggggacgtcttcagtttgtctgaatgcagtggaaaaccgactctccctctcggaaggccgagagggagaacttagcatgaacctgaagttgtatatgattttttttattaaagttttctttttcagactcttctccattgtcattgcgggttggggaatccaaggttttgctttttctgttttggccacactggccttgaacttgattttcttcctgccgccatccttcccccctcccccccaagttctaggattgcatcacacctagcaatacatcacacataggcaaatctctgtctctgtctctctgtctctgtctccctttcgatttccttctacttcaccctaccgctgtggtgtgtgtgtgtgtgtgtgtgtgtgttaaacttccatcacctgaatcctgggaattgaactccgattgtcaagagcagcttctttaccta

SEQ ID NO: 23958 - DNA, 1453 bp, Mus musculus
gaaagagaggacagcaagagggagagggagggagaggaaggaagagagagagagagagcacaaaacttctgaattatatagggaagagcctctgggctgcaaagttcaggactgggagcagggtattccaaggtagagtctgagggatgctgggagaacctggaggccaggtctgctttgatatgtaaaatatgcacctcaatatagtctaaggctgttggctttttttttccccctgaggcagtctctcagctagcttctaacttaaccaacttctctgcctttgctttcctccacatggctcccactgttctacctctcagttcctcctgtaccatgcctgcccggacactgccttgcttcccgccctgacaataatggactgaacctctgaacctgtaagccagccccaattaaatgttgtccttttaagatttgccttgggcctttccagcctccgcctcggaccctgcagccgccgcgatgttgatgcctaagaagaatcggattgccatctacgaactcctttttaaggagggcgtgatggtcgccaaaaaggatgtccacatgcctaagcacccggagctggcagacaaaaatgtgcccaaccttcatgtaatgaaggccatgcagtctctcaagtctcgaggctacgtgaaggaacagtttgcttggagacatttctactggtaccttacgaacgagggcatccagtatctccgagactacctgcacctacccccggagatcgtgcccgccaccctgcgtcgcagccgtcccgagaccggcaggcctcggcccaaaggtccagagggtgagcgacctgcaagattcacaagaggggaggctgacagagacacctacagaaggagcgccgtgccccctggagccgacaagaaagctgaggctggggctggctgggccactgagttccagtttagaggcggctttggtcatggacgtggtcagccacctcagtgaagttggagtttatgttgtattgaataaactttaaagaaaaaaaaaaaaaaaaaagagttgccttggtcatggtgtctcttcacagcagtcaaaccctaactaagacacacagcttactcattctgagccgatcaacagcaggactaagcccattccatatttagtattgtcttttggcctcttccatggcagcttgctttttgacatgataatttcagagatacctctttaggggcagaaagtgacagcatttacatatccctggctctgccagaggatcaattaacaactgaaaatacagggacacctcaacataaccatttaacacagtatgtgtgggtaagccaccctaacaaacatgcggggggggggggggggtcttttcttctaagattgtgtgaactcccttaacatacattttttagattttttttattgattctttgtcattttcacgtcatgcaccccaatt

SEQ ID NO: 23959 - DNA, 1149 bp, Mus musculus
accaaaaccccaagctctccacccctagaagaatccgacccagcgactgtccttcccttaagagaagttgtgggggtagatggtctggtcagagtacacggtcccttctcactgagcgaactttctcagatagagaagagattgggctcctatacttctaattcttctgcctttatcaaagaatttcagaattgccgggcgtggtagcgcacgccttaaatcccagcactcgggaggcagaggcaggcagatttctgagttcaaggccagcctggtctacagagtgagttccaggacagtagcgcacgcctttaatcccagcactcgggaggcagaggcaggcggatttctgagttcaaggccagccagcctggtctacagagtgagttccaggacagccagggctacacagagaaaccctgtctcgaaaaaaaaaaaaaaaaaaaaagaatttcagtatatcactcagtcgtacagcttgacttttcatgatatacacatgatacttactaacaatttgcttcccgaggaatgtgggcgagtttgggaacaagcaagagcgcatgcagacaagatttatcaaacagatcggagtggagacagtacctgacctggatcctcaatggaattataattctgcagatggtattttagccagggacaggtttgttacatgtcttttggcgggtctgagaaaagcagctttaaagtcggtaaattttgaaaaacttcaagaggttgtccaagataaacaggagaatccatctcagtttttagaacgccttaaaggggctttattacagtataccaatctggaccctgagaacccagagggtaaacaactctttttttttttttccattttttattaggtatttagctcatttacatttccaatgctataccaaaagtcccccgggtaaacaactcttaatgacttacttcttttcccagagctaccccaacataaaagctaaacttaaaaaattggagaggggacccctgactccacaggcagaagtcttggcactggccttcaaggtatatataccatgaaagagatgagagggttagcaagcagaagtacaatatgctggcaaaggctgtcccaccagccccagttgctaccctgagctcatggtctcctaa

SEQ ID NO: 23960 - DNA, 1174 bp, Mus musculus
tttgtcggtgctgggtttgcatcctttgacctggtggcccagatgactgcagagtaagtgtaccgctcaaggtgcaggctctgggcaggaactctggctgagcccagcgtcgcgggtagaagggagggactgagtaccatttttttctgtctctagagatctgctaaggattggggtcactttggctgggcaccagaagaagatcctctgcagtatccaggacatgcggctgcagatgaaccagaccctgcctgtgcaggtctgacactcagctccaacgaggggggggtgcccccccaggactgcacaaggattctgaccagccagctggacttttggatgcctggcctctggctgtggcccagaagatggaagtttgggggaggaccctagctgtgacttctccaggcctgtgctccctcccaggaagtgtgccccaaacctcttcatattgaagatggattagaagagggggtgatgtcccctccccagatgccttggggcccaggcctgcctgctctccagtggggagtcttcacaactcagattgggctgcgcttcagtaatggacgtcctggtagggtcaggtggggataagcctgggttcttcaggccccagccctggcaggggtctgaccccaccaggtaagcagagagtactccctcccccaggaagtggaggaggagactctggggatggggagatatggtgccccatcctgaagccagctggtacctccagtttgcacagggacttgatgggggctgagggccctgcctacccttggtgctgtcataaaagggcaggcaggagcaggctgagaagcagcctgtgcctcccagagactgactcagagagccagagactgtgtgtgtgtgtgtgtgtgtgtgtgtgtgtgtgtgtgtgtgtgtgtgaaagacgggggtgggggtatgtatgtgtgtgttgtgcacatgcttgcctgcacagagagcatgagtgtgtacaagcttggccctgtgccctgtagtggggccagctgggcagacagcaaaataaaggcaataagatgactcttgcccctgctcgttcttcctcccaaagcaggtttccttgatttcctcatgtcagtgagggaactagggggctgctagaccttcacaacttcctgggggtcagtgggaaactacagcg

SEQ ID NO: 23961 - DNA, 1181 bp, Mus musculus
ttgtgtcgtgaattgtaattaaaatgcaggtgcacacaaatgctgtgtgagtcagagttctctagaggagccgatagataggatttgtttatttgtttgtttgtttaacgggtctttattagggtgtgtttcttttaaaatagatgttatttcagtgccaagagttgtcctctgaccatctgggtttatgaggttgaagttgctgtttttcttcactaatataaaaagttgaaacatttgttattgcactaaggtcatttgtgccaatatgtccttcaaaaaaagtcttgtaaaaaatgcaacattctgcaatatattagagctcttagccttcccttatgcaagcagagtgtcatctgacaccgagacacttagcactgttttctgtgtatctcagagctgctcttactgtgccgctgtcactgttgaagtaaggtccttgtggagtggccaagcccccttttgtcatgggaggtctggactggccctgactcttactgttatgtgcttgaattgcagtggatcaactcgcgcacagtcgtgcttttagacagcgtggagaagctgcacgtgattgatcggcagacgcaggaggaactggagacaatggagatctcggaagtccagctggtctacaacagcagccacttcaagtcattggccacgggaggaaatgttagccaggccctggtgagtgccaccacacccagcattgatctccccacagtggcattccaggttttgttttgttttgttttgttgttttaaccactatgttgcttataaatggaattactaaggtttttctgccttggtgtgttgaagtgggtatcagtgtgtttataaggattcaggattatatccccaaacagtaattcctgttacttaatagtaaggaatgggttggagagatggctcaggggttaggagcacttttggaggacctgggttcaattcctaacacccatttgtgagctaacagctggtctctaagtccagttccgaggggactccagtgccctcttctggccacaacaggtactgcatgtacgtggtgcatagtcacacatgcaggcagaacatccataatacataaaataaagataaattcgaaaaacccaaagaacttctaatttttacttctaaaaaaataataaacaatttccttgagatggaatttg

SEQ ID NO: 23962 - DNA, 1179 bp, Mus musculus
aaagcccacctacacagtgacacgcttcctccaataaggccacgcctcctaatagtgccacccccccatggccatgcattcaagtacatgaatctatgggggccaaacctattcaaagcatcacaataagtgaattgagtatgaagccctgcattgatttctagaactcagctcacctttccctgtcttcaaattctccccactactggtgctaaactcctggttcaattcttgccatcatcccaacagccaagtcctacagaaagagttcagacacgtttgtcgctttcagagacagttcctgttgagaataactatagcgcagcctcatgatgagcacggaccgttgacttgtaattggattgttaactcggttttgctaattgtcttagtcactgttctgttgtcttgaagagacaccatgtccatggcaagtgttataaggagaacatttcattggaggcttgctcacagtctcagaggctagtccactatcatcaagactgggagtgtggtggcaggcatggtgctagaaaagtagttgagagctacctcctgatctggaggtagagagagagagagagagagagagagagagagagagtgtgtgtgtgtgtgtgtgggtgggtgcctggcctgagcacaggcttttgaaaccttaaagcccacccccagtgactactttctctaacaaggcacacgtccttgtcctttcaaaagggatctatagacagacagagacagaggggcaggggcagagcctgacatgagtttttagaaacctcaaagcccagtgacacttcctccgaagggccacacctcctaacccttctcaagtagtaccactccctcatgagtaagcattgcaatacaggagccaatgggggccattgatattcaaaccaccacactaattttaggtctaaacccattattctggttccttctctgtacttcttgctgtgggtctccatttctaggcgtgtttggttctgatgggcaggggatattagagctgagtgtgggcaagaactcagggccctggtagaacaatcaggcaggattcagcctaagaggagtcctgcccaggctcagtcctcagcagcccatcaggataactggcatttttctaagtacaagcagtcagcgaagtgattatgtgtacgagagtaaagtctt

SEQ ID NO: 23963 - DNA, 1135 bp, Mus musculus
aaggattggaaagattggagtcgttgttggtaactgctatggatttgttgggaatcgaatgttggctccctattacaaccagggctatttcttgatagaggaaggtagtaagccagaggatgtagatggggtcttagaagagtttggttttagaatgggacccttcagggtgtctgacctcgcagggctagatgtgggttggaaagttcgcaaagggcaaggccttactggaccgtccttacctccaggaacccccacccgaaagaggggcaataccaggtactccccaattgctgatatgctctgtgaagctgggcgatttggtcagaagacaggtaagggctggtatcagtatgacaagccactgggtcgcatccacaaacctgatccctggctttctgagtttctgtcacagtatagagaaacccatcacatcaagcagcgctccatcagcaaggaggaaatcctggagcgttgcttatattcccttatcaacgaggcattccgcatcttggaggaggggatggccgctagcccagagcacattgatgtcatctacttgcatgggtatgggtggccaaggcacgtgggtgggcccatgtactatgctgcctcagttgggctgcccacagttctagagaaattgcagaaatattacagacagaatcctgacatcccccagctggagcccagtgactacctgaggaggctggttgcccagggaagccctcctctgaaagaatggcaaagcttggcaggaccccatagcagcaaactgtgattcagccttctgcattttgccatgtatggtggcatctaatttcagtgtgattcattcctaaaatccaaacagatttctctgaagtacaaatgatgattgctgctgttgctgctgctgctggtggtggtggtgctaaatggtcagcaaaagcccctctctgtatcttcctacctcataattctaatggccagatttcaggaatgtgttttctatacctctgacggtacttctatcagaaaaattcagcaaatatgtatttactactgcaagcgttcttctcttttgactgtttgcttggtatagccataacttatacaaaatgttgctaagagaataattcataactccagttga

SEQ ID NO: 23964 - DNA, 1194 bp, Mus musculus
tgaaccatgtctccaccctgtttccttactgcactgaaatactttacttggtgccttggaattgtttaaatttaacagaaggctatacaaagtgttgatttttctccttatacaaattacataaatgcatataatcccagtgatgtaaatatttgtcaagaaatgtaaaatgtggacaggagctacatgttgcctagtcataaccaagcttcttgcattggtggagacagaacgaattgcatagactttgagaattgagcctgccaggaacaagacagttggcctctgatggagaagctggcctctgatggagaagctggcctctgatggagaagcttcttactgcctgtgactgactttcttcttctttgacccctcccctgaacccgaaactcctcacattgatctttatgaccttgcatgtagaaatactagctaccagtgaaaaagcccaagagacactaattggatatcttgactgtccttggtctgtatgccctgcccttatgaatctagtatctgccactggcctttcttttctaccttctaaatacctttaaattccctcttttaggtctagcctgtaccttactctgttgtcagatttcctgagcctctgtaaaagcccctcgcttggttctctatatttactctccttcccttctctcatctcgctgcattcagaggaatcttctttttgatcctctgctttaagtccttgatgttttattgcctcaggccgctaagcaacagcagcagtgtcccctatcccacgtttcccccttgtgtctctgacggtttcaatgagaaacgaccctcattgaaaccgtttaggacgtgcagtcctgctgggggaagtttgtcactgggggaagcatttgagagcttaaggctccgtcctacttcaagtttgctctcagcttggactagtggttgagatgagagatgctagcttcttttttcctgcctctgctgccatgcccttccataatggactcttagccctttggaaatgtaagcccaaataaactctttcttttttaagttgcttttagttgtggtgttttatcatagcaacagaaaagtatctaacatagcatcctagccctgtttattgaactcattctaccaatctttgtccaaatagtttttcctccttttgtgtgtgtgtgttttgttttgtttttgtttttc

SEQ ID NO: 23965 - DNA, 1099 bp, Mus musculus
atgtctggagttagcaggacttggcgttgttgtctacctggtacaggttttgaaatcagtgaaagatgcaagattgaagaggtggtggattcttgctccacagtttcagagagcagccgaggccaggtagtgtggcaaggtcatagtcccacaaagggcctgagaggctactgcctgaagctgtgaatgttgatgtcagacccatgggacatctgacagggaaagcagcgtccatggagtgaagctactcaagggagaagttgagtgtgcctaagtggtacgtccggagggatggggatcccgtcaccccaatggcagacttggtactgcaagcttgatgtcttctctgttgggttttaggcttgctttgggcatgattattctctcctatgccttcatttctcccttttggaataggaatggtcactcatgtcattttattttggaactatgtaacttgttttttttattttctaggcactcacagttaagagattacctcaaatctgaaataaggctttggacttgtgaacagtattggaattgttgaagaatatggggacttttgaagttgtcctggacatatgtttgcattataagatgacaatgaaggctgccaggaaaactcagaaagtattgtattaccttttgacttgagttcaatccccaaagccaaagtgtggaaggagagagctgattcctgcaacttcttctgacttctatagcactcacatatatcgggcacatgcatgagtatgcacacacacacacacacacacacacagatcgaaaatagttgtaataaaaaaaattaaacagatggtcatgaaattctggaaagatgggttgaaaggtccatggcttcaaattattgtgtttggatgtcaagttttaaaggatggagttgtggttagtgttgattgttaactttatagcatctagaactttctaagaaacaagcctctggcacacagagatcatcttgatatggttatctgagataggaagagcctgctatgggtggctccattccttaggcttgcaccctggacttaatgaaaggaggacgcagacagagagccagcatttcccgtcctgt

SEQ ID NO: 23966 - DNA, 1177 bp, Mus musculus
gggctaagagttggacagacagctaggttccctgttctgagtccctggccaccctgcccccttaatgaccatctccattttccattttccaggtttgatcccttacaatttcatctgcgtgcagacgggctccatcctctccaccctcacctctctggatgccctcttctcttgggagactgtcttgaagctcttggccatcgccctggtcgctttggttccgggaacgctcatcaaaaaatttagccagaagcgcctggcgctgagtgaaacaagcgacatcggccacccagaccgcaggaaggacgcatgatgtgggttctgtgtttacagggcccggactgtgctgctggtccctttaatgtcctcattgtgttttaattaccctcaaaggatgagatggacagtgctctagtgtgtgcagaggtctgttagaagggcgttttgtcctgttcagcaggttctatgaaatggaccactttctagaaatcctatccagttatctgtcgggcttgcctcttgctggaccctgagatgtcttggaagatgatgctggtggcctttttggacaagctgtgtgtcctctgtgactctgttgaagagtgtcctctctacctttctgctgctgatctacctctccataagccaagggaaacatgacgggctgcgtaggtcttacacgcagcatttaagtgcagggattcctgcatttcccctgttcacagatacttctatccatgttgaagctccttgtagttatatgtcttgatagttaggctgattcaaacatgattaaagatgaacggaagccagccttgcaggttctgaatgtgttcggaggaaattctacccatctgaaggtcctgctctgtctcatcggaatcaaatggcctgcaaatcccctctacttcctcttgctgggcgaatggggtcactaaatgaggctgtcagccagtgtgctgagaatagctgaggaatagttgtacttttcaattcagagagaaagcagtgtggttgcctagtgattgcctatctgagagctgtgattgtgtcttccagctagggcactgggctgtggggctagcacctgagctgatcgctctgtggcctcggaccttgtgaggacaactcatgacaaggacttagcagaactccctctaagacatccatcacttgt

SEQ ID NO: 23967 - DNA, 1725 bp, Mus musculus
aggcttgcctgactagactgggagatttgtgttagctcactgacgagggtctttggtttccccaggcctcacttgtgtcgatatgatctcgtccttatggagaatgttgagacatccttccaacctatcctgtgctctcagcagcagatgtagctgctgttaagacctgtgggcagtgatgacatcaagatctctacagctataggctttcagtgcctcaccctatagcgtcctgaaggcttccaaagcatggggaagaaaaccaaggttattttcggctgtgttccaaggatgtcgcgtcacaaaaatgtcaaaggacctgcgattatgaaacaccactgggagggggggggcgccctaactagggcaagacagaaatagcccagctccctacagcaaagcactttgtctggctgcgtcccgaggccccacttgttccccactgtcgaatctgctgcctgtcataccacaccctcagggccgtggggcaagcatctaaatggtccctgtgcccaatcctctgccatctcggcgggaaccgaatggagaatgaaccagactacctcacagggactgtgggtggggagggccaggctgtgaagggtttggaaatcccttgggtcccttgggtggactactgtgaacatgcttttcttttgatagggtttggctcttacgtaaagacacacaatctctctttttcaacaccagctttcctcctggactgtttgcctcggggcgacaagaaggctctggcttagtccagactcttctgaagtgatgctgatggccagaggtattgggctgggctcatagccctgaggcctgtgcagctaagtggaagaaagagaaaaaacaaaaaaaaaacaaaaacaaacagggctagcattgcagcatgtggactgggcagagaaaaggctggaaggaaactggcctgctttcactcaagttgcgaaagtgttaattacaaggttgtttttctgctctgggattgagtatgctaagtgcactgagccctgctctcagcttcagacattttttaaaagtagtccttaagactgttttcttaaaaaacaaaaacaaaagctgggcagtggtggagcacaactttaaccccagcacttgagaggagaggcaggcagatctctgtgagtttgaggacagcctggtctatagagcaagttccgggacaaccagggctacacggagaaaccctgtcttcaaaacaaaaacaaacaaatgaaagttttctttccttcctattggtgcaatccatacttattccaggaaattccttaagatgtatagatgtaaaatacaaaactgtgcacagtcctgcctgttagaggaattaatgttaatatttagacttgtttctcaaacttgtggggctcagattcagagcatggccggctcttggggcatggaaactctgagaagtcttcccaggcctccctggaggcagatgtgacttcaaacatttctgaataacagtggcaaacagattaaggggtcacagggggccagggacagagggcaaaatgaaagtagaacaggtagagggtccagacgcctggtgtggaggtgagtgccccccacccctcatctgtgaccactgggggaaggtgtcacaggcccagggcccttctcttcattgaattgccccagctattgtaaagaaatggatactgtgagcaaatgtgttgaaatccacactgtcttagt

SEQ ID NO: 23968 - DNA, 1191 bp, Mus musculus
ctgttgtattgaggccacctgttggtcttgagtgactagaagttacctcacgccctcccacaccagtttcagttggagaggacagaagaagaaagctgggggtggagggaccaggaaaagagagatgtttcaaggaatcacaaggactccgggagagaagaaaataggaaacagaacctcagatgctgtctctggattgtgcatggaacacgggaaggggagccgtcctcagaaaagcatccagagggattaggggaacagctgtgtgggagcacatggtttgcatgcacgaggtcgggggtttaacctccagcacctaaagcaagaaaaaaaaaagaatttaaacatatgatgatgttcataggttactcccaaagaggatacccttaacacactctttgtacagggctctggtaagcggggactttgtcagagttcatgttgtggtgtttcacgactgtggaaatgaagccccgttcaccctgactaagaccaagaatcagttcaggcattatgggatgcatttgatttgccgatgatagtgtgatatagtgcttttccaaacctagtctctccagagaatctcacagcttcctggtgaattgagagactgagagaccagagcaaatggagggctagactctggccaggatggttgagacccccctgggcctcaggggaagtcacctgtaggatggaatcttactggccaacatgactttgtgatcttgttcaaagttagtaagtgaatgaaagctgagccgagtggggcttctgaagtccctagaatggggaagatcagagaagtgatgaatgctgttcattaatcctgacacacaggagactgaagcagatgaaaatccaattagaggctagcctgggctacatagctaattcaggctggtttgagtgatactatggaactttgtcaaggactggggatgtagctgggtgtagcttcatgcagaagataagttcctgggtttaattcccagccctaccgttcttttcctctctctgagggctttgccagaggagcgttttctaagctgactccctgctgcggggctctttccccaaccgggcctcctcctggagctgttctcagggtaacagcctctgtcagagtaacactggtgggaaaaagctacaggctgtggacaggagtcctgactgcatgatgggatgatg

SEQ ID NO: 23969 - DNA, 1211 bp, Mus musculus
catggcttccccgggtttgtcttggattcttttttcttacttttccccaaagccaaggctaccttaattatctaatttctctacctttctaggaaaccaaagtagttttaaaagttcagaatgtattattatcactatatattttaaaagcagtgtctatacgagagagagagagagagagagagagagagagagacagacagacagacagacagacagacactctcacttagaaggacagaggcttgggtttgccccaccctggaaatccctttctgatagagggaacggtatctttctcatgctgtgtgtataagtgactgcttatacaattgctggtttctatgctgatttccttggtagtaactaatgatgtcattgccaattggaggtcactgatcacagagctaggaagaaatggaccagatgtacccttaaaccaagagtttcattctacccaaatgctacgttctcccctgtgccctcctgaccacgtgaactgcagcgttcctagactctaattacagaaatttcccaaaccaggctttctgctactctatcccatgtgacctacccccagacctggactcaacttcctgaccacaaatcaattgtctacctccgtggatgcccccagttctctcctcaccatctccgagtctcaaatttagtcccagctgcgttgggagaattctgagtctcagtgttcttgcttgggtgtgctcactgggtcacggggtggaatgtgatctgtcacattcactattctttcttttttttcttccttctgaaccttccttttcaaaagccaatgcttattttgcacctacagcccatctcagttcacaccggcttcatttcaagtgtccagtggctacagggacctaacagttactgtattgtttgtgattggacacaagtcattgttatttcctgagaccagggtaggtcagctcagcacctgtttgaccttcaccctgctgtctctttgtcagtttcctctcttctgcttctcttctccaggtatagcttttggtttgacttttcattagcttcctccctccctccctccctccctccctccctccctccctccctcattccctccctccctccttccctccctccctccttcccttcctcctttcctccctccattccttcatatgtttggtgctgggatgaatccataatcttatggatgccaggcc

SEQ ID NO: 23970 - DNA, 1205 bp, Mus musculus
atgtagcccctagctgtcttggaactcattttgtagactaggctggcctcgaactcagaaatccgcctgcctctgcctcccgagtgctgggattaaaggcgtgtgctaccacgcctggcaggatttgggattttttttattattatttatattattattattatttatttatttatttatttatttatttatttatttatatgaacacactgtagctgtcttcagacacaccagaagagggcatcagatcccattacagatggttgtgagccaccatgtggttgctgggatttgaactcagggcctctggaagagcagtcagtgctcttaaccactgagccatctccccagccctgggatttttaaagaagtataaaactagaatttgactaaagcaactctaagagcaatgtgctccaagtgaagtctgtctgtggctacctctccccggctagtgtctacttagatctgaggctaagtttctgtgctactactcacctcgcgtactttatattcagggtgtccaaaaggatgaaagagaaaagtatcgaaagttattggagcgacttaaagaaggtgctcatggaagcacgttccctcccacggtttcacaccacaggtaagagaaattgctttgtgagactttttccttagtacagatccatttttttggttttagagcggtgatggtgtgaagagaactgcggtgtagtttgtctgacactgtacacagtgcttagacaacgtctgatattacacagtggctacagaatgggattttctgttagttttacagtcctttgcccacatgaattcttttttctttctttctttttttttttttttttgtttgtttgttttttgtattttgagaaagagtttctctgtgtgtagtcttgactgtcctggaactcactctgtagaccaggctggcctcaaactcacagtgatctgcctgcgtctgcttcctgaattctgctgggattgaaggtgtacaccaccactgcctggctgggtttgtttatttgtttgttttgattttttgttttgttttgttttgttgtttttcaagacaagatctcactatctagcataggctagcttggaatttatagttctctacctccacttcccacttgctgggattatattcatttgataccacatctaactcacatgaactcttactcatgtagcaaaaggaa

SEQ ID NO: 23971 - DNA, 2410 bp, Mus musculus
cccagccccagagatgtatgtagtcaagaagataggaattcaagaaggccgccttgactagaaataaatcccactgtgctttagaatcatgtgcatgggggctggagagatggctcagtggttaagagcactgactgctcttccaaaggtcctgaattcaaatcccagcaactacatggtggctcacaaccatctgtaatgagatctgatgccctcttctggtgcatctgaagacagctacagtgtacttagatataataataaatcttaaaaaaaaaaaaaaaaagaatcatgtgcatgatgtaaaacggtgaagcttatgtagaggacatgtgcattgttgtatttatgacacctaaaggctgtcgtgctgcacacaagagtgtataacactgtcgttcctttcagcaccagatgcctctcttccggaagaagatggtgtgggagatccttcaccagcagttgctgtgacaatgccccgcctggtcttctagctgctggtggttctttgatggatgtttccatatacctcatgcattgtgggttaaaaagtccccgatcatttctcttctctcacaggtactgagctctcaagagtgcatgaaggcctctccacaatggccctgactagaggtgtggaggggctgcttgaaaccctgtttctaaggctgtgcctgctcagagccctggactattcaccccatacaagaacaaatgctaattaatgtgttttgttttaaagcgttatttccatatgaatgtgggaaatgcaggatctgttatatgaattgttctgtgtgttcacacgaattcactctctcattgggcagtgcccttttcccactgctcttttataattagctataaataatttggactatttatttctgaaaagaatgttaatcaaactgccacttcctgctgcagagagatatcagcagggggaggaaggaggtgttcgctagcttctctaatgctggagtgcgaactgccgacatacagttaaggttctctcttttaaggcttgaaaatgccagaagaaatgacgatgctctgttgtaggatctggctgccttttagagagtctgatgctatgacacgggcacagttcgtggaaatgtggccaaggaactcgatctgtgcatcctcagaacggggcgtgcgcatcttagagactttcttttctagaaccgaagtagcttggcttcctcttgaaactggattcaaagtaactgtgagcatccatgttaagtcgtaggtctggtgagtgagtgtgtgagcctcaccagggaagggctggcctgagctgtctgctctgaagatgctcctcaatggaagcctatttttcctcagagttttttttttttttaatatatatatatataaagctgaaattaagttcttggctcatcagcatgccccactccagccccactgagcctttggagagagattagtacttggctctgaggttgccaggtttacaggcatctattttgcatatgaaagtttgtatttaacttttttgttcattaaaaatcttacaggtgtggttatgcattgtcaatttcagaaagttggtcagagcacattttgcaagatctagtgcctagtgttgcttttatgacgtaataaaagactggcagaacctagagtatattctgataatttttcctcttttctctgcctcaaccttccaaagttgttctggtacaaaaagagagagaaagagagagataaaattagaaaagctgcacacatgttagatacaaacgtacacgtctgctcttgggacgcctgggcagctgatcagaggttgtagctgttgaaacctgtttgctctgagacttgaaatgaccttcgttatggaagctgggcctgtgatggggactgaaatggctgagccaacccgagaccaggtggcctaaacctgaaagcgagcatgtggtctaacaattcaggggtaaacggtgttgtaacctcctcaaggcagactacacagggaccccttcctttatttagcctagaccccccccccccccaagcactgtgccagtgatgccgggatcaggcagctggtctaaccaaaagagcccagaagttgatcctgtctacactactaaaacctgggtgctagaattctacctgagaatttatgatcccggcctatcaaacaaaatagctacctgaccagagtttgatccccagtgcccacactggagggcgaaaactgactccccaaaattgtcctcagacctccatacttgcacaaaccaacagatggaccaaattagtaataagtaaaaaaaaattaaaggaattttaagggccttggataggtttgtttctgttggctcagtcctgcttggatggcgactttctctccccaggtgagtgatgctatagctaa

SEQ ID NO: 23972 - DNA, 2500 bp, Mus musculus
gctagttcctccccctccctcctgcgagcccctgccttgtaccctgcaggcttgcggtgaggtggagaggaattctgcccttgactgccaggcctgggggaggtgaaattggcctgagtatccaacttttccttgcccaagccctagaccctcggtttcctccgggccctcagaactgggattgtttcttccctgtgccctcccctcccctctctcacactcactcactctctcactgcagactgcacaacgcaagatcagggaaattgtacagcaggtgaagcagcaggagcagagataccctcagggagtcgccccacagcgcagcaagtgaggctcccacagcaccagcaagcaaccgatgaatgtagccctcccaacacctgacagatgagaccaaacagccagcagatcgggagcaaaccaaagagcatcccgaggagtgcgcagtctgcagagcagccagggcctgcagacctctacacatcctgggatccaggagggcacagggaaggccaggttgtccagaaacaccgcttggcctgcccccagcttcccctggcttctgcaggcataacagccatccactgcccatccaactcagattctcctcagttcccaggacgctatccctttcggttgaactaacataggtgaacatgctcaaagcaaagcaaaattcctagccgtttctttgttgtggaaagttgtctctgtacatgtatgtacatatcagaaggggaaggatgttaagaaatgtggcctgtgggttacacagggtgcctgcagcgttaatatattttagaaataatatatcaaataactccactaacaacaatttttactcagtgattaattttgttttctttttgaagagaaagcaggcttttctagacttccaagaataaagtattgggtgaggtccactggtatagaaaggaactttgagccacccacacaaaaaattcacttggagggaaatcttgtcaaggacacttaatggcagttgtgggtcacctgtgtctgtcaacagaagggataccgtccctgaggaggggccctaggccctggtcacctgtttctcccacacacccattgctcagtttcacaggtttttaaactgatgatttttggtttgttttgtttttgttttttgcatactgctatatagttctgtctctctccttatctccctcctaaccttcctctgtcttctttacccaaaattcttttgagtcccttcgttctttttctgctccccgtatctatgcacccctcccctccccccaggcaaagcagtgctctgaatatcataccacacacaaggaacaaatgcgaaccacacagaccagcctcagcttacactcggttactcaagcgaacaagagtcggcggtacttgtcctagcattcggaagaggaaagcaggatcccagcaaataaaccagccagccaaacaaagaaaaatcccacaaagaaagaatggactctctctccatcttggtatacaagccatcaacatttagtgaaattctttctttctttaaaaatttaaagtgcaggaaaatagcaatttatacgaggttgttggcccagggcgttaaatttacagattttttttaaatgagaaaaacacacaaataaaagctacctcaggtgttttttacctcagcaccttgctcttgtgtttcccttagagattttgtaaaactgatagttggagcattttttatttttttaataaaaatgagttgaaaaaaaaaaaagatgagctgccagccccaagcaggcggcagcccaggtgtgccgcagctcttctgtcttccgctagccaagagcctacgtggccttcttgtggacaaacctaaaaatgtttattttttaaaaagtgacaaagaaaaacagagaatattggagccgtcctgaatttcaatagggtacgtgccgtgagggcttttgcgctgaaggatgaccacatcctggttatgtgaagaaaccatgacactaccagactgcgatgccggtttcctctactgcaagcagtgttctgtgacaaaaaaaaaaaaaaaaaaaaaaaaaaaaaaaaaaaaaggaaaaaaatatatccaagctaacaagatcttggtgtcttggtgtcttattttctgagtgttgggtctcccagaatgtcagctggaggtttgggggaatagcaggtggacaattggactggacagctccttggctacctggctgtaggccgcccaagcagcctcacctgaaacgtggctgggttccagccctgtgggcggttgaggtgccaactagagggcagactgcatggcaggcgaagcctcaggctcagtgggtctcagccttcccaactaacgctgtggtcctttagaatggttcttcataaaaccactttgttgctacatcataactaattttgctactgttagtttgtttgcttggttgtttccattttttttttttttttgtttttgtttgtttctatgaca

SEQ ID NO: 23973 - DNA, 1175 bp, Mus musculus
tgtattttaattgttaggctttaagtaaaccctgctacttactctctgtaaggtgggcgggtctaatgcatcctcccaaaaggtgtttgtggggggttttgtttgtttgtttgtttgtttgtttgtttgagacagagcctcaagaagctcagatttgacctcaaaaccatgcattgatgcccttgtatttcagtcttccttgcctgtacctcctgagagctgagatgatcagcatccgctgtttatatggtgctgggaccacaccaagggcttcggtgtatggtagacaggtgttcttctgattcactccattcctagccccagaaagatactatttttttcgagacagggtttctctgtgtagccctgctgtcctggaactcactttgtagaccaggctggccttgaactcagaaatccgcctgcctctgcctcctgagtgctagaactaaaggcgtgcgccaccacgcccggcgatactatttttataataataaaaagtaccatttaaagaccttcagttactgtcaactgttgattataaattcgctgctgtttctgtaggtttttgctgtttttgtttcttagggttaagtcgcttcagtgccatcctggctgtgcgtgaacgtctaagcctgaaggatccttctacctcagcctctctcatgtggctgagataggcctggccttgctgtttctgagatccctctaatctccctgtggtagtgacttgtcattgtgacagagtattaggcagaggcagcctaagggaggagcgggttattttggttcagaataataaataaatctttaaaaaattatcttttaataagacatagtaatatctttaataagactgacatatgtctaagtaaaatatatagaaaatctggtttacccatgggaatgttctactttttgacattgccatctgcagagttcacacgtgagaaccattcagtcaagtggcctgtgtgagttaggagacatatgatgtgagattgccatagggtgattcattgttaaagctgaggtcattatacaatttctccattttatgtaagttagaaaatatacagaaagtgtttagtccgatttatgattatgttatcggtacagaaagactctaacatcacagctagagttcttgcccatgagaaacactgctatttgca

SEQ ID NO: 23974 - DNA, 1231 bp, Mus musculus
gacgcgcgaggaaagttgtcagccctagcgtgcagagctctcctcaaggtgcacctcactctggccccgcgcccacgtcgcgtccaccttgcacacaccccgcccacgtccgcgcccctcacctcccgcgcgccgcctggctccgccgctcccggccccgttggggccgccgccgcttccgcccgccgggcgcgcagcctgggagcgccgagccctcggagcgcgcggcgcgggacgggcagggcgcgcactctcggcggtgcacacgccgctccaactctcaggcgcgcggggtgcgtccgcccgccgccgccgccccggcaccgggaggcagagcaagcgctttgtccgcacgcccgctcgggactctgcccggaggaggcagccgcgccgagtccccgcctccgcctctgcccccgggcgggccgggccggccgcggtggggggagccaggctgagggcgagggtgggggcgggggcgggcgcaggaggagagaggagggcagcggaggcggcgggagcgccgggtgccgggccgggggagccgcgggctctcgggaagacgcggatgatgaacaagctgtacattgggaacctgagccccgccgtcaccgccgacgacctccggcagctcttcggggacaggaagctgcccctggcgggacaggtcctactcaagtccggctacgccttcgtggactaccccgaccagaactgggccatccgcgccatcgagaccctctcgggtgagcactcggcgcagcccacgccgcgcctcgccggctcgggacggcggcagcggggaggccgagccccatgggccgcgcccgccgcgactcccgagccctcacgctcactttcacgcaccagccccgcgactctcgcggcgggctggctccgggatggccggctgccctgcccccaccgcgggggctaacacagacccttgggcctcagagtcgaggcgaccctgtgcccctccgagggtccccaggctcgctggctccctaggagcgcccctggagtgcccagctgctctccagagcttcccccgcccccacctttgcagagtcccccgtttttctttttctagacccttctagtaccccctttgccagggacccccccaaatccagcatctctcctcctagccagaccttccttcttcccatgcctcgtgccaaagacctctcgccctctgtcgtctcccaagccgcactctccttttgag

SEQ ID NO: 23975 - DNA, 1193 bp, Mus musculus
cagccatcatcagagacgcctcctcctgcagtagacaacaagtacagagactcaccactggacaacgtacagagaatgagagaccttgaaacacttagacctaaatggggtgtctccactaaatccttcccctcagggctcagtgaactctgaggaagaagaggcagaaagattctaagagccagaggaggcggaagagatcaaggaaaacaacgttttctaatcacagcagaactaatgcacatacgaactcacagagactggggcagcatgcacagggctaagacagatggggtcccagggctgagaggggaagtggacatgagagcacacctctgcctcagaagctatgtccgattgataaccactcacaaaaggaaacttagtcctttccagcagtctcactaggtatacagaccacactgaggggctggagccaggcagacgggcaacacaagatgaacttagtggtagattgggaggaattttgcctcacggtgctttgtctttttctcttttaaactttacagctcttttgcttatatattttggtttctaattttgttgttgttttttatggttttccatgtgtgctaatgtatgtgtgcgtgcgtgtgtgtctcagagtctgtgtttcttgtgattattcattggtttttttttttctgtttgctttgttctattctgttttgtttttattttattattatcactgccatttgcagatgcctgtttgtattctaatcagagacagaaagaaagggtgtagacttgagggggtgggaatgtggaggatctgggaagatttaggagagggagctttaaaaatatatttccaataataataataataacaataataatcccagtaatagatcttgaaaatctgtattctttatttttttttttttgttttttttttttgttttttcgagacagggtttctctgtatagtcctggctgtcctggaactcactctgtagaccaggctggcctcgaactcagaaatccgcctgcttctgcctcccaagtgctgggattaaaggcatgtgccaccacgcccggctgaaaatctgtattctttaaaatgacatttattttgggagcacagcagtgcatgccacaaagcacatgtggggccggaggacaccgtgtggaaggaagttctcttctataccatgtaggttctgccg

SEQ ID NO: 23976 - DNA, 1213 bp, Mus musculus
ggggaagaccccacagcacagttgccttttggacaacacaggaaaactgccccaaacatgtttcagcagcatttgaaacaccaacagcagtgcatacaaacaagacagtggtgggagacgtgccaggccttcacctttcagcaggggtgtgaccaagttacagcaaaatggtgccaaagcgctgccacagcactgctaaaaaggccaggtgggaagccggttagctcctgacctggaatgcacacacctgaccaagtcctcacctcgaccttgatagtcaacagatgagcagtattttgtctctttagcactttttaacatggtttcctgcccacacctccacctctgggagaaaaatatattacagcctcacatgagtccaagccagaaatgggttacagggaaggaaggtgcctccatttctatcttgaaacccagcctgctctgggttattctggtgctggttctatgaacggctctcatgtccctactctggcacctcacaccactgggcttcctagtacgcaggcttgtgagggtgactggactgtccagtgtatgtctgctgcttgttccactgactctacagaaacaaaacccggtgggtgctagacagtgctggctctgcttgcaagccatgttgctgtggttgttacttatgtgtctgatccaaataaaggcagctgctgatttgttgttaaaaaaaaaaaaagcactttctgctcccctagacaacccagggaagcacgaggtacagacacacgcaggtaaaacacccatacacataactggttttaagttatttattttctgattataatataatttcatcatttccatcttccctttcctcatgccaagtctcccatatatctcacgtgttagttacttttctaatgttgtagagagacatcagagttaagagtctatgatggtggatctaactctggcggcaggaagagctgagagctcacatcttaatcctctgaggaggccatacctcttaatctcaaataattcagcaacagggaatcaaatattcaaacgtatgagcctatgggaaccatactttttcaaatcaccatcctctctgtgctttctttcaaatttatgaccttttaaaaattaattgttgttacatatataaatgtgtggtcatacacatacacacacacaacttgaatttatgttttcagggctgaccatttggtat

SEQ ID NO: 23977 - DNA, 1495 bp, Mus musculus
tttttttttcaggttatagaaaaaagaaacctcccatttttaatatgtgtgtttttttttttttttttttttttccattttaggtcgctactaaagcatgaagttgaagactttctgaaacctgccatagagctgggatattgtttgtggacaatattttctattgtctcctgtttaaaaagtgaacagtgcctagtgaagttaggtgacttttacaccttttatgatgactacttttggtggagttgaaatgctgttttcattctgcatttgtgtagttcggtgctttgttcaaagttaagtgttttcagaaaagtatgttttgcatgtatttttttacagtccaaattttgactgctgagaagtttctattgtaaaaaacttcatttaaaaggtttttctactgaatccagggtattctgaagatcgaagcctgtgtgtaaaatgctaccagatggcaaaaagcaacaataaacaagtttgatttttacttttctttctaaatatcaatgcttaaccagaaccattcttaagttatcagtaaaaaagtaaaaagttaaataaatgtctttcaggagtccatgaaacttgccatattcaatatacctgcgattaagtgttaaaaaatacgctgtaactctgtactgctagtattagaacaaaactcttcccatacagcaaatgcttaatgcttacattaatgtggatgtgtcggcctttatgtaatctgtattatatatagcagggaataagagctacagatacatgcctttaaagggctgtttcttaaggctgttacaaggagataatggtatttcaactaattatcagcaagtgacaatacattccaccacagatggactcttgttcttctagcgtttagactatatgaaaatactgggtgcttcaaagtatggaaggagcgaagggatcatcaaaccttgtcatggatgaagactgcctgttcattttttaaatatgattttcaggtcctttgcttaccaaaggaggcccaattcactcaaatgttttgagaactgtttaaataaaggcaagaaaaattgctgatgcaacttgtttttacaaagaagtgttggttttctttttaactgttgtaattaaagtcctgtagtttatttagtgactgatgcaatattgttcttgcttcaagataacattaaatctatttctcaaatatattggccaagtagaactggaatgaatgtttctctttggtgcgaggttgtattaaataacctcccaacatgtctgggtattttgcaaagcatgtttttagtacaaatctgcttctgtttaaggctgttaaaatgtaggacttactaaggggcttttagcactttgttgttacttagtatatacaggtgttccataagtgctacatattattatagtatccacttgcagaggcagtttggcttagattaatttgatatctaaaagcttcaagaatttcagaactacagccccagcactg

SEQ ID NO: 23978 - DNA, 2682 bp, Mus musculus
cgctgcagcagcctcccctacaccgaaggcttcgcttactaagtttctgaatggccgagtagccacaccctagagctagcagtcctcatccaggcaaccgagggcagtggttttgtttgtgttcttggctgttcctaaagcttgccctttgagtattatcaggagaacccaagctgtctctggattcgacaccctttaagacaaataccttggctcgggaggagtgggaacagggagagacaaaaaccaccacttcctggggagacgtggataccgtcctccttgccaccatggccagtatgtgcagagcagtactgcagtgtgttcagggttagcgcccatgaaaggggaccgagtgtatgacaatctgcgttgatcatggactactaaaatgccttcacacaggaggctttgacttgcacaattctttgggaagaaactgcacacccataggacagtcgataaggctgagtcggggaggctcagaccattgaggcttgaaattgcaaaactcttgtagctcattctgaaatctttcccctgtagtccagaactggggaggccaggagagccgttactcactccatggctctcagaccgcgttcctctttggccttccttccagccgagccgtcaccataagtaaatcaagtcccttcctcccagtcacacggctgagcgcagacggcttgttttaaaaagatgatgaacatgacagtattttgttttgctttgatttgggggggaagggttcatcttgcttttggaggttgttttggggaaaaaacagtttatataaactgatttttgtagttttggtatttaaagcaaaaacaaacaaaaaacaaacccctttttggtacctgcactgcatccctcgggtggggcagtgcctactttggaagatgctgcagcctgcgaggggatctgctggggcttccccttcgccacacagaagcctgcttagtgctttctgcaccagacaacctgttgaggcgtataacctgatctgtacatttttttaagtgtgcagggcagcctggacacagcttagcgttctacgtgtatagttctccatgctcactaactctccttctctgggaagcagatgtacatactacatacatgtcacatactacatacatgtcatgtactacacacatgtcatatagtacatacatgtcatgtccatttaacgactggtcacctgctggggacccaggcatctgccttgttttcctttttctttcagttttggactttggaccctgcacagccgttccccagggtctgaaacttacctgtcacgcacaggtagagcagtgctagctagcattactggcttcctgctactttttcgtttttttaaattttttattctgattgctgtattatattggggatgttctaaacaaccaaactaaagctgtgtacagattgggtttggagcggtggggacgtcagcaggaaacgccagtgctttgctgcctgattgacaggaatttgctgtccttgacactccacacattgtgttcctcacgtgtgggacaggacacagagctgactgagcgtgggacactccacagccttctcatgacttgtgaaggaggttcacaggaacgaggggtatgttttagagctatgagaacctagtcagcccacagaggcgtcaaacctgaagcttgggccttaattagcattgtactctgatgaaaggactctttcataagcatatttatagctttctaatctatacacagtctatccatagatgcatattttaccccaactggctagagatttatttgttgtaaatgctgtatagattttgggttttttttttttgttcttcctctcttcacttatactggtgtggggtttgttttagttttctttagtgaatttatgctgttttggggggcggattgagaagaatcttccgtagcctgagctgtccctcctgttttgacggcacatgtgccagtcaagggacatgggacagtcgcgccactttgcattcccacgggactcatgtacctcccgcagagccgtccccgtcaaggtgtggggctcctttcatgcatttgcttcttttccagagtgtggatttgaactacttccccctgcaaagggccgcgtgcaccctgccgagctgcgtatattctgtactgtgtacaataaagaagattgctttccttacgcattcctgcaacctgcctctttcttgcactcggtgttttcattttcaagtaagcaagaagcaactgggctttcccccaactcctgcccccaccttcagctattgaactttattggatgacggagttaagttagggctgaacatctgacccactgctagccactccaccccaagcccaccctgcctcccttaaggcatgattttgtttgaaccttggattctgtgaaaagattaactaggcaagaccttttttttgattccttttcttctaactcagcccctttggttgataattttaaaactgctaaacacaaagatcatttccgagtttttctcctaataggttttgttttggacaagtgaaaatatttttttgatggttcctcaaaagaagagcaagtttctcttttttttctctctctttctttctttctgtctgtctgtctctctctgtctctctctctctctctgtctctctctct

SEQ ID NO: 23979 - DNA, 1157 bp, Mus musculus
tcctgagttctctgagcccctgtgaaagggaaaagagaaatgaccccgagagctatcctctgacctccacatatatgtgcccttgaacatgtcgtgcacacaggataaaaataaaacattgttgattttctttaagtaaaagaatgctcctacagtccttagtttttcgtacaagcacagcctctgttgagcagtatggcctttgtctttaaactctttcaggattcccgtatgagaaggaccccaggctgtactttgatgatacttgcgtggtacccgagagactggaaggtaagacgcccccgcccatctgagggtccatgctaagtgagagggttggcgatgtcagagcgcctcagtcccgatgagttcgatgactcagtcaccagtagccactgcttccctgcaaatcctcagccgaaatgattgcatgcacacccctgtcccacacaggcaaagtcaagcaggagcccaccatgtatcgagaggggcctccttatcagagacgaggctctctgcagctgtggcagttccttgtcaccctcctggatgacccagccaatgcccacttcatcgcctggactggccgaggcatggaatttaagctcatagaaccggaagaggtgagtccgggcgtctccgttactttcctgttgatgctgtattatggcttacagtttcagttttagattttaaagtatttattttgtgtgtgctgatgtgcgtatacctggccgtatgtaggtgtgtcgtgtgtgtacagtgcccatggaagccgggaagcggcattgggtcccctggagtttggtggtggctctactctgtgggtgctgggaacctaacatgggtcctgtgcaagagcagagagcttttatttaactgctgagccatctttctagccatctctccagaatagagatgctttttcaaaaactcttgttttgtacgatgctggttgttggagtgagggttgctattctgcgctgctgtggtaaagcaccatgatgagaggatagtggggctgtttgtttctggtttggttttggtttatacttcacatcattgttcatcaaccaagctcagggcaggagcctggaagcaggagctgacacagaagccacgaagaagtgttgcttactggcctgctccccctaact

SEQ ID NO: 23980 - DNA, 1220 bp, Mus musculus
acatttagcaaagagcatgctcttaagggaaatatttttagtaagattttgggttgcttactacacagagaccatcttgtgaagccacctccgccctccaacctattcctttgcccagttgaccgcacacactgaaaaagtaaatttcaaagaagccagcgttttaaaaactgctctaaattatcttggcctggtttttctctccttcctttacagtcttgaaccacagatgcctaggaaacagttatcaaaacaagtgtttctgattggcatctctgattgctcagatagccgtcctgcctcgggtcctcacctggaatccttgtgtgatattttgagtctttgcgtttcacttcgcccttccttcctacacctttatttgagcaatcagatggtgtgtggccacaacagaaataactgttgatgccaactcatctgactgattaccagaagcgtctgccaggtgttgtagagggcgacaacaactagaaaccacaaaatgtccccaaatgttccttatgatcctttgaaaaccaaagcaagaatttaatctagtcttgtatggttgtggatgaattatctttaccttagtggggctaggaggggggcgatgaaagttaacacgacacagttgacaggtgtgtaaactttaaatcgtggccgatgttcacttacaatgactttataacaagaccgtttaaaacagtactggaatatcaaaacccatatggaaggtgggaaatagatcacctcctggcagctaaggctacagagcgtgacgcagagggaattatgtcttgctgataatgtgaagtgcaccaggttgtcataaaagtcagtttgccaggtgtcgtgcacacacctatatggtcctaacacttgggaggcgggggggtgggggtgggggggggcaggaaggtggggagtttaaggtcctccttaagtatatggggagttcaggatagcctatgctacatgacaccctgtcttaaagggggaaaaaatgtcaacattctttgcctcagttgtcaggtgctaattgaatgcttattgtatgtaaggtgttgagagaacactaagatgcttagggtgtgacccttcttgtccttgagaagtcctgctctgtggcaggcacgtgtcaagattacagttctcagactcattgggcttggttggttggttttgaggcgtggtctcactattactgctcctgtgtggac

SEQ ID NO: 23981 - DNA, 1099 bp, Mus musculus
accagagaaggcccataaattcccagcctcacccatacacccctgcacacacacacacacacacacacacacacagatcttttagaaggagggaaaaaggaaaccggaagcagaagctaaaattatcttggagaaaaatcacaagaagtgttaaacaagtcctttgacgccccgcgtttgtcacattaccgaggtacaaatattcccctgggctgtagcgatttcaccgtgttaatgacgtcatttcctggcaacaatgggctgcaaactggttttctgctgggcctggttactatgcaaatgcctccctggagtttaatggatccttctgtctgtctctttacagtgcctacgataggaagcctccctctgggttcaagccattaaccccgcccgccactcctctgtcacccacccatcagaattccctatttcccccacctcaggcaactctgcccacctcaggtctcacccctggagctggcccagttcaaggggtgggtcctgccccgactcctcactcacttccagaacctggatcacagcaacaaacatttgcggtcccccggccaccacatcagcccctgcaaatgccaaagatgatgcctgaaagccagtatccatcagaacagaggtgggtaccactctgaactaacttactctctcatgtccttttctcatcgggagagagaagcagttagtcatgttggccaggtacctagaaagttcctactccactaacgccactgacacatcagtgaagtgagactgcagatgtactgtgggtatgggctagttatatagcaccctgttcaggaggttctcagaatggtttctaggattgtaacctccttaggaagcctgggtggagggatggcttgcccagatgcacagtcaacccaccaatttctgggctcctcatgagatacagcctgtaaaactgagctttagtttacgctgctcctaatcatggtattattattattattctacttgcattctgggaagagtctgagttatgggagccattattattcacattttagcatagtgaactaagaatgttagtaataacatctgcttttttgaggtagaaact

SEQ ID NO: 23982 - DNA, 1197 bp, Mus musculus
ttaaatcagagaagatctgagggggtttagcagaacactgtctcctctgcttatgccctgagtcttgtgataagggggttaagtagtgctcagagaagttaccctacaccctgcaggtagataggcagaaagtagccattttaatattcttgccagaagggacagccctcgtgctacagtgtctgtgttagggtttgttctactttggggaaagggcctctttgaagcaatttagtatccaggtaagggcaaacttagctttctgtattctggagtgtggacgcacggtaaatccttcattttgagaagtcttgtttttctgccctctcaggctaatcctatgcagaatctgtagtgggtgtctaagcacatggcccagccacgtggacttacctcatgaattcaggagaagccattagcattgtcttagtccattttctgttgctgtaacaggataacccagcctgggtaatttatgaagagtacataaatatacgtgtgtgactataagtctgtccatgtgtagtttgtaaagtttattttggttctggttctggacaccgaggagcatctgctgaagtctttatgcaaagcagagggaacggggagtgcatgggaagagacgagacagtgaagcacactcatggaagtgaagaacgggctggagagatagcttagcggttaagagcactggctgctcctctagaggtcccaagttcaattcccagcacccaggtggcagcttaagatgtctgcaattccagtttcatgggggtctgacaccctcatacagacaatcggtcagaacaccagtgaacatgaaattaaaaaacaaaagtggagaccctgcttcgtctcttcatgacccagacacctcccttcagtgtggttacattgggaaacagtttcaaggggaacaaaccatcactgggtaccacgacttcttatggaagcctgcccttcctgataggctgctgggaatggctgggagcagatactgtggacacaaagttccccacagacttcctaggtggtcagccttggcccagagggccaccaagttggttttgtctttcgctctcaagtgttttgtaattcccctaagcctgcgtggtccttactcagaactactatttagtgacacttgagaaaagactttgaaaatcatatttaacttggaaagatgcttctgtataa

SEQ ID NO: 23983 - DNA, 1164 bp, Mus musculus
tggattaggaggtgtggccttgttggagtaggtgtggccttgttaaaggaggtgtgtcactgggggtggactttgaaagcagttttctctcctgctgcccgttattctggatacagaattctcagctatttttccagcactgtctgcctatgtggcgccattcttgatgacgatgggccaaacctctgaaactgtaagcaagccccagctaaatgctttccttcagaggagttgccatagtcgtggtgtctcttcatagcagtagaacaccgtgacagctatttagtatagatctactcctaccctactccttcccctgccaccataagaagtgtcaagccaacatttccctctttttcttctaatttctcccttttgaccacaatttttctgaaaggacagctcaaccttacttgcatgtcttactgtctagattagggcccaggctagtttacttaaagccttgtcccatatatgctacttggagatgattgtagtatattctctaatccatcagccattttgggggtgtctcaatactcaagtggactcatttgtcatgaggcatgccactccataactcgaggaaaatggccaccttgagatccacacgactactccttcagacatagcagatttcgtggtatgccttttacccacagcacggatagtggaagtcctggcatcctctgccacatttggaagtgttgttccggtggagtctccactcttaaacagccagcttcaaagacaatgcaagtgctcctcacaaagtcatctttggttccgtcatgttgcacgtttgggcaacaagcattgtgtgaactttttctgggagtacgaatggatatttttgttcatgccaacaacaatttaaaaaatgtgtacgagtctagaatggtaaccaatgaattttttggagttacttacgggaacatgagtgatgggggtttagtaggagcacgggcagcttataagtgactacaccttgaggaaagttgctgcctctcagcagttgttcactcactgcctatatagcttcagagagggctcgacttctgagccttgccatcctagtaactattaactgcctgaggagcctcagggaggggcaggcctcatgagcctttgcaccctccatggtagaacaccaacatacccaat

SEQ ID NO: 23984 - DNA, 1671 bp, Mus musculus
tttagagctgggagacatggctgcaggccttctgcaaagcaaagaagccccgctgtcgctgtgctcacttgagggctctgtgagctgggctgtgaatcgagtcgcttaggtgaagaagccaggccaaactgaagggaagatgcgatgtcagtgggagggacaggaggctcagggtgaacttctctgcgccaactgcacgtgccctgctctaagtgtttaaaacgataaggaaatgggtagaagcggtgaaagctggcaaaagggcaaggaaggaggagtggagtcagctggggtgattgtcttccccctttttacctgatctcatttcccagggcttcacaagatggggggaggtgggcttgactgaaagaagtaaggcatcacacatgtgtgtttggaggtgtccgctgtgaagttggaagctgcagagaagccacgttttcgttaatgaagccatttactcgttctttctgcaggtatcaagcagcttctcaaacaaggccccgtgcagaaggtgtacaacgggctgcagggctattaggagcgaagagaactggactttgaaagaggtggatcagcgatatttattatctgcagtgggtttttgtgtgtgtgtttcattattttcaatatgcaagtttggcttagtccttttttccctgatgaccgtcctgacaagaactagaggtttgaggctctgtctattgcattcagacaacaatggccagcagaaggttacctaatacctccccctctggggatttaacgtctggtgctgcccgaggttcaaggagtaacgtctcagaggatgcccgagcaaaggaaaccagatgagggttagagacaattgttagctatttcaaaatgccaactggagaagtctgtttttaaatacatcttgttgttattttttttttcttgactcctgtttctttttcctgtgagccgatgggaagtcttcccatcaggcaggatggccacacagcatgcagaggaacgatgagagcccggctcccaggccccactaaacacatggtgtctatagcaacgagctcgaagaaaccgagtagactagagactgagctacatgaattaaagttacacaaagacctcactgtctttgagagaacatattttcccgttttctttggtaataataaaatctgatatgggtattttactgtttagaaggtacttttctgtatctgtccaaggtagccttatgagctaagatggcagctttagagaataaatattagaagcagaattgcaggtggctttgtcttccagtggcacagactcagacgccagcaggctcagcacacttgcctttcagtctcctcctccgctgctccgtacacaggacttgttgccgcagctgagtatttcattcagtgcgactgagggttactgtggcagtgtgggagctgctttggatgtactggtgtagtccagcgcccctgccctctgtgcagcagctggtgtggttgagactgtcaagaatccaacaaaccgcagaaacccagacctggattcagccggctttctgtacactgtatgcacatacaggggctcagtgtgccttttgcacatctgtaaacactttcaggtcagtgggctttcacacgttatacacaagtagaagttcagtagggtatttttacattatct

SEQ ID NO: 23985 - DNA, 2100 bp, Mus musculus
agccttatttataatagccagaagccagaaagaacccagatgtccctcaacagagaaatggatacagaaaatgtggtacatttacacaatggagtactactcagctattaaaaagaatgaatttgagcggaggtcgcgactgagccccaggctggcttgtgggggctgcagcgggcgcgagggggtgtgaggcaggcacgggccgagacgtcgaccccggaccccgcttggtgaaaacagattccagcgctgggctctgcctcccccccccccccgcccccccaatggaaccggcgctcactggagcccagattctctttgttccgcagccatttcaggcccaggacgggaggcagtgccactttggcagaaaggcctgagcgccagaggcctctgggatggtgtgggaccggcaaaccaagatggagtatgattggaaacctgatgagcagggcttcagcagatcctgcagctgctcaaggagtcccagtccccagacaccaccatccagaggaccgtgcaacaaaaactggaacaactcaatcaatatccagattttaacaactacttgatttttgttcttacaaaattaaaatctgaagatgagcccacacggtcattgagcggtctgatcttgaagaacaatgtgaaagctcattttcagaacttcccaaatggtgtgacagacttcatcaagagtgaatgtctagggctggtgagatggctcagtgggtaagagcacccgactgttcttccgaaggtccagagttcaaatcccagcaaccacatggtggctcacagccatctgtaacaagatctgactccctcttctggaatgtctgaagacagctacagtgtacttacatataataaataaataaatctttaaaaaaaaaaaaagagtgaatgtctaaataacattggggactcctctccgttgatcagagccactgtcggtattttaattacaaccatagcctccaagggagagctgcagaattggcctgatctcttaccaaacctctgtagcctgctggattccgaagactacaacacttgtgagggagccttcggtgcccttcagaagatatgtgaggactctgcagagattttagacagtgatgtcttagatcgccctctcaacatcatgatccccaagtttttacagtttttcaagcacaggagtcccaaaataaggtctcgtgctgttgcatgtgtcaatcagttcatcatcagccggacccaggcgctcatgctgcacatggattccttcattgagaacctctttgcactggctggcgacgaggaagcagaggtgcggaagaacgtgtgccgggcgcttgtgatgttgcttgaagcccggatggaccgcctgcttcctcatatgcacaacatagtcgagtacatgctgcagagaacccaagaccaagatgagaatgtagctctggaggcctgtgaattctggctgactttggctgaacagccaatatgcaaagatgtacttgtaaggcatctaccaaagttgattcctgtgttagtgaatggcatgaagtactcagatatagatattatcctgcttaagggtgatgttgaggaagagaccatcccggatagtgagcaggatatacggccacggtttcatcgctcgaggacagtggctcagcagcatgaggaggatgggattgaggaggaagaagatgatgatgatgacacgatttctgactggaacctgagaaaatgttctgctgctgctctctcgatgttctcgcaaatgtttatcgtgatgagcttttgccgcacattttgccacttttgaaagaattgcttttccatcatgaatgggttgtgaaagaatctggcatcttggttttaggagcaattgctgaaggttgtatgcaaggcatgattccatacctgcccgagctcattcctcaccttattcagtgcctttctgataaaaaggctcttgtacgttccatcacctgctggactctcagccgctatgcacactgggtagtcagccagccaccagatacgtacctgaagccattaatgacagaactgctgaagtgtatcctggatagcaacaagagaagacaa

SEQ ID NO: 23986 - DNA, 1547 bp, Mus musculus
gggagcgggggctcagtgtggacccactgtggcaccccctcctgccacatcatgctgctgcattccaaaatatatcagttataaccccagatggccatgcatgaatgtccatggtcaaactccatgtattcctgctgcaatggaatgcaatgcagacccaagaaaggctcgaggagtctcttatgccatgatgtggaactgatgtcccagatacgttggctcagtggttaagagcgttggtttatctagcaaaggacccaggtttatttcccagcaaccacatagcagcccacagctgtctatcactccactctcagtctcaggaaatctgagtccctcttcctgacctcagcaagcaccaggatcacatgtaatgcacgtacatacctatgtgcaggcaaaacatcatacgacccctttcctttcagcggtgcagctgcaagatggcagtgtagatttccaagaagaggaaggacacagaatgttcttggggagaagggtcgttggatcagagagttgaccacagttggccagaagctctttggcttccctgaaggcagtgtagagctttatacagagaaagtggccacaagaggtctgtgtgccattgcccaggcagagtctctacgctacaaactcctaggggggcttggggttcgaagggcctgctatggtgtgcttcggttcactatggagagtggggccaaggactgagaggttgtggtgtctgggaagctccaaggacagagggccaagtccatgaagtttgtggatggtctgatgattcacagtggagaccctgttaactactaggtcggcacagccgtgcgccatgtgctcctcagacagggtgtgctaggcatcaaagtgaagatcatgctgccctgggacccaagtggtaagattggtcccaagaagcctttgcctgatcatgtgagcatcgcagaacctaaagatgaaatcctgcccacaacccccatctccgaacagaaggatgggaagccagagccaccggccatgccccagccagtgccaacagcataacagggtcttggcagctgcatctagaggctggatgctaccttgtaaagacatttaataaaatcttgaacaaagacaaaaaaaaaatcatacgtgtaaaataagaaaatctatttgtaaacaggtccacaaacgccttttcctattaacctttctttcccctacctctggagggttgtgggctaggagggaggttgaagtgttaaagaaccataattaaagtaggttttgaaaaaaaatctaagcttacagagaagccctgtcgtggaaaaccaaaccaaccaaccaaccaaacaacccaaaacaaacaaacctgaataccagctacaaagaaagttttagcatggtcatgagaatgaattcagatgttcaagaaatatcacttatgatctaattaattcccatttcatgtaggcattctcctgggctaagggaaaactaaccctagtccttcctggagtcccttcagcctgcctctccccacataaatttgtaacgctgtcgta

SEQ ID NO: 23987 - DNA, 1117 bp, Mus musculus
gcatatataatagtgcaattatgcctttaagcttagtcttagacctaggttttatagaataactaccatttttggcttttagatccaaaaggtaattttggctcttggagattatatgggagcaacttgtcatgcttgcattggaggaacaaatgttcgaaatgaaatgcagaagttgcaggctgaagcccctcacattgttgttggtactccagggagagtgtttgatatgctaaacagaagatacctttgtaagtagtgaatcttaatggtccttcttatcaaaaggttatgagaacttggtgatgcagtatgactttcttattaacagctccaaaatggatcaaaatgttcgttttggacgaagcagatgaaatgttgagccgagggtttaaggatcagatctatgagattttccagaaattaaatacaagcattcaggtaaagtttatttcttctatttatttggggttaggtttcatgcaggtacagttacaataaaactgaagtgttctattgtcgttccccctgcttaaagcatttgatacattactatctctgcctagctctaccatactaaggcagagacgcttggtttcaaacattttcccgtctagcatttgctaaaaagattatacaaactaaacagataaagacaagcattttattttttaaaggttgtgttgctttctgccacaatgccaactgatgtgctagaagtgaccaagaaattcatgagagatccaattcgaattctggtgaagaaggaagaattgacccttgaaggaattaaacaattttatattaatgttgagcgagaggtaattttgttacaagcttttttttttttttcaccttcttgtataagcactgtgctaaaattgcaggaactaagattctatcttggtttttgtaataatgctagcagagtacacacaagaagaaaagtaactgcactggattgcaaagactggggtggacctctttcttaatgtccagtgtcctatgtcataagattcggtgcaataagtatttagaccagcaataaatactcagcttggagatcatcatgatctttgtgggtagcatatcagatactacagtcaacagttacgaa

SEQ ID NO: 23988 - DNA, 1117 bp, Mus musculus; identical to SEQ ID NO: 23987

SEQ ID NO: 23989 - DNA, 1879 bp, Mus musculus
agtccctacccacattggcaccaagtgctgccccacaggagacagcagattagtcagataggctggggctcttttattttattttattgttttagctgtctactccctaaccttctcctaattgctatcattactctcccttacagcaggcttccctcccaaattacttttaatcattttctgttttgcaattaccccaactttcgctgaccttatgggcccccccgccccccatgaaaggtctctcagggcatggggaatatggtttctgggacttaggttagaatcttaatcataactgattctcacaaggggtgaggtgtgtgatcacagattgccctgctccccctgcaagggagtagcattggtctctgggcagggaggacccaccctgtttggcaagcatactctcacaaggattttctgagacctctctacctggtgggaaaccacagcagcccactcagcccctggtgtggagtggttcagtgacttacagatcagaattaatgctattgaatcaaggtcactgagacacagtctactggattcccaaggctgtgctcacagggcttcggtgtttcgagctgcagacccacagtctcagagctcagaaacttgtttactgctgacccccttgccttatgcgggcaatagaaagcccggagtgaaaagccctggctttccaggttgacccccacttcctcactgtgccactttgtttccatatctgtaaaatgggggtgacaatcctacctcacaaggctgtgtggggaccgcaggaaaacatatatctgggctgtgtgaggaccactggaaagcacgtggctgggctgtgtccacggtgcataggaagtaggtaccctgatgtctttccttgtttccttatggagggtcacacccatactgggccttgctgcaggagagggcagtagagaaaagcagggcatcctttctgttgtgaggcatctgcatcatttgcaacgtgcaggagcctacctgtcttgctgcctgcacctcagggtgtgcagagcattgggctgcttggccgctgtgggggttaggtctagggaattcctggctcattataaggcatcaggactgtggatagagtgcccaggaagctgatgttccttcaagaggtcagcaagaggtacattagagatggagactacactgggtagattctagtttttagttcttattaatgtgggggagtaaattaataagtgtaatatgattctgatgtctgttagactttctctgtgctctgtaaatgtggatacttgagtaaagtggactacggagtggatgtgggcgtcactgttagtctgatgaggtatttagtatttgcgacaggtagtttaaaatctgtgactgagtgctataggaaagtgtctttctacgtgggcactgacgtcactagccatctatgcatcctaaatgcaggatcctcttgattccttctgccaatcaaatctctcattgctcttggtttccgggtttgtgtcagaaacttttaaaacatacctgttaattctaaattatccaaagattatgtgcaaattttaaaataaatatctttttcagaaatctgctgcttctctttatacttttctaaaggtaatgactgattgccacttatgtgtcccaaggagacacgtctggaaatcgagtgccctgtacttcaggagtctctggcattgatctccctcttcaacactccaggaaaaagtttatatatttactgtgatggaatctcagagatattgacagcttattgattttttttttgcccattcactcttgctagatacaagtaacgaagctatcatttatcgcacaccttaggagaaaggagaaatagaatagggtaaag

SEQ ID NO: 23990 - DNA, 1156 bp, Mus musculus
ctgcctttatatgttacttgacctttttcctttacccctttaaatattctttctttgttctgtgcatttggtgttttgattattatgagacaggaggaatttcttttctggtccaaactatttggtgttctgtaggtttctagtgcgtttatgggcatctctttctttagattagggaagttggttttgtttttgtttttgtttttgtttttctgattttgttgaagatgtttattggccctttgaaccgggaatcttcatcctcttctaaacctattattcttaggtttagtcttttcactgtgtcctgaattccagaatgttttaggttaggagctgtttgcactttgtattttctttgactgttgtgtcaatatcttctatggtatcttctatgcctgatattctctcttctatttcttgtattctgttggtgatgtttgcatctgtgactcctgatctctttcctaggtttttcatctccagggttgtctccctttgtgatttctttattgtttctatttccatttttaaatcctggacagtttgttcaattcctttacctgtttgattgtgttttcctgtatttctttaagggattcacatgtctcctctttaaggacttctacctatttatctgtgttctcctgtatttctttaagggagttaactctgtcatccttaaggtcctctatcatcatcatgagatggatttttagatcagaatcttgcttttcaggtatattagagtatccaaggcttgctgtggtgggagagctgggttctgatgctgccaagtggcattggtttctgatgcttatgttcttacaattgcttctaaccacctggttatctctggtgtgaactggcctctccctcctgtaagcctggttatgttgggcctccttgggtcaggctgtgtcttactgtgggagagggtctggagcatttgatttgtgtgcctggttgtggctaacctccttagagtcaagctgactgtgagtgtgggcagagtagtaggtgctggagcaaaaatatgttcccaaaaaagttgcagaccagaaggaagatatgtctccagcagggaagaaggtcctgtgtcttctggaccctgaggctagaaggtcccagttagatcaggtgttggggtggaggt

SEQ ID NO: 23991 - DNA, 1236 bp, Mus musculus
gatgaggattatgtatcccaggttaataaactcagtcttagtgttaaggtgtccaaggtccaagtgattgtctgtctgtcactgtcttcaatgatgatttcagatgacgacaaccactttcactgcagttggggtgagaatacttgagtaggatcccttccgacaggttccagggttcaggaagggatcctctttatcccttccatgtctcctgggtggaactggtgggtgagttcagaagcaggagatggcaggactgactccctttacaatttggtcaataccttgcaagcttcttgcaaagcatgcagggatttgagaagggagtgattatacatttctgcctaggaaatctctcagagtatggggaggggtggggggtgtatctgaaagacaatttcaaaaggagacagccctttctggtaaggacctcactgggccctgaaaagggcagaggggaggaggttggcctgaaagtataacaaagtaaaaacagaattctaggcctttaggcccaggcttgggaatgtggcctttgtaaaggtatactaatcataaaacagatagcaacattcctccacccacctgcttcctgggttcaaagagtgctcattcaaagaaagtcaccctgaccattaccagaacctgcgatgcaaatgtactattgttaggggctcttagaagctgtcttgagagttaacaattaccaggtattccttgtgactcttgtaactttgcacttccttgtgacttttaactggtatctttggtatcttccaacaacaccctccccacttccttgagttgtggtttcttcctttaaatacccccttacccagctactcggggcgccacggtcctctacccctacatggtatatgaccgtgggcccgagagcgctcttaaataaaaatcctcttgcagtttgcaacaagaccgtttcttgtgggtgattttggggtgtcgcctctcctgagtcagaatgtgggggagtcctcacgttgtgggtctttcagacccaatttttgacagtttccatgagcaatttgtttagcgtctccttaagacttttactcttctgttctacctgacctaagctctgtggcctatactgacaatgtcattcccaactgttttatacccttttttttagattgtgagacaatttggccatgaaggccaagccattattggaccccaaagctaggggtggtccaaactttggaattatttcct

SEQ ID NO: 23992 - DNA, 1190 bp, Mus musculus
ggtgttttacaagaaatgggattttgtttcctcatgctaagaaattagacataaatacttaggtaggtctgagaaaaatatgtatgtatatatatatgcacatacataagtatgtaatgaaatactttgggctgaatttataaattattttccaatttgataaaaattaatgtgaattctcaattgctacatttcctcctagtgtttattttttcctgaagccttttattgtaaacaattccagtttagaatgttgagagcagctgtagccctatactctccactttagaatgttgagagcaactgtagccatatactcatatcttttattcagagtcgtctgttgtttatattttgtctcttcaggcttatcatgtccccacctgtgcttctgccttttctctagtttatatacacatattttttgtgtggagaatttgagaataaacatgcattgcttcatgaaattttgggtaggatcaagtgagaacaagttgtaaaaactatgtgtggtgctctacccttgaatgtggcgtgtggtcctgtgaatgaggcaggtggggatcacctcgtcctctctgtgtggtgactcagtgtggtgtaagctactggctgcgcctccctcctcggctaacccacttacattctccatggcatttcctctttcagtgcccaagccggcctagactgatactcatctagctgtcatgtcttttcagtctcctctgatctggaacatttatttctccattctttatatttcacagtgtttgcatttctctacaaagtggtactccgtttgaaaacacatccttcataatagctaattatttctttatgtttaatttgaattgtgcattcccttgtgggttgagaccccttggggtcgaacaaccctgtatcacagaggttgcctgagaccatgtgcatattagattatgatttataacaacaaaactacagatatgcaatagaaacaaaaataattttatggttgggggttaccacaacatgaggaactgttttaaagggttacagcattaggaaggctgagaaccactggtctccagacctttgtgaagatgttgtgtgtccctagcgtcatactgagagactcagaatgtgtattggtggcactttgccaagatgccctgtgatttgtccactatacatgcctgctatcccgctgt

SEQ ID NO: 23993 - DNA, 1144 bp, Mus musculus
ttgcacagattatactccgtcccattcacttctgcattcctgagacttttaatcctcatgtttgtctcacttctcatgtggttgaatagatttttagtgtggtatttgctgtcacatgatttttcctgggtgaatgtgccagcctgcaggtgccttaagtcttgtcctgtctgtcacttttcctctggctgtggctacaaaaggcagtcattctgttaccaggtattgaaaaggtgaagtttcccattgcactacacccctgacgtctcttgctaaaataatggtagggggatatttttctatgttaagctataaagagtttatttgaaaaagttaacaggagcccactttagtctgcaactatccaaattcagcagtcaaggctcattggaaaacattgattagccaatatctaaaatgtggggaaataaaaccaagtttcaccactgtgctaaagaggcagaattctaggtgtatctggaaggcccgttgtatttccacaatcccaccctgagagttagctcaccacactctctggatataagactgtcaggcttgcttttggtacatttataaatctatccaactcttcatccttaaagcactgtgaaacttcacctaatatataagcatggttactgcaattaatatttatcttcagaaagataagtattaaaatgaatcaaattcttatctttctttctttcactttatagtgacccaaacctaaatctcttttgcctgaaaattgcaaatcgggacacataaaatgaaattataggaccatgtttcatcttctttaaaaaagagaaaaaaaagctgggaaagattgtgaaaccagagtttattattcttacaatcctctgtaactcaagtacatactgcaggagacattttcctatcatcaacgtgacattcacaccacactttcaaagacaatcgctgaaaaccaaattgtctttctgaggtaaaaatatgcggaatgcctgcctggaatctttatgcgaactcttattagccagtgaaacacttgcttgccaactggagccagttcgcttcgttaagaggagacacctcgctttgcagttgcagttggccattattgtaaagtcagtatctcagaatgagatttctcaaagctttc

SEQ ID NO: 23994 - DNA, 1306 bp, Mus musculus
ttctacttcaagtgatatgtgttccaaactgatatgtgtcccagatgaaatagagactgatctaatcaaaaaaaaaaaaaaaaaaaaaggtttggcagggaagcagtagcaaaatcatttctcagtgactgtcctttacccatgtgtgcacttgggacacctggggacactagcagactacctaagacatctttcctcatgaatgaagggtagaagagttcccctctaagcgttggagtcaagtctttactcccttccagaaaatatgtcaaggagaaaatagaattatagatggcacatgactgtctggctcttgtcttaagaatgctgtgtggaattatgtgccttacgcaaaacctgaaacttagaagccaagttttgtgcagcggaagggagcactgagctctgtggtggctccgcgaagtgacttagcctgggttttgcattgccttgtctggatctatgcctttatcgttacttaacagatttggggcttttctttctttaccgctaagcatgggcatgtgtgcaattatgaggtgaactttctaagtagtaagcccttgccacaaagtagacgttacacaaaggcacagagcccagggatagtaatcttgcctgagctgctcgcacaggcttcttattccatggctttgtcgcaggcttttctctttctgtgccatcacctttgagaaacatgattgcaccttctccaactctgcctttttaacagcttcagttgagttggcaagactttcccagctctgaatatagccatttcccgactccggcctctgcgagactgatttcaaatctgtgatcttctgttcagcgtacacatcagcaaagtgagaagttgggtgctaaatataggctctattaactttacttttagatgtgctgccttcaaagagtgcctattctgagcaacgtaaacgttattcctacatatgtatgtacacacggtacccggactcacactgttcgggcttcacaaacaccatcagcaggggtaggtgctgagataaggaagcatcgccaaattgaagagggtggctcatttccaatctccccttcagtggctaccatgaaatgggctaaaacaagagtctcctgcacttcctgctgacacagccactttgcatttatatcccaggaatagtggcaaattgctgaggaacccgtatttcatggaaataatacaatcatgaacatttcatcaggagagggaaaggcaattaatatgtgtcatgtgtgttttaaaaactaagtattgctaagttttgagtgtcagcaggtttctttt

SEQ ID NO: 23995 - DNA, 1460 bp, Mus musculus
cctggagctctctctgtcagcgacaggaactctaggtatttttgaggaggcagcagcatagcctgggagggtgagtggttacccagcagtcgtgctcggaggtgagccaggtagatgtgctgaggtacatggagataccgtatgatcgtacaagggttgaacggaggacatgattccaaaaaagattgttctcaatgtgtcgtctgactcaaccagctggcagattacacttgccaagtcgcttcctttccttctaagtcatttggctccatattcccttgaatatgcctgtgaggaaagtaagatgtgtcgccccatccacttagccttcctgaaaggacattagtgatgccctagtggtcaccaagctaccatgaaatgccaccactcctactcagttgtaccaaatgcaagtagaggggacaaactgtgggagacagatttagtgccatcgtggttgtctgccactctgcccagtatgatcccagcaacccacgagatctgaaggaacaggactggtgagtagctttagggctatggccgtacttctttaggaacgtcatgattggagtcaggttgattttttttttttctttttagaggtgggcagtactttttcccatttctcctgttacctatcttttgatctctatctaatctcaacactaataattttctgctgttgacctgatcagatttcagtgctagaaaagaattctaaaatctcttgtgtgctgtcctcaagtctttgggatacacaggtactcctccttgggaacaaacaaactgagacagacacagtgtggccttgctctgagtttcagtctggtgacttgtggccatgagagagagcttgatatgaaagctaagtcatgtttaatgggacagggtaaggacaggagagaaaagctgttaggctttccctgtgctaaacctatctcctgggagcaggcacttcctcctagctagccaccatcacagcctcaccagcagcagcctcaagactcagtaacatttccaacttaggaaaagctacacagacgcatagaggatatgacattgttcatctgcatgatcctgacagagccttggtattttcacagtgtaagcaaattgcatatctttgctgtctcataaaccatcgctgacatccccacgggagcacacataatcctttctgaaaatcagaagttgtgttacaagaaagtggtttgggtaatttcttttgtatttacacattattcaattatattaaaacatgattttatttacattctatcagttttgattgtgtttccccagtgctcaatgagaataaatatgaaaatcacagttttttctgtaaaagaattactttatatttaaaaatccaataaacttctcattccacttaacttgcctctgtgtggaattctttcggagtcagatgatctctgtttccttttaagcccagttactgt

SEQ ID NO: 23996 - DNA, 1118 bp, Mus musculus
aagtcaacacatagaaggttacaaaagtaggctcggtgggtgggtgggtgggggcctactgggctttgaaatgtaaagtgactgcccttttcttagggagataggaccattatatatgactactgtttacaagactcaccttagacaggaaggacaaagagtgttttgtgattctgttcaaaagtaaaagcaaaatacatacaaactgttttagggtttctattgctgtttaagagtcaccatgaccactcttataaagaaaacatttaattggggttggtttacagtttcagaggataagtccattatcatcatagcaagaaacatggcagcatgaagctagacagtgttgtaggaagatctgagagttctggctacatcttcattcacaggcagcagaaggagactataccacactgtgggtagtttgagaattataagcctgtagtctcccctcccccagcctgaaacctgcttgctcggggtggagcttcctgctcattcgttctaccacgcccactgctggaacctgaggagccacacacgtgcacctttctactggaccagagattattcggcgggaatcgggtcccctcccccttccttcataactagtgtcgcaacaataaaatttgagccttgatcagagtaactgtcttggctacatttcttcttttgccccgtctagattcctctcttacagctcgagcggccttctcagtcgaaccgttcacgttgcgagctgctggcggccgcaacattttggcgccggaactgggacctgaagaatggcagagagatgctaagaggaacgctgcattggagctccacaggaaaggatcttcgtatcggacatcggagcaacggacaggtacacatgctagcgctagcttaaaatttcagttttgtaaagtgttgctgaggatgcggtaggatacgaattaagcttgaatcagtgctaacccaacgctggttctgcttgggtcagcagcgtgttaatcggaactagaaacggaaacaggcaggttagccgcagctttttaggaagctgcttaggtggaagaagaaagggtttaaagtcatggatcaggcggtaggccgtagctctccgaagctac

SEQ ID NO: 23997 - DNA, 1233 bp, Mus musculus
cacatccagatgtagattcacatgctgaaatcaagggaagacccttggacctatagcatcatgatgatgatgaaacactttaactgcagaaccaaaacctgacttaacctgaaacagaacttacactttaacaatacccccaggtgacccaagtgtacttttgagtttgagattatctttttctttggttcttactattttaaaaaaaaaaatctttctattgtgtattcctggcagaaattttcttggcagtatgagtgaaacatttgaatctatcctgacagaaaagaagaaatacaccatgcttgaagattctaatctaattcagcatgctttgagaagaaacacataatctttatttttaatgactcatggattttgttaaacaaatttaagggatgatcaatatattgaacctaaacatggcttacttgttgttctttttaggtataatttggtcagtttcattgtctttctcaatttaggttctaatgtattagcaggtatttttctagaacactgagtagaaatttcttgcctgacattagccactagcacctgtgatgttcatctctgttcacttaagtcataaggcagtctttacctgcttgctacaggggcggctccctgacatgagagtagaatatacatcaggtgcagtttgaactcccatgcccacttggcatgagtactgtcggcactagaaaattacatattattcacaaaacgcaaaaaagtaaaataaataaaacaggaaaggaagaaagagaaaaagtagaagaggagaaaggaaaagaaagaaaatgtccaacacccagaagttaaatttaagaaaacaaaaggacagtttgagacgttttcctaatttgcatcggctatgtgttccttttactagatggaaaggagtatgatatttatgtttcctatgcaagaaatgtggaagaagaggaatttgtgctgctgacgctgcgtggagttttggagaatgagtttggatacaagctgtgcatcttcgacagagacagcctgcctgggggaagtaggtatttctgatgagcagcaatggtgcctccctgaaaggacagtgaatcctgagctttggtgcacacatgggttgtagctcagcgttggtattcgggtatggaacatacaattccttcgagtaatagagacttctatagagaagcagccccagtgtgaggtacataggtgtacactgttccgtttatggct

SEQ ID NO: 23998 - DNA, 1165 bp, Mus musculus
caattcttacaaaggaaaacatttaattggggcttacttacatgtttagaaatttaatccaatatcatagtgggaagcatagtggaatataggtagacatggtacaggaaaggtagctgagagtgtggattaaatgtggttgtcctatgtctgttcagggcttgggccactgggcaaggtgtgacatgggagttttgactgcatgcacgcacctcacactggtgccaggagggtgggaaagtatagtctgatgtccctgaggaactacaggagctagctctgtggtccccaggctttgtggtgaggccaggacatcaggtcttggtagaggacatggttgggagcactgagaggccttctgtgggagattagatgcagctctttagaagaggcctgctccattattccccatggcagatcccgatgagaagaggcagtccctcaagaagacaactttggctttcctctgggacttcttgcgctgctgagtttgtggacgaccaggtttggtacggagtgatgagtccagtgaggatgaattttcagcagagatgacagaagaagagacacccaagagaaccacccccatccgcagagcatctgggtgaagacacaggtcctaggagctgcctactcccgtccctgccgtgcaaggtatcttactggatgatcttggattcagtgccccccccccttgtagaagtgcttgttgcctgtggttttaacatggaaaaaatggcctttgcattgaggtctttctcttagagccctgctgccgctttatctttctcagagcctgtgccaattgccgttttctaatgaataaatgtttatatagacttaaaaaaaagaggcagtccatggctttaatgcatttatagtcatggcagagagttttgatgcttgaaactgtaccccacttcttagggtggacctgaggttaaataccttttgcagggaggagtgtctgggaaggggagcttcattgactaagcccatcaaggctttaggtacctcattaaaatggagatttgtcaagatctgtggtcatgtcctctatctgtggaggggcttggggcattgccctcatgtgactgatggccaaagactatcagtggggacctgcaacctcctgtcaggaacctggtatctgggaatgtggcaa

SEQ ID NO: 23999 - DNA, 1327 bp, Mus musculus
aaagctgtaaagacagttagctttcagttctcctttctgtctctcatacctccccttccccgattacctggattttaatggtttttcctttttctcttttccctaggcttccataacaagcagtaaaataatacaaacaaaaagggatcggcctcgaaaatggacttcgtatagcacatattacttcttatagcacatattactgaaagatacaacatgcattccacgttggctgttgtccttctgtgtgccattctgggagttgctctcaagtgttttcttaactaaaaaagtacttcacttcattttaaacttttggtaattttggtcactttggccgtgtaagaaatgtagcatctgaacattggccgtctcttctgtggatatgtttcctgggatgtagtaattctataaaattattacacagttgctagtcataggatattggcgtctagggaactgagtttctttagcaattagaagtgcacagggattcattatgaagtcaagcatagcgtttggatggatgaggtgtaggaaagctgtggagcagctgctttgctgtttattatgatagtttgaaagatacagcctttgcttttttatccttttcagaaaaagaaaagccacaacaataaagtacaggaaaacacacagagcagtgaagtgtgttcctctgaataaatggatgggtagaggctctagatggccttgtaaccctcactcgttatcgtgtactgctgtttcctcaggaccaggtctttttgatgcccttaggcaatgaatcatgtgttaatattaatttgtatagactttaattgtctgatactttctctcaggtccatgaggcgtcaactcaaaattaaagaacaaacagccttccattgccttgcttttctaagttaattatagagccaaaggaatagaacagtttccataggacttggtaccatccgcccaactagctgtgcacatccagcctcctgctcccaggatatagcagtttttgttggcaaccttgcagtgatgttttatgcacctgcaatattagattagttcagtgtgaagttgaacgtgatgaagtgagtcactatccaggtgtatacatctaagctgatggtcattgtattcctctctgtaagacctttaagctcctctataaaactttgtgtattcatccataccacttactcaatatcaatggcagctatgctgaacctatatatgattgccattttcccagcttgacttcctgttcttttcaatgtgtgggtctgacattttctgtcatgtcagtatgctgtttatttagaaaagaagaaaacaa

SEQ ID NO: 24000 - DNA, 2510 bp, Mus musculus
gccctgtgatcttacttcatgtttttaaaagatattttgaaagggtaactttaaagaaaaaaaatatagttgcatttttatttgctaattaggcaaagcaggcaacatcttctgccatatttttgtttttataaatatttatttttctatctcatgaaatgatcacttttaactttaaaaactgtatttcttttgttttgcatgaacttcacttaatcatatttattactgtaaaatgtacatgttttagtttaaaaaatgccaagccacttaaccagaatgctgcagtcttacctgtcgccgtggatggccagaggcagtgcaacctgtgtgatggctagctcaacatcagtattggaaattttgttacattttaagttctttttaaagtctacagttttaaaatattttgtttgtcttattttacttttgtaaagtgaacagtttttttaagagtaccagtaattattatgagtaagaagatagaaaaatattcttatttattcttacttagaattttttctatcagtcaaataatatatctttgagatgattgaaacaactaacagctcttactgaactgccagtcttcactgtggtctctgctttttaatttttatattgaaatgaaagcatttattttgttcctgttattgagcacatgcaatttaacttatgaggtccacacagtgttatgtcttgctgtcaacataagagtaatccttctagctttgggaaatctttttgtttctcaactgtttttctctgcaggccatgtgctgttaacagcagcattcctggatgagcacactatgttaaggagcctcattatgagactggtgtgtcactctctcatttccatcctagaaaaggggctagataaaagtcagattaaatatgctgacctgaaagaaaattaattccagtattcaagctactgttagtcataattgccttattgggagaatagaaaaatgcttcttttgtgctcaaagaatattgagattttttgcaaatggctttgcatgccattgaaatgctatggggtcaagtgactttatgacaaatggcagttggtaatgaactcaaaaccaaactatgtatttctgatcttgagaaacatctaaattaggaagagaggtatgcataaaaatgtgcccaaagaaaactcttcacagtggcctgggtcactacacctaggcagcagtctaaagtatgtgacctgtggtccactggatgctttaatactatcagagcttctcttaagtcactttgtgccaaatttaaaacaaaaacaaagacaaaaaacatattgtaatatggtgcattctgtttaccacataagtggttaacattttacagccttgacttataatatgagtaatgcctttgtataaatctcactttgggaaacatgaaaatgttactctcctttaaaaggtaacttctaattggctgagagcatcagcctattgaagagatgaggcccatgtagaaataactcgaaggcctgagatagaatagagcgtgcagtaaatggctacttccatttggggagggtggtgtttgtggaaggagcgctgacattgaagtcacactgacaaggagacattgttccctttgatttcactgtgaactccgtgccatgttctcataggacacttgtacaaaacagtccctacaacattgaaaacccgacctttgatttatagaagtctgtaatgtgtctgtcatatgctgtttatgactcggtcactcattctctcttcctatctcacaatcagagaagtgacccaggagagtcagctcctctctctctctctctctctctctctctctctctctctctctctctctgtctctgtctctgtctctgtctgtctgtctgtctatcggtgcctgtatgctgtagagccatatctgtatctgactggtgactgatgcttccttcttcccaccctgtaacaaggcagtgcaggcagacagaagcctcctgtggagtaccctgtccacgctgcatgcaacagtattagctgaatatgtgctgggaggtttgtttgtttggttagtttttatcatggtgatatgtaagataattaaagggaagagttaaaggctttgttgcgtctgctataactcatcagaaatgctcaaatttcatcgtagcgtctccaagaaggtagagagcttggaaaacattagttatagtcacctttctgatgagccctgcactttatgtcagcaatgtctgtggagatcagttttgccttaaattagtttgagtccacccaaggccattgtgcttagtatcatgagcacttgtcagctctccattagcatgcagttcataacagagcttcaagcagcagcagcacccagagctttgaacctcgcccactgtgctctgggtgacttgtaacattaataggaatatcttctcagttccctgatagcagcggcatggccagagcactgctgtgagacagttccctggctggagtattcaccca

SEQ ID NO: 24001 - DNA, 1989 bp, Mus musculus
actacaaaagattagaacaaaggttctttggttcagtgacaatactcagattatttctaagaattttagcgatgacctttgtgtattgaaaagcttatttaccattaacaaatacaggagaaacctctccccctcccccaaatggatgtattacttggaatcgtgatctgaaaagtgctctagtttatttcttttaacagaattaagcagttaaatgtggctatggttgaaaagatagaagaacagcttttctaggctgcacacagaagagtacagttatgcaggtaaccacactgatttacatacgtgtttgccactaaaatccattttctgcccttataaattcgaacactgctactaatatggtcatataggtttcatatgcctctgtgtattacaagtaaaaaaaaaagttttttctcctcattttaaaaagttacttttcataatatgctgacttaagcattttagatcagggcaagcttaattatgtaactgtgttgcccaggtttttattggtgaaattcaaatatgaagatgagaaaaaattcaaaaggtttgagtaacaaattagcaagaattgcctacagtaaagagtaggcattgagaggctatgcagtaatgggtggcagtctttggatatattgctacactgatttcacactatgctgaaattgattctagctaaaaatttgataagagtttgggtgtgagaagttttatacttatgtatgaatcgtttctaaattcctttagattgtagaccttgatgtaacccgaaaggcagatgtcctatcccaaggatagctgtatttttcatggttttaaatgagcaaccagatattcatttcatgaaataatgtaaatattagaaagtaatatggataaatgacatataaaagtgacatttccaaatgacaattctctgtaatgcctgttgtctgctaagaagaatctatccctgtgaaacatttgaaaggtgctggatttgaaagtactagagtttgttacataaatcaagtttctcaggatatttgaggtgatactgccatttatttctgttataatttggaaaaaaatcatttcttttgttacactatgaggaaactgcacactttatttggtaagagtcctttaagttcagtaacctagagatgagtataaaacaagtgtgggatcccagcgctggtcagtttacggtcagcccacccctcagtggggaggtgtgaaggagatcccagtgctggtcagtttatggtcagcccacccctcagtggggggttgtgcagtacatattttatggagctgaatggaacttcaatagaatatcgtcccttgtctgaggaaagaccacctcaaccacatgcctatctagagattgaataaaactgtgaggagacactgtgtggatgccttaagatggctggcgctggctgcagggaacaatctatttcagctcatcttcataaagcccaagatgctcccgtgcataaccttgttgaagaaatgagaaatgcggtgctggctactttgatgtgtctggggaggctggcgtcattggttaccatcattaagtcactgtccagtgcccaagccttccttcactaccactcatatgtctacatccattcattcatctatgcaagcttgtgtttttgtggtttgtattttacacctggacatcaggtttaacattggtgttttaaataatttttaaaccaaagtattttatgagtaagtctatgtgctctgtttttgtgaatgttttgagataaatacctatcttgttttctcttaataaagtcatccatttattaagtcaatgatggcctactgttttcattgctacactcaaaatctgaagtttgagagagttacagcatatatacatacatacatacatacatatattactttttatatataagagagcaccactaggtttttgtagatactagtaaaattttatggctcaccatgttctttagt

SEQ ID NO: 24002 - DNA, 1197 bp, Mus musculus
ttcccatcaatgggaggttgatcagccttctctcaggacaacagtgaggtgttttctttccttagtatgtttgtagagcctttaatagttctaataaatagattcctttaaaagcttcggctgggacggccgagcctctgctcgctcgggactgaatcagtcgattcttttcctcagctgcacactaatcttgattgagcctcctggctttgagatttgagtgagcagcttcaatctttccagcctcagtttccccaactgttaaaggagtaatgccagcttgaccaaatggacactgacatatacagaagtacatgggaagaactggcagcatgtgctcttttaccttgacggctccttccggtcgctaccaaaggcttctgttaggcaatgacagcgtgccctattgtcaattgtccgatctaatgcccatggaatggccttaattgaactaaacaggagcagcgatcccacagcctctgagtacctggacagtagtatttgccaaagatcctgaaagataccagggctcaaatggcttttgactttgcattggctttttggtggctttccccccgccaccataagactactgaatgagactgatactgctaatatcagtgctttcttcccctcccccacctctgttgtacaggacagggttcggaatttgctttcctgtgctctgcagcatgccctcttttattaccattatttgattttgctttattaaagataatagtgtggtttggatgcagttcttgtggttagggccatttaagaagaaacaaagtttacgtatttgctgcgtttttctgtctataaagtccaccatatttatggtattaattttgtagcacgctacactgggtaccagaacagcatgttatatacatgatagcggtgatgtgactgaaaaatgtgtcccatggcaacagtatccttaggcatgtaactaaatatgcacagattaaaggagctctcgggctctgcaggcagctgcaggcagggaggttggcgcttggttgggagagctggggccacacgcctctcattcatgttctctgcttcttcttggctaagctccacttcagaaccctcccctgcttctagaagcttcctgtttgactcggcggcttctggtttggtgtgggcagcacctgtgtgttcgcttggggcagtgtcctctcagggctc

SEQ ID NO: 24003 - DNA, 1200 bp, Mus musculus
ctatgtaacttaggtcatccccagatggattcttcctgatcccctctccctccccacccccacccccacccccagttatgcagtctaaggagcagtctaagggccacagaggttgccacaagtttcaggctctctattctgcattcttggctcgagtctcattgaaaccgtctttcagccatgcagcccccttagtagtgttttctagcccctaattttttttcacattgtcccctccacccttgatgcctcatctggtcccacctctcatctttatctgtttttccccctgaataccacccatcatttaaggacaaatgtcatctaatttccctttttaattgattttttccctctccacatcctaatgtgtctggggttctgagcttgggcctggtatcccttcctgtggtcctcaccttctgctgcaggaagacaggaggaaatgtacctacagagggtcggctagtagagcaggggctgttgtaactttgagcatgccggcccaggaggaggctggctggtgcatggctcgtctctgtgcttaatttgtatttggggagtgaatttcattgcccaggcttgtttgattgctctgctcagtgagatgaagctagatttattctgaactgtatactgtcgcgcaaggatcaatccgggatccctctgggtccgtggtcttactggggatggtgctggggtctgctgacacgctttgtctgtggagattgtaatgcctgtgggaagaaccgaggccagaagcccacgctggaagggttaaagagcggtttccctttgggtcttccatagttctgggcagccaagggctgcttttggcaaatgttggaggcacctgttcagaaatctgtatcgacttctacagtggcatctaatgagttctgactgactgcatgttccccgacttgccagtggccctttaaagtccatcttgcccgtggaattggcaggctcgtttaattgtctagaattcagataaaaatgctttgttctttgttcccacatgacatcatttcagagtatctcctctcccacagattgctaaggctgttcaatttggaccttaaattgcttctctttgagcagggctttcagtttaaatggcaaaggcagctccttttgattagacatttagggcatccgttaggtttcctgatccagtcactccttccgccgcttgct

SEQ ID NO: 24004 - DNA, 3520 bp, Mus musculus
gtgtacacacaaacacacacacacataaatgataggaaaatgttgggggaaaaaagaaattctagtatttacataatatatttgataaaattgtgctactattttatggctgatagagataattttaatctagcagatttgaacagttaagctttaattttacaatcatgtcgtgatatagttgcttatatctgtccatttgtcttgccaaatctaagtttatcaaatgggtttgttcctacagaatcctgctcataatgtaatcacctctgcgtttatttgaagaatgaaaacttgagtcttttgtcctgcctcctttcctcccgttctacccttttccgtgcaaaataaagtcacagggtaaaagtcatgtacgtgtgttccaggcacttaacctgcagctgccgtttgagcagaagagccctggacgtggcatccacggtctgtgagctcgtgctgacggcagacattgggaaaacatcactggtgtggccgtgaggcttagtcctcagagattaagaagttgctctctgagtcgtgtttgtggtggcactgatgtgattcactatggctggtatcacacgtacagtggtagctgctctggaataaaacttacagtaattttttaaaaggcatcaattgtatatgacaagatgacagttactgctaaaccatcatgtctacagtgttctgtattcaggaacgctttgactgtaaacactcagtttatgttcaccacatgaaagaaagctggtttataaacagatgcttcagctgggttaatttatgttgggcagttcagtgtatattcagtgaaagaaacatccaccctccattgccagcttagaaactcgccttggaagccaaccgcagcagcgtgcagtccatcgctgcttttgcgccctgtatccgtgtgcacttagttcagtttgaatattgtgtgctctcagtcaggctttctggaacagtaggtctctcctggtgacacagccattgaattatgacccacgctggagaagactaaagaccaccagttgacgaatttcatttagagtgctatcaaatgtctgaactaggcgtcagggaaaggtttcacaatagccctcaaacactattttaaagaaaaattattctaacaagggaaaaatgttgacccactcccacttaaagctgaaaattctgtttaattcattgcagttatagtaataaccttcataatattttcatgcgctttatataaaattacgttggttaaaaaagcttaaggcaaacagtacttcatatttacttcaaatgtctttttcatctgccaccttttttattaaggctttactgttctggtaaaaacacccagggttgcagttcttatttacagttaattttataaccagtttccttggaaatgtttttgtttatgattccctcgaatctgacagtatggaaggggcagtgtttcagaaaccatgaattcaataagtactctatttaaattatcaataagaagcctgggtgcaattctcagagctacgacgaacagtgcccatccttccctaggacaaatgtgcaggttgtaggtgtgggacagtagcgaacagaagctctagagagccctgggctgattcccacagccatgaggatatgctcgtcctaagccagtggtcctcaacctgtgggccaagagcactttgggggctgcatatcagctacttacattatgatttgtaacagggacagaattacagttatggaagagcaacaaaatgatgtcatggatgggggtcaccacagcacgaggactgtatcaaagggtcccagcattaggaaggttgagaactgctgccctaagccctgctagcctcactagggtggataggctgaggccagcaagagaaatctgcaactttctcccaagtaaaagtcttagattggattcatatctctttatactttttttttaagttgaagagaacttttatttctttgcagggatctaaatttgtatcttcaacttaaacgtatattactaaaaaccctttcactcttgacccctgtgggttatttgtaacctggtttcctgctaactgcccccatcccctgaaagctatgtgtgtacgaaacgcagaagctacaggaagggtaaagttgagtcccagcagtagaccctgtgtatcatgtctgtagttcaggtgctcaaatatacacaagccaaacttggactggacaagaagccatttgcaaaaatggagtggataggtttttcttttttagacaaaattttatttggagaactaagggatttttaaatacatcataagcaaaatgacttggtcagaatgtcagttatgaacccctagtctgtgtgcagcatgaaccacaggaagcaagcttgctgcttcagccacacaccaagcaatcttcagttagttacaggtgcagcagtctgggccttcctcttcgtctctcctcatcgggccccgttttccaggctgtagtcagtggactcccacagattcctcagtgaccaaatggaaagggttggtgtggaagcaagtgagacttcctaactgtacagcgtgggatgtcacatgcaggattcaggtggcagaagcaggacagtcacaagtcaaaggcaagcctgagctacatagggacacccctgtctcaaaaacaaaaataacaaaattaagactttaggctcagaaagcaaatttcttatgtagttaattttgtatttatttatttcagatgtatttatctgataaaagaaactttttttctctctccaataaatgagatcacggtactggtgtgtctccatcctctacgctggtgtatggtagattgtcttatactgtagcaactggaaatgtgcttgaaaatatgcttaccttctaaacgatcatggctatttgatatctaaatatttaaaacttaaccatgtcgtcactgtgcactgtgaatggactttgtattatttttaaaccttacactcgatgtaaatgttactacaacttatatttgcctgtgcttgacctaaggtcatttgtgtagatgggtaattaaaggatactgaagtgatattatgattctattattggagagtatcttttacattttatttgttttaatgagggagaaagaagcctttgtacctaaggtcatgttttggccccataatatagccaaatccattatctaataagctcccacagtggcttctctgagaaagcttggacttcacagttgaagcccatgcccagctggtgctttttctcctgtggtgatgttgctcaaagcacattggtattttcttccccaaactattaaaaaacaaaacaaaaaaaaaaccaaaaaaacaaaaaaaaaaaaaaaaaacacagctttctccctacactgtgctaccatggccattgtttctgttcatgatgccaaggtgttcagtcctaccacacagcactacctagcaggctgggtggaaactgtaaaggtcacttctgtccatcctgattaaaggctccca

SEQ ID NO: 24005 - DNA, 1153 bp, Mus musculus
taaaagccttttgctctcggtgtcaagtgggtccatgttccaaaaggcaaactggtgagcgtcaatggaacagtgggcgtttgtcctgccagtttgttcactttttaacgaattctgaatgtcaacaggatagtacattttaaaacgttaccatgaaaaagggcagtcaaaagtcttagtaattgtttttgtattgaatgcattgcttacatatctcatcaatcaaagccattgtctgtgaagtgtgggtgtgttaggtcctaggtaatccttgactcatgcccatctgcagctggaatagcaagttctgcacacagaccccaggctaacaaactctcaattatcgagaattacctgtggtacacctatataatggatacatattaatgaaataggctccacctacacacatacacacacacacacacacacacaccctcaaggccacaatcgtgcaaatgcaagacacaaatacccactaccccatccctgaaatgagaaacaaccacctatcgatcatatggcatagaaccttctaacctctaagacgtgacccccagtctgccatgtgggcctgacacttcctcagagccctctctatgctgtctgtccatttgtctagtattaatagctctactaataaatctcttacccaaaaggacagccctctttagtgtcccccttaagcccaaaggctgcagctatggaatcaggactcacactagccttcgtccttgttctaaaagcacaagcctgcctgaaggtaggctaggagagaggctgctgctgagcagagagaggcaatgccctctgcacatacagagttctgccttgtatgtccaaaacagaacaagaccagatcacaggagatgaagcgaggagcacctgttctgggacgctcaggagagccttcctcttccataccagaaatgaaaaagagcaggaactgatggctgtgaccaaacatctgtcaagaagccacttcagagaggaagggtttcttctgcctctagtttgagcagatccagtccgtcaaggcaaggaagagctggcagcaggagtgggaagtggctggtcacaggacatcttgggtcaggaagtagagaaatagaaaagctggtctgctgtgagatgtcgaggctcagtcttgatg

SEQ ID NO: 24006 - DNA, 1194 bp, Mus musculus
caggttatagtcctttgactcccttgtgttattctcttgtatcctagtgaccagataagggctaattatagttatttcaaaggccccaagggaaggaattgatgaactccagactgttgaatcagcagacttggaggagggctataggcctgagagtgttatgaacgaaccttgctccactaaggctatggtggttttgttggttttgttttgctaagtatgaaaaggagaaacatagattaaaactgaaagcaaaattcaagcccagttctactagcaaacccctttccctaccagggtcctattaatacaacactgtgaccaataccagacgttgaagccatgtcccactcacacctggatgcgcatgtaggcacacattcaggaaggaggcaagcctctattgtactatctctgagtaggtcatcagcatggactgggtacatgacaagatccctgacatggctgagaaatgaaccatcctttgctttcccagctagcacagccttggaatgcacacaggaagcccaggagtcttctactcacacatatggagggcatgggaacctgtctcggaaacctctgtgtgcttgtccatagacaagctactgacgtagatactgaagcaatagcttccaaatacatttgggtcaagtctctttctccaggtttcaagtgtcccttctttaaacgagtgttttatacttcctttgaatgtgtccttgtctagaatcccaaatttcagttaaaaaaataataaaataagagtaaaacaagacaaaagcccctagttttagtcctcttaactgcctgttttgtagttagctgaggctggctgtgaaatggttttgacattctgcttctgctgtccctggtgcttactagcaattgaaacttgaacccagggtcttatgtctgataaacgtgttcttctctgagctataacacaatataagacgtcatgagagccactctgtatgaatgcgcttttgtgtgcttctatatcgttgctgatgttgccagagctcttttctaagagaaggttcttgatttattgaatttgatagaaactttaaaaagtcagagtgtaagacatgcccctccccacactaatcattaccgaacagcacatttctccttctggcattctttaaagcaataccttatcgacccaccttagtgaccagaaacctc

SEQ ID NO: 24007 - DNA, 1157 bp, Mus musculus
ggccctggtccgcctgcctctgcctcctgagtactgggattaaaggtgtgtgctaccaactacccattgaacctcttagttatagaattctttcacctctgttctgaggaccaaatcaatattcattatcactaatgacagcagcaatagtacacacaaaaacatacaactacactggctgtaatgtgaaacattggtgagatgccataatttagttaggcaaagtacacaatgagattaaaaaaaaatcccctctgttttgacattgaatctggaggcattaatataacaagacactctaggcacagtgactacatttaaaaagcaggactgggtggatgagatcagagtagtttgctcggtcatatcaatgtttaaccctggctgtacattcacctgaaaaattctgacgcctagaccacactacaagctagttaaagcagaacccatgtgcatatatgtgctgtgtgtgtgtgagggtgtgtgtgtgctgcatgtgtgtttgtgtgcatgtgtgttgtgtgtatgtgtgtgttcatgagcacatgcgtgtgcgtgtagtggtgggctgagcagcagggtttattttaaaggtcctttaggagagtcttctgtgcagacattgatgagaccccagagtctaacagctgtccctcggggacaggggtgatggctactgtgctattcagtgacaaggtgatgactctgagtgtctagttaaagaaatacctacatgtcagaactggacaagattctagatgcgacggttcctttccaactagggaaactgaggctctgatgtcatataggaggagaaaggcaggatctgcccaagaaactgatgcctttcaccacacacctcttcccaaggctactgtgcaagtgaagacatcagagcgggtaggatgcattgccttcccggcattgagaacaaaactcaaacttttcccacgcatgaccctctcttcccaggaaatgggtatatgaccctgggtatacagataggcaaaccgcttactgataataaaccataagaaattgattttaaaacaattctttgcgatatgtataaatttttgccactgtttagagatggatagattttactcggagagttagatcttgatactacagggctgttagctcctttaatgctt

SEQ ID NO: 24008 - DNA, 1135 bp, Mus musculus
cttggccttctctcttagggttaatctttatgcactaaaacaatggctcccaacctgtgggtagagactgctctagggggtcagtcaaccctttcatggggttgcatatcagataccctacatatttacatgatgactcataactagcaaaattacagttatgaagtagcaatgaaataattttatggttaggagtgacctcaacacaaggatctgtattaaagggtcacagcgttgtaaggttgagaaccattgctgggacaggaagatggggagagagaatagttctgtccctggaatttgaatcttcagatgctaagtttttctctcagaaacatgactttaggggagagaacacacagagagagagaccttgcttgagctttgggctaataccacatttatccaagggatgggtaagacaaataatgatttcccaagttgctgagagatgatgcttgtgtgtgaactatatattttcctttgggatgctgaacttagagaacagttcaggaagagagtccagggagatggcacaactgtctgctatagtctccctcggaagatcttagaacgtgacatcggctttcccactgaggttccttgaaagaattctagaacttgttccctttctcagtggttagtcatctgccctgtgtggtctgtagcactgtagtcatagatcaaatctcacagaatggaagtgggttttcatggcgccagggaatggggtggagagactgcatcctgctctggggtccgcatggggggaagaggttcccgagaggtcacgggatggttcaggacaaagggagactcaggaccaaactttaatctctgtcatcccttcaacttctgtgggtgtggtggagactattttgggtccccttggggttgctcagtatgtggacattgtgtggagtatgaactgagtttttccttttgtgggactgaactgcaacagggccaatcttggctgctatcctagaaggcccatggaaaatgagctctctggaaacatgctggcgcatgccaagctggcctgacctcacaggagaggcctcttgatcaagtatgttgttagctcctggaggaggttgccaggcactgtgtgacttgcacaaatatccagctg

SEQ ID NO: 24009 - DNA, 1150 bp, Mus musculus
cctctcctcctcttcttcctcctctcttcctcttccttctctttctcctccttctcttttctcctccctcctcctcttcctcccctgtctctccagtaaggtctcttccttgtcaactgtcattgcccagggctcaacagttgtgggctctgacaggcattgtcaatcaagaagtggactgagctgcagaagaaaatcctgggaaagggatggaaggtggctgtagaaatgtccacagagaacgtctcttttctgcttccaagaccatagaaatgtctagtccttccttgtgtccaaagaggcaaagaggaagtcagggtttcttagctacttggagttaagtagcagagggagttcttagtaggaaccacaggggaacaaaggcttgaacccaagaaccagtcagccaagaatcacctgtagtcacaggatgatgtagggcagctgactgttagtgactttttcaaggggttctccattgctggctttttgggtgacttcctttttcacatggaaagctcccttcttgagcttggagaaaaccagttgttcattgctctccatctccaaggagcctgttctccttgaactcagtctctagacacttctccttcatggcatttgcaagagcaaggtaggtcaccccaaagctgctccatcatgattgggctccattgcctgattctacctctcctggatgggggcactgtggacacttgtcctggctccctaagtcatctctgccagctctgctccagggatgctcctgtgtgccagcctgcctgactccttacttcccttccttcctccctctcttcttccctccctccctcttttctctctgcctccccatcttctttctctctttccttcctccctttctttttctttctttctttctttctttctttctttctttctttctttctttctttctttctttctttcttccttccttccttccttccttccttccttccttccttcctttctttctttctttctttctttctttctttctttctttctttctttctttctccctccctgcctcccttccccccactcatatctcaggttggccttgaacttgctatgtagctaaggaaaagtttccacttctgattttcctgcctcgtcttctgagtcc

SEQ ID NO: 24010 - DNA, 3312 bp, Mus musculus
caacctctgtagacttaatgatgacaaggcctgctcacatggtgagatagttctctgctggcacagctgtgcctcaaagtattatagatgctgctttcttttttttcccctctcgcttctcctttttgtgccacggcttgactctgtctcttccagtgagaggtcccccttttgtttatctgctgctgaagacagactatattctctctccgagagggtttgaatcttttagctcactgcactggctttggagggtgttctgcaagacaggaagacatctgtgccatctgatccaaggcagtgttattgtcagcatctgctgtgccaagctcagcctttcagaggagcatgtttaaagcctcaagctttccttcaaagagcctggcccttgatggtatagaatcatgccaaatggctaagttctcaaaacacaaaaatcagctcactgaaagtggctgaagaatgtgacccgctgcctggggtccttgcacaccctgctgcctttgcctcttctgattttgtattgaagcatcacacacatacccgtgtgattggcatgataccaagaaatggtattgtagtgactccccactccaagcttgttctgggggactttctggggatgctggagagtttctagcttccccatggtctggggaaggattcttacaacctcccctacctctccatgggaaggaagcctttgcataggcccagctgttaggagtaaaagagatgtaggtgcagtcaggacaaaaagcagccacgctggccagaccagaagcatagaaacgacagtggcctgtgcaagcacttcttccctgacagtgagccccgtgttgctcattggcagcccctctactaatccttttatgggcattctaggcctgtatctgtttctaatttttgttccccacttggggggaagcaaaattgctaagagatgagatcttccagctgaacgaccaagtgtaatggaaaccaggaatcagtctatactgtggtcaaattctccatcagcattagtcagctgtagctagagtgcagcgtgtttacagacagcagatatcggggcacgctggaaggtcacacgagggtatggggtgctctgcagaactttctgcctggggtctggttgtgaactgagtggtttagtttagagttttctctttgggtgacagtcacactatatctgccttagctctgtttcctgctacaaactatttctgcacattaaacagttctgataagacaacacagctttctcaggacgactaatacaccaatccatgcagaagtaaaagcttcaaaataagcagacatggtgggtcatgtctttagtgagttcaagagtagcctgtctacagagcaagttccaggatggccagggctatgcagaaagaccctccctcaaaaacaacacaggaaacaaagaatttcaggtttctctgtaagtgagggaaagaccccagctaagcacagggatttgtgaagtgactctatctccaacctgaggtgacactcataaggcaaatcagaaacccctctgggtcttggcaatgtggaacttacactatgtccaggtccccgacagaatacttcataaggaacgcttgtgagaaccaacacactcgatggcccagggaagctgatgttggtcaaaagacatcatctttccaaggccaatctgggtcgtcaaagtgtttgtaaagtatctctagcaactggcacacacgaaccaaagttgtctccagccccagagtgagtgtgagcttggttctgctggctgtggcttgctggtaggtcctggggcgaagagaaggagctgggcctgctttacagcagatggaagcttgacacagtaccgtgctcccagaactatcaggcgctccttgtgagctatgcccatcctcagtgggctaaggatagagagaggtagcatccatagtatccagtgtcccctgccaatcataacctggaaacacaggctacatctgacattgaccatggcagtggtgtacctcactggctcaaaggctggcctgaggacagctgtcctctaatgacatgcccaggagctcccaggcagtgagcgaaggcacagttcctcaaaatcacattttctagtcagggagagagttggcagaacactgggtggagggtcctttccaataaggtaatccattttgctcagttcttgggctggaaaaagctctgtggtccctagaagtctgtgatagggtgcagagttcaatccactcgcctcatctgttcagtgctttctagactgccatcccagccttgtgcagagtggggagaacagttgactctagaaggctaataaaggccaaccagaactagcatggtaaagatgttcagggcctgggtgtccttcaaagctcttcccctaaccctcttggcaccttaggaaactagttccaccattatcttttgtgagtcttttctgcacagtgcccaacttacaatccctgtagaggcttcatgggctgtctagggctttcatcaggagactgtaggaaacagctcgcagtacagttacagctggcttcttggagcatctcacccacagccatacagtttccacaggcatcgagatggtggaatggaagtgtggaagccggttccagccttgggagagcatgaagaacagaatgataacatgagtcaggaagcaggccttgcatgtgtcctagacttagctataaactacttaaagatctgtccccagactccgaagtcagagccagatctggctgtggaagagaatctggctgttgatgattgcaggagggaagccattagtgttgtctgagagagtgtgcagcaggtaacttccatgtggagccccaccgagtcagggcccttctcctaaggagagattgttcttgcctcccactgtctttgctctgccttctagaacaatcatgcttgacttactagacagtctccgcaagtagtcccagttgcttggcagtgcatttagagatttctaggctcccagggttctgtagaatgtgagccctgctgggcaggtttaggggaatctgtcctttgctagatgcggcttgtaacagatttggtgtacaggatcaacaataaacggtatacaaagggcgagtgtgttctctgtggacgtcttggtgtgtgggtctcctgcctgtgcacctcacccttgtcgcctagattatgagcaacctggatggatggctcctcacagttgaatttgggtggagaacaggcctttgggggaaaatgtggctggtggggactttaagaataggtttggcagga

SEQ ID NO: 24011 - DNA, 2975 bp, Mus musculus
tagaaagaaaactccaaaagcaaagtacatgtacttagcacaggagctccgctttgatcctgagtggccgcctaaacctcagacaacgacggaagccaaagctgtagtaaaggagaatggatcatgtcagattatcaccatagcataacaaaggctgctctctgtgctagtagcagtgctcagcagcatgcactgttgagcttttctgacgctgtgtcagaatggcactagttcagtttatatccctctcataatatggcagttcattaaaatacaaagcagtaaaatgtcatttgctgtacgattattaactataaatctggctatttcttcatccagtaacctaaatatgatatatactttatattgggtatgagagatctgtgtttgggttttatagattttagcttttgacacgtttgcctctttaaatttacttttcataaatccccttattagaaagttcttttacatataggccccaaaattgtgattattaaaaatatagttaattgtgattagcctccagtgaaaataggttgaaagcctgttttgatccagtgttttctcccaaagaactctacgttaaacatacaccagttttcttttatgacctggagttaggagtgagtttgtgtgttgttgatagagcaactcaggtaatttccatttctggttttatattctctgtatctcctgcctgggtgtcactttctagacagtaaggcgctccactgcttgctgtctgagatatccttcatagtattccatggctcccatactgcagtctagttaagcaaagaactctcactagaaaggtttatttcagccgggtgtggtggtggtgcacgcctttaatcccagcattcgggagggaggcaggggcaggcggatttctaaattccaggacagcctgggctatacagagaaaccctgtcttgaaccccccccccccccgccacccccaaaaaaaggtttatttctgagcagccaggcatgataagtaaaggcccctagtcctgcacaggaggctgaggcaggagaattgtttagtcctggaatagatagtaaaagcctgtctcagaatacacaagcagagaaggatcggggttatgtctcttggcagtagatcccattcatacctcttcaaacctatttgttttttttcttttgggacttatatgattttaaatatttcatattctccctcccactcctactctccctccttccctctctccatcccttcctcctacctaaaggaatggaatgatgctgtttttgttttgagtttgaccttaaccttgctatgtctctcctttgaataatggggcttaaaagaataatgaacatggaatttgaattacttttacaaagcaatatgaacttgtagagcttgtcttgtgccattaggtggcaccagagatcatcacatacctattttgtaacaagtgagcttgagaaaattaagaaaatatatacatttatttagccaaaaggaatgaagaaagcatttacacatttgtgttttatctgattctgttcagttctcaaggaactttcacaatgctttcctaggtaggacctggcagtttggcagtgccttcagtttagcattgctataaaatgaaccctgaattagcgaaacagtgtaacattattctgtgttctttattagctaactacaagtgtatgctttccactctggttgatcattagttccctagtacatacttaaaagtttaccaaatgttaaccagatttttgaaacctccccccccccctatttatttattttttatgttggaaatacccgaatgatgtttggtaattgtagaaaaagtaaatgtgtctcaggatcactattactgctgttgccactagtgattcctaggaaatacataattgactttttccaacaaaatgtatattattacatgttagataataagaacaattgtcccgtgaatgattctatgaagctatgcatcttagacctcttgagctgtgaattagcactattttctatggttacttattatctattgttttatactttctatgttcatttcaaataatgttaatgttattcaatcattttctgaattgttaactcttattctttggtttaaatactgaaacatgattaattgctaactacagcttagaaacccaatatcagttgtacttaacatctttaagagcatgatcataaaggctattttgacagttcattttaacatttagagttgataagggtttatatctcatctgtccatattgtttgcaaaggaacaaggttttatgtaggtgagagaaagcatttgtacgaagttagatttgaacatagataagataggttattccagttgagaatattgttcgaagaatgtctgtgaatgcagacatgggtcctgcttagtgccataggtagactgagtcttctgtaagtcatcattacatagtaattttggttctgaattttacattaaattatttgaatatatacagacctaaattttaaaatctgtacatatattattttgatgtattaagattgataatattgctgatttaaattttatttatgcacatacttaaaggacagaaatgtctggtaaagtaattgttaaataatgatatgtagctttttaactttttaaataaataagattttttaatgtgggtctccctcagggttgtttaaagttgtttgttttcctcccttacatataaataaataatggtaaccggtttctatcttgtagcaccaactgctgtaagggaatgctgcagacagtgcttgggcgagtgtggcgccaacaagcctgagattcaaacgctttccatttaagcaaacctcttcttgtttttatacttcattttgtttcccatgttgatgaaagtactgcacagtttcaaaggcatggtaaataatgtgtttctttcatatatatttttttccaaaagcagca

SEQ ID NO: 24012 - DNA, 1182 bp, Mus musculus
actgttgaaggtgtcaactatttaccatccttgatgtcaggttatactacaaagctatattaacaacagctgaatgatagtgatgtacaacagacatgttggccagtgggtgatagtgcatgcctttaactcgggctatgaatttctcaaggggtattacagtgctaatgctgtatgtgcccttgtagattcttcctgtacagagaaacaagatgttagtttttactagtgttggtactagcatcaaaataaataataggcatatggcttcttcaattaataggaatttacaaatctgtccatactggaaataaatatctgggaaataagtaaaagctgttgaaagaacttgctagctaatatgaggactatttcatttgaccatgaagagatccaggtcttcttatttatattttaggaagataattctatgtggagaactatcctgtgcattgtaaggtacacagatgatccattgtttactgcatgtcttcaatactgtcaaaattccaactacttgaaatagagcccttgccatatctttcctggggtgttaaaattacctctgataagaattactgaattaaaaaaatggcttagtagactagtcaatgactaagcaaagtttatcaaaattttgtaacagttgatgatatcaaaagataaatttagaaatgttataatggaaaacttggtagatcccatgtgctatcagttggactaattttcctttgagttactgttgtgttcatagagcttcagacatgctagtatatcatttaactggggcttttttctctttcatctttatgttacattatgttatgacacaacattacatggttttgctggaattacaggtgtgcactactcccacacattgctttatagttactagttttactggtactaagattttccatgagtttcagtggaaaggtaaccgttactggaggcatttttgaaattagaattctgaaaattcgtttacttttatagattattttaaaatgtatgaaaattctcacttccaagagtatttaattatgtcttagtaagaaatttagatacaattttttgtcctttcctttcaaatatagtgagtttaaatcctgcctggaaagagcttgtggcacagagaccaccttcaggccttatatctggggcgctcctcttctccgt

SEQ ID NO: 24013 - DNA, 1819 bp, Mus musculus
acttctaacacaaactgtttctggaaaatatagtagtaaagaagaaactaaagcttttcagttatgttctttttgtttttatttcctgtaccacatgtggagccttggcttatgtgaattatctatgaatgtttcttctgctgtcatataagattcctgaggaatgagtgttagccttttttattgtggggatcacttacaatttttaacattgatgtagacatagaaaatggttatcaggtgttagaatcagatgaaaattttttcatttacatttcatttctgtactatgtatgtatgtatgcatgtatgtgtctttatatgtatgtgtggaagtcaaagactatctggcagtagtcaattcttttcctcccattccagtgccaagactcacaattccctctgaccatgttgtggaccctcgtcccaccatagcactacagtagaagcctagtgcttgttctatatgtccatgtttccctgctaaccttaatgtctttaaaataaaataaaataaaatgatgtctttaaaattaggagacaacatgttgacggctgtctctgtggccagagactgtgggatgattctacctcaggataaagttattattgctgaagcattacctccaaaggatggaaaagttgccaagatcaattggcattatacagactccctgtcacagtgtagtgaatcatcagccattgactcagaggtaatgtttatattgtctttttaagtttgctcatttgaatttagtctgggtggggggaaaagatgatacatgaaaacccagtgttaacaaaaactaaatgaaaatagaagccaggactatcattccagagactctcactcattattgtaagaatctgggtatttacattttgatacagattttccctttctttgaataaatgctaggtttttaatgacatcgtttatagtgtgaaataatcaatcttggcataaacagattgaatatagaactgcattttcttgtatgggtgcctgaatattgtttcaaatgtcttatatataggctattccaatcaaacttgcccatgatagtttagaggatcttgaggtgactcgctatcattttgcgatgaatggaaagtcattttcggtgatactggaacattttcaagatcttgttcctaaggtaagtaatgtgaatttttggatgtgttcatgagctcactgtgaacagcagcatgttaaaaaaaaacaatgtttgttttatagttgatgttgcatggtactgtgtttgctcgaatggcaccggatcagaagacacaattggtggaggcattgcagaacgtagagtaagtattgatgggcttttatggttcttttcttacgaattacaatttcactttcaaattctggatggtaactgatatttctttatatataagctaagtatccttaatccaaacacctgaaatatgaagtgctttaaaatctgaaactttttgagtgtcacagtagaaattgaagcaaatattttaaaatatgaaaaattccaaaaatctgaaacacttcaaatgaaaagtatttaaagtatgggcacatgcatgtgaatgtctgtgtgtaaagaattgttacctatcaagtatgtatttttaaaataaattcactgacatatttatctgggtaatgtatccacagttctttcttaaggttgtaccctcattaattggtgctctttttaattgaaatgtatgtacatgtatgttctttgttacaaacaaacctactccccgttccctgtggtcttccttccgcttctcctccacaatcagatttattctttcttcc

SEQ ID NO: 24014 - DNA, 1121 bp, Mus musculus
aaagaagtacatattttgcattatgaaagtttagatactagctagagatcagtgttttaaactatttttaaactaccatttattcaatttatatgagcagggaatcttttgaaatgatttgggtgtattctcattaatttgggaaatgacattgcagacagtgtcaggctactgagactttacacaggggaggtagagaggtcatagtaggtttacatatagctgtttatgaagaaagacttggaaaaggacctgaattggagcaacttccgtggtgcggtacagtgagaaaggctagaaatgatgcccagttggatgtagaaggtgttaaatagtggattctagggtgactggtaaatttcttgctttaaacaaatcattaaggggtagaatgaattgaaaagtttgaggggcaggatattttgaagaaaggttgaattttagctgtctgtgagaaaggatggaggtctcaatctgtgggtctgaagatgagagatgagtgctgaaaactgatgggtagttgttgctgtcacagacattccagtagtgctacactttgtccccagtgacatagttacaaaaacagcccaggggatattaacagttaagtgatagcaggaaacaggagcttggtaacctgtctacttgcctttctatttaggctagtataatgtaaactgcagttaagcagaattgtggtgggtagaaaggacatttgggggccatctttgaagtcctgttttttttttggttttttccttttcaggagtaaatgattcagctttatttgtagcaacaattggtttagtggatctttagaaaatagaaaataatcctgtgaaaaagtatgctaatgtcctttttaagaaacttgttggtaaagctttttaatgtagtttaatctcatgcttgcctttcttgtctttaaaaagatactatttaggcctggaattgtgcttgagaatctagtggtatattgcttgcctggtgtgggtgagaccttggggttcagccccaagcacctcaaataacaaaccataacttaacaatgacagtatcagttttgtagatgcccatgaaggtggtttctaggctaaataaccctgtacagattagtcttc

SEQ ID NO: 24015 - DNA, 1160 bp, Mus musculus
atacatggtagagcatgtgtaggttcatgtatacacacaaaaatagtttttttttttaaagaaaatgatttaagccgggtaatggtggttcacgcctttaacgggaggcagaggcaggcagattcgaggccagcctagtatacagagtgagttccaggacaaccagggctacacagagaaaccctgtctcgaaaaaccaagggggggggggggggagacagagacagagagagagagagattgatttaagcctggtagtaatgttgcttgcctttaatcccagcactcagacagatctctgagttcaaggccaccctggcctacagagttaagttccaggataaccaaggctacacagagaaactctgtctcaaaaaaacaaaacaactacaaaaaagaaagtgatttggggttggggtttgattcagctttaattgggaatctgtggtgctgatgagcccagctgttgtctgaggactggaaatgtctgtctttataggagtgttacgtgaaagagatcgatgctgccaaggagaacgtgatcctgataaacaaggcagacttgctgactgctgagcagcggtttgcctgggctgtgcactttgaaaaggaaggggtaaaggttatcttctggtcagctttggcagaaactgatcacctaaatggtgacttgaaggtaatgggctgggggcctttctcaaggtgggttttggggttgccttatttctgactaatgtgttttgtttatattggtgatttgtaaggattactttgtttggggattcccctccccccagttcagtgattacaggagagcctataaaaatatttaaaaatctgtaaccagaccacatggatactttgtgatttcatatactctttcatgccgtaccgtatactctttcgcatctgagaccttaacttttttaatcttcaggaagttgtctaagaagtttcatatttttttttaattattaatttgcttttaagagaaacttcacagtgcacagggtacaactgaagagtgtaggcaatttcttttatctttaaccaagttttactaaaacttaaagtctattaaaaaatcagtcctggtatctttgatatttagaagacacttagaagtgatattttcccctcttcttttatcttttggcttt

SEQ ID NO: 24016 - DNA, 1185 bp, Mus musculus
acgggcgctcttggatatttctataaagaagataacttgttatcgtaaaattttgaaacaaagtctccgtatgcagccaagtttggctcaggactgccttcctcgtgcctgtgcctggagagttctgggtttacaagccgtggccaccatgcttggatcttttaaactttccgattttagttgcccagagaatcgatcctctagagatggttccgttagaggcgatctctgctttgccttgttttgcccccttggggtttatcgtaagaaattgacattgtctctagaagcttagggaagatcgtggtagccttaaaaagtaaatgaagtatagaaattaatcccagcagagtatttgaggacattccgagtcctcactaaaatcctgtgctgaagttgtccctggtgcgtgtccgttacatcgtcccatttccaaactctgaggaagacacacatgcttctttctcagtgttcaagtctggacttttgatactactctcaatgtactggccttcgggaaatagtggagaggtttaattttaatctaaagaaattctaactcatatcctgatatttgttaatcctaagcttttaatccttaatttcgtttaaaaaaaaaaaaactatgtttgtatctgtagtaagcatataacttgggatggtatatatcaaactcagggttgttttggttttttgggtttttttgtttgttttttgttttgttttgtttttttttgcaagacagggtttctctgtgtagccctggctgtcctagaactcactctgtagaccaggctggcctcgaactcagaagtccgcctgactctgcctcccaagtgctgggattaaaggcgtgcgccaccaccgcctgtccaaactcagggttgtatgagaaatcaattagcaggtagctctttttttaatggtcattccaggcaagtcagtctcccagcccttgggatttggggcagaggagactaaggggagtggggaaacagatctctacacagttcacgatggcccttaaacttgtggtctctgagactcctgctcctttgatgacagcatgcaccaccacacttggctttaaaatattctctctcatagatccctatgaaatatttttaattggccagccgagtcaagacagtctgggttctagttcttcatcagtacttagtttgg

SEQ ID NO: 24017 - DNA, 1189 bp, Mus musculus
aatcaggggaattcagaatccttcttttggttcactttatgaaaatgagaagtcttgaggccagactggtttttcttaaaatggaagtgtgtctttagcacagtatttgacactactgttttctgttggggaggggggtgggtagcagaaaagaaaaagtgcttagaaggaagaagcccagattctagggcgagctggatcatcttggacttcacattctgatctccttcatcttgcttcctggccacctgggaggaaagcagatcacagaggggcagggctggaaggagagacaggagggaagcgttgagcacctgtccttgagctgagcaagtaggatgagtgatttccagatgccccagttgagggacaggtttgcttgcctgaggtgggaagtcctgagcgaaacaggacttccgagttcctgaagaagaaggagagttcctgtgaacttggaagtcttgtttccctcaggacttcccaccatatttgtccgagaattctccagttttcctgacctgaaaaaatttggtgtagacgaggagaagaaggaaggaaaccaccaggggccaactttgaagaccctgatgtctcccccacactaaccagtgagagttaaggacatgctaggtgcaggacaagatcacttctctaagctggcaagcaagcctgctgggtggggtgggggacagagatggggagcatctccttggggttccttcctgccagctggcctggtacccagtcatctcatcccagcccaccagagagctaccaataatgcaaatcttcaaagcaagcagtcagggttgctttccagctccttgacctctctgagtttgacagctccttcccagagatagggcagtgggctggggggagggagatacttgtgtttgctttggaaactctccaagtctgtgagcaatcccaggtttaacgcttaggcctaaggagaattccacgtttcactggggaagtctcatgagacacaagagatttgtgatgttcactggcaccagagcgtttgagacttgggacaagttttctaagacacgatatttattccaaagaatttgacctcagccttagctgtttatcccaagtgtaagaggcctcagaaaacaacagcaccaccttatcctcatgaggatgcgcagtggactcagagtgtgtgtgacccagccca

SEQ ID NO: 24018 - DNA, 1211 bp, Mus musculus
catgtgctattttgataggtgaatgcttaagagggcacgtgatacttagaaagaattaaatataaccccatagccagtgagatgatgttcttgcattggtttgccttgcaatgctttgctggtgttcgctgctagtcttcactgctggtcttcgctgatctccaattgttgtgactttgtagagataaacaccaaagactctctggtggtcgtccagctacttcttgccgcttctactgactcacgccaatttggcagggctttgtggtttcttctggatcaagctgctgctgctgatctgtgttcggtgacactattgaactggactgctgatatctgcagtgatgattggaatcgccccaaagatctacttctcaataggtgcacgacctctgttttctattaactttttcctttccctacctctggtaggtgggctagaggcatttaaagaatctttattaaagtagattttgaaaaatctaagcctacaatatcctgttgttgccatgtgtcacggagactttatagttttgaatctgtaggaccagcccgttcatgtgctccagcagttcatcaatggggtagatgttggagtgggccaattcaaagccctggatctagacctgagaggtatctgaactggtcagcctacaggctctcatacaatcatgcccttggggctagctcaccagcaaccctgcagttgcagagctggctctactgtgctgcccagggctctgtctcccaagtgttgcagcaggtaagggggagggccagctctcccttctctcatcaccccagggcaagggatgaggataggaaagggtatctctctctcaccattctgcctcacagcagacaagtcgtgggaccagctcttccatgctcacacccttggggctggctcacttgtatccccacccctagttccccatctcccccctgaaccctgctatcagggtcagctctactgagcagggttcgctctccagtgtgctacagcaggtgaggggcaggaccagctctcctgctctttacccagttggagccagctttcccacctggtgcctgtggcaaggacataaggcaggggaggggctatctctctctctctgatgctactgcataccaaacaagaggcagggccagctctcccatgctcatgctcttggggctggcttacctgcaacccccacattcagggccac

SEQ ID NO: 24019 - DNA, 1506 bp, Mus musculus
caatatccaaagaagcttagctgagccttgctgctgctcgagctgttttcctccagggcagcccgaaggactgacacgggtgtcttccaggaggtggtcgaagatacggaaggaaggagaattgcacccttgtccacacggaatcaaaacccttgtaaagaactggctttgctagaccaactaagcatttcaagcggcaggctctaatgcttggtgagagaagaggtgggtgctactgtggctcccagtgagcactgaatgcctagtcagggttttaacaagcagcccagggcttgagcctccaaaggaatgccacagtcccacatcctttcccaggaggctttgtacctcctccagatgttcatgttgcttggtgctggcttcaagagcagcacctcattagataaagactgaacacataaaaaaaacccttactatagtgtccagagctcttatccctcctctatcccagaaccccaccttctcttgtctgtctacctgctccaggtgacctgacttctactaaagaatcaaacccgtcatccaaggacagaggttggccatgccggggcatgcactagattcactccaaggaattcactccaagtctaaagtactgggtcacaagtacaattgggggggcttgggaaagggtggcctcctgctctcattgtagtctctggagaagaaagaaaaccaaactcgtaattgtccactgtgtcatgccagcccctaccccttcccagaagtgagtaccatttctctgtgtgcttgagacgggctttgtgagtcagctgcccacatgaagccccacaggccgtgtctgcacagtccagctcatgtcctcaggcaagaaatgggagattcttattgtatatagtcagtaccatgagcgacagacactagctgatgaatagactttgagaactcttgagtcacggtgtttgttctctggccagtgttcagggctctggatgggcagtaggatcagcatcaagcagaaggcctaagaggcccaaccggcaggcctgcacgtgggcgcagtgggtggtaggtactgccctgtttgcttccaggtgcagaactatctcgttctagctcttagcaggctcatcccctgccgggaacaagctcagaagtctctggctccttagcccagacctcccagttccattcatgctggtgagtggcacactccttcactggccctctgccgggcccagttcctctgttctccttgctacttgatttcctattcatagtgtctggttattagatgcctgcgtgcgccaggcatcgtcttcaggatttatatgtgccctagataatattcatgaaaacctcatccagttcactccagctctaaaactgatggatgaaaacagagacacggacaggttctctgctgtgctgtttactgaagctttttactgtgcaaaaatgttggaaacagcttaaaatgttggctagagaagcagataaataatgcatactgcaaccgtatgg

SEQ ID NO: 24020 - DNA, 1146 bp, Mus musculus
tatcttcatccctggcagagacttttctaggtctgcttccctccatgctatgacacaatacttgtcaggagcagtccagggaggaccagtattttggcttacactttcagaggggtttcacggtcatttcagaggaggcaagatagcagaggtaacgtcttctgtggtggcaggagtgttagtagcagcttgtttatgttgaggtgtttgggaagcagagaaaacaggctgaaacactggcaggtatgaccaaccctagtgcctgactgctgccagccagtccctacctgtgatggttcacagtcttcaaaatagtgtcacacacaagttgagggtcaaacattcaacccatgagcctacagaggacataatggttcctaatgacgtctgcccttttgtggcttgaatcagaatggtccccatagatccgtgtgtttgaatgcttggccatagggaatggcactatcaggaggtgtgaccttgttggaggaagtgtgtcactgcaggggaaaagcataaagtcttatgctcaagctaggcccaatgtggcacacagtctcctactactgcctgtggatcaagacatagaactctcagttccttcagcaccatgtctgtctgcatgctgccacactgataatggactaaacctctgaaactgtaagcgagctccaattaaatattttcttttataagagttgctggccatggtgtctcttcacagcaataaaaccctaagattacccattcagggtacaggtaccagatgaaggccacccatgacttagcaagagtgttccaatgatggcattagcctttaacaaacagcaaccccatctttctggtcccgtatctacgcaggaggaggcggcaacttttgtgctcttcctgtcacttaggagaagggtctgtgttgtacttggccctctcactccatgtgcaaactaaagtctgtgctctgcacctacacttctcaaagtgagtccaaggagccccagttacagatcatgctgtggggagaaaataggatttcctgatcaaataagcctgggaggctggggctatgtccagttaccaccatactatatacatgggcgctaaagcccatggctgtccaagtcccttacttatgcaaaatggcatccc

SEQ ID NO: 24021 - DNA, 1166 bp, Mus musculus
tcctgggactacagagatgttagtcaggtctgagccatactgtgtctttcccctgtgttcatgtgctgtcgtggtgcacgtctcctcagtactgggaaagctaaggcaggaagatggtgggtccatttttggcctaggctacaaagcaagtttgaggtgagcttggggtgtgtagacagaccctggtcaagccaaccaaacaacagacaaacaaaaggtaattattaaaaaggaacaaaatacatttttattacttatataaggattatgttgttggctttttgtttgtttaatctgtaaatttatcagtgggtaaatgaactttcctctttattttattttatttttttttttcttgagacagagtcttgagaaacccaggctagcctcaaaattgtaatccccctgcttcagcctctccagtgctgccattacagacatgcatagccaaacccagccaactcttgctctatccgttcttgtgagttaagtttgtgtccacagaacaatacactatgagcaccctgggccttgctcgttttcagaacaattctgactttattctggtgaacttttaacacatagagacctggcctgcacccttgtgttctggctagtccgtcggttaccacagggtgtcggcatgatgaatgaatgactgacagctggtcccgttccttttctgcacacttttgtctctcacagaggattcggaaatcagtcccaggcatcatgctgtccaatctgaaaatgtcgttttccgtctttttctttgtaagacttacctgctcgtgctggcttagagctgaacaattaagtgttccctgtggttcagtctgccagttcctcagctgatgtgagacatctcacttgctgcccttctgtgtccctgcattgctgtgtgtcaggatgctcacgtgactggtacttcttctgggaagcttcctgacacaccttctgtcagcctcccaccccttcccttagcatttgtttggttttttttgttttgttttgttttgttttttgttttgactgggtctctctatgtagaccaggctggccttgaactcagaaatccgcctgcctctgcctcccaagtgctgggattaaaggccaccacgcccgcttcccttagcatttgtaaactaggacatgtagataaaaga

SEQ ID NO: 24022 - DNA, 1169 bp, Mus musculus
cctctgcttccaaagcacttgtgtcctgaaaggatgcggcatggctgtgcgacagcagctttccctgtctttgacaagagacttcagatactctggagaacctcattgtggagtttaaaggaatagattggaatttgaaagcatcaaattgtagaaaaatctacatttttcttttgtagtatgaaacattaataaaaggaaaatcttagagaggtaaactcaccatttattaccctgtaatgttttctaatgaaacacaactatgaaaaggtgtctggcttccgcctggctgagtcctgccgcctcccagggggttgtcgtgggtagcttcttctgtttacatagagggggaccatgtggacaaagaaagatttaactaaatacaatttttcttcgtattgatcttctcactatcttattttctagatctatctcattccccaaccttatttggggtattaattaatttttaacagggaaagcttgctgtgttatcgagatttttagcaccattttacacgaaggctgaaggttagctcttggaaatgacaagttcctttaaaatatgtgtttactttgctctgtgacatttctggatcattccggtcatcaaggctgatcacgtgtactatttcctgctacctgtgaaaaggattgtaagaatgtataaccaacactccattgctttttattagtatgtagagaatttgtatctaattaatgaatgtagttttactgtagtttgtcattgtaaatggaacaaagtacattatctttatagttattctaaaatgtacattatgtaagaattgtaaatatacttggttactttgtatgctgaaaatttacaatattaagtcaataaaaatatctcacttctggcacagttgctgtaagtgctccagctccttttgaactcggttgggttcggtctaactctgctctagctgaggcccagtttggcttttccacccgtcaggttatggaggtccttgttgatcctatttgctgatcacttcacttcagaaatccatgttgatacttaaagtatcttctccctgattccagagatggtgcagcccctacatcgtgcactgaagaccacagattttgttttaagagactttggactctactgcctctcccattgctatgttcgttggagttcc

SEQ ID NO: 24023 - DNA, 1239 bp, Mus musculus
taaaactcttctgtgatttgtttctgaggaagtgcaaacctccacaggctgaaagcatgttgtctttgctgtctcccctcagacttgcaggtcatctggccttgtaggcatttaggtaaaggcaacggtctcatgtgtgatattttaattggtatgtactttgaaatgtgttgtcctaaaccatgatcaaagaagagaaccaggctaaagatagggaaggaagcccacctcctcccaggggctccttggctgctcctggagctcctgcctcctgtgggaaggtgcagatggggctctctggttctgctgcttggggcagttcctccagacctgctgcctccccgctgtggctgtcagcagtgtcttctgccctttaatgatgagagtggtttttgttttttgttttttaaaaaaaagccttaaagattctagtgaaatgccttaaagattatgatggtcctgaatatctttagaattcagagttagctacgtcacttagtgctgtgtagaggctggcagtacaacactacattgctgtggcttacttcattttctcaatgtactgacaaattggacgagggaaaggactggagtgtagcaaggcttttatgaatagtttcaaaggaggctggctcttggatgagttctgctgtgctcactgatagctttctgtggcatgtggcatgtggcagtattccggtccacgcattagagagatgaacacacagtgctggccagacactcaggctgcttgttctgactgccctgctgtctctccaggatggacgtgctgataatagtttcattctttattattcatctgttctttttcatgctctcactgatgaataagaatagaggcgctctgaagggttccttaagctcagctttaccgtggctatagataaaggtgacccagcagcagccgttcaccgggcttcattgcatcgcatgtttaagatttccaaaatttcaaatttatttttaacacagacctcaaagattaattccggcattacagtgtacctaactaattgacgctggtgttcgttgtagtttagtgaattctggcatttacttcccccaaagtaatacagcttgcaacttatacttcagtgcatcaaaggtgcatttggggggaaaatatatatgttcacattttacaaaacttaaatttgtggtcacgttagcagtatttaaaaataaaattgtctgcatattaggtatgattataagcca

SEQ ID NO: 24024 - DNA, 1344 bp, Mus musculus
tagtgcagtattctaaccaaacgttttagccagtgaaccgctcatgtacacactaagcaatgtatacctcatctttgtaaagtaagcctgtttgtgggatgtggaaattgactgtatatatgtatgtggatatgttcatgtacccagatctctgcttttagttttcttattttgtgttcttttcaaattgtttttatcattgtgtgtgtatgggggtttgcctacagtgtgtgtctgttcactgcttgtatgcaaaacctgtggaaaccaaaggaaggtgaccatcagatgccctgaagctagagttatagacagttgtgatctcccctctgggtaataggagttgaacgcaggtcctctggaagagcagccagagctttcacatgctgagccatccctccagcccctcctctgattgtatactcggaaagttccacctactctttatatatgtagaagtggcctattgtacagtggggaaaaagtaagacttaaatgtctgattcttcgtgttttctttaagttcgttcctaaaacttaaaatctcaagtaagacttttggtttcacaaagttgatacttacttcagaggaatgttctaggcctaatagcatgtcggtaggattttaggtagtcaaatgcaactaaataaaaagtatttcctccagggcattgggaagatggctctctcagttgagtgcttgctatgcaagcatgagggcctgagtgtggaatcctagtacccagaaaaccacatatggtcatacatgtctgtaattagagaggtagagaccgctagatccctggaccgtgctggccagccagccttgctgaatcagtgagaccctgtctcaaagtaggcctgagagtaattggaggggaaacagcatgcttctgtggactccccaagagcatgaagacagagcataaaatattttcaacagattgttctaattgaccttgtgccagactgctgaaaacaagatgggtttttttaaattgtaaccatggaggtgggtgctaaacctgtaaaatggctctagtgggtcaaaaggtttgctctccagaaacatggtgggaggagggaaccaactctacatgtactccatggcatgaagtctgtctgctggtgtgtgtgtgtgtgtgtgtgtgtgtgtgatgagtggttagtggatgtgcacttttgtaaatgttttttaaattttcccccctttggagaaagttatctattactggtctgttctagccacagtagatgaattcttactttcaacttttaaattacatcccctgcttaacactattatatcacttccatttactcattaacccatcacaaaatcag

SEQ ID NO: 24025 - DNA, 1122 bp, Mus musculus
ataaacagactgaattatttgttcctaatgatttctaaacagaaagtacctatttagcaaaacaaaatttctgaaaatgtagatttagctagaagtagaaagtcaatttaattacgtttttaaaatatttgttcttaaactggagatggctcagagtgaaagcagttctatcccttgatcccacacaaaggtggaacgagagaacagacttcttcagcttgtcctctgaccctacacgttagctccctgccattctagatacacgaagtaataataattagagatccaccagcctctgcctgcagagtattgggattaaagcttggctccagcacagaggcaattgaaactcattttctaagcccaattctctactatgctaagtgaaattttgctttagaatttttaacccaagattttagattttaaaatcttaaacatttttattttctccacatgcacacacactctcgagcgtgtgtgtgtgtgtgtgtgtgtgtgtgtgtttgtgtgtacttacacacgtattacatgtaatgttcttggaggccagaagaccgcattgaatcctctgagctggagttacagatggttgtgagccatccaccatgaggatgatggggactgaatttgggtcgtccttcacaaggacaagtgccatctcttcacagttacagagcctgttccctgccatacacattgtttgtgtttccatgctgttttgtaatttgtttcatggacatcattttagctgactcagcgattccatgagttctgttcctgaggctgattgttggatagtcttatcattgtaggactaggataacaaacagaaatctcttggtttttgtcccaaggttactattaatgtggtgtggtgtgtgcctgtaatcccagcactcaggagacagaggcaggtggatctctctgagtttaaggctagcctagtctacagagcaacttccaggacacagggctgttacatagaaaaaccaaaaaataaaatggtgtgatagaaggccataggtctgaggaaatgagtactgttaaatcaagttcttcgtacccaggcgaactcaattctaacccaattaatgagtattagtggcattttaatttggt

SEQ ID NO: 24026 - DNA, 1198 bp, Mus musculus
gacccattttcctggagccatctctgacaagatctacatacactgaagagctgaagaggtcccttcggtctccgccagggaacctggtgggagggagaaagatgaggggagggagtttaccttttgattagctgttgaggattacccactgtcttaggaagacctattttaaccttacgtgttcaatgtggtgaatggtttgggccttcacaaattagggggggggcgggcggagggcgcaggtgggtggccctaaacctcagggccaatatggtgcttctatctatctcgagttgattttatataaagatttgtggggaaatatctttatattaaaagcaggttattggaatagaatccaaaatcattttccagccaaaacatccattcgaaatctgtatcccatttgatccttatgtaagtctcatgagtaaacagaacagaatttttttttcttgtgtgcatgaaagaatttgcagatcgcagaggacatacgagacacctctttcattgtgtccacggagtcccgccagtgttacggcaaaggcaaatcacatttgtgtcccacagacacttgaacccatcagtccagtaaccctgtgaccaactctgtaccttctcctgagccagtcacaccaaaggtcactgtgtgctatgtctctgtgcgtccgtagctctgtgtgactggtggccagcagtcagtgactctctgctggctccaggtgggggaatccagagacttttcagctgagatcttgacattctcattaaagattcgagttaggtctgggtgaagatgctgtccggctaagagcgcagcttggttttgcctaggacaggattggtgctatgcttggtgctgcaaacagaccagtggtgccaaggctgggcactgagacacttgcccagcaatgggtctagatgcctgttgtcttgtgtgctcatgtggtgctcccacatgtgggtgcgtgtgtgcatgcactcacacacacacacacacatcacacacacacacacacatcacacacacacacacacacctgctccatagacttcagggtggtcacctcttctttgtattgggaacttctttttaattaaactgagacacagttagagagcctgtgttctcaatcaagggacttttgcatttgaaggctgcttgtccctgaagtttcctagggtctcagtatttgga

SEQ ID NO: 24027 - DNA, 1244 bp, Mus musculus
ttactggcttgcttcccatcggcttgctcaacttgctttcttatagaacccaggactcagggatggcaccacccacaatgggctggccctttcctcatcatcactaattaagaaaatgctcagcagctggctcttagggaggtgttttctcaattgagattccctccttccagataactctagtttgtgtgtgaattaagacaaaccagtacaaatgtattgaatttcatcaacattataagggaaagtagaaattatggcttagtacttgcatggcatgcatgaaacctcttaggtttgatcaccaacatagaagggaaagggttttagaaacatttctaagtgaaatactgatacctatacagccctaatttctttctttactgtctagacactcgctgaaggctcaagcaaatgaagagtgagaacatttaaataaaaaaatgttagatgtgattagtttggaaaatgtgtgaggatgactaggatcacatggtgttccctgtggtaaatgttcaagtaatgtttgaaattcatactcattcatggatggactctttcagagaagcgttgggatacatccatcaacttctggattatttttttagtggggaaaatgtctatgccaaacttgtgaagtctgttgttaaaactactgtttctgtagtaaatagcttgacagatgttagtctgaaaatgtacatagtttcaaacatactgacagacagttcagagcaatgtttggagatttaattgtttgagagaatctcaataggaaatccattcccctgttatccatccatccttgctgtgtttggatgggacacttggctaggtgattattaacttgatctcttgtttcagtcatatttgtggctgaaaagactttggaccacactgacccaaattcaaacaaatgcaaaaagacacttgtgtttaaccacaaattgaatgataacctggaaatcataaggttattttgctttatacaagatttgacttattgtacttatatactaaatcctgggtaggcaatctttttctgacaaaaatgtcatacaacatggtcttgcctcttttacttgcagtttttgcaaaacgtatttgacattgattagtttctgcaagcacttgtctgttttctctaaatctttgcagtgtaagtttctttgtcgtatttatttatttacagttggtaacaggtgtaaatcttgccaaatcctttttagttaaccttatgactt

SEQ ID NO: 24028 - DNA, 1116 bp, Mus musculus
cttcctgtattgaaactgcattaacataaaatctcccttctttgtctcaaaccttttttaaaaaataggttatttattctttttttcctatttgctcttctttttttttttttacaattcaaatgttacctcctttcccagtttcccctctgcaaaaccactattccatccctccttaccctgcttttatgagggtgttcccctaaccatctatccatccctgcccacttcatctccctagcattcctctacactggggcatcaagccttcacaggactaagggcctcccctcccattgatgctgggtaaggccctttcagctcctttaagtcctttccctaactcctccattggggtccctgtgctcagtaccatagttggctttgagaattcgcatctttattggtcagactctggcagagcctctcaggaaacagatgtatcaggcttctgtcagcaagcacttcttggcaacagcaatagtgtctgggtgtgagatagatccccaggtggggcagtctctggatggcctttccttcagtctctgttccactctttctccctgtatttcctttagacagaagcaattctgggttaaagttttggagatggatgggtggtctcatccctcaactggggggttatgcctaacctctggatatggtctcgacaggttctcctcccctttttgggtatttcagctaatgtcatccctgtggggtcctaagaggctcttgctttcctggcatctgggacttttctggttgctaccccaagttccccatcccccattgctacacacctctgttcaatttcctgaccctctgtacatctctgtctcttcccatacctgattcttaccctcttcccccctccctcttctcttccttccaagtccctcccaccctctacttcccttgattattttgttcccccttctaagtaggactgaagcacccactctttggtcttccttcctcttgaacttcatgtggtccttgagttgtattgtgggtattctatgttctttgcctaatgcccacttatcagtgagtacataccatgtatggtcttttgtgactgagctacctcactcaggatggcattttctagtt

SEQ ID NO: 24029 - DNA, 2625 bp, Mus musculus
gcatgtcagagaagtggcatgaagtgtgtcatctacatgacacttcagacttcggcagagtgcagacagactctgctggctttcctcagggtctatcttgccactgccacagaagtttggtgggaactctgtagttcccacaaaaggaaataaatattttgtattaaaataataaaactgagcagctgaggggcctaaatcagagatagagcatacagttagcctcctcagtcccccgcaccatcagaggggtgagtgagcgggcaagtgggagagctattcaagctcagtgatcagcgcactaaacaaaggatagcgacagtgcgcgtctcgcttgtggtccgctgtgtgttttgtacaaatagtaacactaactaaatgacagttgttgtaaacaagtagtgcactgccatcttccacctcagcagaaatgttgatggcaaaggaggacgactaatgtgctgtgcgctgtgctttctctccttacagctattgtccagggagacacgctggaggacatttacaaccaagtgaaacagatcatcgaagaacagtctgggccttacatctgggtcccagcgaaagaaaagctatgaagacggatgttgttctttcttttttccatggtctcatctcttgccctgttgtggagtctgtcttcggtgtcctccacactgacacagatcccctcctcatggtcggcagttgtgcccgttttttgacatctgtgtcccttcatgttgcatcatctgtactattctgtgttactcttggtttctggccacttttcagaatgaagatgaatggcctgaccagctatctagggtttggggagatgcaaaattgtaaaattccttaatgtttaagggaaagttaactttaagagattttcagaaaagctttatatacattcttttccaatttcagtacaaatgaaagaaaagtggttttaatcagtgatttagtggaccttgagcaactgtgcacgcttcactctaatagcatggtttggccagtgtattagctctcaagttctttcctcaattgacttctgctattaaagtaatgatttcattaaaaacaaataagaaaaatagggatttatttcaaaattaatgtctgagttaactcataatttcaggagttgtttgttattcgtggcaggtctttattgtgtgccctcccatgggacacgtgccaggactaaccatggaggtgtgcagctctgtgggaagtgagtggctctcgagccttgtccgtacactgtggttacggctctgtcgcggtcaaagaactcactttacacacagaactgcagacaagaaagggtttcggtggacttgtagcaatcatggcagtgggaaggagtccaattcatagcctaaaattttaatgtatgcttagggaggggtcagattttaatgactattttacccacaataactgcctattttgttataataaaatatatataaatatatataaaactttctttaactaaactctgtaactatgggaattattttctttacatagttgcacacacaaacatatatatatatatttaaaatatatttttcttttgccacctacttctaactttttgtttggtttttaaattaaatattaattgatgagacttaccgtccttaatcatgtgaactgaagacaagtgtccggtggcggtgaggagaaacctctaggagattaggttgtgagtaggcgccaagcctgttctcctctttcctacagaagttccagaaggttcctaggtttcctgtcagtgttgtgttcttgtcatggagtttgatttcggtcctctgcctttcctcctagttctcctcattttattaatagacagacaaactccatttttgcgactccccgagacacttcatcttgcgtagctgcgctgaactagaattgcacaggtgttaagtaaacgacttgagaaaggttagtgagaggcagatgccttcagaagtcactttctctagtccattattaatatcatttggcttccctttgctctttggaactgtttattcgatacgtgattttggcaactctttaaaatttcctaaatgagtactgggttgtaaagaattatccattccatttatgagaaagaggagaacagctaataaactttattgtaaaatccatatgttaaatgtgtcttgaattttggaagtttctgtttttaataagctgtcacttactggggtggttcgccgcattacataacaagttagatttgctatgtcatgagcagtgtatgtagttcttacactaaatgccgtaaattgctgaaaaacaaactcaggaagaaaaaggaaagaagttgtgatttccataaaccacctcacctgcagagggaagcccagcctagccactctgacatgtggccggtgccaagcactgagggagcgggaaaggtgccattcgcatacggaaagttgtgttggatttctttccagatatctttaagagatttttttaagaaaatatatctgtaatgttttctagattcttgcctgaatattaatagtgtaactactaattgctgtattatgttaggattttacaacaattttgaagaaagaaccaagcctcactacctaa

SEQ ID NO: 24030 - DNA, 1796 bp, Mus musculus
tcgtcagtttgtggttattcttttgtaaggaacttgtgcttgttagtgttgataaggtttggggttggggtctgggggcttcctgagataagatcttgccaggtagccaaactgacatcaaacttgagatcaaatcctcttgcctctgcctcctaaataatgaaattacagatgggtgcacaccaggccagcgataaggaaatctgagagttggaaataatcctgtacatttcattaagtagttgttactaaactcatggtaggggcctcccccctgcaacaatgcctagaacaaaagcaaaatgcactcaaatgaattttactctaatttttatgctctagtggtttgtggccacctgaaactggctagctgtgtctggcgtgagtgcagaggcagatctgtggcatcagcatcccacagtgctgtttctttgttctcaattaaggttcgggacgagtatcgggaggactacgatgctggaagaggcggctatgggaaactggcacaaaaacagtgagtggggtgagccccaagtacacaggtcacggtacatcaacacagtggtgatgctggagaacgttacccaaggtctcatcagtgtctctgctgtactggaagccacctctggttttcctctgaaatattaaaagacagaatccaaagaacgcctttaactctagtcttattaggatgattttctattattaggtcaaaaagctctacccaggcaacagacacaatctgtgctgattaaactgtcagctggataccagacttttagggagactggacaaacatcaggactggcttttataagtaggcaggtaatcttcatggggactgaggtgattttcttgtacgttttacgttttcctatttaccagtggggttttgctgtagcctgtgtaactctgctctgaggaacaggtgtttcccaactggattcgccttttctagtccagtagagttggcaccaatccagccttaaatggtcctggggatgccacctgcttctatgctttatgcatcaggatactctcaggacgtgagtgttcacaagacacgtttcccaaaaaatgcaaaggtttcactgaaaatttaaatcaaaacaaaacaaaaacaaagaccttgttacacagagagcctccgatatcctaagtagggaggacactgtcagtagggaacggaatgaaaactcaaatgttgcctgcagttgagcaaggaagctgaggttggaaccattaaactatttcttcccattttcaaaaggaccttagagtagagtgggctttagaaaagggcttcacccagctgcttgggaggctgaagcaagatgatcaaaaggtaaaggccagcccggggccttgtgaatctgcctcacaatcggaacttaaaggggcaggggaaggtgccaggcacagcagttaaggacttattatgtgagtgttttgcctttaatccttggggttcaacaataaaagagtctgaaaattgggagagaaaacctactctaggagcctctggttacacatattttaggctttttttccccctgaaattgtacttactgaggtccatgtattaataagaggtcagtctgtacaaaaatctaaagattttttcactttctttgtattattatatatgagtaacttttgataccagaataaatctttcgtgtttgtcactaaagcatcggagtctcgctagtttctcatggttgggtcacagcatccttgtcgctgtattaagtgcagttttcttggagccataacaactgttaatgcttaggaag

SEQ ID NO: 24031 - DNA, 2634 bp, Mus musculus
agtccgtagtgtaaagccgggtcagcagtccttgcgctgaccgaggtggaggcactttctgttgctgcagctggaggttgtatcgaccctggggaagatgtcttcattgcttctgtggtactggggatggaacgcagggcccatttctatgttaggcgagtgctctaccactgaggtacaaccttagccctctttataaaacatttttacattttgagacctggtcttatgatgttgccgtaggctggccttgaatttgctcagtggctgagcctgatcttctgtttaatactcctgtcacccaagtaactaggattactggccaggctgcttgaagatcttttagggaaggggtttggggaacagggtctcgtgtgtcagactagcctcaaaggtgctaggattataggtctctgtcaccatgcccagctaaggatgtagtcttaagactttcagacataattataccagcatgagcttcttcaaaatttatgtgcaagatgttactatgggattttgttggtgtgcctatactgaaatagccagtagtaagatgactgactcaaaggtcttaaggaagtatttcacttccccagtaagagacttcatgcagaagttacagttgtgttcctttgagattcttattgaaaaagggtctttgtttagcccaggctggcctcatacttgcagtcctcctgcctcagcctccctgatgtgtagattacatgggtgcgtcattatgtccaatgcctgggagaataatcataacgcccacctctgcagtctgagaagccgtcctgtcagctgtgagggatgcaggaatgaacactcagctatccaggtccagttactctttcctttctagtatgctaggacaccttcaggtggactcttcagcttgctttagcctacatgctgggtgtcttcagtatgttctacacctgtttcctgtttctgccattagtgagatctggtttcagcacacagttgttctttctcttctttattgtttttgtttgtttgtttgtttgtttgtttttcaagacagggtttctctgtagccctggctgtcctggaactcactctgcagaccaggctggcctcaaactcagaaatccacctgcctctgtctcccgagtgctgggattaaaggcgtgcaccaccaggcctgtcgttctttttcttcttgtaattacatgtaaacctctgtttagcacaatcttttgatgtttgcagtaatgctttactgtcactggcttggcactgaattttgatacccataaagtactggcagactttatgtcactgggatgaatgtaagccttgcacaaacttagagctattcatatatgatgagcctttagcaagctgcccggtcctcatgggcaaacttacccggctgtagttgcttttttccagtagtagttccttttgttaaacctctagcaatcaataaagatttaattcatcttttagttttcttaagaattatggagacttaactttcagttggcctctcaaggaagagaaaagaagttgctgccaataacttcacagcacacttttggctttgcactgtattctgtttaccattgaatatgaataaatggtcatcgtgagcttatggttggaatataccagtgcagagctaactagggacacagccagtacttgtctagtgtgacttgtccctttcctctgcagttggggctcactgcttcttccctgccttaggagccattgggggtctgagtgggtcagagacagtgagtgaataatgtcaatgaaatacactgatgtatctgctgtgcttcattatgttaagagaccaaggtaatcaacaattataaagtacatcattttgctatgtgctaggtaggctctgcctcctggccagtagatgtctaagatctggggaatagcatccaagaaatgctattgtatttggggattacaaaagcagacctagacaagttgttcacttgaatgatacctgttggtcagattttattaaaagattatgatcatgtaaaattagtcagtactcagcccttctagcaaaatatttttttgaaaaataaactaaatacctttataaacatgtgttctgttgtgtttaataatgtgtattgtgttgtggatagtgcatttcttagtgtcattccagtggtgacaaggctcactgtgtagccctacctagccccacccacagagcagccctgcagcaacagctctttcttgggcctgctttaccttatcctctacacagctcttgccatgtgcagctactgagtatggaaaatgtgcttaacgtgacgaaaatctcaagcttcattttactttttattgccagatggtaacacacacctttaatcattcgtgtatttgttttgtcttttgttctggtggccttggagccttagaccctcctgcctctgcctcccattgacccctagtaggaccaaaagtgtgcaccaccaatgcttacttattagtgttctgcatgtaagtgtaccatggtgcatgcagtactcagagagggctagagtcacagacagttgtagctaccacttgagtgctgggaagtgaacccagtcctctgcaggcagcaagtaccaagacattgctccagcc

SEQ ID NO: 24032 - DNA, 1179 bp, Mus musculus
ccagcatagctctgtctgcacgcattgagttcccttcaacagacagctgtctgtccagtgaccaccagtcctaaatgtgctatgccgaaatatctcttcatgggctcatgtgtatgcactgtgttcttgcctgcatgctttataccttatcagaccatggttagaattagaaggtaggtgttgaaacaggctgcatccagttttgaatatgaaaatcttagaagcatactgagatctgcaatcactaaactgtcagaatgtatgggccccgtgagcattgggcaggggcagtgtctgcttatcctagccactagatcaggagaaggaattccttctcgttggcatctgacctcagcagacactccccccgcctgctcccacacggttatcatagataatacaatgttttctttcttttctgagacagtcttgctgtataggcctggttagcttagatgagtctagcctggaacccacagctatctacctgcctctgctgcccagtagtggaataatggcatgcaccactgtgtcctgtttaaacttttttctaatgtcgtttcaggctatatagttaatgggtccaggagtgtagctcagtggtgagtcacatgcctatcatgcacaaagccccaagcttgaacccgtgctccactaaaaacagtatctaggccactacttgacagtattgtataatttcaaattttaaaaaaattgctaaaatcttgttaaatgtttccttttggttttctaacaatcgcactgacaggacagattgctctgtcagcgctgttctgtgatgcgtatgtgtgatgttctgtgaagtggcttttctgaagctgcgtgtaggaaacatccccacacattccctctcttatcagtacatccgctgaccactctggcagagatgctgtgtttgatattagagttacgaacagattcaagcattggcctggtcttgaaagaactcaagtctttctcattcactaccctatgctaaaaacagataaccttgtcaaacatgctatttctgcgtcaagaaaaacaattagttgaagttcaaagaaaggagtcacttttttatgtatttattttttggtttgctttccttgttttggtaggtagaaattgagttgggtaaaaagcctatttctattttgttttcagattttatattgc

SEQ ID NO: 24033 - DNA, 2827 bp, Mus musculus
tgagtttccatccctagcacccacataagaagctaagtgtggctatatatgtttataaaccctcgtgctgagggaatagacagacccccggggcttgtttggtcagcctaatcaggaaatacggggaagagtgacagaggagagtgtcagaggagagctcctggcgacctctggtctccacagatgcacacagataagatgagagcatacagccacaaacaagctcattcaccacacacaaaccacccctcctggggctgtaaaagtgatgtgccgcgtgtgagggctttagtttgttaaatgatccagaggtaatttgggggctagagtttctaaatgagaaacacctctaagctttctctctcccttccatttggcagcatcctttcctgaaactggccaaaccattgtctagcttgacgccactgatcctggcagctaaagaagcaatgaagagtaaccgctaacatcgtcaccgaggcctcctattcccttatccattttttaaaagaagtcttttaatacatgaaattgttactctgaggggtgtaaagagacagtctgcatcacatggaggaaaaaaaaaactattattttctaaagatgaccaagagaaaattgcagtaagagagctatgactttgaaatgagcccctgctttagggtccaagaggaacggtggactgcatcactagccttacatgtcccgcagaccgcgcttgacgttcgcatactgtgtgatgacttttagtatggcagatcctgttcctgtctcccctgggggatttcccatacttgaatgtcagattcaagtttttctgagtatttcatctgctgatcttctctccttcgtgaccttcccttcctctaaccctttccttttaagttgtcgttcggagtttttcttatgcctaaatgcaaggcagatgtgataaaatgattgatgtagctctttacattgggaaaggagcttgacatgcttagcttcctatagaagtcaggaccggctggtgtgcggagtgtttcagttcagagcctaaactgaaagggggaaagtatgtgatttttaccttttttaacaaatgtgaaagagtcagctttagaaattttgtggtagtaagtttgacatttgttacatgtatagaaagaggactaataatctatatttataactaaatcattgatacagagaagaaaaatcccactgactgtatattctcaccattttgtagtctttctctgcctgtttctcctcatatttggctttaggaaccaaagtgatctgcgcttgttgacgcgggctgtgtgactttggtgccactcccttcctgtgtttccttggaaataagtgtctgtatatgttgtgattttaggtgtccgttttgaatcaacccttatttcacatacaccccctccaccctctagggcaagtaataaccattgaattttcagaatttaaaagttaaaagatttttcctatttaaaaggaaaaatatttgggactagcagaaaccaagtgagatttgaaccttggtgagttctaggctagttgtaataatgaaatgtcaatattgtagaggtgaagtttctgacagtaaactgtaaagactcatctaatctacagtgttcctgacccattatcaatgttttactgtttatgacagatgaaatagtgcagtacttgatggatcatttgaggtgttgggtactttagtgtttgtttttccaaatgagtagggtattcattgtaaaaaaacaaaaacaaaaaacaaactggagaaaggaaactgcagtgttcgtattgttagtaatacttttattttaaagatttaataaaaggtctgtgacctgtagtagtagctgttagctgccctctccccactcctgcctttcctcttctctgcttctctgtattgctttgttgttttgcctgtgaggaggtattgctgtctatcctatggtcctgcaaccataggaaagaaaatccctgtggttggttcaggtttgtccccaccatcccctttcaaagaacgtgacacatactcgccctgccattctgcagagtacaaatcataaatgagtaagtttgctctttgggttgggggaaggggcagggtttcatttcctggtgttcccattagaatacaggataagaagagatcactaggggctttcagcaaaagtcaacatctagagcacttactggcctgttttccatgcgagctccttttcctctggactgtattttcctacagctttcactaaattacaggaataaagtggtttctttgtggtgggaagctaggctgcctcttgagttctggctgtgagtgttgtttgtgagccgctgtctggatagattgtgatgacagtgctgccagcatagaagaaagccagctacatggtggcactgcttaagaaggtgctccatcctcaatcctcgagagcaccggggacacaggctgctgcccctccttaggctgtgactccacaccggcttgtccacacagaagcagtctggggtttgtccttagaatttcttggatggttatttacatgtccattgctggcgacggactctgtcattcaaacctgactccaaggttaagggagctgcactgtgctttattctctcctgacctggacaaactaacctggaatagttaatcgtaatggttaattttgagatgtgtcatttttaaacagaataatctttaaagcaatatagaattgtgatttattagttaattttaaattaaaattttgagatcctgttgaaagacaattgtatgaattgagattcttttttttttttttttttaaagact

SEQ ID NO: 24034 - DNA, 1525 bp, Mus musculus
tggtccttactcgctgcatcttcagggtattacagttcctcaagttctcatgagtttgactcagaacttctgtttttgtcttgttgttggtaaatgttcatttgcaacaagtttttgaaggtggtgactggaaaacaaaatcacatggttattcattcctcattgaacttagagtcggataattgtctaacaatttaacaccaacccactctttctgtgtcttgttttgattttggtttttttaaaagctgaactcacagcgatctccctgcgtcaacctccccaaaactgggattagagggaatgctaccattcccagaacaacaagccattttagctcaacgatttgagtgttcctagtcaggacaggcctctagagaacagagaaccttcatttatagcctgatctatttactagaaatcttgttagtgagataagtagtggctgcccagatcattaaggtaaactgctgagtgttaaaggaggtcgtgctcttggtggtgcgtaaagagcacatggaagacacagttgtacctgagctgagtatgagtcacctgagtcagtgctgttcaaacatggccagatctcagagtggcttaaaagtactgtggatgggtccgtatcctgatcctggtgtcagaactgggatatgttccgaccataaggatttaaaaatgccctggtttcagaatgctaccaaaggttgagagcagttgtgtcgaatttgacctagaagtttctcacctacaaagtaggaagttcttgccccactcattgcctcacggggatgcagagggcgcaagagaacactgggagtggtggcggtatggatgaacaatggtgcagaagtgtagcatctgtcacattccagctgcagccaccgtgaccagggaaacgtgtcgttgaatttgttgttgctgtaggaatctcttacgtcatgcataaggaagcatgcaggggtggaacaaaatgttaattaatattactcttattcactatggccttctgtcctacttgagacaggcggttatattacctaagttttcataggaaagaagaaatattaaggcttaattctgtaatgttcattggctcataattcattaaaaacttcatacaaggaactctgtggtagtccatgtcatttcatagttgccattttttctcattgttgacttcggaatgtcaagccatttcgttcatctctcatttttactctccagcttacatccagatggaacagagcatgtgcaatggctccgtgctcaggtagtccctgcatgactgggaagcatgaaaaacagccaagacccaaactttacagaagttagttaacttcatagtttatatatctttgaatcaagaaataacaattggatgagacagaaattaaggagttttcaaaagtattagtattaaaatgattccataagccaaggctaccacaattgaggtgttgatgattgttggaacagtccgtgtccaaaccaaatgcctgccctcagacacccttccccctccaga

SEQ ID NO: 24035 - DNA, 1210 bp, Mus musculus
cctgcgtgcccgtgtttctttttgttttgtttgtttgtttgttttcagtactgaggattgaatacatgctagctacacccccagcctggaggaatatctatgaatctgatcactgtagttgtaaaactgtatctggtaaatattatgaatgagagttgcatgctagtctgagagtcagtaggggaggttttaactaggtgcggagggcaggaagagacttcctcataagacatggtgcgtaagctcagtgacacctcaaagtgttcctccaagaggagcaagaagagcctctgaggagggagtctggcttgtgtgagaaacaagaagactgtcagcagctgcagagtgtacaggccatctggtttgagtaaggtgaaaggactgggacacgcacactccagtgaagcttttccaattggaagccagaacaaaggccttggggagtggtggcatgaccagtttgtgggttagttttgactccactatggagaacaggttggagtttgattttagaaatgtggtagatccattagagaggatgtagtgaaggagatggagaaaaatggacaagcttagggaatagaagctgcagaatttgatgactgttcctcctattgcctttagatatggcactaggattttaggtcatcataaattaaaattgattttttttcactcagagaatattaagatactgggattatctatgtattctctgaaatttgcgggatcaaacagtttttggggtttttgttttaaagactagaatttggcagtagttttgaactagagctgaggagggaggagctaagggtgacttgtagatagtatttggcttacataatctaagtatcacttgagggagagtttgaaggaaaatgacagcaagttcacttgtggaagagcagaattcatagtgcttttgagatattcaccatatttcagataggcagcttctggtagccaaggattagaggcagtctaggctcaagataggaatttctagttggattgaatgaagggaaatacgattgcaaaggtgtccgggaactagctatattatggaagaaggccttttgaaagtctttgatatattctttgggctttattctgcaattggaaaagccatacaagtttgaccagaagaacagtgaagtaaaactgtgctttaaaaagattaggccatgagagacagagggcacgtagagga

SEQ ID NO: 24036 - DNA, 1210 bp, Mus musculus
atgtcagagaaggtccatagcacgtacaggtcaacacactctggaccagaagcttgtaaggtgaaagaggccatgtcctgatgccagctattggccatatgttaaacataattaaagctactgtaggtttccatgtcagtgaaatgacttgtcctgatcttacttggcacaccaggtaaaaaaaataaagttaagaaagaattatggctgggcaatggtggcgcacacctttaatcccagcactccggaggcagaggcaggcggatttctgagtttgaggccagcctggtctacaaagtgagttccaggacagccagggctatacagagaaaccctgtctcaaaaaacaaaaaacaaaaacaaaaaaaaaaaagaaaaggtgggtacagtggtgatgagaatccctcattagtaatatgtgatcgtgtctagtgaccattcatctaagagatgagtgtagctggcttatacgttttctctatatatactcaggagttttgttttctacaggaaactgataggagtgacacgaagagccctgtgttgcaagacacagaaattgaaaaaaatataccaacactttctcctcagacctgcctggaaactcaagaacaaggttcggagtcttctgcagggatacccgggccacagttatgtgtaggagacactaaagagtcccttgagggaaaagttgaaacagtatcaaccagtcctgatgatttatgtattgtaaatgatgatggacctagagccacagttttttactctaatgaagctgcagttaactcttctagtaaaatagaaaatgaagaatactctgtgacaggtgtgccccagttaactgggggcaacagagttccaacagagagtagagtgtatcacttactagttgaagaagagatttccgacagagaaaaccaggaatctgtatttgaagaagtcatggatccatgtttttctgcaaaaagaaggaaaatattcatcgaatcctcctcagatcaagaagaaacagaagtgaattttacacaaaaactgatagatttggaacatatgctttttgagagacataagcaagaagagcaggacagattgttagcattacaacttcagaaagaggtagataaagagcaaatggtgccaaaccggcagaaaggatccccagatcagtaccagctacgcacaccctcacccccagacaggctgctgaata

SEQ ID NO: 24037 - DNA, 1409 bp, Mus musculus
ttaatcccagcactcgggaggcagaggcaggcagatttctgagttcgaggccagcctggtctacagagtgagttccaggacagccagggctatacagagaaaccctgcctcaaaaaaaaagaaaagaaaagaaaaaaaaaagattttattattatacataagtacactgtagctgacttcagacagaccagaagagggtattagatctcattacgagtggttgtgagccaccgtgtggttgctgggatttgaacttaggaccttcagcagcactcttacctgctgagccatctctacagccccactgctagattgttaatgcaagggtttaagagtggcatgggctgagtggtggattggtaggtagggaatccctggaactgaatgggtaatcagaaactgggtccaacatggacttcaggcttcttgtagcagaacattctctttaatccctttaagtggcagaaaatatttagagtttacagcttttccctccatggcatcttggtgtgagagggcgaattggtatatttttactgatcttgtctagaaacaaataaattattgtaagaaaatgatactacgctctgctgtcgaacacctggctttaccatcctcgctgcttactggctcagacacatgcttgtatgtgcgcacagatggaaaatggtgtgggtttgtcttgcattaccctgggatccagacgaatcttgtcaagttgagcttctatcttttgttaagacaacttagcaagctgtagtttcagtagattctcttctggtgtcttggctccatttatttcctgtgaacataataaactgtcctaatgcagtgtttggctttttccacatttttgtcatttgaattttttcttccgagttttaaaactttttttatgtttatcttggcaatttttttttcctctaaaagcaatttaacttaatgctttaggaagatagtgatgggacttcaaattagatattatcacattcaatctttgtgaaatagttcatgaccaaaaagggactaagaagaacattcctgtatggtatagtgagagtttatatatttaccaccagtttgtccgtgggcaatcatcctgattgaagttgttttcaggtttttagtttctctgttagctctctgttattcttactgttgatacctttgtgttagcattagattttttaaattggtcattagtgaactgctttttcctcatttttgttggaaaatattagagtattaaagctgtgcagatttgaaaaaaagatgcctggcatgatggcacagcctaattccagcatgtcagaggcaagggcatctcagttcttaaaaaaaaaaattaaaagaatgattaataaaaattggctctcatgttcattttactacactttaataaaaaaatg

SEQ ID NO: 24038 - DNA, 2122 bp, Mus musculus
gaagaccttcaaatttggttcatacgacaacagttattaagagagatttctagtaatcttcagatgtgaggttttttttctgccaacaaaagtcacattcaaattgtatttggtgaaagcttttttcagtattacttagaagaggccacctgaatctgtatagtcctattcatcagcttcactgtatgctcagttctttccttgagctttaagtagagttctctagcagggcaggtagtgatttggtgggaaaaccaaaacttgataaactgcttataaaaccatttctacagaatgacctatcttgtcagttggagatttttcagtgatccttgaacctgtacacaatctaaattgtgatgactcagaaacctttggatgcctgtgtacgtgcagatctctctcggcaactagggggttaaaaagataagcttaagagacgtgctagtatgcaattatagaatgtggttgttaatggctggattttgagggacctccctaaagaatgagttatgtatctccacaaggaaatcatggaaaattttgttatttttcagtgagtccttttgaattaatgtttttacatttttttctaagtctgtgtaagtgcttatgtataagtatataattgtataaatatttataaatatatttatataattacaatttcatttataccttgagtcaaagttctctcttttgattggtgactgaacaataccactttggtgtttttcatagtgcttgagacttaaccaacagtttggatttatttagcaagcatgttaattcctcagttgtatctctgaacttgagtaaaatctggctgtctgaggaatagagtcttacaggcttaaaaaaccagtagtcaaggtcagcagtcttatgcttcaggagccacagggtaaaacgtgagagagtacccagcttcgccacttgggcaccatctcctctgctggcacaggtccagctaaagcccaagtccatcagaaatatgaagtcaagaattttcccttagaggactctgctgcaccctcttatcctgttaaattaggttctctatatacagtaaaacctatcttgagaacctgaggcaggatgttcagaagtgagagggtgtatagttctttacgtgcttagcactggcaaatccatttatgagaaaccaaagtaagataagcaagtatatatgtgagttaagagaagaacatggtgttatgcacctatagagcttagtcaggatgctcagctgtaggggactttatttaattttgacaaggcgtatgattatcaaggctggcccatgggaggaagggttatggattatacatgagagaagtaagtggggatatttccttgcttgagaatttaatctgcataaggagtttgccttagttcctctgcaagttattttgctttcaagggagagctttcactggacagtcaggtgaggtctgtgaggttagttaaatgtagtgactccctatatgtagtagaaacagctcaaaagttgtttttaagtaaggaagaaagggacaagatagacttgagtgacatatagaaggtatggaaacttgtagggaaagtgaaaggagagctttgtgtactggggggagaacagtgccaggggaagggagcagctagcatgtgtggtgtgtactctgtgtgtgtttcctccttcagtcttcataccgtccctacacagtatatatgccttctactcatttataaatgtggaagaaaactagaatttatacagcgtgttcagtacgtcgtgctagtaagggccaaattaaaattagagcccagagtctgtccttgccttgtgtgctgtgttgttccttgtcagttggagtccatgtactctaaggtcaccttattattattactctaaggtcatcttactattatttagatttataaattaagggtctttgtttatttaaagatggaagtagtatttggggccaagattatggatttgcactaccctataaaaatcttaattatgccattttaaagagaagatacaattattttttctggtagattatccacaatagattattaaacaactctttgcttttataccaggttttatcttgtatccaaatgtactgta

SEQ ID NO: 24039 - DNA, 2520 bp, Mus musculus
agagcctgcctggtgggtcagtgcccccactgtcggaaacagcttttcttcctctgagtcttggtttttttgttttttttgtttttgtttttgttttttttgtttttttttttttgaaaactggaattgaactagattattagttctttgtcttttcaagtcataggactttggatgtttgaagttttgacctgaatagggagtgctagggccaactactaacagagtcaatttcatggaggaagtgtaaatgtgcacctggagtcacagccctacaaagaactatgtccaccccaaagttttaagcatctagttatttaatgacatcctcagactaattaaaagtatacaaactatacttgctaagtttttccctggattcaaggatcttttgtccaatcttttacagacctcattgtaatgactgaaatccctcagtacagtagttacagaactagtgatctttaaacagccagttatctattttttaaaacttaatactgtaagcttaatgaattttaaaaatgtcttaaatgtaatgaatgcagaacagataatgtctccaatactggagctgtatttgtgtgctttaagataaggactggcagttacaaagctgaattgtgtgagttgtgaagttcagaattggtttgggcagatgtgaccttttcaagattttcatcaagttgatatttaaaaatagttcttgtcccatggaatggatcttcatctcaccttttagagctccttcatttatgtacttgatagtaagtttcagagtacaaaattatgagtaatgccttgtgtaaaactaaaacttgaaaagtaatgagggtaggaagagccagccctgtgagggctcacacttccccggcagcttaaaccgtcaggagtaggctgcttctaggcaatcactctgcctcccgagttactcccagcccctgaacagacacctaaaggccctgtgagcagggagccaattccagcgccactggtttgccttacagaacatttcggttctttactgtgaaacttaagagtccctagtccacattagagtggggcaaaaatgttcttcagagctcagaataaccaaagagtaccattctaatatattgatttcttgtataacacagagatttaaatgcttcagtggtgatcatttggattttaaactcacctttgcgtcagttctcataatgagacagcttagaattaaaggtatttggcttatttaagaacagaggttatcatagctttggtcaagttttgtttgttttgtttttagagacagggtttctctatgtaataaccctggctgtcctgggctcgctttgtggaccaggcaggctgacctcaaactcatagagatctgcctgccaagtgctgtgactagaggtctgtgccaccacacctggctggttagtttctttattaaggaactcaggtggctagattattggatatgatgaaacctgaagtagaacatcagtttaatcctttatccatttgggggtgggagtgtcttttattttgttttcaaacgttcttacatagttcaggctaacctctcctctcttttttttttttttttctttgagataagttttctttatctagtcctggttgtcctggatcaggctgacctcttcagtgactgtgtagttagttgaacataaccttgaacctctgggtcctccttgggttaaagtgagccacatgcctgtctcttcttcattctttacttaattcctctaaaattggtcatgaaatttaagacacttagctatgcttttaaaattatatttctaagccttaatgtatatttctcatttttataaattaatatagaagagaatattttgaggcaaacaccgtttttacaactcatttcttcctaaggagaattcttgttccaagtaagagaatggctggctctgtgataaacctctaaggtagttggtttggttggttggttacaggttgccctaactaaatctcaccattttcataaacattttgttttttaaaaacacaactcctgaaccagtacttagtttcaagcacattcattagcccagactggcctggagctcactagccctaggttggccttgagctcttctgggattaagccactacacctggtttaacctgattaattttgaccatgtttttaatatggcctgtatgccatataattccaaaataaacttgggtgatccatataaattactttattaagcataatgaagaagttattaaaatttgcttgtgggattggagagatagctgttagcttagcaggtaagaccacttgttcttgcagaagtcctaggtttgagtcccagcaaccatatagctgcccacaactgtctataactccagttccaagcaatgcaactgttctgagtctgaggccaccaggcacgcacacaggaaggaagctgaggcaagaggattgctagttccatgtcaacctgaagttacataccaaaaccttaactcaaaatcctcttt

SEQ ID NO: 24040 - DNA, 2660 bp, Mus musculus
attttgcttatgcttggtttcataagaagccagcgggtgagatggctcagcagttaagagcacttgctgctcttgtagaggccctgggtgggtttagttctcagtcctcacacagtgggccaccaccatccataactccagctccaggggatccagtgctgtcttctgacctctgaagacttctataccactagacatgcaggcaaaacagtcatatgtacaaaataaatggaaacaaaacatgtgtttaaagacttgctcgtatattagggatgtgaatccaatggtagtattctacctaagaacagtcacattgctctataggtatgggaagtaaattgctgcacttaattctttggcagtaagcagcagacctttaatgtgtaatggtacgtctagcaactaagatcttatatgccttatgaggtcacttaggtttttaaatgagaaagagaagagtcaagctaaactagaataataggacatacctaatgagctgtcttcaccagacgagaagctatgggctggtgtgtagctcaggacccttgtttggatccccagggttactaagaagaaaagtttttaatctaactgggacagtgagagtcctgtattggccatcaaaaattgggaactgttttaaatgagataagttctgacctaaaattgaattttccttttctcaaaattttttatatttactcttattcatggtctcatctgggaatcttaactaatagggagccattcactaactccttggtttctttcctgcatcaagataactgatggtatagtatgtgtcaccagaatgattttcaggctaatgacattagaatatttatattcagctggaaatcttgttttcaacagaatgagtttatggtatgcttttctcaaagctgctatgttctcaatgaaaaataatcaataaatactaagtcatatgactcaaaatacaaataggctcatgaaactaatcttatgctctaagttgtgctgacgctctgcctgcctctagaatccccatgttagcagctaattaaagtctcatgggacctctagcctcagatgtcacagtgagtgctacctgatggtgatgtgccgaatgaagactttggaggcttctgtccaagttttggcatgaatattttagacactagtttttcacccctgagaatttttttttcagacaatttttctgttggtttttaaagaaattctaagcatctaggtgtcttttttccccccttctctttaactgttaagaaagttgtctttccggtgttgttctatgtaaacttcaggagtatttgtgggttttgcatgttttgtatgagttcagtttaaacaatgcatttaaatcacctgggatgtccgattctggcacgtcttcactgtttgtgttttaaacatgtttcatgtgtttccaaacctcacttggtatcttacttgagatcattgaagttgatttgggatatttgctttacaagtgttttttcaagcagttcttaacacagtgtttagatgtttcctgggctgtttatatgctcagtttgccctgaacaaagtggtggtcttactaagatttaaattcttaatataaaacaagttctacgtttaatctatagttcagcttgttgctgaatccaagacaatgctaatgctaattcttgtggtgtgttcctgaccagtgccctctagtatgcttgtgagtttccaggtttcttcccacagtgctaggagatcatttactgttacaaaacttttccaaatcggaatgaaggctgtgagagaagcaaggtggggaaatcacaccatccactgcagtttctgttcaaggtgcgtgaaagaccctcccaaatatctagtgattgtaaaggtgctagggggagcctgaatccaaaggaacacacaggcaggagagctaggtctcctggctaagactccctggactccactgcaccctctgtacctagggtacgttagacacctccctattatgtttccatggacacacataggctattataggcacgtgctttctgaagtgaggatctcgctgttgaagatttatttcctagtttgggctgtaccaaattgtgaatactcgctgtgttgtacccagttgctttatattaatactgcaacttgaattggggtgggtgggtggggcagcagggtgtgggagggagggtaatggaataaagtcttttgaagacatcagctcacactgtgctgagagagggaccaaactcaaggaaacctctgatctataaattcaactgctgcattttttataaatacatgtaaatgtcctgttgtaatatttgatcttggaaataaaaaaaaaacttttcagtattatgttttgagtcattgtttttgttaccagtgggtatatcctttcatgtaattccaattacaaaagcttgtccttacagccttgtgttagagtttttttgaaacttggtttcccagaactttttttttttttaaagatttatttattactatatgtaagtacactgtaactgtcttcagacataccagaagagggagtcagatcttgttacggatggttgtaagccaccatgtggttgccgggatttgaactctggaccttcggaagagcagttgggtgctcttacccactgagc

SEQ ID NO: 24041 - DNA, 1221 bp, Mus musculus
gtacactggaagagtcttcacatttccaaacagaaagactagtgttacagaagtgcctgacttatctcagtcctaaagaattagattgtcctcagtgtcttaaagtttcgcacaaaactctgaatgaattttatacttggcaaattttatttttttattttttttgtttttggtttttttcgagacagggtttctctgtgtagccttggctgtcctggaactcactttgtagaccaggctggcctcgaactcagaaatccgcctgcctctgcctcccgagtgctgggattaaaggcgtgtgccaccatgcccggctacttggcaaattttaatgctggacaatgtgcagtcagttcatagtcctggtccaggccttgagtgtattgtctcatgagcttcctgatggcgtgaccatcctagctccctgtgtatactacgcagatcccatagaagcatggggcaaaggattggtggcaccaactgaggtgacattagaggtctttgagtgacccagctcaacttctctgccaatgtcagcttgatttagatctcactgaatcaggctgcttctgtcctgtgtccctgtgaatctgctcttggctggctttctctgatgttgcttccttgcttgcttgcttcgttgctttggaaggctatccaagatgtgtaaacaattctttagtaaataaattgctattaacccaaacaaacaaaaacactgcaaagaggatgggtaaaggtgagcaacaggggagtggctaggatagatggctggggctacatgaactggggattctttacgaaatatctgttagactttgtgatcaaatgatgtgatataagaattgtataaagggaataactgtctgatactgatctgtttgagaagtattgagaagcttctcaatttaaatatttaaactttctaagctgatgcccccttggctgtgtatagcaaactgtttttatccacagttgtgccttattgtctcattaaaattgtattcctcaattcatcaataaatcggttgtcgttaaaacaacaacaacaacaacaacaaaaaagacagagaagctgggacttgcagatgataatgaactttctaatcccaaacacacagctaggtgaccctctaacttctttttcattcttgtttttctttttgttttttttttaaagacagggtttctctgtgtagccctgactgtcctagaactggt

SEQ ID NO: 24042 - DNA, 1197 bp, Mus musculus
gacatttctacgtaagccgaacaatgataaagtgtcttctaataacatgtgtacatgcttacagtgttatagattaccgttagtagccagctatggtggtgcatacctttgatcccagcactctggaggcaaaggcaggaggtatcttgagttcaaggccagcctgcttcacagagtgagttccagaacagccagggctacacagagaaaccctgcctggaaaaaccaaaccaaaccaaaccaaaccaaaccaaaccaaaccaaaaacacaaaacaaaaccaaggaaaggttgcagatgccttccagttcaggctgcagagtctgctcttgtgagggaggcctggcagcaggagctttatagctgtggccgtgggaagttgcccgtgttcagggccggtctttcctcctcagttaaacctctccaggtagactcccacagacttgctgagcagtgtgtctgaggtgaatctaaaccttgtcaagttgacagtgaagattaaccatcataaccacccccataaatcactatgttccaaaatccagtcctgacagtccttgtaagagtaataattaacattagtttagaactatctgttcattggaacatatcacatttcactgagctacctaagaatctggataaagattctataaacaaaactttcaataataaaatcatctatttatcttaaagtcacttctcaaaactaaagaaaaatacaagcaatcataaaatggaagtagccaggcgtggtggtgcacacctttaatcccagcgctagggaggcacaggcaggtggatttctgagttcgaggtcagcctggtctacaaagtgagttccaggtcagccagggctacacagagaaaccgtttcgaaaaaccaaacaaacaaacaaacaaaaaacaaacaaaaacaaacaaacaaaaaaaggaagtaaagtaactggagacacagagctccttgtgcctggctgcttacaggtgccaatgagcagagacaggaattgaatctgtgtagtttattcagacaaccggagatctttcaaaggttgttacatctcctctccaggcagcagctacagggagaaacagggctgggaaggagaccaagaagtcctttctggagcttagtcgtacctgtctagttaagtgctcagccttatttggaggcctgtgacatctgtgtctttcatta

SEQ ID NO: 24043 - DNA, 1601 bp, Mus musculus
agtactgactctcaacacttactattgagcaggagctggtgcttgcagtcccctggcaccccgtgtcactacatggcccagcacgttcatcaccatccattatcctgtagctggatttagggcaaagttgtttatgtccaggacctactagttgtcactcataaataccccttgtgggggtggagctttcttgttttcaacaaagaaaaccacattttctttttccttgtacctcctcactggtccatgctgggactatgagcatttacagtcctccctggacactttctggtggaagctgtgctactgcctaagggtctgaggctaacaccacacagcgcctgcacagcagaactacctaggctcctaaactatttcccaggcaaagctgagcagagaagaggggcaaagaggccccactcgtgttccagtggcccatggaaacgccattgctaactaactcctcatgaagggctgctttcactcagatctgacccatatggccttggcctggaatcctttctctgaacctgttgaaattagtcttttctcacattatgtactgctgtgtggctcactttaacttttctactttagtcttctcttcggggatccgtttctctctgccttattctcccaggtatacagaggtggtgatgtcactgctggcactcacctacttgttctctcagtgcatgtcacccaggtgtaccctgtggaaatgcaaagggagccgctcatgtgcgattttcccccatgtagtcattcaagtctactgtctgggtcccaaacatgagagcgtctatgctgacaagatatgtaacccagctaggactagcctatgctcatattcaacctttactatctcctaacactctgactctcagatagtttagacataagcaaaaatgctgtgggtgtggctgcatgctaggtacttgagggtcagtgtgctcctcggtgctagaaaaaggtgctgctgacatagcgcaccgtcggctacgtgtatctagttaaatgtgggtaagctgtataacgctgttgctgtgactgtagtccacacctcttgtgcaacctgggctatagagctgtttccccaagtctacacgaaagcaagcagcatggaagggccaggagagccgtaagttgtttggcctcatagcctctgtgccttaggaggaggcttgaagacaggagccctggagctggtattgaggaggagccagtgtgacagttaaccttggcatggacgggaggctgaaaatagaggttgccacttagagactgtagaaatggagcaccagtgccatggcagccactcctgggagctaagcctgagaccctaaagtgaggaaggggtggagttgaggtcgagaatcctgacaagaaaaatactgagagaacctttctggtcacttttctcagcagcaccttagttattcttaaggccgctcatctgaccagctgtctaggatgtccctccacagtggctcttctaagtgctttgtcactgtctccagcccacgttcgcttgtgtaactcacgttctggagcctgttgtctttgaaatctgttctttatcaaccttttactcctttcca

SEQ ID NO: 24044 - DNA, 1172 bp, Mus musculus
gactgaagaggagctaggcagcaccacgcttaagatatggcgcatgcgtgctgaggagttcagagactataaaatagagtgggctggatggggagaggaagagacagaagacgacagtttggcaatcacagatatccccaagctccaagaatcatggaaatggcttcttcgaaactgttctggtgatccgacatacctgtgccacagacttaaaaactgagcaagatttactcagtaataaggaggcctgtgccaagctgagctggcgcgaacagcaagccttataggtccgctatggtcagaagacgatcttacatcgtgtgttggaactcacaagttaagcaggtttcctgagaaccttttaaggtcatgctctgttgcttggaaaggaggggaacttggggctttttttatttggcagttagaatcaaaggaaaagtcgctaaaaggtaagcttgggtccatcaaggcaggaggtacatgttggcacttttggattgatgtcagcagacttaggaacatgctatttttactaatgccatcaggttttctttttttttagaacttaataaataaacatgggctgagttcaaaacaaaaacaaaaacaaaacaaaaagccggggcctggcaaacacagaagtggatgctcacagtctgttattggatggaacacagggcccccaatggaggagctagagaaagtacccaaggagctgaaggggtctgcaaacctataggtggaacatcaatatgaaataatcaatacccctggagctcgtgtctctagctgcatatgtagcagaagatggcctagttggccatcattgggaagagaggccccttggtcttgcaaactttatatgcctcagtacaggggaatgccagggccaagaagtgggagtgggtgggtaggggagtggggggggtatgggagacttttgggatagcatttgaaatgtaaatgaagaaaatacctaaaacaaaacaaaacaaaacacctccttcctccacacaacagcagtcctgaacggccaggagaacagaatggatgtcctcggatttaatttcagtgctgctgtttataaaatcaaagggtccttgcgaatctcttgtccagccacacctttacttccctatagtttcccacatccttagatccattagcaccgg

SEQ ID NO: 24045 - DNA, 1169 bp, Mus musculus
aaaatgccgacaataacatgaaggctagtgtcagaaaacccaagaggtttaatggaagactctgctttgcagctattgcactagtcattttcttcttgattggtaagaatgagtggccattcagaaggatttcttatgactaactagttcttagactagctagttcttagactagctagttcttgtttcttttggatgaggagatgctttgtactttaaatggcactggggctccctacctgccggcagattaggtcctgcaagatgggaaacgtttacattatggatgttttattagagatatgcaggacatttggaatagtactaagaaaggcttccagtaagacaaggtgtgcacccatgtcttaaacaggtcactgtaaaatatgacttagttgtggtaatttaaattccattaaactcaggttcataattttctattagattctcatagtttaattaaaagttttcagggataagttaaaaatgagttctgtgagtttagctctaaaacttcctgtttttaggattcatgagtggctacctgggctattgtaagcgtgtagaacaaaaagaggagtgtgtgaaactggctgaaacggaggagacagacaagtcagaaaccatggaaacagaggatgttcctacatcatctcgcttatattgggcagacctcaaaacactgttgtcagagaagttgaactccatagagtttgctgacaccatcaagtaagctcaacttcccaagttcagtcctgatggaaacgtttttgttgggggggtagggagacttgaaaggctttcagagggtcctcctgacaatgtggaactatgctgacaggaaattaggacttacctggagagcctcatagcctcctttttcttcagaatcgttttatcagttgtagtttagtgtgggatgtcagattttcttctgttctaatattccttttaaaaattttttaaaattaaaattactttttatgtattatgagtatagcctgcatatatgaatgaatgtgcattactaattacacttatctcctagtgcctacataagccttatagatggttgtgagccagcatgtgggtgctggaatccaaaatggttcttgcaagaccaaatatgttacatcccagagccattacaatcctctagctctctttaa

SEQ ID NO: 24046 - DNA, 1262 bp, Mus musculus
agatggttgtgagccaccatgtggttgctgggatttgaattcaggacctatggaagagcagtcagcattcttaactgctaagccatctcgccagcccctcataggtttgggtttttttgtttgtttgtttgtttttggttttttttttttttaattaatatatgtaagtacactgtagctgtcttcagacactccagaagagggagtcagatgttgttgcagatggttgtgagccaccatgtggttgctgggattagaactctggaccttccgaagagcagtcgggtgctcttacccactgagccatctcaccagccccaggtttttttaaactatagtgtgtaggtacatgtttggcctggtatatgtggaggtttgaggataactggcagtgagttcttcccaccatgcttgttgccttgatggtaaacccaaaaggtaaggctcctgctctaaatccacactagtataacagcctttctttgtcttctaggatgcagactatccttatttgggcactagattggatacctatgaggcattgactcagaaagttcctcagctcaaccaaatggttcgtacagcagcggaagtggctggtcagctcattattaaacttacccatgacgttgaattgaacctggactatgagatgtataacagcaaactactgtcatttatgaaggatctgaaccagttcaaaacagatatcagggtaagcacctaaattttcttttatttagatctcttatacttttaaaccttcctagttaccttctggtaactgtcatttcttctctcaacttgtatgaaattatgggtgtgggtgtgggtgggtgtgtgttttgtgagttctgaggcagagatttaatgttaatcagactggccttgaacttggaacaataatctgcctcagccttcagatcttggaattacagttgtctgccaccagatccagcttccccctctcgtgtgcactgtattacaacaacacttggctagatcagccttttgtatggcacatgaatgagatcatgtagcaggtgtatccaacctgtggcccagcaccacatttatttggtcaaggatttctatgactgcagcccaacacaatgataaaccttaacttgttatgtctgcactttaagttcacctatgtcatcttgagcatgaactttgtagatgcaacatcatttcccaatgtcaaaaatcggacatattgagaatggttgttgtgtgtgtgcaatcctagtacttggaat

SEQ ID NO: 24047 - DNA, 1213 bp, Mus musculus
cctgtcgccctatgtatctccaagagagtctcctttccgacatatcttctggggctctggctctcacactctctcagctttagtggagaacttgaagcttcgtcaaaaaaatattactgcttttaatgaaaccctcttcagaaaccagttggccctggctacttggactattcagggagtcgcaaatgccctctctggtgacatttggaatattgacaatgagttttaaatgtaacatgcataattaaataagagcagggtagtctgtttctagacttgtgttggttgtgctaaattttcattagagctctaaaatctaatgttaaaattctacccaatcatctaatgtcttaggcagcagcttttagtgcggggttggacctacacttcaagtacaatggataacactttccatgtttgtgatatcttctcagattatctttaaaatttttgagtcctttgtaataacttcctctttgcttcatggtcatgaaaatgtcagaaccagttgtaagaacaatgctatatgtcctgagggcattaactagtgtcttttgaggtaggagaaagagtgtgcttgtggagggtcaacgtggtagttgggtagttggagattgccccgtctccatctgatcttccattgagctgtatgcccttaaggatgtagctggtttgcatttccctaaattagacagtaactttcagaagagatggaacttgttttcttgccagcaaggttgaaaataggtccttagctggaccaatttgtctgtttacaggaataagtaaggccttactggttaaccttggtgttctttatgatgagaccagaagccaaagacctcaagttttctctcctcttggcatctgccctatagtctttagttctttgtttttattttgtttttctttttttcccaacattttctgaaaaagaacaagttttagactcaatttgtcagacttgaaaagaacacactgccaagttttggccaaagtgttagtcttcaggaaagctttctatcattttggcactgagatatttattgtttatttatcagtgacagagttcactataaatagtgttgttttttttttatatatagaagataattatcggaagcagtgccttccataattatgacagttatactgtcgttttcttttaataaaagcagcatctgctaatgagacccacagatactggaagttt

SEQ ID NO: 24048 - DNA, 1774 bp, Mus musculus
tacttacatctacaaaattttacagctcaatttattcaagatgtaactcaaaatcaattttgcaaaatttccagtacctttgtcacaaacttaactcacattatcgggagcagtgtcttccataatgcataaagaacaaggtagtttttgcctaccacagtgtctatatcggagacagtgatctccatatgttacactaagggtgtacgtaattatcgggaacagtgtttcccataattttcttcatgcaatgacatcttcagagcttgaagatcgttagtatctaacatgaattcctaacttcctgtagctccttagttttagttgcaaaaaacatttgtggtcattgagcatttggtgggtaaaatcaactgctgtaaaatcattacttccaagatccttttttaaaatgtgggtattttgttatctctggtttatggaataaaagcatacgtttataatgtttgctggtgacaaaggaatttaactatctccctttatttgcatgttacatgttatttcctaaatgtagttcttagaagtttgaattcatttttggtttttgggagggtagaaagtagagaataatgggtgttgggaagacaaagcttgcaaaaggatctttatgtacctgctcatcactatggtggctatgaattatgtaggtaatgagcaagatcacattaacaaagactagttaaccatcattacgcatctaatcagttttgccatggggtcagttcaaagctgccacctgagaatgtcactaggctctcagggtcttggcaccactcgcccaagttatatccaccagattattttgagcctcactgagttgttttgctactcagtcccttcagtcttcacagtgtttctcttgtaccagtatgagtatcaccgtgcataatgggattccaagtcttgaatgaaggcatgcattttacatagacgtctctgtgaaataacctttgttgtaagtggtgtttccagtcaaagcagtaagttggtaaggtttagtcttgggtgaaatgtggatctgagtaataagtagcttctgctacttatcaggttattgttggttaaaatgtagattttgaagataaaaatagatcttttgtcatgactcactgctagaatttgcatgacctttactgtgttagcttttgaatgccttttggtttggacttgccaacctatactgtctttgctgaaatgcccttataaatgtatacagctggtatgtaacaatgtgaagattccttacctgacttaataaaatacttcgataatactgacttgtcggactcatttcatagcaaaactagctatagagttcttatatcctcctccactatcaacctcaccagagtagtagttacgcagacacactgatctcttgatagagattctaatctagcttcttgtccttagtatatttacatagattctacagcaacaaaaattggtcttattttgagcctcactgagttctaaaaattgggcctgaaaagatggtattaactggtcttgcagagggcctagcttcttagcacatatttggtttacaagtgcttataactccagctacaggatctgtttgttaccctcttctgggatccacaggtactgaatgcatgaggtgcgatggcaggcaaatatgcatacaaaaatgcccattgcattgagtctcattcccaaagtgttttttctttcgtgtctttcttactctatcattgtggcaatccatcatgacagggaagagagacatgataca

SEQ ID NO: 24049 - DNA, 1620 bp, Mus musculus
agaaggggggaggcggccccgcagtgcaggagcgcggcgaggcccgtgccggggtgcaggagcgcggggagggcagcccacgcaggcttctgcggcagccagaggagctgcccgagttggctcacggcccctgcccgcgcacggaggagctcgaaagttcggacgagcgcagctgggagagctgcaggcatctgggcggggaggcggtggtccttggagcatccctagcgagtggggacagactcgagctgctggggagagccaggcctgtagggccccgagggcctgaaggagaggggcgcctgggggtgcaggaagcaaattggctgcccggggtgcaagagggccaggtagtgtgggctgttcaggagacgtatctgaacggtaaagggtcctcagggggagagggattccaagagggacacaggacccgcaggcgcagacggcgaaggaggtggtaatcggcaagctgccttccttgctggcatcagggttgctctagtgccaagagtaatgcaggaagatgtaggggattggggagcagaagagcgctgtgaacctgacctttggaagatattgctggagggtaggcactggcctgcaagatcctttctgctacctcaagtctgagcatcctcgaagcagtgtctgcctggggacagctggaaactcaggtacggatggccaatattgttatcggagttgatatgattagaagcatcggagaatgggttccaaacatcccttgtcctctctagttgaccaacctgggcatcacccctcacgaacacacacatacacacacgtacgcacgcacgcgcacacacacacgcaagcacccaccacatataattgtaagtagcagctgctgtagtggagtagtcaccgctttcaagtctagactggatgtggaaccatttgagtggctgcctggtataggcagagggaagagaaggcaggatagccccagggactaagtcatccccttcacctatctgctggtggaggtaggtgtgtctctgtgcaagctgttgtgcaacctgcatcaccggcctcaagtcctcccgaaagggaaaatggatagtgttgcattagccgctgtgccttatcttgtagtcctgttgatcacgtgagtgtggcagccagtagtgacttgggcacgagcctggcctgcgccttgccacacggttttgtcacggttgattatgctgtgggcccaaagccaaggatgggtagaactgcagagagcaactggtgaggtcttcatttctgaatggaatgggaagggaggttgtaccagcggctgctacccatgccttgacctcactctagaagctggcaaatagagaagcctgtggtatcctattaagacctcctcacctccccgcgaccgtggctccttcttggcgccgcctagaggtggagcctgcaggccaatgggtagatttgatttcttgttggcatatgaacccacctctttcctggttcaggtggtcttggttgacagcttacagcctctgtctttatttccctagccgtgtcaaaagttcttgcacttccagcccacctgtgggatggatccagagttactgtctcagagccttcaccaggaatatctct

SEQ ID NO: 24050 - DNA, 1078 bp, Mus musculus
aaacagttttatttttcctttctaacctctgtctgcaatctgtttccttttcttgtctgttcattacagctacatcatctgtcataggagaatggatacctcagtgttgatccctgagggaaacactttaagtccttcactgtcaagcatgctgtagcttgtaggtatttcatgtacaaatgcatcggctggaaaactctcctcatctgcctgttgatgagaggtgtttgtttgttctttgttttctgtgacagggtttctctgtgtagccctgctgtcctggaagtcgatttgtagaccagattggcttcaaactcagagatctacctacctctgcctcctgagtactggggttaatcagtatatggttggttgttggacttgaggctttgtgtcggtcagtggaatttctgttttgatctgttaacatgaattacataatagtatataaatatgtaccacttgtaagtaatttgttaacttttgtttttgtttttgtttttgtttttgttttgaggttgggcatctacaacccagactggccttgaacttgctaaatagcttaggctagtcttggaatctgcatagcctcctgcctcagcccctgcttccctagtgctgggattataggtctgcactccacgcctgggttgctaagctcttttgtggagtcaggcatagtgttgcatgttggtagccctggcactcagaatggaggcaagagggctgggcactcagagtgtgcatcttttactttctgtagtttactgtcaagtgatgttagagtaagaacctgaaatgatatgccatcatttctcctctctttgaaccagttatattacaaaacccataccacactggcactggttcgtttaaataagaaccttaacttctaagctacaatgagtaataataaaaataataatctcaatagttactgctgagagcgagcaagcactctcctggagtggtaagtgctcagcaccattttcttcctaccccctgggtggtccttccccagtcttgtcagtttcttcacgtgctgagagccatgctcagcagattcctgaggggacct

SEQ ID NO: 24051 - DNA, 1170 bp, Mus musculus
ggctgaggaggcagaatctcccctctgaagttgaaggggattcaccgtgaaaaggcttccattcttatgacgcttctattcctgcttctgtaccccactcttcccctggcactctattctcccttccccagttcctcaggaagtctgggatgcctcatagatacaggcgtccatctggtcgacccatgtggcagtctgagcccaaatctggttccctgtagtccagtaagaaagctgttttatgccgggcggtggtggcgcaggcctttaatcccagcacttgggaggcagagacaggcggatctctgagttcgaggccagcctggtctacaaagtgagttccaggacagccaggactatacggagaaaccctgtctcaaaaaaaaaaaaaaaaaaaagaaagaaagaaagctgttttacactctgcctgtgttgtccttgggtagggcgaaagtaattgaaatgattgacagcccctctttccataaaggaattgtcttctttggattgaaaatagtgaggagcaacagggcctggtggtacacacttttaatctcagtatttggaaagtcaagacagtcagagtttgaggccagcaagggctgcgtcatggtagggggaagatgatctgacttgttcctggtgtccactgggcagccaagtggcagcagctcctggggaaggaggctacctttctgtctacgctgtacctacgctgtctgtcacaaaggctgaagtccttctaagctctctttattatatatatctcttgctggattctggctatttacaaggcaccaaccacattagaattctgtgctaatggttatcacaatagaattatgcaattacccaaagagttacacaaataataactctttaaggactggaatatactattttttaaatttatttatgtgttatgggcgttttcacttgaatgtctgtctatgcacaatgcaccacaccagtgcagtgcccacagagcccgaaagagggagtgataatccctgggactggagttctagacactgttgtaagtaagctcatgtaagtgctaggaattgaaccttcgtcttttggaagagcagccagtacttttaaccactgagccatctttccagccccgagatgaataatttctaaaaatacttttggctcttccatgca

SEQ ID NO: 24052 - DNA, 1099 bp, Mus musculus
gacgtggtggggtgcatatgagaggtggataatcccgtgttgtagcttggggaggagctgtgacctccacttctttgccgagatgttattcctcctgtggttaccagaggagggaagcttgcttgttaggttgccatatattcctaagaatatggtaggttgttttggaggggaaaaaatcgtcttggctggaagtggcttgtcacatctacttctctgtgggaatttgtgacttcgctgttgctgttggagagagagagcaaggtgggctggcgccttttagctacatggtatggagagatagaggagagattgacgcacagtgcaggtgcttgtgtggactgggtccccagacctcagaggcagtttgggttctgtggatttcatggcagtatagtgttggaggtgagctggagaaagcagggagggggaatggttttgaaccttcgttcagcccgccagggcaaaacaggatgggcgagtcacactcagcctgctctcgcatcaacccgccagccttggatccttgtagctgttctgaagactaatgtctgtcatcgccatggcgagataccaaggcttccgtacagattagaacccaggacctggcagagccctctccctgccacagtggctccgagatgggcggtgtgaagaggaagcctgctgggaactcagtaccctcccagaaaccctgtcctttgccttgggataatggcaggagtttctagacattttttttctctgccctgtcccaggaagggggagtgcttagagctcagctgagctctaaatactagttggaaggagtcagaggatgcctcagatgccataggaatgagaaggtgcatggggtgcgcgcgcacacacacaacacacacacacacatgttaccttagggccctgagggttggcgggagagaaaagcctctgcaatggcacttgctgactggccgtaacctcaccccaggactcactgatgcaatctttcccagcatgtgttgaagtgacctctccagcagtctaggctctccagttctgaggttggccgagctctctcagtcccaggctcaatgctgttttgagaggaaaggtccag

SEQ ID NO: 24053 - DNA, 1323 bp, Mus musculus
agtggggaagggctattgctgggaggccccctcccccaattagaataggaaatggttgtctttccaagtagagagttcaaactctggaagagatcctggaaataagagtctgggatgctgactccccaaaactttcaacctcagctgcctccctcgtgagccagctgtgtctccctgagctggcagccagctggatggggacagacaagaaagcagtatacaagaaacaggggctccttaggcatggctgggtgtggggagctgggacctggggagcagaaaagaacttcctgcagctgtcaggtgtatgtgtgagctgtaacaagagggtgtagagcagctggcacttgtgaggggcatagggaccatttgtcagctgtaagaatatgggggcacacaggagcttgacggagtgcctccagatcccttaagctgaggctgttgtgtgttttgggtgctgtacaagatacatatccaacagcctgattcctatagctttgaggtagaactatcccagtagagggcttaggacatgtttgtttatttagagggagttttggatctttgccagctaatctggggagtaagcaccctggttgtcgtgggcattacacaaggcaatcccaggggaggggtggagattctcatcatcctccccccaagctcttggctggattgtcccactctggcaggctgcctgcctcctatttccgtcgggcaccagggtaacagggccacattagcgtctgagccaggagacatccagccaaggttgggatgtgtgtgggggagggtctctgagggatctgtctacagaatctgggaaagactcccatagacccagaaaagcctttagggggcttgtagcccccttttatatgtgctgtttgattcacagccacactgagatcccaggggttctctgcacctacgagggagacagggagccttgtgtagggggagtcagagggaccagtgctgggaagaagagtgcccccccatccctgcccccccattcctgctgtcctcttggctgagattcagaaaggtcttttttcagccagtgtcagagccgctcagctggggagggagggaaggaggacaggcgggcaagcaggcggtgggggaagcctgggagtaggaccagaactgtgagcactgcactggagacaggacagaggacccagcctgcgaccagctgtggaaacccagccgggcttgcaggggagcaaagccaccactccattcttccatgtttccttcttctgtgtgggatctgggggatttctaggacaggttcccccccacccccaccctctgggc

SEQ ID NO: 24054 - DNA, 1201 bp, Mus musculus
agccagaggccatggacgacttcatccgggaggtcaatgccatgcattcactagaccaccgaaacctcattcgcttgtatggtgtggtgctcacactacccatgaagatggtgagtggctgggtgggagggaaggccagagggctacctgcagtctgggctcccagacgcactcttcctcctgcctgctccagtttcccgccacaagtggcaaaggggtttaccagggtactgcctagtgctgtcatctctggattttctactgctcactggcaagatgtgcccataggaatggctggcccttgacatgagttatctttggagtttttagcctgggcctctttggaatgctttattctggggtttagattcttgggggtgactgaagggacaggtcagaaacgaacatggagttcgttcattggagctatggtcgacctccagaaagagactgggaactttgcctttgagagagtggcatcgatctaccggatttatcctgtctgtcttctgtgtggcctcaggtgacagagctggcacctctgggatctttgttggaccgcctacgtaaacaccaaggtcatttcctcttggggacgctgagtcgctacgctgtgcaggtggctgagggtatggcctacctggagtccaagcgcttcattcaccgggatctggctgctcgaaacctgcttttggctacccgggacctggtcaagattggggacttcggactgatgcgagctctgccccagaatgatgaccactatgtcatgcaagaacaccgcaaggtgccctttgcctggtgaggggcaagtgttgctggcttgtagggcccaagctccactccagtctcagcagatccacacctccaacttctggggcctctgttacctaccacaggactgtctgcctcggcctgtccttctcatttctgggcctgggtgcctttcttgaagacttacatgtttgcacatccacccaaggaattctccaggaatactggaaggcacaagcaatctaaagggcatgtacttggtgggggattaaaaggcttcctggaggacttgctgttaagtttaaaacatatggcaagcagccaggccaggatggtcagtaggcttatctgtgtagagctggcggcaggcgggaatagattgcaccgtatcttgtaggcagtgactaactagtgacctccacgttgc

SEQ ID NO: 24055 - DNA, 1140 bp, Mus musculus
aagtttatgtatgtgcacacttacaaaataaagcatacagattaatattaattgaaacatttatcaaacccagaagtggtgaggcaggcagggttgaggtcaggatcctctcaggaagcaagcgtggcccttggggggtgggggtgggggtccgccagcctgtgctgcaagcttgggcactagtcagaagcaaacatagtgtggccctcagcaagcagcgacaccctttactaagctgtagtgccctctgctggtggttgtccctaatttatatcctgagaaacttcctgaccttagatactccagcacacaatagtcatagtttatcaaaaaagatactttagaaagttctggaattaccgcctaaaactatttttttaatactttgcgtgatgtctaaaggcagtaactccctctggtgaccttggatttctggttagctgtttaactagctcccgttctcttgttgatggatgagcttttgggttatttcctgtctttcagacgctgatggttgactggagagcagtggtctgccctaaaagaacctcttgaacctgtctgtgggacaagggtgggggagctgccctgcctcaggcccgaaggacccacaactgcctgcggctcccaggggacagtgagacccaggcagcaggaggctgggagcctcaccttgcccacctcgctcacccacccagcgctgttctgcacaccttggttcagccctcagtgccccaagaggtgggacgttcccagccttgtgaaggcaagacaggaagctgcctggcaggctctgtgtggcctgcctctggctccagatcaaggctgggctggtggctagagtgtgccccaggctttcctctgggggattagactgacaggaagccaggcttgacatggacaagaaggatgtgttggccacacagcagggcgagccagcaaccaacaggccctcctcagggctaggccccttcccagggaacccctgtaggagtgtggagtgttggacagaatgtgacctgtagcttcactgtgaacttgtgggcttggctggtcttaggaacttgtacctataaacagcctgaagtggctcagaaacagaaaaggtgccaggatcttctctggcagggaccagggccc

SEQ ID NO: 24056 - DNA, 2864 bp, Mus musculus
atagacagggatgactttgaatgaacgatttgggatactgaaagagcaaagagccaacctcacgttcagcaaaggaggaagccgctttgtgactgtgggatagatccgtgtccaaggaactttaagtgttgactgtttgaaaagttgatttgcttgaagagttcatcggagaagttcaagaaactttccttcagaatattcacaagcctaaataactttatttttgaaggttattttgttttggtttggtttttttaatgtataaataatgccctgaaagaatagcagggaatatacctatctgttcttaaagatttcatggttggcccatacaaagcaattctctgttgacttctttgactcctcctgaagcagaaggaagacagaaagacagacattgattatttttatgagcgtgggatttaggatctcatcacttttatccagtttttaggatttgccatggtaaatcttaaacttgagaaataagagtacacctctgtgttgtcacttacccatttatgtatgtgttggcgtgacaaggacagctgcctttctgtcattactggtgttttctaaactgtaggagaattttggttttgacttttgaggcttatggaaatatttagaacttggttcatttttcagttattgttagcttaaactccctaagttctaagaacttagtattaaacttttaataaaaaaaaaaatgtggctctcaggattagtctcaggccaaaatgtgttagggctgtaaatgcttatttacaaagttatctgctaggtccttggaggagacgcctggtgtggaacctgatggtctgtgttcagtataaatggagaagacatgaaaggcattggccaacggacagattggacatgggaacaataaagcctgagtcatagctctgccatctgggttgacttctgtcctgagtctagtgtctgtagattcttctataaatgatgcttacaagaattacaatttttaaaatgagttgaatcttgggtattttgacaatatacttactagatatataaagtcctatgtttcatattcaaaagttttttttgtaaagctcttaaactcagtaagttcaataatttataactccccaaacaaaaatctacttatatatgtcacaaaggagagaaaaaaaagtaaattataatgaagttacatttaactatacacactcactccgtttcttctattgctcaaagttcaggcattataggaaaaagggtttttttgttttgttttgttttttcttacactggaggacggtctgctgtgccgagatagtgctgagattgctcagtcataggtcataaattacaatgagatgccaaaatgcagcggcgtgtcccagctacagattatcagtgctgagagtgctcacatggtcataggtcataaattacagtgagatgccaaaatgcagcggcgtgtcccagctacagattaccaagtgtggtcattttgaaacctgaccttttgttttgctgtgatttcaagtttgagtgggtgtttaagtctctgctgttgatttctcctgtaaagacagagcattatactcctgcccgccttcattgtgtcctagacttcattgtctttgatgttcttcaagttcttactggcttgtgctagttgtgggaaaaacagcaacaatgtcatgcttataccaaagatctaaatctttcctcagcatctgttaatctgccaggacttggacttgagaggggtttagaggctaatcacagaatttgaaagtaagctccagttctccttagctgtaatgcttttcattgaggccaaggactcataaaacatttttgccaatatgaatatttatatttggttcagaaacaaaacattttagagtggtttgctggtagcttattttaaagcaaaggaaaaacaattgagcatgaacactatctttggaacaatttttaaaatatgatataaaagtttttgtttcttgttgttttaaatattactatacagaggtattagtaattccatttttggaaaatcttaaaaatcgcccaaatgttgacactaagtacattgaaaaacagtgtctttggtatagtaaatgtttgttcttcattcatctgtaacttaatatttgttcaaattttgcctttgatacaactaagttaaaactcttgagtgctgacctgttgtatatacacaaaacaatctgctttgttggagaaaaattccctctcttggaatgtgattgtagtcatccttgttcagttcttgaagccccccccccctttttttttaattttatttaaacagggtgcaacgtaaaatttcctttgcatcaaggtgtatgcagaacattgatgcagtgcatcacgacgtgagcgtttgtatttaacgaggaggtgctttacactgtactttttggtgttttttggaaaagttacattagatttgttctgaagctgttcatttttgacaaataaaatgtaacaggtttcacatgagttattctgagctataaagattgagttgtggttttttagattgttgtgtgttacaaagcatcttatagtggttttatatatgatttctgggatttgaagttgctgatcagctaaatctccactcttggtgttcctctgacttttgaccatttcatgcatgggtgacctgaggttccaacatgaggccaccaaggcgaattaaagatagtcacattgttataacgcagagcacagaagtagatgagcctttagagatgatctgcgtcagcccctcctcttacatcgtagttaagtgacacccgacattttctaagacgtacatggaacatgggtcatgttttgagcctcatgtctta

SEQ ID NO: 24057 - DNA, 1100 bp, Mus musculus
aggaagtcagtactcagaaccacccgtctgactgatgggtgcatgtggtcctgtgtgtcagcatcctggggtgtgtccttcatgcgatgctctcctgtgtgtgtcccgtggagtgcgtcacttgtgtacactgcttctttttgacattgcttattttcttcaccttcctagtgttccttcccatccagaaggtcccagcacactgatgacagtgccttgctagtggtaagagaatgcagaatagagtttacatgtttgtagagtaactgttgtgctttactcagaattgatgtaaataccataaaacaagatgggcaggcaccataactaaattctctataaataaccagaccgctctctctgtaactacaatctaggcaggcttctagagtttgactcttacatctgtctaatgcattgagaacccttctggccttatctgtgatgagatatatgtaataattagttttttaaatgtcttttctaattttcagttaatcattaatttggctcatgagtcactcctgtatgttaaatggagtcccacactccatgacactaattatatgtgacaacctattttatcatgtatttggtttctgttgttttcatttttacagaatgttctcccaccccttgcaaatacaagctgcgtcacacacagacactggcttgtcacacatgcatgctgccactggttgcagaagtagtgacaaagacttcacttacaaaagtgaagttcaggttctcacagttgaagttcttccatggtcacctttacctcagaagatcatggcctgcagtgctgcctcctgacagttgggaacccaaagaccatgaagggctttatttaaatttaatcattcttggaagagaattcaaccatttataaaattacttttcccatcatgttttatgctactttctttttttttttttttttttatgcaaaagtgttgtcggtagtcacttctgccttaagtgttagacactgccttcacatgtgctgagagcaacagtgctttagaggctcctacaatataacctgcactgggctcaggattctgtgcattctactgccttccttcccactaagatgg

SEQ ID NO: 24058 - DNA, 1294 bp, Mus musculus
taggtcagcagagcaggagaatacaagttgtttttatagttaacacctttaattctagcacttgtgagtcaaaggcaggtaaatctatgagttcaagcttggaccagccaaggctgcatagcgagaccttgtatcaaaaacaaacataaaaaggcacagcaaacaaatataaagtgttgggcgagtgagaaggtgcaaaaggtagagtttgccatacaaggttgatttctggaacccacacacaggggaagggacgaaccaactccacagagtgccacagcacatatacccccacgcccccacgccatgtgaatacacacgatagtagtaaaatatatagatagtaaaatatatatagtagtatatatgtatgtatgtatgtatgtatgcatacacatgtatatctttaagctggtcatgctaggtcacacctgtaatccaagcacttaagagtttgaaacaggaagatcaggagctcaagggcatcctagatggatatatatatatcaagtttgaagtcagcctgtgctatgtgacaccctgctttaaaaaatgataaagttttcactgcctgaaaaaaagtttggtctacggccataccaccctgaacgtgcctgatctcgtctgatctcggaagctaagcaaggtcaggcctggttagtacttggatgggagaccgcctgggaataccgggtgctgtaggctttttggaccaaaaaaaaaaaagtttgaatcattttaaatatttaattttttatctcttgatcttttcaaattcagtgtagactctatattatagaaataaaagagactagacttttctgccaaaaatcatatatcatgccatttgaaattctgggaaaacttttggcgatagtggattcctgtaagctttgctacttaagatggaggagtgagtgatgggagactacggcctgtgtcccgctgatgaacgagcccttctattgatgttcccacaagaggtggaaagtgtggggtgtgtgggcttcttggacaacagggcttccatgcactagctaaactgaagaatggatacacaagttgtatcagcatataacaggaggttgtatcccagttgtgaaacactggcctgcattcctggaatgtagtaaatgctgagggagaggggggactggggagacagtctctcctcttccctcatcaattagaaatgtgtcctgtggggaatatctcaggaaatctcccgttctaccccacacttgtatgtttccagttgcttctgctggttctcatgtgatagcaatgtgtactg

SEQ ID NO: 24059 - DNA, 1804 bp, Mus musculus
ttccataactcacttgattattatggggtgggggtggaaggacctgtgttcttcagttctgtgatgttcatcctgttttctttttgtttgtttgttttatgtcacattgtcccctttcaggagcaattgtgcttgcctctgcacattttagaagagaaagggttgggccaggttgcagtgacagtccaggccctcctggagcttgccccacccaagcagccgccaccgcagcagccgcagcagcagcagccacagctctctgctgtctgaggactcccagggccctgcatgttggcaccatgatggcacagccaaaacaaggagcaggaagacttgattgctggcactgcctgctcagggcgagcccggtgtgttcctagaagcactgtcttcatgattcctgccaggaatattgtgttccttttctccattttaggggagattaaacccgtttccactatttttcgtttttaatgaagacacagtttttttaagtggaacttggattactgaagacctatcatggaagactaagctggctgtgctttcttcatagggagcaggctcgctttccatgccagagccagtattttcatagttggatggtaagctctcttagaggacagacatattatctctgccagttcccaggtgtctacagctcaatggtttccacaactggacttcattctctggagcatttgtgaaatccagatttgcatcaaaggttgggatgtggccggagaacctgcatttctacagacattgtttttctcaggcagtggagaccactgtttgaaggcacacagttctgtggtttgagggcaccacccctactgcattttcaaccacatttcaatcaaaagctgtattatgatgacttggacttttctgtcaaagagagcaaaaccatggagaagccctaggttctgctcagtataacaggtaactaaggccagtacccaggcccttccccaggcttgcccaccaccaccccatctttttctagacagtggttccttgctcaccctgctgtttcctgaacagacacactccacacacagttgtaagctctgaagtgtagcatgcactgcccagcaatgtttgcatttgccttggtgaaccctgcgttctgatcccaggctcctggaccaggcacagcagactcggctcctgctcctgggactgaacacaaagctgagaggactgaaggaaagacggttcttacagtccatgcaggtaacagccagtttccatagctacaagaaagcaccgagaacagcttcctgtctttcacctgtcccctccctaagaccctccactgtgagcagagaacagaaggtccaagggctccagcacagcggaggagccttcatttaaacacagcacagagccttctctgccccagagtttggactctttagttgttgtatctttggtgtttgctgcagttagaacccaaatacagtaattacataaagctgtttgttctatagggttttccctatagttgttaacttttgtgggtttcttcccaaggcttgcatttcagaatagtattaccctgcacagcacctaaaagtaactttaagactggaccagggttccatccccagcatcacctgaaaaaaggttcagagagacgcgtggcctgggattcccaacatcccaaaagtggaagctggaggatcaggatttgaagcccacaccaggcgatgcaagccaccgcccactgggctgtattagactttggctggagagctggctcagtaggtaagagcacttactgctctggcaggtcagg

SEQ ID NO: 24060 - DNA, 1158 bp, Mus musculus
cctgggtgagtacgtatgtacataaaaattcagatctcccctctgagagaattcatgcacctgcacacgaatgcacacacacaggtatacacacaaagaaataattcaaataataatgaatcgtataatgaaaaataatgaaaaaggcatcatgaagagggctcctacctattatgccagaaaattttgtaggtgaaagatcactattataaaccagaataaaactgtgacgaagttttattcctccaactgtgggtcccaggagtcagactcaggtcattaagcttggcatgaaccttgtgccaggtgacagaggccatgagctacagactgcttgcacgcttaaactcactgagccatcttgccagcctgatctggaattttctatgtagagcaggctgtcctcaaagtcactgaaatcttgtctctgcattcccagtgctaatattacagacatgagctcaaaaatgcccagaagtcaacattgaaaatataatgacgggctggagagatggctcagccgttaaaggctaggctcacaaccaaaaatataagagttcggttcccagcacccacggctgtctctccagccaccttttttatcagccgggcgtggtggcgcacgcctttaatcccagcacttgggaggcagaggcaggcggatttctgagttcgaggccagcctggtctacagagcgagttccaggacagccaggactacacagagaaaccctgtctcaaaaaaaaaaaaaaaaaaaaagaaaatataatgacacagtaaggtttctaaatattcacaaaagtaggctgcaacatattcaacaacaaaaacagtttttattaaacctgtagtgggttagtctgatgtattcaaatattaaattttgtaccccaaggtcttgttccaagatgagcagatcctcacgtataccaacttttgttgtataaaccttgccccccccccaagttatccatgattgcttagtaaagatgcctacagcctgtagctgggcagaagagagggagaggtaggtggggcttcagttcccaggcttgatgtctgaggctgggaccatgaggggaagggcagagaggaggagcaagggaggacttgccctgggataggcagatggtgagcatgtggccatgaatgacagc

SEQ ID NO: 24061 - DNA, 1199 bp, Mus musculus
tttggaaaagtgttccttgctgggttgtgagtggtctccaaaggagtaataaagagcaactaggttagctcactagattcctatgtacttaatattggaaactactttttaggggtgtcagtcttggatttattataatctaaattgttttccccaaaagctacttgtgtgtcagttatgtggtcagcagtgaccactggaaaggttaggtgtctgaaaggagcggcacaggggtcttaggtactccgctgggattttttttttttttttcttcgagacagggtttctctgtatagccctggctgtcctggaactcactctgtagaccaggctggccttgaactcagaaatccacctacctcagcctcccgagtgctgagattaaaggcgtgcgccaccacgcccggcgggatttttttttttaaaagatttatatgtaagtacactgccacgcccggcgggattttttttttttaaaagatttatatgtaagtacactgtagtctttagatacagaagagggtgtcagatctatcttgacaaatcaccataaactgaggtggggtttgcaattttgagaactgaaattgaatggacaataagtgctgctttaaacaatttctagaattccatctttaaagtagttaggaagcccagcagtggtgacacgcctttaatcccagcaattgggaggcagaggcaggcaaatttctgagttcgagaccaacctggtctacaagagtgagttccaggacagccagggatacacagagaaacccagtaacaacaacaaaaaagaggcgggatgggctttggaagctgaatagttatgtttacaaagttgagccaatgttgggaattaagtatttgcggtaagcagagaaaggttgagactcctttaaggtataaggaatgacttacacatgctatggcaagtgacctttgcgcagacttcaaccttgtagctcggggctctctaactttccctgtgtagtgggtagacaagctgtcacatatgtaccataaccctagttggctgtccaaatagctttggtagttacgtgatggtgctggagtggactgaagggtctggttcacaggaccagctgtgggccgagcgcttagctgctacggaatgaagtggcagcagcagcttctgaatgcgccgctccgcacgcccgaccgctttgcactaatcc

SEQ ID NO: 24062 - DNA, 1161 bp, Mus musculus
ccaagtgtttataaaaactgactacctcggtgttcagttcaaacccgtcattgtaagtgttttaaggccctaggtgtcaaacatagcaagtgaattgtctcaggtttttgcagaatttacaggaaggaagcaaagccatgtgaggagccctgagcagggtcaggagggggcggggcagcctttggtggtctgtgtcgacccctccgattctctactgcagaacgtccttcccggaatacttacttttttcctataggattcttatatttttaagaccaaatggggattctaaaaatgttctaaattatgcctagcattagtttttagcctaagttggcttagagtttattgaaatttaaagatatatcataattgtatgggttgtaaatagttttaggaagatgcataagtaagtgtatcagagtatttctcacgaaatgttatcagcatcctctttcatattggatttatagattcagccaggcatggtagtcatgcctgtagtcccagcacttgggagatggaggcagtaggattatgatttaagaccagcctgggcgcacgcacgagaaagagagagagagagagagagagagagagagagagagagagagagagagagagagagaatatgagactcaatcctaccctaccctgccaaataaggggggggacgtaccatttgtggccatgtataaagcagctaggtggtggtctgaaattttacgctgtaaagccctgtgactaacacttggcaaggcctaagttgcagctggccctgctcagcgtcccggagtctccagcctgcacagtgttctatgcctggccagctatgtacctagaagctgggtgaacagaggagagccagtctctgaagacagctgagttgtcccagcgtgaggtggacatcctcacagcctcacagctggctggcttcatggtgagcactagttctccctggcatggccttttgcctccagcccaggaggactggcgtgctgtgttcaatccaggttgctccttctgagggcagcgctgaactggaaagatttttttccctttttaaattatgttgggacatgggagggaatgcttttatgtttacattaagtaaaatagattttaaaattgttctttatttatggtggtgaactttaagtg

SEQ ID NO: 24063 - DNA, 1195 bp, Mus musculus
cttcgtggctcagaagatgtacagattttccatggttcttcccgttgtctttgagacagaaaagttgcagatggagcaacagcagcaactgcagcagcggcagatacttttagggcctaacacagggctgacaggaggaatgccaggagctctacctccacttcctggaaagatctagattcttccttcggtatttgtccttgtgggagaactttgaaattcatttatgtttgaactgattgtttgaactttttattcttttttttaaccttggcacattgatctatttgaacatagtgggaactttctccgtttctcatggagagaccccaggtatacctgtgccctacataatgaagtccctcacttacttcttcctgttctcactctgacactggagtacagccatgtggaaggttagcctactctctaataaattgctcctaaggaaggtcttacgtgctcattgtgggaaagaagtaagtacccctgaccataaggacttttttttaaaatgtctaggacatgtaagcaccgtggcactgacaaaatccattatacccgtagtacagaagtcaccaggaatccctgtgtgtgccagagagaagggaggctggctgtagctttagccagagggggactgggcagagcaggcactcatttcctctgcagagtttggctcttagacctgtgtatgtataaaaaagaagtcagcactcactttttgtatttaaatattaaaagaactcgaactgaaaaaaaaagaaaaagaaaaaaaaaaggtcagaggtggctccccgaggccaagaaagaaaaaaaaaatccttaatttctacaccagctttagggggtgccagaaatgaataagcccttccattttttcatggatgagaaatctgggatagccaaaggcgtattgactcagacttgaaccctggcgctgacctacctgacaaagacattagacctggttgccagaggctggccctcctgtttgcagcatcatcacaaccatggacctcctagttaaggatgctgacaaactcactgggccaaagtctgaccatcactacacctcaagctattgaatgggtatccaaacagcctccacttccaatcaatggctcaccaatgccagaatggctcattacactctctccacttaaatcctcctaggatgacctttcagacccca

SEQ ID NO: 24064 - DNA, 1188 bp, Mus musculus
gcatgaacctacagaagtgagaagagtagctaactttgtaattggcaatggggattgaagtcaagtcagtgtaactctccccctttgtgatttttttcattttatttttttatgggtgtgaatgtttgcctgcatgtatgtatgtatgtatgtatgtttgcatatgtgtgcactggctctattgaatctagaagaaggcatcagatcctctggacctggactcatcatggagctgccacatgggttctgggaaccaaacccaggtcctctggaagagcagctagtgttcttaactgctgagccatctctccagcccctctcaatttatgtgttaagatgaaccataagaaaattcttttttgtggggatattttgatatcattcaaggaagtaaggaaaagttcaagataaccagaggtcagtcttatagtagcaattctgaaaaccactctaaattaaagtgaaaaatgaagtagaattagagcaaatattaggtgctcaaaactcatggtctcgccgggaggtggtggcgaacgcctttaaccccagcactcgggaggcagaggtaggtggatttctgagttccaggccagcctggtctacagagtgagttccaggacagccagggctatacagagaaaccctgtctcgaaacccccccccaaaaaaaacagaccaaaaaacaaaacaactcgtggtctccttttcttggcttctcccccaggtttagagtctaaagatgtttaaaacaaaataataacaattacaaaaagtgacctaatcctttactgcttctcaaacaactcaggccatttgctctgtccctactaaggaacaatgagtacttttacgtctttcttccacctgagttccctgtaagtacacatgcttttagaattctttcttgagttctctgagaaagccagccctttcatccctgggccacagctgcactggcaccccactttcttgacttcctgacagaactttctctttgtttgtcctcagtgtctcggtggtggttggcttttctctcctttagttgcctaggttggcttttccccttttcaaggctgtcttacttgtgttgtggactctatctctttctcctttctgacctcagctaatggagtccgagtcaggaaatctttcaggaactcaagagccaggtttttaactacctgtctg

SEQ ID NO: 24065 - DNA, 1394 bp, Mus musculus
ttcagccgctgtgcctgaagtcagtgttcacacatcactgggctgttgtaccaaggcctctctcctctggaggccatgcctgtgtctgaggaaggccgtcagtgctctgttggaactctcttttaaaagtgtatttataattagaattgtaaccatggaggaatttttttcttctgaacattttaatatacttgaaaacaacattgacttgaaaaatttcagaacatttttcaatacctagttttattaaatattatacttaagagacaattttttaaaatgtgttcatgtcaatatgagattttgggctttctcaagaactaaggcatttaaaaaaatagaaaatattaagaagaaaactgttacttttccttacctattttcacttgtaggttcatattcagtattatgtgctatcctgagcaagtttgctttatctgacctctgttcactcaaaagttaaaacttcaacctgttcatgtctgtcagtaattcaattatgtctgtggctgagtacacgtaacatatggttttattttatttttcaaggaaatgtaaacactgaagaaagagtatgaactaaaaagcagcaatctgcattcaggtaaaaattggttttttataggtattttattggggttgaagaattgctggcgatgaacagaatcgtgctaattatggttttcatttattcaagtatttgctgagcacccactcgtggtgctgactcttgttactgcaagctaccttactgtccagagtggtgccttaccctgctcctgcccacgtggtcttccagtcagtgtgcaaatgcacctggcgctcgctcgtaggccgtgccaggcggctgcggctgcgctctgagaaaccgttctcttagtagggttcatagggtgaaaacagcgacaatgatttttcagcaaattgtaaattaaaagaattggtctgtgttcaaccattttaatgattccgttttcatttttgctgtgaagtgcactgaaaaataaatttcaaaatgagctgtcattcatgtgttgggaaaattgaaaaacaataaaaatagagaccagcagtgttggcgtctctttcataaatggagaaaagagtttgtattggtgacacacacctcaacccaaaagctgtctccaactgacagccactcgcaagtgaaaaattaattctctcctagggaattacacatgggaactaaacacttgtgaacccaaatggccaacacaggatactcagtggtatcttccggtttgtatttttatgtgattcctgaacaaccgtgtgtctcagtatctatatgttccaattggtgttggcttacggtctcagagcttcagtcctttatcaccacggtgggaagcttacagagtaaatgtagactc

SEQ ID NO: 24066 - DNA, 1239 bp, Mus musculus
tcgggtgccctcgttctcctcaccgaccgcggcctccagcacagcgccagggccacccagcggctccaggggtccaggctgcaagagcttctcggggtccggaggtgcctgctccatagctgtagtttggcaccgcgagtccagtgcgcctgcgcggggccttgactccagccgccccgccctctgcttgtggtagctccgccctgcgctctcggtagtcccgcccctgcccacagaaactcctcctaggcagcggagaccccagaacgctggaccaccagccaagacctgcgaccgagggaggtaggggaaagctagggcgactacagagggttggctacaaaactggtaatctgggagagccggtaaagacataaagaaactaaagtgaagtgaactcaagaagtgcagaagccactcagattggcgatcccctcaagtaattgtgtcattaaaaagaaagggagattgtcttgtgaccatcgcccttaccttgcattcacaattccgtttcccctcgcaaagaccagagcagcatcaattattaacttttagagagttgagtaacgcattcagcaaaagataacgcctaaagatttgagaggtaagatggctgaagcaggctggagagcgccattgttaagtaagtgtttaaactttagacgctaaagcaatttaattttctacaagtctcttgtaatttcctgaacctaccccttggcaagattccctgtggtgacctgaagagaaatgttcactgactgtagcctaaatatgggacctttgggttggtatttttgtacaaaacctggtctcggaccaaaactgattcttgccaaacatccttttccgggttgtgaagcacaatttcttcctcctggagttttctccctggcttggtggcaaagttccattcatgctcaaagcactttctcttgttattttacaataatttgttctaaatccagcttcctccagctagactctagacttctttaatgcagggaccccttctcctatcctttccctgttccttccttacagagcctggactatttatgtatttaggtattttattgttcgccagggattagttaggtccggcaaacccccagaaaacatgtttttaaatcagaagactttttttttttttttccgagacagggtttctctgtgtagccctggctgtcctggagctcactctgtagatcaccaggctggcctcgaactcagaaatct

SEQ ID NO: 24067 - DNA, 1783 bp, Mus musculus
cctgggagggggacatgtgcatgtgggtcctggtgagacacctcacctctcttcattttcttctcttaggagagggcctcacagtgctagcccaggtagagccttcctgtctttcaaacacagggtcatatcatctacaaccagggataattggacttccctgatcccatttgagttcctcttatttctcttaagatcaaggaccatattcaacaagagtatgagaccctgcagtcttccgacgttagagggatgtgtacagatgcccagccattgtgatgttggctgtgggtctgtctgctgtgtagaatcacattgtaaagtttcttttgttctcagggaattcaggtttggaccaatgctaaagaatgcttcagcaagatgtaaccccatgaagtgacttttctctgcaatcaaagccccaaaacgaagcacaagtaaaagaaaatctattgctaccttatacatagaagcatactgtacatggaacaaatcagctttctttaagcatagttgtgttcatatagcacaaatgatacattttaatgaagaataaatattataatttgaagttttggggactggtgctgattccaaaaaagttaatttaataagataaccaacagattgttagtcaggctcctgatccagtgcctccgtcaggatgtgagttaatctccatgtgcacctctcagtgcccactgtccagatctcttcacgggcagttcttcccagaccagacgcccagatttactttgtaggacccacttctgctatacagttattttatcttgccttagagttgagctgtttggtttgacaaagctcagcagaaacttgttgtgaagtctaaggttttcttctgtgttcctagatcctgtaccatctgcaacactagaaaatgccttcagtttgtgtctcaccaaaattttgatactggtcagaaattttatactgccaacaacgaagtctcagcttctcagatttgcagtggaatagatacattattataatctagaaattgctatatagagagtattaatttaacattattattctcagataagaagtgttaacttcggcagcagcctccatttcttctgctcggctctgtgctcatggcgtttcagggtacgaggtgtagcatctccatgtgtgagacactcgtagtgagcacatgtgagcggtaccgtcaccattaatgtgcgtttctgttgcctggctgtgatttttgtaaagataaatgatgttgttgtgctttagtgtgtgtttcatggcacatgttcagaagccaagcacactctctgccagcttgcagactcctcctaaccgtgcactcattatttctaatgttttaaaactatactcagtactgtttgacatttgacttttttacatgtttaaaatgttgctggatttttgtgctgtttgccaaacttatataataaaggaagtgttgtgtttatttccagaagatttgtattattttaagatgatccatgtatgtaaatacctgattttttgtgagaaaataatgcatgccatattatgttttaaagtggcctgatgttggtgttttgagaaacaagatactaaaattagaaaagatttaaatttttttgttatggttttgctctggtttgattctttttgagacagggtttcatgtagcctgggggcccagtcctggaagtagttttatagataaggctagacacaaaaacctatctctgcctcaaaagaacacctatctctgccacccaagtgagtgctgggattaaag

SEQ ID NO: 24068 - DNA, 1172 bp, Mus musculus
gtctcatattttggtgagagttttacctatatccataagtgatatgacttgtcttttcttgtggcatctttgtcttgtttcaatttcagtagcactaaactgtgtttgttttgtttgtttgtttgtttgtttggatattttcaccagggactctcaatgtagctctggctttcctggagctctatgtagacagactggcctcgaactcactgaatctttccctctttgttttgctaaaaataagtgaaaatttggtttcaattccttagttaactattaggtagaagtaactagtgaatccattttagtttggcatttctttgaggagaggctcctcatgagtccaattttctttaatggttgtataatcactttcctcttgattgagttttggtagcattcttagagcctagggtcaaatttaagagcataaaattgtttgcaatattcccttatcttttaaattcagggcctgtattgataatgtcattttattcttgatattgtttgtaaactccctttctgttagttttatagagagttgagggctgtgtgtgtgtgtgtgcgtgtgcgtcgttctgtctgtctgtataacaggtttaaaggtagccaaggctaatcttgaactcttttggggccttaatctgcctttaggccttcaactagctgaggatgacaaacatctgaccctctgcctccatctctgtggtgttggggttgcaggtgtgtgctcccacatctggtttgtggggtgctgaggatggaacattgggctttgtacatgctaggtcagccctctagggctgtctggcttataaatagatattttcttttctatttcatttatttctgctctacttgtttaaagttcattttacctttatagttatgtgagtgtgagcgcacatgtttgtatgtgtacgtgcgtgtacagaaccagaggtcaccattgggtatcttattctaatctaaaaatctttattatttttgtttttttctaagatttaaaaaacatttatgtatactttatctgcatatatacctgcataccagaagagagcatcagaacctattttatagatggttgtaagccaccatgtggttggttgctgggaattgaactctggaataccagccagtgctcgtagctgctgagctatctttgcagctcc

SEQ ID NO: 24069 - DNA, 1169 bp, Mus musculus
ctcacagagatcactgcctctgcgcccctagtgctggggggttagtactgtttgtgctttaagtgggcactgttatccttgttgttttgtgccattgtaaacatgtcagatctgttcgtaaatccagtgcaaactgtgcatggacctcatagggtagaaagttttataacatcattcatttgtttgacaactttgctaataagaacttgaccatgtagaggtcagagctcaacttgcaggaatcggttccccactgcctccatgtggttcccaggaatcaaactcaagtcatcaggtttagcagcatgtctgttgagcctcgtgtcttccctggcactgttgggttttctcagtcagtgccctctctctctcccgcaggcacagctccctagtttgcatgcatcactgtagtactcagacagcttgcgcacagtgtccctgcatgttctccctcagggagcgggacaggtttcacttatcctctctgtgttctcctgtaggcattggatggcacaagtgactgagaggatcccgagagtttccggggcctgtgaaaggtagaaactcaaccatgatttctttctcaactcaacagcattcccttccttgaagtcttcgtttttacttcagcctcaggtaactttatgtctcataatgttgaaagagtacattttacttatttaattttaggctgtattttaattgagtcatgaataaaaacagcacacatttgaggtagccctttagctgtgaaggtcactgatgattgtatagtgttgggttaggaaagtgattgcagtggcttcagctatgctgaagttaattttttcatatattaaacttttttttgttggatgatagatttcattattgggtttatttaatagtttcagtttggatttttatatgtggaagaaatatgtatttatttatttaattgtttgtttgcttgtttagtttttttttccgtgtagtcttggctgtcctggaacttaccctgaagaccgtgctggcctcgaacttagaaacctgcatgcccctgcctcctgggtgctaggattaaagttttatgtcacagtgcttagcttcttaagaggtttttgagatgaatggttaatatattgtgtaataataagtagtaggttttcttttcattaatctccttaacc

SEQ ID NO: 24070 - DNA, 1420 bp, Mus musculus
gagggttagattcgctctgcgggatttcaagttctttgagcaacactgcctgtttgacactgctgtggtttgctgaaccgagggtttcttgtgtatggtagccaagcgctgttgtaaccgagcagctctatcacagcccttcttagggtttatgagggtcttcctttgcatcgggggtttgcctgggagtattctctgtccgttatgttttactggttcatccttttacactgtaaatgtaatgtaatatgttcagatttgaaagttcttgaactaaagttataaatacgtcctttaatctgttttgtgtaaagttcactttcagtaatgaaagataatgggattatgccttaatttcaaaatgaaaacttgttttgcttttctagcctctggaagtcaatcttggtaattatatggattagatgaataaaaattttctatttgaatgtatatcttttataatttgaaataaaaatctaccaaacaggacataaactaatttttttatgctttgttgccaaacttggtctttctaggcagttatacttaagcatgaacattgacgacaaactggaaggattgtttcttaaatgtggcggcatagacgaaatgcagtcttccagggcaatggttgtaatgggtggagtgtctggccagtccgccgtgtctggagaactgcaggagtcagtacttcaagatcgaagtttgcctcaccaggagatccttgctgcagacgaagtgttacaagagagtgaaatgagacaacaggatatgatatcccatgatgaactcatggtccacgaggagacagtgaaaaatgacgaagagcagatggacacccacgagcggcttccccaaggactgcagtatgcactcaatgtccctgtaagtactaaactagaaatggtccacggtcccgggagtcaccaaaaaattacaacagttagaggctaatcagtttttgttgttgttatcgttttgtttgtttatgttttaattgagtgactaagctgtggacagctatcatattcgaaaggcagaattaagtttttacatgttattgtttttgaactctattttccaacatttatttggtcatggttatgtgtataccggatgttaagcgcttgcttttgaaagacaccatgtttagcatttctttttgatttttggaggtggtttctctgtgtagttcttgctgtcttggaacttgatctatttgtggcaggctgtcagtatatagcccaagttggcctagaatttgctacgtgggccaggtcatcctttgttgcgggaaatattaaaatcaaaccagcacattgctgcgcttatgcctgctcctctctcagctagggggtctggctggcctgttcttatcctgtggagaccctctggcctggagctcccgaaactaccccac

SEQ ID NO: 24071 - DNA, 1200 bp, Mus musculus
atatcaagtgacttcttttgtgattgggtaacctcactcaggatgatgctctccaggtctatccatttgcccaagaatttcataaattcattgtttttaatagctgagtagtactccattgtgtaaatgtaccacattttctgtatccattcaggtacatctgagttctttccagcttctggctattatgaataaggctgctatgaacatagtggagcatgtgtccatattaccagttggaacatcttctgggtatttgcccaggagaggtattgcgggatcctccggtagtactatgtccgattttccaaggagccagtgatatattttcttattttaggagagaagaactggatcacagttaaattcagatcaaagcaaaactaaaactgaactgtgtaaatggttaatgtttgacatctgggactcactcatgatcatctggatcccaaagggcttgagtattccacttctccagctctgctgtccttggcacgctagcttcttgggtaggctcggccttgttccactccatacatggtgctcttgcagtcagttatcccgtggttctacatcttcagtctgtagggatctccttctggactcttttaccagtgacttctcttggcatttcttctggccatgccacatgatggcagtcgtcagcttctccatgatcccttcaggactgtagctttcatgcagccagaaccggttctgtatgtgatactctgctctagtcccatatggaccacagcttctctatttgacctcaaggaacacttcccagaagagtttgcttcaatgaggctgtctcagtaatcacagctgactcttgagctccacctagccagcatccattgtcccagggagagcaggttccatgttgatgatgagactgcattgctggatctgctctcttctgattcttcagccctattaaccaaaaaccaggttctttgggtttggtttttttgttttttgttttcttttcttttcctttttggtttttcaaggcagggtttttctgtgtatcctctcactctgtaggtcaggctggccttgaactcaacaaagatatgcctgcctctgcctcccaagtgctagggttaaaggcatgttctaccactgcctggaagaaaccaggttttttattcaaaatccgacacaaatggcctgataacctttgccccttctaac

SEQ ID NO: 24072 - DNA, 2986 bp, Mus musculus
aacctggtttaattcttctctttctggactcttgatagattggataattaaacagtatcccaagaaactaaagaaatgggcattttaattgcttacttacgttacatttaagtgaatactgctcacgacagttttaccaagcgaaagagcttactgattccagtaactgcaatttctttttcagctagatgagtgatgggaaattttttgttgcatttcaaaatctaaataaactacagactttatccttataccacgaatgttttttttatatatgtatactttgtcttaaaataatacagcatgatataataaatagtgcttttatatatatatatatatacacacttttatgaagaatgatggtttgagttacacattgaacagttttaatttttggagactaacatcggctctacatctcttttatttgttctacttttttgggttttgtactttccatttccgccatctttatcgcagtgccccagtggtgacctgaaaccagtacccttgggagatgacgctttgttaacttccattttgactttgctgttgaccctgtagatgcgtgctttgtttcagtgttgagtattttatccatttaaattatttttcttttatttaatgttatcccaagactgttctcataaagaagggaacaaagaaatatcctcccccagtgtccttcacttacactcatttattttttaaaatgttggtatttttatgacaaggaatataagttatgtttatgtggtttcctctacactttgttatgaaactgcttgaaatcatagttttcccatttgacagctttgctgtcagatcttcaagaactttagacttctttgaagtgactattttaagttctgccattatcgatctgaagactgatgtgtgtctgtggcgcatcacataaccacaggaacgcttcatcagatgaggtgtgatggaccgtgtgcaccctagatgggtgcttgtatttttctcatagtacttttgacaagagcagacatttatctcctaagttgaacctgattaaaaacacagtgtggttccactgagcacttgatgcatttcttgtacagtgtaagggtctgtttttaacatcaccagcacagttttaagaatgtgacggttgctgagcggttcaggtcagcttaggaagaaaaagcctttgaaaatggaagttctgtaaacagaatttcaggtgttgcattcctgtcttaaacacatttctttaaatccacacaacggcagacttttctaccaggtaataagcattcgagataactgatagccagcataacttactgacttaccagttaagtatagtcatcacttactgtgaaattccagatgcctgccaggctcagcttgtatcttcatccttcgagaagcatctcaacaggctgggtttccctgtgttggtttagaaagctttcctgcctgggcattaaagaaagaaagtggccttgtgtgctgctctggacagatccctggaggatatgagataccctgtcagttcacacttctcatttcttctccaagcatagctctagcacccttcagcttctgctcaccgttagcctgtcagtctgggcccactagacaaggcaggagctctccagcatccgaaagcattgctgctgtttgcgcttcagttcttactgcacatgtatctcattggctttggaatagctgagtagctcctgtggtttttatttttgtggatctacagtgtacatgtgctacctagtcaggtaggagtccaccatcttagctctgactcagggtgccagcaatgggtcatttctgtctcttaggaggtagaagaggccttgtgctcagggcaagctttcattcccacaggtgagggacacttgcaaagtgccagcaaggctagatgttttgccacttctttgatttttattaatttgggcttttaaagggctgtttaaaaaaaaaaaaaaaaaagcggccgggaacctctgagtaggtgtgctgcgtccggagctccctcgaacctaagctagaggtcatcttttacagtgtacttacttgaagaagctctattctaatcaatgagaatctatttgagtctgcaatttaagttaaaaccttttccgtttcaaattgctttatttcagggaaataattttccagttgtttttgctatattctgcaaataaaaagtgtgtgtttccttttttccacctaaactttggtaggaaacagactaaagcagacaaacatttcttgttgtgtttgttgctttctttaatccaatggataaaaaaagtaaaaccctgtaaacattattttatttttttatgcaataccatgctgtaaatagggttcatcgagtaaggatgcgcctacctatgactgaacctttgattctgcacagttagagtttatatataaacgtgtcttgacaatcaaggacttgatgtgagtcttcctttatgatgtttattaatgttatgcattccatttgtttgaagtgagtaccaatgtgctaatttgtattgtctgaaagtatgtaatgtttttacagcttgtttttaagactctgtaaatatgtacaaaccagtcacagtaccgctttatgttagaaggcgtgtgatgttgtactgtatgtaagcaataatacatagcagtgctaactttacaagtagcatcaggaacgttctagagaaacatttcagagttatccttattagttacccttgtttcacttaataatgattacctttaatcagtttttataagcaaattccattgttcctcctgttggaacgtaacactgtttacacagcataactgacgttgcaggggggacaggctagatgtggcttcgcctgtgctcactctcactaagcattgaatggccttaccactcttgtgcaaagatggaggaagaccgctgaacttagtgcccatcacactgaaggaagggatgtgttttgttttgttttgt

SEQ ID NO: 24073 - DNA, 1186 bp, Mus musculus
taatctctctgtatgttaattcccacccctcgtcctgcaacccgaggtggctcagtggtcctgctgaagtggtgagggtcagccccccacccccgcctctcagcatgcccgggccgcattctggaagctccatttcctgccagttcggtgtcacctgactgaaccaccgcccttcggacagggggtgctcagggcctgggtctctagtccagatgctcgagtccggacgctggggcggggtcgcccgagatgcagggcaggtggccaggagcgcttgcggccacgtggcaggaccgggtggggcgggcgtggcctccggagcctgagtaggagcaggtgagggtgcgggcactgctctgtggaggggaagagtggctggggtcgcaaggacctgactctggtgcccagagcctcatcccgcagccctcagatctttttagggtgatgtgtcccaaaggaatcttgccctattcctctccccacgagtctcctgcaggatggggagcacggccagttgcctcagcccttctccctccctctcttttttctttcaaatgtcatggggcaaggtccctggcctcaggaaagccagatcaactcctctggtgggccagaactgtacttttctgacatctttttcttacctgccctattctggccagggtccaggggcctctcaagacagccgccagccctctggctctgcctccagtacactctgcctgcactcaccaccagacacgggttccagcaagaccccaaatgtccttgctctgaacaaagggttcccaaggcactggggaaaagagtgtaggactatgtctttaagggctaggcagctgagcagtcagcctagaccattccccaatattcaggagttcagggagtagggagtgaactataggagttcctgtgaccccaggacaacgggaaatgatcaggcgggctctgaaccataaatgaggttctgaagagagcagtggggaggagtccccagatggggccaacaaggtttctacttcacccacgacctttctcagtgcagaggaagctggacaggcaagaagcagcaagggagggagggagggcctggcctgacagagtgatgtttgctttccagagtggtctccctatctagataaaagtatcagaacctcacttcctggagaatggcccagaggtctcc

SEQ ID NO: 24074 - DNA, 1099 bp, Mus musculus
tctaactacctctctcctggtcacatatagatgcagcaacccctgctactaagagaaaatagggatccctttatagagtcattcctcacctctaggtgtgtgtgtgcgtagtggggagagcacacactggagacagagtctctctgagctgaaactgtcctggctctgctacctagtcaatgagttcccggcatctccctgtctcagccccacgaggctggggtttcagcatggcaaccacacacagctttccctgagcgctggggatttgacctcaagtcctcatgactgcgtagcaaatactctgaccagctgaaccatcttcccagtcccaaggtggaaggttttatccttgtttttctgtttgttcgtttgctgttttgatttctaagttcagtctcttctcttttcctgctcctcttccctcctcctgttggctgcacatctgacttcatgatgttctttgcagggcatcctggcccagccccagccctggtggaagatccagctgttcatgtgggagccggtgctgtttgggacctgggatggtgtgttcacatcctgcatgatcaacatttttggcgttgtccttttcttgaggaccggctggctggtggtgagtgagctggtgaccctggagcttctggtgggcctgtgacagggtgaagcttcttggatactacagtttagggaacagattccccaagcacagactctgacacaaagcaggaagtacagggcagagctggcactgcttttagaatgggaaatcggggagcctgggcttcagaggttcccagtgtgagccttgggatggatctgactatatgggggtcagtggtcatcatgggtgggactagagttaggtcaaggatcagacagatggggacttttactctagtttgtgacccttctggacttcctagtatgtcaccgcactctgtggccctctgaagtaccagctccccgtatacatagttgctctctcacacactgttcttggccttgtttgtagggctgcatggttggagatacaaactcctgcctcccgggattcattgcccagggcagactctcttgtactagatcctgatggata

SEQ ID NO: 24075 - DNA, 1157 bp, Mus musculus
gtacacgttggcatacacttccaggaaggtgtacttatttggccagaaagtatttagtgaggactaagtccaatggggtgtaagcccagtgagcatgaaggggagtcgaaaacgagtcccctcttagagctcacacgcagggatcagggctgacctgggaagagactctgtaaatagatacttagctggagattggggctgaccttggcaaatagacacttaggaagtatggagatagataagcactaggcttcgagtactgtagagctcagaggaagggtgccagtgccagccaccagagaaacaaatcctgaagacagagtcgttttcaaggccactttggagttagcctggcaatccatagaataagtagaaaaggctttctaggctatctacacctagactggtgtaggtaagaggacgagagagagagagagagagagagagagagagagagagagagagagagaaagagagagagagagagaatgagagagaacatatcaacatatcctttcatgctaggccaaggttacctgtatggtgggtttgcaagcttctggtgactcactctcttaatctctctctctctctctctctctctctcaagatttatttatttattatatgtgattacactgtagctgtcttcagacactccagaagagggcgtcagatcttgttacggatggttgtaagccaccatgtggttgctgggatttgaactcaggaccttcggaagagcagtcggtactcttacctgctgagccatctcaccagccccgattctctcttttttaattttacttttgtgtataggagtgtttgcctacataaatgggtaccatttgtatgactggtgcctgagaggtcaggaaagggcatcaaatcccctggaactggaattagagatggttacgtggtcgctgagaactgtaccctgatcatctgcaagagcaaaaagtgctcttaagtgtggagccagctcatctcttggtcctgctggtgactctcttgagccgccttcactttatcgacatgtggtatgaagttgtaagagtttgaagggcgggctttccacctgaaaccttgggtgggcctcagctctcccggtactgtccgcttcttttctcatcgcccctcatagtgcccctctg

SEQ ID NO: 24076 - DNA, 1203 bp, Mus musculus
gcactcacacactcattcacacatacacatactcacacacacatacacactcgcatacacccacactcacatatacacacactcattcccacatacgtctatacatgcactctcgttaaaagtattggcgtttaaatgtttgtgggagtgtgcttcggtggctctgaggacagagccctgtgtgcactggtttcttgtaaacatttagttcttgaatagtgcaggcagagaaggccaaatcctgacccaacatcccataatcattatgccctgtttaccactgacagctctcaacccagggctcattcctctcttgttcaagatgtggatgtgaaatggggccttagtcaggtccccctgtggaagagcaggttagacctgatgcttcctcccagacagtggaggtatcacctgctcactcctcccacagtgctggtgcgtgcgcgcgcgtgtgtgtgtgtgtgtgtgtgtgtgtgtgtgtgtccgtgagcaggcgggtctgctgctgatgcctctctgttgctggctctccccaccggggattgcccggcagtgtgttgcaggtgctatgtacatcaccggctttgcggagtccatctcagatctgctgggacttggggacatctgggcagtgcgtggaatttcagttgctgtgcttctggctttgctgggcatcaacctggcaggtgtcaagtggattatccgcctccagctgctgctgctgctcctgctggctgtctcgaccctggactttgtggtgggctctttcacccacctggacccaggtaagcccctggagtgtagtgctttgtagctatggataggtgtgatttcagggcaacctccctctcctgcaggctgtacctctgactagggtgggctggtcctaatcatgtgagcaagtccatcagcttgtgtgcagctccctgggaccagaagatcctccattcacacaagcacccctgaacacacaaatgtccccccacagacaacccccacattcacacacaaacacaaaaatacatacagagacacatacactcacacagacacatacagacacacacttttacttcatgtatttcccatgattctgtttcagtttttttctattaaaataaatgtaaataacacaacttcggccaatcaaaagtacaagcaggtgaacagagaccaactccatagcactgactgggaccctga

SEQ ID NO: 24077 - DNA, 1120 bp, Mus musculus
caccaagctacaacctagctggtatcagtgtcttcctcttgctgaatgtgtgggcagggacattttgatcaccagaattgattgacagtgaaagcaagcaatctttcttcttcttcttcttcttcttcttcttcttcttcttcttcttcttcttcttcttcttcttcttcttcttcttcttcttcttcttctcctcctcctcctcctcctcctcctcctcctcctcctcttcctcctcttcttcttcttcttcttcttcctcccccttcccttccccttcccttcctccttctcctttcccccttctcctcctcctccctccccttcttcctcctcctcttcctcccactcccccttcctccttctcctttcctccttcctcctcctccccctcctcttttattaaatatgctaaccttagttcacaacaggcctgggtgacaagcacttctgtcaatccttagccctcatgtagcatttggatcagggttacccctgcttccactttccaactgtgacaatggagtgcagagtttcaggccctaccctgatggctgcctgcttttgcctgtttctccacccagtactttggcaatccacggtccatcacctctcggtgtgacctgaaggcaaacctcatccggaatggctgtgaaggtgagattgagagtccagccagcagcacccacgtcctccggaacctacctctcagcagcaagggttccagtgccacgggctctgacgtcatccagatgacgccgcaggagattgcagtgagcctccggccaggtgagtgttcttcgggatgggttgggcaccataggcttagaaaggcccatgggtgtgatacgctaatgtggaagatgggcttgattgagctcagagcctggagatggccgaaaggctcagaccaggaagcagaggataaggttgctggaggtgagtctgggtggagtggcttggctatatattttttatgtattgtagtagaggctgtgccttcatgaaggaggcatgccctgggcatccgtttctgcaacaaacataatgaacacacaaacctcgactgaacgatgattaaaaacccagtattgtaggatatttataacattgcaatttc

SEQ ID NO: 24078 - DNA, 1142 bp, Mus musculus
ctctccactaggccttgcccagagcaggtggtagttgttaattgatgtttttccaaggtacttagtgaaggccaggacagttgattaatatttagagatgggaccatcgagatggttcagtgagaagatcatttgagtttgattcccagaacccacatgatagaagagagctgatctctgcaagttgttctctcatgtgtgtgtgtgtctgtgtgtccccatgtgcgtgtttgtgtacatacatgcacactaaaatataatgtaattaaaaattgaaaaggtaggggctgtaaggatggctcaatggttaagattgactgctcttccagaggtcctgagttgaattctctgcacttacatggtggctcacaaccatctgtaatgggatctgatgtcctcttctgatgtgactgaagacagctacagtgtgtaatcatataaataaaataaataaatggatctcttaagagattgaaaaggcttacagatgatgatggaaaatccacccttctctccttcctctctagttacaagttattccccaactgcgtcccctccttcgggttccggcatctgctgcctctcacagacagagtcgacagcttcaacgaggaagtgaggaagcagagggtgtcccggaaccgagatgcccccgagggggggtttgatgcggtcctccaggctgctgtctgcaaggtaagaacacccaagcacgtggctcccattcactgttacatcagaggctgagctcagccgcaccatggcggaatctctagcaatcaagtcagctagacttgggaagagttgagcttgtgttgggtgtggctctgtgcgataggctggtgtccttgccagacagatggctgttctgtgtttatgcatcagcttttttttttttttttttttttggcttgtcattttaaccttaaagattgccttactggggaatccagctgaaatagaatcaccgaagtctttggctgcatgcctatgtttgttttgtttttcctgttcctctgagatgtgtgaatccagagggagggcagagatttcaaccagaagggaactttgactttgagaggttctcaacttggggcaatacatgaatgcaatacagatatcgaattagtgatagaataagt

SEQ ID NO: 24079 - DNA, 1326 bp, Mus musculus
taggagaattacacacctggaagactcgaggggcgtgcagatcctggtgcatgttgggactgctgagggtgaagcgccagaggcaggctcagtggggagttggacagacacagagacggaacccaagaaaaaagctcgagctctcaggcctggttggatggtcacatgagcaagccctctgccccgggcacacgcaggctcagaacagagctcaggggaagtacccctgactccccagagttaagagtctgtctgttcaggttccaggggacttctggggctttctgcctaagccctgtattccacagatgaaaagtaagagctcagagaaggaaagggattcccccagagcacagaacaagtcagaagcaggcatccctgcaggtgctggacgggcctgaggctgaactaacacgtgtgctctcctctcttgtgctcgcaggcctcaaaccccctgtacagaaagcccatctccacacacactgtcgatttcgccttcaacaagttcaacaaatcctacaatggctcagtggactgaggctcctggatggctggagggggactaaggatgaagactctggcgtgccttggacttcctggaccatttgctcacgctagctaggcacgcacggataatggagatgccctccattgagccctaagggacctggtagccacacagcgggccacaggcacttggggccacttccctccaagccagggaaagcaaggagactctggtgttctcagcttcccctctgccgcctccagcttgctgtctccatgaacctctgaaggcctggctgccctcttccctgctgggccagacaagaaggtatccggaagagtctgtgtgtacaaagctagcgcgcagcctggctttttccagttgatcgtttttttttctatgaaataaaaaggtcacgcatttatggtgtagatctgattactggttccctgagggctgtctgcctggcatctgtgggtgttggtagaattggggagttgcctgttgaaagtacatgccttgcaaatgttaggttttgccctccggtctgtgtttgtttagtgcttttgtaatgaaaaggaaagactgggaatgaaaaagtaaggatggaaaccaagcaactttgtgttggctttgtacattcgggcatgcgcctccttttctgagcggtcttgagtagccccagtagagactggcatgtccatacactttatcagggacaggacttgaaccagaccaatactctggagctgggctccctgatgtgcgtgggtaattacggtgctgagcaggtaccattgggcctccctggttttgct

SEQ ID NO: 24080 - DNA, 1663 bp, Mus musculus
aggccggggaatacttgcagcggctaaccgcctagaagcagctgagatgtacaggaaggctgcctgggaggcatatctgagtaggcttgctgttcagtgagacagaagacactgaaaatgggtggtatcccaaaagccgctggcttcagagaccagtgctcagggccctgcacagggtctgtgaagagagactctgcagcattgtatcatggtctaacttgtaatcactgcattggtactgtaatgagcagcccttttgaaagctttctcaagactggtatttgtttggcagctgccacctttcagattccttgggctatactgcttaattcttttagttccagtgtgacttagtcacacacatctaatgttagccgcttacctccttcagtgccatgaagctggatcctttcgtggagcaggagttctagttcattctactcagcagtcagtgtagaaagtcaggcacagcttcctcttgccgcctctgtatccaagagagaacggcagtaccagttccccactgtcattgtgtgtttgctaataacctgggggctcatagtgaatggctcagtggttaagagcactgttcctcttatgtaggatcagcatgtggttcccagcacccacattgtgtctcaaaaccatctgtaactccaattccaggggatccagtttcctcttatagcttccaggggctacatgcatgtgatacaatgcacctttactttacaaagacagtctttgccagtgctaagagggaaaattttagtacagaaatatttgctcacagactgagaaattgggtgcctcctacagtgtgatctgaccgctctttaacacatagaacttagccgtgtccattgcaagtggaattcacagcccccgtaaacttgaaccagttgcccctgtggtccgcatgcttactgagcaaagcaccaccaccctagtttctgccctccacacatcatcagtggtaccttaagtcttattcctgccaaaaggaaagatcctttagcactcacagacagctgtatgtaaatagtctagacttgagataactggtgagcgccagacagaatggtctgagagtatgtagcctgctaacttccttagcactgagtcagtacagcacccggtctacacatctataagattagcaactgcatacactcagcaagtaatggtgcatcctgtagtaaagtggaatcaaagtagcaatagcacgtgcttgaaggagtccgactgcagcatggtcccatcgagtaaaagcataacaaggcatgagcctcaggtgggtttgagctaatgtctgagaaaagctgtcaggagctaatggaacttcccttctaggctttagcttagtcatagtctccaacagctatgtggttccaggagtccaaggtccaggagttgtaagatgcagacctaaactgagaccctgaagttaagtgcacacacacgctctttagagcaggcttttaggaaccaaaaggaaaaatgcattaagttctacactgttaactcagatcagtatttggggaaataggaaacaaagtcctcttgaggacgacttactattccacccattaaaactaacaacagtacccttggccaaatcagttcatcaaaaataatgttaaatgctgtctgcttttccaga

SEQ ID NO: 24081 - DNA, 1166 bp, Mus musculus
tttattgatgatactggcctattctgtctttcattattgtataagtgatgtgatttttaaaaaaactccacattgctcagaaaaaaatgagttgttacacagtgaaataatttgttttactctaactattctgtatataattgataatttggagatacagaggatagcgaacaaatagttgcggtgcattgattaacagaaagtagcttcaaagtaaatgaccacaactaagatttacatagtcgcggctctttagagggtcctagcaagtgtagactcggtacatcttgtgctagctgaactgtcttacatagtgtttcaacagaagcttttcttctctaggtaccaagcgccttgtagaaggagagattaatccgggccagacctgtctggtcattgaggacgtcgtcaccagcggagccagtgttttggagactgtggaagttcttcagaaggagggtctaaaggtaactgatgccatagtgctgttggaccgggagcagggaggcaaggacaagctgcaggcccaggggatccgcctccacgccgtgtgcacgctctcccaaatgctggagattctccagcagcaggaaaagatcgacgctgacatggtcgggagagtgaagaggttcattcaggagaacgttttctcagcagctaatcataacggtctcccccctcctgagaagaaagcgtgcaaagaactcagctttggtgctcgagctgagctgcctggaacccacccgcttgcctcaaagctgctccggctcatgcagaagaaggagaccaatctgtgtctgtctgccgatgtgtcggaggccagggagctgctgcagctcgcagacgccttgggacccagcatctgcatgctcaaaactcatgtcgacattctgaatgattttactctggatgtgatggaggagttgacagccctggcaaaacgccacgagttcttaatatttgaagacaggaaattcgctgatattggaaacacagttaaaaagcagtatgaaagtaagtgtgctcagaaacagactggctgaagggaaggtgtgttggctcacaggagtcagcagaagacagagctgtcaggccctgagctggccttgtttctctccatatctccgctgtgttctccagtctgctttctttgttgatttgtttcc

SEQ ID NO: 24082 - DNA, 1148 bp, Mus musculus
gtatggaacctcactcggggtctaagttcctgccggaaagtttacagaggactggaaagagatccgtcagaggcagcccagcagagcaggtgggcctttggcatcaatgacatctcccagtgcaccccacactgtgatggacagagtcctgagccaaatcagagactcccatagccagtcagcccgctgtcactgtgggatcttacacttcacttccccatctcattcaggagatggggatcggcaatcctgcctccatgtttctctggggcttcagaggatctaaggaaggtgtttgtgagtagtgtataccaatcagataatgctgcccagatccatgctggtatcacggtcagcaacacctgctctcctcgctgggtcagccaaatggcaaagaaatgaagatggctggtttccctgggtctttccaggtgaagaacctacagttgagcctctcctcagcatcttcactaaacctacaccctcagtaggaacgttcatttcttaagcagtgtgcgtttgatagcatacactctccagctagggttctgtgatggggaagaggagtaggaaacgttctctctgcagccatctgggatgtgtcctcccaggcttttgaagcctcacttcaattcttcctaccaagacctgaggatgtaactcagtgctggggtgcttacccagcacggacacgtcctgggttcagtgcctggcacctcaagtgtatatgaaatatgttaacttgccactcgctcccttgtcttccctgtgagactcctggtgggggctccatatccttctctctggggaatctccagcgtggtgggacatagaggccactgaacagttctcggcatcctcaggttctttctccactagagtcccgatggggtaggggaatgggatgttgcagaggctaaagctctgctgtctgttgaggagtgctccatatcacggcaaattttgttttatgttgttgttttttccgagacagggtttctctgtgtagccctggctgtcctggaactcactttgtagaccaggctggccttgaactcagaaatccacctgcctctgcttcccaagtgctaggattaaaggtgtgtgccaccactgctatggtaaacttataacacaaatgtcatcct

SEQ ID NO: 24083 - DNA, 1184 bp, Mus musculus
tggctgaactggaaaaatgtatccaagagcaagacagattggcccagctcttcattaaacacgtgagtgtcaccccagctgtccccatctccctgggtgccaacacactcattttaaagtcctcctgtcttcagctcttctcgagtttgccctctctgaacactctggttttgttttttagcacatttgaccatttgtccgccctgttctttcctttatacggctcattccttgtctttaactgcccttgactctgtggggttgggggtgggggtggggatgggggtgggggtgggggcgggggaggtgagccggaagccaaggtgtgtgattgtcacattttctcccgtaccaggagcggaagctgcacatctacgtgtggtactgccagaacaagccgcgttccgagtacatcgtggctgagtacgatgcctattttgaggtgagcggctccctaggctcccaggctaagacagctgcaatgagacacacccgggttctccacccgcaggtgtccctgccagtggtcttcatggcgggaaaccagcctccgcagagctggtagcttcttaattccatccgcatgtgcgcctttgcttgaggaggagctgaggtggctctgtctacccactgttgagaagtcttcatttatgggaagactgtcccagactgtcggtggaagctcttgatctcatgtgaccactgagcactgactgtccaacactcttcccccaccttcccctaggaacattactaagtccttgcccctggttaaagggtttacagccacttcacagttggccgtgttctcagcctctagctggtctctcacgcctttgaactgatccatccacagcaccccacaccttgggatcctttctttctaatataattcccgtgtctagcacctccaagtgtgtagatgccccagcctggcttcttccaagggcaaagaggcaacactacccctcccccgaccaccttagcgagagccctgagtgtttagagaacagagttcaggatccagccttgtaggcctgttgtgtctgaggggaagtcatctcctaattctttcctggagtcgtagagagagcacagtacctgtttcagcttttctcccaggactaaggtgggggacagtggtgggacagtgccaaggagccaagcaaggtctttggggctgg

SEQ ID NO: 24084 - DNA, 1143 bp, Mus musculus
tggagaaaaacatccaacctttctgtgtccatctcatcttaaaaacaatgaaacaatggctgaaccactaacctccaagctctctcccagctttccctatacacactactacatctagatttgagttttcaccctgacaggaggactgagcaaccccagcaactggtcacagccgagtagggcttgactagcccctctgctcagggtcagaggtcaccctgcctcttttttccttcgatgcactcagtgtattagtccaggtcctctagagtaacagaacttatagaatgaatatatatgatatacatttatacataataaatcctacatatataaaggggatttattagaataagttacagggtgtggtccagctaacccaacaatggctggccatgaacagaaagtccaagaattcagtagttcttcagtccacaaggctggacgtctcagctggtcttcagtgtgcgctggggtcctgaagaagttggctctaaggccggtgaaggaatgaaccttctagcaaggctagaaaaagcaggctaagagtgaagcttccttcctccgtggcttatgtagacttctggcagatgtgaacctgattagagatgggttttcccatctcaaaagatctggattaaaggtgtgtctttccacctccaagatccagattagaagtgagtcttcctacttcagatcaggcatataatctctcacaggggcgccctccatttggaggttttagttaattccaaatgtagtcaatttgacaatcaagaatagccactgatcgccgttatccaggcctggtctgttttccgtgtgcctcttatttactggtgccagggagactaactgtagtggctctccaaaaaagctctccaccatagcagctcctgtgtgcctgttagcagcagggccgctcaggccccatctacctgctccgtgagtgactctacaccagctagttcttcaggtggctggttcacagtggagtctgagaacactgtcttccaaaaccactgtggcctcaaactcatgcatcttccgttgaagacactgaggcccagaaaatgacagagaaccaaatcttagtctagatctgagttgtgtaaatggtcagatattagcatggggattcca

SEQ ID NO: 24085 - DNA, 1192 bp, Mus musculus
tctctgactttgaaagaggcaaatattactttttcatattttggacaatttcagacgtgtacacaatggattgtgattacactcacccctcactattctgtccctcctcccacccctgctgagtccccaccgatccccctcctacttgtataattttgcatcttacagatgtatgcaggtaggcacaactcctctgtgatcatgatcagagtggcctagtagaaatgtcagaagatgacatttcatagcactccgtatttctggttcctattgtctttctccccctttctgcagtgttccctgggtcttgggaggagatgttatacacgtgccatttgtggctgactgcacagcagtcatccgttttcagcacttggaccagttatgggtctctgaattaatgattgctgccgaatgcttctttgacacactggggagagcagcattggcctgtaggtataaacataaacgtgtagaaggcagcattactacacatccatctctcaaagcatcagtggtgcattccccctagagcctgtgccatccccagccgtaagtctcttgtccagctttatggtagtaggttggggtgttctccctctcatggaccaggcctctgatgtaatcagtcaggaagccgttagtgcctccccagcagttatgccactattacaccacctgttgggtagtgttgtagcatccagggtcctcagctgggtaggaacactttaacttttcttccctaacagcctacaagagcagctttagccaggaagcaagtagcatctatttagagatgcccagctacccaagccccactttaaagaatgggacgaggcagggctaagaatgacatggtgtcctgctcacccgtcctggcaggaaggggaagtcaggccacagctcttcagaagctttagtgtccaccagtcactaagcatctgctgtacggggatgtcttcatcttgcctgctgcctccctgaggagctggtgctgggggctatgacggggagtctgaatgacagagtaattaccaagctgggagaaagtccgttgtttctgaaggtgtctttgggaagacacacatggaccgacaagatcaatgagctgtaaatggattactggtctgccagtgtgcagtaaaagggagcaggccattcactctgcagcacgggagcagatttctgtgaa

SEQ ID NO: 24086 - DNA, 1159 bp, Mus musculus
ggtacccagcacccatatgacagtgcataaccatcggtaactccagctctaggggtctgacatcctcctttgtcctcactggcaccaggcacacatgtggtgcacagacatgcaggcaaaacacccatacacataaaataaaaattaatttaaaaactagcttgtcaaggatgatacatattttagagcttggatattactaagctgtcatccacatggttacagcagactcccactgactgcgaaaatgcccctcatgaagagctattgccttatattttttatatttgtatgtgtgtgtgtgtgtgtgttatatgtaagtgtgtctgagtacatgtggaagctaatggtcaatgttgtgccactatacccagctttcatgtaagcactaggattccagactcaggccctctattttctgtggcaaaccatcccccaatcccaagctaagcattttctaaaagcttataaatcacttagctttcttacaggaattgcttgttatatttttttccaggccttcaattctaaaacaagctataaaattgtgatgtgtttaaactttatattctttacttgatggttgttagattttaagtccttcttagggatttcttttgtacttaaaagattatttatatttcctcataaaacttgtgttgttgaatttatgttttgttggtatattttgtgttcttaactctttaatctatccagaattaatacttgtgaatggcgtatggcaagttattatcattttagattcaattactaaatcaaatacatttgtatagaaagtttccaattctggaaagataggaaatgccagtacctagttacatattcttgtttgtgaagtgggtgcacactgtgaagacagggttgatgttaacattcccatgaggccattaccttctccatctaacaatgaaattactagaaacacagatttatgtctcccaactttgtcaatgaatcacaaacatgaaataacatagatagatagatagatagatagatagatagatagatagatagatagtagttggcacccacaggcattctggttgacagaaatggcaattattttaaaggtaaactacagtagtaaggttattgtataagtatacatacacacacattattttgaaagaggaga

SEQ ID NO: 24087 - DNA, 1174 bp, Mus musculus
ccgtgctcccacctccaccccaagacagactggctaaacagttaagcccaggacctgatcctccccagttctccgtgaggccctagaggtgtgttgtttaccctctctgggcctataattcctcctctgaaataggagtaactccatcagaagtctctctctggttgttctgaaattacccagaataaatgtgaagataagcagagtgccagcagggtgggtaccatgctcagtggtggaaactctgttctcaatatccagcacaaacgataacatctttatttggtggcctgtgtcccttgactgttatgacagtgaagatagtgtctgccattgcattactcagctgaagggagcaatgtgcccctccctctcctgttgtgttgctcccattggtcactggatgagagagaaagcagtcaggatcaggaccgcgcgcttggagcaaacggaacttccagaggccggctaacccactgttctttcttgtcttccagtgttcccccagttgtacttccacatgatacaccagagaagaaaggtcctttctcacaccgaagaacataagaagtttgagtagcgctccacaccaccccaaaccagacttttcaatgatcaaaatatgctgcagactttttgagttcccagtaagaactatttttaaaatattaaatataaaacaaaataaaaaaccaaaatccagtgtcacacaggcctgggattttataaaaaataaaaataaaaagattaaaaatgcaaaagtctgttacataaagcatcctagctggtcctttcagcatgctctgaccagaagttgccagttcctatgatggcgctagaagggggttggcctttatcttctgtgtgtcctccattcatctggcagtacagaatgtacacccagtgccaagagctgccgtctgaggggcaaccgtgctccaactgacttcgcggcttgcagcagaagctgggttgcagtctgcggtgtggctaactttccccttctcagagtgcttgagtgcatgctggaaactgctcaggaatgctctgaagttctggctaggacttagcccctcatatctagtgaatgcgttacaaaacgtatatggctgtgaagctttggggagtgcctgtaaccagaaaaccactaaaagcctttcatttgtttttgatt

SEQ ID NO: 24088 - DNA, 1227 bp, Mus musculus
caagcccagggcttcatgcatacagagcacagactatcactgggctccctgtcgcctggcatcagtgttttgaaatgttctatcaggcaccaagattgaagacttgagccctgagcctcccctgtcagcagaggggtcatgtagatgacacaggaatctgatttatggctttgttgaaaggcaagttgtttatatctacagggtttattgtggtgagttagtggagagtgatggccatggaaaatgatcataggcatgtaacagggggaaacaaacatgcttgagggttgctggataaaatgttgtcaggcaaggctgtgctttggtatatttatgctgctcttatcgctggcaattaaccccaaatgtgactggataaatggctaagttcagtgctgtaatatctgcaagaatattttagagtgagtctcagcagagcagggaacctccacttggccttctggaagtccaagtcttttagctgacaaatgcctgttggttggtagtagctcttccctgctctctcttacatctgtatggacaagcatcttagcctcaccctccttggctgagttcattagtttccatctctctcttccattgcagcttggctgtgtctatcgtagatgctcactgaacacccatcagatacacggacggctttgccccgggttacacagcaggcagctagcagtattagttcagcgctgatggacttgcctttctctctctctctctctctctctctctctctctctctctctctctctctctctgtgtgtgtgtgtgtgtgtgtgtgtgtgtaggacttcataaaagaaggtgacatggtattggtggtcactgggtgtaccaccttgagagctcccttcctatctactctgaggttagctctttcttgccacctttgggatggggtaagaagggcagggcatctcttgggggtccctgtgctctggagggcagactgggaagcacctgtggcctgggcttgaggagcacctggagcaagggtagatcctcaaggttagtgcttggccaagcatcacttgtggcctgccatgtctccctttgggagaggcttatccagggagagttaattttggattttgctttacatttatttaaaagtggaatattcctttagcattggtgacgatggcctagaaaagccaattagtcaccatctgagtcctcctgagggtgtgttgccgccctgttcccctc

SEQ ID NO: 24089 - DNA, 1220 bp, Mus musculus
atagctttctaccactgagactgttgggatccagattccctgtttctctcctacttgtgctatgaccttgcacgtctctgacacctttctgccttagttttctcctatgtagtatggtggttgtgattctaaagtgaatggatataggtaaagccctgggaccagcatcaggtgtggccaccacgctcacaaatgcgataaatccttgcacgaagctctttagaagccatcctgtaggggaggattctgttgcaatgtctagcatgcagtgttgccctgggcaaacatttgtgtggacttctggacagagcacacatccgaagagggaaaggaattgagtgagtcacgcctgctgtatatcaggtgctctgttgaaatgttccttacacagcttaatatcctgaagaaggggtgtagagtcaccctgagagaggtaagctatgcctttcagtcctctccctcccagccctaagacacaggtgtgctggggaaccctgtcctatccagtgtggcactagagtccaggcctcagcgactttgctttgaatatacctgtctgtctacctgacagtcttggaggacaccttccctggtgcccctgtgagtccctactgatagggagatgagagataggaggtgagcagcctgcaacctacagttctgtcagctgaaaggcattcttgaaaagcacaaatatagcatggctataaaaagatgaaggtgaactgctttgaaaactgaaagccagtagggagtgcaactgtggccaagtgacaaagtggggaagcaaattttgcaagactggaaaaccagtgcaagtaagactaagcaaagatgctgacaagcccaagactacagccagccaggtctgaaccagaaagctgccagcagaaaactctgatgaggctccctgaggggtcctggggaaccagtgtgctgtcaccatgagctggggtggctctgccctgctcactagcactgcagagctcaggtggagtggtgggaggctccctccttggcctaggggcttcgtttttgacctccactgtcctctgttttcccttttctctagacccactcgctctgtgacctccccacctaggcctccccggcccatggttcagagcttcaaggcggatctccagtgttgctgctgaggacaaagcgagggccttttctgactttggtttggaggtaatcatactactggcttttacgtc

SEQ ID NO: 24090 - DNA, 1183 bp, Mus musculus
ccccgggagctgtatctttggagatggggacaatctaagcacaaacctgtctgtctttctatgctttctgatggtaaggcacttacttgtaagctacacacatgcacacatatacttaacttatttatataaagactccaaataatgtagaaatgtcaagtaccaggtacaactctgcttaacaagccagcctattacatctctccattctcttgctcccttaggccggcctccccagaaccccctcatccccacacttctccacctgatctgatcatgggagccccccttcctagaccagctcaccctgttctcctgtcttccatcccacccacaggctttgcctctgtcctcccacatcaggaggcctaatggtttcctgcttcttagacattcacctcccattttagaaagccgtgcgtggcatgctctggcccacccgatgcctctagaaacatcacactatgcactttctgacacagcccaccccaccagttactcatctgacacactctctctttagctaacgagaaaatgagatgcaaggaaccattcatcggacgccccgatattttaaattgacggtgtaggaattagctctaggctgacagttacctttatgctttcaataagtgggggttaaaaggggagcattaacagtgaacctggattgtgaagcccgaggtagatggttttcagcccactctgtatgtgtgctgtgagtaggcccacgcccttcaccgggcctgtagctgcccacgccatgactctaccagtggcttgtgctctttaaatgttttgaaattatgtaacatcccttctctgtactatgacattttcatgagtttcagctttgtgtctctgttaggtcagatcaatggtgttacttgccattgccattttaggtagctgaaaagtcatctgcccattatctgccctgcgggtgcatttcttccgaaataacccataactgtcacgggcctcttgtgttctcttgtgttcctgcatcagatgttgggaaatccccgagtccttccccatcatccccactctattctggggccaactggctgctcccctaagtctggccatatgggtggtcccacccatctcaggaaccaactcaaatgctaaattcagattaaatttgtagctcaggccttaatttagtctcacaaagctc

SEQ ID NO: 24091 - DNA, 1208 bp, Mus musculus
gtgtggcggacagtcatttggcaggcaaggttactgctctcccctgactcgtgcggcgtgcatgcgatgctgctgctgctgtctttcgctgtatcaccagtgtcctgctgtttcacttggcccgcacatgaagtttctgcctccctgtgaaagggcttctgggggaatcgcaggcatgcaggttaccagaggaagatggatcagctgccacggcgctttgcagttggtcacactcggtggctggaagggaaaagtgaacccactggccttgaggctcttcttagcagcgctatagggaatgggagagagcgccagacatgtctctgttggtgttcccgttgccaggtgtagagaagaatacaagatctgtgttcacacactggacaggccctgcatctgccttcttacacttagccagaggtgagtcctttgaagctcagtttttatgtatctcatgtgggggtggctccacttcccacagcagtggtttatagcaagaacacatacatatccttctggggtcaggggaggtcctggaacccaggacctcacgcctgctagacctagactgctctgtcactcagctctgaatcccaccctgcgtcctacaagcacggcagatagacctgcgtctctgaatgcttagttttgctgcctatcagataccctgatgcttctgatccatgtcatttgaaaaagatgcaggtgtcgtcgtcccctggattgatttttacgactgcttctgagtggggaccagaaggctgcaaacgtggatttagactcattgttggaggacagactgtgttaatgtgttgaaagcatggctgtgtactgtgggtcaggagcacttgagttgtttcttttttttttttttcgtatcaattagagaagctttaaggtatgattgggtttccagagtgggaattcatcccctcctccccctcctcctccccctcctcctccctctgctcctcctcccccgctctctaattctgtgtttctaccagttcatccttgttagcaggcctggcacactgggctggcattcacccaaagccctcttggccctagaagaggtttttccaaaacattaaaagcctcagggacttacgtcttggttaaatgcactgcagttgcaatttcaggataagcaaacctgtcttataggctcctggatcaattgtcctgccccctgacttgtcccttgt

SEQ ID NO: 24092 - DNA, 1187 bp, Mus musculus
tacaaggtgtttgactggtcggttgatttgtttgtttgcttgctataatacctcgtaggcagtccacagtcagtttctctccctctgaagttgtctctgtgtgattgctccagcaagctccaccccctctcctctgcttctcatctttcccaaacttccttaatcttctgaagtgtctctttatatctgggcccaggactctcagatctcccatctttgtggttctgcaggggggaggagcaggcaggtgggtgggggcgaccagtccaggtaccacactcttcgttaaggtagcttctggtttgacctgactgctgttgggcagccccacagcactactgggtttgattggccttagccaatcatcagacatctcccaggtccctttaccgtaagctgttagagctccatcttctgagtctttgagcttctttggcttcctaggcttgtcataacaaagtaccaccagccgggtggaccaaacagcagacgtgtgctgtgtcacaggctgagcagctggcggtcctgtacgggcagggttgatgctctctgcagggatgcggttgaggactttactgatgcttcttgtattagttggcagtcttgagtgtttcttcacttagagaagatctagtctatttctgccttggtctctacttggatgcatctgtctccagatttcccttctttataagggcaccgccattcacattgggtgagggcttcacccttctccggtatgactccatgtaattcaatctgcaataatcctattttcaaataaagctccattctgagatattgggggctaaagatgtcagaatatgattccaaggggggcatgtgattcgccccatgagtatgctgtagctttttggtgtctcgggtggaactttccaatttttccctggttcgttttctccacttcagttgcatctctctctccagctgattgggatcttgtaggccctgtttctggcatccaggattcttttgctgttgctcctggcgtgcgccgcttcctgtgtgttgatgatccaagggattgataagacactgaagtaggctggagctctatagtgggcctcctctctccttccaaggcctgttgggaagcaccctgagggctaggtcatacagctgtgacacgttctgctaacatccaccttccagcttcctcgtctggc

SEQ ID NO: 24093 - DNA, 1345 bp, Mus musculus
caccagcagcaggtggcatgcaggctctggacctccacgtgggcaccctggagcaggacctctggaatggccccaaaatctgcctttaaaagaaggctgcaaatatattccccagctctaaggaagaggagcaaagttaactaatgaaaggaacagatgagcagcctcctggaagacttaatggagctagggaaggagggaggagggaggagaaaggagggaggagggaggagggaggagggaggttgaaggtagatgccaagaaggcaggtgcacacagtgaggacaaggttctcagtctcttggcaaaggaccttttgctcaggagacaaatgtctgccatgacaagatccacctgaggctagtgggaggtcccaggctgatttagttcttacaaaaccaaataatagaaaatgctttagaagggcctgagagatggcccagtgcttaagagatggcccagcagttaaaaatcacacactcgctttttctgcgctctcgctggacaagtgagcagggacggcctcaggatgcagaacaacaccggggagtttgtggacctgtacgtgccgcggaaatgctccgcaagcaaccgcatcattgctgccaaggaccacttgtccatccagatgaacgtggccaaggttgataggaccacaggccagtttaaaacctatggcatctgcagggccattcgcaggatgggcgagtcagatgattctattctccgattggctaaggctgatggaattgtctcaaagaacttttgagcagaagaaatcgggaatttgttacaaataaaagttttaagtacctgcgggggggggggggaatcacacactcttgcttacagaggacctgagtttgattcccatcataccacattaggctgctcacaattgctcataactacaactccaggagatccagcaccctctttgggtgccttgggagcatccagacacatgcacacatgcacacacatgcacacacacacaaataaaacttgtaaaaaatgctttagggctcttaacacacagcaggcaatgccaccagtgttttacaccttccaacaagtctaactgtgtgaaaaatgagaacacagaggctaggaaatcaaagtcacaggcacaacgagcgagcttcccccaactatccccacactgagcctgtcattctatggaggtgttcctgctcagggaggggatggcacgggacaaggaatggtcttagtattcccgaccaccaagctgactgtagctcgagttccctggtcaccctgacactgtcaaactaaataacaaaaagagtttctcaaaaagactgatggtgttttttgtgaaaa

SEQ ID NO: 24094 - DNA, 1223 bp, Mus musculus
tgtcattgaccatgggagagagggctggcttcaggctggcacatggctgcagatccagctcagcccaggtctcatggtctcctctgacccaccatcactttcccctgccatgtctgagctgtggacctattgggtatgtgaggaacttggagagtagagatggcagagaatgggttcttaggtttgagctggaaatgacttccaatggccaccaccagctaagtctgccccttcttactggtccccccaaagtccggggctgcgtccagcttgtcagtgaaaagaattcatcaaatgtcccatcaaatgttccagaagtttcaaatctcagcccagggctggcgcactccaatgctgttctctaagtgtcacaggggaccactcactgctggcttaggttgacacctctgtcagacagtctgtatcttgaccagaggcatccctctggtaagaggcagtgaggactgagaaccggagcctggactgtactgagaggcccttcacaggactcttggcacaggtcttagtcttgccttcaggatgcactcaaggtggcccagaaggaagactcaagaccataggaggcagagtctggcctccatgcctgtggagactgttgctgctcaagattcgttggctgagaactgcttgagagtctctgctggcccctcatgtattcaggaacgcgcgcacgcgcgcatacacacacacacacacacacacacacacacacacacacacacagacagacatacacaccatctgctacagcaacaaaaaggatgttaagctgtggcattattaattaaagatgatatccagtctccaaatggaactgtctttgtgcatatgtgtgtggaccctcttggcatggtgtagtccatcagtgcagtgctctgaggtaacagatggtttctcaagacggaggaaacaacccagtggagtttgactttaatagaggccatctttctctgtgggtttatgtgcatgcacacacccgtgtgtgtgcgcgcgcgcatacacacacacacacacctttctctttcagaaaagaagctggggtagggggtaaatggaattcaccagtgaggccacaaggcccagcaaaggcaacatcagatgtgggcctaccctgagcagctcctgtgtggagttggggaatccagcaggagggcattgatgaggaggattcatgagatatgttggaagctgagtttaacaaa

SEQ ID NO: 24095 - DNA, 1745 bp, Mus musculus
cgatcaattttcccccttgaattaatagattgattttttttcaaccaaagtcaaggtatatcaaattgatgaaaatttattaacaacatcgattaaatattctacctgaaaatctggtaatacctcacacccaccacttagcctccagaccggcagtgtgcagactgtccggtcgccgccaggatgccttttgttaggaatgcagagtagcttatgcaggtgatgctttgcagatgccgcaaaaatgcttacaactgctgtttgtcttattttattttttgtcttgcagagttgtcttggttcaactggtgccttcctgggtcgtgtctgctcagtctccttctgattctgtgcttcagggaatcctatgacagactctaccttgacgtggtcgtctcggtttaagaagacagacttgtaggactttaaagggaccgtactttagtagtgcacctttgcttgggtgcacatgcaatgggagaaaaggcgaagaaagagatttctttcagaggttctgttaagttacagagtctcacattaatttaatgactactaggtaataatagtgcaggacgtgagtgtcgtgaggatgtgaaaactctgtggacagcacagctgtgttggcggcactcttgtgtggagctgtgacagctcacacaggacgcactgcccgagttggtcacccccatgtgcactgtacccgtgctgacccactgatgagctgaactacggcaagaagcatgggtggtcctatgaagatgacccctcccaggcacacagcagagggatgggactcacgccgctaacttctgaagacatcagaaccctgcgtcagactttaattacaaaatagcagagctgtataccagtgatagaagttagtcctgtgtacactacatgtttttctaataaagccatttcttatatgactccttacttttaaccaggttggaagcctttcactgtccttgggaacaggccctggctccttcccacccacccttgtttctgtgagtatggcgtcagtcacgccagcaaggtaacgaaatgcctgatagggttgcattaactgttgtgtgaaaagcgtaactctgttatgatttagcactttgttaaaaatgaactgagaaccacatgaagcatgtgtgtcttcagacgtgtgtggcacacgtgtaaagtccagcacccactgtaacttaccaggttagattgtagtcagatgagcccccacttgaaaagaacagtgtataactttgaaggtttgaagatctgtgcgtgatttctgaattgcacctgtgtattttaacttagattgtaatatactcagttctaaatgaagtcattgtatttgattggacagatttttgccaatacctatttctttctataaataatggatttttaaaaaaaacaaaaacaaaaacatactcattgcatggctcctggacccgtctttcaggaggtcataaactgactgtggcgggcctgtgacactgaccactggtgttccgtagctcctcttagacagaaccttccctaagcttccagagccgcagcaactccattgccagccagttctccttacagcccagtctcgtgcaggcatcagcagctcctggtagcccgggtggacaggctgcgcagtactgacttctgctcacccgtgtgtaccattgcacacctgcagacgcacctctcaccagaaattcacgatgtaccaacttacccgggtcttgaaggagggt

SEQ ID NO: 24096 - DNA, 1099 bp, Mus musculus
gctttgaggtttcaaaagcccgtgccattctcagcgctctccactgcctgcttgtggaccaaaatgtaagttttcagctattgctacaacttcatgcttgcctgactattgctatgctccctgccatgatggatcatggatgctaactgtcttagagttatcatttctatgaagagacaccacgaccaaggtaactgtaataaaaggaaacatttatttggggctggcttacagtttcaaaggtttagaccattatcatcatggtaggaagtatggcagcctttaggcaggcatggtgctggaggagctgaaagttctacagcttgatcccgaagagagtcaggaggagactctcttccacactgggcagaactttgaaccctagaagatttcaaagcccgcctacacagtgacatacttccttcaacaaggccgtatcaggtaaactcttgcttcataagttgccttggtaatggcatccttacaaaactaagaccgaagttggtactaggggaagggtatttctgtgacagacctgaccacactagttttgggggaatgtagaagactttgggactttgtgtgtgtaatcgtggcattaggaaagtaataagacatttcatttaccactgtgtgtccagtagcacataacagtatcaggcatgtaataagtatgctgagtgaatgaataaggggtcccagccaggtaaggtattgcatacctgtaccccataacataagagagtggatgaggaactcaaggtcgtttttggccacatagcaagtttgaggccagcctagacataaaccttctctcaaagaaaatgaagaaggggccagtgagatagtgggtaaagtgcttaccctgcatggctggcaacctgagtttgaacacccacccatgccagaacacacgcacagtgggttggcctaaggctgcctctattctcatactaagtgctggctaaatggagtcagcacatagacccagatgcctgcagccaatagctggggagaagagaggtaggcgggacttaggtttcctaggctagagaccgcgaggaggagcaggaagggaggaagataccatgggttagct

SEQ ID NO: 24097 - DNA, 1100 bp, Mus musculus
catctgaatagatggcatttaggtatgacaatggtatgttacagaacatatcaaacatacagctgagtaaaggggtatttattttgtagcatttacatcccatcaaatccattcttttaaaatgcgtaaagcagtggtttttagaatgttcccaaagctgtccagccatttgtcactgtcattgcaaaacattctcaccattcccaaaagtactctgataccattgccagttactcactgtctcccttttgctctagctctggggaacctgtcatcctcatctctgtagatctgcctattctagacattgcctttaaatggagtcatacagtatgtgtggtatctaatgtcgctcccttaacaggtttaaggtgtcatacacgctggtgcatgcatgcatgtcgacctaccacattttgtttatccactcatcaactagtagatattgggattatttctacttctaacattgaccaacagtacacctatgagcatttgtgtatgtgtgcatgtttgtatgtatgtaaatatgcttttagttttcatagatgtatatatctaaaagtagaattgctttgagaaaaatcattggttcttaatttaaagttagaagtgggagaaaaaaaaatggcaatgtgaacctgcttcacagagtaacgtagcctgtacacacagttctgtagatagccttcaatttcatattaaagaacatttaaattctctctttagaccttttaaactgtcaccttctccagaaccattaattgaggatggcacacacttattataaagaaagcaaaatccttctgtaagagacagctttgtcttcaattagacaaggcgagagagaacaaaaggtttttgttttttttttttttttttttacaaatgcacatattacaagggtgcaaggagaaaagcaaaggcattttgtatgaagatggatgcagtgggagccctagaaagtttattcttttagaaaacttaccaccatttttgttatcaggaaacatgttatatacattataaacataagagtgtacagtgcatcagaagacaactttaccttaaaatcttaccccaaaaccgctttgaatgtt

SEQ ID NO: 24098 - DNA, 1133 bp, Mus musculus
aggattccctgtctctgtagctctgggctgggataccttatgtggcttctagggatctgaactctggtcctcacacttgtgtggcaagcacttaacctgctgcgccatctccctagtgtttatgtgccagttttttgggttggttggttggttggttttttgagacagggtttctctgtatagccctggctgtactggaactcactttgcagaccaggctggcctcgaactcagaaatcctcctgcctctgcctcctgagtgctgggattaaaggcgtgcaccaccacgcccggcttatgtgccagtttttgagacagcgacaaagggtctgtctgggtcagctggggaaaagttctaagttccattggaggaatctaaaaggcttgtgtctgaatcctctatttgccccaagcttggcagtgacgtggttacgttgtaactgcctcagcattaaaatgtggtgtttcttcagtagcaaaagatcactaaatccttgaaattcccaagatctttgttgttgtcccggctgacctggaacttcactggtggactggaatttacagagatctgcttgcttttggctcctgagtgctgggatgaaaggcgtacaccttcatacctagctacttactgaacattttactcaagcattatgttaccttttcaggagaactttcttagtttgtattgacatttcaaagtaatacagcattttgtttgcccaaggatgcagaggcctcctagtcattccaccttagccccctgagtgctgggattacaggcgagtgtctacagtgcacagtcctaactcgacattttgttaggtgtacttctagcaggacctggcttaaatgacactagcgttttgtcctgataactgttctaatggcttttaagtttcacacatgtgtaatagctgtcagatggaagaggcttctgtacatgtatgtagttcagaaaccccccccacccccaccccgtgccagggttttgttgttgtctccctgctttgttttgctctggggatttctatattgtaacttttatgacagcttgcttctgcacaagttttatttataaattttttcatttgtattttctaatgtgagagacagatttttaacttcaggaa

SEQ ID NO: 24099 - DNA, 1151 bp, Mus musculus
gaagtttgctgaagtaacacgaaggtgaatatcttgcactctttagcaaacctaaatcacagggatgggaagcaaaaagggtcattctccctccctctcactgccaccttcctccctctgcccctcctttggtccctccctcactctgtccctccctcctgtctcaagttttcagccgaggttgaaggcaggtcccacagtttccattctctggattgttctgtgtaaagtacgtcaggcttgcagtcaggcctgatggcttatttgccattggctagttcatttacatctgagtttccttagtatcctttgacagagaaaataaaatatctcccctgcatcttatgggcttcttagaagagcggacactgtacatgtgtggtattgtgttgatggtgtttagagtcacactctacatcttcccaacaacacaaaggactgcacatgacttacttctctttatggaggagacctctgtctgcctttgggccgcaccttccagcccacatctgtggttgaaatggcctttgatattgttagtgttgctccaactctgccgtctcgtctctgccttccttgttgacaccttttgttgttgagaacatcacgttcctcgcttggctttgtaatgacggagtcagttcaaccccactctcccgaatcggctcacgtttctatgtttttctgcatgtttttacttttagtatatgcaatatgtcatgtggttaatttggtaaatattttgggaacattaggtatccacacttttagctgctgtagtgtggatttagttaatttgtgtgtatttgtatgctattatatatatgcctatatattaagcatacgatttgttagagtgatttctatagtatgagttattgagttactgagatggatgtttctttgaggctttggcttcatctccccaattatttcccaaagcacagttctaatttacatgtatgagcatagagtatacgtttattgtttctttattgttgttgctgcttgagaacggtctcactgtgcaaccttggacagcctggaactcggagatccacccacacctgcctcctgagtggttgggccttcctttctgaatgctgagcactgatcccagggtctaccacatgcacggcaagcagttggcc

SEQ ID NO: 24100 - DNA, 1124 bp, Mus musculus
ttttgattgactacctaagtgttacgttccaaaattttcactattttaaattacaggagttagaaagtttttttaattaaaactttattattagcattaaaaattatttaccaaccttaaattttaatatgaaaaaaaaatcacttaaattatgttaataggtgtggcgcctcccacctgcaacccaagtatttacaaggctgaggcaggggatctccatgagttccaagccagcctgaagtacaccataaattccaggccaacttgaactgtatggcatgaggccctgtctccaaaaaaaaagcaagaattcaggcctttgaagccaaatatttatctaagatttgccagaacagcatcagccattctctcggcattctataggacataatgacacacttatctctccattgttgtctgatgctctgtgcttctctttccccaggtgaacctgtcaaaccttttacaccagagaaagcgaaagagattataatgtctttacagcagcctgcaatcttctgtaacatggttttcgattggccatcacgacactggactgcgaaacacctttcgaaggtcttggagggcaagcagatacggttcagaatgggcctgagaggcacaggcacaggtaattgccatggcaacccctcctccatagcatcccaacctgctcagcagtgctcaccccatcttgaggcagtcctttatgtctaatcctctttgaccacttactgtacagataggaaactttacaagaaagtgtggggaaatagtttgacctcatacaaggttttttttaccccttgttaaaacaatgggtttaaacaccttacccaaaatgcaaatctgctaactcacgtattcaaggcgttgctagacattgttacggctgattgagcatggtagacaatatatatgttaatgagctactgcttagtgcccctttccactgaggaacagcagtaccataatactgcagaactgcagtgtgacactcgctaagagtgccacgtggtggtcccttgtgattcatcaggagcacatgcctacatgtgtggccccaggctatttatgacacttagtcttgcttataatcttatcttttactttatgatctgctt

SEQ ID NO: 24101 - DNA, 1105 bp, Mus musculus
taaaaccgagccttcagctgctaccttcttacatgtttatctcaagttgagagctaacttgtatcttgctttgtttgtttgtttgttttgttttgtttttcattaggaaaagatggcatctctttcctcctgaagatacgcctttcctttatccaaccagaattccttacgaagagtctagtgtgttcagtaaaatcaatgttgtcaaccctgatttgaagtgtttcccccagttccagaaagctcgaagacatatggtcacgttgagcccaggacaggtaatggggctttaaacagggaggaactgtcagtgggcaccacagcccggttggtgcctgggcttcccttgtacagatggcaggagcggctcccaaggccctgctactggaggacttctccatctgctggcctgagagatggagaaagggagcgcagctcctcctgctggtcacgggagggaatggctgccgaggaaattcagagcaggtggagccattgttactactcgggttaagagacatgtcagggcgtgggtactagaacatattcacagttaacacctgttccaccagacggatgcacacaggctgcattgcatcctgtgctcagaagcatgtgcactgagggtgattttcagcaagaatgactgacatctgagtcccttctaaagagactgtgttctgcatatccaccccgtggagagattttctgttacaacactggggcttgctgtatcagtttcttggcatttgaaaagtttgtattccctccatcagctttatcctgtctgcccttccttgccccctccttgctggctctcatcctgttctctccacacacgtacacagatccaccgggccacattgcatcaatcttctaccaggcacttcccttcatgcatgcctcttcctccagcccctaacagctactaccttactctgtatcactgtagattttcctgttctgggcattacatgtactgcagccaaacagtgtggagctttttgtgtctgacttgtgatgcagaacatgttttcaaggctggacagttcttgattatgtaggtgtaccataatgatctactcctgagctgatttcgagagcc

SEQ ID NO: 24102 - DNA, 1153 bp, Mus musculus
cctacaccaccctcatgttgagggatctaatcctggcccatgtgacaactcccccaccctcctccgccaccacagaactagctgcccattctcctgttcgtcacatgattcgtcttttctccataaggatcattgttccatgtgtttattaattccttgaaaaaaaaaatctggacatacaaggagtgggaaagattagaaaaaaaattatccaaggtcatttgtacataaggcctgcgtcttaagttcggtgaactacactcataggtagcaggtgataataacacatgtgagttatggtgctcccaaaagcatgggtctgccttctgtgacagggttggaattcatgaggggcagagcatacagctaaaaggctcttaaatcatgaggtacagagacagagaagaaaatgtggtttggtttttttaattttttttcctcaggaagaggaccacctagcgcgggtggaggaggccatcacccgcatgctcgtgtgtacactgaagactgcagaggacccgcaccaccccaggacctggctgaaccccactgaggtaggacggtcggctcttggtgtggatggtgagtctgcccagttggtctccagcgcagtgctgaagggctctcctcttcctaggttgaggagacatctcacgaggtcaacagctgctacttgaacagtgctgtttgtgccttttttgatcattgtgaaaaagctaaagcagtagagttgcaagtgctgagcgcaaacggggcggagccacgtgtgcaggaggagcacatggaagtggagcaggcccagggcccgagcctcacatcgagggctgagaaacaggaggccgtgagcctgtttggcccagatctgatccctgtgacaccagcatccgaagagagaggaggcgcactggaaggcgacagcgaagaatctgtcagcagtaatggaggacactttgcagaactgccctgtgccaggagacagcaaaccagcaaaggggcgagcgcattgacggagcccttggccccgaggggtcctatggcgcattctcgagtcttcgtgtccacagatgacttgctggactgcctagttaatccacaagtaaccaggatggtggcccagcttttgatacaaggaaaaagctgtgatactttctag

SEQ ID NO: 24103 - DNA, 1193 bp, Mus musculus
gagttagagtcaggagatgacagggttttggttgagtttgaaaaggagagtctaaacatagcaggaaaatcagaagacgtccaaggcatgagccagaaaatcagggaattaatagagagcaccactgaaaagctcagaagggaagagcagagtctgaaggagaaagtggccatttccccgggaaagcattatcttttgcaccacagtggcttcctgaaggatctaagcaaggggttcccagagatggagatctcttacgacgccacggctcagttcctgtacttgaagggcttccgtgcagatgtgtacaaagtaaagtgtgacatccaagagaaggtgttctccatggctcaaaaggatgtccaggtctcttctgaagtcttcgaatttctgcagcaagtagacagtcagagactctctaagtctctgtttgaggcacagaacattctcgccatatatgagctgaaaggtacagctcttttcttagttggaagttctttcaaagatctggcagaagccgagacaaaaatgctcagtgctttaagtcataagcagattgaagttgaggacaaggaggttctgataagtaatgggtggaagaagaaagttcaccctctgcaaaagagacacagctcttgtgcaaccattatagtccagaatgaattgacttcagaaaccccggcaaaggtcattgttacaggctgtgtgaaagaagtgaatgaaatccataggcaactttttgagtatttggaaaacaacatgaaagttgaaagagcacttaaaatcaaaccatccttgattgttgactatttaaggacagacaagaggctattgtcaaagataaagaaggcacatgtgtatgtgcattttaagcctaaagacaatccaaacagcattttgctaactggctgcaagagcaaagttctagagtgcatgaatctagtcaaggaaatccaggattcagtctgtgtccaaagattccagactgacaaagctggcgtcaggcacttcttcaaagataaagaatcgtattacaaaacggagattggtcgtcagttcggatgcgtcattgaattggaggaggatagagaggagaagggtgaagaggaggatggtgaagaggaggagggtgaagaggagggagaaagcagcattaatgagcagaagtgtcacctacagagggacatagcccc

SEQ ID NO: 24104 - DNA, 1228 bp, Mus musculus
ggtctaaggggccatggccgtggtcgaggggggagggttgtggaggtaaagctgaagataaggagtggatccctgtcaccaagctgggccaccaggttaaggacatgaagatcaagtccttggaggagatctatctattctccctgctcattaaggaatccgagattgttgacattctcctgggcggatcctttaaggacaaggttctaaagatccttccggtacagaagcagacttgggctggccagcagaacaggttcaaggcattagtcgctgttgggggctacaataatcacaatggccttggtgttacgagctccaaggagattgtcactgccatccaaggggccatcatcttggccaaactttccatcgtctctggctactgggggaacaagattggcaagccccacactgttccatgcaaagtgacaggctgctgtggctctgtgggtatgtgttctcatctctgcccccagaggcactggcatcatctctgcttctgtgcccaagaagctactgatgatggccggtatagatgacagccacacaatagccaggggctgcactgccaccctgggcaactttgccaaggacacctttgatgccacctccaagacttacagctacctgacccccgacctctggaaagagactgttcaccaagtctccttctcaggaattcaccgaccatctgtgaaaacccacaccagcctgttcagaagacccaggctctgctgtggctaccacacaagggtttttatacaagaaaaataaagcgaattgaaagaacccaggactacagacagccatgccatcaagtgaaatcaggtttagctggtggaatacagccaatgaaactgatagagctttatcccgtcccgagggattcagttattcgtgggtgcgaggggggccgcaaacctggaaggagatgggaggaagaaaaagaggaataggagaccaggaagggcacctatcgaggtctcgtttattaggctgaggtgccttctttttaaagcatacatcgcggggaatatgggagggtcgagggggaattatacaaagaaaaaagaagtgggcaactgctgacatgggggccgaagtcaggcgccaggcagcgggcactctgcatcttatctctagaacatagatcctccttgacagccttgggtggcaggctgggctcaggtgtaactcatgtccttggatggcatgggagttcagg

SEQ ID NO: 24105 - DNA, 1143 bp, Mus musculus
gtcttttctagagtggctggcactctttcatggaaggcaaactctacaggcacaggttggggggaatggccctgtctacaaagcatgaagaaatgagctcagatctgaaattatccatggaaaagcctggtgtgttggcatgcacttgtaatcttagcactggtgagtagagacaggaggattcctggagcttactggccaactagcctagttaaaaccatgagctctggattcactgagagaccttatctcaagaaataaggtggatcgggacatgggggtgcatgcctttaatgtcagaacttggaaggcagaagcgggcaatctctgagttccagacctcacctggtctacagtgtccaagtcccaggacagccagctatacatagtgagaccttgtctcaaaacaaatattaggaagacagaaacaaatatatctaacatcatcctctgttctgcatacacacctacacacacacacacactggggagcggggagatagaaaagaaaactttatagttttataggatttcaatttttgctgaagaaatctgacgtcattcttgtgttacggttggggtgttgggtgagtctgtaatcatcttctatgtccttacataatggaaccttccctgatttttgtttgctttgtttatttgagacagggtctcactgcatagctctggaactcaatttgtggaccagcttggtcttgaacttagatctgcctatatcagcctcctgagtgctggcattgcctggttttttgtttgtttgtttgtttgtttgtttgtttgggggttttggttttagcttttttggtttgggttgatttggtttggtttagttcggcttgatttgattttgatgttggaatttaaaccctaggccagtgagttccatcccataattctttttcatgtccatctctgtagcaatacattagttgtttattttttaatctcttcctgaacccttgtgtaagtgggaaagtgaaacccttgtataaatgggaactttaaaaacaggtttggcagccggacgtggtggcgcacccctttaatcccagcacttgggaggcagaggcaggtggatttctgagttcgaggccagcctggtctacagagtgagttccaggacag

SEQ ID NO: 24106 - DNA, 1202 bp, Mus musculus
acaccacgcaggggtagaggagtctgaccccaaccctattttccagcaggtttataaaggtaaaaaccagaacctagggggaggatgggagaggaaacaggggaagtctaggggcggatatttacttcaaggcacctgggacattgaaacattttgtggttgtttttcccaagagttccagggaattaggccatctggccgggggcgggggcccatgttctcagggcagtcattattttatttttttactcttcatttccccacttcttcttgtgagtagctctaatcttagagcgacccctcttcttctttcggcaaagtcaggtactgttgtcggagcaccattacctgtacaacactaaccctgtcttttacaaaagccactaacttattaagaatgcaaggtccaaaagtgagcaaaagcaaaaggatgattaggggaccggcaagggtagaaacaagggtggtaaaccaaggagacttattaaaccaattttcaaaccagctctgtctatcttctctttcccttctgcgcttgtctaaccggctcttcctatcattgtgaagcagaattcaccaagcgttggattgttcacccactaatagggaacgtgagctgggtttagaccgtcgtgagacaggttagttttaccctactgatgatgtgttgttgccatgataatcctgctcagtacgagaggaacagcaccttttctggggtctgatgagcgtcggcatcgggcgccttaacccagcgttcggttcatcccgcagcgccagttctcagggcagtcattattttacttttttactcttcgaatcaatacatctataaatgtaagacaggaggagaaaaaggaccacatgggctaactgctcccaccagattggcctgaaggctcgtcggtggggtgttttcctgactcacgataaatgtgagactcactgtgggcggtgccacctctgggctgtataggataacaagctgagagtaagccagggaccaaattcctccatgatctgcttcaattactgcctccaggttcctgccttgaattccagtcctggcttccctcaaagatgcactgtaagctgaaatgcctgcccccaagttgttttggttagttttatcatagcaaccgaaagcaaactagaacaactttctcgatccctcagtccttctctccctttcttctcacttt

SEQ ID NO: 24107 - DNA, 4030 bp, Mus musculus
aacatgaacatgggagtagtgggtgacacagagacaacagtagtgagactttgcttccttgggccagaaactgcttgcaatgtgcatttaatttaagatgttaatttataatattgggctttggatgtaatggcaataatcatttctgatgcgtatgtatagagtctttacatcaataaagtagaattaagaatgtagttactgaggttttcaagaaagattctttatccttcattttaggtctggataaaattgagttcttacagagtcatgaaaaccaggagatctatcaaaaggcttttgatcttattgagcattactttgggaccgaagatgaggacagcagcatcgcaccccaggttgatcttagccagcagcagtacatcttccagcagtgtgaagctcctatggaaggtttccagctttgaagcaatcctctccttcttgttcctgtgtcagaccaggctatccagtcaagtcctcttgtggagcccacagtcctcatggagctaatctctcaaatgttttccataatactgtttgcgctcatttgcttgccttgcgcacctgctctcttacacacatctggaaaacctctggctctctgtggtggaatacccttttattacaagggtaaccagaacggcccactctcttatggaaaaatccctaagctttggagatccgcacttacattagagtcatgggaatatatacacatactaatgtggctcccttttttgtgggggaaaaaagaggactcttcctcattccgtaaagtggggaaaatgacattgaaagataaaactaaaacctttatcttgaattttacacaactacaagggagatatttagacttgtgtatacatcagagtactcttctcgagttcttccacagtgaatcaacccttggagtacctggtggctttttctagccacatttgcattaatccttattgagatgggatggttttctttcctctaatggagtcattttcttcagatattaaagttaaaccatccaatccctcaccttcagccttcagtgaatgtgcttctagttgtcaggaatgctgaagaattaacactttgacttttaaatgtgatcctggcttggcagatttccttaaagcaggaaggagagaagcatatattagtttgtatggcttttgcttctctttgtttttgtttcttaggatttggaagtggttcagttttaacgctggtatgaaggctaaaagtccttaagtaaaaccatgttcaaaaatccaattaaagactaagaacataaaacccatcactttgtttaaaccggtgtgacgagaggctgtgtttctgcattacaaatgatcctcaggctttgtggtcctgaccaagggcctggtaaattggagtcaccctaggtgcttttcctcttcgtgactggcagataacacatatttaaatgttacttagggatttttttttcctttgttgagtgcagctcgattctaatgtaatcatgctgcatacatgcttttgctgtgcagcatccttatctttaaaagcatactagtctcctcagtgtgacctctagactaaaagggcagtgatccaataacctcagtatcccctgtttttatttcatctcctactagtaccctacctcccctaggaagaacatgcccacctcctgcttatttaatgatgactgtaatgtacctgcaaatggcgcttccagtactgtgttcactgacatttgtgcttggactagaaggggaaagaaacaagaaaaaaaggataattgccaagagaactgcaaatgagttcaatgtgacttctcggtgctagttggccatcttggctcaatgttgggacacactatcagagagaggagtctttttttttttccccaatgatattctgttcaaaatgaattctgaaggaaaagttgctcatgtctgtttcagagcatacccttttaaatctttttagactactcttctagaattcatcataaccccaaaatagataaaagctatctagaagttgccctgacaagctattgcacatctctggtaaatcctgctgaatgtaaggaatattcagagctctcatacctcatcatgatgttatttaagcagccaatttacacgacctgatttactttgaaaaatttgtttcattcaaactagaaagttccagagacaaaggacatttctcagccaagagtgtgatgcattcttgccctagtctttacttgtgtctgctctgggatggatgctgtctgatgtctgttaccaatggagcagataccacaaaactagtcaactcccgtctgtcctgttgttttctagtgctgctttgtgctgagagaacatgttagtttactgaacttgacctgtacaagactgattctttgtaattttagggttaaattaggtggttaatttaaagatgaactttcaatgttgcctttacatcacattacagtatcacttctttgagaaggtaatagaagcactgattcatagtaaaaatcttgtttttagctttgacttttcttgtggctgatttctttttaaattgtaaattactggtaacatgttatttctatagaatgttttaaattatgtaccttctattggatagttaaaacctttgcatcttataaaggagtttgaatgaaaagaaatagaaagcacacagagttgtcacctcaccttaccaagagcatacagctggaacttttgtagcaatatcagggtggcccaatgagttcaggtccattaatcagtgtgagctcttttatcttaagcctgaccagaagttcatgaactttaaatattctgaactttgtttttatagtaaaatgattgtttcagtgtaaacatggcattcagctaaaccctggcaagttcagatgttctggaactgagtacttacaaagaagacttttgtttcttaacgcaagtggaatcttaggggttacttgtaaatcctatttttagtctttcacctggcaaagtctattaatttaatcttttgaagatttttatcagaaaggtgttacttattacagaagcatgttagtatttataacataaaacctcttaaggattttagatagtgatcagggcaaagtggctttgttgttttccttctctgtctccttccagactttccaagtatgtattttatactgagaactttgatttttaaagaagcattcagagactttgagatgtaaaggtacctggtacctgaagcaccaaaaggtaaagagccgggtggagaaacaccccagaacattcagatgccaggtacagaacacagttaggagacttggctgtgggacacgggttcttgccaccagtcaaagccatctttagattgccctcgttagccccctgctggaaactctgctgcaccagggttgtttcttccacacaccagactaagctgttggactccgggtgtttctcagccttactgtcctataataaatctgaattattccagttgctgctgactatgcctaagaaaacatatgtaagtataatttgtcaaccaaattctgttgtacatgactacctaccggcaactttgattgatttctgtagtgctaaataaacatttcagctgtctgaccccaaacgtggggctgtattgtaaaacaggttttccttgggttatgggatttattttatgtctgattaaatttgggggaaattttcatatcagtaagcaagccattttagctgtttttaggggctggaactttttatttaagttggaaagtgtgttgagtaatgtgccataagaaaaaggagtcagtttttgagcggggattgtttcttttcagggtgcatacataccttccaaattagaaagtttgctcacttgcagtttcattttgaaatcctaaattagtagagccatttttttttgtttgaggtagacaaattaactatctgtctgcagagttggaagtatttagactcctatcattcaaaattagttaaatataatatttgcctgtatataaatg

SEQ ID NO: 24108 - DNA, 1099 bp, Mus musculus
cctgctgagccatctcaccagcccccaaaatttttattttattttatttatttattttttttggtttttccagacagggtttctctgtgtcgccctggctgtcctggaactcactttgtagaccaggctggcctcgaactcagagatccacctgcctctgcctcccgagtgctgggattaaaggcgtgcgccaccacgcccggctcgcgatttcttatcatttgatccgtgtagcagttggcaggaactttccactcacaatgctcgtggttcacctgactggaagctatgcaaacagcttcgtctctgggacatttatggaaaactggtgcttgttcatcatggtgcagaggtgggagctgggtaaacacacacatctagaaggaaaagctagggaaagtgttcattctggcctgacaagctccgggctgctgctgggatggagtgcaggaaagaaaggccgagggaggctccagaccctcacacttgcctaactgtggctctgtgtaagtggggattcagagctgaggggaatgggagctgccagcctggagctaagagggcttcatcttctcagagctgacagcaaaggctcccagagttattagtggaaactttgtctaattatcaggtgaccacgaaactacaaagagatgtctgtggccaaccaaatacataaagaatacaagataatactaaaagtaattatatgcccgaaattacataaagtagatgaaaaggacacacctggaaaaaaataccgaaactctgcccccaaacacttaaggaggattggaagtggtcctttacaacgctcaaggaagaggaagggctgagatgtagctccatatgaagtgtttgcctagtgtgactaaggatgtgggcaaaggaaagaaaagacaggaactttcaagcgagccttacataggtcttattcgagatgtgatggcatacacgcacagacagacccaatacttggaggctgaggcagagggttgagagtttgaggccagcctgagctgcgtagtgagattcccattttaaaacgcttcctgattcctttaatgagggtgtattatctggtataatccagcaaata

SEQ ID NO: 24109 - DNA, 1200 bp, Mus musculus
ctaagggtctgcgtttctccttcttcccttgcagccctggcccgccaccgctacatgaagcaggttcaggccctaggtcctcagatgatggaaaaacccctgtactggggggcggacaggagctcccaagtttcatcttatgcaatgaacccgctgctgcagcgaggtaaactttgccagaaagtcatgggacggggagggcagagggtgagggcagaggtgccgtctgccaagaagcatgcgcactaaccgggtgtctttcgatggagggtgggagggagtgcaatcctgcttactaacgtgacattttgatgccctggttcctaggagggtatttgggaccagcagttcagtgtgctccatccttgtttccattcagatctgtccttacagtccagccttccacagatgccaatgacccagatggctgctcaccctccggtggctaatggtgtcctggaatatttggagaaagaattgcggaacctcaacccagcccaacctctgcctgcggatctcagagccaaatctggccacccttgcagcatgctctcctccctgggctccgcagaggttgtggaacgcagagtcatccacctgcccccactaatcagagacccaccgtcctccaggaccagcaacccctcacaccagcagcggctcaatgctgtttcttccagacactgcgatctgagtgagcgcccgaggcagcgccatcactccgatttcctccgagagctccaggaccaggggatgagaccctgggccccggggagaggggagctggacccccattggagtgggagacaccaccgctctaggcccagcgagtcatccatgccttggtcagactgggacagcctgagcgaatgtccctcatccagtgaggctccttggccccccagacgaccagagcccagggaaggcgcccagagacgtgagagacgcaggcatcgcagctactcgcctcctctaccctcgggccccagctcttggagctctgaagaggagaaagagtcgctgcccaggaactggggtgcccagcgacgtcaccatcaccgccgccgccgctcacagtctccaaactggcctgaggagaagccgcccagctaccgctcactggatgtgactccaggcaagaacaacaggaaaaaagggaatgtggagaggcgcttggtgagcctggggcatcctgtggag

SEQ ID NO: 24110 - DNA, 1153 bp, Mus musculus
atagaattatatttgtggatacataaagattaaagatgttaaccaagatttcctgagtaaatatggcacgggtaactgtgatcctttagatatgacaaaactgtcaatctctacatcagttatattgaaaaatgtgggtcactttctgatgactaacctagccacattcttaaaggttacagaacaaaccatagcaaaaataaatttaaaaagtagttaatactgattataaagtagacccattcagaggtaactttattttcattcatcattacttaaagctaaatttaactcactaaaatgaaactgacatattacagaagtaacctttaaaaactgaaaccacacttttaataattgcagctgcatttctgttacaaaaacatctaaaaataacttcaaaattgtcacacaatcactctatgttatttagtagatatcctataaaaactttcttctagacaaatttaaagacaagtatttttacttttgggcatgagtattatcagcaaagaaagtatcaagttttcaaacattcatcaagtagattgtgagtgtgtgtgcacgtgtgtgtgtgtgtgtgtgtgtgtgtgtacacatgcatacatatacatacatagagagagggggtggaaaaatgtgtgagttttatttatgtgtatattgttttacatatatagttatatgaaaatattccaaaattgtgcgtgtgtgtgtatgtgcatatatggaaagagagagttacagacttgagtttgtaactggctttagcaacttgacaagttatcaaaattcttagcctcaaatttcaaatctagaaaatagagataatgcctgtgtttcgtagcacaggccagtaatctcacctactcaggaaacaaaggcaggaagaacatatgtttaaacccagcctggattacagaatgagatcaaagctgctactgctggacaatttagtagagaccctgtctcaaagagtataaggaggactggatatagttcaatggtagaacatttacctagcatgaacaaaccttagggtgacttcccagcactgtaaaaattaaatgaatgaattactaaagttcatgtacctcacaaggttgagataatacatttaggataatttaaaaggttttagtatatggcactt

SEQ ID NO: 24111 - DNA, 1222 bp, Mus musculus
cagctggacacagctcaggaggtgccgtgcctttgcaagcacacccagttctttagtcagagcaagtctttgaaaaccataccaacaaagaagctttgtatttccatttgtacagtatcttgaatgccgtagtgagctctagttactctgttccgggcatgaggttctggggctgtcttggagcatgtgtctgacactgaaagaagtaccaggggtcaacagaatctaacttcacttgtaagcttgattttctgatcttctcagaattaaaacaaaaacagctctagaatatttaagccatttttagtatccatgaaaatttctaattaaacgtacgtatgagttgattctgagtctgagagcagacgttctctcgtgtctgaaagttgctgctgggcttcttgctctcccaacatcctcgcccttgccattcagagctgaggtttaggaagctgctctctgtccgtgctgagtgcctgtcgttgcagagtaggctgtaagagtcgtctgtgaaatgctctggagagtaacttgtgtagtttctctggtgtgtgtcttcagttgagttccatgcagcaggtggtccgagagaaagacgcccgctttgaaacacaggttcgtctccatgaagatgagctccttcagttagtaacccagtcagatgtggaaacagagatgcaacaggtgtgttgctcaagctccctagaatgactgtcatgttggttaacatttaatcaagccttcacagccactgcccttcccacggccctccctccacacagccgccatgcagtccttggctttttatccgtgccctatcttttgttgcctgtcattttggggtcctgagcttacattctctttttccttatccggtcggagcttggcactttaaagctgagcttgcgtgggaatctgtgtggggtgagcagtgggctggcttctctttcatttgctcatttacacctaccgttcatgctctaagtctgatcgaaaacttcaaattgatgaagtcagttttgtagtttaaatagagataaaaatgagtttgaagcaacttattttaagttcattgagcaaagtgttttaagatcattgagtagacactgaaaattgacttcatcattttggagtttaccatgtactaactcacatcgtttgtacttaaaagtagaactgtgtagtaatgagaggtgctttagtggcactttgtgtgatctgt

SEQ ID NO: 24112 - DNA, 1197 bp, Mus musculus
gacctcagagcagggctgattgaattatggacattcagtttaggagatacagagttttacagatttttaacagttttttggcataaaagaagtttgaaccagagggttccaagttttaggaaattcataaaatgttcatttgtgttgggctatttgtaatgctctatgagccattcaattaaggcctttcttggtgttttgtggttatttgttttccttattttgtaataggtcagcacggctggtactactctgctcaacaggagtgactcttctcctgaagaaaatgggcaggctgttctagagaacacattttctcagaaacataaagagctatcagttttattagtggaaatgaaagaagcccaggaggaaattgcatttctcaagtcacagctgcagggcaagaggcccgagggggactatgaggtcctcgaccgtagagaagtgcagctgatggagagtgaaggaccgccctcagttacagcaggagatgtcctctgtgcacccagtgatgagagcagcggcccagcagctgaagaggaacaggcaggcatgaaagatcggcatcgagcatctgaggcaggacctctaaatgatgctggaatggaactgagctccccgaagctggatggcgtggacaaatccctcgcagtgtcccatgtctgtcagtgtcaccagggcgaactggaaaggctgaaaactcaagttttggagcttgagacaagccttcatacagcagaggaaacttacaagagaaacttaagtgagaaagtgaaggaaattagcagcctaacccagcttagcgaagaggtcaaagagagcgccgaggaagcccgcagcacgctcgccgcagtgacggaagaaagagaccagctgctttaccaggtgaaggagcttgatgtcttagcagaactgcgggctcgggtccaagaactggaaagcagccttgcagaagcagaaaagcaaagaggtctggactatgaaagccagagggctcagcacaacctgctcacggagcagatccatagcctaagcatagaagccaaatctaaagatgtgaaaatcgaggctttacagagagagctggatggtgtgcagctgcagttttgtgaacagggaacccagatgaaaacccttcagagccagctagaggcaaaggagagggaagtgcgagaggggacagagcgtctgagg

SEQ ID NO: 24113 - DNA, 1161 bp, Mus musculus
cagaagatcataagcctgctttctggcaaagaagaggcgatccaactagctgttgaggaactgcaccagcaacacagtaaagagatcaaagaactagaaaacctgttgtcccaggaggaagaggagaatgtggccttagaagaggaaaacaaaagggcccttgagaaaaccaatcagctcacagaagcattggaagccatcaagaaggagagctttgagcagaaggctcagttggactcctttgtgaagtctatgtcctctctccaggatgaccgggaccgcatcgtaagtgactatcggcagctggaagagcgacatctctctgcaatcttggaaaaagaccagctcatccaagatgctgctgctgagaataataaactgaaggaggagatgcgagggttgcgaagtcacatggatgatctcaattctgagaatgccaagctggatgcggagctggtccagtataggcgggacctgaacgaggtgatagccataaaggactctcagcaaaagcagctccttgatgctcagctacagcagaataaagagctgagaaatgagtgtacaaagctagaggaaaggctgaaagggttagaagcagagaagcaaagcctacaaatgtcctccgatgccctccagaaggagaaacaaggtttgtctaaagagatcaaaaacttacagacacagttgaccgccctgcaggaagaaggaacgctaggtgtctaccatgcccaactgaaagcaaaagaagaagagctccagaggctaaatatggctctctcctcctcccagaagagaactgcagatctggaagaggagttagtttgtgtacagaaggaagctaccaggaaggtaagtgaaattgaagatcagctgaagaaagagctgaagcacctccatcacgacgcagggataatgcgaaacgagacagaaacagccgaagagagggtggcagagctggcgagagacctggttgagatggaacagaagttgcttacggtaaccaaagagaataaggatcttatggcgcagattcaggcctttggaaggtcaatgagctccttgcaggacagcagagatcatgccactgaggagcttggtgacctgaaaaagaagtatgatgccagtctcaaggagctggcccagctgaaagagtggcag

SEQ ID NO: 24114 - DNA, 1727 bp, Mus musculus
ctgtcgaagggtaagaggaggacacgggatgggctcgggaatgggcttccggtgtggaggtgggtaatggggtaggtttccagccgttgtggagacttgtctcccaggattgctggtgaaggggaagagctctgattttcctgtgttttatttgtttgtgcgtttcagacccggagtggtgccggatggaagcgggtcctgcgttcactctgccattctcgaacccgagtgccactgctcgcagccatctacttcctaatgattcacgttttactggttctgtgtttcacgggtcacctataaacttgttacttgactgcaactctggaacttgtaattccttcatctctagtgtcaggattgtcgattccacagcagccttctcactttagcccctccacctcttcttggaaagtgcctgtgaaaacagaggtggctgtgaggacaggcagagccttaaagcctgccacatccgctctccttaaacacttgtgcttggtctgagcagcttcccagatgtgctgtgctcactgctcttcagatgttgcagatccacatcctgtgtggtcttgtaggatgctgagggaggcctcccagccaggccaacaagatggttccaataaacacagtaatttggaatccagtatcacttttcttggtaaccggctttgtcttgtggcctgtattttctcctgcctcaggatgaatacaaagttgtgggcgtgtgagcagtctttggagactcaggtgggagctggaaggctcccagacttcagttgttggatctcggggaggaaggcattttcttcctgcctgttgcattgccagcggagggacggtttgttgctgtggatcgtcaggactggaccccattgcttatgccttcagtcacatgtagactaagatagtaagtggccagtgcctttccttgcatcaaaaggcaggaagaactgacaatggacagacagcaaggttcgaattctatatttctggatgtgcctccataggggtcctaagactatccagaggccagtggggccatgccaaggtgaactggagtcagggctgaataccacatcacaactagtctcaagaactactgagctgctgcaccagtgtgctggtccttggttattctgtctccaacgccattgtcacccaccactgggcacagggctgaggcggtggaaagaaaaggcaaagcacctggatccagacctgagagcagtggccaggaatggatggatcccaccgtgtcgatcctcccctttacggacatgatgtgctcccttcctgttctcaccccctaaagaagagtgaactgctggactcactcatcagccctttgttctgtggtgatgaaaattttagtcacaacatcccaaaaccttaactactgtaaaataataaaattattttcagaataaggaattgtgtgagactatctgttggcacagaagttacatgcctgtgtttgcacactatgggagggatggaggagtggcaactggaggagaaagttctgagactccttcatctcactggccagcaccacatggctgtgaacatccttctagcctcagctgctggagccaaaggagatgaggttcagattagaaaatccatcctgagattgggttaaaggagcagaaccataggatgtaaatttgtgaagccttgtggatagttctgagaaaactctgaaagtattggaccaccaagtatgg

SEQ ID NO: 24115 - DNA, 1166 bp, Mus musculus
cctgaggatgctcctccttacaaactgctgccaaacaacaaaatacatcaacaaaacagcatttgttttgtcttattattcctccacaccttattggcctttattaaaaataactataagacacctaacagctttggcagggctcactcctttcctatgtaaccttcaaatacatcaaaattaaaacatcaagaccaaatagaaattatattcctttttcctattagtctttaacaccttcagttatagaactgaaaataatctaaaagccaaagcagcagtatggtttctggtaacattcggattgcctatccagagtccaaaaccatagctatgataacaattatgcactcgtagcaacttttagcatctcctgtctccactcagtaagtcagacttctggttaatagtgccttatggacatggcttagcattgaagagatatgtgtttttggttgtaggtgaaagtatcctagtttgtaagaactctgagaaatccaagggcattgctctgcttcaaggatctctggagcctgtgcacagctgtctgcagagacagggagaagtcactgctagcatgatacgagctattctggaggtaggagttcaggaaatcatagtttactcttttatatttatcaaaaattgagcatgtcaaaaatatgaggtgagttttctttaagaacgagataattatattttatagctttctcaagtatgagtctgtttcttacatatatttaaacatacatacatacatacatagatacatagttctttaggctctgctattgggttctgttatataagttgataaatacattctaatacatgtacatatacatgtacacacatatgtatatgtacatatatatatatacatacacaaatatatatatgcatatacatacatgcctatgtactatgtatatgaatatctggttatttttagagttgaatatagcaactagcatattaatctatttaaacatgattaaacaaccaaatgacatgtggctctcttcaccttttttttggtagtgcagagaattgaactcagccttgtatgctgtgcgtgtattcctctattgagctataactgtggctcatctttactttttatacattctttattgcattttgagaaaagatgacaaaatgaaccc

SEQ ID NO: 24116 - DNA, 1955 bp, Mus musculus
ctgcccattgcagagaaactcccatcaggtgcttaagggccttcccgcccgtgtaagaaagcacctggtaatctagcacagaagcatagtaggagagcaaatttgatttttttttttaatgtaagaaacttcccagaaaggtaggtaggttataagtattcagttccctcttactattaaagtattaatatttttctctatttctttatctaattttttcctttcctttttaagacatagttttctcactctgagtaaaatgttcctgtctacgttcagaaccccactagggataagtgttccctagtattgcagctgcactgtggtcaggcgtctgagacaattgcttataatcctgccaaccaaagcagcttaccaagaagcaggtcactgcttaggggaatggagtacccaagcacttcatcttcctcaaaactgagtgtgggccagtctgtaaatggagtgagagagtacaggagaggggggcctgaaccttaggttcctgtgtaagctagaaccctcgtctgtagagcccataaggccggtagattgtttccttctcatagaccttttgggttgtactttagataaacaaagcaggttaggtctacccgcatggagaaattcaaggagcacatgcatgaagggaaggagtctgcatccaggttgacgaatggagagtactgggaactgtgccttagagctgcctcagtgtgatttggaaatctcagatggaaagctgagactggccccacttcccccacttgttctacagacctgtgccagcgctctgaattgaggagcctttccagtactgagcagtgtagaagtgctgattcccccactttcctcactcttccagaggtcatcaaaacctttatttgtctctcctttgagcctcatcagatatcgtacttcagtgcctctactgtgttgttgagcattgtaacctcaaggaacatagtcattagcatggtgttattcctgaaggcagaacttaaaaaataaaggactttcatataaggtctacagcaatgaaacttttatagtattttcccttgcattgtgacttttagttgtcattttgtagtatatgtgtgaagctaagaacgttttagagaatctgagccttgtataaagtgatgacatggttacctggttgttggatgactgaatattgacagtcgacttactacagggtaaagctggttagtttctggctctgacttcttggagcatacctaccatgagcactctttccatgtaaagatgttagaggctcctcatcggtcattgtcttaagagcacaggtgcaatttgatgcgacttaaacttttggcaatgaattgccttaaaaaacctttttatgtatttatcttaaatacatgaactgttcaactttaaaattttgttttttaaaccttcatggttgtagaaagatgttaatttgtaaaacgttaatttttaaactatatgttctttgtttcgttttatatgagattgtgtaagttacatttcagtagtggaaaatgtactaataaaggcgctcattaaagctgcatttgaaatagactaaagaggtggttatactcactaacgtacactaatgaggaactaaatatttttcaagaaaaatacagccattcctaagaagacattgggaagaaagggtatccatagtgtgttacatgtaaaaggattcactttccctatagagggcatataaggtactgtttgcaagaactcttggctattctagttgactgatcatctagaacaaacatgaagcagggatggtgtgtgtgagtgaggggtggaatttacagtggtccagtgctttatacaacagaaaagagatgcccatattataaaatacacatagatagtgggttacatggagaaatagggaacgacaaaagcaaattctatgctaatgccagggttactaggtgtat

SEQ ID NO: 24117 - DNA, 1198 bp, Mus musculus
ggacattaacttctcaggctttgggaaaaacatctcaaaatgctacctcaccctctcttggaaaattgaaaggaagcagcggcatggaaggtcctagctctgcccattctctgtatcctcaccaccctgtccctgattatagcttatgtaaaagccttgtgacgacataaaggcttgtcaaacccatgcagtaaagaactggagacaagggctgcagcgaaggctgactcttacttggaaccagcgggttttacaggcctgcgattttcccacacttgctgctgaaggcttaattaagtacttcagaaacatatctgtgttgttttacttcctgaggggaaaggtcatgttaatcagccctgagttatccaccccaaaccatccctgccattttaaaagaagccaaatggtgttatttcattttctccatcctcattacacacagggatgcctaagaatagcaaccccatctcctctgctctctctgggaaagggcttagtgtctgggaagagcgatggactaatagctggagttaaatagaaatacaaattaataatacatggcgaacagaccagaagagaagggtctgtgagactctaacagctcctctgctccaaggttgcagctgtcggaaggctctttctgctttctgtttggaaagtgggtgaaatctgagacctgtacaaggccagtaagacagattattgcctctttggtggttctttttgttttgttttgttttgttttgttttgttttgttttttttaattttcttttcccagtttggttggttgttgttctgtttatttgtaaggaaatccaattcctggaatgtcccttaatacgatgaacagtaagctaagactattatccttgtcttaacaatgtatttatgagaagtcaattacgtcccagagtaacgaactcatatacattatgagcccgtgtttgaggtttcatcatcacgctgcaacgtttttggcggtggtgtgtatgtatatgtttgcataactggttgtcattgtttcttagcccatcttttttgctggtttaatctcagttccttagtttataaaattggttgccaaaaaacgactgtaattggctgctgtgttcaacaccttgtttccagatgctcctgtctgcagcggcgccccgcttcctgctccccgctccccgctccctggctttgtacct

SEQ ID NO: 24118 - DNA, 1099 bp, Mus musculus
ggtttgttttttaaaataagtttttttttaaatgtttatgtttggctttttaaatttttgtttatttatttaatgtatgagtgctctgctgcatatacatcctcagaccaaaagagggcatcagatccctttaaagatggttgtgagccaccatgtggttgctgggaattgaactcaggacctctggaagagcagttcatgctcttaactgctgagccatgtcaccagccctacttaattcatttgtatgagtgttttgtctacatttctgtatgtgtaccacatatgcctgatgccagaagaggcgagaagtagacattggatcatttggaactagacttagggatggtggtgagccaccaggtgggctctgagaactgaacccaggtccttttcaagagcaacaactaaccactcttaaccactgagccatctcttcagctttttcctctggttttggtcatgaagttactggtattttgtgaaatgaaatgtctattccagagacagatctggaagctattaaagtgcagactagtgagtgactggtgacttgagaggtctcattgtgtggcattcagatgcatttcatctctggccttgctctgcttgtccggttactattatgcgaccatactgttcatttctagagcagcaggaggttaggtttagacttctctgactggtagtgaactgatcacctttgcagttgagggatttcaacctgattgaaaggctgactgcatctccatcaaggctcccttaccttcgagctatagctggtcacctcagggtcgaattgctgtaattcagcttagtttgaaatgtaaatgtcgaagttatttcagtcttgccaatcatggctgcttggtgttggttaagaccttagatgttcatgctgcatactgaagactaaagctgattttatttgcttattttaatctgccagttaattggcgagaataattttgtagaatcatttggggatttagctaattaagtttaattatgtgtttggggtagattttctattcttaggagattattttagtataaatatattaaattacttttttcttagccaagataagctgatttt

SEQ ID NO: 24119 - DNA, 2244 bp, Mus musculus
tcagaagtgaaggtgaagggggtttgggcatttttccaggtacagggaactctgtaacacaaacagcccataccctgtcacatattagaccggttgcagttcggagctgcaccccaacccagagcttctagaaaatcagctccatgccacgaagcacaagaggcccctcagacagaagccacaggacaaagcatcttcatagacagctgttgagatccaaacagttaatttgcttttgtttcttgtaagaagttccaaggatggacgctcaggctatcccagcctgccagcctgctgtgatctgtggctaactggcagagtcagccactgtggtccttagctgctcctgtttctaggtgtcagtttacttagtaaactggtaagaatgaatcttggaatttaataaatggtagtttgtggtttagccaactggtccagagggagctaccttctccttaggatagatgaatctacaccataagaaaaaccagccaggaatagcatggatgggttttgctttggttgaaatgatcctagcaggtgactgggtatgaggacttcatggtcactctgcccaggaagagagcgtgaaggacaactagcagcttccttagggatggtacacatgagtgtgatctctggagtcagaggtttccccacacacatgatgataaaacttttcagatttagagcggttaaaactggagatcgaatctggattgagaatcagcactgggggagaaactgttattgaaagtcaatcctttctttgagcctccgaataaactatggagattttcctgcataggaaagtgtggaatgttgagctattgagatgggagtggaattcgtcctaaatagtttttcctggtctcatctgaacaagacaatttggctctgcctagtgttctgtgccctccctttcaaaagctctgagccccgctcatgcagtccagatttcatccccctctccaagtgccttggagagctcacagcagcaatgccatcatcaaaagttttgctgctgggaagaaaaaaaaaaaaaaaaaagaaaaaaaaagttttgctggttcttggaggtgatgggagagggcaggagtatcaatttgttcaagtagctgcagtgtctgttggccaatcatctttagaaccctgtaacactgagtaccagagggcaagcccacattcctcttctgctacttcagtgtaactagggcagctgttgtctgaagcaccatagattcaggtgatcctccatagattcaggtgatcctccatagattcaggtgatccttgaaccgttcatgaaaagctgctaagtagcctggtttgggagacttgggttgagatttgcatgggaccaacacgcaggattacatcttcttcagttcctagagtcctctagaagcctatagaacaagacggcaagctctctgggcttgctctggggttttgttctgtggttttatgttgttcttgttgttttattaacatcagtgtctcttaagatccaggacccagggaggtcttttcacatacatataccaggactcttgggtactactgtcagtcttggggaagcaggctcctccatcggcaaccaaatccatgtgagcactccgaatgccttggttagtcctatgacctaaatagttaaacttcagaaaatggtttcaacagatttctgtgccgagtggttttgaaattgcatttgtatttgctgtgcttctgtattccatttaactgggttttttgttacttctgatttttgttactattaataaataaaaataaaataaaataaaataatagttggtttccttattgccaatgaaggccaatgaaatcatgaggatattaaccttttaccatgtaaaagtaggctctgagttccttggagccttggtaggggtgatatgaatacataattatttccttctctttgatgctaagcattgagccaccatgcatggcaacagtcacttattctcagcagtttgaccagttatgagtttctgcaataagtgttgcccataactgaccaaggctgacagcaacaaaaatctgtggcagtaaagaagtgtctagaagacaatttaacaggcacagcacagctgcttaaagcaatagccgtagcttcccccactatggctattctttcacctctctctctggcttacagtaccagacataaagtcctggctatggaataggcattgagtccaatcagaagagagttggttg

SEQ ID NO: 24120 - DNA, 2821 bp, Mus musculus
tatttcagagcaacctacaacctgacactgtgtaaaacacttggaaatatactttaaccaattagttgaacaattgtttagataacacctgggttctgagggcctggaactctgtagaatgggctgctctggaactcagagatccaccaggtgggagatcttccaggtggcaattccaggggtcctccacctccctagttgctgagattacaggtgtacactaccatctgcttcctgcttccatgtccatcttaacttcatttttgtttattacaatgatctcttctaagtaaacagcttttacacttaatgagaatgagaggctaaagtcttcatctgtctattcaccaaaagacagaataataatttgggaccaaaaaaatctagatgacggagtcagcgtctacccgagagcacagccttcttgcagctcctccgttgccggtccacacccccagttcgccatggatgacgatgccgctgcgctcgttgtcgacaacggctccggcttcgcaggcgacaatgctcccctccccgggccgtcttcccctccatcgtgggctgccctaggcaccagggtgtgatggtgggtatgggtcagaaggactcctgcatgggcgacgaggcccagagcaagagaggcatcctgaccctgaagtaccccattgaccatggcattgtcaccaactggaacgacatggagaagatctggcaccacaccttctacagtgagctgcgtgtggccctgtgctgctcaccaaggcccccctaaggccaacagtgaaaagatgacccagatcatgtttgagaccaataccccagccatgtctgtagccatccaggctgtgctgtccctgtatgcctctggtcgtaccactggcattgtgatggactccggagatggggtcacccacactgtgcccatctacgagggctatgctctctccctcacgccatcctgcgtctggacctggctggccgggacctgacagactacctcatgaagatcctgactgagcatggctacagcttcaccaccacagctgagagggaaatcgtgcgtgacatcaaagagaagctgtgctatgttgccctagacttcgagcaggagatggccacggccgcatcctcttcttccctggagaagagctatgagctgcctgacggccaggtcatcactattggcaatgagcggttccgataccctgaggctcttttccagccttccttcttgggtatggaatcctgtggcatccacgaaactacattcaattccatcatgaagtgtgacgttgacaccaagatctctatgccaacacagtgctgtctggtgataccaccatgtacccaggcattgctgacaggatgcagaaggagattactgctctggctcctagcaccatgaagatcaagatcattgctcctcctgagcgcaagtactctgtgtggatcgatggctccatcctggcctcactgtccaccttccagcagatcggctcagcaagcaggagtaggatgagtctggcccctccatcgtgcaccgcaaatgcttctaggcggactgttttacaccctttctttgacaaaacctaacttgtgcagaaaaaaaaagagagacaacattggcatggctttgtttttgttttttaattttttttaaaaggttttttgttttgttttggcgcttttgactcaggatttaaaaactggaacggtgaaggcgaaggcagtcggttgaagcaaacatcccccaaagttctacaatgtggctgaggactttgattgtacattgtttttttgattttgtctttttttaatagtcatcccaagtatccatgaaataagtggttacaggaagtccctcaccctcccaaaagccacccccactcctaagaagaggatggccgagtccacgccctgagtccaccccggggaaggtgacagcattgcttctgtgtaaattatgtactgcaaaaattttttaaatcttctgccttaatacttcatttttgtttttaatttctgaatggtcagctagtgtggccccccttttttgtccccccaacttgatgtatgaaggctttggtctctctgggagtgagttgaggtgttgaggcagccagggctggcctgtacactgacttgagaccattttaataaaagtgcacaccttaccaaaaaaaaaaatctagatgacaagtagtctaagaatacctgctttacaatattggaataaatgagtgaaagttggacatagttgtgcacaccttcagaccagcacttgggaggtggaggcagaagaacaggacttcaaagttactaggcttcatagtaaatttgaggccaacctgggctacaaacatgaaaacttgtctcgatatggatggggggtggattttaaccatcaagtgtgtctcctttgttcctctttgttactaaaccatgacttccaactacataaacatgagcatgaagcagagcccgttatgttcatccacagtagagtagttcacagagctagcataatcattgaacactgaaaaaagtattaagaaaacattgtatccttaaggtgtgaagaaaaatagtaacacaaattattgtcattggaaattaatacattttactaactagttgattgggcaattaaaaaatactaaaagtataagctaacattaaaaaatatgtaactctcactgctgatcattaaccaacctgtaatgacaggaagcctagttggtaagtgccaaaagtagtttcacattgtattagggcatcaggtggtctcttcaagtgtgttttattagaagccaactgtatg

SEQ ID NO: 24121 - DNA, 2373 bp, Mus musculus
cacaggtcgcttgtaatgaaatctgcagttagcttttatattttttagaactcatcttagaccctatcttttacggaagttgctagtgatttcttaatttttttctttctttttcatatttttttaaactaatgattagatgtcagcttagtgtaataggaattggccatctggaagctgatcatcttctgaagtcagcagatgatcatttaagactgttaaatgctatttggcctcattagttatgagttgcatgtgtatctaatgaatgcttagagtttcagaatccgcaatttttattatacagttattttcttttcctttttttttctttctttttttttttttttttttggtttttcgaaacagggtttctctgtgtagtcctggctgtcctggaactcactctgtagaccaggctggcctcgaactcagagatccacctgcctctgcctcccaagtgctgggattaaaggcgtgcgccaccaccgcccagccattattttattctctgagacagggcctggctgtgtagcccaggctagccttgaacttcttatggtaactcttgtctcagcttcccagctgctgggaataccacataccctgctttaaatgttttactttaaaatgtgccaaaggtgcctcttggtctaaaaatcttgatattaaatgttattgccaatattaaaaataagcgttcattataaattgtacttgaaatatatgacattttggggtgatgtaaataaaagtagagctcaacccttagtagtgcagcacgtccctgagaccagttctaagagacgctgaaatattgggtttaaatgaagaatcaagaagaggctgttggctggaatgttagatgaaacaaatcttttaaaatcaacatggggtagggaaagagaaatcataggtacccaggcaaatccctgagccagtaaggccctgtagagtaataatgaattgttaccttaaaatcttatcactaactttattagtattattaattattacgttggttcctactgctgggaagctgttcacatcgctccttatacaggagccagcaagctgtaggctttcttcagccttgctcttcccagctctggagagtccctccctgacctggtggttataatacagcaggcggccttggttaatgtttaccttttcattgtgtttttgaaaactacaaatcaagtatttagtagtagctatttacaaatgtgtttgcattcgagtgcttgtagatacaactttacatgtaaacatgtgtaacattatttagctacattgagtttgtaagtgcctttacctaaatgatttgcctttcatcaaaaagtagacattctattataagtattgctctttgtttagtgcaaaatacggagttcttaagttagactgggcatgtaacacagtgaaggtgctgtgtaggcttttaggcggcatgacctttagcgcatagttctatgccagtgcttaaatagaagtgtttatttatccttcactagttatacattaggcatataatgttatgtgacattaactcagtaatgtgtggttttatatttctgacatagtgtgatctttttaatagtaccgtaggtatcgtgtcctttgtgatcttccatttagcccttagtgtgggaaagaaagtatatggtaaattgttggcaatagctatatgatgcgtatttgacttgagggagaaagactgctcctgagaggttcctctgcccacaacagatgtaggaaatcttcatcatgctgtgccaggaagatcagagccctccagaatcaaggatggagccctaccactaccaccccaccccccagtcaaacggtgtatcttttacctagaattttatttaaaatgtatttgctaccacaaaggataagagaagttccatcctcttatgaaaacattgttactgaggtctagcgagtttcagcaacagttttcctataggttgaaaagggggtcgtttaataggaataaaaacctccattctttttatattttttgtgatctgtatttacaaaggattgaagtaagcattccactaactcacagagttgaacatttagaaggcagttttatggttgctgtcaggcttttactttagtcagtctcaatgagtgacataatatgcagtctcatgtatgtattgaatttagtggcttaatgaaggctatttacatgcagaaagctatctgcattcatcataatatacttgattctttcagccataaataaattgaatataactgtattatttaaaactctagctggaggagtcttagatgagttggcattgctgtttgctggcattggagcagtagctaagttggttggttttgtgtacg

SEQ ID NO: 24122 - DNA, 1197 bp, Mus musculus
ccccaaatgaatgaataaaagaacaccatgaccaaggcaactctcataaggacaacatttaattggggctggcttataggttcagagattcagtccattatcatcaaggtgggaacatagcagcatccaggcaggtgtggtgcaggaggagctgagagttctacatcttcatctgaagactgctagcagaatactggctgccaggcagctaggatgagggtcttaaagcccatgcccacagagacacacctactccaacaaggccactcctactccaacagggccacaccctctaatagtgccattttctgggctgagcatatacaaaccactacaatgagagttggggaagagaaatagctattgtaatgctgtagttaaagtagaagttaggaaatatcaagaatacttctggttagcatgatgatgcacacctttaattccagtacttaggaggcagagacaggcagtatgagtttgaggccagtctgatctacatagagagttcaaagaccgctagactatgtaaagggacgctgtctccttgtgatcctgtttgttgtatcctccatcttgtcctatggtgtctgttcctgttccctcccaagctgccccttcccctcctcccatcccctgtcttcctgcaaacaggaaacaaagaggcaaacaaacacaatgtttgggggatggagaaatggctcagtggtttagtgcacatgttgttcttgcagaggacctgagcttgattctcagtatccacacagtgtcttacaaccatctgtaactccagtcgtgggggatctaactacctcttctactaacctcagaggacaccagacacacatgcggtgcatatacatgtattcatacacataaataaatctaaaaagcaaaactatgcagactgtagaagaaatgtccttatagaacttgaaacagatttattttttaaaatgttgtacctgctcagttatagatgatatagaaattataaaaagggaaataattgtctatattttcatgattcagagccaatttctgtttgctttttgatggagaccacgtagtaaatagcactttgtaacctgctttttcatgtgatcttgtattgcaaaaaaacaatcttttataacaaatagcatttgtaatttttttccatcaatttactttacatcccaatccctgcccctactgttt

SEQ ID NO: 24123 - DNA, 1160 bp, Mus musculus
catctctccctgcacctcacacgcctactgagttcatcattagtctgtgtcttcattgttgttctgaaattgacatattagccagattgttgatttttatggtttttatcttaatcttttagcaacttttgatatagatgaccacatttcaaagctcttttttggttctaagataataatcttttctttcttcatttacaattccattatccatggttcctcttgccccctattattcaaacttattctgttcaatttttagaactctctttcagaatggtaagtcagatcttaacttcacctgtcaaaatctccgttgacttccatttacatttaaagtgaaattgagtttcttgccatggtttgtgaggtattactcctcttttcccacactgtctttctctctgaacttacctttctccccttactcccctacttaatggtgcagccacagtctctgtgcttaacattattttagaagtaccttgatcattatggtgaggagctgttatccttaaatgtttcatgtgcttcctttgcagaaccgagagctccagatcatgagaaagctagaccactgtaacatagtccgactgcggtatttcttctactcgagtggtgagaaggtaggtgtgagagcgcatgagctactgttctcgtgggaataacctcccccctctccctcgttcctctatcaactagctttgctaattgattgggagaattcaaagcacaaaccaggattctgaacccaagatacacagctgatggtagcgtggaaatgccaatgagaagaatgaactttaagggatcttcctggcgatgccggggaggcagcttcacagctcttgttactccaactggagggactaccttagttcaagtgtccagagcccgcagttaaagcttgacatggctgcgtatacttacaggccagatctgtgggatcgtgggacacatgggttcctggggattgatctctgccggcctagcttcaaattcagtgagagagcacgtctcagggaactgatgagctagacaccgcacacccttttctggcctcctcacatggacatgggcttgtgttcttgcacatgtgggtttctcccccaacccacatccccaacacacaatttaaaatgaaagcaaattttctgagc

SEQ ID NO: 24124 - DNA, 1099 bp, Mus musculus
gagttcatttgtagcagacattttttaaatagatttagaaactctagccaaagttaggaatccagtgatgtaggcagctatcacagtctggtgttacgctaacacttgttcttgtgtgcacacgagtgtgtctgatgctggatctttacagtcatggtcaggtgcctcgcatcattcacagaggtagggaagtaggtaggtaggtaatgatataataagttagaagcagtcaacctttaaatatgtagttcaaagaagaccctattttaaaatgtccacatgacattgattagttcgtttagttgactgtaaaatgtttaggaggtgaagtaatttaagactataaatgaaatggttcatactcgcatgtatgtagttagtatgcctgcctgtcttagttaaggttttgttgtgaagagacaccatgctctcttcaactcttacaaaggaaaacatttaattggtgctggcttacagtacatacttagtccattaccgttatggagagaagcatggcagcacatgggactggagaggtagctaagagttctacatcttgatctgaaggtagcaggaatagaactgtgagcccatggacctggacttgaacatccaaaatctcagatcttgcactcacagtgacaaacttcctccaacaaggccacacctcctaatagtgctactccctatgagccaagcattcacacacatgagcctatggctgccattccttttcaaaccaccacaccgcctccctttctcttcccgttctgttatcctcctaattccatgatggttccaggtacttcctttaacattctcatagcctctcttcaaaaaaaaaaaaaaaaaaaaaaaaaaaactttgcattcattatttctttcctatttaagcaaagatgtcagtaatattttagtgccagaaatatagacaggctttccttcttctaagaggccaagtccccttcattttagaattcatggtgaatacttgtctttgataaaatcatcttggatctttgtatttaaatcttattttggagctaagtgagatatatttagaatctttgatgtggcactaaacccagaggactctagg

SEQ ID NO: 24125 - DNA, 1188 bp, Mus musculus
ccagattttaataaagtcgtttcccttagaaaaacacttgagagaagacatcatagctaagtaatgtgaactgttagccagcctactgctttgttttccttactttaattgaaaaccaagcttgcaagaattgccacattcttatgcatagctctaattttaaatccaaatctagactctgtatttaatttctgcttttttaacatcatgctttttaaatttatttattgatgcatgtcagatcggccactatgattttaagtggtagtaatattaaaaaccacacatcaaaataataaagtcacttgtatctgctgactttataggaaaactgattatattaatgtgtatatatgttttatatatacatatattcaatactgccttttctttttgtctacagtatcaaaattgactgactgaatcatgaaaagaatgttcccccaccatcaccattaagagttttatttttgttttctttgtttatcaatgaatggtgtaagaatcagtctcttgttttttgaagaaaaagcaatattccttggaaagcaaggtggattgaaggattacgtttgtgtgaggaacagaactcataactagtttgttgatacttttaaggttggtgtctttgtgggccttatatactctaaaatgaaccttggtgcttatgggccattacttgacctatgaatctttaaggcacaatcagttatcttttacatttaaagatcacttgagtaatggccaccgctccttccttccttcccactccctccccacacatctgctaaggtgagctgatgactagggctgtagggcccttggttatgtatgagacacagactcctttaccctcattacctgaccttaagtcacgttgaggtcttgccctccaggtggttaggaagaggagtctcttggcggcccttatacaggccctagcaccctgccttgcttctccgaccgtgtgtgtaactctccaagagagttgtattgtctgccgaaatgagttgatgctagaaagacatcagtgaggctgtgcggctggctgatctcttcaggccaccgaaggggtttctcagacctccgtttagatcagacttgacaagaaaggaagcaagcccaaagcaaacaaaggcgcttttggtaaagcgcttctcagataattgccgtgcgaaagacttctga

SEQ ID NO: 24126 - DNA, 1125 bp, Mus musculus
tccagagaaagtttggccaatgccagatctcccagagttgggatttttgttattttttttctttgttttaaatcaaatttgtgtctggttcctatttacactactgattgttctaatcccagagatgaatatgtttctcctctgtatgagaagtaagcaccctttatggtgaaacctgtctcttgtggtagaaacggaagccgctgaaaacaaacatcagcacaggagagccccaggcagaggtctcccttgagattcttccgaagcaatcgttggggtctgggtcagtttcacagggttatgccattttattcaagtccgttgctccgttgtgcagtctccaccatataagcaaaaatgacagccagtacataaggggttagcttgacaaagtagacttccttgtgttcatttttaaggttttttttttcttaactatatctgtctacaggcagatacagataggtatatggaaatgtgcttgcctgtaaaatttgcatttataaatgtgttgcgatggatcacttcggcctgtacacatccaattagcgtgaccacttccatcttaaaaacaaatctaaacaaaatttattattattatatatatataaaggactgtgggttgtatacaaactattgcaaacacttgtgcaaatctgtcttgatataaaggaaaagcaaacgctgtgtaacattactacttgaatgcctttgtgactgaattttttttttcattttaaatataaacttttttgtggaaagtatgctcaatgtttttttccccctcccccccattcccttgtaaatacattttgttctatgtgacttggtttggaaatagttaactggtactgtaatttgcattaaataaaaagtaggttagcctggaaatgaaattaaacttcaccagtgtgtggtctttatttcagtgcccatccccctctcttcacccttcccactctgccatcgccacatgcagtcacactgccgtctccactcctctgacagaggaaacatgaatccttgagagaaaaatcaggactctccttctctgagatgaccttgctctgatgtgtagacaggaggtgcagcttccagcttggaaaccccctggacttaatgtag

SEQ ID NO: 24127 - DNA, 1199 bp, Mus musculus
agccgcactttggaacccctggtttatgacatcctcctgtccacagatatttgcttgcccctccatagtatctgtaacacataagaacttataggaaccccaactccacatgaaaaatataagacctcaaggcctggggagatggctcagtctgtaaagcacttgctggaggacaaacatgaggacctaagttcaggccccagcacccaggtaagaaagctgggtgtggtggcacatgtatctcagcagtggagagtcagatgtagcatccctgggctcactggccaatcagcctggcgtaataatcaagccccaggtctcagtgagacctcatgaaaaaaaaaaaaaaaaaaaaaaaaaaagcaagatggctgtgtccagaggaaccacatctaagtttgacctctggtttacacacacacacacacacacacacacacacacacacacacacccatacacacctgagcatgtgcacaaacctacacataagcacacataaacatgtgaatccagacacgtatgtacacgttgaaaatccgtaggaccttgataaagaccacgtatatcttttgtcccctaccctgtccccacctgcgtttgctctccttgaatgctgtgctcagtggtctcgttttctgtaagatttttttcccctgtactttgtgttgtactgcagaaacttactttcactcctcatctgctgaagctctggaccgtgtgttcactttaccttctccagtgctcagctgtgtctgtcagagcaaatgtcgtgtgaataccgacctaccctgcagcagcgtatgaccctgaggtggtcaagatgcatcgtccattttaagtcattgttagatctggtttgctaatgttttgcttctctgcttacgagtgagtcagacaatagagctcatggctcttatttttccttctaattgtccctcccacgtgtgggattgcatcagacttaggcattctcctgaggtggccttgaagcatcccttcttccttctctgagaacttgaacaagactgagatgatctgtcgcttcagtgtggaaagacgtacaaagccatcgaggactggtatcttcatgagaagcaatttaaccttgcttcaatttctttacagcatagagagctactttgcattcattttggtaaattatatcatttagaatctcattttatctgttcagtttt

SEQ ID NO: 24128 - DNA, 1144 bp, Mus musculus
gtgtttgtttgtttgttttattttttaaattgacttctcctccacaggtcctacttcgagaaagaatgggaaaagtacctggagcttagaggaattttggacggcaactcggctcccgtcttcccgcagccctttggtgtgaaggaaagggatcagttctacatcgacgtgagctactcgggctggggtggcagcagcggacacgatgcccccatgattgcctacgatgccctcctggccgcgggggattcctggaaggagctcgcacacagagccttcttccacggtggagacagtgattccacggccgccattgctggctgctggtggggagttatgtacggctttaaaggcgtaaatcccgccaactacgagaagctcgaataccgacagcggctagaagaggccggaagagctttgtattctctcgggtcaaaagaagaccctgtattagatccctagggagaaggtggtttgtttctggcggtttctttccctgtagccctgaagctcagtctcttcagccttttgagagtcaagaatcctaattttgtgtttgaagagttctgagataacaagtcccttggatgcgtttagccctgcctttccacatttaccctgttctccccgagttcctctcttgtgtatgagaatctttttatttcagttgatggggtcagcttttcccattcagaaacctcataaccttgtattccagtttttgtttttatcacagaattgtgcaaaatgctttgtctgacttttccttgattgggtctcccacctatcccaagtagactaaaacaaagattttttttgggaggagtttatttgggagacaattccaggaagcaagactggaagggaggagtggccacacagggtgtgtcaagagcaggattctctggccatggggtgtagtctgtgctacttccttccttcctctgcccaaggcaatcttcagagttgtcctggtgagatgccttgccatccttgagtgtgtgtccagtgactttcacgtgattggttaaggcccagggacactgttaagtccctggtggtgtggatttggtttattggttgtattatgttaattgagtccccaaaattacatggggatttgcaagtctgcatataagaaggt

SEQ ID NO: 24129 - DNA, 1173 bp, Mus musculus
agataatacaggacagcttccctttgagctgctgtgagttctctaataactggaggtaggtgtgtgtgtgtgtgtgtgtgtgtgtgtgtgtgagtgtgtgagagtgtgtgtgagaatgtgtatgtgtgtacgtatatgctttgttaattcataagatcacaccgaggattatatataaggaacactagctgtcatgccccagcatgggggtttgaaattgaggagccacccccatcatgtgtccatgactctccgttcatttcagagaaacctgggagtctgtttagttccgtgctcgcactgggtctgttgttctggtgactgacccctcgctctccccgactcacccctaggtggtgcttgcatgcagaacgccatgctgctacagcccaacagggccgacggctataggattcccttcaacagtcacgagggtggctgcggggctgccatgcgcgccatgtgcatcgggctgaggttcccccaccccagccaactggatctgctgatccaagtgagcatcgagagcggccggatgacccaccaccaccccacgggctacctcggcagccttgcgtccgctctttttacggcatatgccgtgaatggcaagtcaccatggcagtggggaaaagggctaatggaggtgctgcctgaagccaaaaagtacatcactcagtcaggctactttgtgaaggagaatcttcaacactggtgagtctctgggtgtgtgtcctagctgacttgtgggtgaggatgtgtgcacaggctccatacatgtacctagggttcagaggtcacagctgccatcagtctcactaacctgaccctgccggggcgtctgctaagtatttcaagctcctttccgtccatggttgcctgaaacagccaagtggatacctcactgtaggcacctgtggtcctctcttaagtcctattctggattatgtctttctgtaatttttgtgaccagccagtgctgagatgagcttttcttggttacttccaacttccctgagatttgtttttccagtattgttccaaacagtatttcaaaacccttggttgaaatccctagagaggtttctccaggagctagtaagctgtaaggccacctgtccccttttattggttaccttacattatctttcttagaagaaacaaggctcagag

SEQ ID NO: 24130 - DNA, 1259 bp, Mus musculus
catcctttgattgtaggagaagcagtctgcaagtcactgagctcctcccgatggagattgaaagtggcttggagaagattcagcctgagggagacgctcagaggattgaggagctgctaagcctccctaggaacccttcatcgccacatcaacaaagcaagcactgaggaccagggggctgtgtctgggaacgccagtgccaggctactccgctactccttgccagcccgctgactgatgtgagggctggaagctgtgctagcggtcacttgtctctgatctttttctttctttctttctttttttttttttttttttttttttttggtttttcaagacagggtttctctgtgtagccctggctgtcctggaactcactttgtagaccaggctagcctcgaactcagaaatccacctgcctctgctccgagtgctgggattaaaggcacgcatcaccacatggcttccgatctttttattacatccagaattaggcacccagtactcagggtgccactgacctgtaaatccagaagcttgggaggctgagaaaggaagatagtgtgatgctagcctgagctacttaatgagaacctggttaaaaaatgtgcacccacaaaaaaacccaaacaacagaaccaaaaagcaacccaaatattcttatttattccgatcattgatccatctaaatatttcatatttctctatcatgctagattttgtacaagtaaaattcttcccaaaagatttaaattgtgttgtctggatcgcctaatcatgcctcagtctttgaagagtgttctcttggaggacctgaaggaactggaggaggagcatgtccgcgagaccctcttcctcgggccctcagacagtggatagtgtgagcctctacgtttagttgtttggattttttttttaaaataagaataagaggtgattccttgccatttaaacgtggtttaacaaactggaagcaggtgggtatcagtaaagaagcgatccagcttagtctccgcccccacactgccaacaaagcacctgtgctgcaggacacagaagatgcgacatgctgtccccacagtaaggagctggctgcctgagagaagccgtcctatagatttcagctatggacagaatgggagaaagtgcaagaccgagtcacaggcagcacttttctggcctttgggtgtgttttttcaattttactaacatgcagttaatggtctgaaaacattaaatggaagatcccaggactaagc

SEQ ID NO: 24131 - DNA, 2403 bp, Mus musculus
tacctaaaatcccagcaatgaagagactgaatggagaattgctttgagttccaggatagcctgggctatgaagtgagtcatatgaaagagtcagaagtctcaaaacgccaaaccaggaccaaaacaaaacaacaaaactcaagtgcttaaaaatgaatattagctggaacaatgcttgcttttaagaaacaaatgttaaatttattcctaaatgcatgtggattatgatagttatacggttgttcgtgagaaacagctgagttaattcaaataaaatacttggaacgaggctcatgataaagtactcaaccatatgtagcctgtgatatataatattcttgttaatcttctgtccaggggaagccagttcatcataaaccatttgcagatggatgacatcacctgttactgggagaacctcttgactgactattccaaattcctgtcctataatgtaacaagaagaaaagattattatcagatcgttcccagacgtttgaaaactgaactgtagtatccatcccaggaccagaatcctgacagtggatctgagatgctctgtggtgaaataccatgatcatgatgcctgtaccttgaacacttttggacaagccaaacatccagttttccttatcatgttgaagccagagggactcttgagaaagatctagtatgtgtgtaatgagcagaaatgaaacagctcagctctttggaatcatgagataaggctttggaactgcattctaaccatcgttttcctatgatcagtcacagcttgtgcctcgggtcatctacgtgtgttatcactgtgaaatggactgtgtccatctgaagatgctttgtcctgttatttggagcagaccatccatcgtttggaactagtacaatacacaagcaactctgaagttattttaggtttgattctgttgctttatttttatgtagaaatcctttggagtttgtgaaaaataccacagcgattgcttcctctggagtctgaaggaggccagtggctgtgctctgttttgtaactgcataaattctctggcactcaggaggtttccataatgcctcagtggcatgagtaacttctgcagttggatttcagattcccattttgtgccttcatgccctttttattctctctgaaggagattaagagaaatttcccagtcctttcaggaagcagtctcactaaagaactatgcctctgtaatactagcacttctgaagcgagaggcaggaagatgaattcgtggccaccctcagctacacaggagttcaaggagagcccggctacatgaggtcctgtctcaccttttgcacatcttttattttgccattttgaatttgtagcagcaggatcagctcagtttgcagagactgcagtcttcatatgtgaccatatcatgaagtggcaatttatagagcactcagctttcgcttttactccggtatgaggttatccttgggctccagcatcacctctgaacctccttggcagttggcggctcacatctgtgttctgtgccaccgtgctgctttgtcgttacgcgcctctttcccccacgctctgtacgcttactgatggacgagaatgacgtttctctgctcttgatgtctccattatcagcacagtgcctcacgcagagcagttactgaacagctattggaatgagtgagtgggaatggatggatacactcgcctggcctaactaaagtctattttttaaactgctcggttgcttgctccagtggggatgagatacactgtgagaaatgggtcagttcagatccttacttgccctggagtagtaaggagtatctgtttttaaaaacaacaaaagttactcggctctgactcttgcctgtgtacctcactgtagatggtatgcgaatggtgggtaacagtatgtcaagtgtgtgatttcgaaaatggtttgtatggtcacacttctgaagatttctgttatcattaatactggttcggtcctaaacgtaaccattggctcctcatttacttactatagaaaagactactattgttttcaatataaccgaatataatatgttttgtaagagttgtacttggtgagcctggaaaagagaacccattgacccaagagaaaagtgactgtgggtggaaaaagtggttgggtttgatgagcagaactcagctgggctgagggataagcgttggttctagacagagatgattgaaacccttcactaatggttcctgttagcaagtccatgtcctgaggatgagagagctgtgtatgttagagggtattttgactacattttgactgacagtattgctttgagacccttcaagatcagagaacagagctgggcggtggtggcatatgcctttattcccagtacttgggaggcagagtc

SEQ ID NO: 24132 - DNA, 1149 bp, Mus musculus
ggcgtccccgtgtctgagtgggtattctttctggcttctggcttcctgcattataaataaaacagtctctgggctggagagatggcttagcggttaagagcactgactgttcttccaaaggtcctgagttcaaatcccagcaaccacatgttggctcacaatcatctgtaacaagatctgacaccctcttctggagtgtatcagaagatagctacagtgtacttagatataataaataaataaataaatctaaataaatatttaaataaataaataagtagaacagtctcaaagagattaagcgaccctttagaaaaagggggatgggccttccagttgtacaagttggccaaagaaaagagccaatattgcatagcctgattgcctcttttccagaggcccatatgccctcagtgagagagccaccttggtattaggggaggtggctctcaggtcttctcccattcctccctctggtgaagggggttgtaatggccccagtctcagtctcgtatgggctgaggatcctggaaccagtactggcactggcgggggccatggggacgagtggagggagatttagaggaagagggtcttggagtaacaggtctgctgttgaagattcttggcagatcagaagtttctcaggtctgagtctctccccccacaagaggaatttattgttccagtgcacaatgggggtcatcccagacccaaagaagagggagtgacccctggtcgtccagttgttagagtgagtttttaaatggtttccaggggcagaacagagcatcagcaactaggcacaatatgattggcagaacagtgcaccctttaaactgattggtctttagggaatgaggtggcaaggacttcccttgtctgatggtgggcaaagtccatccagtggaatgtggaatgtgcccccagacccggggtctgaggaatgttaattagcctctcccttccagaggagcaagtgttccatgatcttcccaaagttcctgacgggaccttttcagctgacagccttaacttttaggttggtggaagctagtgatttgttcctacatcctaaaaagtttcaaatgatagtcacaagaaatggtaaatgagttgccttggtggggacagaatgacatggttgct

SEQ ID NO: 24133 - DNA, 1228 bp, Mus musculus
ttactgaagcttgttgctgcgttctcttatttattagacttaacttttctagaactcattctttatttctattatctacctagttcattatttaatattcagtccctgcaaggggcaggcgtccgacgtgcttgtcacagtcgtttgcatatgaaagacgtgatcttaggtggcatctccgaatttcccttctcttctccaagcatttctctagacactagctgactggagccagggaaaatttggggaaaaaaacaaccaaaaaccaaactaaccaacaaacagaaaaactccgccgggcacgtatgggccggaaagcccgggcgccggagagtcccactgcgcaggtgcgccgggaggagggcgagccagctctgctggccgcaagcctgtttccgggggccagcgcgacgcagagctgacgtcatcgctgtgcgctgccacgtctcctcagctcccgggcgatggaggctgaggatgatgagtcttggtgatggggtcggactgtgcttctgactttagctctggctctggcacggactcccggtctgggtctggtaacctagcgacccgagagctttcttcgactgtccagtgggatcctgcctgcgtcccggcagctgtttttggagcgctttagaggagggagtgagtttgggtgcccggggtcgcggctgtgaagccgccgcctcctcccagggatccctctccgtggccagcctgtcccatgcgtgagttttacttaacctgctttgtcatctcgccggccctggcgtgcttcggctctttcggccgccggcctgagaccactaggtgattccgtcttggaggtttagtccagtcaagtttgtggtttctcgccttccacctcgaacaatcttacgctgatgcgccccagccttttgccctcaccgtactttctctttaattgagcagggatcagctttctttgcctttaacagtttggagtctttgtcccacctggcgtttgttagcctacagtggactagggaacctcggatccctctacagtagtaatgttaagcaaaaaaaaaaattttttttttcagagtatttttagtcgtatttaggaaatacgtggtatatgttggcagaaccatgtttgccgaaattgaggaaaacataatgtcgtcgtccgcccacctcccccctgaagatctctttagccctttaattttgcacgttcatttaatttcttagcggtttt

SEQ ID NO: 24134 - DNA, 1099 bp, Mus musculus
tactggctgttgactataaatcctcatctaagttggccaagctggctttgaactcgttctgtagctcaggcagcttttaaacttgtgactgtcctgccttagcctcctatatagctatgattacagaccttgccaccagactcagcacccttctatcttactgtgcatagtcatttgtgaggttgtcagaatcctgttgcctatttctggactagaaagttgttagggattgatgtttagtaagcagcctggcggccctctgctgataggttcttgggctaacatttaagaggaccaggtataagcaagcttacaggaggtctgcatgagggtatggagggaaagaaagaaacagcggtgtctggagatgtctaaattctcaacggttgggttggtagctgtggataggacacattttttacttttttaaggcagagcttagttttcaccaaatctaagctcttactgttaaggcacactgcttttgagtagaagtggatacatggataaaatgttcctttcggtgcttccacactcaggctactaaagcaggtgctgcgtctacggttcactacacagctctgatcctggcccgcttggtgctccttactctgtgtggatgggtgctctgctggaccctggtcaatcttttccgaagccattcagtcctcaatctcctgttccttggctatccgtgagtatttcagtttcatagtgtgttgacaactctctgaagttatttgagttatgcagatgatataatggaggggaaatgaggttcttcatacacagcgtaagagtttggaacattggaatgccagtagataggaataatttgttttctaaagttaggtagttggggaagaaggtataagccaagagcattctgaggaaactgagatccgtggctatcctcccagtggagaccatttcagttaggtctgttcatctggtagaggtctctaagaggtggctggctacagagtctttaagtaagtagagaagcttactgtgtgcagctcacggctttaacctcaggacttggaaggcaagtgctggtgggtctgtctctgagttcaagacgagccagggctacatg

SEQ ID NO: 24135 - DNA, 1188 bp, Mus musculus
ttaataaagattgttttttattttgatagacaggcttagtcccttagctgacctctggcttttcacccttgctgttactgcaaggtgtccttagctccttaggctgtaaaaaaaaacagggatgaagagaaacgacttccagcttctattttagccacaagtcgtggtgttactaatgacataattattgcttaggccttactaaatctgaggttgataattctcctttaggagctgcacagcactcagaactgtgcatactggtttgtaatcatacaaattcagtatgggcaccgcttggtgcagagagcactgcaggggaaggtccagcttgaccatttctgagtttcctgtgagataaacccggtttaaaagaggttggtatcaaattttggctaaaaatcaaaaatgtttttcggctctgcctccccctccccaaaagataccaagagccacaggtgtgggtcttatcagtacccacgggagaaatcaggtcaatgtccacccaagccaaggttaaaggcccactcatctacggatgagaaaatcatttggtcacctcagttaagcgttgccttatttaacttaattaataggggggagagagattggagacgtactattgaaagggcaagcccttcactgcctcccacctaaataaaaaagccaattggccttgtactacagagccggccgaaccccttctccctgtttcccacctatcatccaaaaatgcggaggaatattaacttagtgttattcttattatagtgtatttcacatttgttcagtcaaacttagccagagttccaatgccctacttaaaattcaactagaaagttacctaccaagtactaattagcattataaagtcagagcctacaactccaggcttttcagttagttgtttactaagataagaaaggacagtcttagccagatacagtttaccataagaaaagttaaggaatcccacgaaagcaggttttttctttagccctagattccaggcagaactattgagcatagataattttccccccctcaggccagctttttctttttttaaattttgttaataaaagggaggaaatgtagtctcccctcccccagcctgaaacctgcttgctcaggggtggagcttcctgctcattcgttctgccacacccactgctagaacctgcggag

SEQ ID NO: 24136 - DNA, 1165 bp, Mus musculus
agactcaagaagactgtttccccaccacagatgtcctgagattcagttaaaacgaaacatgctgcatctccagagatgtgccaagccaaggagaatgctagaagcagagtaaagcttaccccccaaactgtggtccagctggaccccttctttaattcttgcctaacttaattattttcaggacccttcaagtgccaggtggaatttacataatgaaattattttttaaaaataggtgtccttagggagagaaaacaggagcaagctcatggtctggcctagtctccctctcccactccttctgatgacactagcaatgcattccatctgacctgactttatcatagaggcaaaattgttcagaacactggctggagatggggagaaataaggaaacttcttgtgaacaccctacacacacacacacacacacacacacacacacacacacacacacacacacacacacacacacatttatttacctcctcctgaaccatgaatcgtattggtgattttgctatattgacagattctcatctgttacactctaggatctctcacaggtctgtggcaattactgttcatgatttcctgaaaaaatatttttttaaaagaaaactattttttttaaatactagagagacagtggactaggaaagcgagaacttgccgccttgtctagtgactgtattcaatgactgaacagaggccccccccaccatacaagagttttaggtgattgagtgggtggaaccagctggagccaggtgggaggggcctttacattgccagcagggccccaaagaattgagattgtgtatggcaaccgttaatgaggacagcgcctgatgccttttgtaccgaggaagataattgcctcttgtttgacaagtagagtttagtaggttattacaaaaagggcaagagttgttttggttttgtttctttcaaaataattttttttcaaaagaataacaagggttaggcaaatgggggaccttcctgtgtgctcttgggggtctgctcagcatctggaaatttgggtgtgcgattttccctgaacacattgcataccagtgtaaaaagactctgcctcccccctttttggcttttttactgggcttggctggccttgcagtttaccagattcatttacagactc

SEQ ID NO: 24137 - DNA, 1192 bp, Mus musculus
ttctattatgtagctaactgatagcctaatatatgtgttatttatcaaataaagcaagcaacagaagaatattgagcacctagcatatgcaaacagcctgtgagcactaatgatctcacactgttttgacattatatagtgtaactgaccatgtgtgtgctctttgcctcagtgtttaatttttagatatgtaccaaacagaaatttatgtggcatgaaaagacatagaagactatttatagcagcaacaaatagaaacaaacaaacaaacgaacagcagcctatacagtcatcaaaggagaggcacatttaaactcagaatcttcttttcaaggaggacagagaccattgcaggaaaccacaactggtcaaaagccaatgactgtggtgtattcaggaccaatggatacatctataatatatatattatatatataatataatataagacgacctggaaactgcaggcaagattgtcttctagaaatgacatgaaagctataaacatgatcgctcaatgatgtgattacctaaacaggtcctgaacaatgacaatggcaacatcaatataccccggagctcttgactctagctgcatatgtatcaaaagatggcctagtcggccatcactggaaagagaggcccattggacacgcaaactgtatatgccccagtacaggggaatgccagggccaaaaaacatgggaatgagtgggtagggaagtgggggggaggatatgggggacgtttgggatagcattggaaatgtaattgaggaaaatatgtaataaaaaaataaaaaaacccacaatataccaatagttattatgaaaagaagcaatttcatgggactccattcctaggcaaattactatttacaaacaaggacttctgtgagcaaaaaaaaaaaaaaaaaaaaaaaaaaaaaaaagccttcccaggaatgaatgagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggata

SEQ ID NO: 24138 - DNA, 1163 bp, Mus musculus
tttgccaacaagcaacctctgtgtgtatagggaacagatgtagtttcaagttccagtttggtgacatgagaattaagcatgcattaccaatgcaagtgaagtatttatttaaaggaacatgataatatgaatgcctattttataaaatctcaagttggtatatgaaaaacctattctagtctctggcagtggaggtggaaagtttaaatagactatgacttctgaccactaataattggcttccttcataaaataaaattaaatgagattactaagtgacatttcctatgactaacgccttagaaactgatcttgtttgtatccttttcatttaagtaaaaatgtagcattaaggaaatgaaaaactgtggctgcaaaaattctaggagtactctatctcaatgctctccattgagcaggtgataaaatttatccaaacagcaaagttgtgaacaaatcatggaagaagttctgttgttgatatttcaaggacaaaaatatgctgatactattactcattctgtctacagccataccaccctgaacacgcccgatctcatctgatctcggaagctaagcagggtcgggcctggttagtacttggatgggagactattactcattctgttttgatttgtcccaaactttgctgagtcatgtgtgattcttacatgagaaaattttatacatagtacagcaaataaacattttaaaaggtataaaaattaaaagtaaaagatatgtggatccaatgtgggtttgttgttgttgctttgttttgttttgttttgttttgtccatggcctcactggaagtaatctgtcctcctcagaactgcctattgaaaatgtacattcatgagattttatgggtataggtatatgctttggaattcctaggagacaaatcttaaagcatatttttattcctctgcctattacagtctttcatcttcttgtctgctatgatctctgagccttaggtgtataagatatgttgaagatgtatcacctggggctgggaagtaccatgtagcctctggttctcttcaattttattgtctcttgatctctgtagcaatctcagtctggtgcaaagacaccaagtgtaaatcctgaaattgtaatacatacaaggcaccttatgcagactaaaaaaaatgt

SEQ ID NO: 24139 - DNA, 1220 bp, Mus musculus
aatcatcagtcacagcaaaaacggtcatggtaccactttacattgacctaatatgtctgtttataaaccttatgatcttctctatgcagtggaggtaacacgggaggggagagagagagggggaaatgagttgtacatggattgctatggaaacaggagctgaccaatcaatggagagtcatcagaacatacgcctcctcttcactgcagaaatgatgaattgatgtccggatagaacaatccttttggctctgatgccacttgtagtgatagtttctcagcatccattagaagacaaatgtttgttgtgttttttaaaagaatcagacgtgtgagttcttactcttgcaatttccggactccatatgtagacacatactgtctttcctttctataaagtagtctgtacatttctcacatgctctctaagtatggcctaattttcggatgctctaatcctcacgcaatctagctcatattccctcctttcgccttgctgtcccaagctgcctcagtcagctagagtgtagccatttctacaagattaagaaatatatggccggtagtggtggcgcacgccggtaggatttgctgaaggaggcagaggcaggaggatcacgagttcgaggccagcttgggatacacatttggaacaacattatgaactaaccagtaccccggagctcttgactctagctgcatatgtatcaaaagatggcctagtcggccatcactggaaagagaggcccattggacacgcaaactttatatgctccagtacaggggaacgccagggccaaaaagggggagtgggtgggtaggggagtgggggtgggtgggtatgggggacttttggtatagcattggaaatgtaaatgagctaaatacctaataaaaaatggaaaaaaaagaaatatataaataagaaacaattcaaacccctgcctcattttagagctaataaaaaaacagatgaagaaatgtgctggctttagaacaacagagcttaaccatcagaaacatgaagaaatcattgtcgtatgcatctaatctattgaatttagatatgaaaacaactgtttgagggggaaaataaagttaaagaacctttgaagtcagagtctaaactataaacagcagtatattccatttcacaataatctgcttgttgtgagataagccctgtttgggaaagtgtctgagtttctttcaagaaatga

SEQ ID NO: 24140 - DNA, 1169 bp, Mus musculus
ctgctataaaaaatttcagcgtatacagtgatttcaagtgaacagtgttccaagttactgctgcaacttgttgccattgaaaaacttagaacatccaaatactagtttatggaaaaatagtgtgagctctcaattcaaggaatcaatggctagttaacgctctcacaggatttactgggattcctggtttagcttcttgtctcaaggacatttttctatattgtgggaatagaccccaaccctctgaccctctccacaaatgactatgtcaggatctgactacgttttgtatttttgcgttacagttaggtttgacttgacttctagggaaagtagatgaaacaaaccaacaaacaactcgcttattctctcagatccttgctcgttagaattcctaataaatcgtcagagtgcccacgcaggtaggacatggtggtactccagcatctcttgaatcctcccaagaaacttggttttagaattgttgaagaaccacagatggttctgttcagttgctctagtgtaaaagcctaagattggggttctgaattccattgaattccatttgcagaactttgtgtctgaggtcaaacggtgctgaaataaacctgtgaggagaagaaattggagttttctggaagtctctgagctgcccagagagtgaggcaatcaggcattggggctttgattcaggtcttagatgacagaagtacaagcatttcagctatgaagagcaggttgacaggtatacccccaccaggctccagagcaataatgccttttcctgatgaccttctagtgtttattaggttagaaaaaaaagcttaaaaatgattaaattttatccatgttctggaagctgtctttgtttgtctgcctaggtaggccagcattttgggattctcactataccaagatcctgagtttattgactaggtaatgaggcaaagagtatgttttttacttgagggcaatgctgggggtgggtgtttagatcggttagatatggtgttgactctgacacctagttaggtggcaaggctttgggacatatagcgtactcctgtttgcctgtatgactttgactgattgataaaggaaaaagatagaagagcaaagccttttcaagtgagttgtttttgtgtcatttctgcagattttcagaagac

SEQ ID NO: 24141 - DNA, 1166 bp, Mus musculus
aaccacacccataaaatataataaaaataaaattaaatagtgttaaatagcatctcaattattaataagaattcaaagttcaaaggttgttttaaaatttttggtttagtttagttttgatcttgagatcggatgtagctcagactagtcctgagctcttttgtctccacctcccaaatgctgggataacaagtctgtggccccatgcccatgtcacatataactggaatagttttgtgaagaactttcaaagctgttaacgtttgagacaattataaagtattgctatgagtcattactagttagaaaaagtccataatataataaaatgtgggaatgtctgcatcaggaagaaaaaggatttctatttaatgacttttttcatggattaaacaccgtatattctcatttagtgttatgaagaaactaaaattcaaagaaaatggtgactcgttttattcacaactagcaagtgtggctacttgaggcagatccaggctgcttgactttaatgtccattttgtttttccagctttactctgcttcccttgtatctgctgatggagtgtgtgtgcctgaataatcatggcaatgatgaaagctaatctttcaggtcctcagccagataccatcacgacgcacagtacacttattattcttccccttttctttctaaacatttcatgttgatctgcctaccttttccttatgaaaatgctatgagtcagatggaaaacatgaacgaacagatatgatcacataactaaatattacataccacaagctagctttcccccacctcaggtttcttatctgggagaaagtgctatgaagaatattactggcttatcatgcatttcaaaagtgaaataattcttcataaaattaaaattcttaattttaatgaaacagatggtagtcttcatagcatgtttcatttaattttttagaataggcaattgatttcaggtcagttgatgaatttcctgctttatacagaaaatatctcagaaaaagccactatggaaacatttaagatatgtttagatcaatctgaggtccgagtaaagacacaccacatgtcttataaatcaccatgagatgctgcattttgcaaaggtctggagagtgttaattcttcctgcagagatataatagagtgcaga

SEQ ID NO: 24142 - DNA, 1110 bp, Mus musculus
cttgaccttttccctgtcaccaaatccactgtcaggacaccattataggacactactgagcatgtagatttcatttctttaacgggaactacattagttcatccagcactcttttatttctttaactgtctgtggaccaagttcttctgcttacttttggccttgatcatcaagaaatctctgttcctgctcttggtgttgccactataagtaggaaagtaatttaggcattgtacttttgtgctttgtgcttaaattcagggactagcacctatgataagcaaatgtcctatcaatgagctccccgaaacctaacatatagatttgtgagtttcttattgtgattttaaaaataacttctctcaactttaaagttttgtgtgcaaaatataaagtaggatttccagtactaataatttctgtgttcatacaatgattaatagtttacattgtttacacttattttatatatttttaagcatgtgtctgggaggcaaaaacaactgctttgtcgctctctttcaaatatctagttcaaggagatagagtaactcatcctacatcaataagtttgaattgactgaacctgaaattgaaatttagatttaccccccttctatgatgtatggatttccctgggaggtacaatgtttctcccttgaagtgtaacttcattaattaatatttaatatgtgtatgaatatatgcttccttatacagtattgaatttgaggtaaaatttgtgattttatttttaattggtgaagtctcctagatttcctaattaaaaataacaagaaatatgttacctttatttgtagaatttctgatgtcactatagaaaagctattttcttatatataaacatagtatttcagaattaaccttttcaataataatatttataattggggagggataaaaatataagaaaatccctttgagtcaatcattttccttggacagtagtgtactttgaaaacaatggttcatttttgtttactcactattacgcttgcttattcaaagtgatttatgtttgtttttgagaagtttttaaaaggtgtttctctgaaataaattgtattttaaataggtgcggactagata

SEQ ID NO: 24143 - DNA, 1108 bp, Mus musculus
gcactctctgatgttcttccaaggtataaagtctctaatgtccattgaggtagaaatcagtagaatcagattgttgaaattatgtggttactagggggaaacaattaaaaattagaaacaaaagtatttagaaagtcaaatgtctgtggtaccattttttaacaaagcatcctggttagaaatgagtaacggcattaggagctcccacagattgttctgcagtgtctcagtttctaaacctacattaggaatgtaagacaaccaagctgcattgaaggaaacaattgagtctttttgaaatccaggaactataatactatgtgaccctcctatgcagtatgtttgattttgtgatccatttattgaaaccacatcatctgccagattctatatagatttaatctaatattttcttcctgacattacttgttcacctcaggaatatttaacaaggaacacaagacccaagactgagagctagtattcagactttctttctgactcccagactgctctctctcttcacgattactctgtgaaatccttcatagaagacttaagcagtgcaagttacaacaaatgggacagagggtctgtgcaaacacaccagagaaaaaggaacagggagagaaattgtttcttctaaaggattcactgagaacagtctcatattgtgttggatacacttctctggactcctctattattttatagtatcctagagtcttagttaaggtttctattgctgtgcttatacaccatgaccacacccatggcaactcttataagggaaaacatttactatgggctggcttacaattcagaggtttagatcattatcagcgtgatggaaagcatggtgctggagggttacctgacagttctacatatcgatccacaggcagcataagtagactgccacactagggctggcttgagcatgtaagaccttaaagcctacctctgcactcatatgcttcctccaacaaagccacgcctactccaacaaggccacacctcctaataatgccactcgctatgggccaaacacatacatgagtctatgtggtcattcctattcaaaccatcacacacagtattttctatg

SEQ ID NO: 24144 - DNA, 1099 bp, Mus musculus
atcatctttttcttaagtctacattgaaataattgaaaaactacccaagttttactttcatccatcagttgtatttcacttacacatattatagaagtaaaatttatcattatcattcaaattttctaagaattaaaaaatcatttttctaggaattgaacagactgcatttgtcataaactcaaattttgaaaacttgtttgggatgaattttttcctgatatcaaattttcaaaaagatgttccgcaggaaagccatccgttatgtcatttggggagtttggcccagagggcagtcatgttgaccccatctgcagaggttggctaaactagaatcttggactaagtaaatcccattcatcaaggtccacataaagtaaagtaggtggggagcagggggacagatggtagggtcgacagcaagaaagttgttgttgacattgatgtagacccttcttcttgccagagtgactccatggacttcttttggcatgaaagcctaagccaaagctatcatcttaatggaaggtgagctgcaggcacactggagagatctagacacagtaggtatctaggattggcttagattctgtctatcagcttgactgccatacctatttgattgatgtgcagtggggcctgaaagtgctgttttgatgttaaggattgtgtcataaggttcctgatatggtgcacatgtctggatgagattggacattgactgtctttgcctatgccaagcaacaccagacttgagtgcattattctgtggatcagtagcagatggtgagtgcacacatttggagggggtgtgccttcaaacacaatatggagccaacaaacttagaaggttagtgcatgtcttgactttggcagctatttttaaacaatgacaaaaatttcccgtattagctatttttactttgagaaaaactaaacacattcgtgttctaggcaacagaagtatactaagcaagtatactattctctgtgttggtcatgtcgggtggagagagctcttggcattggctaaattggccaagtgagtaattttggattgtatatactcaaacttggtaccaatataattgttaacaat

SEQ ID NO: 24145 - DNA, 1115 bp, Mus musculus
gatagtcactattctggattcatgaaaaaagtgaggaaagattataggagaggtaaaatttaaatatagaaaaaagtactgtgttgagctcagttagtaattgtcctaatagttaacaatactgctgatcatcaaaaacacaattactgcttgcaaggatggtagagtttttatagttgttgtgctaagattagtaattagttcctagaagtatctagatgggaaatcttagtctattaaagaatggcagtgagtgctccaggactctgcacggtggtggcctgtgttcaatgtagaaggcttggtagtagaatgagcacctctgctgtagaaactacaaggtgaactggatgaatgagataataataagtcatttagagattggtgaatccaatgttatgagttgtgaaaacataatggatgaaagaaaattcaaacctgaatggaagggcatgtttagaaatgatgaatttagaagtaaggaagtaaggtccatgcagactactggagcctagatttgcaaagttttatgggaaagctgttgagaaaattaaagaaagactttgtgaatagaaaactcataggcctagcatagaatggcatgcctctacccacaatggatgttaacatctgcatactaatacttttttcctgtacttgtaggtaaccatttccactgattagtgggcacatgtgttataccgttggacgctgtttcacattctctttatgtctgggtgagggaactgtagatgtacattagtatgtatttgttgacacatctctgcatttacctgtctgtcaatgggactagtaggacatggaatttttcatgggcaagaactccgagtcaaagccgtgcccttggtgctgctgctgctgctgcaactgctgtagctttctcattttagtctgagggtacaggacatcttgttagttccaacctaactttggaaaatagaagttgtatccgatataattcagaaagacctgtcgaatgtttaccactgttctggtagccaatagatatagactctttaaaatatgtataattttccattgtacagccatagtctatatctcttttctgtctaaagacactgttacattattct

SEQ ID NO: 24146 - DNA, 1169 bp, Mus musculus
atactgcttccagatagaaagaatagaaggcaactaaagttatatttgaaagagaggaaggatattttcttcatattttttttcttaatttttattattttaaagtattgcctgggttgctaagggcctccgaggcccgcccaccctgctgtaatttcaactgctgctctgttttcgatgcatagatctttgacttctagcaggcttcagtggagcgagccactgaacagttatcacctatctatctagaattctgtcctttatcatgggaggggtgtgctcttttacaagcagatttcttccttctccaaaatttcactgagctcttaggattctagagttccatgagccttgctttgtttcctctggtgaaacactagtggtccagacaccttgacacaggggtctgtttccttcatggtcctcactcctctcccctgcctgctcaccctctcagagcactgtgtgggcgtcactctgagaagcctgttacaaaccacagtgcattgatgccaaaactcctcccttcctttcacggcctctgactgcccaccatagctcacagggctgagttaggatggtcattctttagttgattgttgactcttgcttttttggaggaattaacagtttctctgtgctaacatccaactttcaaaaggccatgaatctccagcatcatcctggatgctgctctttctagttgggatttctctctttggtgttgatcaagaaatcataagattttccaattatatacagagtcctgaaggggttccagcttaaaaaaaaaaaaaacgggacttttaaaacctagataatactcactaagtaattttatgactggccatgttttagcacacttaaaaggaaaagtaactattccaataacacagaaacacaaaactacatttttttttaaaaaggagattttctttttaaattgctctacattttaaatcagttttcttcctaattttcctgttagcattttatttacaaaaaaaaaaaatgcagcaaatgagggaaaattttccaaggcaagcaactctataatgactaaattggttttattcatatattttagacaattggttaacttgaatcttttccataagttctttgtgatgtttagtagtttgtgcaactggagtatttgtggcgttgaa

SEQ ID NO: 24147 - DNA, 1178 bp, Mus musculus
agcctcctgtttttgtaagctgacacctgtcaagagcaccaacagcccgaacaataactaatgcagcaaaaataatggtcagaaacactatagtatatatttgagagattaggaagtgatttttcttcttttattcattaaaaaaaacacacacacaaaaacaaaacaaaacaaaacaaaaaaacagcgtgcgtaccccctccccaacacatttcagaaaacctgcatctcattttacagttagatagttttagtttttgtgactatagattaggaaatgttctggaattgaagctggtagcaaacacatttttttttctgcactggacattaggacatgtgtgcatggatgcgattccttcaaagaaagtgaaacatggcaaagcaaagggacaatactttcacacattaaaacagttgtctgctatctgtaaaccttgatttaagcataattataacttcatagaaatctgaaactggaggaatgtgtattttatagtttgtttgttgatttgttttcctttatgtctgtcttctcaagctagggaaatattttgattctctgatttgatgctgtccccgtatgtcaggcaactgccctctaccccagagtagtcttctgccccttagaaaagccttcagttttccatcaaggggtcatttctcatggaagtcttaccttccttttctgctgttgcttagagctttgaaaatgaaagaatttctgcactttggggattggaatagttaaaacagagcatagtccttggaggaaaaactatctttacctgaactgacaggtctggggccaaagaatggagccaaccactgataaaagtcattgattttatacttcatatcatcatggcctcctcaaatcctttttggaataaagctggggacaaatttattttcttttctttggatgtttcttgtgagtatccaggacagaattcccagaaaggaaaaggaagacgcattagtaaaaatactcacggcatctgatcttcccactttcacagtagtggggacttcagtcatggccacttaaagctctctatggtcctaaggcccctccctggcacagagatggtagtaagaaggacatctccaggctgccagcactcgcctatccatgcctagcaacacaaaagaagaaaacagcaaattaagactgg

SEQ ID NO: 24148 - DNA, 1134 bp, Mus musculus
aagagtgaggaagctggctgatgtgacatgaagtcttcatcttggctcacaagaagacagaaactcccccactacagcatatcccagtgtgcctggggtcatagtgtctgtgttcagatatcctgtcactctgagcatacttttctatcatggtaagacctagatctctgggtaaccaaagaggaaggccatgcatgtggtagagccctgtgaggtggcataagggaacagtgcaataaacactgcccgccatgaggggaaaggcttattctgacacaaggtaggccaactggaaaactggagaaagggttggacatgtcctcagagtccacaagctgctccatcctagaccatccttaagcagagaccttgatatagtgcctaaaagttaaaagttgttgctccccccccccaacttttctgtgttcaatttacatttattgcctttttaaatcttagaagcaatcggggttgacagcgctttcgtaattactaatgagaggatcttgtgctaccggaagagcaatagactgtgtggcgactcaaacaagtgtggggatgctgaggggctcctccagagtcccggatgacagctcttggaaacccttgtttgctaagaatcacagcccttgtaaacacctaatgttgagtttctttgaacactgtcccacctgaggggattcgtttggaaagcttccatttcaggcctctttaacagagtatcaatctgatgctttctccttcctccttatgataggtctcattctactttcccatgtcagagtttctttttatatatacaaaagtgccagccttgctagtttaaccctacagagaccattcagaactaacttaagcagcaacttaggagaactcaaagcattatctgtatttcaagcaggctcctgaatcagatctcatagcagatgcctgggaatgcgtggtgggaaagcactaacaggacatggagacacccaaccaaagctatgagaggaaacagttgacctttaaaacagtctcaccttaactttccttgaggcattggggacaagtttttcttgaaacttgcatatccactccagttccttcaccaaagattttcttctccagagcccagcctcctttctcccaggc

SEQ ID NO: 24149 - DNA, 1114 bp, Mus musculus
ttgttcttattttatcacagtgaggtgagcaaggcaagttgcctcgttctcccaactcggtgcttctgcttgtggggtgggggtggggcggtatagacaagggtgcactcctaaagctctctggtgctgaagggcctcaaggttgagtttctttcagaaaatgtgtatggcacactctcaagtgcacacgtgaacggtgtcatgcgcactatttttaaaggacaagggaaggggctctgaagtgggttttgctttctctcatgacatttgatttccctggtgccttattcctattctatgctggcactcacatgcccacaggaacacacgctgatgtcagccccaggagtgaggacctctaggtgacagttgagcatgtggggaccatcggatattggggtcagttggtaggggaggaactagatggctgaaaatacacagggactgcacaagcccatcacagtcaagattagtaatgctcatatgtgagtatgtgcaatacatgcacacacaaacacacacacagacacacacagagatgcacacacaaacaccaaatacactcttcttcctctgaacattgcttccttcttcatttcctgtctttgccttctcataaaggtgctgcttgctgctgctgctgaggtgcccggagtccagaatgcccagtaatcactcaggcacaagcctggcactgccacgttcagtccttggcaagaccaaaccctggtttctcttgcctggggctgaaaaccgtcagatttttctcatcaaaaaaaaaaaaaaaaagttatccaaggaatcagtggattatagttactctgcattaaaaatgcactttaaaaataaataaaagctccagactgtttaaaacacacagagggaacaggagaaagataaacgtgctagtgtctgaacccagttcagcatatctccagttgaaacagtatacactatattatgtataaatgtatacacacttctatatatgtccacatatatgcggtgtgtgtattatacaggtataggtgtgtgtgcacgcacacaggtgcacatagcatatcaagtgttcattacaaatccagatgctcatttcacaaacagcagcagagga

SEQ ID NO: 24150 - DNA, 1180 bp, Mus musculus
ttgccagattgcaggaagcagctgagaaaattttgggacctgagggtctgttagtccgacaacttgctcttgaaaacgccaattcagcatgtagggctgctctgagaggtaaaaccaagagtttagatataaatggtatgatcaagctttgtaatgaggtagatgtgttttctcaacaagtttctaagtctattaacctggccattggggctgctctaactccagctccaagattggtgccaagccccattggcccaagttaaaagtagacatctgtgtcctcacattgggtatagatgccgcctggggcacccctgattattatatgcctcaattaacagcagttaacacaggtaaatttgagccccctcctcaaaagacgttttttctcatcatcggccgagtgtccagacttttacaaggcctaatggtgactcctacagtggttgacaccgactaccatggggagataaaaatcttagtcaccgccacgcaggaaccacttacccttagggctagagagcgcatagcccaagccttaccactcccactattcggccatttcccttatatgaaagaggagcgaggaccttcctctttgggatcctcggaagtctactgggcacagaaaataaccgattcatggcccatgccgactttgtttctagaggacaaacagttcaaagggctcctagataccagggcagatgtgacagtaattccctcaacacattggcctgcagcctggcccttacagcccactaagggatggtgtaatccactgatcataaaatttactgctaagaggaggaacttagaggcttgagaaagttctcggctctctcacctggggcctaagattgtatcaagataactatgacaatggcctgacctttaaaaccatccctaacaatcataaaggatccataggacttccaggcacccgcccccctgttcctgccccagggtgtgctacgaccctgtttcagcccactctccctgcggggaggcccccctcttccactgatttactgtggtctatattgaatgcttctgctttagccttgttgcataagacacaaagagataatgcgtcagaatctgaagattgttggatgtgcttttctgcttccctgcacttttatgagggcatagccttatttgaaaattttaccctgct

SEQ ID NO: 24151 - DNA, 1240 bp, Mus musculus
acaggtggctgtttacaggcatgcccagttgagttatagagcccagacccaatccccgaggcaagccttcccacaagagtatatagtagtagtctccatccaagagaagatgtagagattggctgagacagtacatgcgtgtgagctttgtaagcctccgtatgttatggaggttgtgccggggccgctaatgctattctcactagtgggagagaagcttcgtttgccagaagagcatttcctagtatcaggtgcctttgcactggctctgggaatgctctgagcggatgagtgaccactgtggatttcttagcctccagacttgagaggttgtgtctatcagagcacccctcgagccttgcccagcaaggctgtttgttattaccattggtaacctctccagtaggataggtagcctgggttctagatttcgtagtcttcacttcctcgttctctttgacttccttctctcaggtaccaggaagactttgacccgcttgtaagagggtgctcctgttactgctgtaagaaccacactcgtgcgtatatccaccatcttctgatgaccaacgagctgctggctggtgtcctccttatgatgcacaactttgagcactactttggatttttctgctccatccgagaagcactaaagaatgacacactggcacagctgaaagaactcatttgcagacagatgttttgagaactggaaaatataagcctgtctcatcttcagaaacagtgaaatggcagagatctgagctctcagcggttacggtgggaccaaagagcatctgccccaccctgcccacaggagtgtggaggaaggccttctgcagatttcttggcccatatcgatcagaactgtgactttatttttctaggtttattcttctagtgagattcctttagttgaagacaaaagtattagatatgagagagccttgaaaggatttgaggttttaggaaccagtgagatgggtgaggcccgagtggagatggctgtcatagctggaagcacagctattccctggagaagtcatctagctgattccacaggcttttatttgtttctcctcatgctctcaggggctttgggccatacctttgtcttcagggctaccacaacaactaccacttagggttctcctgccttaaacatgttcatatgtcccaggaatatggggctcaggccatgcttttgtgatccgttgacgtcatttggctacaagtcttt

SEQ ID NO: 24152 - DNA, 1867 bp, Mus musculus
acatgtactgtttctgggattccaaagatcagagataatttgtgagaccttaaatttgccttggccttgttgctccgtagaggggaaatgggaactgtgcacgcagctttttgcagttggtttctaagagacagtctacaatcagacctttgtgctttatgatcttaagatgtttgtgggattctggcattctccagacagtagatttttttcacttggagtcttcaaaaaggcaagccctttgtgagtgggttgtcccaagcatccgtggataagctagcagtcccttgaccatgggagcaagaactccccaccaaagtgactccagataagcaggtcctcttgtcctacatctaagcttcataaagatccctccctgttcccatcctttatgttactgccatactgtcatgtatattcccaggaaagaagacagagcttgcttctgaaaaactcaagggcaaacactagggatgaagactggaaggaaggaggaattccttccttggtagaaaagtgttttaggagcttacaaagtactgtgtaggtcaccctcactgcctcgtcggcaagccactctgacactgctaaaatgaagccttaaatgtgttttggggacaatgctgtctgctccctcaaccacatagttgctaggatattgtaaatctctgctctcccagtggcattttcctctgatgaatgcactgactgtttgttgtccactgtaccgcctgcctggaaggcaactgctgtaagcttgctctcttacgcaatactccttggtactctaatatttttagcaaaagaaaactttgtattcaagaacttcccactgccagaaaacacaattccagtaagagtctatgtaatactgatatctgcctgcctgacttccttcttttgggtaggacatcagcttttattattaagctcaattgacagaagtgaaaacttgtagaagcacagctttaaccatgacgtctaataaaagcaatgctccacgcactcactcgttgctttaaactagccgagtagatttctgtgacggaacttcccgttagccatattttggtaccctgcctttcgaaaaggacacttctcaaacaagcagcgggttcgagttgtgctgcttgaagcctggtttgctcagcgtaactttgcaggtgaactgtttcatgttaaacacgcagaggccgtgtggtgggaatgaaagccatgctgactaaactgaacaccaaatgaaactcagtgtgttcttgtgagtgtttgctgagattcatggaactgtccagaagcagcggccagactgagtcctgttgctgtgagctggctctgagcattccactgtaggaacagcaggctgaatggtgagcagagcacatggctctcgccacattgggcttgagacttctaagtagtggagatgtcctggtgtcgcgtttcacctttaaaaacccctacttaaaaggcaaagcttcaaacccagagctagtctgctctaatggtacaaacgaaagcctttcaggcagagccactgacaagatgccatgtcagagcagccaactcaagcttgtgccagagtctgggtgattggatgacgtgtgatgtctttggggccttttcgtgatccgatttctgtgtctgatggtagagtaagtgaatcctgggaatgactttaatattaaattcagtatttgatatggatggcctacaacatgaagtaggattcccgaagccaagctgaggctgagggctgggctctactctttttgtccctttgtctacatcttagcctttaaaactggaattttacaaactcctgccttttgtgcaaaataatgtgaccacattgtttaaaaggaaaata

SEQ ID NO: 24153 - DNA, 2699 bp, Mus musculus
tagtttgatcattgagtgtcaatagcaggcaaaattcagaaatgaaatgtttgattttgttttagtccatttgcacatttccacttcaaaagaaaattgggcttacctgcgatttaccagttgatactccatattaataaataaactatcatacatcttgaaaattattttctataggtaaatttgtattcttttctttttcaggatccagtgaaagatggcgaggcaaagatcaaggccgactatgcacagcttcttgaagatatgcagaatgcattccgtagccttgaagactagaactgtgatttcttccctcttccacggcaagctcatacgtgtatattttcctgaatttctcatctccaacccttagcttccatattgtgcagctttgagactagtgcctatgtgtgttcttgttcattttgctgtttctttggtaggtcttataaaacaaacattcctttgttccagtgtttgaaggagctagctcccttacctttatctgaagtggtgaatgtagtgcatatgatatacattgtaagatacacattgtaacatgatccatactgtaaacttgtatgtaaggtgactaccccttccctcatctccagtaaactgtaaacaggactactgcatgtactctgttgggaatggaaggccagaactccataccgtggatggatgggtacttaggaaacaactcagcatttgtagtcagaccacttgtaacttagtggtttgttgagtaaccattttgcaggaaatacttccatttaaaaacataaaagattaatgttccaattatttgtatcaatcaggaccatttttgtggggcacttgggaactatttgtttttcaaacagacatttgcaagactgaacataatagataaatcagttacctctgaaaatgtgaaagaaaggaaaaaaaaaagaaccaggtggtcaaacttaaattgacatcatcttgttaaagcatattttatttcactaagagaaatttaatatcagagacttttatatactcaattactagaaaaccttttttttaagtacaatttaaaaatcattgaaaatgtgatccacatcatagccattcttttcctcagacttagtcagacaagcttctcagagtggtgggatggggattagaataccacagacactctgcagtgcctgcaggcagtcggccccaggacaaccactgctgtaggagtttggggccagggtggcatggttttcacaaggtacacgtgtcacgtgtttgtttgcctgttgacattctgaaaacagcaagtttaccaattgcagaaaatactttctgttttctctttcacatgctcagaaagcttctcaaaggtatctggtcacagcagcttccttcctgttatagaggtaaaaggtgttcttatatttaactggtaacaaaagaaaaaagaaaaaagaaaagatcaatttttgtcttgatgtttcagtgtgtttaaataataattcccatacttgcttaataaggctcgcttcagagagcttggcgagcgagctccctgttcactctctccagctgatagtgctgtcagtatacacttcagatgtaatgtgtaaatccttgctggtgcatgtctacacagtggactgctgctgaagaaggatattcttccaattattgaacactgttgacagatatggattatgcaatggcttgttgggaggtggattagtggtgctgcttaatcggtttgcttccaatgtggcttcgtatccaggagccctgactagcggagatgagaaagatttcaaaacctgtctgcttatacctaccagcaacctaggcttgtgatcagaatgaatgatcccaagaaactacttgaccaagtttgtttttgttgtcctggattcgagatgtgttttcttccttgctctaagactgttgatgtatgagtgtgaagaggctacagaaacaatgcccagattttcactgtaactttccctttgcccacactgtagaacttgagattgttcactgatagtgcgtctttagtaaggatgtgttaaaatatagcagtctttttaaaagattatgcagttctctatttattgtgctgtgcctggtcctaagtgcagccggttaaacaagtttcatatgtatttttccagtgttaaatctcatacctattccctttggaaacttccatcctgaacaatgaatagaagaggctatataaattgcctccttatccttaagatttcactatctttatgttaagagtaatgtataattattaaaatctatgaaaaataaaaagtggatttaaattaacttttctttccctttttattctttttgtgggggaaggcggggtgagagctctgagaaaacattacatgtgtattttaacttaatgttgcagtatgtccttttggaagtgttttactgtatgtgtattacacgcatcttgaggttggattgtggcattcacaaccgtctgtacagcatcctacagtcacagcacggggcagttgggaaatacagtcagcagaatattttcccgttataagtgagttaactttttcaaagttagaggcaatccataatgctcatttcaatttttgtcaatttaactaagtcttgtaatggaaacaattttagatctcatataaccatttaccaatggccattgttgctttccagtatgttac

SEQ ID NO: 24154 - DNA, 3297 bp, Mus musculus
gaataggcaccgatccttctgatctctgccacctgccttgcaaatggaggaattatgttaagagatttactgataggaatcgactaacctttgttaaatattgattgttgatatatatgcgaaatgtctgagttggctactcttgaccagttttaactacctgtggttaagacttgaaagttgatgaaagttgtcttatatatgtgtctgtgtatgtataccctgtatctcaggcatgtccagatcagcaatgagtcagcgattgacttttaccggaagtttggctttgagattatcgagacaaagaagaactactataagaggatagagcctgcagacgcgcatgtgcttcagaaaaacctcaaagtcccatctggtcagaatgcagagacacagaagacagacaactgaacaaatcacaaatgaactttcttgcacttgcttgtcgccaaataaaagaaagacccattggttcccttcccccctttcttccactttcctcctttgttattcctttttttttttctttcctcttaaagtttttaatactttcatggactcttaaaaatgatcatgtgttggattgttttagttctcttacttttgtgaggtggttggattgaaggaggagaagatagatctgtatagtttcacagttaagatgtcccgaaaattgggtggcagatgatttcaaatttttagctgaatttttttaaaaaataaaaacaaaccaacatcctgctttcacattgaagggcagagcctactatattgtttatttcaaaagacaaaaagcagcagcaataccttgctctctaattcatagacaagcttagtgtatctgtggtactttgagttatacagactgtctgtggggtgctaatccccagcattgccttcactctacccttagtcctttgagcactctcaggagttggaccattgttatccttgtgagaaaataccaagcttatttaggtttttaaagcaatttttttctatttgctgattggcggggcagtttgtgtaggtagtaagtattaaactttggtcaaagtatttcagttaaactgctttttttgctgaggaatggacttcttgttagcaggttttttttgttttttccttctttcctgctgttaatcttgttactagaggcattaactggtagagtgtgggctggtgaaattaactgttttaatatcccagctagagatatggcctttaactgacctaaagaagattgttataattgattttttttcctcttgtttttcagtaagcccaataatagtgtaaccttataaatggagttatgcccttataagtcaatatccctaaataaacctgaagcaagtgttttctcttggacgaacagaattgcattacgtaaaaggcttagatggacttgtaacacattaagtgtatttaatgtcaactaatacagattgttaaaagtgtggtcattgagtgtttaataatatatgaaagaatttctagacagtatttttgaaaagaacattgttatgctattgcttatctgttggagaacatcccaggttagcttccactctgtgcctacaatgttgagtttaaagatttggaataagaggaatcagtagaaaaattccttctattcttggaacaatagacgtataaagtattaatacaaatatcactgtgaccttcagctgacaggtttggttaagaccagaccatcttcaggcacactgggagtggctctgatggattgagaactgtaatgtggagacatgtgagatacgttttgctcacattgtcctgtctcaaatatatggaatttcttagattgttagtagtcatcagtggctcaagaaatgttcttgttagactttaaaacagtacagattgtgtgttttctttcatttgactttaaaaggaagtttaatacatcatattagtaaaattgtggtatgaaagtatcatttccaaataggttgaatgataaaattatctcacaagatgataaaacaccttataactcttacgtttttatttgagaatgtgaaagtatgtaaaatggacttgagtagtcttgagtgccaagaatatagataaggggtgggatggatggatggatggatggatggatggatggatggatggatgggcgggctagtgaaattgtagaaataccatgcttgtttcttgggtatcagtttcctaaacagtccaaatctaagctcagaagtttagtgttaagcacctttactttaatggataagcttcagcgtgctcttgccaagagaagagggcataaataatagtaaaattagtttgaaaaacgtcagcaattttgtaaacttcctgatagcaaaatagattttgatatataaaagagttttctgagatgacactgcctctatttctataaccatttcacttggactaagtagtcctatgaatgtatccctaaatgtggtttttgaaaaccgaatagctgcctcacaacaattaagtacatgttatttaaagaggaagaacaaataataaagattgatttgaatgtgtaggctccctattatagcttctttttccacactagtcagtgatttaacctaaaatttaaatgtatgggtcaattgtcctgtatcaaagttacagtaaataattccatccacttacataaggagaagatgtggaaaatgtagaaactgggactagtccatgtacctgtgagtcaagaaatactaaagtaatgccccagttgagtttgtgggtttgggttttgatttgtttgggctttctctttgtttttaacattataaaaataatctttgaggtaaaactaattctattaactggaagatacccagctatcttcatcattttttcaggaaagatcatttttattgtggggtaaataggttaaaattattctgtatgctatttgaatttaggttctaaagtaaagaatccgtagaggaatctatgcaatatgtaatttgtcaagattaattttcatctggggaaagaagttgctaagtgtctccaaagcaggtcactcaataactgaaagtcctccaaaaagagaactagtgggaagcatggtgtgtggtggtggaaaagaaaaactccctcagtttttggagggaataactttaaagatacttaagtggctacgtttacttggtgcagttaagaattaaacttgtcaattttaatgttgctgttacatctaaaataaacttatgtgatgttctggtagtgatctgtctgtaactgtcatgaaatcattattgtgctgaattttacagt

SEQ ID NO: 24155 - DNA, 1159 bp, Mus musculus
ccgtggcatcagactacagtgtctgcgctggctgccaaccagtctgttcccctttgtcttcccgctgccatttctgctcaaaacattctcgaactttctacttctgaaagccaatcaagtgggctgggtgccactggtggctcagtggtcaccgtttcagttggccctgaccctcacccacatcgttcctcgaatacatgcctaaatgatcaaaatgcttcagaaaataacaatgcacaggagagccccaaatcatcaaagaaaacagtcacgtgtgtctcaggcatctcctccagtacttcagcagctgcccccgaagtgcaccatgaaaacaagtccagcccggcaatgcagggctccagtgcagattcgcaaaacacccttgtgtcagttaccaccacagtgtgctcccagcctcccagatctacaggtggctcttctccagtgagtggtagcaagactgtagactcaccaagtacagccacagtggtggtgccagcccatgctgcagtagcgaagagtaccctcccagtgagcagtctctctgcaaaccctttggagggtggttggactctctcttgttctctgccttcttcaagtgtcagtgcttcagaactaaaaaacatcagcagccttacccgaatctcttcagccggaaacacacagacaacgtggactacactgcatctggccggaaacactattcagcctttaagccagccaccatcttctgctgcgactccagcactaaatgagtgtggtaccagccctaccccaaacaaccacaagcacgtggctacagctatcaccctaaataattcccctccaacagatgggcagccagttgagcaagtagtggtgactttgccttcgtgtccacccttacctatgcaaccactaattgcccagccacaagttaagtctcagcctcccaaaaatatccttcctttgaattcagcaatgcaagtgattcagatggctcagccagttgggtcaggtgtcactgcagctccagctaaccaaaatgtcatcattcttcagccaccaagcacaaccccatgcccaacaatgatgagggcagaggtttccaaccaaacagtaggtcaacagattgtcatcatacaggcggctaatcagaacccattgccactcctctctg

SEQ ID NO: 24156 - DNA, 1737 bp, Mus musculus
agatggccccagaataaacagctcagcagagccatcatgcagtgatggactgctggacagcctccctgttggcctatcgtctgttgctgtgtcccaggcaaagaatgttagtatttctgcttcacattctttggatgttctgaattctgaatcagtaacccctgactctggtccccaatctaagtcaacagaagactgtagctcaccttcccacgaatctgaaacaaacgaacaacttgtattggcgccagcaaaacccaaagattctactcctattttacaagagacatctcagggtacaccaccgtgttctgtagcgttgtccaatgatatgaaatcctgtacttcagccaacgtgttgactccatctcctatcgaatcccagagtttggtttctcaggtttctggtctgtcatccactacgagcacttcaagcactgactgtatttctgaggtagaaattgtggcagaaccttgcccagttcagcaggattcattggacaccatgcagacagcagggtctttaaaagggcaaggactaactatgttgctgtcggatcttgctaaagaaaaggaccttcagaggtcatctctctcagtccagatggagcatcctgacttttctccagaaagttctaagataggtgattctaatgttgatttgcctcccaagcaggaactgctactgatgagcgatgacagagacccgccacagccccactcctgcctccctgatcaggaggttctccatgggtctttgctcaccagtagacaggctgactctcctctgtcaaccagctctggcagtagtcgtagtttctccgttgcatccatgcttcctgaaacagctcgagaagatgtgacgagcagtacaacatctaacacgtgtgatggctgcacctttgcagagcaaactgacattgtggcccttgctgcaagagccatcttggaccaggagagcattgagaagggaagacttggcacacaggctgatgtgaaggaggttactccaaagccttctgaaacctctttagagggagaccagccctttaaaccacagatccacaaggagacatgcacgggacaggctgacccaacaccaagtgaatttaactctcaggattctgtggaagtgacagtcgataggcctcttgaaaaaccaagctgttctctgggaattaaaggatcaaatgcccccatacaggtgtcagcccctcagccaccaagtctcacccatcagaatagcatcagcagccatcctctggtcagttgcacaggtctatcgcagagctcagatcaaacttctaatcctgtgacggttaatatgactgtttcatccagttcttatggcagccagcctcctgtgccacctctgatgacagaatatccccaggaacagctgaccagcatgactagcgccataccaaacccacaggttcaagaaccgctttcaaagcccagtcatgaaagtcgtaaagattctgcaaagcgcactgtgcaagatgatcttttactaaattcagccaaacgtcagaagcactgccagccagcccctctcaggcttgaaagtatgcccctgatgagcaggactccagacaacattcctgatcaaacccaaatgatggcgagtcagatcacacctaactcttcaaactcagttgtacctgttagcaacccagcacatggagatggccttgcacggttatttccacctagtaacaactttgtggctcctcc

SEQ ID NO: 24157 - DNA, 2024 bp, Mus musculus
tgtgtcatatacgcatgtgtatttatcatgttgcacatggtaaatggatataatcttgtctcagttggaaatgagcaaattggaaatgaccatagaacggctgtctgcaaatgggcagttgaggcttgctctaaagcaccggttctcagttctcctaacacttcaccctttaactcggttcctcatgttgtggtgactcccaaccataaaattagtttccttgctatttaattttgctactcttacgaattgtaatataaatatgtgattttgggtggtcttaggtgacccctgtgaaagagtcattcaacccccaaaggctgagagcccctgttctaaagcataggaaaacatactgtagatttttcttttttattctttcaaacattacatcccaactgcagttctccagccccatccacctcccctcttccccagatacagtccagcgtgaaaagttacacagggctgggcacaaaccctcatgtccagccgcatgaggtgacccaatggaaggaaagggtccccgctgtagatatttttttaaccccaacgaattagtaatgaattttaaacatatactgaatcttgagaagttaaagctaagaagaaatttgtactgaatctgttttaaacgtttaaactcagctttcaattgttgctacactctgttaaaaactgaatagagggagaggtacacagaactgcccgcccgttggctgggtggaagcaagcccaaggatcagcaaggtttcagttttgaaggttggtttgtttggttttttgtttttgtttttgttttgtttgtttgctttctttttatactaaaaaggccacctgacgcctgatcagagcagttacccctgaatgcctttctaaaggctcagcgaaaggatcctttatgcctggtcacatgtctttaccaaacccctctgtttctgctgcccttgaaaatcacccttcttggtgaactaggcaaacctgtgtttctttcctgcatagcattcccgcggggtagaagagaacttcacaagttcattacttaatgtgtgaacaccacagtaggaaagctactgagggaaagagaacatttatcagttgcttttaggcaacaaaaattcatcattttctttgtacttgaaaggtccaatctgccagcttctctaagggcagtgttctgtatagccagtcacccccatcccaccagctctttttggtagctgtctgcttgtcacatatgtatcctcacatcatggtggctcttgagttctgaaggacagacttgctcagtttgaactaaggtagcatggcgtggacagagttcaggtttaggttgtgtttctgagacagggatcttgccacgttctccagactggcctagaattcctgggcataaggaggccttctacctcagcctcctaggttgctgagactagaggtgcactcttccaccatgctgagaagcgccacctgagacagcagtgtaagagtcctagaacctgttgccattttgggttattcttgtttggctggctgactgcagctcagctctgccctgagagagcatcactgtgccagggctctcatggtgagaatactgtactgtgatgctgtctggctatcagccttttgtgaccatctagagagagatgtaaaggtctgcagtaattaggctcctgctcacatgtggctctgaggaaagacacggtgtatttgtgtgttagatagcacttcatacgcgggctcagatgagaacgagttctcactgtgctcctgcctggtttaaaagtttgggtacctatcatgactgcttcctaagtgagggtcattgattggatcattttgttctaactattgatcccatagaatcagccaaagtgctcagttcctctcagcattccacaggaagttttaaggaagtggagatttttcagatttctctatgtaaccttcttcaatgagtttgttaaatatgtcaatcacaggtgaagtaaatccattttaatgtttttaatagacgttgg

SEQ ID NO: 24158 - DNA, 1888 bp, Mus musculus
tagatggcaggcagcctggccatgtcctgggatagagttctccccgcgttaggatgtgatggggccatcctgttagatcagtgtgtagtagtgagacccaggttttacctcttggcaactcctatgcctctttcttaaagggcaacaattcctcaaaatgccattagtttaaagcttgacttaagagatttttgtttgtgggaataactacattccttggctcggtggattttccccctgtggtggaaggaaaggtaaaggtgatgccaaaatgaaatagccttcagttcctgttgacgtgagagtcacagcaatcctgccatgtggttactgactacctggaggaaatgagcctgtggctgatacatatggagggcaacgattagcaaatgaccagagacactagtgtggacttgctctctggtggttttgcaatatgtatatgcaaactagcttctttgagagattcctttccagctttgttttccccaaagttctaccaaaaaggaaggttttgtgtttgtttgtttacttttttttttttcttaactgtgctctgtgttctgcccctgctgtgctgaattctcctgtagtgtttttagtagctcctgtggggctcgcaacactcagatggagccagtccagacaggctgggagaccacacctaggacctgggactcagagcttctgcttctgttgacatgcctctgtcctggtactgcactccacacgaaactgtgcctctgatcctgggacataatcacccagccagccctgcgttgcagcgaaggagcttcagggatggcacatgccctgtagccagacacctcatagacgacaagtacagctgatgcttctcactcttgccttagcacccctgagccaccgttgacagtcactggcgagttgtgtagctgagcctgtaaacagagcttatgtgacaggcagtccttcaacgtcctcatctctacatttgcatacactctacctggtaatctttgctttgggcgcatgtaaattgtcaggtgcttcataaacacaagtcagcctaggttgagaagattgggcaagttcttctggatgaatgtgtaacctaccacaagattctatgagacatgggtagacctctcttgtaatgtagcacacttaaaagttaaaactctttgggcccagttgtgtgtacagctgtacgtgcattatctactaggaaattaaagctcgacccgtttaactttgtcctcacgtttgctgagacatctctgccctcctgctcttgaagtcttaaagtcattttcatctgcagggcctctgagcacagagcttgactatagtggtgaatgtgtggggtgttgaactgttagcttccaagaagggaccagacagtgtggcttaagatgctgcagtcgtgttactgtgaaggaaaattcttccactttcagcagggtgtgtgggtgtgcgtgtgtgctcgcatgtgtgttcattttggctttttaaaaatgttgaaaatcgaggagaacttgattaccttcacagattatttatagatacactgggcgtgatgcttacgtaggcaagcaccggggaacaggagttcagtgctccggtcatgtaataccttgtctatgccccagccagcactctgctgggcactgtgtcctataactgtaaatcgcctggtttataatgctaacagaaactggtttgttttgtaatggaatacaaagaagatgtataataggaccaggattgtcccgcacttgtaaataagaatgggccctgtttattttgacatctttttacaaatgcattgtattaggatgtgaatattccaaaacatgctcttgtttaaagttttgaaatttttattgttaaatgtaacattttaatg

SEQ ID NO: 24159 - DNA, 1208 bp, Mus musculus
ttctccttagcctacccctcctgccccttcctgccctgcagggctgagcagactttccatgactacattacctttcttcatgggtagagcagctcattttgtaactcatgactgtcatttccagcttacagatatgtatgtacaaataatcaggtgatggcattgatgccaggtttcaaattcatgattggccttattcctggcatacacttagctacttttttgtgatgtttcatagaaacaaaaatgggaaaacaccaaaagctttttcatatacccccttaggagttacacagtgacaaaatgaagattagataatggttttaagcatttgagtaatggaaaatcttttgataatccatctttaataacatagcatacactcacatttgttattcaaaaggaagacctgggcaggagatggctcagcccatgggtaaacacatgatgctatgcctgacaatctgaagtccacctgtggtgacttgaatatgcttagcccaggaattggcaccataggtgcctggaagccagttttcccctgtttgcttttgaacaagatgtagaactctcagctccttctgcaccatgcctgcctggatgctgccgtgctcctcctaccttgacgataatggactgaacctctgaacctgtaaggcagccccaattaaatggtgtccttataagagttgccttgtcatggtgtttgttcacagcagtaaaaccctaactaagacaccactcctggaacccataggtggacagaaccaactctcacaggttacccactgatattcacattcatgtaagttaccctctgatatccacatatacgtacacaccctcgcacaaaatataaaactttaaaagggagtgaggtcagtgaggccaggtgaccctttatggtgctttgctactccagccttgttctgtttaccttcagatatgtaagattttatgaaattactcagattttaactcaacagtagatcataaaatcatctaattcagaaactgacttgtttcagtcatgaaggacgtgttcctcagactgttcatcatagttaacaccttgcacagtctaagccaaacactcaccatgtgattagcttacacaaggccgctgtgaatgtttattgacctgaatgcactcctgtggcaaactgcacagaagcagctctcaggctaagcagtgttcccagagctta

SEQ ID NO: 24160 - DNA, 1547 bp, Mus musculus
tgtgtttacccatgggctgagccatctcctgcccaggtcttccttttgaataacaaatgtgagtgtatgctatgttattaaagatggattatcaaaagattttccattactcaaatgcttaaaaccattatctaatcttcattttgtcactgtgtaactcctaagggggtatatgaaaaagcttttggtgttttcccatttttgtttctatgaaacatcacaaaaaagtagctaagtgtatgccaggaataaggccaatcatgaatttgaaacctggcatcaatgccatcacctgattatttgtacatacatatctgtaagctggaaatgacagtcatgagttacaaaatgagctgctctacccatgaagaaaggtaatgtagtcatggaaagtctgctcagccctgcagggcaggaaggggcaggaggggtaggctaaggagaaaacagcgagtcttccttccccctgccctccagtgacggcacagcctacggcctgcaagcctgaaaccttaggcacaactgcacacttgctttaaaggcccgagggtgggagtggcaggatatgaatctggattttgcacactcacttcaactaggacactgctgctttctgctataaaactgaccatactcatgaggctcaagaaagctccaagtttgaatatttctgattttgggattcttggccgtggggcattctacaattaaagactgcaaacagccccaaattctgtaatctgaaccatttccagttcctagctttgcagataagagctgaaaggagcattaggtgttccagttgtaagtgcagagtatgacagtttgtgacctttcaaatcctcttgaccccactgtgtcaaccccctgttgcatagggctggaccttgccttctgctctgatgacctgtcctggcattttagaatgtgtggtctgtgtgtatagtatacgtgtctgtatacatgtatgagcgttatgaatctctgggtgcttgggtatgtacaactgggaagaggtgtgtccctgcctcatcctctggtccctgggcaggcattgcactggaagcccatgccttgagaatgctcagaaagcccctcaagagcaagccgcagtgcctgtctgtgtggtggcccagcatggtgggcaagcagtccttccacttcagcgctccttttcctggtcacctcagctgtctgctgctgtgggaagcatcgacagacagttctgcttttggcagaaggatggctttcaaagtaattattttgacatctatgttttgctttgaaaaacaaaacaaaacctttctgctagttagggtaaaatagactaattctatcaactgtagaacaatggaaacatttacaattgggtttttaaaaagccacagagttgtggagccttaccacagctataacctctgacagcagtgtcactttggaatgctaagatatctcatgaagagttatgagctgccagtcaaagctcgtctccccattcagaatctagcacagtgactctaaacactgcactgactgggaacttctcc

SEQ ID NO: 24161 - DNA, 1151 bp, Mus musculus
aagtattggcagatgcaagagatcataattgctaagttcctagagaagaatttttttaaaaaatatgtaataaggtaagacatcattaatgtctgtatattctctgagaaaaacaaaagtatagctgaattgattttagtagtcttgccaatatctaaaggaaagcattgttgttctaaatttttccttagttgacaaagttaagtattttattgctgttttcttctataataatgaatgtctagttctacattggttgtagggaaaaaagggtttaagttgctttgtcctctatattcttgtgtatattccagatgtgtgtattcttttacccaaggccactctgtgcctttcttcacagatagctctgatcttctgcccttctgctatcctctccttcttctccttccttttcattgatgcagccaactggtacctaaaagaaccttttccgaaatctcaccgctggccccacttaccttagtgtccatctgacaaaacacttccaccagctgtgaccctcactgtttcacccgcgaaagtttaagccctttcatgaagctagctttctccttcccacttcatggagtagcgtctctggtttcatcacagggattccatccttcaccactcttcctcctcaccacagaagccagctaaacggtgaattctagacagaacgaatcccactcttgtataagagaatgatagagaaggtgtattcttttcattctcaaatacacaactctaaaaacactttctaacagacaaagacgctaaccaagaacttaatcatcgcttacgaaaagccctctcctttgatattttataccaaacaattgactctagtttgtctttccttttctgattcctacgtgtttcatgaatgcaaaagcgcaagtagccacattgtgttatctttgcatcaattttaacttcactgttgtaattgtggggttgtacattctttaaaaattatttatgaggacactaaactgcacatgcaaaaacatcttggtttacagaaacactagtctgcagaggatgaatgtcagacttcggatctgggtgttataagaatctttgtgatagaataaatgtttgatcagcacttttaagttattcctctgtatacattgctcatcagagaa

SEQ ID NO: 24162 - DNA, 1190 bp, Mus musculus
ttatttgtgaacaatggaacttaaatccagagaaagtcatagggttgattgtatcattgacataataaatgaccaagccaccatcaatccactgccactctccgccactgaagtgtatttgtgtttatttttataaacttaaattaaaacataggaattaaaagtgagtttgcattttttttcctcctctccagctccggtgccatagccatcatgaatgacacagtaaccatccggaccaggaagttcatgaccaaccgtctgcttcagaggaaacagatggtcattgatgtccttcatcctgggaaggcaacagtaccaaagacagaaattcggaaaaagctggccaaaatgttcaaaaccacaccagatgtcatctttgtatttggattcagaacccacttaagtggtggcaagaccactggctttggcgtgatctatgattctttggattatgcaaagaagaatgagcctaaacacagactcgcaagacatggccattatgagaagaaaaagacctcccgagaacagcgaaaggaacgaaagaacagaatgaagaaggtcaggggcacggcgaaggccaatgttggtgctggcaaaaagccaaaggagtaggtctgcagtgatttgatgttttgctgtgacatgcagatttctgagaggacaaataaactaaaaagcttctttttaaaaaaaagtaagtttgcagaaaactttatagtaatctaaaaacttgatcttttttctgtcaaccaatattgatttttttacacaaatattgaacataataaattgggaaggcagaaatgattcttttctgcatatgggctgtaaagcactgattcatgtagtacagtctctgagggagtctcttgttggatgtccaggctggtctggctgccttagttgcatctccagctgtagcatctggagactctggcatgggcagaacagtgttcctttctctcttctccatccctgtctcctggttccatggaaatgatgctgctattgagctatagagttttgactgtgactatccattggggcctgatggagtcaccactggttatacaggtaaagacaataattttctctttccctgaacccagcagtgggaaatagtttagcagtgaaacacaggactcacggaatccctcctccacccatcccttgttgatgggtccttt

SEQ ID NO: 24163 - DNA, 1173 bp, Mus musculus
atctaatgatatagtgtttttatatagcggttggttagactaaagaggaagatgatctttccgcattaaccctgctttggggaatacgattagactggcataagtgcaaatagatgggtaggtaccattttagtttaagtggcagaagggtagagtcagtaaggaaacatgaaatactagtgtaaggtgtgatttttaataactactgaggtattaatatttattagcctttatattaaattgtggtttgcttttttttacttattaattttggctagactttagccctcattgattatatctatattaacatgccaacataactcatgagtatgtgttgaagagttaatttttatcgcataaatgagagtcggcagacaataaacctggttgaaaggacagtttaaaaaaacacagtatttatagccaatgaagaaaagggcaataaaatttttgtgcaggaaagtgttgcagctggttggcagattatcctgagaaaagtaccttatgagttggcttttgtctgggaacgtgggtctcaaggactcccactatggccagaactgagcatagtagctcactgtgcttgcatgaactctctgcaaacactggcttatgctgaaccccactttcttcccaggtgcccagagtgttgatatatgtggagcagcgactccctctgagtggtccagtaaaccccttggcaccgactcttagcaagctttcttgcagatggtatcacatgagctgttagagctccttgctggagacccagtttctgcctctgtgactccagtgtggattcttggaagcttacccccagtttccctgggcttcaccccatgtgcctttttcctttgctcactctgctttggatccgttcactctaataaatcagtagtgaaagaactgtatggtgagtcctgtgcattctcacaagcctgcatgtctgaagtgatctccagggcctctgatacacttaaaattaaactaaccatgactatcccttatcccagagaaaagcaagggggggggcgagggagtgaatcctgttggctttgttactttgagctagaatgggaccatttggggacccctttggctagatattactaaacatgaaaagtattggaaagtgaaggggatgaagttcctgcccattggagtttcgga

SEQ ID NO: 24164 - DNA, 1219 bp, Mus musculus
ggtcataaacagcgcagcactgtggacatccttccctcttggctgcctacgctgacgactgatgagggttttacctctgcttcccaaagcctggggttgcaggtgcctaagaccttgccaaaattattagaaataatttggtaaagaggaaagaaagaaacaaaaacacacatacatttcttttcccctactcatctggtcaaagtaaaagacatgaaattcctgaaacattgttaaaacaagaaagaaatctcaggggaaaagctgaaagtgatgtatttaaatctaaatgttaattgctactgtttaggataatcccatggtgccaacatgaagatatttttttgatgaatctctgtcttttgtttcactgaaattgttatttcattctgtattttggaaagtatgattgggtaaaaaggtaaaaattttgatgcaactttaaaacttaaaatctcatacttgaagcttattttaattttcctatcaaatgcagtgggttaaagttaaaatgtgaaaatatgtgtgattttccaaaaatattttttaaagtataattcacactttgtgtactttgttttagcttgcagacaaaaggcatcactttctttccttaaccgatcagaacttccaaacctggcttataagaggttaaaaggcaaaaccccaggaattatcttcatccctggctatctttctaacatgaatggtataaaggcagtagcagttgaggagttttgcaaatctctaggtcacgcctttataaggtaggaacaatatatttcagataatatattaccatttagtattgtaatggagccaactaaagtcaatgccagcattttagtagatggagttatttcaatagtgtgcagactttggtctcatgatttagggtctatagggtatttgtgctgtgctggctagatgggcagcagagggtgtcatccgggggctcgtcacttagttgtttagatacaatgatctgtgtggcaaagaaagtatacctgttgggtttcctatcataccttgtgattatgggttttgcactaaagacataaagaactcatgtggccgctgtttattactctctaccacgggtgtttgaagctgagagtataatatagcatacctcaggggtagagcatttgtttagcacaaaaatcccggaatcagtccctagcacaacccacaaaagacaaggtttttcagtgtaata

SEQ ID NO: 24165 - DNA, 1157 bp, Mus musculus
tttttatagtctcatgttcatgtctggaaattcatgcttctatttaggaaggcaatgaaatgaagcattctgagatgaaatgaagctttctgatgtgtctggatatttgcattttttccagttgttagggttagggtcaagggtcaggggttagggttgtggtcagtggtcagaggttaggaggcatctccaaagagacataatacacataagcacaaagtgtaaggtggagacccagaagaaatccaggctgaaaggaaactgctgtttcctctgagaagcaaaaggactgcatgctgacatcatttttatgatgtccttgattgtttgttatgttctgggaaacagaactgactaatgaatgagccacggtcacgagatctcccttaactgagcaactggtcctgggctaagctgtcattggttcttccatctttaataatgacacaaatctcaggtggctgattcataaattacgaggtcctagagctcagcctgaatgccttgtgctctagggatgcacccttagcatgattctcccttttgtgcacatgtgcagagaatatggttagagtcatgcaagaatgtggtgcaggccgatggagttcaacgatgtgttgtacgtttcagggtggacataatgtgtggggctcaatgaaatctgccaaaatgtacatgggcccctgggaggcaggttttctctagaggaaacagtagacattgagagtatcaaacatccaagctgacaggaatctcatttggtgcagcatagaagagcatagatgtccttgtcaatttcattacctgtctagcgaatcttaaccctctaccacagctgcttccttgtaggtgattccacagtttcatttctcagtagtgtcaccttaggacacagggagagtggactgattgaatagcaagtggtgtcagtataaacttctcctcaattccagaaggttctaatcagcttgtgactgccccaagagacctcctacgtccacagcctttggattccccagcttcctgctgcacacactgacactaacggccatgtctcttgagctagcctaactccgaagcaaccctacaatgatgctattgattcttcctttaaaaaaaaaaaaaggaaaaaaaaaactatgtcttagacagtgtaa

SEQ ID NO: 24166 - DNA, 1263 bp, Mus musculus
aaccaggtgatggcacagattgagctgtggacccacccagataaataccctgttggggttcacttcctgcctaagaagctggatgaggcggtggctgaagcccacctgggcaagctgaatgtgaagctgaccaagctgactgagaagcaggcccagtacctgggcatgcccatcaacggccccttcaagcctgatcactaccgctactgagtgctggggctgtccttcaccttccagctgccatccttgttccgggccctatctctcgttcccaagagcaaatgtcaccaactttgcagtagcctggacagtgcttctcccacacagccctccccttacaccctctggggctggtcactctgtctttgacctctgctgtatccctcatactgttccaggtgtggagggggaatggagaggtacctggtaggcatccacaggggacatgatctcagaagtcttggaagtcctgaggctggatgttgctagtgatggtcacaagccatgcaccttatcattgataccctcacttggtctttagatctgtgtgcctggtttgcagatccattggtttctcagtccaggacccaagaacgagctccaccaaagagcaggaacccctggagtttgaaggcccccgagagctgggcctttttactgttgggcagtctcttaaacctcatgatactgagttggtactttttttggtccctatttcacaagggttaggatagattaaccaagaaaggacaagtgacagactgaaaggggctggaaaaacaaagaggaaaaggcctgtcacttctgtatagttgatggttcctgtcacaagcccaggtcacaaacagattaatttgttttataatgtttatatgctatttagaatgttaacaaaggaaggtggataaaatacagtttctactgcctaaaaaaaaaaaataaaaataaaaaaaaataaaaaaaacaaatttataaattgtggctcgaaggcacaaggaaaatcagcatatgctttgatgattatgaaatttgtgtaattctggtaagtagaaacacatacaactttcaaatgtgtccaatatactccctatggcctgcaatcgacccaaaagagctatgtgcattgcccaaaacaatgtcaaaagtttactcgaaacacaatgagatgttctctggaatattttagtaactaaactctgcagctctcgggtttgatctttatagataacaatgtcaaaagatcagacatgcctgtaagaaata

SEQ ID NO: 24167 - DNA, 1224 bp, Mus musculus
caagtcagaaggaaaggtgaagagagaggctattttgggcagtgttttaaaatctccccatgatcagacatatggtcaaatgccagctccttttgctttgtccatgccctaatcccccagtgctgaatcttgatgtttatttttgttttgtttgatttaactctctgactatctcatatattccttccaagccagagcgctatttgagaggctcctgacattcacaaccatggcttcccctagctgaccttagtgggacccaattccaaacctcaaatcataaaattcctcagcgtttgtaggttacagttacagtttgtagttacaaggtgccactcctcttactcgggtgccatgggcaccaaatgactgcaccatggtggttttccatccagttcctttgaggggtagggtcagggtcatggccttgagtgaatttgacttttgtttgttttcaccagtgtcctagaagaaatgtaaacagtgtctccactaatgtaagcaatgtttgaatttctagaatggaccaattagcaggagatttgactatgaggatgagagcacaatgcaagaagatggaactcagcgcatgtgccccctttatagccagatgtgccaccaagaccgaagccctcgccaacatcacccacgcaaccccgagagactctacatcaacccacgagaacattatgtgtgattttccttgtcatgaagggtgttctaacaaatgtttattcttagacctgagagacactgaggcatctaagtgatttcagtcttaaagtgtgttgcaacgatcgatggacgaatcagagctaagagtagattgcttaacatcattaagggttccttaaccaccagttgtgtgtgtgagctcacctgtagcttcacttccctgtaactctgaagtttagctactaacacttggcctccagtggtgtgttcatttggaggggaaggccccagatgctggcgactgctttgcttgggtctcaggcactgcttgtctgtcctttaaacaggtgggaaaacgagccccacatccagttcactgattattaagctgggattttgatttccctagcctcccagtacaataacaatacctgcgtacagaggccagaggagaggagcggactgctgtaaccaatggtgacaaaggcaaggggaagcggcaagcctctgtgtgcttgtgaacccgtgttagtgccccgtgtccttcct

SEQ ID NO: 24168 - DNA, 1186 bp, Mus musculus
gtctggcagataacattagtaaatgtaaaacttttaacattaaaattaattgaatttaaattattgacaataatttatgagtaatacctctagtgtaagaatatacagaacaggttctgtaattgaagggtgtgggggatgttaggtgcatatgtataaacgttctgcactttgaggaagcaatgtggagcttattgatgagtctcagatcctgtatagcaagtgaccttaaaaaacagcaccaagacacagcttgggtgctgtactgcacaagtgttccatttatactaaaaagactattgagataagcccccctttcccaacgtgtctgtgtgaagctgattttcttccatgctcttcaactatatagcatattataaatggtagctagtgggaacatctagtttcctttctgagtttgtctttttgcttttatttttgacctggatatttcctttcgttgcttttgtgtgtgtgcgagcgtgcatgttcgtgtgtaggtgcatatgcagtagaggcccaaggttaatgtgaggatccgccaccactgatggatgactctcccttagtctttgaggcagggtttcttggtcgagctcagaattctgtggtttggctgggctcagtagccagcttgctccagaatccagactctgcctaaggaggctggtattccaggtggcccttcacagctacctagcatttaggaggctactgagttttgaaagttgattttgtaccttgccactttgctgaaattatagaaggtttttggtggaatcctgggtgtcctctccataaggtatcatgtgagtcagcagttacaggtgatttgtcttctcctgctgtctgtattctttccatttctgtctctcttctttccccagctctggctggtgattctagtgctaccttgaaaaggagtggggatggtagacagcctgggctgcttcctgttgataatgagattgcttcattcttttcaccactggaaaaaaatgggtttgtcataggtaatcttcattttgttggggtatgttccctcctacctaatttccctcaggacatttattataaataaagcacattggattttgtaaaaggctttttttaacagataaatcatgtgtgttatgtctaagtccatttatgtggtctattacatttattaccttgtatgtgttga

SEQ ID NO: 24169 - DNA, 2981 bp, Mus musculus
cagacactttggttcaggtctttggaagtacactttttagtaataatacactgtgacaaaagtaaccttatttaattatcaataatgatataagccacaagaaaaataggtctaaaatttctttccgtgaaagataagaatttattgttcttttgatcaaagatcttaagaagtagggttttgatgtgttgtatgagtccaagcagaatggtcacatctaggcttctatataaatctcaatttgaatatttaatctaaaagacatgagcaacattgtcttaagaactatgtcactgaagtgcagatgcctgctgacgatggaaccccgtcatgctttgtttactaagtggctagctttaggtgttttgtttgatttgtgggcaaaaggcaatctcaaaacctatagagtatttaatgtagtctgtatccgtaatctggatcacttggcgtgctagaggcttagcaggttctaggaatcttacactggtgcttaaggcttttggaagcattgcactcttgttcattaaagctctatgtatgtacattgtacatagggggttgtctgtgaacacctgtattcacatgaatattggtcatgtgcacggctgattgtcaggtatataaaaatcacagctccttagagaatttggaagataatttttactctatagaggccatgtttacttttgttactttgatatgttttaaactttttacatttttatatttacttcatggtttctttcctactggttaaaatatttcaataatacaaattgattttttcctataaaagtttattaaaatacactaaatgtctttatgctacgagtaaactatgaaatagtacttgattatacttaaacatttagtatttaaccatgtgcctgataagagctctgtgtgtgtccctcccctgccacacacacacacacacacacacacacaacacacacacggctgtcgatatataaagaaaacattaagtgttttagtagtaactgctgtttctgatagtcaccggtgtgtgaaagtttaggaagaaactatagctactcgttttacattaatggatcataggacttagaataagtgtagaacttgacaacaatgtagccaagtcatatgcaaaaatatttgatgtgattttgataaagactgttagggcatataaatatagtaggtcatatatggaagtaataacataaaatatgagagaggaaaaaatggcacacatactgagtttttaacctagaatctagagtattaacagattttctccttacttgttcattggaagtgacctctcagaaagggggtgtatttctcagatgatttttaacactggattcagttttcttcagttttaatataaccgtaatactttttcttccttgtttttttttttttttcctgccaagttaacttactaggtgatggctctcattgccattcagtaaatcatgaaatagactttcaaagaaagactttcagtggtatacttctaaaataaaactaaattctgtcttattttcttcattctcacatgagcttctgtgcctgtgttttatttcatttgtgcacaacccactttcatttcaactaacatttagaatgccattcggaatcgcaggacttaacaaactactaatatcaggttaaagatggaattacgtaaacttttaacagtgcctataagtatacatgttagccacattgacatgttaaccattgtgcagtttggtttaacacgtatccattatttgtattcattatcaatgatattcagaaatatttgaaaaattgcatctgcatcaaacacccaacttgttcatctcacctcttcttaagcacgacatacaacagttacacagaatttacaacgcactaggcatgttacgtgatctgaagatgaaagtctgtaggaggatatgtacaggttatgttcatctagaaggttgctagggatttggacatcactgtaatttgacattttggaatcctggaaccattgtgtatagagaccagttggtttttattttgaagtcagctcattttaaaagacgcttatccttgccatgtagcggtgtttacttactgcttgtgaactgttttggatagaaatcacactataatccacttcctctttactgctggttatttttaataatggtatacattcttctaagctgtttttaaagaacaagcagccatttcttcaagtagcatgcactttgttttgtttgcttcatggtatacacataagaattcattcatgagagcaccttcataatagtggcaccatagcccaactttaaagttttggacacgtttctttctgcttacatatgtctgtcgtcttttatggtacatccagatttttaaaatatgaggatgagtagtgagattcagcctagttttacaaaaggttgcactgtacgtctgttattggagctaggcagtaggtattactggcttactgttcagaagagtaacgtttacttcattgtggaaaggaagtagcgttccgctgttgtagctgtacaccatgatggcagcagagacagggagaaaattagaatggtaacagtgctgcagaagtcattcttaattcctgacaacaatccaaagccttatttccttacatgcatgatacttctgtatagatacatcgatacagaaattattccatttcagttaccagaaatgtctcagggaaaacctatttgtagatttgtttgtttgtttgtttgcttcaaagccacctcttagttattaccaggtcactgtcactgatgttgcattgtaagcctgttattctttctgtcattacctcactggcagtaaatccttatccattctaaaagataaagtttgttcgaaaaaccagctgtagtattttttttaagtttctatggtaactataccaaaaatgagtatttctctaatttcaagcagtaagtattcacatttctgttact

SEQ ID NO: 24170 - DNA, 1187 bp, Mus musculus
atcttgctcgtgtaagtaagcacccaaggtgctgcgtttccaggtctgaaacttactatgtagattgtgcttgctaatctcaaacttggagccaaaaatctaccttctgcctcctacttggcattatgccacactaatatgtttttgtgcgcctttgggacggccaggagccaaggctcacctagagattctcactgtcctgtctctattttcccagcctgagattgcaggtgtccccccaggcctggcatagatgccatgctggggatcaaacttgacggttcatgcatatattcccaacagatctttcttgtctgttttagatcttagtaccttttcctggttctggtctctgatctgggtatgacacaccttgtaatcccagcacttgtagtgtagactggggtggatgattgagagttcagggcaagcctgatctcagtcagaggtggggggggtggtgaagtggaaaaggaagacataaataaatgaatgaatccataaatacacttgttttctaggaacaagatcttgactaagagcctcgaaggataaaggacagatctcttgtttgagctagctgctggcgtcactcactcttgtggtgtgatcagcagagctgcggctgacgctgagactgatagaaatctacatctctgcctttgaaggtgcctttctcatccagaacttaagggatagtgtaagttagttgatgcttaagttcacgcagtttgaaaaaagccagcgaggccacctctgctcgctgtgatgactgatcactgagagtgaactcttactcttttgtgaagataaaaatacatcctatgtgttttgctgcaagtaggtcctggggcaggaggatgatatctccagataacaatagttgctagtcctgtcaccagcacaacgggcgtcataaccagttcagcagtcaactgtaaagacttggcttatacctgtagcctccgcatgcatgtcctcttccctgggttgtagtgtgttgttagtgtttaatacttgtgtttgttttctgctgttgtaaaatattacactaaatctggcttgtggcttttgtttttgttatctgaatggttaaatttcccctgagttccttctgcccctgtctggatgccatgtttgaaagggctttggaacaatgcttggagcagagggaagtagggtggggg

SEQ ID NO: 24171 - DNA, 1109 bp, Mus musculus
gctagaggaaacggatatctccaagggcagtcacccagactaaaagacaggatcaagtcagccgaggcggatcaatacttcaagtctagactgtgctacacagcgagtttccacctcataaaaaagggttttgtaacacaagatgaggcaatacaagagcaaagtgacttccagctgagtcactaaaccagggaagctggcttagttttcctgagaggaagaggtttggctagtcacaatcctttgtttgcaataagcgtagccatttatttgagccaatcacagtcttgcctcgtagcatcaatcccagtgattgaagcttgtgtcttagaccagtcataactttacctcttaacgccaggcatccatctgctagggcatcttcaggtcagtgcttccccactggccaggcagaaatgattccagagtcatctagaaaccatcagacaggacttgtgaaaacagaagtctagaaccaactgtttccagctcgctttgatcccaatactcggaaggcagaggaaggaagatctctgtgagttccaagttagccttatctgaactcaaaaaaaaaaaaaaaaaaaaaaaaaaaaaaaaaaaattcaagcttagactgccagcagtcagaaaccagacaaacagcagacattcttcagttgtctcaaggtatgcatggaatgttcctaaatggctggtgctgacctaagaggaaactatctgtctatctgtccttttgcccaaggcatccagacttgtaagggagaacctaacagctgctatatttggggagtcaagttactcccccgaaaaccatctttgcctattagaaaaatggttatcaggaatgcttactaatgcaaatttattttatttatttttttaaagatttatttatatatatgtaagtacactatagctagctatcttcagacacaccagaagagggcatcagatctcattacagataactatgagccaccatgtggttgctgggatttgaactctggaagagcagtcagtgttcttaactgctgagtcatctctccagcccactaatgcaaatttaaagaactaatgataaacactaaaaatagtgaaatttaggcaaa

SEQ ID NO: 24172 - DNA, 1134 bp, Mus musculus
ctgggtttcactggctctcctggaacttgttccatagattaagctggcctagatctgcctgcctctgcctcctaagtgctgggattgaaggcctttgtcattagtccccacccctaacccccagctcagtgttttttatggtaacagaagtggatttgtgtctggggaactttgataaggcgctatacaaatggaaaaagaaatccttatttctagtttggaagtattggtgttgagatttccataggagaaggaaggggaggggaccaaatcttcaggaacttcctccaggaggtgtcactctctagttgatgccttgcttttctgagcgtttagaaagcccttccacagtggtttggtagttcccagccgcctgcttcctgaggttatcttctttatttcaacactaagactctgatggtaaatgaattcagcagaaacccctcactgcttctctttgcagaaccaatctgaggaaaacttggatgaagaaagtgtgattttaacgctggtcccctttaaggaggaggaggagccaaacacagactacgctacgcaatcaaatgtttcttcttcaaccttagaccacacaccaccaggtatctatcatccaatgtcagaatcctggcgaaaatagtgtaggtttgagatggatttctcagtaagactctggaaagccaagataaagtatacagttttgatacaaggaccactccctccgcccaccaacacacctccagttttacctccctgcagctggttaaaggtgcacaccaccatatcaggcaggcttcttaaacctcactgagattttcaaattccactcatctcagttgttaagccctgtgaactgctttatttaaggtgggaattgggcaaggtacctgggaagctgtcaccccacagctaggcagaagttcaaaaacactgatccacagtagtatgactttttccaaaaaaaaaaaattgaggttaaaggacagggctgtgggggctggacatttgcctagcatataggaaggttgagagtggtacactctctttaagaaaaggttaacttggtgactcagtgcctttaatcccaacacttgggaggcagaggcagagtatattaaatatcttgcttactaaaag

SEQ ID NO: 24173 - DNA, 1243 bp, Mus musculus
ctgagcagccttgactgtagctcttcattcatcaatctcagcattcaggcaagccatctcagggactccagaaatggaaaagggtctcttatttattgtatgtgctcattttgcttgggttttgagtcaaaaagtctaggctggcttcaaagtctatagagatccacctacctacctttgttagtgctgggattaaagatgtgccccaccgcccccagcttttgtctctgttaagggaaaactctggcttctcccccttgcaactttaaaaaatgttttctttaacatttgtcttacagcaacaagaagatcctaagaaactttaaaattagaagccgtgcaaagaaaaatgccctacccccaaatatgccgccgtagacaagattttactctgatctaaagggaatggaagaatattctgtgatccctataatggctaaaaacaaacaaaacaaaacaaacaaacaaaaacctggctgtcagtcatcagaagcccctcctcctgtctcccagcagagtggagactctgttgacaaatcagcatccatctctctaacaacagcccgttgcattttaacatctctgactgacagctcctcatggcctcgtgctggatttgcatcactctaacaacacctcgctgtatcttaacatctctgacagctcctcatggcctcgtgctggattggctaaatgcttagctacctgagaaatgattcggttttactgggtttgttttgctgtactttttttatataaatttttttttggaggggggagatggggagcagtttcaaattagcaaagcagaaagtactttttttaaaaatatatataattttttttgagtatggctttatcatgtagcaactccagtggacctggaaattctaggtagaccagacacgtgttgggttttacatgcctgtacaataccacttagccagtactgatgtatgtttgactagtatagagttcattgcttgtgctaaacaacctgggtgttgacaagtgtttatagagtgccatacatttgaaatcatatagtatgctaccgttcagattggcttttacctagcaatatgcctgtgagaaatatccatgtcctcgattgatttttcttaatgttgagattccattgtccaagatgtgccttatgaattgatgctattacatatggatatctggttggtttttatatatccaagacagggtcttttgcagcacaggctggtcttgagta

SEQ ID NO: 24174 - DNA, 1224 bp, Mus musculus
tttaaataacctttctaaatacaattctagggccctaaggaaagcaagaactctctctctgttctttggagtgaacacagaagaccaacaccaagctggaatgttcatttacagtaataaccgattgatcaaaatgtacgagaaggttggtccccagctgaaaatgaagtcattgtaagtagttcatttctccatttaaaggcagtatagggaggccacagtccatttctgtctgtggagctagatgtatgattgactataacaccagtaggtgtcctgttcttcactcactcttcctctcactatacaggaattgatatgcgtaatttataatatgatgaagctgtgtgctgtctccatgagaaaatcacattgtaggaaaaaatattgtttctaatatatgaccttatgtctttctattccttatgacatctcttcatgtttctaattttaccaattaaaaaagtactacaaattaaagaaatgttaacagagaaaagaaaagccaaactctaatcttgtaaggaaccatgttatggattccgtacctcttgtcttgtcagttatctaagtgtgtgtgtgtgtgtgcgtgtgcgtgtgtgtgtgtgtttccagtctgtttagaatctagattccattttctggtgctaaagttccataaattgctttgacagttatgtggaatcttgcaaaggcatcagaggaatagagtgatggtccaaatattaaaaaggttaatctcacaaccaaaaagtcaaagggatagagtcagacaagatgtccaagagtggtagaaggactcagggggggtctttggtcttcttgccgccttttgctcaggggagtcgctcttcattcattgttcaggcaaaagcaggtgtgttgctatctcatgtgctaagctctatggacacgaaggtcaagggcactcaccttttgctgaggatcattagtgcactttaatactgtgcacggacagtgaaaacaatatttctttattatcagttttaagcttaacatatacagtggccagtttcatcatggcatcttcatgcatatgcatcactatagtttgttttcattcatccccatctccccgtgctcttccccatgttcctgtcaccatgttcctgtcaccatgttcctgtcccttctagtgaatgccctttctcctcccccagccccccccccccccccccggcctagtgagtctgcttttctgct

SEQ ID NO: 24175 - DNA, 1164 bp, Mus musculus
ggatataagaaagcatactaactgggaatggtatgagcttttaaaacctgaaatagggccgggcgtggtggctcacacctttaatcccagcaattggaggcagaggcaggcgaatttctgagttcgaggccagcctggtctacagagtgagttccaggacagctggggctacacagaaaaacccgtctcaaaaaaccaaaaaaccagaaatatatgaatctatgggtaccactcacatttgaacataaattggggagatctgggagaaactggtgggcaagactagggggtaaatataattaaactacattacatacataaaaatataatggagtgtcatgagagaagatagtaattcatcataaatgatgcaactacaactcataaaattatgtcttactgtttttaattaaggaaaaatccaaacttgggagaatccagccttcaggggcagacctgactcagggcagtccctcatctgttaagctttcgttcatgcaaagaagccaaaagaggagcacagaggatactcactcggacgtggagttcatctgcatgacgaagattccgaagaagtctgtgaagaagaccgtgaagtacctgcagcctggtcacgctccagctctattggaaaacctcaaactcgaggacacagcccaggcatgtctcccccccccccattcttttctcttattcacaaaatatataataattcccttgttctggaaatagcatgtggtaaaggttttgcttcattttcacatttttagctcactctaattatgggatgtacattgcaacctgtgtttgctggataaggtcccaatttctattttttccctttggttttctactttggaagaaaagttagattgctaatatcagcacaatttggagaactcagccaagtgacagtgccccaaagaatgcctggatgggaaaagagctcacatttgtatttaacagaagagaatgactggagaaacttctaacttatagcagccatggtgtggtgctttgaaaatgcttggcccatgggaagtggcactattaaggaggtgtggcctcattgggataagcgtggccttgttagaggaagcttgtcactgtgtaggcaggctttgagggctcctagggtcaaactctgcctagtgaggaagagac

SEQ ID NO: 24176 - DNA, 1201 bp, Mus musculus
gtagttgtaacgttcatcttgtaccatgtttattgctcgtgctcagaggcactttccctggctggctggctggctggctgtctttctttctttctttctttctttctttctttctttctttctttctttctttctttctttctttctttctttctttctctctctctctctctctctctctctctctctctctctctctctctctctcccttccttccttccttccttccttccttccttccttccttccttcctttctctctctctctctttctttctttctttctttctttctttcttttttgttaagatttatttatttattatacataagtacactgtagctgtcttcagacaccccagaagagggtgtcagatctcatttcgggtggttgtgagccaccatttggttgctggcatttgaactcaggaccttctgaagagcagacagtgctcttaaccactgagctatctctccagcccactggcatcctttcttttcttttttttttttttaaagatttatttatttattatatgtaagtacactgtagctgtcctcagatactccagaagagagtatcagatttcgttatggatggttatgagccaccatgtggttgctgggatttgaactcgggataaaatgtgtagcccaggctggcctcgaactcgtgatcctcctgcctctgcctccttcagcaaatcctacccgcgtgcgccaccactaccggtggcatcctttcttaaggttggctctctctaagcctctttgttttttatgttatcttcctggctcatcagtctgactttgattgtttctcctaataacattctggtggttggaatatgctccccagggggtggcactattggggaggtttggccttgttggagtaggtatagccttattggaagaagtgtgtcactgttggggtgggggtgggttttgagaccctccttctagtcaagtgggaaccagtctactcctggtttcctttgatgaagatgtagaactctcagctccttcagtgttgtgcctgtctggaagctgccatgcttcccaccttgatgataatggactcaccctctgagcctgtaagccagccccggtgaaatgtatacatatatgtgtgtacatagacatatgtgtgtgtatatatatatatatatatatatatgatatattcatacatataca

SEQ ID NO: 24177 - DNA, 1189 bp, Mus musculus
ttagttgatctttatatgtatttattggcttgtgaccctcctgtctcagcctgctgagtactgagattataggtgtgtgctatcatacccagccaaccatgcagttaatagcgtctccgtgacatagtgaaagtggcttcaagtttaccattgcttggttctaccgcttgcttaactgttgacactgttttaggtttcttcacgggaaataaaaaagcagcagagtgagagcctcgtgcaggcaggcaaggcatccactgacgtggctagcagcagagatccaactgtgaccatggtaagaacaacatcatcttaacactctttcacatccataaaaattaaagagtctactaaattttggtaggtaaaacatagcttgaagatgaaggagcataccccaaagacactgttatctgcatgaaccagagagatgataagtattcattctttctttctttctttctttctttctttctttctttctttctttctttctttttttttttttagagctgaggactgaacccagggccttgcacttgctaggcaagcactctaccactgagctaaatccccaacctcttgttattttgtcttttttttttttttttgagagataataagtaaactctgacctatgactcccttttttcacgctgagagaactttgacatatatgtaaatgtgtgaaaaaaatgtacatataatttgaagaacgtatcagaaccccatgtcccaatccaaatcatatgcaattttaaatatggactcttgtcagaaacgtaattcttcttttgatgttctggtctttattatttatttattgcctgtctgtctgtctaacccttgtggtgctagggaccactaagttataacatcagtccctgaagtataattttgaattgacttaaattctccaaaagccctttggagaaatcaattcaggaaacacgggaacattttacactcaatccactagataatgcatcttcattctgatggttggtatcaaacagctatgtatcttggcaactgtgaaatcactttgagtttacgaagccaagagtggcaatgctttggtgttcaggattgattcaaggcctggctatgtcgttgactggtcagtcattgactgattcaaagactggccacgtcttcctttgtgaagtcctgttaaaaccattgtcca

SEQ ID NO: 24178 - DNA, 1152 bp, Mus musculus
cccttgtatgtttggttattgtgcatctttgcaagtataaaatagaacctacgtctcttcctgcagagaagaggtgagtggtatataactctattgttgactaggtgtgataggatatacctaaaatcccagcacttgggaagtgggcaagaagaccaggagttcaagactatcggctatatacgtagtgagttcaaggtcaatcaagtctagataagatactgtctcaagcaatcctaaataattagtgaattatcacaaactgtgtttaatcaatgctatccccaaaccttgaagcaatgtataagactaagttattattgctataagacttttgtataatccaatacgtgggatctctgagtattacattgatgcctgtccttttctttcattgtgtattaacaattcatgggaatgtttctgaaatgggtggaatctaacatggttattcttgacatctgaaatcccagcttgcccggggtgcaaatggaagatttaagtccacgttctggacacaaaatcaactctgtgagtggtgactgtcagctgccggcttcaccaatgccttctcaaagcatgtctgtggaagaaacagcaagaaaactgctgtctaacttaaggtaaaaataattcctagttttcccacatgctgtattgaatctttaaaataagcagtgataaacagtgttttgttttatgttggcttcccgctgatagaggatgtttttgaatacattcagtggaatgattttatgacctatttccttaaccatatttagttagatacaccacaagttaatagtcccttgaaagataacttgtggtcactagctgcccactgtgatgtgacccagcagtatggtggatatacacacataggctactctttccttgaatgtaataaagaagatttttattgaatattatgggtttttttttctactcacaaagatacgcatgacattctcatggcctttgaaaaggattttttgtgggtttagatatggaacttacagaagagaactgagtttcactctttggtgggttgaatttggacatttgtagacatggttactcaaggaatttagatgtcataatctcagctctcaaaggagaagctgggaaggagagatgattctgggttttcag

SEQ ID NO: 24179 - DNA, 1120 bp, Mus musculus
aaacatcataaatctaaattattgtcacttttgcttgaatgcttccatgatgaattaagtaatgggtactggtccatcttcttttattggtatactttcactgtacatagtgatgagttttataaatacattttctttctagtatattgttgggaacaaaataaaaaaggggtaacctggggccctggggaataacggaaaggaaaagatgcccacaccccgccagagtttccctattctctggtcagtcaggtgtgggagggctactatctaccctatctactcatccctaggtgggcattcctctatccgactcttcagggggtagtcaagaggcagccctgcctggggacccccccccccccagctactttgctaaagctaccagggttgtgggagagagggaagaggaaagaagttcccaacactgaccagagtacgcagtggaacttgaaggagcagaacagagactctatggttttagagctttattatagaaatgcaggggaaagagagaaggtagaaaggaggaagagagagagagagaaaagaagaaagagaaaggaaagaggagagagaagtgacataagagagaggtgagaggacaaaggaataagcgagcgaggtgggggctgagcacccctttctaaggtcttcactgttgctaggtaactggggaggagtttagcctgaaggtcagaagcttgggccattgtttacttgactactgaccatgcttctcttgtggggactgtgggagatggtaccttaggcaggggctggagttccaggagcatgagggaacccctaccatgtcatgtaggtgaattatgaccatcggggttcagacctcagctcgactggagaccagcctgcaatttcccacagtatatcatgcccctttcccatgtccctctagacctataaagagtggcccagtttctagatagcacataggaatcttggttatatcaaaaacttaaatatagtagccaaagctgtaaaggctttctgtggattctagaaatatatggagaaatcagagtcaaaactgagtttaaggagcctgtggtattttagatttaagtcatgagctaagtcttcctgagcgtcgcacact

SEQ ID NO: 24180 - DNA, 2643 bp, Mus musculus
cactctcaggtaaatgtttaagcttgtcctgttaacattttaccattaatcagctaagcaagatcactaccttacttacaaggtccatcagcatcctgtgccatttcacagtcccactgggcataactacacttcactctgggtgccatacagaaacgtttaatctgtcactgtatacagtcatggttgtgctactgtttttcaggaggacagcctggagatttaaatggtatacagtatacagttcccatgaacagaactaggagaaatattgattgacatagcaatgagtgacaagactagcaacaaagaagtgccactttaccccgacttgctataaattctacagtgtttgttgtcctgtaataatggcccttctcattttaaagcagaaggctttcttagtaatctctctcagctcttgtgtttacgtgtgaaggtttagatcctggcgtgttgatgctagagaagtgtgaggctggcatatcttttgtgttcttgatatttccatgttattacctggtgctgctgctgtgtaactgttactcatgtataatgtatcgcccaaatcctcttgtgatttgacaaaagaaaagataatcttacaagaagtgttttcttggggattttttcaaaccatgtttcagagatacagtatgtggtacctgatacaaaattgtcttcttcaatctgaagaggtatgaaaaaatagccaatcccagatgtcttcaagatgacacttagccacccagctttcctattttgaaattttgatgtatgatgatttttaaagaaaagtgtttaacagaacttatacccacatcacagtgaacaagtatatgattcattcaggttactctttagaattagttattaggccctaaacatagtccctgtacataatccttttacctgatttggctctccattattcaaatatcaaaaactcctgggtttgatgttaatatgtagagtcaaaacaaagccaatactttatagttcaagattgttgtcattgtcaccatagaaaacaatcagaagagacttttcctccagggagtttcaggattagagccccgtaaggatattggtaacattcatatgcttagttatgattttttaaaatgaattataaatgaaaagaacgaataaaattgacagaagagagactatagcagtcttacccaatatccttgtcaggaagaagcactagtcatttttaaaatagggtgagaccaaaattctagtcaaatagattggcttaaagatactctgcagttgccagctgtgttgcttagcaaaccaaagagggagccacacttagagcagttggctgggctttccagtccaccagaagatgtgatggttggtgtctacagtgtatagagtgatagctgcctctgctaggctaaatttgaaactctgacttgaatcattttgctccttagtgcattagaccatggttgatgcaacagggcacatgccccacctgcagactccatgttttgcaaccagaagaattccctggccaccccaacgggcagttacccaagatctgatacaaggcaggtagctatacctaagatcagctttagacactgggatttagttctgctttttaatgagctaattgtttgaacagtattatgcagcagcatgtgccttgaccagctaatcaaaccaaagctgagtcaaagagattgagacagatctacagcacgtgtaattaaatggaagagactaaagaacatggattttattgctttttgtaagattttccatctgtaaacacaaggcctgtaaacatgactatcagtatatttcttagaatgtcctgccttttcagccttttttcttccttcttattctattgtcttttcctttctctcaagtatgatatattttattttcatgaaatgagtttaatagaacaagtagaagggtaggaaatttctatagactttagttttcttaactttgaaagcttagtattaaaatataattattgtaagttatatttctatcttctgaaatggccatacttgctaagattatggactttgacactggtgaccatacaatggtttgtaatagcttgggagaggtgattattatttttcagacagtacagatcgtttgtcaacttgttgttgccatgcaatttccacaataactatactgtagaaactgcaactaagattctcctttcccccaagagctagttcttaaaaattacaccacaagatgtctatattcccaatatttagcaaaataaatatagaatgaagttagaatttgaaatcaagaggtaataaaaggggcagatatgcaaattaagttatttgctgggataagtaattgaagttttacattcctttgtaaacatactctttggttcttagtcatttacatttggagtaattagaggtttttgttgttgctgttttgttttgtcttcgtctttaaaagtgtctcctttatgtagttgttctggggaagagaagaagccattatatgtattgctgctgcttatgacagagttgatatccactaaggccagttgtctatcaaagcttaagtttcaattcttagacaataaagcctattttaaaaactagtgtaaatacctgtaagtattgtaca

SEQ ID NO: 24181 - DNA, 1149 bp, Mus musculus
tttgccattatgttgccagtgttagtttacttaaataaaatcacagatggttgaaagccttctgggttagaagaatctgcagttccttctgcttaggagcatgctctttttgtctagagtttttgatagctagtcagagagcagcatgtgtattgagcactgaatatggtaaaattctcctgtacttcattccttgaaacagtcctgccctataggaccttagggtgcaatgtgagagactacatagaaaaagaacattaatgtggatttttcgattctccaaattcattttcagatgaagtgcctatcttcaaacttgattataattatttctatcatctgcttcatataattattatttctggtactgacatggtccggcaaatatttgatgaggctatgccacccactcttttgaaaaaagagctgcttatacacaagaatgtgctggaaccctactacaatcatctttggaccaatcaccctttgggtggatcatggcatctgctttaccccccaaacaaggagctaccacagtccaaacagtttgacttatgcctcttattagcgctcattaaacatctgaatgtattccctgcacccagaaaaggctgggatatggaaccaccatcttctgatctctctaagtctgcagacattctgaggctctgcaagtacagggatatccttctcagtgagattctgatgaatggtctcaccgagttacagttcaattcaatttggaaaaaagtttctgatattcttctgcgccttgggatgaaacaagacgatattgacaaagtcaaggagaatcccattgagaatatctcccttgattatcatcagctgtccatttatctaggcataccagtaccagaaatcatccagaggatgttatcctgctatcaacaaggtactaaataattacttacattagccagcaaaccattttttgagtgtctgttctgtgtttagggattctttgttttcctatttagggttttagagccttttttcagtattagaagacactaaattttatgatgttagatattagaaaggaacccttgaagtataatttggaagccttaaacaatacatttacccaaatgttttatatatataaaatgcatgtatatatgtgtatgt

SEQ ID NO: 24182 - DNA, 1179 bp, Mus musculus
acattctcacatgatagcaatgatccacagtttaagtggtggaaaaataagcccagaaactgtgaaccttagtatataaacattctggctttggggaatttgtgcatgaatacttttgttgtatttatatgttggaagtggcagtaaacggaggaaatcgtgacttcaaaacagttatcatttgtttgctatctaacttagtaaagatcataattgcattgatgttttatttattctttgggagatttttagattttggttttttttaatgtttactcttacatattctcatgtatgattatagtcatggattacttaatatcaaccatgaataaatttacataaatgtgctttttaagccctttgtgaacatgctagaatagacacacagctatcaggaatacagggtctttaggctgtatcatcttttgcaactatggtaataaaaatatgacctatcattaactaaaatatcatcaccattaccaagtggtgatatagttgttaagtagttttcttgatccagcagccttacagattaattgattaagatcaacaagtaaaaaatgttctgatactactcaggaagtttttttctaaaggtaacagaaaatagactgaaagaactttattactgcatttaagatgaaacaatatatagcctaaattgtaaatttggaaacagtgctgtagctatcagaaataatgtttaaaaatggagagtatccattatgttaaatgatttcatagtctcctaaaattaaaaattgtataattatttgcaactttcttttgttctttgcttttttttctcacgttctgttcttattttttgctattgttctttaattttgttatttgctttatagaacacagtttctctttctatcctaggctaatcttgagcttactgtggacctcatgtgtcttaactcccagtgatctcctcttgtaatccaggcactaggattacaagtggtttctactatatcagtataaatataactatttcttaaaatgttgtatgttgaaaaacctatcatcgctttcaagagtaattggatttctattctagctaatcagaaatgttatttcttgtagtataatacacatttaacgtattcaattgagccattgaattttatataaaagttatgtatccttgttttggtatttcat

SEQ ID NO: 24183 - DNA, 1271 bp, Mus musculus
cctcagaattgtgtgtgttacctaatacctattagttacacattctgttgagcacttaaaatgtggtatatggagctgaaaagttggatatttaacttattttaatagaagttctactggatatcttgacattggaatatgagatcatctacaatattttgggctgcattcatagctgtcctgagttgaatgctgtccatgggacccaggttagacttgcctaatggttcattttgtttcctatagtttcagttacaatgataaacttttatctggaagatagaaataataatgtttaaattttaaatagcgcatgattctgagttggtgaaatcttctgtcttcccactttattttagatcagttatcatctctttaccatcgtgtctctactgtatattctacttgcaatatggctacacactagtcaatccagttatcaggtcatgttctcaggaactgaaatgctgtattcaactaacccttattttataatactaatggctcttaaacatgcaaaagtagtcagattactatatcacacataaaggaagtaggataagtacaatggtattttaagataaatatgataattaaataaatcactgcatgatctttttataattaatatttttaattgtcgattgctatttcctcttagtaccttatttataaattaagctttatacctaggtataacgctgtgtgtgtgcctgagactctcacactttgagagcagagagacaggtggattacaagtttcaggtcaatccagctgcacatgagcttttattttacatgaggatgaaatggcggaggttgctagaataggagttagctaaattttataagacgtattttgtttctggttctgtgtacttcagattttaaaaccaaaaagtaagtgtgtgtgtgtgtgttgtgtgtgtgtttaatcatgttcatactattttaccatagttgaggatttaaagtatgtatactatgacccccccccaaaaaaaaccaagaaattaattactagttttacacaaatctgcataattttttggaatattgtctaaaatacacaactattctgtttccttttactatttatacttaacaacttgaacaaattcttctgtggtagtttgcataaaaatggccccataggctcagggactgttactactgggaggtgtgaccttgttggtgtaggtgtggtattgttgaagtgtgttgtagtgagtagcctttgaggtctcagttgctccagccatgccagtggc

SEQ ID NO: 24184 - DNA, 1173 bp, Mus musculus
gagagagagagagagagaagagagagaggtgtgtagaagacaagcctctgggcttgactcacctggcctggcctcacattaaaagttaagtagttataatagcagctgaatatttgaggagctcttgctctgaggagcagtcactcacggtgccaagttctctccactgaaaccatttatttcccacagggcctctgccagtgctgtggctattgttccaattttgtagaaagagacaagaagtttgtccacagctacccaactgtttcctggtaatccccgatttagacagtgctgttaaccagtagattgtctgcttgtcttgaatgtctgcgggaaggatggatgggtatctagttcaccactttgagcctatgaaactgttaataatagagcagaatgttggtctcgagtgatgatttattctacccgtaccaacagggactgctgggcactgagcggaaggcttgaggtgtggatgtgcccatgcccattgactttgtgcccagcctattgactttgaggccaccacatggcagtcaattatgttaacaaagaacgaagacttttcctttctggatttctagttcatttttgccgttcattctggtctgtactggaccacaggacatttctctcggtgatctctctggctgtgcatgtgaatctgtgaccatgctgcaagaagaagcctacacctttgaggacagttggtttacagaaagctgtgtcttgaagcacggctcaggacacttgtagcctttcctcagtgatggagtctgacctgagagctctaagctgaaataaaccctttgctctgtaagctgcttttggccatggtgtttatcacagcaatagaaacctgaagatagaccaattatcttggatcaactcaagagttagtcatgctattggctcctggctgatttggggggttcttcatctatactgtgacaatataagttctttcctacattttgatagctgataggtgctttcaagtactgcattgtactgtagctctttcaggcttaaggcccagctctacataaaacactggctgtccattctttgttttcttttcttttaacccttgtcctatattgatagatgatctttagtatgcactcagcagcatggccatgaacctgactgtgaaagccgagctctgca

SEQ ID NO: 24185 - DNA, 2334 bp, Mus musculus
tccaagaatgatgcttgttagatcctagagtctctgaacactgagtttaaattgattccgagtgagactcgccaagcactaacctgagggttagttacccagagatacctatgaaaaacagtggtatccagcaagccttagtaaactcaggttgccagcagctttgccacttccgctgctagctgaataacaagactgccacttctgggtcatagtgatagagactgaagtagaaaaacgaatgtggttgggcaaatcccgtgtggcccctctgtgtgctatgatattgatggcactggtgtcttcattcttgggggttgccatcattcacacacacccctttgacatacagtgcaccccagttttgaatacattttttttgcaccctgtcccgttctgctactttgatttgcgttatgatatatatatatatatataataccttttctcctctttaaacatggtcctgtgacacaatagtcagttgcagaaaggagccagacttattcgcaaagcactgtgctcaaactcttcagaaaaaaaggaaaaaaaaaaaaagctatagttgtaacatatgtattccagacctctggtttaaaggcaaaagaaaaaaaatctacagtgtttcttctcatgttttctgatcggaggcatgacaaagcaagactgaaatctgaactgtgtctcctgcatggcaacacgtgtctccgtcaggccctcgcaaggcccggggagggggttctacgcctcttgtctctttgttgcatgctgaacactcatcgccttcctactgtatcctgcctcctgcagcctccctcttcctcctcctcttcctcttcctcctcttcctcctcctcctcctcttcctccaagtttgaaaggtcaaacaaaactaccacattccctacccagttagaagaaaaccaccgtcctgacagttgtgatcgcatggagtacttttagattattagcacctgtttttacctcgtttgtgggcgtgtttgtatgtgcacatgtatgaagtcggcacatgcaccttctgtatgggcagaggcgtggcatctacagaagagcagatgccaactttgtgcttttagtgaatacattaaaaaaaaaaaaccaacggtccttattgagtggaattctatttgatgcaaatatttgagctctttaagactttaaaactagataatgtgccaagcttttaggactgctcaccagtgccctctgaagaaacaccagtactttttcctgtttgtgtaataaaggcatatttgtatttgtgtttgcatcactaatggttatttcttcttagtccactgaatgtttccatgtgcctctcgtatgccaaactttttgtcatctttcatgtggggaccaaatggtttgtctgtggcaaacctaaacctatgacctgctgaggcctctcagaaaactgaccacagtaccaagatagtacttcgcaaagaaaagtaggttccctccctggttttgtagctgtcgccaatattagcgtaattccaaggagctgaacgcctttatataaatctgatggcacctgatgcttttagttctgaaaatatttacactcggatcatgttgttgatgacttaaacaaagttttgatgaagagagcaaaaaaaaagcaggtggatttggaacagtttcagggttttttttgttttttgttttttgtttttgtttttttttttttatttttgtttttctgttctctgttagaaaagtcaggtgttctctgtcaggctatctttatagtcaattttttttacgaactaaagtagtaccttttaatatgtagtcaacgcccctctgctcggggttcagttttgggtcttaaccagctgtcatgttctctatgctgcctgccacttgaggcactgagtgccctagacagtcccatcggtggtagccagggaaacgaaagacgaactcaactcttgctcctaataatcaactctctgtatgaaggatggcagcattaagagtcctcctgcctgggcattattgggccagttcaccctctttaaatcaaacccgcagtggctcccagttctcgtcccatcagatttaaattgctaacagtatggggggcaccacgcatctgttttgtcccacaatgcgcttttctctcccaaatcccgatttctgctgtcatagcctctattcaatttttatttattgtctgccctccacttatacaatcgtagagagcaatgccatttgtcactttctgcaacagttttttgagcctttatggctgaatcccatttttcttctctttcaaactgtttgctccattgctcctcccgcacg

SEQ ID NO: 24186 - DNA, 1099 bp, Mus musculus
tggtggatcaaaactctaacttcatttaacccccttcttgagtgatcttgtcaccccggcagcctattccccacaagtatgagaaatcattttatcagatgttgcctggaagccatactgaaataattcccacatgatcactgttgtgctccttctggtccttacaattgctggaggaaaatgatgacaacactatgagtggaaggggcatctgaaccatcagggttggagtctgacgtgttgaatcccttgttttcttactaggtcagatgctttgctaagtcataaaaaatgtgtttgcactctgcaatctttggctcagtgtatggaagtgtttgcactgatgtaaatgcccaagcacatgataaattgctatggaacagacattagctgaaaactgaataatgcgttctgtttatagggtggggtggggaataccgcataactctgctctaagcttggtatttgatgttaatgtgaagcagtgggtccatgctgcctgctaaactactgtatgcgtcataagtgttgtgaagaccagcagctgaaggctggaggacagcagccattgaacagaggagaagcaccactggcttatcgggggagaggaagaaaatcagaagaggcccagagtcaccatttgtaagagaaatgttagggtgttacatgacgctgttgagagccacacttgattgcactgctccacagagccctcagataaggccaatcctcatgggctacctcggctttcaaagttaacttcagtaagtctttcacctctaccttcagtgccacgattttccactgcagtgtttcaacttcacaaaaccgacttctccggagagaacaacaccttgctgcgatgggcagtagaagcaagtgcttaccacatttgacctgtaaagtgtttggagtgatggctaggtggaaattggatttagcttctccccacacatccttgttttgcactttatgcaaagtgtactaattgctaattagatgttgtttctgttcatacaggcattcccaaagagttagactggacttggttttgagtttggggattgttaaagtcttacttagattaactaacaacatg

SEQ ID NO: 24187 - DNA, 1864 bp, Mus musculus
acttaaccacctgatgttcacagtgtcttgtttcctagcaacagatgcaaagtgatacatcaaaattaatctgaggctacagactttacagggtatttgttccatagcacaaagtatttccccactcttgcatcacagcacaaactaccaaattttgattttttggatcccagcaataatttttaatagttttcaaactggtggaattttgatagtgctagctggagtttgaagcttttgaattagatctctaaatggtgacagtttacatggttttatctagctttcttatttatacttgactgaattgtaatgttttttttttctaattgtaatttgacctaatagccatataaaatgactctattaatactgtctaggtctagcttctcacggttgtagatattacttcagttccggtgctggaaaatatgtacaacaatactaacagcattgaaaaacatagaggtttgttttgtttgttgttgtttttccaaagcaggtggggagggcagcaaagtattagaattatgtcctcagactttgtttcttgtggggatgacggaagcaggaagtggtgaaaggtgaatcagtagggatagcttaaccccattcgcgtgaagagccccagattttagcatactatttttactatgataacttttaataatattttctaaatttcaaaacaaaaacctgaatgattgaaaattgctgggtcctgatgttggtggctgttggcgtttggaccacttgctagcagtgatttaaacatgataattagctaaccccccaaaaataataacaaaaatagaaaaccaacaattgcattggtgcagaacatgcatcttgacaatggtactaacttgttattctctagaacacattagaatagatctatttttgccagagcaccctccctcagtcctccgatacatttcactagagtcctttaagagattgctgtatattcctgaaagtttttttttttaagaagcaaacaagagataacttttttctacatggttaatatcttacctggtctgcttttcctaaaccccaatggcttttactttagtcagggtgggaaggggagggacttactggatatgactgttttcagattctttaaaaacaaaccttttttgtagaaatgcttaatttttaagcggttaggcactgagagtagcagaaatcctgcaaagctttatagttctccaagtgaggtcttgatttcagtagctgtgcttcttatgccccggctctgctggagaggggtgttggtattttcaggtaacatttgttagcacaaatctttcggtctgttacgttgtccttcttcactctatccgtgttgtcatctccatttcacgtctctccttctggaaactggcgttgctgtgttgctctgatgtgtacttgcgatccgccagcaagcaccatccacactaatattcgtctcacagcatcctcatgaagacaagtcgttgcaccttatgtatatctcaagcaaaccaaaatgcaatcttctgctttgttctgttctaaatcattgtagttatatctttctgaaaccattttgcatttagttgaaattgtcagtatttatgcttttaaccttctggattcaagcctgtatataaaatgttgaaagaagcccttgcccttcgctgcagggctgggagtggaaggctctgtctcaggtgcacacttagtactcttccagcattctttagccctttatttattttaggtattctggtatttccgatgtaattttgaagtgtctagagtatattatagtaactaaaactgcagctctgaagctgagtgaaagaagaaaatactgtaagatgtccttgaa

SEQ ID NO: 24188 - DNA, 1098 bp, Mus musculus
agtgggaagcacagactgcagacaagtgcttggtgccccacacagcccagaaccacttgaagcagaacttagcattctgggcccatgtgttgtttcagaagccacggtttctgagggcagtgctactgtgtgatactgagtgaaagcccggtggcctagacctttgctttgcatggaaggaaggcttttgatggtgaccagtggtgacttggtaaaaggctgcctttgctgtagctcatccagcacctcttttaccaaccagagagcgtgaaactagtttcatatattatctagttattctttcaaaacaaacaagaaaaccctgacgcactgcactagttattattagatattcttagccttttgtacatgaagatttaagttctaagatggtttatataataggttatacctacatttatattgtagaataaatataaaaagcctgtaccagagcctcccaagcagcacgggcaggcagacgtaccattgttagcggtgtatgctcggcctcgtggtccatatattctgcacttttatatttgccaccagagtggtagtggtagtttgctggcagagagagagagagagagagagagagagagagagagagagagagagagagagagacagactgactgactgtgactgactgagaaagagaatattacaattcttacaatctgaatttttttcttagccttgagtgaccaagaagaatttgcttggggcaaattgtggcaaatattttcccagacaggggaagcatcctgcagattacagattactgatgttttcatgccttgaggattcttttatttttacacaggggtctaagtgaccaatggatcgttcatataaacaaacaaaaaaaaagacaaaaatattattcagaagtgaccttagtattacttcattattctaaacacattgaagatgctcacttcatatggacttggagcttcagaccttttacatccatcacacacagaccagacgggtggtgattgctatgcacggcctaataggcactgcaggttttaggagccatttggagtttgtattgttgaggaagtattgagtaaacgaggggggagg

SEQ ID NO: 24189 - DNA, 1188 bp, Mus musculus
ctttatcagggtcatctgaagagactttcaaaagagcaatacttagtagaatgctgttacctcagggctcaccagtgaaaatcaataagttaaaacaatgctaatccacaagtgtccctcctaattgggaccctggactgacaaagatgcttcttcttctcaacaccattattttctataaaactgttagtgtaggctatgtggcgaaactacccttttaggtctgagtgtcttctttagagttaacccagcccagttcacatctgtatgtagaaacacatggtcccacagttagtaaactgcagttcaagaggagatgagtccttgtgtctgtggctggattctctgaaatcttgttatctcaggaagtcagatgatgtttcacaaaccacttggccttttcttttcctaacacaattttcttttcaccgttggaccctgtgctttgcacttcttaccacacgttttagattttttttagcaaagggaaatgagtatgttttggggatccccacctgtgaagtagcagtggcactggggagttgagcagaaatccctccagagtgacaggagggataagcaaagctgaggcttatgaaagtgcaacagacattatttgatgttcattgcaaatccaggttgggcttctttcaccttgtctgaagctttgagttttaaggctatctagtcattaaacttacttgaattattcctaactaaattgtagcaaatttttttattaaagcttttatatttaaagagcttacatatatatttccattggcccatgctaagctaagaagcaaagaaccagtagtctaagcctgagtacctatgatgaaagctattctgctcttgaacctgggactaggtctaaattataagaaggccttttctctgattgtggagtccatactttcgatagtgcttagaggcatgcttaccgggtgttttgaggcagtgctgtgaaaccagtaattgctgccttaagcctgtccccacacagccatttgtgttgcagtactgagatactgatacacggccaaaaagaagtccatactctattttggtggaattgtagtaattttcctatgtgtttggagtatgaatcaacctcttcatttcagatatctatgatttccagggcaaaaaaaaaaaatctctaatttgtagtcctcttttgtcaag

SEQ ID NO: 24190 - DNA, 1177 bp, Mus musculus
tggggctttaagggggaaaacatggtatgtttaaattccaatattgaagtgtctgtgagataagtaggttgaagtactcatttaaaagtaaaatatgtctgggttttggaagagagaaatgggcttgaaatacaaatttgacaatcgtccgcatgtgatacctgaagcccttagatcaactcaggaaaatagaagaatgaagactgactgaggaactccagcccaaggcactgcaaaggacacagcccacacagggaacgcgaagtaaaagcccacagcacaggcgcatgctgtgatctttgtttcttactagttctgctttaggtttattgttgagctatttactgaggtagccgtagactacatattactactactactgcatattatatccatgcctgtcacttgggttttaccccttgttgcttacttcacatggcttatagtgccatagccatcgcataccacagtcaagactcccagcatcccagggacccgggccattgcccgtactgtagactcatccactttctttctcctccgtccttttacagtccctcgaacaatatctcttcatttccaagactttgtcatttcaaagccagtttagaaataaagttccgtagtatgtgggtagtctcttgagctgacttttggactcagcattattttctggcgattcatgcagattgtgtatatcggtagtctgtttcttatggctcactcatattcttaatctggaaacatactttattaattttcatagaaacatataggctaatttggatatggaactatcaggagtgaagttgctgccaataggcatatacattcttttgtcattacttccttaattgatttttgtgtttgtgtgtctgtgtctctgtctccatgtctgtctgcttacaccagtgccatctatttggaaagctgtccttactccattgaatcacttttggacctttcttaaaaatgagatgggctggagagatggctcagctgttaagagttaggttcacaaccaaaaataagatgagaatatttgtgtgattttaattttgggtctctagtatttcattgttctagatgtttctgataacaatgcattcttgattactgtagctacatgtcttaaaatcaagaaggttgatttttttctttattattttttattgtt

SEQ ID NO: 24191 - DNA, 1145 bp, Mus musculus
agaggaggaaggaactaagggagggcagagggctgagcacgaacatttctagctggatgctgtttacctgaaccgtcagcctagttctgtgtactcagagtattttttgagctcctgccatgttctaggtgctaacctcgtggaacttcctaaccttggagtgacaattcaaaattgctttttggcattctctcccagaggagctgtgccattagctctccctctgttagaaaccagccacatgaatgcagtcctctgcctctgccatcccgatcgatcggacaggtacgtgtttatttaaagcagtttcacatctgcacacgaaataagccacagggttctaatttgcttttctaatgcctttgtagccaacgtgggaagttccccatttttttgtcttacaaagacaggctagtctgccgaagctatgcacaactgactgcaagtttaatttcttctcagagatcctcttgcaagtttggtatgatcttcaagtaatagttcttatcttattagtcattgagttatcagatctttattgctaggctgtaaccaacccttattacttctgcacggtggtaaaatcttacacttggtgtatcttagagcctgcactgtgattgtatttactgattttacttgcacttaagaacactctgtgaggtaactagtatgacattattcccattccacagacaaagacataacacttgcttgagattagtggcttgacccaggagactgagtttgtattggctcccccagggcaagatttacatattctagcctttcttctagagagctgcccctgtataagacagactgggtatttttgtgctaagatctttcccccttattttcagcttgtttagattgctgtcacctagaacagtgtgctttaggaacaagtgatttagctgtttatgtcataaggcctgcaaaatatcaatgaaatgaatactacacttccgatttgcttagataagtgtttaagataatgtggatagtttgtctactgataacattttttagagcataagatgggaaattaaaaggactgtatacggacaaagaatgagcttagagtatgtatatgttaggatccccttccccttcccattccccttccttcccctccccttcct

SEQ ID NO: 24192 - DNA, 1121 bp, Mus musculus
gtgatagccagaagctggaaataacccagatgtcccacaacagaaaaatggatacagaaaatgtggatcatttacacaatggaatactactcagctattgagaaggaggacatcctgagttttgcaggcaaatggatagaactagaaaatattatcctgagtgaggtttctcagaaccaaaagcacatggatggtatgtactcactaataagtggatagtagccaaaaaaaaaaagtgcagaatacacaagaactaaaaattttcctgtatatctttatataggatttatttgtttcctctttaaaggcttctaccatctttataagattagatttaaggtcatcttcttatacttcagttgtgttaggatatctaggtcttgctgtagtacagtatctgtcctctgaaggtgtcatattgcctggcttttgtagattgtgttctttctagggctattagccatctgaatggctttggtccctggatgttcctgttgtagtaggtattgggagggcagttaacctcgatgatccttgtgtgttaggcctctgattggctgaatggttcctcttcaccaggcctgatgaagttgaactgagaggtagtgggagaatgggggtgtggtagggattgcaggctgctcagggcacatgggataccctagaagattcagtgggcagagcgtatggttgtgggaagagaatctatcctgtatgcttgcagattaggaggtctgatgaaggtgggtagagatgtggcaaaataatgcaggtcctaggatgctatcagattacttgggacagttgggggtgccccagaggacccagcatgaagggaagatgagtccagtaagggaatctaagttccaaatgctttcttaattgtctgttaactggtaaagagtatagaaattactgttgtttaaacctaggtgcataagttataaaaacatatacccaattgcccgttatgcctgaattaaataaatgtagctgaccagctctgactgaattctggacttaatgtctagtataatgaataagatcctagaagctaggtaccctggatatctcccagtctccaatatgtattcttttgcctaacctgtaatgtcaaaata

SEQ ID NO: 24193 - DNA, 1636 bp, Mus musculus
cctgagcgtagtatcactattgacatctcctgtggaaattcaaggccagcaaatactatgtgaccatcattgatgccctaggacacggagacttcatcaaaaacatgattacaggcacatcccaggcagactgtgctttcctgattgttgctgctggttgttggtgaatttgaagctggtatctccaagaacgggcagactcgcgagcatgctcttctggcttacaccctgggtgtgaaacagctgattgttggtatcaacaaaatggattccaccgagccaccatacagtcagaagagatacgaggaaatcgttaaggaagtcagcacctacattaagaaaattggctacaaccctgacacagtagcatttgtgccaatttctggttggaatggtgacaacatgctggagccaagtgctaatatgccttggttcaagggatggaaaatcacccacaaagatggcagtgccagtgcaccacactgctggaagctttgaattgtatcctaccaccaactcgtccaactgacaagcctctgcgactacccctccaggataaaattggaggcattggcactatccctgtgggcagagtggagactggtgttctcaaacctggcatggtggttacctttgctccagtcaatgtaataactgaagtcaagtctgttgaaatgcaccatgaagctttgagtgaagctcttcctggggacaatatgggcttcaatgtaaagaacgtgtaggtcaaaggtattagacaaggcaatgttgctgatgacagcaaaaacgacctaccaatggaagcagctggcttcactgctcaggtgattatcctgaaccatccaggccaaatcagtgctggctatgctcctgttctggattgtcacacagcccacatagcatgcaagtttgctgagcttaaagaaaagatcgatagtcgttctggtaagaagctggaagatggccccaaattcctgaagtctggtgatgcagccattgttgatatggtccctggcaagcccacgtgtgttgagagcttctctgactatctgccacttggtcgttttgctgttcgtgacatgaggcagacagttgctgtgggtgtcatcaaagctgtggacaagaaggctgctggagctgccaaagtcaccaagtctgcctagaaaactcagaaggctaaatgaatattacccctaacacctgccaccgcagtcttaatcagtggtggaagaacggactcagaactgtttgtctcaattggccatttaagtttaatagtaaaagactggttaatgataacaatgcattttaaaaccttcagaaggaaagaatgttttgtggaccttgtgtgtgtgtgtgtgtggcagttttaagttattagttttcaaaatcagtactttttaatggaaacaacttgaccaaaaatctgtcacagaattttgagaccattaaaacaagtttaatgagggaaaaaaaaaaaagatactacactgtctctaagcaaggctgtacatcaagtgttacagttccagactccaaaatgttctccattttgtactccaggacaaaaaactcctatcagacttatatgaagctaattatcacctatgctaacatcacttagtatgattctctg

SEQ ID NO: 24194 - DNA, 1122 bp, Mus musculus
tttctttgggaaccatcactgttgagaggtgggggaaaacctgaatgtaaaaagcatttatttgtcaataaactgccttttgtaaggggtttttatatactataaaagagcttctcttgttagtttaagttctgtgacctttaggttcccgaactctccctctcatccacccaggagtgtcataatgctgtaaaagtgactgctgcagatgcagggaaaacaggcttgcaggagactgcttgtactccagtaccataatgagatgccctgatattaatgcctgcatcactttcaggagagatggaaaaggggaccaccgcctggaaatatgttaatatgcctttagataaggtcatggacatacatgcctttcccaagtggaatagagcccattttctattttatgatgtcaccctggctcctcacagtgtgggagccccctaaggcactgacgactgttatgtatcactgcaactgcaggccttgtaagttgcaaaactcttagtaccctttctccactcatggtaggagtcctgtttactctgtgggttttgttgttgactgctctgtgttgcccccatccaggcagatgaaactgtggttacttctaatctatggatatcttttgaccatctgtaatgtgcgttgcactcttgtgggctttgaaagcacaaactctcacacatggactccatcatattatttgtgtagatgcgtttggtggtaaatgtctccagtctgatggatgaagcttccaagattggtgtaaggactttagacctctgtggcaatttcaggtttttgggttgggttgggttaggttgggttggggtttttgtttctttggttttttgtttttgttttgttttgtatccctaatagtggggggaaaagaataaaaactatctctgtgcaagaatgcttgaaccacattttgatagtttctaaacattgattttaggcttgtgtggatgtttcttaccactcgttactccacacctagtctcacatacagagatgcctcggataatcacttatcctgacaaatgacaagatagtaagtacatcagacagatccgatggagctgccattgtacaagactcatggacaaagctgtgttt

SEQ ID NO: 24195 - DNA, 2473 bp, Mus musculus
tcctccaagagttttattacgagaatgagcttggaaagaagcagttcaagtatgggacccagttggttcatctggcttatcgggaacaagtggcactgtatgtggacctggatgacatagctgaagatgaccctgagttggtcgactcaatttgcgagaatgccaagcgctactcaagactgtttggtgatgttgtgcaagagcttttgcctgagtacaaggagaaggaggtggtgaataaggatgtcctagatgtttacattgaacaccggctgatgatggagcagcgaagcagagaccctggggcagtccggaacccccaaaaccagtattcttctgaactcatgcgaagatttgagttgtatttctgaagcccaagtagcagcaagcctcgagtgatccgggaagtacgagctgactctgtggggaaattgttaactgtgcgtggcattgtcactcgtgtgtctgaagtcaagcccaggatggtggtggccacatacacttgtgatcagcgtggggcagagacctaccagccaatccagtctcccactttcatgcctctgatcatgtgccccagccaggagtgccagaccaatcgctcaggggggcggctgtacctacagactcgtggctccaaatttgttaaattccaggaaatgaagattcaagaacatagtgaccaagttcctgtgggaaacattcctcggagcatcacagtggttctagaaggtgagaacacaagaattgcccagcctggtgaccatgtcagcgtcactggcatcttcttgccagtcctgcgcacaggattccaacagatggcacagggcttactctcagaaacttacctggaagcccactggattgtgaagataacaaagagtgaatatgatgtctctggggccggagagctgagctcagaggagctgaagcagattgcagaggaggatttctatgagaagctggctgcttctattgctccggagatctatgaacatgaagatgtaaggaaagcactgctgctgcttctggtgggtggtgtggaccagtctccttaaggcatgaagatcagaggaaacatccacatctgccttatgggagaccctggtgtggccaaatctcagctcctatcttacattgaccgtctggcaccccgaagtcagtacacaacaggccgtggctcctctggtgtagggctcacagcagctgtgttgagagactctgtgagtggagaactgactttagagggtggtgccctggtgctggctgaccagggtgtgtgctgtattgatgagtttgacaagatggccgaggctgaccgcacagccatccatgaggttatggagcagcagaccatctccatcaccaaggcaggaattctcaccatgctcaatgcccgatgttctatcctggctgcggccaatcctgcctatggccgatataatccccgccgcagtctggagcagaacatccagcttccagctgctctgctttctcaattcgacctcctctggctgattcaagaccggcccgacagagacaatgacctccggttggcccagcacatcacctatgtccaccagcacagccggtagccccctgcccaatttgaacttttggacatgaaacttatgagacggtacatagctatgtgccacgagagacagcccacagtgcctgaatctctggctgactacatcactgcagcatatgtggagatgaggctagaggcccgagccagtaaggatgccacctatacttctgcccggactctgctggccattctccgactttccactgctctggctcgacttcggatggtagacattgtggagaaggaagatgtaaatgaagccataaggttgatggagatgtcgaaggactcccttctaggtgaaaagggacaaacagctaggacccagaggccagcagatatgatatttgccaccatccgtgaattggtgtcacgggggcggagtgtccacttttctgaggctaaacagcgctgcatatctcatggcttcacaccagcccagttccaggcagctctggatgaatatgaggagctaaacgtctggcaggttaatacttctcggacacggatcacctttgtctgatagccagtttttacaccctcctgcctacaacagagggcatgctgaatgccccctcaagaaaaaatatcattttcccatgctgcactttttttattctgccaataaagtgttttgattgccaaaaaaaaaaaaatacaacactgaatattttataggtgggtgcatttgatattttaatgattctagtaattcttatattcatgggctaagaactgtacattattttcttttaattttaaactggattattgtcttttcacttttattggatattttatttatctacatttcaaatgttatccctatttccagtttcccctgcagaaactgcctcttccatccccactcctccttcttct

SEQ ID NO: 24196 - DNA, 1099 bp, Mus musculus
cttttctgttatctatttatggcaagtcttctacttttcataaatgctttcaggaatatacagctttaaatattatactatctctcttggtaatttttttatgtaaaatattaagattggatttataataataatatatatttttcctgaagtgggaaggggaaagcagtcattggattagtttccattcataaagaaatacgaggctcagttacacggttgtttaatgtatattctttgttttgttttgtttttctttttttcgagacagggtttctctgtatagtcctggctgtcctggaactcactttgtagaccaggctggcctcgaactcagaaatctgcttgcctctgactcccaagtgctgggattaatgtatattcttattttgccacatctgtgttaaaagaagtttattgtagttatgtttttaactttaaatacatagtacttttatttttttgagacagggtctgtctaaaaagccctggttgtcctggaactcactctgtagaccaggctggcctagaactcagagattgtgtttgcctcttcctcccaagtgctgggattaaaggcatgcactaccgtgcccagccgtggcgcccttgttcttgaagtgaagcagaagtagtttgtaaggaacattttcaattttttttttctttttttgaggtgagggtctcattatgttgtctagggttggtcttgaactcctggccccaaatgatcctcttgcctcaacctccagagtagttgggactataggcacagaaacatttaaattgagaattttggtgataaagtctattgtgccatattacagttaagcgtcatgtaaacaaggtgggcctcatagtcctggagagaaactgacccccatctttctaggccgaggcgcttcttattgttaatgggtggaatcacactggactttaattcttttcattaattttagtggatagaggggattgctccttagagtggccttgtcagtacatttctttggatgttttgtaatatttgtgtgtgtggtgctagcatgctagacaaagcacggtaccactttacaacattgcagccccgtgttccagatta

SEQ ID NO: 24197 - DNA, 1194 bp, Mus musculus
tggagaaaggagacatagagttagtcacttggaaccatgctgttcaaatgcctcttttcattatgtactcttttaggctgttgacatttatgtgccaatactttggggaagaagtagatcgtaagaaatcaatatgtattcatcattatggtcttgcttttatttctatatatacttcaccagaagagccaaagctacacttcacagtgtgtgtgtgtgtgtctgtggaccacaggagttacagccctgtgcatgccccatggagctgtgtctcagtccttatttcactcgtgacctttgtcccttagtgaagaacgtttaaaatcctgatagactgcaaatgttgtttttttcctgaagaattttttttatctaatctctgaaaagtgccatattcgaaggacaatgtactggtgactaagaaaagataaatccagctgggcttggtggcgcatgcctttaatcccagtgcttgggaagcagaaacaggcagctcccatgagttcaaggacaacctggttaaaagtaggtgctaatatcatccattattctattaaagccattagagccctttaattgaaagtatataaaaacaaaagttctggtccttccagaatagagttgaggaccatgtggtacttgctgagaggaacagctctaccttatggcgagctgaattcataaacacatagtactcaggttgagaaggcttgcatttcattctcagaaatccagagtcctttgacaaggacatgttttctgggttttataaacagaacaagtcttgagttcaaactatttcctctagtatagatgtgtactattgaatgcttgattgattaaaactgaaaagttaactctgaataataattaccttttataattttgcatttcttttaaaatacttaatttgtatgcgtgtgtttgtgtgtgtgatagtgtctgtctgagtgtatgagaatatgtgtgtatgtgtgagagagtatatatgtgtgtgctgtgtatgtgtgagaacttgtatgtgtatgtgagagcttgtgtgtgtgaaagagagagtgtgtgtgtttgtgtgtgagaatttgtgtgtgtatatgtgcaagggagagtatttatgtatgtgtgtgtgcctgctggaggaagccagaggtgggtgtcagctcccttgaacctggagctgacaggtgtttgtaaacc

SEQ ID NO: 24198 - DNA, 1196 bp, Mus musculus
tcgtcaggtagcgcaggatggcccggtagctctcctcgcttgacatagccgccggcagcgccctcgggggcgcctgtcagtggtaaggagaggcagacagcgccgcggctcgggagaggggccgcggcgacccggggaggagcgaaggcgacgcctgtggtgggcgctctctctctccgagggcgcccgcctgcccgcccgccggcagcgcggaggggaagaaccgaccacctggtaaccagggggaactgcacttcggcagcgcgcgggatccgctggcgactgacaaaatggctgctgcaccaccggaagtgacgcgcgggagcggggcggggccgccaccccgattggagcgcgctacggctctgcgctcccagggagccggcggtgtgacgtcaacactgcggaggacatgttggaagagggaacgcgctctctcgggcagatacgggggtcctcagcagacatcttaagtcttggcagggccctcccccaccgccctccctttcctttcccacgctctctgtaaagccacgtgtttgagcggttcgctgtttgtttccctgagaccctccccgtaaacggtaactgagtcagttgttctgtatactctgagactagatataccagataccgccgagtttgaaactgtagcaattgattgccactgtctgagcctctgggccaaatactgtcgcagtattaccgagcattaagtgcttcagtgttacgaattttctccaaactacctaagtaattttctagaaacatcaccatggtgacgactatgcaggtccagattgcttagatgattaaataacatgcagaagtaactctcaatcccgtttccttgtaatgcccggacgctttgtgcttattccttgaagctagaaggttccaggcttcccaacccaatgactttagttaaagaagctatttttctttatttctgcctagaagacacacacattatctatgacgcttttaaacgtttgtggtaccacaggtaaggagcaagcaggtggcagtgggctcaagaaaccagacagtggttagagtgtttccatcgtctatgaaggaaatgaagggtaaaaatggagagcatctttctcccaagagattcagatacaggtttgtacagggtgtggcttcatgacctttgtactttaaaaaaaaaaaccgctaacgggatattt

SEQ ID NO: 24199 - DNA, 2123 bp, Mus musculus
aagaatggtgtaagactagctttggagccgtttttctttcttctttttttcttttccttttttctttttttttttttttttttaagattgagtggtacactaataaatgagagtttgcaattagaggtaatttatgttttatatacagatttcaagacatttgctaattttgtagtttcacatgattagtttccaagggttacagataataaagaaatcacaagtggtacctttctaagaattgcatatttttttagacacaactattagcacattaagagggaagccaaaagttattgtctgcttcaaactggaagcagttcctctcctgacttctccctcgttacccgactgtccggctccctgcagcagccttaccgagagggagattggcttgagaagccagtgttactgttgtgactgttggctgagaggaagtttagatgaggttcaagtaaaccctttcctgcgggcatttcgttttgtttcgggccattctagctagtactgcttcgctctcagtgggtaccgatgcttgctctgtaaaaataaatttttttcgttaaaaattcttatatgaagaattgagtattatgactagcccactctaacggagtgtgtctccgttgaggaccttcagaggacactatttgctaccaaagtgaaccagtattctgaatgtgcttctcttggtttctgttctagttcctagaagcatttccaccagaacttgaggcaaaacataaggaagctgtttcttttaaagtacaaacaccaccaaaaatatcagtgtacatagtgctttatgtatttggctggcttttattttttaaaaggtttaaataacaaaaaaggaaaaaaaggtatagcattgtatgaaggcagatgaggcgacacacctgtgacatttgaagcatttgtgttactaacttactagatccggtttgaattgaattcacaaggtttcttacttgtccaactccaggcttattttacgtacatacaacctgaccagtggtttcaaaagcacatttagtgactgcaataggacagaaatgcttctctagacacatcttcattgcgagcgtctcatcgcatatgctcttagagttctgaatgtaggatgtttgttttgtatttttgtattgtatatgggctttttaaatgtgacagttaaatgcatctttaatagtcacagacaaaagagatgataaaatgtcctttgaaaatggcaatgttgagtttggaggcagcttcggggagtttcctgggtggcgatgattcactgggcagtttttaatgtagtgacttcaagaagcagcctgcggatattcctaacacttggttcactacagtttagtttacttcataagccccaagtaaaacgatggaaatgtacatagcactattagttcatacatgatttaagtatatcaagatacataaatttaacatttatgtctgcaaactgtccatttgtccattttactgtttgttgaaataacacctctcctacatattctttacttgactcgaataacaaattaacctgacgtcaagatggagagagacgactgagctgaatgtctttactaaaattacaataaattttgtcaaacttggtggtggtcttattttctttctttttttttttttactgtgtctttgaaaatgttttttaaaatagtctgtgtatatggcatgctggtgagttcaaggagacacaaaacattgtgaaaatattgccacttagaagcatgcccccagaacctcttactgctcattagacagtcgtcagaataatgtgttagcattatctgttactctacctgactctggtcggcagattcttgcattccatttacaatgctcttatatactctgtccgagaggagctacactatcagctcctgagatctctaaagacttccttttcctgtgtgtttattgtgagtgtccatgcacatgtagcactgtactctagtagatcagacagagcacactctgagggattctgttcttctttttactctctatgcactgcatctcaactgtgcccccctcccccccccccaacacacacacaacacacacactcctcctagttcgtcccccacctccct

SEQ ID NO: 24200 - DNA, 1162 bp, Mus musculus
cagggtttctgtgagggagataaaaaaggaagtagggaatttagcatcaactgtgtatcttatttgatttttgttactttttaaaggtatatattttaatgcatttaaattccaacattgtaaaaatactactggagaatagggagatgatggcccagttggtcggtttgctgcagtacatacaacctgagttctgatctgtgaacagctgagcatggggatatgtctgtaactccagctctcagttggtgaaaagctggttcagtgaaagccctcattccaagagtaaggttaaaaaaggggtagaggaaacactcagcatcagccttgggcctccgtgggagcactcacctgcatgcatgctccacacacataaacaggttaaaatgcatggatgaaagtaaacttagtgtctgttattttaatggcatcattccctaagtttaagcaaattaatgctttttttttagttaatggccagccaagaccccttgaatcaagtcaggtgaaatatcttcgtcgagaactggtagaacttcgaaataaagtgaatcgcttattggatagcttagaaccacctggagaaccaggaccttccaccagtattcctgaaaatggtaaactggatttattttattttattgtcatgaattcttttttttcatttttgtggggagaggattatttgattgcttcttggagtcaggtgtcatccttaatatctttattctccttgtttatgcttttgtacatgtcaacattccccaactatttgtcaagattactgtaaacttgcactacagtactttaattgaatcatagagctctgggaggacagggcctggaatcccattttgaagtactctctaggacgggggaataactcagtggtagggtgcttgcctgacatatgcagcactctgtactcagtccccgtactgaataataagtaaatgtgcagatggctgcataaggagtgcttttgtgatgatttctttagtttgtctcagtctgtacagtaggccagttttcaaacacttttgattcacggattgttattagtgtgataattaatgaatcttagaaatcgattttctgtagtaaaaactatgtttcaaatgtaaaatacttttagattagtactataagtattatattaaag

SEQ ID NO: 24201 - DNA, 1183 bp, Mus musculus
ggaagattcgcagaagagggacatataaatatttcatgaatccagccactctttaaaaattcttgatccttgatcctttaaaattatttacttaaaaatctataggcagtatcacatctttttaaagttttaaacttattcaaattttaaacttctaacacttttctaaacttccatgttgttttcctttatgctcaaagggcaagtatatgatatagtatgtattgtgttttaaagaagtcaaaacattctggttaccaaatttaagatctctataagtcatttaacttctcatctgaaaattggatagtgatttctaatctgtgggtatatttcaaaaattagggtgaggatgacatttaaaacacttgtcccagtgcctgatatatgataaatgtcaaacaaatgcaaatttttgttttatttttatttgaattgccaatcttatagtaggagctacaatatactcataatccacacagcagtagatttggtggggacaagagatatttttgctgtgtttaagtgaaatatctatttcttgtacctgtaggtcatggggagtttcaaaggacatgctctccctgggagtttcttcttcgccatgggcttttggtggactatgaagaacatcctgaaatctgtctacaaaaggcaaactcgaacctgctaccttaactctaaaacattattacgtcggacagagatttgggaaggagttgttgtgcttttaatgtctctcactggtaaggagaccattcatggatgtattctgttttctccttttgagtatttcatgagcaaaaaaatccattcaatacaatattgaaatgtacaaaatgaattttgtattactatgttgcttagtacttaacccaattacagtttacaactgtcataatcttaggaaagtgacatttcataattattcaaaagcctaatcctttttttttggtttttaaagatttatttttttatttattcatttaatgtttctatgagtacattttagctgtactgatggttgtgagctatcatgtggttgctgggaatttgaattcaggacctctgtttgctccagtcagccctgctcactacagtctaaggatgtatttgattatatctaagtacacagtagctgtcttcagacacaccagaagagagcgtcagatctcattactga

SEQ ID NO: 24202 - DNA, 1194 bp, Mus musculus
gttattggtcctattttacaaaggtggaaactcagacactcaaaggttaagtaacctaccaaaagccacagaggtaacaagtgataaagagttttcagacctacattaatttttaacattttagtatcagttttgggctggagagatgactcagcagttaagagcactgactgctcttctgaaggtcctgggttcaaatcccagcaaccacatggtagctcataatcattggtaatgagagctgatgctctcttctcatgctgtctgaagacagctactgtgtacttagatgtaataataaagaaatctttaggccagggaccagaacaagtggggtcgaccagagcgaacagaggtcctgaattcaaaatgcccagaaaccacatgatggctcacaaccatcagtatagctacagtgtacccatatacattaaatcaatcaatcaatcaatcaattaatcaatcaatcaatcttttaaaaaattagtatcagttttagttgttattagggaagtctgctgtgtggagggtgtggcatgatgcatatgtgggttgtagaatcacaagggttctaggatccaacttatgttgtcaggcttgggtggcatttgctttcgcccctcatccatatagtcctgctctctctcactccattttcaccccattattttcactaaatatattactggttatttgaaaactgtacttttagtgtctgcataatttcttgaagcattctcttaatcctttgacttaggtcttgtttttatttgatcttaaatttcaaaacttttttttaaattttaaaacttttaattttaatccagagtcttaagattctagacactcttacaaacacgtttattatattaagaaggaacaaaatgtatcaagatcattaaatcatacaaaattcctttcccaaaaagaagagggggggggcagaggatatataggctgggtgggtttctgaattcttcgtagcagtatttctcaatctcttatggttgtctgaaccagacaagcaggcagaatcaacagctcatgggggttaggttgctaaatgggagctcatcagagcagaaatttcatgtatcattaaggtctacatactttttttagtagcaaagaactgcagttagatgtccaacacatgttaagtaacgtatatggtccaaactatagcacagagtg

SEQ ID NO: 24203 - DNA, 1149 bp, Mus musculus
gcaggctgtgaaattctttatcttttcttgtttgaacttgagttttaaggagattagagcttatgagtctgcctctatcttactctctctctctctcattcagaagtaaaactacttttctcaactatttaatctgtaaatggaatacccttacatattaaaaatttcaggtgatgagatcaatgatattttccagaaatcatgtagaacacgacaaggaaatagccaatgtgaacaaatatgttagagctatgcaccgcagagcatacctacccacagaaacgatttccaagggtttctaagggtcaaaaactccttcttaggagtttggaatggaaacactaaacacaaagctcctgtttgttgaatggagtttcctctcccctgtgacatatgctctgttatggtgtccaacctggactcagcgtgcagaggttaaaagggagttttgcttaagcctctcacaatagagaggaaatgagagcagggaggacggaacacgcgagtctgagaaacgtgctggtgcttttgcaaggctgttagctaacataactggcattgtttgactggtaagacattttgagtgaagacggcttagttatatagatgaacaaggagctctgggcgagtgagaagagatggaggatccaagaggtcatgtcaacatgctgtgactgagaaacacggtaatgaagaaccgtgcaggtgctgtggaggcggaaggatacagagtaggtcgaggtagaaggtaaaaaacaaaggaaacgtggtggtgtacacctttaatcccagcacttgggaggaggaggcaggtggatttctgagttcgaggccagcctggtctacagagtgagctacacagagaaaaccaacaaccaaaaaacaaaaacaaacaaacaaacaaaataacggaaaagtccacttcgagctcaggccgctcaggcccagcagttcctatgctcaaaatccagatctctgtgtcctgttcttccaacccttatatccttcccagttttaaagaaaagcataagcagatataaaaggaattgagcaacacactagaagatggaaatattttccatacttgtggattggaagaattagtattttgcaaaatggccattctaccaaaagcaatctacagattca

SEQ ID NO: 24204 - DNA, 2549 bp, Mus musculus
cttctcagaggagaaggggagagggagtaggggaagagctgttggaggagggactgggaggagaggaggagatgaatatattggggtgtaaggtggattcattagtgttttcagtatgctgtgctaggcctttttattatgaaagaaacgttttattagaattacaatcgaaggcttcatgcagcacagttaaactttattggttattaagaactgcttgttgaagaatctttgaatttttgctcttttagaggaaacatggagaaagccattgacatgttcaacaaagctatcaacttggccaagtcggaaatggagatggctcatctgtattcactttgtgatgctgcccatgcccagacagaagtagcaaagaaatacggattaaaaccgccgacattataaacacaggggaaacagactgactcttttcaaagaagtttaccccctcttcaactcaaccctgaagacactgtcataaattgttgaacggtggaacttagtagtccctttgtgatgttgtcattcattacatctgtttcatgtttaggtgtagtgggcgtggctgttgaaggaagtttgcagtcttgcagcttttattccctgtgcaacaaaagcttagaacctgttaaagggatattaaaacaaagttgtagaatacaaacagtaattggccatgcaaataaaaactttgatttgttgatttgttttttttttttaatattggggtggggattatgttctgaatgattttgtttttttatagctgtttgtataatatgtgagtattttatagtatgttagtttttaacatagtaagtgctgtaaaatatacttcttttgtattcaattaatcctttttaattttttttgaaggatgaaaagcttcaatgtggatttcagtaaaattgaaagactttaagctattgtcagcatgcacagtgcctctgattctgtagaactttagtaaattatgcagaagcaaaatattctcattgatacttgtacaggaagacttaatgagggactgaacaaggcaggtaagatgaacaagacatgtatatacttggccgtgcctattccatagtaagtactatttaatagtatgcttttaaatgaaagtgggtgtatgtgagcaacccacgtacaggtggagtacatgtgatgatatataggagtatttaattagcttcaattttctagtgacagaaatttggtaaaggttctaaaggatgtcagtcctgaagccaggacatacttgtttgaaatggaaacctcagtggtgtagctgtggctgctaacttagggatttgagccagtatttccagagctgtccaatacatagagtacttctgtattgaggtgaccttcacctctaaggacggatggcccacatccacatctccagggatgctgacagttggttctgttcattttgatctgtacctcatcctcttttgactctctaagctgtttctcttcctcactttcacagcctatccttttacttacttatctgctggagttttctggttggggagggatgtgttcttactgagtctgtttccaagatccaggacaggttgaggtttatttaagtaaaatgattttttaaaaaagcaagcctgcttataattatagtttacattgttgagagtaaaggagcattttacactcttattttaaaagggtgctttatcccactgaaaccaaaatgattttgtctacagatgctgtctttttagaaaatattagaaatgactcctcttataaagtcagtttttggacgatgctggttagcctatggctgatatcattaggaacaattaatgtaatttaaggtgactgggataatggaaagttggagagatcttcattttgttgtgaaataattctccaatgatgataaccttaaatacagaaatgtcctacatctctgaatgtgacctcttcgcttaaaagttttttatttgcatggctgtatttacattaatagggacatcttctactcttctcccttctttcttggggtagggtaggaaacactgaagcatgtgccgttcaatactgtcattccagatactcaaatgttttgcttgttgtgaacatgtttgaaactgcactgaaagctgcatctgtctgtatctttacttttgtaaatggcttcacatgtaaattcacaaaataaatactacattcaagcttttctatccatttttgaaacagaaagataggaaatttgtttgtttttttaactgaaaccctcttcagtcagtttcttgttgattcaaactaactttgaagatagatatatacaaggttttattggtgtggtcatgaaatttcctgcgaggattcattctttatctgtgtcttagactcagcctagaaagccatctgtcatatgttatgatggagctacgttctccgtgctgactccacacggtagtttaatcatagtctcaaccatggagagaacttgagaacttaagtaagctaaagccataaacatcagaggacacaaaagaggacaacttcaaaaggaaata

SEQ ID NO: 24205 - DNA, 1341 bp, Mus musculus
gaaaataaacggttagactaatgattagctcactgttctgttcttaaaaagattgaagtctgttggatggaatggatggagatcatagcaactcaaaacacagcccagagtgagacaccgaaggtcagcttccccatcttccttcctccagtaggtaattatccagagactaattgcctcagagatagtgagcctcaccccaagttgctaaggaacagttaacagcactagaagtaagtaggcatgttaaggttaaaattagcatttgggggacagaattgtatctgtaaaaatgtccttggtctttattacaaatgggtcatttggtctaggctgtttcaaaatgctttgccacactgattatcctccttgaaatgatcacccgtgaccacactaatgtccagtttttaaaagaaagataatcagagagctgtaggaatttcccattgtttctctatcactttctaaaagttccccggtttttgccgtcgcagtaaagtttgcgtggttggcacttgttccatccttactctctgaaagacggacgccgtctgctttgtttcgcagcttgctcagactagtcactgtgctgagagagccggaacagcttccgaccatgggatgatttttataaaatctgtctgaaaaatagtaaatagaacctgccatgtcataacatgtaatagattttttccaaggggttggttgatagaaatatctagatgtaccccaccagtagccagtgttttaatttgcttaatggaaatcaagtgaatggtaacataattaaaagaactctattctgatatctaaataaaaacaatgtatttgagtggttgaagacatttgcatgaaattgcaccttgtacggtacttgatatttataactcttcccccaaactgttgtatttcatttcttccattttctcgacaccctctttgagatgtcctgaagtctctcagctatgggactttttttcataatattaatgtaaagatgtttgtgttactgtttataaattacaattgtaaataaactgatacaagtttgctcaaaacttctgccctggaggatgtctgttctctttatctgtattttgcctgcagattaaacatttgtcttatatatgtaccttaggctaaaaccagtggcactaggtgggtgctggggtgctcatagccccagctattgaaggaggaaggaggatcagttgagctcagggagtgaggtttctgtgacctttcccccctctttctactagagctgtcaatagatctgtcaccttagacctggctttgtcttcagtagttgccatggctaccaggccactgcagtttcta

SEQ ID NO: 24206 - DNA, 1199 bp, Mus musculus
gaggtacctccttcccccatacctgaccacactcccatagggcatatcttttatctctttatctttttataaacacatcagtctcggcatatcttcccacctgggctctagcctttagcatgtatgattagcacatgattgtattctgcttcatggcttgtgatggtattaaatatacattaggctttctctctacctgaaccatacactgtctgtgaatatgcacaagtgcccaaagtattaaaaaaaatcttatttacattttaaaagatttattttatgtatatgaggtttgcctttctgtctgtttatctgtgcatatctggtgtggaaggaggtcagagaaagggcagatgtcctgtaagtggagttatggatggtatgagccactctgtgggtgctgggaactgaactcacatcatctgaaagagcagccaatgctcttaacagctgagccatttctccggcccatagtcctgacgaaaatgttaaatttctaatacaaatattttcatatgtgattgttagctttagcagaaacttcgaaataaaaagaatgacctacaaataaacggggggggggtgttatgaactgtatatttctccattcctttgaatttgctagctgcagaatatagtctgtttggttaatctagttgaaaaataggtaatatatttaaaagtctgtatgcccatgggaaatattaaaaatatcttgttaatcaaatactctgaatctgagttacttcttgttccaaaaattatttcatcttttgaaacctttaacacaaaatgaggtcatctcgtcgccgtggcgtgaacacattagccgtttccttagtctgacatttttcggttccaaagaggaaactgctcttctgaagtaaggatggtagctctgtgatttccattaggggaacagtgaaagagaaggatagccgtccaagctagccagtcttcagggctgctgggatatgaggtgacgccaggtctgtccccctcagtcccagtgggtcactcagcctgtggagcagaggcaccaggacagggctgcatttttccagctccctggggactagttaaaaaccacatagccagatgggattggttggatttttccaaaagaggaggcaaggacaacgtcctttttcgacccatggcaacagtatcaattacaaacagaaggttgctcagctttc

SEQ ID NO: 24207 - DNA, 1195 bp, Mus musculus
tgatactcatgcattatactatcagtgacttcattgtttctcttggcaattttaaaatacatctgtgcatggcccagagatacagactgaggtaaagaaagatgtatttgcaatggtggtttaggattgtatgagtgtcatttcccaaaacttgcagggagggtggtggataattgctttttgctttaaatactaaatgccaaataatggtgacttgctgctttctgaaagcaccaatactatgccaccttaactgtccttcatatgattgtgacctttgagttcatagactgagggtcaggaaacctgacttctgcttccagttcttcccttaattaggcaggcctgacttcctgcttacaacatgagaaataagatcattcaagatggaacaagaaccagggttcttccccttgacctctgcttttgtttcttgctcaataaataatagatcccctgacagcagggccggggcctgagactagatgaactctaaagtcttggggcttcccgcactgaagttttgtgattctctgttgtcttgtatctatggatacaaataccatgtagttggcagtgagaagtagattggattttgttttcatatgtagtgacctcggtctgtttttctttggtttaagctagttgaaattatggcatattttggtaagaatgtgtcaatgtaagagaaggactacagaaaatttgcaagccttttttcttaatttaattgtaggaaataggcatatgtaaatagaaacttattctattcaccaagtcaagcccttacccataaaactttttgaagtcactttattaatcttatacatcaaagtgtttattccacataactgagtagttattcagaaatgcgtttagtattaatgtatgattagtttcacatgtgaattatgaaagaaatatgatgataatattttatttgtataaagtaacttgggaaaggctccaaaagtcagtttgggtctttttcatttaattgaatattaaggtaacgaatcaaacgtactttgagttaaaaaataatagtagcagtgacaactaacatttagtgctaaccctgcaccctattcaacatggttttcattaattaactaactcaatcagtacaatactatttatttttcctctctccattttgtggggaagaaaactaaagtttggaattgttaaataa

SEQ ID NO: 24208 - DNA, 1184 bp, Mus musculus
cggggaacttgaactcacagcacacagaatcctggagcaagccattcctgatttgctgggtttgctgtgctttggtctgttagtgaactgtttcctgacgttcaacgctgccacctagttccttctcgccggcctgtgctcaggcttcacacccactctaccgctgactcccatgtccctgggaaactatccctctgtgtagttctgttgtgaacatgaaggaactgaacagatacaaggcttgtctgcagttcctgaagcaagtcacaagagaaggaaggctccttcctgtcccttgcatgccttgcttggtgccctgttgctgtctgaggcactgctccctggcctctatgattcagctttccaactaaggtcatggtatgtaagcgctttcttcagtaaccaataataatcctggtttttgagctttttccatcacgccagtggccatcctttgagttctatgtgcatgtcatcatttaatctttatttacaacacatttgagataggattatccatcgttttcagatgaacaccttcagactgaagtctcttgacttcaaagttatgatgcaaggacttaagcaattttttttttggcataatcttggacttactcttcagaggcttgctcagtgatgtctgtcattggcaggggactactgtgatttacttgagacactcacaactgtgttttacaaactaggtaataaactaggacagctaagtaagagtctgcctctgcacatttacaccagtgctactctacctgtgcatgaactaacctgtgcattaactaacctgtgcatgaactaacccatgggcattgtgtacactgcagacggcatggaatcgtgtatgcgacgggtttctaggaggtggcaggaaccggacatgggattttcttataggtcaaacattataagaaatggactttctctgacacaacagccagctgttgtatctgcagactccaaccagccatttgttgtgcttcactgactctcaagaactgatgaatagcttttcatttctttcctttctatgaaatttcttcttgaactgtggctcttgttcccttctcacatataacttattatgaaatagtcgagctaggactactgcacttcaaaataggctgagaaaatttcacttccttgcctagttctggctaattagcata

SEQ ID NO: 24209 - DNA, 1152 bp, Mus musculus
gctgaataaaccctttcttcccaaacttgctttttggttatgatgtttgtgcaggaatagaaactctgactaaggcaggtgcatatatatcactatcattatatatatgttcttgatggattgttctattaatatgtgttggccttcttaatcccatctcattagaactagctggagatgcttccttagatatgaatgtggttgctgcttgctcccatagtcttcttctttctcctataatccttgtgcatcattgcacacaacatatttttgatacattcagtatgtttgcatcttttaattggacaaccgagactatttatatttatggtgattgtggatatactaatggtcctcccttcatttcagaggtatccctgtttactgcatttctggctttgtgctgttactcattgcttatacactcagtctttggtacagttcatttattcctgagctcttatgcttgcatatttcttatttgattctctaaatgaggttgcttttttttaagtaaaagaaagcaatatcagaaagaacgtgagaagttggaagagaacatgagttaaaacatgattataaaatagaggaaaatgcacaaataatagataagaggcagaagaataaaagagaacagaaaaaaattaaaaacaaagaaaaacaaccttaaatatactgaaaatattaaaacaagaagtaaaacagtcacaagtgttggcagaggtgtcttccaggacctctagtactggaacctgccaggtctgctgtgggagggcaggagatcgtatctgatgctattgtagttcctctgtgttgtagggctcttcaagtgtgtgctgtcagcagcaaagcaagcttcattgtacgttcttaaattctttgcatgtggggctggagagatggctcagcagttaagagcactgactgctcttctgaaggtcctgagttcaattctcaacaaccacatgatggctcacaaccatcagaaatgaaacctgatgccttcttctggtgtggttgaagacagctacagggtacttatatataataaataaatctaaaaaaaaaatctttgcatgctaagagttgttgttggccctagtaagcgaggccagacaggttcccattaacttgggaacttcccagtttgtg

SEQ ID NO: 24210 - DNA, 3309 bp, Mus musculus
tgcacttcagagaaactgaaaatcactgagtatttattaccaatgctgcaggtacattaatgaacttgaggtggttctgtaagccttgctggcaataatgcatggtactgttcttgaaataccgaatggcttgaaattctccctttgtgaaagtgggtactatcacgcgtcccttctcctttaatcctgtagtgccgtctgcattctttttttttttttttctcacatccatcagtgataagcattgctctagctgtggccacatacacttctctgtatttccctaggaaggtgcagagttagaacagcctgccttgcggtgagctggaggactgactccttgtttgatgacacttttaacagtattgacaccgcctcatacagggcttggtctcagctctgctcatccctgccacccttggtggccttgctccaacctgtgttcataaaccctggcagctcctatccagcagcagtcacgggaagccagcccttcccatctttaagtatacttctccacagggaactgggagagaagcaacttacgatgtagaaaagctataaagggagtcctctgcgtcactaaagtaatctgtaaattactttagggacaaagttaagggggaactaaaatttaaccttctttgctttctttacacacaagcccaaaaatttgcaaaattttttttaaatttcaattaaatttttaaatttaattttaaaccattgtaagaaaaagaaagccaacatgagccaggtctgatggctcaagccagcaatcccaactgacccaagtggacccccaaggtcagtgctttatagtctacagagtgagttcaggattaacctaggccgctcatgggataaggggtggagctcaggctccggggtttagtgctccagtataacaagttcaaggtcataggttcaatcctctctactacaaaaagaaaaacgggcaacaggcgttctccaggtctgtgtgatttctgccttctgtctggggagacacttaagtggtcctttgtgtcagacctggttgacagagatgctgtgcgatcggaattgtgtggaatccttcccagcaacttacttgtcagtgcttgacaaccgggctgcactcacgtcaggtcgggtaaattaaatgttacagcggattagcactgaagcagcacatcggatgaaaacacaaacttgatccctcgccacaaacctgtgtgtaggtttagagtacactcggccttcaggtccccagccgtttctcagcttgtaccatcctggttgtagacctgccacacttgtctagatttggatagccttgaacagtgttaactgtgcttccttccacaagtacatcagcgttttaaaacgtcgctctgcactggtggcaggctctctgccacctcctcagacagtttgcatcgctttcattataaaccgcctttcgtcttgcagagtctcggacacagtctctctccttgttgaaaaaaatcagtgcacattttgtttcaaagttcttatgaagcaaaaaaaagcacagatgctgtactaaaacatgtaagaatgtgtagagcacaagatgcagttgtcctctttcaggtgggaacaaagcaaacctttagctgtttcattttcgttcacgcttagtgggcagagggtagccttttctttgagtcacctaaccattggaagctttaagagaccctttgaagatgaagttgttttcccaaagaagcctactattctaactgtgtgtcccagaactgtttcagaacagagtgaggccatggttgttgatgcgttacacattgtgagacttgactcctatggccactgctctccttgcactctaccaatggttttcataacatacctagttattgttatatggttttctcttgcagataaagagctgagcctgattcaaatgattttttttttctggttttgtacttttccttttaattttttgtattatagattacatgtctggtaaatctttggaagacaatcaagtaaaatgtgaaagtaaccattgctgaccaaaccccttggttattttgttttgctttaattctttgcttgagatattcaatacttaagtcactgtggcttagtgggtttctcttttcctgatagtacaattgattagagacagcagtgtggcaagggcagccttaggagatttcagaaaagttacactaacttggctgtcacttgatccttggaaccagcacagatattatgaattctgctttgcatttattttaaatgctgtttatagatcgtagtagttcctgttgagagtaacaggactagtccagttatttaattcatgtttcactatttgcactttccactgaacagtgggttgatttgctgttcacacacagaatttatccagtagttacagctatcatgtgttctgtgtatgctcctcctccacctgcccccagggatgaagcagtaaaagtgcttgtagccatttccatgccttggctccacgttgtcacccagagagcagtaaagggagtaggaaagcaagatagaaaaaagacagacaagaccactagaacgaacccagaaattatgggggggtgggaggttccaaatcctctacggagcagaactaacggggctccgctgtatggaaaggagttgttaattctaccttttgggttgaacttgaaagtccttgaactgcaaaaactctaggaagttggatggttgtagggtatctaggttaactgtggcaccaatctcaattagaccattttgtgtgtagtttctctcgtttcctgtgtttggcactgggaatggtgaaaataaaacttactcaagtacagaagaagtggaagtggctgagtgtcagtgatattcccccagaatgtatttttcttacctcggcatgtactgtagtcacttgatatttgtatatgttgctagaatttaggctgttgaaaatagtgagattctaatgtgtttttaataaattatatgtgtgtgtcttgctcagatttttttggattaaataaaacaaccttgacatcatagtccagaaaatgccaaatttctcaaagttgacaacagtcacattttatgaccagtattatagtgggtatagatagcatcattggtccccctgccactgtccctgccggcaactccacaaccctcaagcctaccttatggaagtgaatctgggcagcccagctctgtgtggctatagagtaaaggggcacaccccatcagcatggagagccagccagtgccagcgtccccatcagttaggtgctggacactgccagc

SEQ ID NO: 24211 - DNA, 1283 bp, Mus musculus
acattgtgtttccaggtctttgagataagggaatgtaaatactatgataggtaccaggaaactcttcattttatatgttgcttgaagttttagtttttgctacagaagtttatcagggaatacattttatcttcattagttcagtcaggatgcccttcttgggaactttggaatgcaatttgaagccagtccgtggtgatgtttgcctttaatctcagtattcaggaagcagaggctggtggatctctgtgattttgaggccaggctattctacaaagggagttctagtccagccagggctacacagagaaaccctgtcttgaaaaagaaccaacccccccccccaaaaaaaaaaacgaaaaaaagaaagaaaggaagaaagaaagaaagcaatttgaagaaacatgtttttctttgttgcttttgaagtttctttgacgtaattttcatgtatctttctctatattccagaatattataaaaaaatactcattttttttttaaagatagctatttaagagctctggaaattttctttagtcagtttttgtattatataatgatgacctagtttacaactgcagatggcattattattatttaaataagtgatatcttcagtggtaaggtttttgtgagatcataattagctaacattaggattctatgtaattttgaaagtgaaagcttatatccctggattctgatacttaaaagttttatattttagagacttagatatgggagattagcctaaggacaaatgaaacacattttttttctctttaattaaagagaatggagtctaacctgggcattttatattttttatttaaaaaatgggccaatagaaattgtgttactttttaaattagagattcttcaacttttatcttttcttttaaaagtcacagcagatttctttttctttctttttttttaaaaattaggtattttctttatttacatttcaaatgctttcccaaaagtcccccataccccccccccactcccctacccacccactcccacttcttggccctggcgttcccccgtactggggcatataaagtttgcaagaccaaggggcctctcttcccaatgatggccgactaggtcatcttctgctacatatgcagccgatttcttaatgtgtggtttacttgtctaaataatagtctgactgcgctatgttacttgatttataatatattgaatttgtaaagaacaatatttaaatattatcctggaatatgttggatgtatgtgattgtgtttgccac

SEQ ID NO: 24212 - DNA, 1804 bp, Mus musculus
gaactcttacatcagaaagtagagctgcccaaggatgtatctggagaatttggatggtccttctgcctggcctgcgtctcggctcccttacagttcatggcggccgctctcttcatctgggctgcccacaccaaccggaaagagtacaccttaatgaaggcttatcgtgtggcatgaagggaggctgcctgcttaatgattaatatttttcatacattttttttaactattgaggttttcccttgtcttcctctcagtcgtctttaatttttatttttgtggatatgccattgtattctaaaagccccttttatttatatacagtgccactaaataccatttaaaatgtgtgtggttttcactgagtgacttagtctttttttaccacactgatctaggttcagagttcagacagaaagaactgtagagatgtgacccaagtttgtaaaagaatattagcagtggcaaattgacccaaaacagggtctgctaacgtctgctcagtccagtagtgcagtaactatgaaactagaaatgaatttctgtatgatatctgttatcactgtcagacttcatctttactttcctgttgttgctagcagaaccagcgttcctcaagatgtgtgcacataaaattgggaaatgagctaacatgtgtccctaaactttggtacattactttatttgaggtgaaatatggcagctgtttatactgtgattgtctacaagaaaaaaaaaagtgaaaaatgatgtttacttgaaattgtgcttttaatttcacttcagtgaggaaagttgactaattgtactacactatacctgtttgttttttttttaaactgaaactcatcaggattttcagtgccaccaaaccattgtggatttttgctgctcccctcccccctcccccccacaccaggcttattaaagagtactttctttttaacagagtgagagaagagtcacagccaattcctcaacttctttgttctagctgagtactatatgggaggtcctaccaatatcgaccccccagaactgggggtactaccaccacaagatctaaagctgtagctgccacctactaacctccatttatgggtctttatttcttgtggtgaaatgatgtgcctttccttgcccaaatcccttcctggtgtgtatcaacattacttaatgtcttctaattcagtcatttttttataatatgtcttctgtaaacattgaacttaaaaatcttatttatttactccattattgtagcatttcacagattcaaaaaagtgtaactcagtaatttcttaccaaatcctaaatctgtcttttttaaaaaaataaataaaaaagagaatcatgtagagtgtctaaattgtttgagatcacaacatgaggggctaaatgatggaggtctatgtggatctctgtgggagatgagttattcctctgtatatttctttttgttgcagtgataaaacaccatgatcaaagcgttttaggtaagagcgtttatttcagcttgcagttttgaggcagagtccataatggcaggaggttactggagcaggaggctgagaaatcacaacttcacctgcaaacaggtaacacagagggagaacaaactgaaagttagacaaggctttaaactcacagcccacccccagtgatagcacttcctccagcaggcactacctcctaccggtcccattacctccccaaacagcactggggaccatatggtcagatacattagcccacagggctcattcgaattaccatagtctactgcagaaaaaggaaagcctgt

SEQ ID NO: 24213 - DNA, 1103 bp, Mus musculus
gtggtggtggtagtgggggacatgtaaaggccagagactatttctctccatctctttccatcgctctgattttgatggcaggacctgtcactgaagctgtagctccccccttaggctagactgtctctgcctcctggagctggagttagaggcacgcagagtgggtgctggggattcaagctccgctctttgtatctgtgtggcaggtacttcactggctgagcactggccagccccggaaaacttccttttccataggcttttcccagctcagtaaataaaagtcgcagatcatggatcaagtcaagaagcagcttgtgtctcttctcctcctctattgcagagtcctctccaattccacagtgtgtctccaccttttctcttatccctgccactctgtccatcccttgtttgtgctgcttaatcatagcttctaaattagtcttgaatttctgcagtccatcctataccccaaagtgacggcaaactttaaaggtataaattgacttgtttcttctagtttttcatgtacctgctcacatctgttagatacctagagtgtgcacactgcagagattcctgagactcgtactgcttaactgtctgccccatgatgattgtacagcagagacgtcctaattgaatttactttcttatttgctattcacttttttctttgtcaaaggatgagctgtggcggatccaggaaaagctggaatgttactttgggtccttagtaggctcgaatgtgtacatgactcctgcaggatctcagggcctccctccacattatgatgatgttgaggtaagaggaacttcgttgtacaggctggaaaaaacaggctgctgaggccagacttgttcagttgtctgggctgtcttcatcactctcgggcactcttaaaccaggtcatggctgttcttctggtccttcctgaagatcctgaccgcgtctccatgttgggatgcctgcagactggcttcctgctccttctcaaagcatgagtattgctgatgaaagactcacacagtcttcagaaatagggtttttttgtttgtttgtttttggttttggttttgtttttttaacacttaaaaaagaa

SEQ ID NO: 24214 - DNA, 1237 bp, Mus musculus
tttgtagctttggtctaatttgacttaaccatgtactttctcatttacaggtaagaaagaaataaactcaaaatatatattgaacccagtttccatatgtttgcacaaaaatagtttatcaaagtactatgtgtgaatttaaatttttctatgtatgaaaatagactcagacctgaaaggggcctcccactgaattatctgagctgtactacacctgcctgactgctgtctggaatttgacatttcccgacttcgtggtgaaatgtttaagtgcgtgcgtgcgtgcgtgcgtgcgtgcatgcgtgcgtgtgtgcgtgtgtgtgtgtgtgtgtgtgtgtgtgtatgtgtgtgtgtgtgtgtttgggtggtttgctgagatcgatctcctgcatgctgagcaaagtctacatggatagtagtatctcaagcctgaatgagacacgaacattaaacccaacgatacatgaaaaatacaccctaccaaccagaagcacatgttctgagtaaaacatctgtgagatccactttcaagtagtgtttctggtttgttctgtgaattttgatagtgtttgcaagctgtagaaaatttgtagttttagaagtttgtgcttcatgttcattgtgaagcctacatcttgtttgggactcttctctcgactgaaatgtagtggatcttctccttaaaacagggagttccttggtgcctgatgctcccagtaccgtgtgcttttgcaacaggaagccacctgtgacagccacctctgtgggccaggggagtgccagggttcttactgcccagattttggcagctctttggtatcagagtgaacaaagaatgaagctgttaagaaccagatgccaccagaggatgagggtgatggcgagcagcctctgctcagggagccttgtttctgatggctgcattggcaggactcctgtgtgcaggtcatttattacagtgcactccttgctaccatgcaaacatgtctgtgcggcagcgtgggcctggggccaggcctgttagagtctcccgaggatggtgagatattcgtacatagggtgcagacattcattcattcattcattcattcattcattcattcattcttttgattcaaggcctctagagctgcagtttagttttttgtttgattttgattttgtttttgtttttgtttttcccagttcaaagggggaattttagttgggatttcattctctcttttaccatgacaaa

SEQ ID NO: 24215 - DNA, 1173 bp, Mus musculus
tgtgttaatcctccatttttttttatattggctgaatttcaaaataatacagaatagttagattgtataaatgtcacttgtcttttgatgcaatgctggaatggaaccaaatttcttagccttactggtacatttaccaacctttgtccctgtgcctgttgaggcagatccagagaacttcccaatcatgagtcttgttcggcagaagagagattttggaatcacagctgccattgttactgctattgcagtgtccgccgcatcagcggttactgcaggaattgctatggctaatcaagttaatactgctgacatcataaatcagatagaagaaaaaacgtctgaggcattgcttaccctgcaaagagtggactctcatatcgcctcaggattaatgttaagatgatggatgtcatacatatgacttgtgtggcatcaaccccacatgtgtgcattactcccgttaggtatattaacaattctttcattaaaagtacagatttatcaaattatctgaaggggaactggtcgcaggagctggaaaggttgcagaccttttgtctcatcgttttttcactgacccggtgaggcggggggaggggggggcgagccccgaggggctctcccttctggcaccaagtgtcagtcctgcacatgcgggcgggcgcgacccactccggggacagtgccaggtgtggacaatgccaggtggggagcagtgacggatggacataattacataggcctagtccagcatcattttattaaaataaaaagggggagatgtgggaagtggcaaacaccattacaagatggcgctggtttctataagctgatgcccatgaatatgggtaaacaaccaatgtgcacatgtacataagagtgttttgccgagtcactgcctgacccaaggcatattaatgaggtactggtagcatagccaatcaggtatggacacatcactcctaggcctatataagcagcgccatttctggggctcggggtctttttgcctctgcaatcaagctctcccaataaacgtgtgcagaaggagcctgttgtggtgtctgttttgccggctagtcgggcgcacacaacaaacaaacataaaaggagagaatgatactttgaagtaaacttcatttcaatgtgttttatttacacaatggaata

SEQ ID NO: 24216 - DNA, 2591 bp, Mus musculus
gtattgaagggccatgaccaatgccttttaccatttccttcatggtctcccttcatggtcctactacatgcttgaatagctccagggacttggtctgactggggcagcgaaggaatgaagaaatgagagacacacagataccccaaaacactgggattagctggactgggttctttgatggagaaatctcagcattccggaagcacagcctattttattacatacagttgaacatggaagtgggctgactgcatacaactcaatgaggaagtgaggttattaaatacagataaacaagcactcattgaacatactgcatttgacatcatttacatgacagacataaagttaaaaaaaaatccctgcctttaaggagttcaccatggagagcgcttttccagagctattgaatttctatgttagagtgaagtaaaattacgaaaaacaaaactattgaaagtttaaggacgggaagcgaacgtcgccgcggcgccgggggtggaagatgccgctgccggttcaggtgtttaacttgcagggggccgtggaacccatgcagattgatgtcgatccgcaggaagaaccgcagaacgcacctgatgtcaactatgtggtggagaatcccaccctggatctggagcagtatgcagccagctacagtggcctgatgcgaattgagcgactacagtttattgctgaccgttgccctccactgagggtagaggccttgaaaatggctctatccttcgtgcagaggaccttcaatgtggacatgtatgaagagatacaccggaagctctccgaggctaccagggagctgcagaatgcacctgatgccatccctgagagtggagtggagcccccgcccctggacacagcctgggtggaggccactcggaagaaggctctgttgaaactggagaagctggacacggacttgaagaactataagggcaattctatcaaagagagcatcaggcgcggccacgatgacctgggtgatcactacctggactgtggggacctcagcaatgccctcaaatgttactcacgagcccgagactactgcaccagtgctaagcatgtcatcaacatgtgcctcaacgtcatcaaggtcagtgtctacttgcaaaattggtctcatgtgttaagctatgtcagcaaggccgagtctactccagagattgctgagcagcggggagagcgggacagccagacgcaagccatcctcaccaagctcaagtgtgctgcaggcttggctgagctggccgcacggaagtataagcaagcagccaagtgcttccttctggcttcctttgatcactgtgacttcccagagctgctgtcccccagcaatgtggctgtctatggtggcctgtgtgccttagccacctctgaccggcaggagctgcaacgaaatgtcatctccagcagttccttcaagctgttcctggagctggagccacaggtcagagacatcatcttcaaattctatgaatccaagtatgcctcatgcttgaagatgctggacgagatgaaggataacctgctcctggacatgtacctggcccctcacgtcaggacactgtacacccagattcgtaaccgggctcttatccaatacttcagcccctatgtgtcagctgatatgcacaagatggctgcagccttcaacacaacagttgcagctctggaagatgagctgacacaactcattctggagggccttattaatgcccgcatcgactcacacagcaagatactgtatgctcgagatgtggatcagcgtagcaccacctttgagaagtccctgctgatgggcaaggaattccaacgacgtgccaaagctatgattctgagagcagctgtgctccgcaaccagatccatgtcaagtctcctcctagagaagggagccaaggggagctgactccagccaacagccagtcacgcatgagtaccaacatgtgaaaggcattcccgtgaccgtcagaccatagtctgcacacctactctgcctgtggaagcagcacctgggcctcctgcctgctttcctcaagacgagagagaccccagactgtgtgtggttcattagagcagtctggccactggggtgccagttcgttggccttccacgctgaggtaccctctgcagtggtaggcagcctgcccatatggccacttgggcctgactctaagtttctgccccagtgaaacagaccatgtgcaattcccaggtaagggtacctcagacccttcctgtccatgtagttccgactgcagcagtgtcttaactgagtagtccattaaagtacaagttgatcattgaaaaaaaaaaaaaaaaaaaaaagaaagtttaaggacagagccataaattttgactcaaggaagtgtttcattgggttaactgaaactttcaatatacaaatgtgtaagattccatagagaatcaattgtgtgggaagcaaagtagtactaagaaagatgtttttatgaaaacatttatagacacatacctccactaacacacacacacacacacacacacacacacacacacacactgcctttttattcttcatctgtttgggga

SEQ ID NO: 24217 - DNA, 1164 bp, Mus musculus
taagatatatgtacatgaaaggggaattcctgggaaattataatctaaattttaactatttttatatttttttctaaaccttttgtttaagtttgctattgtattgactacgctctttctacagatgctctgtttaaactgtctggatagaaagttgatttactgtacacacttgaagtgtacaagcatgtatgctttgtgataacattgtttctaaaatgtacactccatcttgatgtaattttaaaatagttactattttaaaaagcaaattctcagatctttaatctaccaaattacatgatttgagagtggtacccaaggagagaattcagttctgttgttgctgttcattttccttggtgatgatatcaataaatgttaagatgtgtgaaatacctttaagaaaataactaaaattgttaaattagaaaaatgtatcctgtgggataatgattcaaaatcctcacccccccccccccaagggactagaccttctctgagttcagggccctctctgtgctctctgtcagcagcttcattgactgcttgggttgttttctttcgtccatgccttgaaattaaaggtaaaaggctcctgagggtctagagacttcaggtttccagccagcatggctgtacaaataaagatgttggtgcaagtcctttcataaagcactagttctaacatgacttcttaattttagatgacaatattctgctcttgagtgccattgataaggttctctgtccaacggccctttaccaaaacttgtagagatattttagtaatggatttataaggtaatattcaattggaggcatgcctttaagtcaaggtgaaaataacaaagatcaagtcccttctcaccctgttaagattggtaccatatactggcaatgaacatacactggtttctgaatgtaagtccacctaaggtagattgatctgatcatttgccttttaaatgtttataatgtattgtgttcatatttgagctccttggacccggatcagtcaggtcacatgatgctagttggccctggtagtgtttctgtgagtttgttcattgtacttggcacagtgatggggaaaaggtttaatttctatgcaaaacatatatgcaaaattagcaggtggctcacataagagaaccacaagac

SEQ ID NO: 24218 - DNA, 1141 bp, Mus musculus
tggggtgcagttggacctggatgaagccatttctaaacataaggacattagagctcactcgtgcccgtcagtgaggaagatccagaagaatttttagactctgtttcctgttcttctaatatctcttttctcgttgtaattatgctcacattcctatcaccagctggcaggtgttacctgtgacgtgcaatgtttaaatatgacgtggtactttgtccttcagatttttgttatataaatcacatttttgaaaagtcttgcactcattgctgtctagaaattaaataatgaaacacatgaaacacttaaatttcaatttatttcctataaatgacactgctttttttgtttttttgttttgttttgtattgttttgttttcttttaaaagtaagacttatcatcatggaactagtatttaaatgtcctgtttttctcagaagacgaatcagtttaaacccaaacaaaagtccacgtgactaaatgctaacagttgcagggaaacactgtatttttgttgttgttttttgtctgtgaaagtggcagagctgatagcatatcacaggtgaattgaatggaaggtctcgaagctctatttcaaagtatttcctttgactgaggcgcgtagctcctttaggcttcatttttcttttacctggctttccacttgagccaacaccttcactgaaatatagaacaagggcagattttccacgggagcagcacatgaatgttgtctcaatcaggtttctatcagagacatcaggttatgctgtaagaggtgtgaacattgggtggacagatcactcaacctaagctgctgagagcacacaaggtcagagtcagaatggcggccatccttaatggtgggaaggagggtgaagccatcaagaagttcatagttgtctttcatattgggttttaattactataggtggcttgaatgtgattgttaaagttaaaaaagtgatggaaagtagagtagatttttaacaaaatgataataataatagagatgctggataaagttacatgttctatctttgtaatgaaagaagttacagaggtaagattgtccaatatttgatgatagtgcattgcaagtggctggccgctttgctgttcttcctggattgatcgtt

SEQ ID NO: 24219 - DNA, 1182 bp, Mus musculus
gaaatatgttttagtgtagactaaaatggcccatggtcccgtaggaccatgacctttctctaatgatacaatgcaggcttcagcaatcctgaagatgataggtaaataaaaccaaccagcacttccctttcttaaaagggtgggtaactgcggatatagaaggtcagcatagtggctcattgttgaagtgaatagaagtaaatttggttttcttgagttacaatgctggaggaaaaactaggcaggaagtcatactcccgccccccactacctgtttatagagggaaggatcagggtagagactgaacacatttctttggggaaatattttgagtattacaaatatattacagaatatttggggaaaatatttagtgaaggattttctccactcttagataccttgtgtaagtggcacatgaatgaacaaagtgctgtcttgaagagccggttattttaagactatgaggttatgtggctcttgtacaaacagttcagttctacagagctgcttatctcttcaccgtcatctcggtggtttgcctactgcagaaactgttggggtttatttaaaaccacatccaaatactgtggctgttaagaaagagtactctctggagctaactgacaggcagactgagagaccatctaaggctatctatggatagatttgtttcttttcctgtacataggtgaccatattattgaaagagacggcctgtagtaaaaaatatttacatagattgattactaagaaagccaaactttatagagttacctgagaaacctgactccagaagacttccgagaggccagcagtttgttatttcagggccgttggagcgactgacagatcagccatgttgcagcagcttctgctgtccattgacttctttttattaaatgtattgtctggctagttagctaataatttgactacctatcatggctggaatcttggattgagtgaaaatgagaaaggaggagccagagaggtggctcagtagttaagagcatttgaggctcgtgtgaaggactagagtttggttcctagctttcaaaattgcctaccactgtagctccagggaacctgatatcttcttctggtctcttcaccatcatcttggtgttttgtgtactgcagaaactgttggggtttatttaaaaccacattctctctct

SEQ ID NO: 24220 - DNA, 1257 bp, Mus musculus
catcgatatactttcttaggtttcaagtatcaatataaatgccctgagaaaagcataagattaaaaacaatccatgggctatttgtgttactgctatagaaaggttttttaaaaagctatctttcatattgaatttttgaattcttaaaaagcctaggggaggaatagatttctacacagctttaagtcaacttgaaaattttgaagtattattaatagattgagaggattggctacttttttcaggttaatatttcaggtgggatattcttacaattgaagcaatctaacaaagatatacagagaaataatgaagaaaatgttcagagaaagaaatctagaattgaaatctgttcaagaagtttggaaccaaaagtaaagtgcaagtgtatatgttagggaacagctgaggcaagctctgttttgctgtattctacctagctaatacttgaaaaaaatctagcaagtaccactctttgcatagaatatggagtgattggtatgctgactcattttatatcaatttgacacaagctagagtctgaggaggagggaatctagattgagaaaaatgtctcaaaggtggagctgtagagcattttcttagggattgatggggagggcccaacccattgtgaagccaccctggtctgatgttcttggtttctacaagaaagtaggctgagcaagcaggtaagtaacacccctccatggcctctgcatcacttcctgccttcaggttcatgtcctgtttgagttcctgtgccgacttccttcagtgatgaacagtgttgtggaagtgtcctgaataaattctttttcaagtgactttggttaaggtgttgtgtcacagcagtagtagccctcactaaccctaagacagttagggtttcagattcagggatcttctgggctttgctgaaaactattttgcccatagcctaatagcagggtaggtacatggtgaaatactcctgtaagactctggtaagtcttaggtacctggaaaccccaagtgagccactcggagttggaaagttggagatcgatgcaaaagcgagaggagtttattgttccagcatgctagggccgtcctgcacccaaagaaagaggtggcgatgccagggcggccccttcttccagtttttatacagtttccagtggcagattagagcatcagcaatgtgattggcagaacagtgtgacttttaagctgattggtccttacggaacgaggtagctagggcttcccttatc

SEQ ID NO: 24221 - DNA, 1933 bp, Mus musculus
cctacaggatcgcccttctcctcagcatctttcagccttccctaattcaacaacaggggtcagctgcttctgtcaattggttgggggcaaatatctgcatctgactctttcagctgcttgctgggtctttcggagggcagttatgatagatccctttttgtgagtgctccatagccccagtaatagtgtattaaaaattttaaagcagatagcataatagtttttaagttatatttagtaggaatatttttgtttttccaggttgaagaagaaggcctacaaatttgtgttgagatctgtggttgtgctctccagcttgatctccatgatgatcctgaaactaaatgtctaatttataaaacaattgcacattttttgccaaatgatctagagattgtcagggtttgtgctctctcagtattttttcttgagcgttccttagatgcctaccacaccgttgaagagctttacagacgtccggatgaagagtatagtgaaggcatgagtactgttcaaaaccgtgttcgttttgaattacttccaattttgaaaaagggattgttttttgatcctgagttttggaacttcgtaatgattaagaaaaactgtgtggcattactgcgtgataaatcagcagtgaaacttctaaatgaaaatacactggaaaatccttcaagtagtctaaaaaagagagtggaccagcagagtgtggaagaagatcagagcactggagagactgatcctgatgatgcgtctgtagtgcaacctaaaggacaggttaatgtgaagagaagcctgtctgctcttaacacctccaaagtggatcatagtgtcccaagacatcggtgcatgttatgcaacaaggaatttcttggtggccacattgtaaggcatgcccaggctcatcagaaaaaaggcagttttgcatgtgtgatatgtggtaggaaatttaggaacagaggacttatgcagaagcatttaaaaaatcacgttaagaagattcagagacagcagattgctactgcacaacaggatgatccagaagtcatcactttggaagaaataaatggttccaaatctttaatttcctttgaaaatgggaattcaaatactaagggcttggaaatagagacattgacggcttccagtgagagaaacaaagaggtcatccgtgaacacatggctgagttcattaaaattcccattgctataccagagaatgctatagaaaacattattgaaaatggcaaaccagatgcttctttcaataatatctcagaatctttacctcagtgtgatgatgactatgaagaggaagagaatgaagatgattatgaagatgattatgatttgaatcaagaaacatcagtgcttcacaaaatcaatggaactgtgtgccatccaaaagatgtatatgctacagaccaagaaggcaacttcaagtgtcctgctcttggctgtgtaaggatatttaaaagaattgggttcctaaatatgcatgcaaggactgtgcatccaactgatttaaatgtgcggcaaactgtaatgaagtggagtaaaggaaagtgcaaattttgccaaaggcagtttgaggattctcaacattttatagatcaccttaatagacacagctatccaaatgtgtacttctgtttgcatttcaattgcaatgagtcatttaagctgccatttcagcttgcccagcatacaaaaagtcacaggatatttcaagctcagtgtagttttccagaatgccatgagctttttgaagatcttcctctgttatatgaacatgaagcccagcattacttgagcaaaacaccagaatcatctgcacagctgagtgaagtggttcctaaccatcaagaaatagacccatttagtaatgagaaccaaactattcatcatccagtttctactagtaagtcaagga

SEQ ID NO: 24222 - DNA, 1117 bp, Mus musculus
gaaatgtttgtgcatggaagaacttccttgcattgtagccctgttgccatgtatggtttttgttttttcttgtgaggttacgtaatgatttggattgagaactagcctagaaaactgaagctgctgccaggctatacctctcacaggaccttaaagaagctcacattcttttcaaagtggaatagtaggccggaaatgttcttagagcttgagatctctaggagaaatgactgttcaaattacattctacttgtatgtgaaataattgcttaaccttcacttccttgtggtcgcttttaaagacatatttagtagcagcttcaagtgactaaaagactaaaatctctcttagtgtctttgacaaaagccatgggggattttgcagtgatgagattttagtcttcaactatgaacaaaaattttcaaaccatagttttcatgttaagtagcatcctggatttgcaaacttttttatgtcttggtattaagactattaagacagtcttgtagtcttaatttaaatttaaatacactgtggttctgttttctctttttacagggaattggttactttttggctgacaacaaataagaaaattgctttctatacattaatttttccataagattttataagagtttatttaggtaaatagactagaaatgagttttaaaagtttcacctttactgctttgcctctggtgatgcaggttttaaaacttggatgctaaacagtgcagaaaacgaggcaagaactttatagtaaaataaagcaggatgctgagtcaggaaataatcagctctgtcaaaggtcaaccgtgtttaggttttctacacctcactcttctgtaagcttattaggagtcatttagctcagagaagtcctcttcatcaaatccggattatattttttaaaagtttagtaactgaagacttagattagagctttaatattaaaaaaaaatcaaatagttgaaaacattgaagttatatttctattctaaatcagtggcaagatgccctgattgtgacttggagttatctttgaggtcattgtgccacaaatttccattaaacaaagccaaagttaatagaaaataatttgtgggttttgtg

SEQ ID NO: 24223 - DNA, 2302 bp, Mus musculus
ctcaagacccacctgcctctttccctcgtgagtgctgggattaatggcgtgtactatcacgcccagcaataatttgtgtttttaagaacatcttgtcttatgggtcttacagatttaacattcccaattcaggttgtcaaagtgaccacttgtttttattttaaaagcctgctatggaatttaaaaaaaaatagttctcaaaaattgcagtttctattttctcacgtttggttatattcatgtagcacataaatgcctagactagttgtttactaactgcaattggtaaaacacagaccagcagcaaagtaaacaatgattgcttccacttccttaaggaatttgcgggcaaccatgtttaaattgcctaagatggtaggatatctaagcaactaaaataattgagttttgtaccactattttcagaagaaaaacgatcatttaattttccaagattccttgtgattcgggctattccctattgtctgggactatatgcgctgtcagtcaacatggcagaacagcttctagcagtcgagtaacatgttggacggtgcactaggaatataattcacctttgcctttcttacagttattactgatttcaccgttacttagttcctctagaactgtttttccaggcttatttttgaatctctaggggcagagtgcattctgttagggttgtatcatgtccttagaatgaggtttccgtccccttgagggaaagttagtagtaatgtttcttcaccgattatgaacatttgtttcttggaactggttaaatttgtctcgtaaataataacagtggttatagtagcctgtgcaaactggtaaagatttgcaaaactatgattggcatgttagataacaaatgagaagtgtctaaggcgcgtgctatgtgagagaggcaaagtgaacttatgtacagaagctttcaatcctccttatatagtggtagttgatgctttactattggaccaatagcagctcctgttaattagttggatgcattatcacaagctttgtaatgtttcatttataaactgccttcagcacatgcgtacctgttaatgttttctcagtgtcgtaggatgtcttccagactctcactgtatcctgccagtaaatagttctagcttgttgaatttcctgcttatttttcattatctgtggcatatagcaagcctaaaagataattgtaatcatttttttttcttttacagagtgagaagttagattgtgtatgaaagcctatagttattttatccattatctttgattaaggctttctaatattatttagtaagtgttccttccagttaatgcctgtggccctactgaattttaagggaacagacaacttttaagaaataaaccttactgttttatacagtaagtttgtctgattgggaatgttctgaagttggacatacaattggccagattcccaagctaaaaccttggcctgaaaggctgtgtacatgaatgttaacaagtacaggaaagcaaattaaacttaaggtgacctaaaacaaaggctagaaacaagttttcattggattcttagtctttgtaagggctttctgtttgacttacctcaactgccattgagtgagggtaaatcaccttaaaatgactgatttacctggaagggtagttgtagtttccatccttagcttgcttttgctttggtcggcactgatgaaatgtgaagtggctattctagaccttggttgatctcagcccctactcccagactgctgaggtaactacagtccgttacctagtgctattctccttgtatccagaacactattaaaattttattatgttaattttcgtactcctgtgcttcttttttacttttgctcatgcacgtattttagtatgaatgtgttgcttttttaaaagtttgtgatatttagaaataaatttcaaaaaagtttctaaagtttttgaaatcatattttgttttgtgagccagtgactgacattttataatttcaaggttttacctgctgaattttgatttttctaccaatcatttatttgtagtgttaaccttttaagctactgtgacatctaggcttcaaactgccctgtttgaagtcttccaaaacactagccagtgggtaagttcagtcaacattttaatgggaacattgtacttctacaagtcttatgaaagggctaggatgtagcttagtggttaccctgcaacctataacttcagctccagaggatctgatactcttaaggatttctcaggcaccagcatgcaagtgcatataaattcaca

SEQ ID NO: 24224 - DNA, 1148 bp, Mus musculus
ctggtggtaccaccatgtacccaggcattgctgacaggatgcagaaggagatcacagccctagcacccagcacgatgaagattaagatcattactccccctgagcgcaagtactcagtctggatcggtggctccattctggcctcactgtccaccttccagcagatgtggatcaacaagcaggagtatgatgagtcaggccccaccagcgtccatcgcaaatgcttctagatggactgagcaggtgccaggcatctgctgcatgagctgatattgaagtatcgatttgccctggcaaatgtacacacctcatgctagcctcatgaaactggaataagcctttgaaaagaaatttgtccttgaagcttgtatctgatatcagcactggaacgtagaacttgttgctgagttttgaccttgtattcaagttaactgctcccttgatatatgtttaataccctgtgcatatcttgatttagtccttagttcatgtggctcggtcacttggggcctggggaaagcacgctgtggacgagaaagccccagcctggtggatctctgtgagcaccacggagtgatctgtgcaaggtattaaccaacagcagacttccaggatttcccgaggctggcaagggttcctgaaccagttaccactccttcttgccagtctaacagggtgggaaagtccgagccttaggacccagtttgcgttctggtttcttccctcctgaccgccatcggttgttactcgccttgaggtgggaacgtttgcatcgacacctgtaaatgtattcatccttttaattgatgtaaggttttttgtactcaattctttaagaaatgacaaattttggttttctactgttcaatgagaacattaggccccagcaacacgtcattgtgtaaagaaataaaagtgctgcagtaacaaagagagagagagagagagagagagagagagagagagagagagagagagagagaaagacttgttttctttgtaggtttttgggaaatgtgaacttggtttgtttgctcgcttcgacctcgaactcacggcgatccccctgcctctgcctctgcctcctcctgcctctgcatcctccctgctgcctgtttgctttttgagacaaagtctctctatggagc

SEQ ID NO: 24225 - DNA, 1831 bp, Mus musculus
acatctttgatggctctgatgatgaagaagaaagccaggacatcgtgaatcaagttcttgatgaaattgggattgaaatctctggaaaggtaagaatggcttcttctcataatgaaaacagcagcggccacttctgttggttgtttgcttggtttcttctgctatctgcatggctgtgtgtgtcagaagagagtgcatcctctgtcgcatccacgtgcttgctaacttgtttttctcccatttttgtctgtaatgtagatggccaaagctccatcggctgcaagaagcttaccgtctgcctccacttcaaaggctacaatttctgatgaagagattgaacgtcaactcaaagctttaggggtagattagatcaaaagccatacatactgttctcacttgagtctaaagtgagtccggtgtagattccttttacaaaacacattcattttgcaaaaatgaagaccatgagtgaacagttatttcctgacccatggctactttgaatcctttgccaaagagtgccaatgatgcaaaaaacaatgggagcagtttggctcttaggtagaagcaccctggtctgaggggtgtgcaagctgagttcttttgtgcatggcatagggagacgacggtgtcactgcttagtgttgggttgggttctaagttgttttacactgaaatcagacttcatgtttaatgccattaggcgtcaacgtaaagagacttgtaaaaatattaaaggtatatcgttaattctgtatctgttgcttgtcctttgtagacagttatgttaggaccataggcagtgcagctgccaagttatttttaaaccatctaaaaggagagtgctatttaaacatctgtcttaaactgtcctgagcttctacttttcttccatttaccccctttgggagaacattctagttggtaagtttattacctttcaaaatgtgcttggcacctgccttaaatagcacgaacatattgtgcacatctttaaattaatttaactggcaaaaaaacaattacattttaaactaaaactgagactgagaacagtacccaatctgtcttttaaagcttataaaagtgaatcgggtacaattagcaaaaagaagaaagaagacactgaatttatgacgttttacagtaatgaagctatactttggtctttcttccaagaactgcgatttttctctgtatgaattataacttagtctgtgttggaactttgaattgtgtaatatacacattaaaccatctaaattgaagccattcttctaaaggaaggactgctactttgacagtacttgatccagatttctaaagaaaatgtttttgttttgttgtgtttttggtaaataaactgcaactttgtcagaaatgactgcctaacgcgcatcattgtctctgcagtatttaaaggtaagatagtcagcggtgccacgtagacagaagagaaaggcgaggaggccaagagttagaggtagaatgtgagttaggttaattttgggattctggcacatcctagcacagaaactgtagaaatcctgatcagcataacctggtgaaaccagggcgatggagctctgggctgcccgttagcagaggtgaggtggatggatacacactgactttaaacaaggcgcaataggtgcaagagcagaggctggtccctctgcttcaggttccacaaccgttctgtgctcagcactgccattctgaagtgcacacttcacgtcactcctgaatgggcatggatccaagcattgtactgtatcatggggtattgcacccaaacatggcttggatatacattctaattttctctaac

SEQ ID NO: 24226 - DNA, 1192 bp, Mus musculus
tcctccctccatctgcctaatactgactattttattcctccttctaagtgagattcaagcgtcctcccttgggccttccttttatttaacttttttgggtctctggggtgtagttcagatatcctgtacttgatggctaatatccacttatcagagagtacatgccattcatgtccttttggttatgggtttcctcactcagcatgacattttctatttccatctatttgtctgaagatggttttagtgcacaactctaccagactttcaaagaagagttaatatcaacacacctcaaagtataacacaacatagaaacatgaagaacactgccaaactcgttctatgaggccacagtcaccctgataactaaaccacacgaagattcagcaaagaaagagtatttcagaccaatttcttttatgaacaatgatgcaaaagataataaaatactcaaaaactaaataaaaaatcacaacataaacattattcagtgtgatcaagtagacttcatctcaaggatgcagtgatagttcagtatacaaaaggttgtcagtgtattccattatataaataaagtgaaataaaaagaaattacaggatcctctctctctctctctctctctctctctctctctccctccctcccccctccctcccccctccctctctctctcttgttttttttttttttttttttttagacagcatttctctgtatagcccttgcttttggcctttgaggactcttcctttcatcataagattagagagaaatgagatttgcagagacagagcactgaaaccattaaaatccaaaacaacagtattcagcttctgactcattttgctgattctttttggaatcagctgactgcatcagacctgtccagcatttaccacatatcaaggtgtgatggttaaagttgatgttcaatttacacatctaggaaggaagaaaatcaactgaagaattgtctccataagactgatatgtgattatgtacatactaatacattcatgactgctagttgatgtaggagagcttagtccactgaatgacataggcagatggaactggattaaataagaaaacttgtgagaagtaacaaaccaggaagcagtgtttttctgtgtatcctacttcagatctcagaagagtgtgttttagcctcatcagcctgcatgtgt

SEQ ID NO: 24227 - DNA, 1184 bp, Mus musculus
ttacaatgaattgcttttccaatataagtatttcaaaggatttctgttattaatgtgattttaatttcaaacatctttttataatttatctgtactgtgcttcctaggatgctatggaaagccacattttctccgagtttggtatttccagtgtttcacggttttaattttatgatagtcctaactttgcaaaaaaaatatctatctgattctcctctactttctcttctacctcctctctctcctcctccccccacgttcttttctgcctctacctcctgttcctccacctcctcttctgaaagtataactaggtaaaaacagaattctaggcctttaggcccaggcttggaaatgtggcctttgtaaaggtatgctaatcataaaagagatagcgacattcctctacccaccagcttcctgggttcaaagagtgctcattcaaaaaaagtcaccctggccattaccagaacctgcaatgcaaatgtgctattgttagaggctcttaaaagctgtcttgagagttaacaattaccaggtattccttgtgactcttgtaactttacacttccttgtgactcttaattggtatctttggtatcttccaacaacgccctccccacttccttgagtttcggtttcttcctttaaatacccccttacccagctactcagggtgccatggtcctctacccctgcgtggtgtatgaccatgggcctgagagcgctcttgaataaaaatcctcttgcaatttgcagtaagacccgtttcttgtgggtgattttggggtgtcgcctctcctgagtcagaacgtgggggagccctcacattgtgggtctttcacttcctcttcctcatctttcccctgactgccctccctctttttcttttggtagatgattattaacatgaagactcctaatggaccaagttacatagaaagagacactgttgaaagctcatctgtaagtgggatatgcatataacattgtttggccacatttcagaaattgctttagaaagggtgtagaacaaaacatgaggtggcgagtacaagggaataggaacatgtggacacattagagcacttgcacaaatagcacacaaagacaaggaagcagcatctcccaaacgtgtgcatgcacaaacaaaccacattttaacacaaaggcaggggtgaata

SEQ ID NO: 24228 - DNA, 1208 bp, Mus musculus
gcgggggcccgcgctgaggacgtgtgtcccgggctcaccctggcccgctccgccgctataaagggcaagtccccggcggctcgcctaggctcgcccggctccgccctgccgctcgcactccactcggcccactcgaccctctcgggcctcggctactcgggctgctgcggcgaagatggcggcgccggcggctcctgcggcaggggaaacgggccccgatgctcgtctggaggccgccttggccgacgtgccggagctggcccgactcctggagattgacccgtacctgaagcccttcgccgcggacttccagcgcaggtacccgggggaacccctccaccgccctccgcctgcggccggccttcccgcgtgcgcgcgcgcgccgcccgactcccccctctccgcgcggccccgccccctcgcacgccaatcatgcggtgggcgtggctccggcttcccgggggagttcctgaacttttctgctgcacgtccgccccgtgctcgctcacttgctcgcagtccctggccgcgcgtcctcccctacgtgctgggacaggcagcgctgcagccacgcagcggcttccgggactcacaggccacccccctctggtcctgggagttgcagtggtcgtgacccagggcgtgtgtgattttgcttttccaactttgtagtctacttccgagcagcgtttgtgcagtctttcaggcagtctttcaacatcttgcaccctcctgtttgctcttgtgagttcattaatctgcgtttcactttaatcgttggtcagatctcttctcccttaaaccaacatcgaagagcgacctttgcgggtgtttgaccttagcttccaggagagttaacagggcatggatggcttaacttgcagagcccaattcaaaaagtataactcctctcccaccaggcttcccacttatcagaaatttataattgcaatctgctcaggttaagattgaaaattaaagtagctagtatataaattagagtagttatgagtcgattgcaagtattttgctgcagtcatatttgtcatactagtttcttctttaaagcctagatactacaaaaatcaaaactaccttggcaccagtcaatttgtcatatttgtcatactagtttcttctttaaagcctagatactacaaaaatcaaaactaccttggcaccagtcgatagactcttttttaatcata

SEQ ID NO: 24229 - DNA, 1195 bp, Mus musculus
aggacccagttatagctctctcttgtgagactatgccggggcctagcaaacacagaagtggatgatcacagtcagttattggatgggtcacacggcccctaatggaggagctagagaaattacccaaggagctatagggaactgcaaccctataggtggaacaacagtatgaactaacaagtaccccggagctcgtgtctctagctgcatatgtatcagaagaaggcctagtcggccatcactggaaagagaggcccattggacttgcaaactttatatgcctcagtacaggggaatgccagggctaagtagtgggagtgggaaggtgggggagtgggtggcggaacgtgtgggggacttttgggatagcattggaaatgtaaatgaaataaatacctattttttttaaagaactactgagttagtacattcttaggtggtaacgtccttacattttctcagattaacacatccctccctctttgaggtttgttttcctagattaggatttacatgtgtataaaatatattccatttttctctgttcatcaggtcaaggtttttcgggtgactataatgaatattttggactacaagtagatgaagatgctttgatttatctcatgttggcaaatcatttggctcacacgttgtacccagactcgataacaatagcagaggtaagtctataatgaagtcatcccatttgactcccctttaatagagaatattttgttagcatacagtatttgaatagcgaaactcatgtcatcaataattgcaaaaatggacttatgccctgacgaaggtccaactagcttgtaaggatgacacattatttggaattcactgttttcctaataggggataatttacactaattacttgtcactattccattgttagaaagaacatgccagtggttagaaagtaaaatgtcctaatcagtggacaggtccttctgccccgagaccttcagcggtgaaaagaattgaatattaatgtgcatctgtcaatttatttatttatttattttccggtttaatcattagagatggcatggatcactgcctgcccacttttctgagcgttccatgttctgatgcgattacctttcttgtttatgttactgttctcaggctgccaaatgtttcctagttattcatgattactaaaagttcatgattaactgtcc

SEQ ID NO: 24230 - DNA, 1172 bp, Mus musculus
tttagggtgaagtagaaatctagtgtaatggaaatgcccaggaaatctattaaggtgaccttagccaggagtcctagtaaggtgagatacaggccctcaataagccatgtcctatatatagctaaacaacatttccagtagagggcatgggtcaccaacccagtcacaaactgtcaacctacaatttgtcctggcagtttctgtaaaggtggcacaggagttctgagactggccaaacaacaacttgtacaacttgagaaccacgccataaaagtacccccaacactgcctggagaaccaaaaaccacaggacaggtagcatagagacctaggataaaaccaaacattactgggaaaaaaaatgtcgatgaaatgatgcctaatgactttctgcttttctcagagattggggtctaagccaactgtcacttgagagtttttgtccagtaactgatggaaacagatgcagaaaaactgccaaacattaggcaaaatttgggaaatcctgattatgaaggggaggagggatcataggagtcagagggctcagaaatatgacaagaaaacccaccgaattaactaacctggactcatagggtctccaagagactgaaatgacaatcaaggagtatccaatggtctaacctaggccctccacatatatgttacagttgtgtagttttgagatttttgtgagacttctgatagagtaaaccgggtagaaggtgctatttctgaaccctttgcctgctttgagcaatgctttcttccaacagggatgtctagtcctaccctagtatgagagggtgtgcccaattttattgcaacatgatattccatgagtgtttgatatcccttggaaggctgttcttttgtaaatggaaacagatgaggagttgatggggagaaaggaagcaggaggaaaaggaatggagttgggggtggtagggatataatatactaaaacttaattaataatcttaaatatttaaacaccatgaattggtcttaaacatggaaaaataaaagacccagagttacataaggtaagaaggggatggtaagtggaaattactgagatttttgagggatggattgaatataatcaaaatgcgttagaaactcacaaagaattagtaaaaagtatatacttatatatctgtatatatgaa

SEQ ID NO: 24231 - DNA, 1150 bp, Mus musculus
catgcttccccatttataaaattgggaaatagtcttatcttcagatatagctcttgctctggcagccatgctgttggcagtagaatataacttagcacagtggctaaagaccaggctttgaagtcagttggatacacttagacccaattcctgcctccaccattccctggttgtagcttgacaggttggtgtattgagacttgttttctgtgtgaaataatgattaaaactgttcccccccccaaaaaaaactgctgttaatattaaagcactttgaagtatgacatatggtacctttgccttacaaaaatactcaaaagtctttttatatgaatgtcaatatgttacaggtatgctcatttgactatgggcaaataaatatggctttaggatgtacatcataatatgtgatacaaccaatgagaaaaattggatctcgaggactggagagatggctcagtggttaagagcactggctgctcctctagagggccgaggttcaatttccagcacccacatgatagctcacaatggtctgtaacctcagttccaggagatccaggaccaggcatgcatgtgctgcatgtatctgtgcattcaggtacacagatgcataaaataaaataaatcttaaaagaagatcaaatatttaaaaaattagatttggcttatttgaaagcaaatttgatgtagaagatgggggagttcattttatcagcttagcaattggaagagggatttttgaataaataaaagtaagcacacttcatgaagatgtcattctgtcatttcctctgctcccttattctgttggattctaaatgaggcaaacaagccatgtgtacttgcatagataggtctgtagattcttgcggctctggacacatacaggcaggtagggcttgatatcttgcatgattgtggccgtagtttaatcggcttcaacatctgctcagagagcaatttctgagttactgggtttacccagttttattttagtgtgtatgaatataatttgaacagggcatgaaatattgatattgtgtagcacttcctcttccctcccaaaagttttccagggttattcttaactgccaaaagggaacaactgaatttcgggctcagtgtcataagcctattgatacactgg

SEQ ID NO: 24232 - DNA, 1162 bp, Mus musculus
caatggaggaattctgtcattctggagctttttttctgatagaaatatttaaaacgacgtacctaatgttctgaatacagaggagaaactggaaacttagaagaattattaaaacgtcaggtagggtgggacctaatacctagatggtttggaaagctgtattctctgaacaccaaccagacttttaaggaaaggagggggaggatgaggaggaaaaggaagaaaagtagaaaaacgtcacatttgagagagattatgacttatcttttagtgtctcaagagcctcactcttgttatgaaggtttatgatgggtgggcagggctcaatggagcagagcctaaaggtgataagaagattttaagaaagctcagattttctgtatggatgctgagataactcaagatagtagtatagcattgggagtggaatggtgagaacgtaaagggatgaacttgcctattctatatccacagaagtgtgagctgaagatgagactggcaatgggctgcatgaagactccacttatttgagtaggggatgttttttttctcaagtatattatcagtgggctgaaagttccaacgagctcaaaaaatattagtgttttactattgttctataaagcataggtcatttcccaagccttctttggttagaggtttgatttaagaaaaggatatgaaaaggttgcaaggaattggtgaaataaagagaatatcatgtatgcctgttcagggatctactgttcttctgttcgagggtatactgtctactgtccaagtataatagaagacagggaattctgagaccctagcaaactggtccatcatttgtattttaaagatgtggtttgcttttattggtatgtgaaatataatccacgctgctttaaatgtcagtcacaaatcattactctgaacccattacctctttattccaaggcgctgagagattatgggaaagtcctctttcttactcattaaaagattgctccatacttgaactctaatttcatttctaaatttgagccaaaagctgaaatcagcttcaaatgaatgcttttgaaatatgaacactattatcaatatcagtacccgaccttatttttttataatactttgtcattaaaaccgataatcttacctttattaaccctattgc

SEQ ID NO: 24233 - DNA, 1984 bp, Mus musculus
gaagagaacattcatagtcaatgactataagtaaacataagacaattgaactttggatttggtttcaaattgaacaacaacttcatctcttataggaaactgaaagctgaagacaaccagagaggcttacgatgctaatgtgaaaaaccatcactcaagaggcctcctcccgtctgatgacacacaataccagatgaaattgttcagtgcaatcagaatggacaagttgccgtttttattcctcctgttgggataacattttttaaaagtttcttgggtttttagtgttgctgattgattgcctaacccttaatgaacctccccctgccgcgacgctgttacagccgttatccttgacttccaacactggaagtgtcttgaatgcttgcttcagccatcagccagcaaggaagaacagaccaattctttttgcgatttgcccctgagatatggcattgcactgcttatatatcacgctaattgatagcaaaatattgatcaatgatataaaggtgatgactcaacctcatgccaagggctctcaaagtataattgttctatgaccaactgctaaggccaattgaagcatacttcattttacatgattttaggatcagtcttttataccaccctttgctggcataaactaaaagtctatcacatacagaactacagtctaatttcaatggggtagaagcattgtaaatatatactctttgcaactcctggtggtactttattttgtctttatttcaaccattgaaatatattcttggaaatgtacttttggataagtagggctgagccagttggacctctggttgtctagtcattgtgagaagtaaacctagcaaaaatcttgttctatttttcaatcaaaaagcaactacaaatgcatattccacgcaaatggatgtttttaacgaccaattgagtaaagacatccctatcttaactggcctaaatttcttctggtagtgtcagatcacctttcagaagtgccacttaaggaggtttgtttgattttttttgttgttgttgttgttgttgttttttgtaatgcactgtttttaatctttttttttttggttttaaaagcacaatcactaaactttatttgtaaaccattgtaactattaaccttttttttcttattgaagaaactgttgagaagtgtttctagcctgttttgttaatgctctgtgtttgtatttgcaatatttgaatggtgacagctggtgaggtcacgtacagactttatcgtgggctgtgaaccaaatggttccaatttttcctggacttaaaaaaaaatttttttgttctaagtttttcgtggccaatgttgaatcttataagatttccttagaagctcataagaggaattccaactcggaattgccaagtgatgctctgtgactgtaggtttctataattttttttgacattttaagaatttcattgactttataattggtgctatttgaagaaaacaaaatgaatctttagtcatgcataggtatcaggcttgacccccacaaagccaaacaaaactgaactacaaaataaataaataaataaataaataaataaataaataaaagcaaataaaaacaaaaggctggtattcacctaaaactaagtgtattcatttagctaatttgaagaagccccatgtcccatagaaaggatgtgcagttctaagggaacaatccacgtgattaatgttttcattatgttcatgtaagaaacctctttatttttagccatacttttgcatactgaaaattcaataatcagaaaagtaattttgtcatattatttattaaaaatgttctcaaatacatcatccttccttgtgttgattttttttttcattgtatgactatcagatttattccattaaatcacaaagttgttttgtcttcgcatttcaccaccacattatgaaaacgaaggagttctcagttttcctaatgagcatcca

SEQ ID NO: 24234 - DNA, 1099 bp, Mus musculus
ttacagatctgttatagagctgaaaaatactgcaactagagacaggtttttccagtaacaaacgcaatcccagggattcacagagtaatcaaatatcctgcaacaactcttcttccctggatttcacttaatcctctgtgcctatgacaatctacctttccctccatactttaaagaaaaatatgatggcctcaaatcaataacccagagaaatcttctaagttttggatccctcgtttaataacattttcaatgaacaatttactccgaataagataacattcataacttaatggcattaggatgaagatagtcttttgtttggttgtgtgttgtttgttttgatacagcagatgtcaacaggggaaaaaaaagctagattcttgtaaactagaaaatctcagcctagcagtgtttggctgacgacattagttttcctccattttgcaggcaggagagaggactttaaaggagacaagggtgaccttgtgcttctccgagctgtatagtcagggcagacggtttctattgctcaaagtcactggacagagttttaagggactgactggactcccttctgctgggtataggcagtcatctagcccctgtgagtgcatcatatcctttttaagaggaagggacaaattttacattttatgaactacttcagaaggaaagtgattggaagagttttctgccagggaagcttttctgtttcatcttagaaaaatatgtccttgcagcaaaatcttgctagtgtatgcaatggtgtcagcgtttggaagctgattatgggatggatccctggatatggcagtctcaagatggtccatcctttcgtcacagttccaaactttgtctctgtaactccttccatgggtgttttgttcccaattctaagaaggggcaaagtgtccacattttggtcttcattcttcttgagtttcatgtgtttagcaaattgtatcttatatcttgggtatcctaagtttctgggctaatatccacttatcagtgagtacattattgtgtgagttcctttgtgattgggttacctcactcaggatgttttgcattcactagcaagattttgctgaaa

SEQ ID NO: 24235 - DNA, 1238 bp, Mus musculus
cctgtgtccattgtaatatttaccttttaagtttattttcttgtgggattccattgtgtcactgtcagatataaatgatctaacttagaattcatgtagaattctacatgcatactatgctttgcaaatgcaaggctggcttttctgtctcagagaaagtatatttcaatagacaaaagtacctaggactaaacagacaatgagacagccatacctctgagactcctaatgtattttaaaagaatatgtatattcttttacacacacacataatttaaaatttaaggaatacattctctagttataagtaaaaaacaatcaataacaaagtggtatctcaatagcaaagtggtttcatctcaagacaaaaaaaaaaaaaaaactgagtgaggttggttaggtggttacccatcttcctgattagtttcacctccttattcaggaccagcacagactggcgcaccctagggatctctgggtgagtatctctttgagcacctcactctcaagcacgactaggagatctctgtgccttccaaggggctccccctctgctctgcaccagcctgccttgggacctccacctgaatgaacctctcaagccactaggcagctttgtaactgccctggagcctctgtcaagtcttagaccaagtaaaagtaaagctttttgagacagaaaaaaaaaaaactaagtgaaaaataacaacaaaaagcaaaacaaaatcaaaactacaacaagaagaaaacaatacatatggagttttgtcattttgaaatgaacacaatcagaatgagccaaaatctagatcttttttaaaaacatccaaattcattgatcatttaaaatgtctttgttgctcatcaagaacagtcaaagactttgagaatggttgaagatatgatcaagaaagttatctttaacagctgtaaaagtaaaaaaaaaaaatcttgacaaaaagtctgagtattaaaacttaaaacacaagggtcctcataatgcccaggttttagaaggttgcagtactaacatttattgctaataagttggtggggtaggaaaaataaatgtgagcaaaagccaaagaaaagagattaaggcaaacaaaagacgaagaatttaagttctgtgatgagtgtgagtctgttcatgagatgtggaaggttatggaatatcataccttccatttcaaaatttatccatgactcagtcttataattgattcctagataaatca

SEQ ID NO: 24236 - DNA, 1434 bp, Mus musculus
caggcaatctcttctccagctcaagcaattccaagttcttttcacttttgttccccataggtccatttgccaacactaattattttggttgctcttccctggttcatttccaactttccaaatcacttaaaaaaatatatagaacctcaaatgggacaaagccttccacggagctggctggatctgagcttctagatggtgcgctggccactgcagcattttctgcttagtggagaagggagagcaacctcgtgttatatgagtttttataaccagaaactgacaccggtgagccttctccgccgcagcctgctgtaatttgcacttctgctcctacaagatgcttaagcgcatgatgttgtcatggtgctgcaagctaggcgtttctcagtaagtgttggttgatattgctctatatttttttctaagtatttcacatcatagcttattttaccgatggtttaggctaagaaattttgttcattctaaaacctccagtttatgtagacaaactttcatatttaaagtgaggtagtgtagcaagtaagagtacttgcgctctttcttgactccatcttcgcggtagcagcagcggcgtccgcgggctagtagccaacatgcagctctttgtccgcgcccaggaactacacaccctcgaggtgaccggccaggagacggtcgcccagatcaaagatcatgtggcctccctggaaggcattgcccccgaagatcaagtcgtgcttctggcaggctcgccgctggaggatgaggccaccctaggccagtgtggcgtagaggccctgaccactctggaagtagcaggccgcatgctgggaggtaaagttcacggttccctggctcgggctggaaaagtgagaggtcagactcccaaggtggccaaacaggaaaagaagaagaagaagacaggccgggccaagaggcgaatgcagtacaaccggcgctttgtcaatgttgtgcccacctttgggaagaagaagggccccaatgccaattcctaagtcctattgccaccctgccatgctaataaagccactgtgtccagaaaaaaaaaaaaaaagagtacttgcaaagcaaacttgacaaccttagctcaccccaagcatccatgttcaggtgagaggaaaaagaatctacacataaagttgtccttgattatcacaggggtgcatcgcacccgtgtacgccccatacaaatgatgcccacgcaataataacaataatttaataatgattaataataataataatttttaaaatgacatgtaagttgtccgtgtaatcttttattctatacccacacattacattggtttggtaacaacaataagagctttgtatatatgaagagttcatattttacagtgtttgcttgtacagtacactccagccatccactgaacaatgtttattgag

SEQ ID NO: 24237 - DNA, 1226 bp, Mus musculus
atataaatcttctataagtcacaaaatttgtcccctttgatttctaatttttgtttgcttcatgtctttaactagaaaggaaaagtaggaaaaaatgtcttttccttgagttttatttatcatcttccatacattcaactctacagtattttgaaagtgattgaattttatttattctttttaaaacattcaacttagaagaacatctcttattcattgcacacttgtattccagttggttcttctagtattaaatggcttgggaatgactagaactgactctgagcaaggatgtaaggtacttagtgggtgactgggagcatggatcagggaaagtggtgtgacccaggggttacacacaagttgtgtcaagtgcctgtagctaatcaatagctccacagataatattggcaatagcaacaatagtaatcattgcttggatacacacatatccattgttcttaaaattattctctgtaccatctatcaaaaaacgtttctagccatatatggtttaaacatttgggatcgagttaactgaagaatatagtattacattgtagttcaagtttaaacagctgcatgttgctagtagctaatgaattagctggattttggagcggtgaagtttctgtatgggtaaaacttattctttgaattgattaaagtaaataaacatatgtgctctttgtttcctcagaagtgccgatttatcacattttctcagtaggtcacaagggattaagagagtgatgcttgtctatatgaagttgctgtttagaactatctcaattttttaaaaagcttattcaggcctaagctcagttaaaactgggaaccctctcttatctagactattaccctctcatctacctaactgtccatctacagataatctatattttattattaaatatgcattttttaaaatattggtcaaaactaaatataggtagtatttaattaacaaagaaaatgcaaataatgagccaaataaacatactgaaggatattgaagacaaagaatggaatgttttaaaatgattcaagcaattgcatagtttaagaaagtcactgtaagttatgcttcaccactgagacgtaaagtattaggcagatgataaaagtaaagatcgattcactagagtacagaggcttcctctggatcagcggaaactcaaaaatagaacattgggtgtgctcttacaaaaactcaaaaacagcat

SEQ ID NO: 24238 - DNA, 1154 bp, Mus musculus
gatgaagggaggatctgcatgagggggtacttggaggagagggggctaaaattggggtgtaaagtgattaaatgcatttaatttaaaaacaaaagcaaaagccacaccattctctctctctctctctctctctctctctctctctctctctctctctctctctctctctctctctctcctctcctctctctgtatctcttaggctctatctgtctctccttctctttctcatctctgtctctatgtttgtttctgtgtacttatatctttctgtttctctttatttctgtgtctctttctgtcttttttttttttggtttttcgaaacagggtttctctgtatagccctgactgtcttggaactcactttgtagaccaggctggcctcaaaactcagaaatctgcctgcctctgcctcccaagtgctgggattaaaggcgtgtgtttctctgtctctggttgtctctctctggctgactgactctctgtatctctgtctctctgtctctgtctgtctctctgtctctctgtctctctgtctctctgtctctctctctctctctctctccctctctctctctctctgtatatctctctctgtatctctctgtctctctctctctgtcttccccctgtggatgtctgtaccatgccaggacattccctacaatgatggccatagaatgatcctttgaaactgtaagcaagcaaatcccaagtgaactgcttccttttataagttgccttggtcatgttatttcatcccatcaatagaaggcatgatgatcaggattttctggcactcagaaaaatttctgttgagtctaagcttcttcctcgtacagcacaggcaccatgatctgtcaagcttagagggctccactctcagctcaccaaatatgatccacctcatactgtacaaacacacatttccaaagctctccagtagtttgaaaggaaaatatggcattttagtttcatctcagtttttaaatttgaaatattaatttaattacatgtctccttttcttctttcttaactttatatgtgcttcctgattatcttcaaattcataggctctgttttcactaattgttagtggggagaggtgtctaaatataatctgttgcttgtataatgttgcttttattca

SEQ ID NO: 24239 - DNA, 3520 bp, Mus musculus
tttttttggttattgtgaaacaataaaggcttaagagtaatagcattgaccatctggaaaatttggggtttcttaccaagttgattttaaggcccttatcttatatctgaagaaagatatagcactttgaatatgatgtcatgggtgaagaaatttgtgagtttacacacatcccaagttgattcttgaatcatctgaaaatgatacttcgtagtttctaccattattttcaggatatctgtctcatttattgatgaacatcagtatctctcaaattgaaaaacaaatccatggaaaaactgcttaatgtatgaatttgtttttatagtctgagaattctaagtgtatttggttacctgtaaaagtaggagacatgactgttttagaaatgactagttttctttctaagtcattcctaaacatctatgacacgatttctttcctgtctttttttcttttgttgctgtttggagatagggcctcagtgtgttcgttgcctaggctggcctcaaatcctgatccttctgctccctgaatgctgggctctcaaggctgtatggctgtagaacagtttcctaagcatttaaccggtacactacagaggtagcaggaagcaggaagctttagtgcactacaaaagaagcgtccgctacacagagctgaaacccttgatgctgcatgggtcggggtagggggaggatcgatgaggacagtgtctgtgcctcgctcggggcctgtggactgctgcaatcctgagcaggcagggtgagggtggcagatttatgggtctgtagctaaacactgcccttctactgtaagtgatggttttgcaattggaaaggaaggaacagagggagggaagggagagagggacagaaggaacgaaaggaaggaagaaaggaaagaaaactgttaattcacttatctggatgagaattctcaaattactgatttttaaatgtgtgtttttgttttgtggcagaccgtactgcacattttatgttgtaatctaggcttttgagttgtagtacggttcctggaggctatttttttcctctaagagtcagtgaacaaagagatttgaggcaagttaagtgtcttccctggtcctgaattccagacttgagcaatgtgcttgctggcccgtggccgcacctgcctctctctagctgtcagaaatcaagtctgagtcttagttttgtgaaagtgacttactcttaaaagaaattttaaaaggagtaaagggaatactcctacctgccaaatgtattaaatatagttttcgtaggaaaaaaaaagtgaatttattgtatatcccttaagattgtgagggagtgtgtgtagcgtgtattgagccagcatttcctttatagtagataaggtctgtaataaaagatttcattaactgcaaaacctttcccctagggaattggtccctgctaatctcttcaggtgctgtgctggtaaatgctacattataaattaatgttggcatgcatttacgactaagcagaataatgtgtatacttttaaatggtgaatttaaactgaatgtccatgtaatggattcgtgtacagttttacatatttggaagcattttttttaaactaggtttaaacctcacgtaaaatcactttttatatttgtgttgtcttcatctgtgcctttttaggtaaatttaatttctacaatgactttctggtgcctatgagctagctatcacctaccttgaaggtgcttagaggtgaaggtactgttttcaaaagcacatcactgtggctttctacccttagagtccccctctcgccttctctcctctgcttttcttgatgtcacttaaataataccactgtttattaggatttaaaagaaagtcacaccctcagtacgctttgaccgtgcttctagtttataaccatagccatgtttgactttcagatgtttggcatttttataagatattacaagaataaactggaatgcagcttgtaatggtttcgagaatggtaatgaagattatgctaggtagaaaacactacaaaagcagatgtgtggaatcttttccttttcctagactttgtatttatttaaaggcaaacaaaacctagagtatcccgctatttttagtctagatctgtagcaactataatctgaaagagaaacttgtttaaaaaaaaaacaaacactgtgaaccccaacaggcctggaggatcaagaatcagagacatagttgattttttaggctttggcctgcagcgcttctcattgttagcctcagtttcccccaaaggtcagacaagtactagcaatttcccagacaacctcactgattttagtcaaccaaggagcaagtacttgctctagaatcaatgttggtaatggtcaacagctcatcggccgtgctggcgcatcttaacgtagagccagtgtgagttcagggccagcactgtcttcccagcagacctttctgattccgcgctatacacgagagacttattaacccatattgtgatgttccaagaacattaaaacatctctggagtgaaatgacactcgtctgtgttctgaatacagaacagtttatgagtattaatttattgataatcttagtagtattttcctgttagaaagcctccccttctgctcagaggctggcatcaatttttgtgattttgtagttacatagacaagtacttccttaaatttgagttatctaccaaggatttattagtatggagacagactgagtgtgtttagtggggaagatccatatagactatggaaatgcctaatttctggcacatgtgactgtgcacatcatctatgatccctgaactcagaggcacaggacgatcatggctttgaggccagtagccagttcaaagcaagcctgagcttccccgagcgacctggcaccgagagactggactcagtagtacagcattttctctagaatgggcaaaaagaatgaggtctgaatctgaattcttttaaagaaatgaatttcagactgtaccctgggaattagattacgtggagaggcaagtaagctttttgattaaaaagaactcactgcatggagttggctattctttaatgtgtgacttatgaaataactactgtctctgtgtgtacagcatgtaaatttgaagctatgtgaatgttcattcataggtttctggggtttttttctaaaatatttccaatagtgtttagagtgttctcagctgccttatttcagtgtgaacagataacattcctattttatgtggtgaatgctttaaatgtgtcacttacagagtagttgtagaaaacagctggcacgattttaagtggtttgcgacattatatattatatatgtacatatatgtttataacattattgtgtttcatagtataactgttctgggcaagttttaatatttcaaatgcctctggatattccagcaataaaggcaacatgttctgcagtcaaatttctcgtttgcctactttgacactaaaataatctgtatttg

SEQ ID NO: 24240 - DNA, 1123 bp, Mus musculus
cagtttaaggaagcaggaacttttacaagtactggtttcttctctgtttggctctttcaaagttgttgtgtgttttgagaaagttcagaagaaacttcacacgtgatttcatttaaaaacaacaacaacaacaacagatgcactgctagtgagcccgtacgtagaagcccgagcttctacgaggagcgaagtgaagttttgtcatactagacttcatagttaaacaaggtgcatattttaaaaattagacttcatagttaaacaaggtgcatattttaaaaatcagaagtcagatgtgattttaacacatatttttctttaaagattagtgtttttatgtgcctagcacatatcaggccctgagttattaattcctgtcaccctagtacatatacaaaggtttggtttctggtttgggttctattatgttgcccagacccaagcttagtggccatcttaccgcttcagccttctgagtggagacatgggggggaggggaggggattgacatacattgccatgcttggcttaaatactcctgttgtccattcttgtagcatttctccagagattaccgcctgattctcgcattaatttctaagttagttctttggaacgggcatccacttggcacgccacgctgatgatccaaacagtccgcttgcttcactgtgtgcttcctgcgtgtagcactggagtcaaggaaacccttgcgtttccaagtcccatgtttgcctctcccattcttatataacacttaatgattatttttcaaaacgtgtgcatcctggcaagtgatttcaggaacatggttgaagaatacttcgttgccatcttgacaggtagcttgtggtttcttggactcttgctgtttcctatggaccattgagaaatggcttttaccattttgtttgtttatatagaactcaccttggtgtttattcttttaaggcttgtcaggtttttgttaattttcaaagtcatcctttttaatcagtttgtgtacttaagtgagaatgttaaagatctcgctggccttttaaagggttcagatgtgtgaccaggcaaaataattccatggacatgagctgttatttaatggcggagtatagcgttcctgtca

SEQ ID NO: 24241 - DNA, 1203 bp, Mus musculus
cctgctgactttgtcactgctgacaaatttgatgagaatgccaagactagccaagctactgtggcctctggtatacctgttggctggatgggcttggactgtggtactgagagcagcaagaaatatgccgaggccgtggcctgagctaagcagattgtttggaatggtccttttgggttatttgaatgggaagcctttgaaaggggaaccaagtcactcatggatgaggtggtgaaagccacttctaggggttgcatcattatcataggtggtggagacactgccacttgctgtgccaaatggaacacagaggataaagtcagccatgtgagcactgggggcagtgccagtctagagctcctggaaggtaaagtccttcctggggtggatgctctcagcaatattgagtttttttctttcctgactttggttcctgtgcacagcccctaagtcaacctagtattttccgcatctccatttggtgttagcacaagattcagctagtggctgagatgcggcaccaggaacccttaaatagttgcacagcatctcagctcatctttactgcatcaggatttgtctgcgttcttcaagatcccatttaaattccttagtgactaaaaccattgtgcattgtagagagcgtctatttatattttgtcactctcagtgatctttgtgattgtagtttctgacttcctgattgcccagggaacacttacgatctaatatctcaaacaccaagaaaggaagggctcacttgtacacccagccatacctagacaatagcaaaggtgctggagatttggctaatgtcttcatgtttgtagaggataagttatatatgctgaaacatctgccaagtacttataatttgtcttctttaataaactgagtgtaggtttatattggagggagaggatgaggcatggagggaagaagaaaattaaggagataaaataaacatacacagatacatggggggagagagacagaagagacagacagaaagacagagacagagacagagacacagacacacacacacacagagagagagggggggaggagagaggagaggagaggagaggagaggagaggagaggagaggagaggagattttgtaatctaaaacctgggaagagaaggaaaagacctcttgtttctagtgcttttgcagagtcacaggtataaaaaatgtaa

SEQ ID NO: 24242 - DNA, 1208 bp, Mus musculus
ctacaacaagaacaacaagaagctatatatggctcagcaaatggcacctccgagcccaaggaatagcacccccaacagcagcggtggtggcagaggcggcaggagcggtggaaacaaccagctgagcaaaaccaaccggtatatcggaagactgcagccaggcaccgctgaccaggaccttgtcaagctctgtcagctgtatggcaagattgtctccattaataccatcctggacaagaccacaaacaagtgcaaaggctatggctttgtggacttcgacagtccgtctttagcacggaaggctgtcactgcactgaaagccagtggtgtgcaggcaggaatggcaaagcaacaggagcaagaccctacaaacttatacatctcaaacctccctctgtcaatggacgagcaggaactggaggggatgctgaagcccttcggccaggtcatctccactcggatccttcgagacactagtggggccagcagcggggtcggctttgcaaggatggagtccacagagaggtgtgaagccatcatcacccactttaatggaaagtatataaagacgccccctggagtagcagcaccttctgaccctttgctttgcaaatttgctgacagtgggccaaagaaacgacagaaccaaggaagatacatgcaaaatggatgggcctggccaaggaatggaaacacggagacatgggcagtatggccttgacctatgaccccagcgcggcccttcagaatgggttctacatagccccttacagtattgcccacagcaggatgcttgctcaatctgtgttagccctgtatcttccatctcgtgtgtcttcctgggatggaccaccccattctctctccagcctgcctccatgatgggacctcttacccagaaactgggtcacctgtcactcaacagcctgggcacgttcatgttagcagctactgctatgctcagggcttacatgtcccagtacccagctgtgccttcttccagtgtttctgctgaggagagcaatggtcagcagaatcaactggcagtggagcccccctcagaccacggggtctatcctttccagttcagcaagtgatgaggtccagacctgaggagagaagcctaatgcactcctccttgggctccttcccgttgctgatggaacctgaggaaccacgttggttttttgtttgtttgttttttgctt

SEQ ID NO: 24243 - DNA, 1432 bp, Mus musculus
gttagatgaacttccagatgacaactaagaagccaagagcccagaacacaccttaactctctaaggggttggggggacggggaggacggacttgaagccagaagaggctaagcctgatgataaaatctgggacctgacttgcaacttgagtgatgcctttgtcccccgccccctccgcccctccccaccccccctttctagaggcaggggctgagctcatgcccctatactttaagagcgcttcgccagcggttttgtccgctagatagaaattttccaaaaaatatctcccacgctaggcaaaacactgaaaaggaagtttttttgcgccaagaggagagacatggcgagacagaccgagccactaccgctcccaacacacacacaccctgcccatcccacccggctgcgctcctcctgcccccagctcctcgccctggggacagctggcagcctagcgcgggactagacacaaagcggatcagtctgggggcggggggccgacctgcagggttctccctcaagaggctagtcctctgccgccactcgcttaggaccctgcggacaccgcgtcccgcgtccacgccctcccctcaaccctcttccacccttcaaaagaaggactgtcccagacaccacgtcctagggccagaagacctgcccccacgacagtcgctggagacaccccagaccggagagactgacatcgggacaggacccgcccctctgcttccacctctcagggacctcctctgctccgccgccgggcgaagtgctgggagacccagccgcctgtcgcgctcctgcagggggaccctcagctaggcagccagctggcgcccgcgtagatggcgaggagcccccaaggcctcctgatgctgctgctgctacactacttgatcgtcgccctggactgtaagtctctggggtaacagtcctttccaccctccggtctggctataccagcctccgggaccctcgcctgcaggcatggcgctcagtgctagggggtctgtctcggggcgccaggctttgcagtctgggagcacggagggtaatctggatgagggcaggctctgggcagggagactgaagtcctgtgcgtcttgtaaatagtgttggatctgggcagttaagaattgaagaaaacagacgatcctcatctccttgcaaagtccgaggaagttttcaaagacaccgggacgtgatcagaatgcaaaactctctaagtattcaagatgcgaagagcccaagaaagatggcatccggggttggcgaaggccactcttaagtagctgcggctgagggatcagtggttacggtcccagctgccccgggcaaggtgctgggtaaagcactttagaggcggtagcggggtgaaattagctgagccccagtagcttttcgcctttacgcctgcaaaaccggctta

SEQ ID NO: 24244 - DNA, 1872 bp, Mus musculus
tactgttctggccagttgaatcaaggtcttcatttgttgatggcaaggcaggcaattggtggagtatttttttaaagcaaacatggtgccaggtgtggtggcacacacctttaatcccagcacttaggaggcagaggtagtaatctctgagttcaagaccaacctggtctacttagagagccccaggatagccagggctacagagtgagaccctgtctcagagagagagagacagagagagaaacagagagatggagacaaagacactgagggaaagatgttttaaaatgtcctacaaaaatatataaaatgaacatgtaagttcaaagtttaaaattaagttgtttttttttttttaaccaggaaaacaaatgctttagttttaaacaaaatgactcgaggaggatactacatagaaagttgcttgattatttctaatgttattgtcttttgttcccccccccccccacaaaaggtgactttaaagaccgtgctgagatgatagatttcaatatacgaatcaaaaatgttacaagaagtgatgctggagagtatcgctgtgaagtcagcgctccgactgagcaaggccagaacctgcaggaagataaagtcatgctagaagtactaggtacagcacacacatatgtaacggctgccagctgtcccgtcctcgtcccccagccccgcggaaagattttggctttgtttgtttttcagcagcctggatggtattacataagtttcctgtctctcctctccctttcatcttcagtctaacagaggcatactggatcctttttgtactttgaattactagacacttccttcggtaattagccagcgtgaaccctgaattttaaaagtccatgctagggtctggaaaaatgggccagcagtggttaagagcatttgatgctcctgcagatgacccagtttgtcccaaggtcatttcccagcatctacatggtggttcagaaacttctgtcactccaggtcctgaagatcttctaccctcttcttctgacttccattcgcattccatgcattcggggcatatacatacattcaggtaaaacattcatacacattaaatatacataaataaatcattaaagccaccatgttgtgtggtcatatccacatttctatattaccgagaatggatttgaaatcttaattatatcttccagatttcttcatagtactttataaatataatcttatataaaatatataaatataattttaagtactgagagaccatgcatgtatactgaagatgggaatgttgtgggactgccaggattctgcctaccatcttcagtcctgaattttcaaggagattattaatagttatctacggtcttacttagggttttcttgctgtgaagagacatcacggtcatccaactctttgtaagggaaagcatctaattggggctggcttataggttcagaggttcagtccatttatcatcatgttgggaagcatgacagcatccaggcagacatggtactggaaaaggagccaagagttctacatcttaatccacagggagtagaaggaaactatgtgtcatactgggtgacctcaaaacccacccccacagtgacacacttcctccaacaaggccacacctactccaacaaggccacaactcttaataatgccactttctatgggacaaacattcaagcacagagtctgtggagatcattcctattcaaaccaccacacccactacattctattttagttcaagtctctaagacccaatttccccaatgagacccttcttttttcctttatttaaaaagtactatataatataatatgataagataaaagaccccacttcttaaagtctccac

SEQ ID NO: 24245 - DNA, 2510 bp, Mus musculus
agcaaaatgttcttgccatcactaaattacaacctggcatcttgtgtctgacctaaagtgaaatgtctggtaatattctgagtttttgaagtgcaaatgaatgtcagtttggagttgactatatcacactgactgtaaggctaatccaagaagcaagaatatactccatgtgttctctccatgcaagaatggcttatgtgttcaggaaatactctaacgaatggaaaccctgttcacaaaattcctaccagaatcctcttcttacctctaaataacttgggttccattgtcctgtgtctctatatcccagggctgggtcttacgtctaaggatttgcactttatattttctttcacttctcagaaccaaaagcagcatgaagggagctgctactgccatttccttggaggcttttggagaggctcagcgacctggacattagaatgcattactagagcctacacaactccacagacaccctttttgtgcttgagtggtgacctgttatctgtctctaaaagcaattctgaactgggctagttcctccccggtgaagatgaagggttcccagtcagcttatgatggaacaggggcacaggggagagaagcatttgccccataaggcaaaggtagatgaacaagctcattttgactcttgatccagcaaaggcacaggagaaaccatagctgaaatgagatgggtctaatgtcttctgaactggttatccacaaaggccaccaaccagctagtgtcagaattggaaattcccagggctcagcaggaaacccagtcctgttggggactactttacccatattaaaacaaacaaacaaacaaacaaacaaacataaacgcaacctgggatgtctagttctgggtaaataagcatgaaaggtcatttactccctctatcagctttgaacatggtcaagttggctttgcacccaaaaggcaaggcagattctcaggatttgcaaacagggcaagtggtcagagagtgcctggtattgatctggtcacaggggcgatgcccactgccataatcttcccctttaactttgtggccttgagtccttcctaaccagtagacacctttccaaagggctgacttgtgtaaaatggctcagccctcaagctcagattcacacttgagctagcaagctacaaggaacgagacagtacataattcaacccacatggttcttgttacaaccacttaatgtagagtacaggtaagtgtgcccacagatccaagctccttgcccctggtagccaacaaacacctgtggtgtataagaaatcagggtaaatgttgcctaggctgggactatgagctctgctttgataggaggactgctatccttctgcagtgccaagcagacagctctcaaggatgcctcttcaggcccacatgcctcttcaggcccacatagcatcacaaggcccctgcatcaatttaaacgacacaatccaccccatgagaggacagttacgtagtgccttaccttcactaacacatgagaagcttccttgtaagacactgaagcctaaaggttcactttatgcggtgcgaacatctaacaaagtctgtgccaaacacctattatacattcttagctaagctactgtatacagccatgcagaaatcattgtattaagaatgctttcttctacacaaaggacctaactgcacactaatcttctagttattaagtctatccgggagtcactgccatgaagacctgtctgtctgctgttttctgtgacttgaactctaacaatgtgtcaaaatctaattgtagtgtctagatgttgattttatttttcccgcagtcaaagtgcagtaagggtctagaaactatgtgagcgagttttgttttggtactgttgctgttgtaactagatccagctcatttttggtcgggataggggttaactcactcaagcactaaggctgcatgtttgttttccaatacaactttacaaagaacttccttcactctacaactcactttgtttgattaaagttcacgctacaaaaatagctatgcacagctcaacgttttagtctcattcaccggagggggaagtcactcacctattgttcaataacccaggaaactcctccctcccttccacctgctgctgtgaggcagctctagcagtttaaaatcaagtttcacttgtctctacgcttggatcccggccaacttctaaagtcagagaacacagagggtaaactacttactggctgttttgtgtatggcagaggtggggttgagggagtgccaaatctccctcctcttccaagaccttgtgaagaagagcctgcggtgaccgcttgctttgcagtgctgtgttactggaggagctgaacacagccaccagatccacagctcacactttcttcacccacccccatccaccatggtccccaaacctatctttgtcaaactttagcatttaaaaagaaagatgcaacagaattttatacacaaccaacccagga

SEQ ID NO: 24246 - DNA, 1155 bp, Mus musculus
gtcttcttttcactctgtgcactgcctttttcatgagcgttgggcatgtactctgtcagatctttctgattcatcactttgtctgccactgtattagacatcacttacaaacatgggtgcttccctctacgaactaacaactttacctccattgtttggattaaaggtgtgtcctaagggcatgcctttaatcctgctaaaggaattaaagctcagggctgagccacactacaactagatacagcccctccccccaagtaaatgactcacagtatgatcaaatatcctgaacaccaacaagttccaatccatagagtaatggagtcaccatctcaggctaacagatgccactctaaacaaactggcttataaatgttgtatgtgagcttttacatatagagagtacctctctccctctgatgtaattcagttttggtctcttgcagatcatttttgtttgtatacatgaagtttaaaaaacaaaacaaaaactctttaacatttacctcttccaggactgaacttttgaacgtcttcaaccatgactaagagagaagcagaagagctgatagaaattgagatcgacgggactgagaaagcagagtgcacagaagaaaggttgatgtttctgaattgatcaattttaatattatcagtatgccacgttacagctgaggagtaggccagtgtgcttgtttttaacctgacctcacagtttagaggactacatattgtagtttggtttttgtcgtccccatctgacttcgtagctcagagaggaaggcatttctgaaatacaggcagcagtgaggttagttgatccgtatcacatggttacagtagtctgcacccaccccatctaaggatactcttttttttttctcccatttaagtgctggtgacttttatgacaaagacagtttaattcaacctgaacttacttaacaatagttatttatggataactgtagaggatgactagaaaggataggctgctgtgcttatagccaaaaatatgccaatagtcctcacttagtcaaaaaaaattttttttacattaaccaagtataatattattctaaaataatattatcattaactttaaaataatattatcataaactttaaatgttttaagaaaaaaatgtgatgtat

SEQ ID NO: 24247 - DNA, 1207 bp, Mus musculus
caactcggtttcattcattttgactgctgagtagcatgtctaaaaatgctgcaaatttcactagatttaagatggtattaacaatttctattctacccttccatttcaaatgagctaacataatcgcaggaacgtcagttttattgattgcatttatttctattttctgtattagaagaaaagtatattcttcttttttccttttagctgtgcagattattccagcctcagtgcctcccgctacaccgactacgattaaagttataaacagcagtgcaaaagcagctaaagtgcaacggtccccaaggatttcaggagaagacagaagttcaccggggaacagaacaggtacttttgcatgaactggtgttagtaaacttgtcgatttagatatattctaagttggactagttctctggcagtgttaagctaatatttataaattgagaagtttgtttttgctttggttgagattggaccagagggcttgtgcactgcctttacctgtgttagcttctaacatgacctatgcttattctgcttacggatttaggaaacaatggtcagatccaactatggcagtttttgctagaacttcttactgacaaggatgctcgagactgtatttcttgggttggtgatgaaggtgaatttaagctaaatcagcctgagttggttgcgcaaaaatggggacaacgtaagaacaagcctaccatgaactatgagaaacttagccgtgcattacggtaagaatttgttttttgttttctaatatcatacttctctagaaatgtagcttcttattcttgatataaacctggtagttaatgaaagtaaaatactttaagattgtgtgcatcccgcatgcatgtgtgagcgtgtgcacgcgtgtcagtgttggttgctgaggtggctcagtgaacaaaggttttcaccccagagcctgctgcccagctgaatctcttctctgaacccacatggtaggagactagccggcttcaggttcacacacacacatatatatacccagagaaaaaacagagaacgtgcatttacaagatttatttacaagatttatttacagttatttatgtgagtacactgcagctgtgttcagacccaggcccaggagatgcctcccatagacatggttctgatgggacttgaactcaggacctctgcgagagccagcagccagtgctgctaa

SEQ ID NO: 24248 - DNA, 2755 bp, Mus musculus
ggagctgtttcctctccgctgctttacacagagcctgaaaaaggacattctcagctaaagcatgtgtgcctgtttcatctaatcaagcagagctaagcagtcctatcaaatacaattacattggtaattactaaactatcaggttattaatttataatttacaagaagagaggaagttaactggcagaagaaagtgttgaatgagacccagatttaaagctggcttaactcaaaccactattaatggttttctgtatagattattcattatgtcaagccaaggtcttaaattattttgagagaggcatttaattctaataaaccagctattgcaaaaattccaaaatgatatcattctttctctcagattttaaaaagtatacctcagaaagaaaaaattggtttagttttgacttcctatttttttaaaaattaatctgtagtaccagattattatgcaagaccgtttatatattcccttctgtgtttctgataaaatgaagactttagatcaggcgacatgtttaacgtttgacgtaagttccttgtgagtagttatgaaagggtttgactgggctctgtaggcgatcttctttaaataaagtttcccacttgtttcattttttttcttttgaatattgcatatatgactcttaaaaaatactgtacacatgactagctaaccatttctgcatatatgaagacagatattcaaggggagattaatatttctaacatttttaaataaatcttatatgaaatgccttactgcttgctaacactaagaagaaatgcctaaaaaatttttttcttcatttattttaaagtattatccataaatcatgatatgagagattagcatatagttttcataacagaaaggaattcctcagaacaggataaaggctactttatatacacctctctcatttgtttttctttcagttcatttcccaaattggctttagaagagtttgaggagagaaagtgcagcctgatgatgcagccaggaccgagtgttagggagaagacagagggtttcttacctcctatatcatgacttccagtgctgggctgtcagacttcaacaagggttgctagtttctttatattaagtcctttaagattatacagtaaatagttaaaaagagtaaaatcctatttttttatatttgctctttgtttttataaacaacagtaggcaggcaaattattagtacagtttggtcaccatgaattgaaagagtagagtataagaataatctttaggccctgactttcgacagcaaataggcctgggagccgtaagtcactgcttgagaacagggcattgccgcagtacatcagagcttgagaagctcagacttacagtgtgttggagacattatgttaaagctttagccaagaggacagactttgtgtatcattcggaggaatgtgttttaaggaaaggaacatttatatttgttctaggtccctacaatcaaacatttccaaatccttaacaaaacaaaacaaaacacacaaaacgtgttgtatagctttgcttcctttggaagctggtgggttagttgtgatttgagcacagttctcagatcttaggtggttgttctctacccctcctgcatcctccatgctccccccacacggaaggagacccaagctttctcactctggctccactgagagttcaaagatgtgttgttcttattgaggccccagtttgctatcatctattaaaataactcatgttataaaagaatgttaattcatggtaatccttgctcagttttgtcgtgcatttttcatagagcctaagatacagttgaacaaaaagaacagaaaacggtctgaccatcttttgtaccttataagttgaagaataatgaaatgttcctgttgctagaaaagcgagttttccatgtgatgtttacattgacgtcattttatatctgtgctagcctgaagtctgagctagcctgaggtctgtgctagcctgaggtctgagttagcctgaggtctgagctagcctgaggtctgagctagcctgtagtctgtgctagcctgaagtctgagctagcctgaggtctgagctagcctgtagtctgtgctagcctgaagtctgagctagcctgaggtctgtgctagcctgaggtctgagctagcctgaggtctgagcgttggtgctggcattggaaggtgcagccagttaggcagaagtgctggctgtgactgagctcctcatgatgagttagccaactgcattcattttagtgttgatccatgtaaataaagtaggaaaaattattcagtttttctccccagataaacagtaatgctggagtatggttatttcttttaaagagtgtacctccaagtatttttggcaagttctgtcattttctgcatttgccatttatgctactgccttttataaagaactagtgtatccttgaaatagcacaaaaatgttttaaaatttataattgcaaaacaaacctgtgactgacttaatgtcttcagatctaaaggctataaaaaaaatgttgatattcaatatttcacttactcccaagaaaaaatactcttgagtcttttgtagaagggaggagaatttttgcatacatttttactctttaaataaagacacttatactatcataataacaattatgtatttctttgtttttttgtaattttacataaaacagttattttctatttttactcagataaatatttgtgcataaaatgt

SEQ ID NO: 24249 - DNA, 1148 bp, Mus musculus
aaacaaacccttccgtttatttactcaccctcggcttttgacagctgtgctgtaacacaagtagatgcctgaacttgaattaatatacaaatcagtaatgtattctcgctttctctctttacattctggtctctacattacatgattcatgggttttgtgtactgtaaaaaaaaaaattagctgtatcaaactagtgcatgaatagattctctcctaattatttatcacatacatagccccttagcccgttgtatattattcttgtggtttgtggcccggaaaaaactcctacttgaaatatgctttaaaaatcgatgggggatgcttcttgtgaacgtgggcgtctagctgcttctcctacgtattcttttcctgatcactatgcattttgaacatttttttaagtattccaaatgacttagaaaattctttttccatgactgcatcttactgtacagattgctgcttctgctctctttgtgatataggaataagaggatacacattgatttctttgtgcctgttttatgtgcacacattaggcattgagaatttgaacattttttttgtccatgtatctttggatctttgataaaaaaaaattaaaaaaaaattatccctgttcatcataagcacttttacgggtggggggagggagtgttctgctggtctccaattaccaagaattctccaaaaattaattttctgcaggatgattgtacagaatcattgcttatgccatgatagctttctacactgtattacataaataaattaaataaaataactccaggcaagacgtttctttgaagggtgattgtgtgggagggaaaaggcaagatccctgcatttatcaacccaaggcgcttcgtttaataatactgacagagaatgaaaagccaggaagagagtaagagggaagagagggcaccctgagacacccctgagggtttgtataaaattgtgttttcataggaataccttagactggtatgattgtatggtgagagtttattgcttagtcatctagacccgtgagaacacctcatctggtcactcacacctaacctgtgagtctgatgaggaaattgtgggcgcacacagctcttagtgctggtaaactaactggtggagtttgttgttttta

SEQ ID NO: 24250 - DNA, 1204 bp, Mus musculus
gcgcagttttaagtacagcggaacttagaggtaaagtaagctgtgccttgagccatgggtgtcaggatgcttttgattcagggtactctggcaacacttaaggctatcaggagtcacttcagatagagtctttccttatttattgttcaacttttaatcttctccaggtggtcaaaaattgacaccaaatatagtttagtttttgggaaacctcatcttttcttcttggagaaatatttgtcctttttcagtcaaaaggttttgcttagcaataccatttctagtaatgataggtcagtgtgctactggctattaacacaaacacacagcacacagaggcgcgtgcagaataatcagctaggaagcaagaagctcataagggccccttcacaagcttcgaccccatagtccatgccgcgctgtcacctaacctgtggtttacatcgagcaccagggaattctgatgccacctcacttctgggctgcacgtgtctcttggcagtgtcacttccttttggccatgaggatctattgttcgaactttgtccccttggcaatgagcacacgatgaacagtgttggtgagcttgagatgggtccgcggtgtggaaaggggaagggaagcgttgtgagttctgggcactgccgtagctaggagccgggacaggacccacccgggttttgaggaagtgaccacaaagtgtttgctgagtttgcttggttttggtgggaggtggtgtgggcacttatggagtatggattggtgttaatgtgtgttgtgaaaatgtgaccctcaaggaggaatgtattttagtgctactgacgtaaataaaatgtaaacgtcaaaaaaaaaaaaaaaaagaagcttaacaccatgttttaaactgtaggacaataataataatagcactgcagatgttataactggaagcagggaaaaaggaaattattagtggggcaggtatttctgggcaggggacctacttctaatgacaactataaaggtctaaagtcagacagaaaaacaggataaaatcagaatagatggctcagcacccagaaggcttgctgaacacccagaccagctgggtttgttctctgagatccacataggagaagaaaaagaaagctgtcctctggcctctacatgtgcacacagcatccctgccttaaatgaaataaacatgtgaaaatgtttttccaga

SEQ ID NO: 24251 - DNA, 1236 bp, Mus musculus
tttatgtaacaatttactgtctcttgcctaacaccatatttatcattctagaccagagagtggcttggaaccttttgtaatagggacatttttcaggaaatttttcttttctagacaactgagtcactagaaagaacaaccaggctggcagttagtagtccagttatttataaagggacaccttcacacgatctgacccaggtcagcagaaatcgctagtgtatgacacagcaccttcttcccattcttgcccaagctcggctattttagcaacccagctctggagaaactgcagcctcacatccgggggaacgtgggcttcgtgttcaccaaggaggacctcactgagattcgggacatgctgttggccaataaggtgccagctgctgctcgggctggtgccatcgcccctagtgaggtcactgtgccagctcagaacactggtctgggacccgagaagacctccttcttccaggctttgggcatcaccacgaaaatctccagaggcaccattgaaatgctgagtgacgtgcagctgataaagactggagacaaggtgggagccagcgaggccacactgctgaacatgctgaacatctcccccttctccttcgggctgatcatccagcaggtgtttgacaacggcagcatttataaccctgaagtgctcgacatcacagagcaggccctgcactctcgcttcctggatggtgtctgcaacgtgaccagtgtgtgtctgcagattgggtacccgataccacactccatcggtaccacactccatcatcaatgggtacaagcgcgtcctggcattgtctgtggagactgagtacaccttcccacttgctgaaaaggtcaaggccttcctggctgatccatctgcatttgcggctgctgcccctgcagctgctgccaccactgctgcccctgcagctgctgccaccactgctgcccctgcagctgctgcaggccctgccaaagctgaagcaaaggaagagtcggaggaatcagatgaggatataggattcggtctcttcgatcaatcccgtcaaagcaaccaagtcagcctgcttaatttgagaaagatggaaataaaggcttacttctcttaaaaaataaaagaaaggaaaagaaaagaaaaggaaagaaaagaaaagaaaacacgccaatagtgttgcgtatgaagcacgtgtttttcaagcattttatttacatcaagatatttaacgaaaacac

SEQ ID NO: 24252 - DNA, 1184 bp, Mus musculus
catcccttcaaatgatcagaaattaaaagtatggggccaatcccgatcttccatagggaaccgatggaagcacatgtatttaagaatgtccgccgtagtgaggaggtaagccgtatcagcacgcccccagaaggtgaagggacatagagtaataacagatgagcactggcttctctaattggggaaagtagacctgctgtatcctttgctgattgttctctggcaaagctgtaaaataccatgttcagtcctactccaagatgaaggaccccatttgtctcttatgagtgccctcacgtgctcgggtgaactgaggagccaaaataagccacagcacaacagtgtcttacagtctgcccatagctcctataatgaaatgccacacggtgggtaattaatatctatttctcacaggctggaggctgtggagacatttcaaagagtgtgactggcaaaggccttgctgctgcgttatgatagagacaccacacgctgagagtgaggagacattcataaacacgtgactctcttctccttttcaatatggccaccaggccactatagccctcttgatctcctgaccctagtcaaccatctccagaggccaccagcatatcagtagtgggtgaagcttctgatatacaaacttaaagctcaagaaagagctgtgaagaggacccttgtgatacaaacggttcagtctgggccagagaccagtgagggtccacactgtgcaggccctctgaccacatgcacacccacacacatccgcacacacacatcccacacccacacacagccacacaggaagtcaatcaatttttaaacagggttccggccagtgattccagtccttaacatctatttttaaaaaccattcaatagctggccgtggtggtgcctttagtcccccagtctcaggaggcaaaggcaggcagatctgagttccaggccagccagggctatacagtgagaccctacctccaagcaaacacaaatcattcacttagaggataaaaactgaagcagacagagcccgtgtgcagagcaagagggaattcatggtcatggtttcagttcatacagagaaaacagtcattgaggaaacagttctgagaacacggtgacccacttggcgtctcaatgtatttccagcaagatggctcagcaggtaaaggtgcttg

SEQ ID NO: 24253 - DNA, 1194 bp, Mus musculus
tctcagcacccacatggtagggtagttcacaagggatcctgccctattctgacctgtacctttggaggtcagaatgacatgcatacatactgcaggcaaaatatccatacacaaaaacaaaataaacctaacaagaagaaaagaaaaagatagaaagctgggtcattttgttttcagagaatcaacatatgagtttttctgtgcaagtgcaagtaaatatgtattatatgtataccatattttatatatttatatatgaaggcacgtttgatttagccttagctataatatagcaaagcaatttaattaccctaaatgtccaccagaaaggacactggttaaaatctcagcctagggctggagagatggctcaatggttaagagcactgactgctcttccagaggtcctgagttcaattcccagcaaccacatggtggctcacagctatctgtaatgagagccaatgccctcttttggtgtgtctgaagacagctacagtgtgctcatatacaataaataaacctttaaagaataaataaagtaaaataaaatctcattgaatccattccactgaacatgtagccatgaaacaaggcactgtgtagatcctgcacccgaggctttttggtgaccaggacaactgagtgctaagaggctggagctgaatttcatcccatacacgctattttgaaaagccagccaaagcagtgtatcgctgtgtgtatataacaaagattgggggggggggggaataaaggggaataaactacaggaataaaagaacttcagcctttgtgtagcgtctgttttacctggtggtaatattggactgtccatggactatcacagtccgcatggtaagaacttaactgcagacagtgtaaaggtgagctttcactctgtgaacagcataacgccacttgctgatgctcccaggggttcatcaggaaggcccctttccctcagttacttatgaaggcccacctcaggctagtgatgtcatctaaaagtccagcctcctatggagggaagcttagatgatcatttgcaaggatcgtgaccaccttcctcctctatcacttttaggagtggctactcgtgcattgcctacccccccaatggataatgatactgtacccagcactaccttgactcagagttaatactatatacacagacataattttttaaag

SEQ ID NO: 24254 - DNA, 2078 bp, Mus musculus
agtacaaatggtttacatctagcaacaagtccacttgcccgctctgccgtgagacctttttctgaggtttttttcattggaagttgtcgctgccgtaggtcaagccaaagggaatggattggctccaccttgaagtactgatgtgaagccagtgagcatgacaaagtgccatctgtcagtatgatcctcaaatcaggcaacctctgcagattgctttgtaaatcttcggaaacttttttcttttacaagagactattacatatttgagagaaaatatttatattaatggcttaatctctttgtatgtttaaaattaaaaataaatatatctcttctcaaaaatattctaaattatagaactgaaatttgtgaaagcataaactatattataacttataaaaccatccagttttttggtctgtgttgtaaaacagtccaaggataaggcaaatgaattgagagctgatttacatctgtagataactaagacttgtttgttagtgatgacaaacaatagtttaaaattactctgattttcataaattgttttaatgataaagtgacactgagatattcccaccctcatccagaggtttgaagtgtactgtgaaatttcacatgaagaaggaactgagtgaactctaaggggctctggtgagaattgtgaaattcataacttacatccttgacactaatcttttgcttgtgaaagaattatttccatgttaatgagatttgaattgtaaatgtgttggttgaatctattactcagtttagtgagtctacaaagagtgggaatctgaagtaagcagttttttgattattttgtgaagtaaaatgatagcagtctatctatcaagaaaagaataaatattactaaagtataatcatgtgtggagaaaacaatatttaaaaatcttgtaggaggctgtacattttgcagagtttgctatacttattagccatagttacaccaattcaggaattgggggagctaattatttaaaactatcagcaatgaaggatatagtactaagtaaaattaatttttttttttgcttttgttttgagacaggatttcactatgttgctctgggctgggctgtaactcactctgtagaccagactagcctggaactcaagagatctgcctgtctctgtttcccaagtgctggggttaaagtgcaccaccaagcctggtggaattgtcttaatggattgaagtgtgtaaacttcatgaaacctgcctttggttacagtacctttgcctttaaaaactattcacagtataacgtgtggaagtttggatcacagtcttccatttcatttctagtagttaggatacctaaaagtttagtccatcatctgtgtttcaaatgtttaattagaagggtgcaactcgtgtcaaataaaattactgcttaccatcaactagtcaaaatgactgttattgaaatagtctgaaagtggacaggattacagtccagagaactgtgtgtcggttacaagtgtagtatcggcttgtctgtcttctctttttttctctgtagtagttattatcttacagtcttgaggctcagagacggagtgaagtgtagatagcaagactctactacctcttagtccctcacatctccctcttccctttctgcctgcctctggcacagcagtcacaaggactgtgtgatgcctctgggaaaattactcttttccttttcaagtggatttacaataaaattttgtttataaccttccagcattggttcttgactttggatccaaagccccagtagaagagaagatggagcagagctccggctttttgcggtgtgtgaccttagtagcccctcaagcttgggactgggaacgcattctgggagacttgtgtgcatagctgtcagttcacaccggttgataatgctaaggaaggctttccagaagcaagactgaaactcagaatgccccattcaggttttatttatttagctttgacaacactcatggacaggataccatccctgaaaattttagcataagaggaacttcaaattgctagagagtcaaagccctgttacaaa

SEQ ID NO: 24255 - DNA, 1236 bp, Mus musculus
cttcccaattttatttattttgagataacttaatgttcaacctgtagagctcggaagcatgggtatgtaatgtattggtaaatgcaaatattattttcttccatactttataaatttttttttttttttttttttgtttttcgagacagggtttctctgtgtagccctggctgtcctggcactcactttgtagaccaggctggcctcgaactcagagatccacctgcctctgcctcccaagtgctaggattaaaggcgtgcgccaccacgcccggctatgatactttataaatttaaaaagttcatttcaaaataaattgttcattgataattgttaaattcccggtaattttgaaagttgtttgatgtaaacagacatgattttttcctgaactatggactaaaacagccactttcttttcctcctcttcttcctcctcttcctcctcctctaactgtctgatgtgctgaagatctccatcctgtgctgtttgtggtgttgggtagcaccttgcttacctgttttatttctgtcctttccttagacaaccagtgagaaccaggctctgtactctgttccacttgtgcagctgtttgcctgtgtcagctttgatctggcctgtgatctctgtgccttttttgactcaataactccagatattgttgacaatcttcctgtaaatctcatcagtgagtggaaagagtttttttctaaaggcatccacagtttgctattacctcttttggtaaatgctatcggtaagtgcaaaggggtatgatgatggtaattattgaaaatggctgttgacaaatttaaaataagcttgctttcttagaggcagtctccatgctgctgcctcatagcacaggcacagaatgacagaaaaaaagatggcttggtattgagaaaccaataccaagtaagtttagatactataattcagcagagtacagcactagagccctctagacaactactgcttttctcgtcttctttctttctttatttttttaatttattttatgtatgtggatacactctagctgtcttcagacacaccagaagagggcatcagatcccattagagatagttatgagccatcatgtgggtgctgggaattgaactcaggacctctggaagtcagtgagtgctcttaaccttggagccatctctccagtcgcaaactattgctttttaaaaaagtgtagtagagacctttatgacagttgagggt

SEQ ID NO: 24256 - DNA, 2173 bp, Mus musculus
cctggagctgtttacaacttggagaacgttctgctaagcttctggggaagactgtcagagatctgcaccgagaaaatccgccagccagaagcagatgtgaagtccgttctgtgtgtgtctagcctagtaggggtccttcagaggccaaggagctcactgaagttacacagaaagaaaactgctcaggtcaggtttgccatcaatatacctgaagctcataaaggggatgaaaagtccatgtcttcagaaggagagaacagcgagggctctgacggaggggctcagtctcctctcagtaatacatcttcagacttagtatctcctttaaggaaaaaacctctggaagacttagtctgtaagctggcagaggtgagcattagctttgtcaacgagcggaagtcagagcagcacctgcagtttctctccacgctgctcgactccttctcctccgtccaagtatttaacattctcctcagtgacaaacagaagaatgtcgtcaaagccaaacctctggaaataaccaaacttgcagaaaaaaatcctgcagttaagttcttatatcataaattgataggctggctaaatgacagccagaaagaggacgggggcttcctggtggacatcttgtatagtgccctccgatgctgtgacagtggtgtggaaaggaaagaagtcttggatgatctaaccaaggtacggctgtcatctgactgtcataaacatccttgttgtgtgtggtaaggataagcatgggagctgttcctgcgtcctcactggactctgaatgtcactttaaagacaacatgctcttccctgatttgggaagtactgataaagaggttgatagcaagagagctccttagctgcactgcctccatgagccagtttgttctggatatgtgtagacgaggctggcctcaaactcagaaatctgcctgcttctgcctcccaagtgctgggattaaaggcgtgcaccaccaccgcccggctcagtcatgtttttaaagctgtatttttgtccttaactctccaactttgtctgtttcaggaggacctgaagtggagttctcttcttcaggtcattgaaaaggtattttagccccctctcccctttccctttctttttcaatttatgtgtgtggatatagaaattaaaaccacagccctagtctcatgctggctgtggtcaggtgtctgatggagcgcatcctaacagctgtaaattctaatgagagacccactggagaggccgggtggggttttagctgaggatacagcattgtgctgtattctaaaggggactctaaggtttattctgctcttcatggtctgtagaagttaagcagatgattctagacttgactgcacacatctggaaacgcttttttcctatgtggagggctgtgcaggatgtgagaatgtctcagccctgttcagtttgccacatacaaagaataagaaaactgataataaaggaaccaatgaaatcaaaggatgcaattcagaaaaatctaaaaagactttggtattttttttctagtaatgatttaaatggcatagctaacttttcgactgtaggtgtttctgatgaactacttaaaacacctcctcttagagcatattttactgatctgtctagtttacatgaatttatgtttttctttttttaaagtggtagtgaaaaatctgaaacaaaattagctatcctaagagtttctttccttgttttcctctttgccgtgctggggattgaacccagagcctctgacatgcttagcaagcattctgcccctgagctaggcttcagtcccatggtcagggatggtgaggtatagtcacattattgtctaattttcccaaaactacatcatggttgttagtgtagctcaaaggtagagcacttgccaggtgtgtttgaggtcccaggtttgatttgtaacagtacaaaaaaaatgaaaaattaaacatacaaaaacccctttcaattatgttcatatcattctcattttgccagttggtttaccttttacagaatgtaagtgcagactatgtttcgactgtttactgagacttacagcttccaggcgcacggttacttttatttagtattctgtaagcaagctaattgaagagctagttagctgcttgataggccttgaatcagaacagggag

SEQ ID NO: 24257 - DNA, 1195 bp, Mus musculus
cgtccacgtttacagagttctggggatcgaactcaggtgtcagtgagtgcttcaaccactgagctgttagctgcccagagctgaagttttgagcatatagtttccatatctcttgatgtacatattggatgtttacattggtcagctctgtcacgatcatcggcttgtcacgtattggttaaataaatgattccagtgtttgactagcattccctttattcccatttgcaggaacctttagaagtaaacctcgagcctccaggtcctcttactttagccatgagccagtttctcagtgagatgcaagagaacaaaaagcgagttgtgacacctaaagagctcttttctcaggtctgtaaaaagtgagtatccacttgtttgtgctttcagtgcgtcagtgagatgctgagaaaggtttatgacaatagcaccagcaccaactgcaccagcatggttcatgctgattgaaaagcagcagtttgtgtggtaatgaaatctacctaggctcttcgtacagcagacacaggtttgagaaaactctgacactgttactttaagactttagtagactcatcctgcttttctgtgtgttttctttagagcaacacgttttaaagggtaccagcaacaagacagccaggagctgcttcgctacctactggatgggatgagagcggaagaacaccaagttagcatactctgagaatctcgtttgtaatctcatgggcgcacttgccgtttctggccagtcccagaggccgctgtgcttttaaacacttactttataccagggtttccagccaatgtgcttcttcatttgggacaagtgagcaggattagaatgattctcgtaaatggagattttctgttgactgcagcaatcccatctttaaggactctgatacactagactccgcgaggagagatgcagaacactggaaaacatttctccccagacagtccttgttgcagcatactcttcctgagtatggcttactacaagtgctgagtctgggaagtattttcactttagttagagtcaggagatgcatttttaaactaaacacttttgttaattaccaggatatatagtgcattttggaggtatgagtttaattaattatactagtaacagtaataataactcattcagttttccatttaaaccaggcagttctgtgtctcatatgaacta

SEQ ID NO: 24258 - DNA, 1269 bp, Mus musculus
gcgcatctgtaacctcactgctagggctagaggcaggcaaatcccagtacagtgcagtcataacatagcactcctgattgtactatctgttcaccctcacatctggagatcacagctggctcaaattaaattttaaaacttttggcagttttaaattagccgagaccatttagacatgggggatgggggcttgggagagtgtaagcttaatgtggtatgaatataggctacaaaagggaagtgcaggctcatttattataagtactgtcagtaagtatgaagtccctaattgtttctggaggtgggaggaccagggtatgttagtttctctgctttgctgaagtacagcttgagacagtaggagtgtcctttgattatattgagatgaagactgctgataaagtggttaagcctctctcacacacacacacacacagtttgtggttcttacctccataggtagaagtttaatgtacttaccatgggtttttgttatttagatcatcatggcaaaaccagctggtgggcccaaacctccaagtgggaagaaggactgggatgacgaccagaatgactgaggaacttgtcataggttaagagttgtgtttgtagagtagaacttgcccagtgttttatttttcttatttgtgtttgtactctgctgggtggtacaataaatgtgttactgttatggccgtctgtttaatcactcacatgactgttctcattgtatacttgaccatatctattgggaaagacactttctagtctgttgtttatctcatttccaaagttgttcccccaatcccatggccttgaaagtctggcttctaaatgtttgttgtttatcccatagcaaacaaaaaaagttcagacagtgtcctaattaatataaggcttttcaatagtggctgggccagagtttatgcgcacacactgacaccaagatttcacattgctcccaatcctaatctcagcactagaatagtgaaacatggtgttgccagtagtgggtacagtaaataacaacttaaactctaataaaacaagttttgggaatatcagtttattgatgtgtcaagcactaccacccagtcagagtaagcacagaacttagttattcaaatccttcctaaagttgaaactagaaggaataaaaaccagtatgctaatacaaaaccgctgtaaattattttgcctgtatttaaataaataaacatgattttttttctgtcatttacttaggtgaacataatttatagtttaact

SEQ ID NO: 24259 - DNA, 1161 bp, Mus musculus
agtgaagccaggagtatcactggaacctgctcaccagattgagcaggacacctgagagccactgtgcatgtgcgtgcctggacagtcacatgggcttacggtgtacatatatattgtacctattccaatatgtgtacttttaccatatacaagtaaatgattttaaaataaactttaaatctactagtaataacattgagtagtttccattttaggcattggccatatgcttcgtgtgaatttgtcctcaaaagattcctattgctaagtgttcttaaagccaaggtcctctgagtgacaagtgttagagtaagggctgctatttgtgttgtcatcagagccgtgtagtccatagctattggctctgcatgcatttctgcaagcacttgccatcttatgtgaaaatccccacatttgttggattaccagagtaagtcatgtcaaaagtatgtctactaaaacggttatttttatatcatggtttaggtaatatcggggtatgaaatagcttgcaaaaaagctcatgagatccttcctgagttggtatgttgttctgccaaaaaccttcgagatgttgatgaagtgtcctctctgcttcgaacctccatcatgagtaagcagtacggcagcgagacgtttttggccaagcttattgctcaggcttgtggtgagtaatagtaggttacaaaaaataatccaagctgcactgatctaatgtcactgagatgtcttctctgtggtctaaaaatacgttttatttctttgacagtttctatctttcctgattctggcaatttcaatgttgataacatcagagtatgtaagattctggtaagtttcaaaaaatctattaccatatccaactagatcttacaaggggatcttgttctgtagtcttggggctttgacccagagcctgagcatgctgggaaagccctctgccgtgaaggcacattcccattccaagatcagttactttgcctggtcccctgcttcaaagttgttctactcttttcttaagacttaattgatgtccagtcttttgcctgcgtttctgtctttgtgtcatgtgcatacagttgcatggaggccaggagaggccatcaggtctcctggaactggaggcacgatggttctgagttaccttttcagtgctggaat

SEQ ID NO: 24260 - DNA, 1133 bp, Mus musculus
ctcaggattctgcaggacctcacgggctctactccttgtcagccttacacacatatgagcagtcaggtgacgtggcctttgctggggtgcagagtaaaaccgtgaagacagaaaagcctctgtcgaggccagatgcccaggacgagaagccatcggaaaatcaggatttatatctgaagtctagcatgggccctaaagaagacagcagcagccttgcatctgaggatcggagtagtgtggagcgagaggtggcagagcacctggccaaaggcttctggagtgacatttgcagcacggactcgccttgccaaatgcagttgtcgcccactgtggccaaagacggcccagaacagggctactcgcaaaggcgatctgagtgtccctggttgggtatcaggatcagtgagagccccgagccaggccagcggactttcacaactctcagttccgtcaactgcccttttatcagtactctgagttccgaaggctgctcaagcaacttggaaattggaaactacgattatgtctcggagcctcagcaggagccttgcccgtatgcttgtgtgattagcctgggagatgactctgagacggacacggaaggtgacagcgagtcctgttctgccagggagcaggactgtgaggtaagtggacgtgtgcgctcactgttcacacagcccgttcatgggagatgcagggggttgggggagcgagggaggaagggagagaccatgtgataagctccggctgggtgagatggagtgtgtgcatgcatcacacattgctgtgtgtattaatcatgggggagaacacaacataggcttgagtaacttgtaatcacatgttccagtagggagaagggacagcaagcttttcatctgtggttaatggtaacttttaaaggagactgtcatttagtctgtagtgcctgtagcccccaggttatcaaacctgagcccagtctgatatgtgagccgtggctggctgtgaatagctgcatgattgtggtgtgcaggaaagctttctcagaattaattttcaaagctattgattttatttattgttttggttttctttagccattttaagtatttgtttaatagatatcttaataatttagcatgagttacttg

SEQ ID NO: 24261 - DNA, 1187 bp, Mus musculus
gtggattatgtagaaactgaagagcagagacctatttgttaaggatttgttttacttaggtgcatatgtgtgtccttgtgtgggtatgtgcacgtgtgtgctggtgcccacatagagcagaggtgttggatccctggagctgaggtcacagtcagttgtgagctgcttaacacggggtctagacacagaactcagctctcctgcagggctgtagcaccaggaacttctgaactgttcctccaacctaaggtctgtgtcttttgtaatgtgctaaagtgtctaaaaaaatgtaacaggtgacttcccgtgtcactgacgtagtcagtcttcattgatctttatccactaatgtcttcactgatgttcataatgtgtatttcacattctaggtgaagctgccattcaatgcccaacggataatttcgctctcacgaaatgatttccaatccttgttgaaaatgcacaaactgaccccagagcagctcgactgtatccatgacatccgcagaaggagtaagaacagaatcgccgcgcaacgctgtcgcaagaggaaacttgactgtatccagaaccttgagtcggaaatcgagaagctggtaagtgtgtggctgtctcgggttgctaaagcccagacctttctgtttgtagaataaagagttacttaagttccaaggtaagattcagagttcaaataccatttaagagaaactaggagatgttcaggaagattagaagatctaaaatagggtctccattaattcttttgatttgtatgcattctacatttttagcatatactaaaaatgtgtgggtggggaagtatttctggatttttttttgagttttcaatttaatggctgttctaattcttagtggttgaataaagattaaagtaattatataatactttatgatgtttgattcctgtaagagctattttccagttgagtagaactgcagacctgaattacctgttctggtaccaagaccaagcagatgaaccaggctctgtctgccaagggagaagtctgatgtgatgtgatatggttagagtagaaacctccgctgccgccgtgtcatcctcagtgcacggagtgattgcctattggacctgtctcttccagcttcaaagcataagctcattgcaagattattaatttgcccacatttgtgggagaggacaatga

SEQ ID NO: 24262 - DNA, 1197 bp, Mus musculus
gcttgcttttacatcggttttcagtgtgtctgacgtgcctccaactgcaccacctccctgtgggcgagggagcagcgcggccagccaggagctggtgcaggagtccccgccaaccaccgcagctgccccagagcaggccacgctgttggaaccctgtcggcagagtgctgggatctcagacttctgtcagcagatgtctgacaagtgcactactgacgagtaaaccccacgggcagccttcagcccatggcctccctctgaccttcggcattgtctcgaagcctagcgtggccgtgtcttcttgcttagcagtcctgtgtcctcctggtagctttctgttgagggaatttctctttcaggtgatcctgcgttctccttggttttcataggagatgttctatctcttgaatgatgggaaattggatgtgaaaatatagaatgaccaggtaataatctcctagagttcaaactaactagagcagcggaagccgcagcatccatttcaacagctcggagcatctgcacgcagtcctcgtgggccgtggataacctactgatcaggaagaagagcccttcctatgcggagcagtggtgatctccccagaagtggggtacttcttgtctatgtggaaaagaaatctcctttgaactctaatgtcctgcacctcagctccttcaaagtccagcattggctggtgaccctgaggctgccctggcaggacctaggcagaagccacagctggcctgagctggaggcctctgctatcctcagtattgactaggagttttgactgcacaaaccagaaagtgtatcatcgttccctgttctcagttctgttcctctctttagtctccaccttgtctagactgttaggaactttctgtcccgtggaggaggagctgccccggagagctgcacactgcacaaggctgtcgatcatctcattgcaggtcgttgatgaccatgagggcattggagtcaatgagagggaaatgtctacaatgacctgaagagcagctcattggaatcccagtgaagacttgtagtctgttaaaaaaaaaaaagccgtgttggagacaaacacggatctgaggctctgccggtgtttgaaacggtaaaattcgggctcggttcggctcggtccgttaatgggtttgcacttgagagccagatttaatcctcttatttttttccta

SEQ ID NO: 24263 - DNA, 1099 bp, Mus musculus
ataccagatcatcactctgaaaacatactgaatagatgatatttaagaatatatttatagctttctgctaggccgttctccagtataggaggcagccatggcgcccagctggaatggcttgatcctgaagccccacttccacaaggattggcagcagcgagtggacacttggttcaaccagtcggcccacaagatccgcaggcgcaaggcccagcaggcgaaagctcgttgcatcgcccctcgccctgcgtccgtccccatcaggcccattgtgaggtgccctacagtgagataccacacaaaggtccgggctggcaggggcttcagcctggaggagctcagggtggctggcatccacaagaaaatggctcacaccatcggcatctctgtggacccgaggaagcgaaacaagtccacggagtcactgcaggccaacgtgcagctcctgaaggggtacagctctaagttcatcctgttccccaggaaaccttctgctccgatgaagggagacagttctgctgaagaacttaagctggccacccagctgacaggacccgtgatgcccatgcggaatgtgtacaaaaaggaaaagagtcatcacagaagaagagaagaactttaagccttttgccagtctccaaatggcccgtgccaatgcccgactctttggcatcgagcaaaaagggcgaaggaagctgcagagcaagacgttgaaaagaaaaaataatgcactgttggagagttgcaataaattttccataaagcaaaaaaaaaaaaagatgcatttatatatacatgtacctgtattgatgtaacatcaattaatagaaattaggccatgaatctgtaaaacaacaaggaagagtttatgggatggctgagaggcaagaaaagtgagaaatgatgtaattatattataattttaaagattaaaaattctaacaaacgtgaagaaaaagtagtaatgcatttagtcaaaaatttgtaagcagtaagtaagcacacagaatactccactggaagacaacaaatccacaggagatgaggaaagcttgtctatgaaaaaaagcaaggtgtttaaatcatgtaagtaaacagc

SEQ ID NO: 24264 - DNA, 1099 bp, Mus musculus
aaagacctgaattttatagtagctttagcaattatattttataagaatcagttatgactttatatttccagatagagagttcagaacaccatgctctaaagcctcccccaccccggcttgctttcctgctttcctgacctctctcccccccccccctttcgggtttccagggctttgagcttgatcttttgaaagttttattctattacagtttttgctattaccttctggttttcttaagaagctttagagtggtttctatgccctttgtaccactgcactgttcgtaacatctcggggtcgattgcgtccggatgggaaactgaagcagaggtgtcggatagtcacattttctggtctccctgcaacacgtccatcggaaaaaaaaatactggaaagtctggtgcttagagagggtgccattgtctcttgtatatacggtcatgatgtgtctatgtcaaaagttcttatatatttcttttataagctgaaagaaggtctatttttatgtttttaggtctatgaatggaacgttgtaaatgcctgtccaacaataaaagtactgaaaagggcttcgacttccctgtgccttttttgataaagggctgaagagctaagtgtgggagagagcaagtccaggagagaaaagtcctgtgattgtgtgtgtgtgtgtctatgtgtgtacacgtgtgcttgcactctctctctctctctctcacgcacacacgtacgcacgcacgctcgcacgcacgcacgcatgcatgccatactgtgcctgtggaggttagagggataacttaacagaaatgattctttcttgtcataccacgtaaccccagatactgcagttagttaggtgtagcagcaatgcttgttacctggtgagccattttggtggctgtggggtgggtgtgtgtgtgtgtgtgtgtgtgtgtgtgtgtgtgtgtgtggtgtgggaacagatatggaggcacctgtctgtaacctcagcactcaggaagcagtcagaagctgagtacacgtttgaggctggccaggaatgtattgctagtgagacccagctgcagagtgaggccctgcctcacaatgtaggaaaatc

SEQ ID NO: 24265 - DNA, 1311 bp, Mus musculus
agcagcttcaggctgcctccatcagtcagcgggcccgaggccggagaaccctcgatagccacgcctcccgcatgacacagctcaagaagcaagcggccctctcgggcatcaacgggggcctggagagtgcgagcgaggaagtcatttgggtcaggcgcgaagactttgccccctccaggaaactgaacacggagatatgacttccttgtccctgtagagaatatgtgtgtagatatgatgccggccccaccctcactccgcccaccctcctgtgccgtccacgagaatgtccccttaggtcgcactcttgacacagattttggcagctgacttgggtctgaagccatgtagccacccaccttcatcattcttaatgacaccagagagaatcgttcagaatcccagacaaacaagcttgagtcctttcctctgtgccaagggctttcttttatttattctcaattcatcggggcctgaagatttagaacgaagaaccgatagcgctagaaatcaaaccgtccccaccccagcagtcaaaacagggacaggacggtgtgcacagattgtcccagctccacctctctaaatccagtctcgcagctgaggaacaaccaccttcaaacacacatagagaaacggaacagatggaaacacctgtacagcgtgcagtgttctgactcctcccctcttcagcgtccgagaatatctgtgtatcttaagaatgtgtgaggaaagggtggtcgtctctgtacgatgagcctttattcttattttttttttcttctgttcatgtctatagctggtcttactctgtgtcagtgtctggaagctctagttttgcagagaattataaagatgccaaactcttggaaaagagatccaaatttatcacttagagggagagagaagaaaaaaaagaaacactattttttgtattttccttgagatgcaggggcacaaatagatgagaattttacagtgttaggtgtaactcagtctgaaaatgaggatataaccttttgcagagcaagcggggcacgatgactttatatttatacacaaacggccaacaagaagctcatgctaagaataaacttttctgagaaacagattttttttttaaatgtatgaatctatatttgagatgggagtttggttggattacagggacaggaaatggggcagtgtgtgcgtgtgtctgttgttcatggtgggggaggggagcctcctcatggggttgccatggcaatcattggttttcccatcaaacttgcatcttcatccacagatgacctccccttccctgagagt

SEQ ID NO: 24266 - DNA, 1205 bp, Mus musculus
ctagagttggatccccatagcccaccaaccaactctccctgttcgtagactcgtttttctgtcctgggttctagtgacaagcagagcctgataccatttcaggatccacgtcattgacattttttatgttggaaatctgttaactgaccacggtgtacattttctccttactttgtcttcccattgccttgaaagcccaggtctgcactccagcgtattctaagccctagttccagtctgtggtcatttgtggtccatagttctgaccgaagtccccctgttcctcccttcattcttctttcccaagcacatgtttatgaacacaccaggaagggagccgggacagaacacaagggtaggtccctcagtgcgtgtgattctgggaggatctgtgttgtgaaggggaggcagctatgagaaccggaaagggatgcttggatagagtttccaagaagccgctattcagttcttacgggattccttgtggtatgcatcttaatattttggctcaggtaattctttggtgtgaagttctatatatccctacaagctttgtaagacagtagtggcctgcccaatcccaagcaaaatgccctcagagactgcctctgcccccttcccctgaaaactctgccccagtcgagcatcatgggcaaggtgtgttaaaaggcacacgtgtgcctcgttcagctgtgcatctcagcatcagtgtgggaggaggggtacagagcctaagtttcttagaagcatcttaaacacgcatctattgtgttattaatatgctcgactgccacatcccttttctgtcgtgtgtgctaaggaacgagaggagagcttatttttgatggtggcttcttcaaaatgagtaactattgcggcataggatagagattaagaaatttatcaacagaacaaggctacttgccatagtaattatgcagaaaatcaacttctatgcaaattgtaaggattatcattagcatttgggggtctcctttcagaagttttaagcatatgtttagggccaggaatggtgatagaagcctgtcatgccatcacttgggtgacagtcttaagtaatgtagtaactagaccagccaagactatgtagcaagaccttcttagacacacacacatacacacacacatatacacatacacactctttcaaaagtctgtcgctcttaagttgtgttattagagct

SEQ ID NO: 24267 - DNA, 1195 bp, Mus musculus
cagctttgacttcttggccaagtgcccagatacattatggattttctagtggagacgctgggtagtggggccacgaattacttgcccagcgaagaggatggctttctgtgttctcagagattgaagagattggctggtttagatttagtgtggaatcagagcaggcagaaatctgctggttttcacggaccttcagtgtcattttgaattaagatgctgctaggtaactgacccgtcgctgtcaggaggatctcaagaaaacctggttccatgcagtaggtacagctcaagtctgactggaggacggctaactctcagcaccgcggcatattgtattgccgttttattcattattgttgattttctacagtgattgagctcgccagcttttcatcttacgtcagcgaaggtcccagagtccccatgccgtcactcactgctttgaacactagggtcattgctatcctttgagagggggttatggaaaggtgggactagatggcaccccaaggcaccggtgtcagccctttgcttcttctgtctttacaaatcccaggtggcagcccggactggtgagatcggagtgagaaggcgtactcaggccatgtccaggtctgcaagcaagcgaaggagcaggttttcttctctctggggcctagacactacctccaaaaagaagcagggacgcccaaccatcaaccaggtaggccccagagtcaacacagaggatccactgatgttgcttctgtgtcagtggatgctctcgagtgtgcatgtgtgtgtgtgtgcatgtgtgtgtgtgcgtgtgtgtgtgtgcatgggtctttactgacactttaaatcaacttgagactttagttctgagagacagtttttaataagtagtttatagcccaaacactgagctctgccattagtctgtcatcgacatccttctcccacctgtcctctccccaaactctgcttaattacagacctagtaaagaaagtgcagaattcagagtcctcagaggagagcaggctccacaggaagccaagtgagcattaaatatagtcttcttaggtcgtctctgatgcgggatccaaggcaacctccagggaaagggaccgtttccttgcttctgagatttggaaggtggccttacatgggcagctccttggcctataggaatgaggacccaggaacgtgagagta

SEQ ID NO: 24268 - DNA, 1349 bp, Mus musculus
acccattttttcctccctaatggcttaggggttcctttgataaagttgagccacgggccactgggaagtaagctgcacaagggaaatggattccaagcagagaacactaacatcagaagaggcaggaacaatcctgtccactcagcctgtcctggcggagtgcagccacagagcatggtcttcgtgaagcattctgggagcagtgtggagcgtggaagggagactggcattgaacacccgtgtttctggttcttggtctggaagtgggagaagaaggaagcctttacacatactcgccctggacttggaaagatccacgtcagcagccttgatctccacgaactgacctctcggctagcccaccaagtctgctcagatgatcagtggtcatctccggagggaactcacgtgtcacaggcaagccatgggatttgtcactgttaacaagacgatcgataatacagtgagctctccctgcttttgctgagaattcctggtcttgcgctaagtactttgaaaagctgtcttagatgggatgaagattttttttctcccaggtgttcattttcttctgtctttggtctcactgttgggtgatcgaaagagctgtaggatgttctccatttcccggggtagaccccgcctccatggagcctctgatcacctgggacttcctcagggaacacttgcagaatctgtcccttggagcagttggctatttaagctccgaggcggctttctctgagtcctgcgggtggcgtgtgtccccagtgcattctggaaatcctttggtttgcttgatgcatttgtttggacgtgacctttttctggtttctctttcctgggcttttgcccgctgaggaaatgatcttcagatcctgtccatctgcactggtggcagcagaagagagattttctcttctctgtggtccagatccaaaggccagacacctgtccttcagggactcgtgttattctgatgggtgtcgtttcctgatgtgtagacttaaagatgtctagttctgtaagtcatcaaatgtgatgtgagacagggtggggcgggtccttggctgatctgaggtgcttttattgattgtttactggacacacaatggaatgatttcttacctccatacctccgtccccagccggccctcagtgttggccctgtttagtaagtttttcctgtctgtgcctgattcatcccgagagctttgcagatagatcctttgggaacctttgagtttgagaagaaaaaggacagcgtttcttttaagttaatgaaaaccctctgcaggagaaacgtgtgcatgtgctgtgtctaggctgtgctcacggacacttgccca

SEQ ID NO: 24269 - DNA, 1196 bp, Mus musculus
cctcttctggccctcacaggtacttcacaaccggtgtatatacacggtgttttgtatacacgcagacaaaacacccacacacctaaaaataagtttaacaaatccctgatgtatttacatggctaaatcatctccagcaacaatcacgtgcagccgcaaaacatgctgagcgcgcgcgtctttcaggggctgtgttctcctgcaggagtctgttctcccccagagactttattgagtttcttgactgtcatgctctttagggtaattactcagtgtgtctgggattctagaatatcttaatttcccttacccaaggctttctggcgcgatgagctggttcttgttaattcctgtagcttcagtggggctgcgagtgttcttggaaatattggggagttcccatggatccaaggcgttatcggggaagttgggtttcccctctttgggttcttagtcttgctaatagaagacttttaataatggattgaaaaggaaacttcagggcaattttatgagctgaacaggaaaaccacagggcagtaagctgtaaaggcgtccacgggagaaagatgtagaagacaaacaccactctgttggagcgtggatctggcgtgggggccggctgctgggctgccgtggggactctggaggaagactgatggggaaacacactttgtaggagataaaataaaaaggaaatcagaaaggcgggccagttacccagcttcgtggcagggcactgcatggattgtgctggggagggaacagtacgctctttggtggaagaggtatttcaccattttctttagcctgctgaaggcccaccttcccaaggggtgggcgcattgggtaattgactgggctagagaattggcttttttttagtgggtgccgccagtaagctatctctacagaggtgcaggggccatcaggagaatgctgtgggctctgcatggtgacacgtggctgtcctaagctcactttgttgtttgtttgtttgggttttgaggttttgtttgtttgtttgtttgttttgtttttttgagacaggatttctctatgtggccctggttggccttgaactcagatctccctgcttccacctcttgagtgctggcctcaatacttctcataacatgctttacttaacctatttattttgcctattttgtttttctgcctaggctacctagggc

SEQ ID NO: 24270 - DNA, 1169 bp, Mus musculus
ggtggagggcaagagaagaaatctgacattttcttcatgtgctcgaatcgatgtatacagctgcatactccttgtatgcaacacacacagacacacacacacacatacatacacacacacatacacaccacacacataacacacacacacacatatacacacacacatacacaccacacacatacacaccacacacacacacacatacacacatacacaccacacatacatacacacacacacacacacacaccacacatacatacacacacacacacacacacacacacacacacacacacacacacacagagtctgcttgcaatcacttatactcccaacacttgccaggtagaggcagcgggattgggagtttaaggctagcctgggttatgtaatgagaccttgtctcaaaaaaaccaaagcagagccaaacagacgtcagcagcagggacaaccaaacccaaccaacccaacccctggcattcaaccaggctggaatggcggcaaggagattctagctggtaaacctataaaaccagtgtcttctctagcattttcttcttctgttccccagcgccgaggcaagtctccatgtgtgcctgctgctgggccacacgcactgccctcctgtgcactgctgactggggcagaggctagaccacacacactgccctcctgtgcactgctgactggggcagaggctggaccacaaacattgtcctcctgtgtactgctgactgggacagaggctagaccacatgcactgccctcctgtgtactgttgactaggagcagaggctggaccacacgcactgccctcctgtgttctgctgattaggagcagaggctagaccacaaacattgccctcctgtgtactactgattaggggcagaggctagaccacaagcattgccctcctgtgtactgctgattaggagcagaggctagaccacaagcattgccctcctgtgtcctgctgactaggggcagaggttcttttgtatgtttctacctgcccgttccagctgcctctttaaatggattctcaaattagattttcttaaaactgttttcccttaccctggcaaccaggatgaagctcttttttttttttttttaaataatttaagaatatttcctttgtattattaaatcttttctgccc

SEQ ID NO: 24271 - DNA, 1237 bp, Mus musculus
catgcagggggcggggtggggggtggggactgtctaatctccagctctagtaacaaaaataaaagaagtaaaaaataagtaagaaacgggggtgtgtctagagatagaacatgggctttacacattttagacatcatgagaaaataaagctggaaatgacactgggcatccatcttggcgcatctcaactttcacactgcaaccgaggcgcgctgtgcaaagtcagtgacaatccgcatttccagacacagtgggttcagaccttccaggcgcgcacgcgggcctcgtgttctcggtttccgcggcgactcggccgacgtcacagttagaagacaatagcgactttccccgctcaggctcctcgggaactttctcagtccgcacgctccaggagccggagctaccctccgccccgcccccagcgtgccccgcggccagggagctccacgaagggcgggcggaggccgcgggtagcgattggttccgtgccaaggtgggcgtggtcagactcaggcctataaaagctccgtggcgccagggcctcgtttttttgcgcggtcctttcctgcggcgccttccgtccgtcggcttctcgtcttgctctctctggtccctccggaggaggccgccgcgcgtctcccggggaagcatggcgatgaaagcggtgtgcgtgctgaagggcgacggtccggtgcagggaaccatccacttcgagcagaaggcaaggcccggggcgcggggcgcaggccgcggtgacgcggcgcacctgtgcgggagcacgccacgcccccgccacggcctgagcccgctaagtgctgagtcaccgtggcctggggcaggggctgggcgccgggaagcgaggcccggggcgccgcggggccttccgggcgggcgggggcctccccgcgccccggagcggctgggcctgcccgggagagccggcttggcatccgttatccttctggggctgctgcttttccggtgtccgtgtcccacaggctcagagccccgtggccaccggctgcgattgttgtaagaatatttgaacccggtggtgccagaccggactaaggccgcaggacgcgtttgcggcactttaaagcaaagtcctgggctgttctgtactaggtcagggtcgtgtcgcaaggcggaaagaaagagatggccttggacagccgtcccttgctttgcactccagagagagacccggctgtgggttttttctaccacagcgagt

SEQ ID NO: 24272 - DNA, 2243 bp, Mus musculus
tgatttggttttgtagcatttattgaagatgaactaatacaagtgccaaaaggaaccaatacagaaaatatcatggataacagtactgtcagtcactggcaaagtaaatcattgtataataggacgctaatgcagataatgaaaactagttgagattccatttgtatgtgaaaccttaggaaagtcctaaataaagaagggctagcctgtttttagaatgggggcctgggagcaaacctttgctaactcaggagctggcatactttactaaagccccagattatgactcttctcagagcactacctttaaacttgaagaactgtctgtcaaggtatcctgtagctacctgttttgaactttgtgtttccagacctttgccggtctggaaaagccatcatagttgataatgtatgtgtactttttcatccactcatacgtatttgacttagtcagattttaacttagttattgaactctagtgatgtgaaatagacatcattgttcatccacctgatgctgttttaatgttaggcatgttggagacctgggcaatgtgactgctggaaaggacggtgtggccaatgtgtccattgaagatcgtgtgatctcactctcaggagagcattccatcattggccgtacaatggtggtaagtttttcatataaggatatatacataggatttcttctaacatagttatgtaccttcccatgactttatggtggttaaactagtttctaaagagtcacataaattgttaagagttcagggtaggaaaaaagttcttttattggctgtgatagtaaagaattaatttgcctaggtcagttaagaacactgttgtgctgaaatgcagtagaaagcagttacatttgatgagactggatctgagttgaggatacaatagtctttagtctaaaacagccggattttcttgccatgattgcccccccccttgcaacatttcgttgagtctaaaatctgcgatggatggcagtattcaagtctgtaggttatcgcttggttaccatatgggagccgtcttcccaagttaccctcgggagatgcatctgggtcatgcagaacaccaagtagtaaaggctcttgcccacctcgggcagctaacttttcagtaggcacttccttccttgcagttgaccctttatccttagaatgctcttcagccctattggtgaagcagaacagtcattcataagtgttgtaaaataaagctttagagtcttgttgctaagtagagatacttagaattgcctcttatgtgtaggcctatagttctttcaacatgagattttgatagagaaatttgtaagaatgactactgtgtagttggggaggagctaagatcagcatgtacctggtagttacttgggtcttagtatttcatctagaaatagccactagcaaggaaaaacttagtggtctgctcttaactgctagtatttaagtctgtagtattgctgggaagaagtactagttacttgatcattcaaacctaaatgttcttcttttcaaaggtccatgagaaacaagatgacttgggcaaaggtggaaatgaagaaagtacaaagactggaaatgctgggagccgcttggcctgtggagtgattgggattgcgcagtaaacattccctgtgtggtctgagtctcagactcatctgctaccctcaaaccattaaactgtaatctgaagagttgtaactgtgtgactcctttgactgggctaaggacagcaatgacagctgatggagactgtgtacaactcactgaattcaaatctgtttctgtgcctttccatattttgccagactacacaggtgataagctgaaattctcatttgagcctgttagtaaatatgtgtggcacttattttgagcctattaatgtgtacaaaaaaaaattttaagttagctctatacattgagcatcaataacagactcaatgatgctaactcatagtatttcattttgaaagtgttttatgtgataccatcaaaatggtgggtggtagcccaaacaaaatttgagcagaaaattttctgccccttatcagagaaattattgaaagctctcaagattcagagtacttaaccttatattttaaaattgtattaggattagatgtcatgatttaagaaaaagccctttagtaaacttgtatcaaactcatagaaggcaaacatggagcctcagctagctctactagccaagtgaagttggta

SEQ ID NO: 24273 - DNA, 1142 bp, Mus musculus
gtgcagtgctgctggatgaagtgtgtgttttaatcactaatttactttcagtttgtagtaccacactgtgggtgggacaactggacaaaaggactactcagcaggatgttgccagtctcttagaagagtttggtccaattgaatcgattaatgtgagtatttattgcccttagggtgcggtgctaactaagcaagaagtgctcagttgttttgagactgaggccttgagctctcagctgcaggctcccttaacattctgtgcagaagattcctcttggacaacggtgcttacgttgaactacctttctaggagagtaacaaaatgtgcacacacggtttaagagcaaacttgaattgccagcgtctgaccccacaggttcttacttagccgtttgctggtggtgctggggctgcaaggttgtgcttgctacagtgcttgagctctcctgtggactcaaagcactgctgagaaggaagggacgagtgttctgacctgaggttcggttctgtcagatgattcctcccaggggctgtgcctacatcgtcatggttcatagacaagatgcataccgtgccctgcagaaactgagccgaggaaactacaaggtgaaccagaaatccataaaggtacattttatcatttacaaaagggtttgatatgtaaatatactgttgtggggggttttcttttcaacgataattttactgcttgggaatggcttaagacataaaagctaccctgtaaaaatacggtaacaacaataacaaagcaaaacgttattagttgacataaaattttatgtaacaattttctcagggtatttatttatttattttatttatatgagtacactgtaactgtcttcagacataccagaagagggcatcagatcccattacagatggttgtgagccaccatgtgcttgctgggatttgaactcaggacttctggaagagcagtcagtctcttaacttctgagccatctctccagctcttccagatcccacctccctccctgactctccatgccccttcatcccaccccccaaccccccacctgggactggaaaacaagcaataaaagagagcagaaaagcacagaaaacaccacaccctcctcaaaatcagaaaccaaaacac

SEQ ID NO: 24274 - DNA, 1099 bp, Mus musculus
ggaacttggtttggtcaaaccagagagagagggaaagtgcccgtgtctgagagtagcgacatttgcatgaggagaggcgttgtgggtttgcagagtctgtataagagcattagaaatggttcttgacgtgtttaccttcctttgtatttgctagctgtgtattctgtttatattccttttcattggatcataccaccgagaaaaggttaatttgagtttaactgggtaatagttctggtggattttttcccttatgaaacagtaattctctttaaaatcagatatgatacattatttctataaatatttattgtatgttcattttcttacatataacagagtaaaatagttcgtgtgctaaatctttggcaaaaaaatggagtgttcaaaattgaaattattcagcctcttttggacatggcagcaggaaccagtaatgctgctccagtagcagaaaatgtcaccaacaatgaaggtacagtgcatatctgccagtgacagaaggtcctgcaagtgtactggcgtctgtctgcttttctgtatgtgtgtctgtgttgtcctgtcccagtgtgtttgcctttgttttatcttattttctcttattgttctttagctgcctgtttgttttcaaagggtgtggattcagatgagagggagggagggtctcagaggagctggggaggaaagccatgatcagaacatagtgcaactggtcagcatttaacaaaagttagcaaaagcaagcaagcaagcaaacagaaagaatagaatttctgtatgtgaaaggctttgtttctaagctggtagaaattcctgtggaagatgacttgatttgcttttggaaggtacagtttttctttctgtatttttacttcaaatgagaatgccctttgtcgcttcatctctctctctctttctctatctagaatatgtcttagtaaccactatctattcattttcctatgtaaaactagacaggattttgttttagcagcaaaacttgaaaggcatcttaaaggggaagtatgttgacttgtgaggcctgatgccctttgctttttcaggctcacctccacccccagtaaaaatctcttctgaa

SEQ ID NO: 24275 - DNA, 1193 bp, Mus musculus
ttagtaacttcaggaagttattcaagactcagaatgactgaattgtaggaaagtgggttggtaaagtggctctggaaagttttggaagtgaagtcaaggatttggggaaacaaagtcctgagagctactttgaagtaacaaagagtgtcactattgacagatgtgacactgacagccagatagagagatggctggagcacgtgagcagctgctgcacagtgcgcagtgcatgtggcgagctgcgagctgatgtgtgacatagtgggtggtggatgtgcttgggctttgtcgttacttttcctttccttccctttccctctttcttttctttctccctttctaattccagacagttttactctgtagccctggatgggcaggaactcactaagtagaccagattgggtcagattcacctctggaatactgggcatggaggcatacaccattgcacctcctgattccactttccttggtctaagcttgtctcctcccctttgcagtgtaagccagaatataaggttccaggcctgtatgtcatcgactccatcgtgagacagtctcggcaccagtttggaactgataaagatgtttttgggccaagattctctaaaaatataactgctacattccagtatttatatctttgtccatctgaagataaggtatggttaaaacgtaacaagctaacattttgcattttgtccagcttatttcctctttatatttctcacacaatgcttacgttcacgttgttgacacttgttatttatgttactgggtgatatcttcatgtactgatcttgaattgtaaggtcagttttttctacggtggtcatttcctattcttgcttatatgtgaaatggagaagtcacttggcctctgtacaaggacttttataatgttgaatcatagaaggagccagagttatagatcctgagcagagcagagcagagcttgctggcgagtgaggagtgccttacctctgtgcatgggaagcctcttctaaacggcgtggtaacaacagccaacagctaggcgctgtacactacacatttcatgttacatatcctgcagttaaaagaaactagcaaaggttgttcaggaagcattatctttccttaaagaacatattgctagtgggcatggagacacatatcctttgatctcagcacttagtgggcagattgct

SEQ ID NO: 24276 - DNA, 1177 bp, Mus musculus
atctaataataatttaaaaaaaatgaatggcattcttttttgttttttgttttcttcatcgtgtttagtttctggagaatttcatgtatttattaaactaaccctattcctggtcccccccccatccacacccccttcagatggcactttaggtggtcttccagcctcacatacatgcacacacatatgtacacacacctgcatgcacatgtgcacttgtataaacataaacatgcttacatacatacaaagggaaagattattatattctgtatctgcgagggaggaggaggagggtgtgtcttatgtgtcctatcctgggggctggccttgaacttgctaggtattgggggatgaccttgaactcctgacccatctgcctctacctcccaggtgctgggatcataggcacacaccttcacgcctggcttttctggtggtagggatctaacccaggacttcgttcaagctaggcaagcactctgccaaatgagctgtatcctcagccccttgcagggtggtacgctaagacgcaatagaataggaaaatgtagtctcagaaaaatgcaggaaaactggtcctctgtgtgtggactcttcagttcggtgtggactcacactgactagtactgaacctgtgaccttctaaaatacagatatgcatgatatacagttgtcgttcctgttatgatcatgaaggatacagctttctgtctctagtgtttgggtagatcgagggtgttctgtaaatgtttgtcttatgaaaggagacccagggtacaaattgcttggtagggactaaagtaatacaggtggtgaggatttggtagcctggccaatggtttctctcatcccttcttactctctaactcaacatggctggagttctataccaggtatttgggctgaaactatgagcaaataccacggtcatacattctgcccagactgccccttccttttagtgggcagcatcagacggacatgggtttgtagtgaggtacttgctaaaactctgtgacaaactaggatttgaagatacaagttccagttgacctaatacttaaacaaaagcatacagatctctggtgtcatgtcagcctagttagctggccagcatgggtttaggctagcctgggcactacattataatctctcagagtctgggggaaatgtg

SEQ ID NO: 24277 - DNA, 2330 bp, Mus musculus
ccaaagtgctgagattacaagtatatatccgtgtctggctcaaaatagcaattcaaaaacaaaaactagttggccagatgaaaagtagttttaccaaattcacgtgtttttgtttttctgagaggctgcagctcagatggccgaaaggctggcttgggtggcaacaggaggaccacagtggcctgcctgcctaagggatagtagcctagccatcctgtgtttataccgtggcaacagcagaaggcatagaacttagctccagatggctctggagagagagaaaggattcttaaagcagagttgagacagcaagaagcagggaattcgctgtgtcatgctgttctgccgtggttagaacttagctgttctgctgggagctaggagcaggcttgccgccccctgggaacacgctcacaagacggttcgtccccaaaggaaacagtgccccccaaacaggctttcagtccatgctgtaatctgcaccttcccctccaggattgaaccaaagatgcatttccggttttgtgactgtgccactctgtgtgtctcttgtggaacctggtgttgtctgatcctgtccggctggcgctggatggaggactgtctctgtgtgcatcgtgggccctggtacttagcagaggacaaagggcactgttgtcaggaggggaagacttggcacgggctggaccacagttagtttagaagttatggaacagctcagaatcttctggcctttgactatttcagatggggtcagagaccagagctgtagccaggaagccaggttcatcatcttggtccatcgattctaaagtgggcaaatttctgtgacgtcacaaagccggcctttgccagtgagggctgagacacagtacaactgcctctcatttactggtggcgggcggcttcctttggcctctcagagctctgactgaactagaagagaacacggatttggctgaccctggaagaaagctgctctagtcctggctgaatttggtaagacctggactacttaaactttagggagggactgactccctcccgaggacccattacaggaggaggccaggcttttctcccagagctgatggtgttcttcattcagcatggcttccgttcagctcccaggacttgacactgaaaatagaactctttaagcagagagaagaggagagccatccacagacgctctccgtatttgatgtgacgtgtttgagctttgacgggtgaagagtccttttaaaagataactgccagctgcaggcatctggctctgcaaagctggtaggatgtgtacctgtgtactgtgcccgccccctttctcctagccctttatgtctttttctgactgtttgcttttctcgtatgtatgtgtgcctgtgttggtgcgagcctgtggagaaagagtctcccatccttcaaatgcttcgagaacagcgtcagatgtacaactagtttgcctgcgttgctactggtaccttggactctgaactcaggttacccacctgagtcctcagtaggcagtggacccattgagaggcaaatgagaacaggagggagacaagctgtgttctggggcgcacataaacacctgacagacgagtctaggaaaccgcgtgaaagaagaaatgttaaattctttattgttttattatatttatacggaaaatgtggctatccttttgttaagtgcagagtgtattgtctgtttgacccatgactgtctgtccttcatgaatgagtctttgcctgtgattctagtcagcctgtggctactgatgggaacggccgatctgtcatcatgtgaagtccaggaggaagagtctattttagtcatacgatttggtcatgagtaaggactatatttatgtcaccactattgaatatatgtacttttataatggctgtgaaatacactttttcctcacaatggctgctgctttgtttattgatggttcttaaaacattgagtctaagtaaggcgcagggtacttaaacctcttggcacagacacaaatgaggacttgggagcattttcaaccacaggagcccctggttaatctcatccccggggtgggggtggggggtgtttacaaagggttatgtggctatgcgctgagtggaagctcaacatggctccccaatgtactgttcacattcaaaggtcaggatttcccaagttgaaccagagacagatggatatccatgaatcttgcttctggagtcagtcattattttaggtcctggatcaggggaaggggtggatatctgttggggcagaagtagattcgccgtttggattttctgggtgtgacaccagtcacctg

SEQ ID NO: 24278 - DNA, 1167 bp, Mus musculus
ttaaaggcatgtactaaggacttgtatgtattccatacggatcacacagacctaagtctttggatgtgatcccttgccagagtagccatgtttctggatttaaaaaaaaatccctctacacccttcaaacacagtacatatggcttcaagtgtcaagctttggactatgagtatcctcctagctcatacacaagtacacaagtgtaacctgacaatattggagaactagcccctaaggagttgttcccaactaacaggagagcagttgatgaataatagctgtgccccctctgctatcactgctatctatctatctatctatctatctatctatctatctatctaactatcgtacaatcctcttcagatgattagccagtgttttctggaatctcctgggaaaatcagttttatggcttaagttacatagttctcttgctggataaatcatggtaaccaataaagggctccggtgagatatctagacccttccatgatgtgctttcctacatgtacattctgattaagactgttcctgcaatggtcattaccaaggcttttagaatgcagtttctcacttgctgtggacatgaacataaagaaaaattcccatgaggtttttcatatgctacttgactagcatttaacctgttgggaacatgtgtaaaaaaaaaagaaaaagaaaaagaaaaaaaatgtttttgcagttgcagagacccagagccaaatgttaggtggagcccagagaatcttgtggaagagtgggaggaaggattgaaggagccagaagagtcaaagacaccacaagaaaatctagagaatcaactaacctgggcccatagggactcacagagactgaaccaccaaccagagagcattcgtgggatggacctaggccccctacacatatgtaacaaatgtgaaaattggtcttcatatggtacctgtaacatcaggagcaggggctgtctctgactctattgccttcctttggattcctttcccctaactgggatgccttgtttacgctcaatagaagaagatgtgcctagtccttctgtaacttgataagccaaagcaggttgttactgatgggaggctgccccttctctgaggagaaagggagggagtacaggaaggagagatgagagggagggactgggagaa

SEQ ID NO: 24279 - DNA, 1162 bp, Mus musculus
catggtagaaaggatagcacaaagtggagattcatttttatccatgtgctcacctgtgcttacacaggttttggcagagcgtatctggcagttgtgcaaagccctggtgcattgtgggtgggtggtttgctttccatctgagcaagtgcgcatcctaatggctttgtctgactccccagctcctgcagcgttcctggtgtctctgtatgttaaggacatgtggctgggggcccagcagccagataccttccttgctcacatccgaatggtctgtgaggctgcaaaggacgtgccacttgatgagcccgaggccattgttgtgctctgcaggaacgtggactcctcagcccagtgcttgactcgctcccgctgaacagagccccagcgggttccaggaagcttaagtgggttccgagacagacataaactgatacatgcaactattttccagcaagaaagctaagaggactttattcagctgaccaacaagtaagcccttatagtcagatctagtgactgaggcactgccaggccgtgaggaccatggaggtctcagatgtctgccgtcccctcccctgaaggccctgacagaggagctaggtgctggttggtcatggattggtattaaaactgaaatgtgaaagctcttgtgtcttcggttgtacatgacacatgtgtaaagttgcctctctttgctgttttatttaagaatgttgagtccctaaggtagaaacctctactttgggaagacatcctatttttttaaagttatatttcaaagaggatttttgagttttataatgttttgataataaatagctatttttgtgatttgcttttgtactttgtttcattttacaacctatttttattccagagacctgcattctagttcagaatttaacttttatggttcactgttactaggtgttgtccctgataaaagtcagtgtgcaatttcatggatgtttgcagataaaacacttgtatacgcggtcccttgggtttgatgtgccacttgggagctggtgatatagtttgtctgtgcagagtgtatgtagtactgagaatggcttggtgttgtttacattgttctgtgcatctgtgtgtcatcttgttacacaggcatgggtatataaagacgagggtcatttacctaaag

SEQ ID NO: 24280 - DNA, 1109 bp, Mus musculus
ttaaataagaaaaatttaaaaacaaatttcatgttgtcacaaattaaattaaaattttgttgggaaaccataccacttactttagggttgtctggcacattgctgttcaacaacttaggtcctttggaaattacagtttggtgtttaaccttgtaatgtagcaagagctattaaaagatcagagagctctttcctgcgctgagcatctcgggctttgcctgtaaggtggtactgcacagggcctgcctgagctggagagggattggcatccgagggtagagagcactgtgtctcttccagcacagttgagattccaggtctccccagagtgcctcacttttcctcttccatgtcctgagccctcacttgtctgttaaaagtgtgtgtgaccctgactgccttgggctgctcaggacagggttagtttctgctcagtctataacgttgacttccaaacaggcccaccttggcttctgcccagctgatgaacttcttttggacacttgaatctgtgctgagttatcgggccaccatcataaaattattcaaggacatgggccgattcactgtgaacaaggtggcactttctaccaaagatgtcctgatcctcttacacaagtggagcctcattgaaagagacacgaagctccaaggagagctgaaagcagtcattgagcagcaccaagccaaggacctaatgagtaagtccacctccttgccgccccagctgcctggctccacctggagcagccagcatgcctctccttggctagttccagagctgacagggcacagacatggatatgaggacctaggtttgattccagccccattgcctaggggtcttgtttgcctttagataagactatacccaagtgtgttagctttctgttactgtgacagagtacctaaaaagataaatttacgggatcaaggattttatcctttgtgtgtttcggtccatggttgcttagccccagtgatccgggcctgtgttgttgttgtagactgtgctggtggaagcctctgggagttgcacacttcacagcagccagcaagtgggaagagggaggagaaaagggagtccaagcccagatgcagcctttaag

SEQ ID NO: 24281 - DNA, 1232 bp, Mus musculus
caaccgtgtccaactcagttggcatgtgcttggtgctcctgagagcagtgtagactgctctgaatgccaggacacagttcctgcgcactcaaagtaacactgtttagagatgaagccatcaccccagactactacacatcagtgcatgttgctatgtcataaactgctaagctgaagacagaagattgttagatgcaaagtattggtacagatagtttaaaaatgcactccacactccatgcaggcaggaatatatatgctgtgtattgtggtgattgtggtggaataattgggaagattcttagactttaaaatcttaggtttctttaaaatggtggggtggtagatcctgagcctaagctctgtgagtcgtagaatgatggtgattgtggagatgtgtttattaccaagggtgcctgtgaccatgggaaggtggctggatggaggcccaaagcccaaccttactcagaaaagatcgttgcagcttccagggctcgctgcagggcacccaattgtgctgtcctgagactgtgtcgccatgatgtttatatctgtggtgtttcctgcagaaaccctgctggacctgatgtccacagtggtgaggctgtgcccttctgtctgtcagagcagccactttgctgtgctacttgggacctacagtgccaccctcagtgtgctgggtaaggaggacctgatggccaggctgtgtggcggggctagtgcggtggaccctcttgtgtagttgaggggctcagcttcctgaaagtggcctttatttgccctctagaccagaagattttacttctcctccgtgcatatgaacagaacaacctcagcctcatcagtttcaggtgagtgttgggttgacaggtgggcatgaggacagggcactgggcaccccaggccacccgtgcagccctcaccacggagcagattcgagcttcaaactcgaggcttcattccttttgttgttgttgtttgaaaattttattagcatttatatttccttatgttatatgcacgtatgcatctatgtggcatgtccatgtcacagtgcatacttgggggtcaagaacaaagcctccatgtaaatgtcagcaggagccagactcacagcatagcactcgccatgtctcatggggctctggagagctgtaggggattctagggcggcacatggttataggcctatgtacgcagggtgggctctccaggtggtcaggatcctgaaa

SEQ ID NO: 24282 - DNA, 1145 bp, Mus musculus
cttttctgtagggtggaatttatgcctgtgacatagcagagcttttcagggagcagaggaacaaataagattaaaaaaaaaaaaagacattttttattggtactttgatttttttcttacccctcccccaatctttgagagcattctattttgaatcttcaaaatcttataaaacctgagcctaggagatggctcagtgcacaaaggcactgcctcagttctgcacttgggacccatgtgaaggaggaaggagagagccgactccacggagttgtcctctgacctccacatgcatgcactggcagtaatggatccatttgttcctaaaagacttaagaactaaggctttagaaagtacactgtaaaatctcccacatttacagatatctgtaagccttgccaagtagagaaatgtcagagcaccagaaacatctgtgatccatgtgagtgggcagcgagcagcttcatgaacaaatgtaatctacagccttgagctagaacactccacactgtataagggagagagacaggggaaggagaagggactcacactgtgtatacaagagacagggaaggagaatagactcactggggtcttcctaattcagacttgaagctaaaagctttcctcagaatattgtcaacattagagagaatattgataagaaaatcctctgtacctgtgatagaaagccataagtgtcaagacagttagggtactctgtctgtcacaccaatggtaccaaggtgacaaacaaaagcacatgctaacaagagagtgggtgtgtggtgcacagctcacagcagccttaactagggagccctctacagcagccattgggcagcgctttggtaagaacactatccctgtgtatttggaatgacaacattcctggaacttaagagcttcaagccagagaagctgcggcagttgtcttggtcatgtctgaggcattgtgagatgtagtctgtgtgcacttgatttcagaagaagaacatagtttggcacacttctatttgggtctttttttaacccttaaaatccataatcttttagaatgtgagcatgagaaaggttttctccatatcattgggaaaattcagtttgcagaattgcttctgtaaatcagatggataacattgtt

SEQ ID NO: 24283 - DNA, 1197 bp, Mus musculus
tgtaaaacctgctgtagcgtccacgtcttcttctccatacgtaaaatccatgcttggaaggctgtactgcagattctctaagttagtgtaaaatcaagaacaaattttatctcaatataatattacaaattttgttatctctttcagggaaaatataaaacagatagtaaaacttcttgcaagcgttcgggctttggatcacgctatatctgttgcaagtgaccacaatgtgaaggaagtcaagtctctgattgaaggaaaatagatctgcgaccaaaaagtgtttgctttgctgccatttccagtgtgtacattttgtatatatgtaaagtttcttaaactgtaatatactgattcttgttttaatacaaaaacattatattaataccgtgtccttaaatgtgatttcttgagaatgaaaggaactcagattatttctaggagtctatggatgtttctttactgcctgtcatattttgtttatggaagtattttatatggtcattaaattaacttcgtttacgtatgctctataaatgatgagtgtttagtgtaagttgtataattttgcgtgtctgtgtgtgtgtgtgtgtgtgtgtgtgtgtgtgtgtgcatgtatatttataccaccatggattttcatgctggaaattttgcagtgtttttctacagaggaggctttttaacagcaggaacttacccaatagcaatcatcttagggaaatactgcactgcagcagctgaagggctggcaggtgatgaccttcaccccccacagtgactgctgtcactgtagttgtgctgccttaaaatgaaaactgaaataagactttgtcgttgagtgagtgtgggacttctgggagtctgccctggaggcagctgtgggtttaatacgagcctgaggcgacatatgcagtagtgtggggtaggatgagccacaaactaactgcatggcctgggctgactgacctttctcactattgtcttccctgcccagctatagatatgcatttctttagtctatcctgttttgaatcccacatatgtgagttatatatgcaataaagaacatgccttgctgatcagacacacccaggcaatttactatccatggtattctgtaatgtttctaccacactgtaaatactcagagaaacttgttttaaggttgatgctttctgattctgtgattttcag

SEQ ID NO: 24284 - DNA, 1129 bp, Mus musculus
aaggacagtgtcatctttatctgtttaattgtaagctcttatttgcatttattttgcatagttttaataggcataaaggaaaccgtgttttgattttttttttttttttttttttttttttttggtttctcatttcttgtcagctatttaaggaaaaaataaaagaactgtgagctgtagagtggtttggagatgtgcagagcagagtttagggcttgttttcctgctgctcatttcagtagcaaaaatctacgtgaaaaatctgcatgagctttaagtggcaccattcgctgtgtgagttcatgccacctgccagttccttggtttttgttttgcttttcaataattagtattttccagaatgtcttaagtagaaatgctctactttaagcaagtttgtagagttgctgacatctggagtccctaaaagagttgtcattgtatcagtgatgtaagggaaacaaacgcctcttagttctcatatacgtgcagggagattccatacttgctcttctttttaaaaaaagttttgttgctgtttttaaaattatgtggatttgagtgtgtctgtgtgtgcagcaagtgcagtgagtgcaggtacccttggagggcagagacatagagcccttggcctctcagggagggtactgggacctaaacgttggtcttctgtaacagcagtatacacttttaactgctgggccattcctcctgctcctgatcttatgtcttttacgtgaatgagcacttaatgatcaccagaaaggccaaggagtctgaggaaacaataggggactccagagctaatttatagccttggggggggggacagtttatgaggccctccccttcctcccccctttagatgtggtgctgcagactgaatgcagggcttcctacatgcaggcagccctgccagctgacctgtgtcctcagccttggtaaggcccagggtggggtgctgtgaaggaaataacaagaaccacttctttgaagctaaaactatgatgctggaatacaaatgtaagcaggagagacttggaaactaacggtagagcatgagcaccgagtcctcaggagagctgagaggtagccagggcgctcgatgtgaagagtttcctactccgca

SEQ ID NO: 24285 - DNA, 2032 bp, Mus musculus
agaggaggagagtgtgggcaccgagagcggccaagctgtgctctccaaagctccctgcggggggccatgcagcgtgcctagccctcctgggaccttggaagacgggacctgcttcctgggaaatgaaaaatatcttcagagcccagccctgaggacagagccagctcttctctgctgacaggtgctcggcccaggctgggggccgtgtggaggagacagacttatctgaagtggctgccagcttctgctgccagctggaagccctgggtgctgtttgtgccacagatgaggctcactgatgtcaggcatctggtggttctgtctcggtgtttgtcctctaggtgacatttagaacattccgatttttaatcctgccgtagcccctcagtgtgtcacaggtaccattgtctacagccgcgcttcctaacccatacctcaccacagccgtggcttctgaccagaagtcactgaaaccatggagaaaggggacactaactggaggagctggcgttgtttaagatctcagtgtggcctgggtgtgcccgttgtactctagtacttgcagaactagaaaatgccagggacaaaaagcaggcatgaaccattcagtaagagagaagctagtgaacctgatggtgaaagaagaccgtgtccagtcagtgtttgtgtgaaggccctgtgctgctctctgtagccttcccgtggtacttataaaaccaggccgaaccctgtcctctgtccggcactattcaggtcccttcccagctccaggtacttaaaaaacaaagtgttgggtcctggggtgagggaacagcttcgacggcacagtgctgcctgcaggcgcctataagtgaccttagatgaatgctccatgagcatcttcggtaggcaggacatccagcagtgctggtggctccagggcagactcagttgcaggccaaaaaggaagagagaggagtcatagccctgccccaatcgagcttgttgctcgctgcactgcgcctttgtaatcaatcttggtttttttgttttgttttgttttttttaacttttaggtgataacatattctcagatatagcacacaagagacactacacaaattacgtctgaaagttttgatagaaaagagcttttgactggggtagacagcttgctcctcactactaccttgtatctcagtctcctcaacagagagagaatgcagattgattttcatcctgagttttattttcttgcccggtttctgggttcgggtgtgctttcaaggctctgaacagcttgtctgcccacaggggagcccggagacccagccttttggctaaatgttgcaggttcctgtacttgaaggactccagctcctctgtagagggcatggtcatcgcggtctgcaatcacgctgatacccagaaaaatggccacacaactcaaatctggtgccacgctttaataattctacccagcacggcccagccctgttcacggcggaaaagctccttctgccaggacagcctgtgaagaaacaagacctccgaggacgtggccaaggaaggcccagatgctagcgggaagttgttagttggcactctttcatctctcaacaactgtgacacaggtcttcagggtgaagcccaaagcagctatcggttgcagcagcgggtaaggagggggcttcacctgagcctggccttctgggcgagcagttctacctgcacacttcaagacagcctccatgacccttttcacggcacaccgcctgcttttggtgtgaccggggtttcctgtgcaggcacatgttcttaaggaatgccatgcacacaggcctgaagagctggctcagcgggtagagcacaggttgctcttgtctgggatctgagctctgtccccagcacccacagagtgcttctggttgcctcagactccaggggtgcacaaggccatgtaagcaaagacatgtaagcaaagacagttgtacacagagaagtcaaacctttttgaaaaaaagaaacaccacgggctggagagatggctcag

SEQ ID NO: 24286 - DNA, 1141 bp, Mus musculus
ataaaatacagagcccagagcctgtgatgcttcagatggcctcggacttctctggagacctggggaacgtgttaacaaagccttccctaaccccatggaagccgtgtgtccctgtgtgcattggtcctttggtgtttgcctccctctgtattgcagaagctctttgagcagggtctcagttcctccctgtggccccccagcccctgtgacagtgcagcgctggcacagacagtgcccacagctaccgaatgaatgagatctgaaattgaagcagatgactgttctggctgtttgtgtaatgaaataaccacgtttgtgtgtttctatgcatcacctttgtgtctgcatccttttatatttttgtctggagccccactgttgtatatcgacaaacctaacacacaccggaaccaggactctggatctcaggtgctgctcctttaaactggaatccgtgaggcagaggtgccgtctacaacccgttcctgacagcaggacttgcattctggcattctggatccacactgctgtcccttccaagtgttactgtctctcattcctctgtctctgagatcccttctgctctacctcaagagactaagagggtgaacacagtttgtacttttcatcttccttacagagaaggaaataataaattcatatttgttcccaagaaatgctttgttgattgataatagtgacaaattccagttgcaaccaaagtttgattttgggttttttttaaagatgctcctgcctcagctctaggtgctcagatcactggctgtggcctgactcttccaaggtgaagaaacatcactgcccaaggtcaggcaccagcaatagactaaggagaaggtgccgcctaaatcagcgttctcaacaggtgggttgtgacccccttgggagtcaaatgaccctttcacagggatcaaatattagatatcctgcatgtcaggtgtttacattatgattcataacaagcaaaattacagttaagtagcaatgaaaataatcttaggttggtgtcagtacaccatgaactatattaaaggctcacaggatctgagaaccaccgctggatgtccagcttgctgagccagcgaattcattcaggtttctcacaagagctcagacaagg

SEQ ID NO: 24287 - DNA, 1226 bp, Mus musculus
aggattaggaggccacagcggcttctgtggaggatttggcagcggtcttaggggccacagtcgtggttgaggctgtggccatggtcgaggccgcggggctcgtggaggtaaagctgaagataaggagtggatccccatcaccaagctgggccgcctggttaggacatgaagatcaaggccttggaggagatctacctgttctccttgcccattaaggagtctgagatcattgactttttcctgggtgcagtcctataggatgaggttccgaaaatcatgccagtgcagaagcagactcaggctggccagtggaccaggttcaaggcattcgttgctattggggactacaatggtcaggttggtcttggcgttaagtgctccaaggaggttgccactgccatctgaggggccatcatcttggccaagctttccatcgtccctgtgtggagaggctactgggggaacaagattggcaagccccacactgttccgtgcaaggtgacaggccgctgtggctctgtgctggtgcgtctcatccctgcccccagaggcactggcattgtctctgctcctgtgcccaagaagctcctgatgatggccggtatagatgactgctacacttcagccaggggctgcactgccaccctgggaactttgccaaggccaactttgatgccttctccaagacttacagctacctgactgctgacctctggaaagagactgtgttcaccaagtctccttctcaggaattcactcgtcatcttgtgaaaacccacaccagagtctctgttaagaggacccaggttccagctgtgcctaaaacataagagtttttatacgagaaaaataaacgaattaactctgttaaaacaaacaaacaaacaaaaacaaacaaacaggaatcttttccctcgaaatatatatttttatttggttactgttcctctctgtgtttggaaaggatttacatgaagctcaaataaatcttgtttacggtccttctcgcacttgtgggaggagagtccctctccagcgtgcatccgtgtgcacttgcgtgtgtgcttacacttgtgtgtatctgtggtaagtgcacatgagtatgttttgaacaagacgtgagctttgacctgtgaaaaggcccacagagcagagttgctgagaaaggacagttttggtttgtttgttttttcagtctcagcctcggtgtcattgcatgtagcttg

SEQ ID NO: 24288 - DNA, 1175 bp, Mus musculus
agagtctcctctgcaagggaagacaatgacttcacagtgccatcccacacttgatctctatatgaggcttgtgctttctaaggcagtgtgcaatcgcagctccagtgctctgggctatggggagaccagcagagcagtgtattgccacagtaagaacacattttgcatctttttttttttttttcagaattctaaacagtcctgattatatttataatttttttaaaatttattttatgtacatgagtgctctatcagcatgtacacctgcataccagaagagggcatcagatctcattacagatggttgtgagccaccatgtggttgctgggatttgaactcagaacctctggaagagcagtcagtgttcttaactgctgagtcatctctccggccccctaattatatatatatatattttttttttaatttgtttctggcatttcatttctactcacactgaagttgaaatgagagctacactgtagctgtggtaaaatgttctgtttaaaagtagaaggtggcccctactacttctcgtctgtcacatcagcactggggaggtggaggctggagaatgggaggtttgctacagagaaacagaacagtagactggtgatctgccatgagagtcaggtggagagctgctccgtgagaaagaactgatagtaaccacggctgcagaaactgttctgcccagttgaacaagacttaaaaatgctatatttctatttccatcatatttttttccatgcatgctttatcacaatttaggggggggggaaatgaagccaggtgtggtaatgcacacctgttaactccagcactgggaaagtgagggaggaagcctgaaaacccaaggtcaccctcaactgcagagcaagtctgaggcgcacctggctcaaaaaattggtttatctttaaaaatagtatattacctctgcaagacgcacatgatcaaataagagctgctctcagtataggcaatgtagtcaggtcagctgggaagggtaggaggcacacttgcgaggcacgcttcattgcctcttcctgctctggagttgggtgggtgcagacaggcttaaaacatagtgagcactgtagtggaggtgaaaaccaagtgtgtgtgtgtgtgagagagagagatctcttccaccttatcctttgagagagg

SEQ ID NO: 24289 - DNA, 1136 bp, Mus musculus
gcgctctatgatgtcagcttatgagcgctccatgatgtctcctatggctgatcgatccatgatgtccatgggtgccgaccggtctatgatgtcatcgtactctgcagctgaccggtctatgatgtcatcgtactctgcagctgatcgatcaatgatgtcatcttacactgatcgatcaatgatgtctatggcagctgattcttacactgattcttatactgattcctatacggaggcatatatggtgccacctttgcctcctgaagagcccccaacaatgccaccattgccacccgaggaaccaccaatgacacccccattacctcctgaggaaccaccagagggtccagcattatcaacagagcagtcagcattaacagctgacaatacttggtctacagaggtgacattatctactggagaatctctatcacagcctgagcctcctgtgagtcaaagtgagatttcagagcctatggcagtacctgctaattattcaatgtcagaatcagaaacttcaatgttagcatcagaggctgttatgactgttccagaacctgcacgagagcccgagtcttcagttacatcagcaccagttgagtctgctgtagtagcagaacatgaaatggttccagagagaccgatgacttacatggtttctgagactaccatgtcagtcgagccagctgtgttaacatcagaggcttctgttatatcagagacatcagaaacatatgattccatgagaccttcaggacatgctatctcagaggtaactatgtcactcttggagccagcagtaactatttcacagccagcagagaacagtctagagctcccatccatgactgtcccagcaccttctactatgactaccacagaatctccagttgttgctgtcacagaaattcctcctgtggctgtcccagaacctcccattatggctgttccagaactccccaccatggctgtagtaaaaacccccgctgtggctgtcccagaacctcttgtggctgctccagagcctcctaccatggctactccagaactttgctccttatctgtctcagaacctcctgtggctgtctcggagcttccagctttggctgacccagagcatgctatcactgcagtgt

SEQ ID NO: 24290 - DNA, 1121 bp, Mus musculus
aatcttggtccagaggttggcatgcaggagactctgttgcatccaggtgaagagccacgtgatggaggacacttgaaaagtgacttgtatgaaaatgagtatgatagaaatgcagaccttactgtaaacagtcatttaattgttaaagatgcagagcataacacagtgtgtgctactaccgttggtcctgttggtgaagcaagtgaagagaaaattttgcctattagtgagactaaggaaatcacagaattggctacctgtgctgccgtcagcgaagctgacataggcagaagtctgtcttctcagcttgctctggagctggatacagtaggaactagtaaggggtttgaatttgtcactgcatctgcactcatttcagagagtaaatatgatgttgaagtatctgtaactactcaagatactgaacatgacatggtaatttccaccagccccagtggtggcagcgaagcagacatagagggacctttgcctgctaaagacattcatcttgatttgccatcaactaattttgtttgtaaggatgtagaagactcgttacctatcaaagagagtgcccaggcagtggcagtggctcttagccctaaagagagcagtgaagatacagaagtacctcttcccaataaagaaatagttcctgagtcaggatattctgccagcattgatgaaattaatgaagctgacttagtgagaccattacttcctaaggacatggagcgtcttacaagccttagagctggcattgaaggacctttacttgctagtgaggttgaacgtgacaagtcagctgccagtccagttgtaattagcataccagaaagagcttcagagtcatcttcagaggaaaaggatgattatgaaatttttgtcaaagttaaggacacacatgaaaaaagcaagaaaaacaaaaaccgtgacaaaggtgagaaggagaagaaaagggactcttcattacggtctcggagtaagcgttccaagtcttctgaacataagtcacgcaagcgcaccagtgagtcgcgttctagagcaaggaagaggtcgtccaagtccaaatctcaccgttctcagacacggtcacggtcacgctcaagacgcaggaggag

SEQ ID NO: 24291 - DNA, 1186 bp, Mus musculus
aatggctggcaccgagtgcccaaaacccgaaatacagatgtggcagcggcagaagctctgtttagcaggccattatccgggatggctaagctccgctagctaaaaagttacttcccattacttttgctttccagttttagaagccaaactgactgaggagtggaacggttcgtgtgaatggaggaggtgttgagtgagcaacacgcagaagctcgcctacagtttcgtttccattcacgacgtgttcactgatcgccaagagtgtactgcatatacgcaaagacacagacaatcttcagaaatgatcttttgccaccggagcttggaaattaatgagaatagctggccattgcctgaaaggaacttctttcgcatcaacatttcgggttttggctgtttggtaccagccattggcgataatggccggccattatcagttcttcctgcggttcgggttttggcagtaacatattttaaatatacttatttttgtttttaaaaatttgatcttttgaaattgaggcttttgggggaagctttgttttactttaatatttttttgtgtgtgtgagggaagacgctgaaatattgctgctaggatccagaaataacacagtttcatatgctgaaacttgttattggctggccttatgccagcctgccactgtcaacatactctgttccattggttacatgcttgatagatacactcttgtgtttttggctaattgagctttttaattctattgtaatattttcaattgataatagatgtgataaattctgcttgtatagacaggtctactaaaatttactcttaacctttttataaatggaatctgtcctttgcttctgagaaaggaattgactttctgtgttggactgcatcaattgtgccctctccatcatgccttattttccattcttaagttacagtcctgaaataaatttaaaaaaaacatttatggagagagatgttactatttaccctgccacaaatgtttaaaatcttttatcacacatttgggggttataaagtttaatttgtttcttcacttagactcattatagtataaattataacttcaaaaagacctagcaaaaagcctctattgcttacttaccaaatgcaagctctttctctaaagctctgtgaacgcttagcgtttgctgctgtttgcctcat

SEQ ID NO: 24292 - DNA, 1653 bp, Mus musculus
gtatgtttttcttgaataggtattgagaaatggaagcccttaccagcccaattgtatgtttttcttgaataggtattgataaatggaagcgcttaccagcccagctttgccagccctaataagaagcatgctaaagccacagcagcaactgtggttcttcaagcaatgggccttgtaccaaaggacctcatggctaatgccacttgcttcaggagtgcctcacgtagatagattgaggttttatattaatcattcagataattttactctgcatcacaatgtatttcctccttaatgttgtaaatatttcacaatttaagacattgtgtaaaaagcaatctgtacaaacatctccaggctttcgtttttgtaccatggaaattgtatttaaccatacagggttttggtatgtttatattgtttaccttagtgatgtatttgtttaagtggctaacatccaaacaattgtttgagggcatcagtaatattcagtgtggaatgttaaataacgcttttatactgtattttgtactatgatgtaacttcccttccttacggctaggctgctgtaacacttgcctgtaatcagtgaagggctgtgcaccttgtactatttcacaatgggttctgctggacagatactgggccagtgttattaaggcaatgaagcaagatctgttccacagggctatgccaccatctccccctttttgtagagattatgaaaagaaagtgatacattgtgtcatgatcagtactaagtcctgcattcccattaaagccacttgacttgggtcataagaaggaagtcaaaatggaagtccaacttcagaggccaagtacatattagtatggcttcagttgtgatatagttttactttgatgtgcattttgaatttcagctacacctagatagacgtaaataaaaatgctgtaaccgacttatctaataaaaattggcacccagccgctattttgttgactgaggaagtttatgttaattttttagggtctgatagaatattcatgtgtattacagtggtattcatatgctatgtctctaaactttattttcaaaagcttaaggcccaaatacaaacttctctggaataaatgttgtgtcttattctctggcttttatggaacacatataactaagcactatttgtttcttacccaattcttgtgatttctatgcacgtttatttaaaaatactgaattttatacacacatgcaaacacagattacctgtaagcatactaagtagtaagttgacatggctgagggcccagcacttagatgaagtacaaagtagcctcccctctgacttgacacagaagatgaacatacgtgagagcagaggaactagaaatcattagtaaaaatgctcatttccctacgtcttgaaagaactcactgctcgtctaaggtacaatgtggatgctttagtctccattggaataattgctacaggtagtctgtttctcaattgtaataaaacactgacttttctactcaggttaacaataagttgcagggatagaactcttatttgaattatctgaggtattaaggaagctccttgcatcttcatctctgaaaatgtatgaaaataataaaagcaaaatcttgatttaaaacctaatgctatt

SEQ ID NO: 24293 - DNA, 1273 bp, Mus musculus
atctgacgccctcttctggtgtgtttgaagacagctctggtgtacttgtataaatcttttaaaaacaacaaaacctcggagttcaagaactaatgtgctttatggatgtggacttgtgttttcccagaaagttgctcgtgaggaccttgctaattgtgggctgcatcctaaaaccctggagcagctcagtcagaggccagtgctggggaagtcatccctgcggagtgtggaaatgagtgactacattttaagttggagatcctgaacaccaaagtaagcctaaaaggagtctgaggaaaaagcttcctagcaaggaaatgcaagatgcgtaggcccctggcttttaaagttcattcggaagaatatattttaaaatactgaaatgttcctaaacatttttatattaacttattacatgcaatagcattaggttttaaatcaagattttgcttttattattttcatacattttcagagatgaagatgcaaggagcttccttaatacctcagataattcaaataagagttctatccctgcaacttattgttaacctgagtagaaaagtcagtgttttattacaattgagaaacagactacctgtagcaattattccaatggagactaaagcatccacattgtaccttagacgagcagtgagttctttcaagacgtagggaaatgagcatttttactaatgatttctagttcctctgctctcacgtatgttcatcttctgtgtcaagtcagaggggaggctactttgtacttcatctaagtgctgggccctcagccatgtcaacttactacttagtatgcttacaggtaatctgtgtttgcatgtgtgtataaaattcagtatttttaaataaacgtgcatagaaatcacaagaattgggtaagaaacaaatagtgcttagttatatgtgttccataaaagccagagaataagacacaacatttattccagagaagtttgtatttgggccttaagcttttgaaaataaagtttagagacatagcatatgaataccactgtaatacacatgaatattctatcagaccctaaaaaattaacataaacttcctcagtcaacaaaatagcggctgggtgccaatttttattagataagtcggttacagcatttttatttacgtctatctaggtgtagctgaaattcaaaatgcacatcaaagtaaaactatatcacaactgaagccatactaatatgtacttggcctctgaagttggacttccattttgacttccttctt

SEQ ID NO: 24294 - DNA, 1175 bp, Mus musculus
atgtagggtatattctactacctgggctgccttgtctggcctcagtgggagaggaagtgcctagtctcgcagagacttgaagtcccagggtgggggatactcaggggatctctgctccctcagaggagaaggagaaggagggtggaagatgaactgtggaagcgggtaacagggagggggccactgagtgagagagagggaaagtgaataagtaaaaaaaattatacagagaaaacccaaggtggggctcagggtgtgccctctgctgtttgtacatacactgtgtcttacacatgtattcacacattttaaatatgaaatgatataaaaaaaaagatcaagtgcagagtcaggcagagctggtaactgttgagtggccacgtgatgaacggaaggtagaagagaaacaggacctgtgagagcgagcgagcggggactggtcaggaggaaggcaatgtgtgtgacctgtgtgtgttttctggtcagccccaccgctgtgcttgaccttctgtgtgcttcctgagtgcctgtggacagaaacagggacagaagagacaaagggaggactgcagcagcttcggcgcccacggtgggacagacgaggtactaatggaacttattaatgagctctttcttcttgtcctttgtcataatagttcataagccagaaaaggtgtcatggacggaagctgctggcgtcatccgggacggagtccgagcctgcacagctctgtattatctttctcaactctctcctggaaagtctgtgctgatcatggacggggcaagtgtgagtcccagttgatgttgtttaaaaaaaaaaattagtccaatataccataaacatggggactgtagagaagttgtctacagatgtccttcttttctttgttttttttttttaaagattttttattcacgtaatatatgagtacactgtagctttcttcagacacaccagaggagggcactggatgccattacagatggttgtgagccaccatgtggttgctgggaattgaactcaggacccctggaagaacagttagtgcccttaactgctgagccatctctccagccccctgtagacgtccttctttgtcattaaatcattagatttcttttccatcctccccttttatccttgtagacagcttttataaatagtacgtaag

SEQ ID NO: 24295 - DNA, 1223 bp, Mus musculus
ataagttagatatattgggtgtgtttaggaagtacctcttaacactgtaatagtataccagcttttaaagggttctcccaacaatgactcttgaaaggtacaaattagacacttaaagtttatcatttaccctagcctgtgacaacccaattcctttgagtcaaacttgagagaaaaaagtacctgagatctgcaagtgttgttgcctgtggtttgtttctcaactgttggtttctcaggcgagtgtgtctctgtatgtccagccttgcacttgccgctgaattcttctgtccattgaaggataaagctgtcagttcctgtttctgagtgtgggaagtaaatttcattatctacaaatttctgcatgtcagcggatttagtggcaatcataactgtttctcaatctgctactaaggaagagcagattccctggactgttggagatggttttgtttctaaccctgaagccagcttgttctacttactcattcttgagcatggaaatctagagcctcaccttgtcttacttattacactttggagggtaattggagacttgtgtctgtggaagcttgagatactgggctgagctaaaccagaatctaatgagcaacgtgattaaataaatcagtagccaagagaagtaaggatatttacattttacctatttcacagggtgttgttagaatcactataaatagacttaaaattgtagcatgtatttaagtttttcacacgagtgctatataaaaagcaaggtgttagcatcccattttctgtttttgacactagaaatgtatgttgtattctgtaatttcctgctatgtgttctaataaacgttttgtatttgtgctcttggttaggatgctattctatctagccttctgttctatttttagtccttcacgatgagtctggacatagctaagttaatagcaaggtaattgaagtgtgtgtgccaagtgctcgcctgaatatcctctggcttctccactttcagggttgagttactgtttacagtgacacatttcaccatgactgggcagtctgattccatttgcttgttgtctggccatcttgtgcccagtatttgtctagctctacatctctactattcatcccgttaatcttaagtttcaagaggatcggtttaaccgggaaagattagctgtctaatagtcagaactggattgttcatgccccggggcaggcattggagaac

SEQ ID NO: 24296 - DNA, 1148 bp, Mus musculus
atattccgaagatatggcctatacacttgaatgtaaatccttttaaaaactatagcaaagcataagatttgaagtattccaactagttccagcaagtatgtaaggtgtaaattttatctacaagccagatactggcagtcattggtatgcttggacataagaacagacacttacagcttcttaatctggttcagcagcttcaaccactacaggtgtagtggtcttatgtcctgaacagcaggccagtgacttagaggagtaaccaggctgtgcttgtctgtcatccgcgcctgtgctcacaggtgttgttgccatttttagtatattagacacaatgatgagcctgaaaacatagacatagaaaaggattatttgaactgagtggtaataatgatttaggaattttttatgtgtttatgtaacatacatatgaatacacacataaacatatgtaacaacaattagggaagaaaaggaagggacaaatgatattctaatgatattataactcaagatatctaaaaatacattataccaggatgaaaaacaacaaataagtcagagagagcaaatgctataaagctctttcaaggactgtgcacattcctgcatcctaactgacccatggcacagcgggcagcaaatgcacatggctgctgcgtgtgccaacatctgttctgaatgggtccccctcaatgtcctgctctgttttcacagacagacgtcttggtgtcttcaaattctggctccttagagtgtgttaggatgccagctggcccatctgtagagtgaccctctcttcctctgagtatgtcccggtgacttagctgacacagctggctagacatacactcctttcctttcacataatctgatgtatatgttatcccgtgctttcaaaaaaacaaggcctgcagttctttgtgtagggttgaggccttgagagctctcctccatccacgtgagcacatctactggtgtcattgttgttcagactaggtttaggcagccatgttgacgagcctgaaacacatatacaaacaatattaaagaaactgagcaggttatagttatttaggaatttgttacatatatatgtaatataaacatatatacacacatgtaacagggaggaaaagaaagggaca

SEQ ID NO: 24297 - DNA, 1175 bp, Mus musculus
gtagttgcagtgttcagcccctggccttgtccaggttgtagtgtgtttaggacacctatggagctttgaggggagggggaggtcttgtgtggccaagccctctgcctagaaccagtgcttagaagatagattgtggtgcggtcactccttagtccccacccccaccccgacacacaggtgtgtacgcatatgcatgtccccacacatttacatgcacacgcagtcaatggtttcatgcccactgtggtgtctccctctccttgactgtgtgtgctgctgtagtgctgtttaaaggaagcttgcttctttttcagcctctagatgacgctgttctctctgagttaaagacggtgctgaagagcttcctgagtccaaaccaaatactgaaactggagatcaaggtgggtctgcatgattgtggagtgttagtgctgaggcccggcttacacataccgagtagttcccacctgtgtcttggtgccctgcctacccccgatgcctgtctgatagagcgctgtgtttcacgtgtgcaacctgttttctttcctagactgacccgtcaatcatgggcgggatgattgtccgaattggggaaaagtacgttgatatgtctgcaaagagcaagattcagaagctcagcaaggccatgcgggagatgctctgagagactgtcacctgtgtgagctcttgtccttggagcaacaataaaatgcttcctgaacagagggcgtgaggagccttgtcctttaaggggcagcaccaggtctccatcctcctataggaccctttagagtgtccagcttagacagttcctttgggctggagggctcagtttgtatgtgtcattctcaggaagtcattgatagagttagcattgtgcctacagatacagtcttgcactgcctatcaaagtcttgtgtccttggaggtagctgagaactggtccctaaccagtcataatgaaggcctccctactgaaagactctcggtcctgacagagctcctaactgtagggtgctctgactgtcgagactaccgtctatgctcctggcagtcttatgatttgctcagagtaatgtggctatgcagcaggaggtgaggcccagggtgccagctcgacatctccagccagccaggctacacacaaggcccttgtccctttccccagtgtccct

SEQ ID NO: 24298 - DNA, 1222 bp, Mus musculus
cttctgggtcaggctaggcacacacagcaaatgcctacatagcccttcggttccaggcttgtttctttgcggcttggtgcagcagtcactccttagcaccccgccttcctccctggagacgcgggcgaggggcacacagcagccagaccgcatcgcaccgcaccgcaccgcggcgcacgcgcactcgctcgcctagcacccgggaagggagggtgggcggggaggcctggaaagttccaccgggttccagagcccaaggttggtaggcgcggaggcggcggggagcgggtgcgtgccgagcgaggagacggcctccgacgggctgctcgagaccgtgtccacgctccgcaggctcgggggacacagacacggcccgggagggcaagcaggaagccgttgaggtgcaagtgcaaggcgccctccgggagaggggcggggcggtgccgggtgggcggggctctcggtgggcggggcgagccgtctgcgcagctgccggagcctttaaacccggcctcgcggggtcgcacggtgctttcgccgtccgggagctgaccggccgtgttcctctctcgtcttcctctgcgccccgcgtccccgccctcgcgaccccggctctcctggactcggcgccgccaacctgggcgatgccccgctacgagttggctttgattctgaaagccatgcggcgggtaagtgaccttccctcagaccgagttcccgcgcgggcgcgccccgccgcctctaggcctcccagtcccgcgtgtcctgcctgctggacaccgggtcctctcgcgcggtgcgcgggtggtcgcgggcgcaaagtgggggggtggcgcgtgggtcaggcgctcggcgcggccgcgtgcgcgcgggaggcggggggtgtgtatgcccgcgcgtgtgcgcggtcgcgggagggggtgtgccgagcagggggcggggcgggcctcggaccccggctctccggagtccgatggaaggactgcgggaggacacacgcgcgagaacccaggccagccccgctctgcgcccacgcgtcgagaagctgctcgtcgtccccgccggccgctggtcccgatcgcctgccctcagcgtccgcgatcagttacagccttcctccaaagcccgccagtgccggctgtgtacccacgcacttgtcaccgctatcacaccaaaaagaaaaaaaaaatcttttgacctttctttttctgactccagcgga

SEQ ID NO: 24299 - DNA, 1222 bp, Mus musculus; identical to SEQ ID NO: 24298

SEQ ID NO: 24300 - DNA, 1100 bp, Mus musculus
ttagttgctacaaagagaaacacttgtaccgttaaggtacaaggctggtgcataagcagtgatggactgagacctttctcatgaagaccatctcctgatgtggtactgttccgttgcactgtcttgcacactgtggctgctcagctaactgctttgactcctaggagtgccgtgagcagaggttctgtgtaagagcgtcactagtgccaagtcccacacttcatcatgggtttcaggtcaagttctcactctcctgtgctggcaataaggctttactactgactgatcttgtaacagtgttgtgaaattgatcgttcatgtttctgtctccgctcctttataaaaggtaaggtttagtttgaatgtaagccactcacttttctggcaaccagcaaccgttgacctgtagcctttttctcagaaacaaagaaaagatgtgctgtgtgtctttactcgtcagcagtgcatgctgcatgtgctgcagatggcctgcttcctctgtgtgtagaggagaggttttctgtgccaggaacggagctctgcgctggcacccccccccccttgtttcacgtccagcagtgtgtgtctagggaaatgctagtgattttcctgacaacacaagttgacagtgtacccacagcataaatagatgaattcaccctactttcctagtgctgctagatatataaatttatatataaataacacacatacatttaatgttcaatttatcaatatagcctaggcttctgaaaatagaatgctattagtaacttttgtgtgtaagtgggtgcgtgcgtaatttggagatgaatcgggctcattgaaatctttaaatggcagatgctggtatacaaggttttctgtagtataatcaagttttgagattcgtgtttgggttggtgccttctgcttaccagtattgatgcgctagttcgcacttgtccctttcttagtagtaagctttctctgttttaaacttgcaactagtgaggggaacaagtacaaagtgcacatttctatacttttatgcagtcttttggttcaaggaaacaaggcagttgagtatctgtattaatgttatttattcatctttattt

SEQ ID NO: 24301 - DNA, 1051 bp, Mus musculus
gacagaaacagagagagagatatcaacaaggtcttggtatatgatacatcttagaagagttcacatgaacactgatggaaagatttttcccctccagcaacaagctaggcgtgtgtacccataacagaattttacagcaggtaacctggaggttgcaatgtgggggtgggagctgagggtaggagtgtgtgaggagtgtccttggcttagtaatgtgtgacagtgtagagcagttaacctttcaggcctaaagactgtattctgtaactttaagagtttattacaactttatgaaatacttgttaaaatttctttggcagaaatgtttttcgtggaaacctgctttagttagactaagtgaaatgtagttgtagcagtgtaaatatgtataatttcctaatttcactgtgagatctcagacttttgagtggcaaacagatcactgagtcttttgctaatgacttgtctgtggggtcagtaagatgtaaactctttatttttgtttaatagcgaccaactgtggtgctgtgggatgatggtatggagccattactccactgcccttgttggttttgcttcactttgagggcctgcaaagttcagacccagcagggcttcctgtcccttgctcagctgcctttctttgtctggaacggttgctaatcaccatataaactcttaggcttttctgctttgctttgttgttgttttgttcttttccttttttgacaagatggatatcaaaaatagttgctgtgcaaaagttagtagtcttcttcaagaagaaaacagttccttttctaatactatcctgtgaaattgcttcacccattcctttattttaaagccaaatgtcagcagaatactgctgtttttatctaaataattttaatatgtaagtattaatgcatttaaaaagatgtctgcgttgagaaatacttcactagtgtactgcctgtgaaaactttgttcagatttctggctaagacaccagtcagtatactggggctgcacattacatacatgtattattttagtcaggtattgttgt

SEQ ID NO: 24302 - DNA, 1163 bp, Mus musculus
tgtcagttctcgttcctacaggtgagtgccaggtccttttcctcactgtggaaagtggctggctgacttacggcctgactgtttctttcaggtgtaccaagccactagtaaagtccttggaaattagaagaccatctaataaatgtttccacagaataatcaatagatgatataaaatccgttcttgttgatagggtagaaaattctacatacacagtcttacaactgttcttattccctgtgcctggtgtcacagccttgctgtgaagggggttccggctaatttttactggggcgtaatgataggtgcagtctggaaggaggctgggtgtgcccactgcacttgcagctgagtgtgagtgtgtgaggtgcccgctgcacttgcagctgagtgtgagcagtgatctctgggaaggtaaagatcacaacgctgagcagagagggcgtgttatccttcagatgcagcattcacctgtccctgtctgttgcaggtatttcctggtggatttttatgctccgacaagtgctgtggagaacatactggaacacttggcgcgagacattgacgtggttagaccaaatattgtgaaacaccctctgacccaggaagtaaaagagtgtgacggcatagtcccagtcccacttgaagaaaaactgtattcaacaaagaggaggaagaagtgagaagattcaccagattctggccttatatttaatcctaagggcactatgggtgctgctaggttgttgtctaggatactttagcccatgaccattttgctgcaggaggtagaaactgctggccgagacctgccctgatgtctctgctgagatttcatcccacttgtggggtttgtcgggagtgggggtgttcacagtaccactgtagcgtttccaagagcaaaatgtttgtcattcacacttggttgtcttgcaagcctatatggaacactgggagcagagtaataaacatgactttatcaacactgacggctgtattgcttctcccccctccccagcacagtgtacccccaaagctggcagctccagttgtgctgtgacaccccaaactgttattcgcaccctgaagtttgggatctgggtgagtctgctgctggactactggacagtctacggaatttgtgctttcttctgtccatggg

SEQ ID NO: 24303 - DNA, 1428 bp, Mus musculus
aagttatccatgaggaggcacaagggcagactgtgtctggccaagcaaaccctggtgtccctccaggtccctgccctccatgctcagggacaagccgcggttaccactcaccatgctcttgtctccttcccccaggagagaagtatgaactgcatgcagcgacagacaccactcccagtgtggtggtccacgtgtgtgagagtgaccaagagaatgaggaggaagaggaagagatggagagaatgaagagacccaagcccaaaatcatccagacacggagaccggagtacacacccatccacctcagctgaaccggcgcgcagactgagacagcgctctgaatcccacgtgtgggaaggaatcttttactgtgcaggtggctggccgtggctttggagggagcggccgtgaccactgtggcagaaattccagttcatgatgctcagaagagagtcaaggcctcctccccttgttctgatgctgcccctcagtccatgtccacggcacctgggactgtcttgggccattcactgaatgtgtggcagtcacacaaggacactggggacatcctgagaaaactgatagttcttgtaattgctcatttctaggttctgtttttggcaaggacaggttgactggtggcccagggagagatttctgtttccaaccagagttcagggtgcagcccccccactggtaggcagaggcacaccccccaaagccaccaagtgtccagtgcagaaaggtggtgggacaacccccgaaccgtgtggaattgtccttctcgttccttccccatggtctgacgttcatgcatgtgtattactgggtcccaggaccagcctttgttcacgtaggaagttacgctgttttccatcttgggaagccaggaaagttctggaacactcttaccacgtgtcctcgttttctctgcacatggggtcgaggctggagacatccacacgtcaccctgcctggtgcattgtgtcacttgtgcttccctgcaaaagaagttgatcttgagtccccaagtagaacttagcctaacctgtgggagagcagcagggttgctgccagccgtctgtctgggctgggaaggtttggtgtgggtgcttgcgttcagcaccggtctccgttgtttccttcatgtagtggtttgtgtgtgaatttcatcccagacagtctttgggaactgttggttgagacagtttttcacccccattgaaacgtgaagataaacttgtaaatacagccaagagcatatcttagtacctgtctgtacctgggtggaagtagagggcagagggagtttcaagctacctgtgacttgtgtgtggtagaggttactgtcatgtgtttaatggggtgaatcagagcatgtggagtccgtcgtagccatgtgttcctagagggacacagtgcctttcc

SEQ ID NO: 24304 - DNA, 1176 bp, Mus musculus
gtccacactcccatgggagtcacagagcactccgcaggctttcagatgctttgctcagatgacctcacagaaaggttgaggcagatggggagtgccccacctcagccagcacagctacacgggtgtgcacagagtgataaacgacctggaatttctcggtaagtgtctgcattggaaggaacggaactatgagccttttatggaaccaaatccctgagtccctcgcctgtgggagagtgcagtccatgcccagtggtcctcaggagccagcggcgcacccacagctcttctgccagcgggactattgtggtccgttcatgtggagccaatattttatagtttaataagaaaatcttgtgttaacatttaggctttctgtttctgagtttgaagcagggtctcaccctggcccagactggtttggaattcaccaggcatccagcagtcctcctgtctcagcctcccaaggtctaagtcaccacactaggcttagaggctgggtcttcatgtcctcggaactgcctacgaatccatgttccagttcttctcataaacagactcctgaagcggtgcagaaaggggcaaccctttcccgaagtggctggttcccacgggtctgctttcacagaggctgggaaacaccctagtcattttgagcacttagggtcaattcccagcgcccacctggtggcccacagacccctggaactccagtcccaagggacctggtgccctcttgcctccacaggtaccaggcatgcccacagtacacttatgtgcatacagccaaaacatacacataaaatttttaaaaataagattgttttaaactaaggctatttgagccacatagaacttgctcaatatttttaccccttggaaggagatgtaactgttctgagtgcttttgtgtttatgcacagagcattagaatagaatcaaacacagacaagataagcgggcaggtcactgtttccggattcaaaaatagtcccatcacagctcacaaatatgttttagggatcatttttcattgcactaaaaataaaagtttcaaagtagttacttgccaaaacaattcctagtactggagagaaccgggtgggactggggctgtctcctctgtttatgctggtcatggtttcaacacagtcagctggctttactggacatggc

SEQ ID NO: 24305 - DNA, 1148 bp, Mus musculus
tgcataatacagcatatgcataatacagtatatacataatatagtatatgcataatacagcgtatgcataatgtagtatatgcataatacagcatatgcataatatagcatatgcatatcctcccgtgtgctttaagtcatctctaggccacttacgctacctggtaggttgtaaatgtatataaatagttgttatactgttattgttgttgtttttaaatggcaagaaggaatggtatgtacctgttcttgcaagtgcagtttttctttatgaaaaaagaaaaattattctagattgtccgaacctgtacatgtgcaacctgaggtactgagggccggcagaagagagacgtgcagcatggaatgtaaagagaatcaggtagtcgcgacaggtggcagacctagtgacagccaggtccttacagggctgcacactggcggctcaggatggaactggctaactgggctggcctcaggagttccacaggaggtatccagaccagtagccatgaacagcagctagaagctggagctaggagaggaacccctgtgaggagctgcctggcaagtgcgtagatctgaagatgtgaagttggggtgctaaaggtcacaggaaagagcctggccttccctgatccaggggagcccaagccagatccattggcaggatcagccttccagggtctggaggagggctctggggacagtgtgggtgcagaaagttactctgagcagtcagttcaaggggcctacggtggccctgcacaggctccttagggagagttttgtgtccagaatccaaaggagtagccatgctgatgtgtggatgggtgccagagtgaactaggaaatggccggaaggagctccagtgagtgctgaagggcagggtgctgggctgcagcggtctgaagagcatccagggaagggtccccagagggatgcagtcagatggtactctaacttcaaagttgggtggaaaatgtcccatggggaaggaagatgggtgggtgggagagggaacagggaggcaggccagggggcttgtcagattgctggaaaggagggtcctttgtgcagaggggtggttctgaggagacagacacgggacctctggaggctcctcccctttctttccaccctctggagc

SEQ ID NO: 24306 - DNA, 1154 bp, Mus musculus
tagcttgtttcagggcaaacaggctttgacttaagttcttggcattttaaagaggttagtcttttttttttttttgatagttttcataatcacctggcttgtttttctcttctcaagtatcagtttaaaatggagatgctgttttatacttatagaatactttagaacagtattagagggtatgaagaagaaattttttaaaatcacctaaaattctatatattttctgatgacaatttgatgaatgtttccagaatcggtcaatctttcatgtatgcctgtgctcatgcgtgcacatacatcacatataatttcattcatttgtggaatggcatttgtgtaagaaagcaatgaagggatctcctggttccttaaaggttatcacagaagacttaaaacaaaggatttagccctgctgagccacacaggggcttggagagcctcttgcagaaccaagggacagcaggacctaggataatgggaccagggtatcttgcttctgctttaaggatgttgttgctctgagcccaggtgtggaggagagggttccccgtgcctttgggtctactccttttctggaacccattgttctcactcccccagagggactgtgctttcctggggactcttcctgtcagctctggcttggagactctccctgccttatatcacagtgtaaacctacaagtcctgctcatgtcagtgcttcagtgaagatggtgtacccgaggctagctcattcacgtcttctttctatctcattgctgttctttctgtgtcaacctgaggcgaagcaggaaaactgaattccagatgaaaatccagaaagtcccactcttaagcttttctggaaaatggtcctttcctgagaagttgaggagtttctggtgtgcttgtggcattccctccatcattcttggggccacccttggtcatagtgaggcctgttccagcctaaccatgaatgaggaaatgtgagcttgcaagctctgcaaggcttgtcccttcaccaccacacaccctacaggaaacatctcttgtacacttggctagagcgctgggctctggaacctcgtgcttcataggcacttgggtgagggtaccagtaagaccccgagattaggtgaaaaaatatctcgaaaggaaacaaagtc

SEQ ID NO: 24307 - DNA, 1118 bp, Mus musculus
gagacagaagcagggcagggcagagcctcccttatctgtatgttgacttttaggtagattatgctattttgagaaactgtctcagttttttctaaaaatcagaataactaatataattttgtgctgttattacctgagtcctaaatctagggcctaataccatgtttacctctgaactatgcccccatctctgtagactgtactattttattaaggaattatgtgtttgttacaaagaatgtactttctttttttgtttgttttgtttttgttttttgtttttgtttttccgagacagggtttctctgtgtagccctggctgtcctggaactcactgtgtagaccaggctggcctggaaatctgcctgcctctgcctcctaaatgctgggattaaaggcgagagtcaccatgcccggctctttttaaattaatatctgagtaatgttgaacaaacttgtgaatggttgtttagaaaggaagcatttgttctatttctttgcaggcttactgcagcattttataccttaaaccaagaatgcagatcatcatacgtggacagaaagtgaagacacaactagtttcaaagagtcttgcctacattgaacgtgatgtttaccgacctaaatttttagtatcctttatttataatatgtaagcatagcaaagcatattcaaaatcatttgctatttttctttttatccttataacagttttttaaatttcatttgtgtgtgtgtagatcagaggacaacttgcaggagtcctttcaccatgtgtgttccagggattaaactcagtttgtcaacatactggccagcatctttattctctgatctatctcaccagccctctctcatagagttccacgctccagattgcttttctacatctactttaggtgtgattctggacactggctgattccaagccctcttaaaaatatttatttttattttatgtgttgagtgttttgcctttatatgtatttgtaccatttggatacctggtgcccaaggagatcagtagagtctgtcagtcagatcctgtggtactgagatggttgtgagctgagaatccaattgtatccaagacgaggtcatctgtccagccctgtat

SEQ ID NO: 24308 - DNA, 1362 bp, Mus musculus
cctagcacttgggaggcagaggcagatggatctctgtgagttcaagggcagcctggtctatggagcaagttccaggacagccagagctacacagagaaactgtgtctctaaaaaccataattaaggaacaattcagtttattttcatcagcgggaggttgaagtccaaagccgctcttgatgaatattgtcactgtcgcactgctgtttgtccgggggatagcaagtgggaagtaacatctaatttgtatgttgaaccacatgttttataaaacttgttcttggacttagcctagcatctagtgaatccattggctgttaattaaatccagttctttaattggtagtggtggtggtggggttcttttcactttattttcttttattcaacagacatttttatcttttcacttttaagttccataagagaagtcatttatattgtaattctcacctgattagccaatgcctgtgtttgcagcctcaaacttcgttctcttcgagtcaacgtaggacagctgctggctatgatcgtgcctgatctggatcttcagcaggtcaattatgacgtggacgtagtcgatgagattctaggacaagtggtggagcagatgagcgagatcagcagtacttaagtgcagacgtctggtgatggtttcagctctcacgtaacgcgtgccaggtcacagactgaagagcggcatctttctgtattctatgcattcgagtgtcccaggcactgtggacacacaactcttgacataacctgtgaactgctggggttgagcagcgtaatagcgaacttagcctctgttctaaatgtcaatatttgtattaagtccacaaatatttttttattgccctagagactggtgtttttcaccaagagcttttcaggttgttacaatacagtttgtgcaatttttctggctccctaaatgtatttttctcaaaatcgagggctgtgccatagtgtatgtaaatggataagttgctactgttgtttccttaaatgagcataagacaggatttgaaataatgtcatggcactcctagcggggtctgcttgtaagggaattgagcattactgctgttttctatgaaatcctgtctctgacatgattctgttcatagagaggaaagccaaagctagctgagtttgcctggctttttcttgtggtaagattgctaattgtcaagtaaaaagtgttttccaggacaaagaaaagatctttaaagtgttaaaaaatatccagtgacaaccatgtttactttgaagcccatttttggctgttgattcagcatgaagtgggtgcaataattatttgagatttctttttgtgaaatttcctgtatagccttt

SEQ ID NO: 24309 - DNA, 1268 bp, Mus musculus
ttgtttttctttaagtttctttatatgaatgcttctatctagtgtgtgtatgtgtgggggtggtgcatatgttcaaacacggaggtcagaggagaactctgtggggtcggttctccggccacctcacatggcacccaggagtcaagcttaaacaacaggcacccgtaccagctgagccgtctcactggccccgaatttatcttttatgttgggaaagaaaagattgaagttgagaggaaagtacatagatcaagatggcttcagggactgagatgggactgagaaaggaaactgggtgtctgaagtgcttgttcaaacagtctgtcgtgccagtcccctgtctaacaaagcctatggttggtgccagcttcctggctagccataggagggtaaagtgtgccctatagacatcagttaaacctctgacttctttcctgttctggggacacaggtccagcgatggggccttcttggccatttcctccacggatggctattgcacatttgtgaccttcgagaaaggtgaacttggcatacctttgaaagagaagccagtgctgagcataaggactcccgacacagccaagaaagccaagaaccagacacaccagggatcttcgccgggatccagatcagtcgaagggacccccagcaacagaacccaagaccccagcagtccctgtaccactccttcaccaaccacacagtctccagctccgtcggccatcaaggacagtccctcagccatcccggctggcaaaagccccttgccacaaccttctgaagagaagaccctgcaacctgctgggcaaaacatgaaagccccccaaccccgcagggtcaccctgaacacgctgcagacttggggcaagacagccccccggtaagagcatttgataaaacaagagtgttgctgtgaaatgggccccagcatagcaagtattgaaggttccacctccctccttctggacctacattcctgcctagggatgaagcctagcatcttcccgtgattccgtgggctaggtgggctgctgtcagagcctggggcttttcctagccttgtctcccaactctcctgtcacattcccagagcacactctgccctttgagatatccatgtctgcttcccgggggaaggaagctttggatactcctggtgacattggaatcttcctgagacccaattaaatgtgtcttctctcttcctggtctctgtaaccccaggcccccatagtattgtctggcaggggtttgtgtcctcttgg

SEQ ID NO: 24310 - DNA, 1174 bp, Mus musculus
gagtgcagcactgtattgtaagtcatgactttctgcccccaatttcataatgtcaggaaggagagagagagagactgacacaaaaatgccatcagtttggagagacgtatgtgcgtgcagagcatgcctgattttgcgtgtgtgtgtgtgtgtgtgtgtgtgtgtgtgtgtgtctttaaaagaagatgttcaaaacttgatgtgctaaaacgtctccgtggaagaacaaaggagaggaagcctttctgggcttgcgtttccagatgtgctccgtgctttcccgtgtacctcccgtctctgtggagcttgtgaatcatacccatcgctgcccagcctgaaagaactagttcctgtctgccctcctgcttcctgccacttccactgaagtgggcggacggaacagatcgcttcgcttagagcaagatcctcgtcataaacgagtaccatctttatccagcttctgtagtcagggccaactccagaaaccagaggtcttcggcatagaatccactcaccctcagcctagcagagtcagccccatttgaagcaaaaaataaaataaataaataacagggtgaactataccaacctgacgtgtgtttgaggggctgtgacactaaaggaacttgaaagtaacttttcttgcaaataagactttgactaatgtttttctcaaaaaaagaaaaagatacatatataaaatttagttccgctatttttttaaattcatgcgagtttaaataaaactgtacgccaccccaaattataaagtgacaggcccaagagagagagagagagagagagagagagagagagagagagagagcgagagcatctgtaaaatatcatcaagaatgaagatctccaagctggctgttgcaaaggttcatttctcagactttgtaatataaggctgttcatctctcagaaccgccatcattacatttgaaatttctatgggggattatttaatgaaaaacatgctatgttttattttaagctgaaggcctattctggatagttctactttggggaaaaaaatgttatcatttaatttcctttctgtaagttaaaactaatgaagtgtggtcatgtcagagcagacagagatgttctgggcatgctgattggccctggggtagttacactgtttgggggtattcttgcgtatgca

SEQ ID NO: 24311 - DNA, 1241 bp, Mus musculus
agcagagtgttacagcaaaacacttcaatattgcccctctgccctagatggagacttactgagagatgaacagaactaggaaaagatgagcagctaacaggaagtggttgctcagtagaggcaggatggttgagagtatagcagtttttatgtgctgcgaagtggtatatcttatggtatgttgtatagcaggtagagaagtacacagtaggcgaatgtcttttctacattcagcaaacactttctgaagacatatcttgctaggcacatacagagtcagtgcccttagttatattctacccatgggagatacatatcccttgagttcagagtagagctggtgaatatctaaacctaaagaaaagagcctgggaagaagaacagtggattagggataagaatatgtagacttcagtgttctgattggagttacttccttaggatacaggacccaacatggttctactataccatagggaatagtgctgctgctctgttacctcaggtgatgtcactgctgactggaatgtcactgtctccttaggactgtgcagcatggatgactttgctgagggaggtctcagtttggcagatgatatcttactggaagattacccttatgaggatgactgtatctgtactcctgactttaccactgacgattatgttcgagtaacccagctttactatgaaggcgtggtgagtaggcttgtgaactctactttagagcagtttttgtggcatatgtattgacaggacagtacgtgtgcttctgaagagatgattgcagaagggaagggctgtgtcgccagagtggtgagaactagttacttagactggagatcaaccaggctcctgaggaaaaggaacaaactcagagcaatccaatgagaaagcccgagatgagttccgaaaccacaaaccatacatactttcaccttttaccagataaaaatcagaataattttcttcttttagggtatgcaatataaagattatgcccaaagtgagaaaaatttaggtgagtatattaatactttaatgctaatttgttgcaagactattaagggaggtctatccatccagtcataccaacataacaaatttatcttttaatatgtatttttagcttgatttggttatataggcctgtaatcccagcatttgggaaggaggttgaggcagaaggattagaagctccaggccagctttgatcagcatgctgagactcttgtctcaga

SEQ ID NO: 24312 - DNA, 1175 bp, Mus musculus
aacattggcaattcagctattcagattcttaaaaataaagtaaaaagaatattttgtgaactcccgatgagtaccgttgcactgattgcccttttgcctggcatacgctgcagatcatgtggccctgttctgaaccttgatctgtgccttacacctgatggtcaggatagatctctagtcgacatgtgaccggagagtcctcatctacctttatattactgtattctccaactgcctcaacagcccagggccagagacctcaacttccatgtctgtaatcattgtagaaccattcttgatctgtgagatgtctacggtcacatgaagatgcctgtgagtccacagtgactgttcttaacgtgtatgtaggagtccagctgttctctattgcatgatggagtgatgaaaatcagtgtatgagtaatggtccgacatgccacagaaggcaaacacacagtgccacacacattcagacttaaactcagatcccctttttcattcctcttttgaaacagaaaatcttggcaatggaagatgctttaaattggataaaatacacgggtgatgtaacaattctacctaaattaggatcagttgacaattgctggcccatgctaagtattttctttactgaatgtaagtataattgctttaaatgttgagtcttgtttaaagaatattatttgggaagatgggatgtgttcatagatgatattcaatttatcttaggaatggttaactgtttttcttctggtataatgctcaaataagatgatttttttttaacattgcagttagtttattctctatttcttgtctcactggtgttgtaacattatagtcttaaagctcgggctagcggatgtcatccctttacaggtgcatctgctcgttggttaagatggagctgccttctgtgcttttctttgaaaagtgttttacttccaagcacttgaatattagcagtgtttttatggtatacttacagtcttaagacaggaaacatttggccctgtaatagatgatagcagaaacctgtcattgtgactgaggaagaagagtgcatattttgtcagttggtttagatgcttataggtaaatagagacaggattttgcggtagggttgttggacactggagtgtgttgcatccagagagtgtagattttgttttcc

SEQ ID NO: 24313 - DNA, 1163 bp, Mus musculus
atgattaaaggcttaaatgaatgctaaaatgcaaaagtgatgttgaaatattttaattctaaaatactagaaagtgaaaacattccattataaaaataacttcagcaagattatgctctaaaaaggtaaaaatgcatacattgactcatgacaggctctgtcctgagtactttatgcatatttattcctaagaacctttacaaccttgggaggtattgtagctatctctttcagatgagaaaaccaaggtacagtaaggcctagcagtgtcccggtgtgcttaggcgggtgtgatgcagccaagattcaaacccagtggacctggatgtggcctctattgttagtcaccttggaaaggtgacagtagaggtgacacacgggaatgtgaacgttggaaacattttaagacaaatgatctgaatagtcacacatttatgaggacctgctgatccttacataacatgcagattaaaaactacgagcttctctttcatacccatcagattggcaaaaacttaaaagcttcgtaataccaagtatttgagaggatgtggaacaaaggaagctttcatactcggctggagaaagataaattggtacagtcactggagagcagtctgacaaggagaagatgtgcattctctgcagttgacatctagggtcatcccttccaactgtcagacatgtactcaagaagacatgtacaagccttcattgtagcactgactgtttgtaagataaagatgtgcaccgacaaacgtccatcaggaggggatggataaatgaactgttgtatattcatacaaagatgtttgaaacagcacttaaaacgagtgcaatgttgagtgtcaagcaagttgcagaatggtttgtacagtgtgatagcatttatatactgttaaaagacacacaaaacaatgtgcatattcatgttatcatgatgtatgaatttcaagtgttcttgaaatgtatggacatgttaagcaaaatgagtggctatctctggggagagaaggaggagaaaggagaggtgatacacagtggacgtcaactataacaaatctgcaaaaaagagccatagtaaatatggcaaaatgttgatttcttgataagttggtacatgagtgtcctacatgttaatattatgttctctgaattatgtg

SEQ ID NO: 24314 - DNA, 1135 bp, Mus musculus
ctggatgagcagggttgtgcctgctctgcttacatgttgcagttataagatctggccgtgtgctgggaaatctagtgtaacttacactcacacatcaccaggtgggttatttatagtatgtgttgttagaaccactggtacactgttatggtacctcagtactaccattcagcccgactcaacagctgacaccagggttctagttatggttggtgacagaagtgagcaaagacagacatagcccctgtgttctagccagtgagacagcagtgttaagcctgaaattagaagtggcatgttgtattcaagaaactgctgttgtgccacatgacctgaattacagaggggaggttagggtctagactttgcaggttatgttatggctgttggccattgagaggggtggtaagatgccaaaaattccaagagttgagtgttatgcatgattagtacccttaaaagctcatgctggacacagaaaattgctttggatgacctgcacaaaggctgaggctgtgaggataccaggctggaggaaggtagctagagtaggcataggacagtgggaggagtcaggatatttagaggtgacgttgacagaatggctcatggtttagtgctgagatatgactatggagactggtatgtgttcttactagagtcttagatttttgggcctgcttattagcagtgggagtcattggaagaggaataaatttataggaggtagaatctgagtttctctatgtaaaaaagtaaatgacatgtttgggatagatgtccaagaagattgaagttggagatgcatttaatattgcttaggaaagtaagtttcaccctcaactgaagaatcatttgaactttgaatcccagacattctggcttaactgatagagggtagagcttgcagaatggactttttgaagcttccctgggaattaatattactgttcaggcaagattgaaacagccttgctgtcttttagtgagagagcacaaggtaagagaaaggagccaagttgaaccttgaatatcaatcagggaaaggtgacacctggcctgaaaactatttacaggtgtccagaaagaaaatattttatagaaagaagtgagaggacacgagtgtctagctgcc

SEQ ID NO: 24315 - DNA, 1153 bp, Mus musculus
ccgtgggtcgtgaccccttggggtggttgattggtgtttttacggactgtcagaaaacatatatttacattacaattcataacagtaaaattacagtgatgaaatggcagtgaagataagatggaaaatctctgttctggagtttgtgctctgttcagtatagctgaaccagtctgttgtgtgaaaggctggagagttacattgttgagaatcagttttgttaaaagacaaacataggggctggtgagatggcttagcaggtaagagcacccgactgctcttccaaaggtcctgagttcaaatcccagcaaccacatggtggctcacaaccatccataatgagatctgacgccctcatctggtacgtctgaagacagctacagtgtacttacatataataaataaataaatctttttaaaaaaaagacaagcatagtgtataaaagcatatggataataagtcgaatgtagatactggaaagctatataaagaactttctaaaatcactaaatgtaattcctgagtcgttgtaatggggttcgggtaactactccccttcgttttacttctctgtattttctaactttgctatagtggacttttgccatatggcttaatttttttactaggctatctatattcatgtaaaattcacagcatacgagtagatatatgatatatagtacttttaaagtaaaatcatgaaattcttaaatattttatttcttgcttttctttttagaaatgcacttagcgatggaaagagggccattgttttgaagaacacctggccaaaggtaagcttcttttattctacaatgagcaagcccttgaacattactgttgtgtgagaatcagtgtgtgggatcatttatttgtatgtaaaaatgctgggtgacatttcagagaactcaaggacaggaaatgggttcaagagtttatagtcagttccaagacttgctgtgagaggtaaagagcatcagagctagttagacacctcggttaataggctaaccagtaagtggctgaggagggggtgggggaggaagagaagaagacaagaaaaataggagaacacaggagagccttactcccctcactgttagaaagtattcaaagctcttcccaagtgataattgtacttcaaggcac

SEQ ID NO: 24316 - DNA, 1197 bp, Mus musculus
acctgggtcctctggtagagcatccattgttcctaactgctgagtatctctcctgcctaggactgtaacttctttagtaacagtaatgtatctcagatgggtttaacttgtatagtataccctaaatctgagagatcaggtgactcctctggtgtgggaggcaagtagtgctcccagtttgtgtgtggtccatgtgggtgctcactcctttgccatggtttaggtctcttataacccctgatctttgccaagttcaggatttggactcctgtcaatctaaagcatgatcataagagcagacacctcagtctgtctccagaccctattatgtggaaaagaatgcagccttcctagtccattctgcattgtgccccatgacactctgagcccctgaatctgagtggtaaattctactccatctgttctgttagtaagatgttactctacgcttgtgtagctaggacgttattgagatgctgagaggacaggcttgtgttcgggttgttaactggtgtgtttttattgacagcaattgaacctggccatgattaattatgtattagtagtctatggacttgccgtttctctccttggaataggacgaccagaggtaagctgttaacagagataaatgactgaaataggatattggatgtggaaggtgttttgaaattgtcctcttattttggctcatttctttcttgaaagactaaaatagctgagtttaacttagttttttgggggggtgttgtgggccttgaacacagtcttgctgtctgcctgctttggtttcaagcttgctctcctcctccttcctgattctaaacaccagcgtaagttgatgggtggattgctttagagttaagtttggcagggtggtgattcatggctataatcccagttcagaaacaaaaccaggagagtcataaatttgacaccagcctggaccaagacccagtcttcaaagaagaaaagaacattttctttgctttcctagtagagaaaagctatacttagcaatttctaggagtctacattttacacacagacaaagtagatttcaaaaatgtattgtcaagggaaagggctagttggagcaaaacatcattgtgagtctgttctgtttgtttctgcaagcagtaggacattactagtaagtcccttagaccatctccagaccacataaagtaaccattg

SEQ ID NO: 24317 - DNA, 1201 bp, Mus musculus
ttccagccatcctaatgacctcaggattgccaggggcttatccttcttttcactgtcactccaagcacgggtgacagaagagcattatttttaatggggaggggagatcttcatggctctagctaggagggaggattatgtgggagacgggtaagaaagagtgagcaaggggtacaagcaagtggaagtttccacacagcttactgttgtgtctttgaaaatgagagttttatttacattaagttacagacacatttacacttttgaaataattggaaactaccaaagttttaatttcaatctatttctggctgttaaaattttttaatactgtattctttttataagaaacggagtatgcttttcagtgttgacatttggcatttttgtgtttatataaattctcattaaatccagtggtgggtttttttcttccatggcattttagagtagaatactgttatttttaaggtagactatttttgtcatttatgctagaatttcatcatttttagggtaaaatgtcattcctattttgttttcttttaacccagccaatgttagtgggatctggagctgcatcagtagcaccgagcagtgaggctgtcactccagaagaccataggtgagtatagctcatcactgcctcggtgtaatgcaagcgtttgcactaaaactcagccagtttacatagtcttgtttactcccttctcttcccttcctggaccaattacgatagtctaacatgagtcagtgctatgactgtaggaattaaaagcttaagaattcagttcagccatgttaaagtcacaggaataggggaaggagagactagagtaaaatcataagacagacaaagtaaaatatgcgacatggaggtgtgacagtgtcacactgacccattttatataattagtggggctcagtttataaagtgcttcctgcgtgaagaagcatgaagacattcttttaagtggtggggaattcttctaatctgaactaataagatcctgttttggtctagttgggctatccaaggcaagatgctgaaatgaagcacttaaaaactgtggaaatctgagctggagggatgactcagaggttaagaatgcttgtttttgcagaggacttggatttgattcccagaaaccaaccatatggtggctcacagccatccatactccagttgttacagatctga

SEQ ID NO: 24318 - DNA, 1681 bp, Mus musculus
cgcctttagctctcagtgcaagtgaagttctgattgttgtagcattgatttcagtcagccctatgtttcctctggattgtattgatgagagggtttgatatcagaagtaaaatacttgccttgggaggaaaaatccaaaacaagtactttcttgttgtaacccaatgtaaatttatttttccaagttatttctctcagttgttggaagagcacggccccttggatatgagtgacaggatgttctctgaggaatatgagttcttccctgaagaaactcgacagatactggagaaggcaggagggctgaagtcgttcctcctgggctgtcctcgatttgttgtgatcgacaactgcattgcattgaaaaaagttgcctcaagactcaagaaaaaaagaaagaagaaaaacatgaaagctaaagttgaagacatttcaaaaacaggagaatatttacgagttaaactaccactaaatccaactgctagggaatttcaaccagatgtaaagtctgaagcactgtctgaggatgtgaagtccataccaggacctgccgactcctcaaccctagctgcggaggatctgaaggcccagctggactctgatagctcttctgggtcagcttcggaggacagcagactggaagtggcctctcctgactctcctacaccactctgtgaggatgcttctccttcccccacgccagctcctgaagaagccaaaccaacatactgggctcaatcacacttggtcacaggattctgcacataccttccttttcaaggatttggcatcacccagcgaccagcgtacattaacatggtacctagcctgtcgcagttcactagcatttacacacctttggccaacatttcttctgagtatccaatgcaaagatccatgccagtggtgccatcttttgtagccagcaacagagcagatgaaaatgccgctgcatactttgagagtcctaatctgaatactgagcacgactctggtgaccacatggcctctgaaacacagatcctggaggatactttgggagtgtgtgtcaggtcccagggcagcgcagctgatgctgatccagctctgagtgagcctgagggaaacagcgaacacagtgggagctctgacagcctgtgggaagcttctctagaaaatgtcagtggaacaacagatgctccagctgctccatcggttgccatacaggtaagtcttaaagagaaaaggatattatttttgcaaaaagtagtagttggcttcatagtggttgtaaatacttttccacctgtaaatacaaacgcctgtgaaagcatcacaagtgtttgtgttgtcaggaggacatttggatgaggtgaggcatagtctgtgtcccctaccacagtctatactggtaagaaatatggaatcagagtcagcacctggagccaaggcatcatttctatgattaataaacaaaagagtataggagtgttgcggctactttatagggaggtacacatactcccaaccacggtggcttcatcacattggctgatgcagcattcacagcccctggtctgagctgattgccccatataacactggacacactgcacactccccagaaaataaagagtctgtgggagtggagctcagtgggagaacacttgcttagcatgtacaaagctctggattccaggca

SEQ ID NO: 24319 - DNA, 1437 bp, Mus musculus
cgtggctgctgcaggatactctgagatgagcaggttctttggaaagaactgctgagctcctcaaagcagtgctgagattgtaaaggctctcagcctcctcagttcctcatgtggcactgtagcatccccgtcataaatttttaaagtgcttatgattcaattaatctacattttggtaatcaattataaaatactttttaaattagtattggctattttttttttttaccctgggaagatgctgtctgctcacaggagtcccacacttggcacttacactaaggttaccatgtaagtctcatgagtcagcagtgcttggaagtgcacagctggctagtgctgaaaacaggacatagtgcccagcgcagggcagccaccctcaccctccttccttatccttccaccagaagagaaatgtaccacagtcctgatgtgttggtgttaacattgttctgtttgacttttgtgtaaagtaatgcatgcaatcttgtaatgtggcctgaaaacaagctaactgtattagaaactattcaaaaactaggtatttttagtgacctgtaggcagtggcaaatacagacatgtgaaccttgaatacattacatttctctcaaacacaaagaaacaaacaaaaaacttttccagcgtgttctctgctgccctggagatgccgtcaccttccacccgtgtctgtgtgagttgtggtgtcttagtgacttagtatgtagctcactccttattctgagacattgtctgtggtgtccctgaaacatggtgtccatgctgtaacagtggagtgcagtacatgcctgagtacacacagcagcttatagtatctgtcgggtacaaagaagagtagctgttgagacagagagctgtgcttcgtgtcagagcctgtgaacatgccttacacttgtccagtaactgtcaataaagaacattataaaaggtcagccgttcactgtcgtccttgcccaggtcctttagaattgcattctgcgtgggagttcagggtcctgttctgtcaaacattgagaaactgactttatttgggaagaacaggcaagttgcacctgatgatcttaaccaaggatcttggggttattttagaggctggattaaaacatccctttgtgcctagatactgctcgccaagcccgagttcccaaggctgactgtttaaatcggtgactaggatgttcatgcagaaatcacagactcgattctcccgttcatgtgggcacatgcaaacatgctgaggataacttgatttcttgcgggtttgtttctgaggcgcttgtgttcgtggactgctgaagctgattgatagtgcctttttaaaggctcttttgggtatgctaagcactaataaaggaagcacggtctattaatacattttactaggtatagacaggctaatgttaccaactgggcctgtc

SEQ ID NO: 24320 - DNA, 1166 bp, Mus musculus
gggattaaatgtgtgtgccaccatcacctggttctaggattctcattagaaagtggaaagtactgttgagtagtcccggggtgctccttttgacttagtgctctagtgataagacagagaagttagtagtgcagtcactggtatggagacctcactggctctacagagagtgcagggcgacactgcctgggtcagaagcacagaatcccaagcagcacctggacactggcttactgttaggactctggtttccagtgctcggtgtgagtgagcatctctctcttccctacagagtttgaggtcaatgtggtggtcctccttcatgctgaccacctcatcactgagaactttccgctgaagctctgtcggacatagtccagctgcaggaaggggagagccagaatggccatgtggacattgacccagtcatctgctcacatggggacgtcacacagaccacctgctcacaggcatcacatcagcagcatacatcttcatgtcttctcatggcctcaaagcttgttccctgcaggtgccttacctcagccctcacgtctggaatgcaacaggatttctcctgtgtgttgcaagatcacagaaagcgttcccaatggctccagatgtgcctgtttcttcttaggttcattaagcagtgtgtctgcacattaagatgggctgcctagtgagatcatggaggcagaagagagcccccacccctctatcttgcccagactcctgacagcaaagagtcagcaaccagcaagctctctgattgagtctgtaatcccctccaaggagtgacagtgacttcatctgggaatacggagttttcccttcttgacatcttgatagtgtttcactaaagcctctaaatgttttagggcactggaaataaaaaccaacaaatagtcctggttctcacagagggagaatggtgaacagtggctgttgctggagtgtttgtgtgtgtggtactggcacacagttaatgctgccatattcccagaatgtattgagagacaaggtgcttgcataaggggaagaatgcacatggactactggtaagtactaggttctgagtgacaggacaccgtgctgaggaagggcaatggccttggcctgtccctgaccccctgggtcacatggctttagcctcacactgtaac

SEQ ID NO: 24321 - DNA, 1194 bp, Mus musculus
ccatcatggtgggctcagcagccctgaagtggaagtaataaacaggaggggctgtgagaaaagtgaggtggaccagttggagaacaagggaggggtttatggtagtatgtgaaaaatgtctctgaactttatctacaaacagtatggtatcttatacgcagtctttcctacaggtaatttttattacctaggccttgataatcactgtgaaaagtgaactaaaattcttatggtttgtgcaaattgtataagatcataaaaagcagtttatttccttagataaattatataaaacttgacagtttcatgcttacttgatgcctagaaatgcctgaaatgtgtattggtcataggcacattttaaaactttttttcttttccacaataaatgtctacatatattttcatttgctctaagtgaatagagattatttaaatacgtgtaaatgttagtaatttaaattgacaaatttgaaataatttatcagtgttttggggttgtagttatattagatactcctcagttaggggaaattgtcttacaccatcatatcttatcgtaatttgtttttcttcacacagtgttatagttttgccgctggactcttccctcccttcccccaccccatcaggatgatatgagacttgaaagaagacgatgcatacaggtgactcaagttttgaaatacagtagagctatggctgtaagacaatgtggggaccactgagagtgtacctgggggggacttcagataacattgagtggcgggaattacttaggcaagtatgcagaggtggaagatactgaaagtgaatctgggtctcagtttcatactcagttttaatagtgatgtgaacagtaagagtaattcctagtagttgaacttttaaaagctggctcatacttttaaagttgaaataatttgttttaaaaattaatagcatttactctagtggttaaatatatgtctccctgtattcctgtgagaacgtaacagatcttccatgggaatgcgtgttaagatgatttcagcccgacaagtaagagtggttatggttagcacagcactgcgtccgttgcagacgtgctggctgtggaggttgtattttgtgttccttttctccctatattattgttaatgtagtttcctgcctctttcatccccgtggcatttgagtttcttgatggaaaag

SEQ ID NO: 24322 - DNA, 2837 bp, Mus musculus
tgttcagctgttggtcttggtcatttgccaactaattttaaaataaaaaggcactgcacataatttgcataaagggccccataagggtgttttgttttgttttcatttttattttttccctttttcccttgttttgttttgtttcattttgggctgggggtggggtgggaaatttgggttttttatgtcctctacacacttgggcacggaaatgcagtactgtaaggaagagggacctctagcacacacaaacatcatcttcagctgtgtgaaagggacgattgtgttgacatttgtaaggcacattaagcatgctaagtggcggggatcaggactctcctatctgagcctactgaggagcaaagcagccattgcatgggatcctgtgggtctcctgctggagaggccacaggaggataggatggaacgtgactggtcggtctccttaccaaggcgcactgagaagcaatcagcgggtcggttgtggccagtcctggggaggtctgagtggtggtccttgggataacctttggccttacggatttggactcggagttagaagagcccaccatttcagatgcaatcacttgtggacatgcgtttgcagacagtccttaatgctgaaaacacagagaatgggtaattcaagaggcctttcttttaaaatagacttttgtgacccactaattgtaaggtattgcaaggtcactttgcgtgtgtcataaagctgactcccttcttggttgaaggccacagaggtagtggtttgctttgatggaaatagctacagctgtgtcccttcctgcttttcccttttctttggctttttctcggcacgtggtgtctccaccatttcttctgcacaaagacgtcttctgttcaccctgaacattttaaaatgcagaattttatgtgactgcttttttgcctcacaattatgctgtgaattttacaaaaatttattttcttttttgataatttattgtaccaaagctgtttttatagcacatagatgtctgtaaccaataatgtcgcaggcctgcactttgacacaggtgtaacgagaccgttttaaacgtcagttgaaatgatggctgtactattgcttaaacaaaactggaactgttgttgaatccatagccaatacatttacagcaatcttgtactggacagaatagattgacatctaattcaagattacaacacctgtcacattctaaatgtgttcaggcttctgaagggaaagggacactggatccagaagctatggagccagcagttgatcttgtattcctgattaacttccttgtaaacttgaacttgagaccttgattgaaccgacaggtccacagtaggaacaggaagcaggcagagctctgagcatgacctgaaggaagcaggctggcactagcagttgccttgtctggagatgctgctgccttcaagtagcacagtctggcagtggctaaatctgtgttcccattgaaattgagcaattttagggtgttatactctgaagcagttgaattgggagaatgaagatagagtaatttccctgtccaggatcaaaagaagcctagaaagaagcagtgatctacctctgccaataaccctgttggaagcaacgcagcagaacaccacggtactttttattgcttaattccacgtggctgactaggtcaaggtttgtttggtgttttttttttttttttttgtttctgagcaaaagcaggtttttttttgttttttatatgtaaacaaaagaaaggcctaagctctgtgagtgcaagtggagactcagagagccccgtttctataaacacagacacttcaggtgttaatcaggaaacccatattgattttgtaattaaatgtcaagcctgtggattgttttgagcttggtagttgatgagcatttccgtacagaggcctcaccttgagcacagcactgtcaggagggcgcagcgcctgtggctgcggagccccaggtgccacacacccaccccacgtggctcaggtcattctttttttctttctgtgctggttgccacattttagcaagcaccaaaaaagaaagcagtttttaaagctatatttacgtaaagagagccacacaatccagtgcttctgcataccgtgtcacgttacagtccagttttgtgtgctttactacacagtttggttacaggacttctgtgcattgtaaacataaacagcatggagaggttaaatacctgtgttcagattgtaagatctagtccagacttgctgtgtatattgtaacgttaaatgaaaaaagacccccctttgtattatagtcatgcggtcttatgtatgataaacagttgaataatttgtcctcagagtctttactatgcttttttaaaaattaacttaaggaaaaatgtaaacagtaaaaaaacaatcttcgtgtgcagtgaagcgggtccgggtgtggtaggtaaagcaggcacaatcctgtcgcctatgtaaagggaaaagacttgtgagacagagacattggctgcaagtgtctttgaaagtaaaaattggaggtttaacagataatttggtttttaaaatggattctttacctgagtgattatcatgttgatttgtgctcccctgtggtactgtctctgtgttgagagcacgtgggggcctgtcctgtggggatgaaggacagaactgagtgccatctccctgagtctgctctgtccctttcctgtgcagagcccggaatcctgccgtgcggaggcagtttctaacccacagccctctcttttcagtgctagcctgcacagggtctgttgagtggccttcagaaggtaagaaac

SEQ ID NO: 24323 - DNA, 1175 bp, Mus musculus
atgtgttatgtgtatatatgtgtgtgtatttatgtgttatgtgtatatatatgtatgtatgtatatatgtgagtgtgtatatatacatatacatatatacatatgtatatctacatttatacacacatatacatacacatatacatatatgtgtgtatagatgtagatatatgggtatagatgtagatatacatatatatgtatatatcagtgctttgccagcatatatgtaagtacacctcacttgttcctggtgcctgtggaggtcaggaaaggacattggatctcctggaactggagttactggtggttgtgagccaccatgtgggtgctgggaactgaacctaggtcctctacaagagcaatcagtgctcttttgctgggccatctctctcctgccccgactttctaaggtctgagtcaggattttgtagtcagccttgtgccatgaaccttttagtcagctttgttaaaagccactttgttaaaatgcagctaacaagatatggtagcctcaggtctacactgtgctaacccgtggtatcttcattagtgttctgcaaataaaactgggtgtctgcccaggggctgctgtaacttctaagtggatccacaccacaccagcattatgtatgtcatctccaacagctgtatgcaacattcaagtgactgacgctcagttctgttgtttgtgaggggaaaatcccaagcacagtgaaaaaagaagaatttctttctcattcagtgtggctgtgtggtgctctgaaggagactggcctccataggctcatatatttgaatgcttgttctgcagttggtagaactgtttgggaaggattaggaggtgtggccttgttggaggaggtgtgtcactggggatgggctttttaaacctcccccaccccacccccgctcctctctccctcttgccttccttggggttcttgtctcaatatgtaagctctcagatgctgctccagcaccaggccttgcctgtctgccatgctccccatcataacagtcatggactaactctctgaaactataagcctccaataaactcttccttctatacattgcctttatcatggtgtctcttcatagcaatagaaaagtaacaaagatgggggaatcctggcttctaactcagagcagggccttgtactcacccctcc

SEQ ID NO: 24324 - DNA, 1132 bp, Mus musculus
cttcagctcgcttctactaaccctggaatctgagtcttaaagacaccacactgagaatcttgtgtgtgtgctatagttacacacaaagtgttctagttggtatacatctgctttttatttatttctttggtttttctagacagggtttctctgtgtagccaaaggatgtcctggagctccctctgtagaccatgatggccttgaactcagaaatccatctgcctctgcctcccgggtgctgggattaaaggtgtgtgtcaccactgcccggcattcatctgctttttattaaccagtgagtatgtatgttaagattgatatgctttttcctcccagtagacttgaagcatcgtttttctacattgtgagagatttttaaacaactttccaagagttttgatttttaaaggaccctctgatccccaaacattttaccctgggcaatgcagtctccatttcctcacaagcaaatctagaatgtgtttttatttcccactgaggtgccagttaccctttttctcgtgggagcagcattcggtggagctctttgtcttccagcacacaaaccagaaacacacattcttcctgtcattaaagtagaaaacacggtctatgagttacatatggccaggttttaaaaagcctagccttgcagcctcactcatgttctctgaatccgcttgcagtcatcaaccctggagctgtctgtgcttcacccgcagctctgggtttcctccacgggtgggtccttgcaggagggtcgccgggtgtggagcgggcgctgcgtgccccggttaacaggatgacggaagcgcgccgcgggacatttctcgcggcggaccggaagctcttaggttctcccccctccccccacggaaggcgtatcctcgctcggaggcggggtgggggcgtggcttggagggggcgtgactgcgggccggcgcgcatgcgctgtctggccgcgcggagctgagggaccatggctgccacgttctttggcgaggtggtgaaggcgccgtgcagagctgggactgaggaggaagaagaggaggaggagcagagcaggcgggacacgccggaggaccgggaggtccggcggcagctggcgcggaagaggtcaggctcccggaag

SEQ ID NO: 24325 - DNA, 1159 bp, Mus musculus
ttccctacttagggcataagttaattgaagttcaaatctactttacagggtactttaaaaaatgttttccatttctgcagtttagcttttcccctttcttgattggaagtaaaatgtcttaagagtttgtctttaccaggttgataaactgtcagcacaggctcttccaccacatctggagtaaccactactaattcttccaccacatctggagtaaccactactaattcagcattttcttgggaagagagattttagttgtgatggggttttatctaatactgggcatgaaccagctgacttagttttcttagtatgcaatgcatggatgtagttatttggctgatactagtagaattctttgaggggtacccgcttcccttttgctatattttgaaattgtacttattttatcctagcatttgctcaaaatagatttaatgttcatttttgcatttggtattcatggagaccccagcttataagtttctacttttaagaaagtcctctgaaggtaaaaacaccaaggcactttgtttctacagagcctaatgagttacgtcagaccagcctagtaaaaaacattggaagttacataaccctaaccctttgagggaatagtctcctgtttggaagagcttgtagatgtcagattgacctttcaggtggctgggaacagtctgggggctctggaagagcagccattgctaccttctgttttctgagctggtttctctatgcatttctgtctgccctagatctaactatagaccaggctggcttagaactgagagatctgccttcctccttccaaatgggagtgctgagattaaaggttatgtgccgccaccacacctggtgcaaaactatatttatttatagtcaggtgacatgtgcaagcagccaggccaagcttgcttgatgatagctgaccaaaacgttgcctttttctgggactcagtaagaaagacaaaggctgccaagtcctccagatgcctatgtgttttttactttggtgttctacagcctctgtattgatgtggctattacattcatgtctgactcttcatgactgtaagactgattttaagaaatccccaaactccagctggtagcagatagatacatcaaagcacttgaaacttgtgtctttgagact

SEQ ID NO: 24326 - DNA, 1062 bp, Mus musculus
tttttttttttacttcctttgaaagattactattaccaagcatattaagattaaaaatagatttaaaaggatttcccacttatatcttattttaaaaggtatactcacaatgtgtagtaatttatgaataaaaagaaaatatatcccattttcaggtagttcctagggtggtcattgctttttttttttcttttctttttagtggaaaacctgatcaaataatgtctgaagttagtgtgatgttggaaattgtgatataggtctcctagagtaagacatgtttttgcaaagcacttcaagacctagaaaaacaatgcatcgggtctataaataggttcattcaacaccactagagggttacatcacagacaggttcatacagtactgccagagagctgcactgcccacagtcacgtgtcactatgcctttgccctcatttgtggcttttggggtaaggatgggttcacaccacagcctcagtttctgtggtgctctttttcttaaatcactgtactgtgtgataaaaaattgacctggattttactctcgcgtcactgcgagttgaatgtaattgtgtcagctgacaaaagacatctgaggtttgtaatggagcagaatgcagaacattaaagatgcacgggatgttttatttccctccccctccagtgtcctgattctgctagaaacaaactcacaggctcgagataggctgtgcttttcctcaatggtcgaagtaaccagctcaagttttgatcattaagccagcacatttcagatatcttacagctattaccaagtccatgctgttttctcatggtgtagatagtatgctggagtgcaaaggagcttggagagccttcctcctgttagtgactactgaagcttagaccctcagctttggctgtggaccctgatcagcaccataggtttacatctgtgtccgcccacccagtgttctgtaatgtactgaccaaaccagctctggtagagcaaggagaacatgaggcagtgtgcactcttacttaactgggttagttgtgagtctcacatacagctcttac

SEQ ID NO: 24327 - DNA, 2291 bp, Mus musculus
ggtcagtaactgactctgatgttgactgtaccgataacacacaaacccaaaggaagaagaaaaggaaagggaaagcaagagtgcttagcaaaggtaaaccctcctcatccaactcacctaaaactgcaagacatccaaggcagagtaaaggtcctaggttaaatgtggatgacaatgactgggaggatttggactatgcaaaagctaaaggagttgtccggctctcaaaaatccaaacgagaaatcagggtaggagaacggtgagataccacgatggggaagatgatagaagcatagagagcgcactagagctcactgaccgcaccttacgcccttgagatccagtgtgctcagtagactgactggaatgtactgtgaaagctggcttacaattcagggaatatatttatatttttctatgaaaagttgtgaatgtgactaaatcatgactgttacttttatttgcacttgctggttttgaagcagcattcagcacaggtgccaaaatatgctttattttgggggcagatgtactttgacagtattgactacacatagcaagagttgggagacatgttcaacactagacaactgggttatccaaaccagtgagcattacttttgtggtagcagtgtcacacagttattttctgaatttatccagaggtggtagtttctaagcccctgccgtgcagtaggagaaaaatccacgtggcctatgtttacagaatcttgaaaaatattatgataatcatggcaagggtaaccatggttagtaggcaaggcacctaccacttttttttttttatcttttccctggagacttgagtagaacacattttaccttatatatctggttatttcaattgacatggcttctactcctcgccccccccccccccaaattcttgtcttttttttctttaagacaaacctgatgactttcatgtttataaacttgaatttataaagtgcttgtaaattattttacatgtttggagtgcatattttaaaggtctaatttgagacgtagtcatagtattttcttttagattgtttactgacaagttgttgctttttgtccaagatctactttccattaggattcaccaaattcttgctcttccataatcttactctgaagtagagaagtttgtgtgccttagatttagggaaagtgttctttaataagagtgcgtagggctaatggtatttcagttctgtatagatttcactttgtcacactgtagagttgagagtgcagttgtaaatcctacctgtgtagggaagcagcttttgttgcccagtgtaccctaagcatcctttctttgggacaactgcgtgagtctttgttgtagtgatccccagtggaagcaacaatgactcttaggtctgtctgaagggaagcatcccatcatcccaagtcccacagctttaaagacactgtttgttagccagggtcttgtctttaatggactgattatttgtggtctactggtgtcgctcttcccagtaagtttctccttggaaagcttcccaggagtgaaaaggatgttgtagtgtgcacttgtgagtgctttttgacttagttgtgcttgggttcatacacaagctactcttgtctccattttcctgaggtggcagcatgtgctgctctccagtgtacgcttactttgtcttcatggctcgttcgtggacttgatttgacgtggtaggcatcttctcatgtaagagagaagatggtttcgggcgtttccagctgtggttggtaggtgcctctgtttctcttggatagagaattctctgccaagctgctttccatagagctcctactagacggatgtgaggggcacagactgggtcagctgtctttgactattgactgtaaaagcatttgattcccgttatgttcctcaggattgtaactccatgtttatcattatctgcaagaaggcacccaaaatccacaagtatatatgacatgtactcttttacaaaaaagtttgggttttgtacacagagctgttctcattttgggactaagtgttaactggttattgtctagtcaaacactcctttctaaacctttggtccagttgtgtagaagcatggtttggtttcatcagattagggtccgtcttaagagcagacgtggacctggtgaccctgttgtgtggttgactgtggctctcagcttgtgaagtcaaggtgtgggcttgtgaggaagaagtattttgctttccttttttcctttttggttatggtgctacttctaacattaactttgacta

SEQ ID NO: 24328 - DNA, 1099 bp, Mus musculus
tgaactcaggaccttcggaagagcagtcagtgctcttatccactgagccaactctccaggcccccagctatattttaagcttctgaattttatcttttttttttcttttttaaaccattgcatagtcaaagatactgcaagcttctatctttagagtggtgagattgcacaggtgtatgccggcacgcaggtctgtgggattctgggaacaactctaagggttgtactaggtttcagacatttaccaactgagtacaccccagcccttgactccctgttgagtgtagcttcatgtcattcatggcatcgtggacatgtaaggcagtgtgggcatgaggctcatgagctgctgtggcctgtttttaaagctttccaaggaactaaaagtaaaaaataccgacttgagttaacaaaattatttttaatctttgtctcctttaaagccatttaaagttgactccatacaatggcaattttgtcatactgatgcccatgcttcttcatgttgtagtccaattcgatggttttggtgtcccagtctagacaacggacgtgtaggcgtaaatatgcaaattatagtagaagaaacgctgaccagtgtgaattatcttctggaaatgaatcttcaggctctgttagacatgtaagtagaaagactgcggggtcacctaatgtgggtttgcctgactcttgtgtacacacacacactgttagggattaaagaggcctaggcatggtaggcagattgtgagagatcacccctcaggccttctgacctcttgaccttgaggaagggtcttcctgaatcctaaaggggtcgaagggcctttggacttggggttgttcctgtctcccacatacttgcagtctgtgccaacaggttctgctgagtttgtcttaggtctaagcatggcatggtatgttggtggaatcagcctgtagtgtagcctgcgtgaaagtgctctgctgtgacagcctgtgggttctggggtccagctgagtcagtatgcctgacagcaagcacctttaccctctgaatcattctttactttgagatagagataagtcacaagtttggttttgacccttagccagctgt

SEQ ID NO: 24329 - DNA, 1102 bp, Mus musculus
atctgaaagcctttaggagcaagcatttgctaatttatattagttaccttctggcctgtaggatatggctggtttctttcccacagtgcagttttaaaccttgattttcatagattatatttcagtgtctgttgagttagaatttaaaatgaacaagcttaaggtagagtttgtgctactgctaatcttctgacatctttacattttctacccctgcccccacccccaattagttacatttttctcctcttgtactacattgttttcctaaggttcagtgtgtttgtgaaacaactgagtttgtagtgttatgttttgtagggccaggcaaacaatagtaaatcaggggttttacccatctagccttgtcctgaataatctgaccttgaataacatctgtagatcaggtccatcgggattggtactctaaaattagtttgtacttcacttgatgttcgtgatagcacttggtagctagcatgtgagtagatgtttctgaatgctttaaggttcttaagtggtagccgagatggaacagcacggatctggaggtttgagcagttggaatggagaagcattttactggacatgtctgccaggatctcggggtaagtcattgaactgtttgtaacacataggtgagttgttggtgtgttactcacacctacatactttgttaattttgatggaagagtttaatatgcctcctatatatgatgaataactattgtctaagtgtattgacttgtgtttttaaatacttcaatctcataactgaattaatgaaggaaagtgcacctgtatatttaattactttgaccaattttgtccgaagatagaataaaggagaaaggacttacttgctcatagtttgagagcctcaatccatcatggaagaagaatgtggaagagcagagcaagtggaaaacacaggacaagggactagcctaggacaggatgtaggtcccttgactcatacccagtgacctgctgcctcctgctaggctgcctgcctctcttccatgaacccagcttgtgattgacctgttgtgatgagacagtcctcatggtctgctggtctatcagggatacatacagaatt

SEQ ID NO: 24330 - DNA, 1176 bp, Mus musculus
gtgtgatatgctgtatgtatgtatacatgtgtctacactgctaatgggcacgtgtgttggttctgatgttagcatccttcaattccatcatgattatttctgttatgagctgttgctgacatgatgctacctcttagatgctccagtagtacaaagcctgactgagaaagagcaccctgcttggtttcctgccagaccagcctgccggccttagttgtttcttagtgcctgatagccttgcctcattggctctaatcaggaaactgtccctgtttgctttgtaatcattctgtagtcagttgtttcactgcagttgcttgggtagtgcatttcctttctcctgtgtcaagctaaagctcagagttgttctgtgatgaggcctgcctgtgtgagaactgtctgaagagacttcagcgaggccctgtttctgctcgtgttttgtgctagtgccagaggacgccttccttctattcatgtgaaacacggcatgcctgtcagttaggggcacctgagctccgctcagtagaggtttagcacgatgcctctcccttgcttgtttcaaagttgtgaagcaggagtggagcccaaggtctgtgtgttggcctctgttcttctgtgacctccagtggggcaggtacttcccttagtgccgttcctttagttagatccagtggggatgcaactttagaaggctctcgcaaaccctgtgtatgctcttctctgaagagttgccttcgccctaaagtgggaaactatttagcttgaactggtcaattcttcctaatgagctgaaggcaagccaacagatttcaaaaggaatgagtcaagtcaaagatttttagacacgtcaaaatatcttcttaaaattctccacttttgaacactgggtcagttgtgataagactgctcatttttaatgttgtatggtattttgcattgaaaaataaagttaactcggtattacagtccctataagcaatgatttacatggatctctttaaaggtcctggaacctgtgagcctcagttacctcatttgtaattagcagaaacacctacctcacagggttgttgtgaggactccatgagctgatgtatgtggaaaacacttggtggattgtaaagtgctgtgctgtgttactgctgtatctgagatgttttaagttcccctcagaaa

SEQ ID NO: 24331 - DNA, 1069 bp, Mus musculus
gtgtgtgcatagaagcaggtatgtgcctgcaatcccatcttagacagctgaggatgagggtctcgaatggggaggccatatgtagcataaccctgtgtcaaaaacaaaaacaaaacttgtgtcattgaatagtcatggtgctaatgaaggagcttggttgtagattgtttcctgttcatgtgtgatgctctggttaaatcctcagaactgtaaacagcacctccccactcagctattaaaaacaatgaatttatgaaattcttagacaaatggatggatctggaggatatcatcttgagagaggtaacccaatcacaaaagaacccacatgatatgcactcactgataagtggatattagcccagaagctcagaatccttcttagaagggggaacaaaaaacccatggaaggagttacagagaaaaagtttggagcagagactgaaggaatgaccatccagagactgccccacttggggatccatcccataaacaaccgctaaacctagacactatggcagatgccaataagagcctgatgacaggagcctgatagagctgtctcctgggtgcctctgccagtgcctggcaaatacagaagtcgatgctcacaatcatccattggatggaacacaaagtccccaaagaaggagctagagaaagtacccagggagctgaaggggtccgaagccccatagaaggaacatccatatgaactaaccagtaccctcagagctccttggaactaaaccaccaatcaaagaaaacacatggtggaacttgtggctctagctgtgtatgtagcagaggatggcctagtcggtcatcaatgggaggagaggccctaggtcctgtgaaggttctatgtctgagtataggggagtgccaggactgggaatgggtgtgggtaggttggggagcagagggacgggggagggaataggagatttttggagaggaaactaggaaaggagataacgtttgaaatgtaaataaagaaaatatctaattaaaacaaacaaaaaaaacccagcacctccccaaacaggcaaaccattctgcagcctcc

SEQ ID NO: 24332 - DNA, 1211 bp, Mus musculus
gtcctccgcgcgcccgcgccccccagccgggtctctgctcccctgcgggcgccgcggggccgcgcccgggggtggtctctggtggtccggcgtcccggggcgacgggcccgacccccgagggctcgcggtggcggggtggggggcgggatttggcagaaaatggttttgggggcggtgccgggcgcaggcgggggcgcccctggctcgcggccgggctggggctccaggtgcggccgccagccactgagaggggcgctctcatctctctcccttcccgatttgtaactcgagctctcattggtctctcctttctctgccccgcccagactttcagacctcttgttccccaggaatagagagagagtccttagtctcccaaggtggagaaatggccccttcctgtactgtactcccttcctctgtaggatcgcacagagttctccgtggtgaatatgtcagtgcggcacccctgcttccccgacccgtgcactgtgtgttgactgcctttagaaagttggctcacacttgatcttgctgtatgtagcggttcaggctttaagttgacatccgtcagtcggtgtatttattttttgagacagggtgtcattacgtaccactgtcttgccttgaactcgggtaggccaggctggccttgaattcatttcctgcttctgagagctcggactaagctctcagaagcagttgtgtgtgcctgtcttaacatttccgaggagtggtaacttgcggattacatttattttcctttgccttattttccctacttgcttagaggttcttgtgtatagttgagttttatccaggtaacagaggctttgggtgtttatcgttaacgaagcacaaatgttgcaggagaatatcttcgacaattttaagataaaagactcacactgagcatattggttacagaaggttgagatgagtgtgtgctgttgatgtttggctgcacagccccgtttggcttggacttgcagtcctgcttcactcatcctctgctgggtcgggattacaggagagctcactgacttcaccatgtgtccaagaccagtagtgaacaaaaagtcagccagggcgtcagtcatgcatgtgggcagttcattctctataccttgttttccagggctaaggagttaactggataactagagggctcagcagaacagggcaggagtgctaaagcagcggttctcaa

SEQ ID NO: 24333 - DNA, 1566 bp, Mus musculus
aggatggctaagcatggtggcacacactttaatccctgcactctccatatagaggaaggtacatctttgaatttggggccatcctggtctacatagtgatttccaagaccctgtctcagaaggaaggaggggtgggaatatagaagcgcaccattctgtaacagtgtacttgatgtttgctttttctatggtttgcagagtccagcctctgaagaagagaaagaagctaagtccgactaagcatccatcacgtctgtcagtggtcccgcctcccttcttgtacaatccagaggaatatttttatcaactattttgtaaatgcgagttttttagtagctctagaaacatttttaaaaggtgaggggatcccacctcatcccattttttaagtgtaaatggtttttttaagaggttaaatcatttgctggttgtttattttttggtacaaccagaaaatagcaggatactgaatcaggagaggctgtgactgtctcgggggtcaccataacattccgtagatggggctagttttatatcctataatacaaagtatactaaatggcaatttggcgtctcagtcgtgcattcgtgtctgaaatattttcagttctatctggtcccgtgtttctagtagaaccattttgtaagaaagccagtccttggcccttgccctgtcagaactgtgatgtctgtggtcatggcagtccattttcctaacagttgtgataatgtgctgtgaaagatggaagtcctgagtctgttctgtgtgtggcgtaacattgtgaattggtgggactgaggattacaggcatttggttgttgtgagaggtcttgggggaacttgccgagtcactggaacaagttcaaagaaaaacaatacgtagctcttcatttgtgtacatgaacacaatgtgacttcagagtttgggtacgtgaacacagtatatggctctttttgggtacatgtaataaaaattggaatgtctgtactctgctcctcgaccaataaaatctgttgtgaaagagtatttggaaatgcctgattaattttctgataaactctggttttttgagttatgcttttttctttctgtgtggccctcactgttgctctatagaccagtctggacttaactctaggatcctcctgactctgtcttggatgctggaattaaaagcacatgctgttggcagaagaacagctcagaggttaagagcactggctgctcttccagaggccttgagttcaattcccagctgctacatggtgactcatgtgtggtgcgatctggtggcctcctctgacatgcaggtgtacatacagatagagcacataaatataattgtcatgcattgtgtctctggttttttgagaggtttacattgtgataatgactcttggagttgactaagcacttgggtttacaactgtgcactgcgtctggcttctacttccatgtgtgttgttggtgacttgcactgcaagaacctgggacttggtaaagttatctataagctgggtctttgcaccagtgcaagcccttacttgacagatggagacactca

SEQ ID NO: 24334 - DNA, 1192 bp, Mus musculus
cgacgctgctcccaggcgctgccgtagcggagcagggctgcagtgcgcaggcgtaggcgagcgcggaggcgcggtcaccatggcgctgtcgtagcggtgcaggtgcctgggatccagcatgagcgcgtccgagacggaccgctgggcgtggctgctggtgttgagcttcgtgttcgggtgtaacttgctgcgcatcctcctgccgtccctgtcctcgtttgtaagtagctgccgggggcggggagcggccgagcgcggggccttgcgcggtccatgctgcaagctctcttcctccaggtgcctccgagcttctcacagatcgcgaggttgcaaccagctctggagggtgggaggtcccaagccacgcttcgcgacagaggagcagccccggcccagcatcctcacaggtgcctggctccggagcggctgatccccggctacagggagcccccttctgttctgtccgtgggaacaaggaacactacagagcaatctaaacaggccataccgttcttgcacattcaggtttctgtttatgtatggggggtgtttttcctgcgtgtgtatctgtgcactgtgtgctttcattgccagcagagtccagaagagagcgctggatgctctggaattggagttacagacattagttatctgccacgtgggtcctgggaacagaacccaggccctctatagtagtatccagtgctcttatccactgagccatctccagccccaacatactttccatattttactcatgcctgtataatgaagtctgcacacagttctccaaaggactggatgcagaaaggtttagaaggacttttctgtgtactggaagagggattggggactactaactggggatggatgtccccacactcaatgacctgtctgcaaagttctcttcatctgtcctgctatctgtagcctttaaaccatttaaaaaaaactatttgttatgtgagagtttcgcttgcatgtatgtaagtgcatcacacgtatgcagtgcttttgagtccagaaggggcattgattccctgacactggagtcaaggactccatgtgagccactatgtgagtgtgctcttgaccactgagctatctctccaccctcttaatctgtagccattaaagattttatgtgtgtgtgtgtgtgtgtgtgttctgagtgtatgtatatgcaccatgt

SEQ ID NO: 24335 - DNA, 1176 bp, Mus musculus
tagcctatgttctcccaattaaacaagctgtcttattgaagcctgtctcccgagagtctgttctctcctcctgaggtctccttccctgactgtgcctctcacacccacccccacgctccacctcaggatctgctggttgtgaccacaggtcatgttgctatggggtggggaagcagagccctaatgacatgtttcctgtttaagcatcctttataggggccctgattttttaaattcaaagcttttgtatttatgtatgtatttaatgtgcactggtgttttgcctgcatgtatgtctgtgtgtgtcagattccctggaactgggaatctagttgtgagctgccatgtgggtgctgggaattgaacctaggtcttttggaagagcagccatcttaaccactgaaccatctctccagcctcccctccccctgatttttcttttttttttttcttttttgcaaccccacaaaagaaaaacaaaaacttgtggagattgtagcgtgttgcgcagtataccctttgtccacacgtctttgccagcgaacactgtaaatgttcgttgcaatgagtcattactctggtttgaggcctctggcttctgctctccgtcattgggtcctcacctggactcctctggtgtcctgtccttgccctgtgtcatggagatgctgcagctttggatctgcaggatcagccacttcatgtgctcccagagttcatggattgtgtagatgttgggatgggtgggcaagctcgaattcctggatctgggccttgggggtagctgagtcggtcggcctgccagctctcctgcacccataccaccagggcagggtctccaatactgacctggctagccttcctgagtgctacaggtggcaaggagcagggccaactccaggcagcaagggatgtggagggggagggaggttggttctctgattttgaatgatagctctgtgactttttaaaaatgttggcctttaaaaatacttatttttttatgtggatggtgtttggcctgcatgtgtgatgtatgtctgtgtatcatctgcctgcatgtatgatgtatatctgtgtatcacctgcattcatgtatgtatgtctgtgtatcacctgcctgcatgtatgatgtatatctgtgtatcacctgcatgcatatatgtatgtctgtgt

SEQ ID NO: 24336 - DNA, 1508 bp, Mus musculus
aattttagaaaaacccacactttcgtaccactactaaacctcctttttatctcagttacagaaagtgacgcacactagtgatgtagctgtacttgtctcctgaaatgtcacacataagtgtgtggaaagtatcgctgtatgtctaagtttgttcattttttatagtgcttcctacatgtgttcatgagacgacgtgtatttttatttaaagcatttcaaatgaagtctgtctttaaagcattgggtgtttatgctgtgcgcagaatagggttaaacaaggtgcggtctgatccagttcatctgagactccttaggctcatgaagttactaggcagaaatctgccaagtctgtttttttttgtttgttttgtttttttgtttttttttttttttttttgttttgagacaaggtctctcagtgtagctgcagctctcctgaaattatgtagaccaggcttgtctcaaacccacagagatccacctccctctatctcccagatgataggattaaaggcgtatgccgctactgtttttgtatatgccgtcaagactgtttttgaagcactttccctagttacagtatttgccagtgctagtgtgactgtcccaccagccttacagcaggagctgggctcactgcctgcgctgcaagctgcggtattcgcccctggggaaccatagcacagaaaagctccctgacagcactgcaggtctctgcacagctctggctgtcctggaatcactatgtagaccaggctgacctggaatttataggaatcctctcgtctctgcctcatagctgctgggattaaaggcgtagcactgggtttgaaggatcatatttatactccagtgtttcctaatgatctcctaagtagctctttgttttcctgactgtactgtgaacaggcccagtgtgcggcccttggattggttgtagaccgagtgccaccagagcaggcttgagagtccattgatttaaactccgcagatgctgcagatagatccacgtggcaccaagattacttggctgtatttgttgtgggcacaaacggaacatagtagtaggcatagccaacattgccaggaggacctgcccactagctccagcatgctcatcacgaaggaagcacgtggtctacacaagattattttgggacctgaggaggttggctgcagaatctgggttccctctgggtattcagccctcggggtgagggagggtgtgcgctttcctcttttttgcagtgagccatagtctgcaatggcgctttttgcccacatcgtttaggtagcctgggtcagcatcccaaggccacttggaagggcaatcagaagtgcccagaacagatgcctctcatgatttcagctgacctgaaggaacaaatgacttagtgttcccatgtgtgtaatgtggatgtcagcgcttccacatgcataatgtatgtaagactgttagtgttcccatgtgtgtagtgtatgtaacaccgcaagtaggggacagctgt

SEQ ID NO: 24337 - DNA, 1154 bp, Mus musculus
tcttccttccccctccttctctcccctcatccccctcccctcctcccctccctctgttctcctccctttcctttctcttttcttttttcttcccagggaaacattatttttaaataactaaaactgtggaaactagtctaatctgtcagactgaggagtgacaatacaagcaaaggggctggacagacagacacacacaatactctggcaagaggaattggcctttctgtaagagctgaaagcaggtgttcatttcaaagggagattctcacaacacactgtagacctctggctcacaggacatgcccatgtggccatccaaccagctgcttccagacaggctggagagcactcttgctggagagcactcctgcccactccagtgcaggctcccagctctaacacgtgtgctccttcttccagccccctccccccactctctactagacacagttacttgctgtggtgagctgggtcacagcccatggctcattgctctcttaccaatactggaacttctgagacacaaacctgtatttttttatcatttgcttccattttggctgtaaggtcggtcaacctgtcagtcagttcttctctctctgcaaggtttttgtcttctgagagtctctgcagggcttgcaagacgtctttggtcctcagtaactcgccgtcggtttctcggagtttcctggacacagctcgctccttctcctgggatttccggaggagctgtcgaaggttcttcacctcattctggtgcttggctgtgatttgaggtaggttgttctgagagttcacgtatttccctatggctttcaggtgtctaagctgaagctgcttcagaaattggttttctatggcagaggcttccagcttccgatgtacgtctgccagctcgttcttcagctctttgatcttatgaagcctggctgacagtatccgatgtgtcatggtgtctcttctcttggcaatcgtttgaatttgagaactgatcaacgaagcattccagaattgctttttctcagctgggatgtccttctggcctgagtgagcagagagcgcaggttgttaccagtagtgcacagagagaggcatgtaaatatgcacacgttagtgacccccaacacacacacacacaaatgccatgaaac

SEQ ID NO: 24338 - DNA, 1158 bp, Mus musculus
gtatgcatatgtcaggacctgtgcagatatacagtgtgcacatcttgtgtgcatatagatgtatagatttgtagatgtgttatagagtgtatggatccatgggagttagatgtgtgtatgtatgtatgtaagtatgtatgtacatatgtacaggcatgcaggagtatgcctgtttgtacaatgcacaggtgaatatatgttagtatgtatggatccataggaatacacatgtgttagtatatgtaccatccatcatgcaggcatgtacatgtatatacagatgcacaggtatgtagctatgttgatgtgtgtatgtttataggtatgtgcctatgtgtgctcagatgtacacatatgtacatacacttgtatgtatgtacaagtatataggattgtgcacctgtacacctatgcagaaatgtgtgttcgtgtgtatcctgatgcagatgcacacaggaatgtacttttgtgtggaggaattatttgagcgagtcatcaaggtcaggatctttctggagaagtgggtcacagtagtgtagtagaatcaacttatgtttatttctgactagcttacaaataattgagacttagactatgattattttatttggttttgacaattactgggggtcacccctaagctacttttctaactgctggcctggctacctccccagcggtgtaccccaaatacttgctgtttctcctggccacgtgctcatggtacctttcctgttgtggtgccttctctcctctcctcattctctgcctcctcgtccttttgcccagctcaatcaaccaggtaactcaaaaatcctctggcctctaatccctccagtaattggtggttgtcatttttatttaaccaatagttttaaattaaggaataaagcttgcaggacaaaagctggtaaatgtgagaattcactcgtaggcctataccttctggtacagaattcagcattatagaacccagtaacagaccaaacctcaacactgtagctgcagtacttaccatgttataccttggtcctgggcatcttccaaggaagcagccttgcttattgttgtcatgaagagtgtcatcattaaagtgggacagtagtgacttctcatgaaaatggtttctttctatgccaagcatcatgtgatgcaaag

SEQ ID NO: 24339 - DNA, 1202 bp, Mus musculus
acctttaggaggaagaacccagtgggggaaagtcaggtcattaggaaatgccctgaaagggacatttgcttctcagctgccgtgcagggagtggctttgctcaccctacgtgtttccactgtgatgatatgatatgatgatatgccgcctccggccagcagtgccaaccacagactgaatctcctgaggctgagccagtctcttcttgctttcttcttcgtgaccagccactgtcctcatcctggattggaacccacttcacataataccaacctgccaggagtcctgagagttcaggcagaggcatggaactgggttagagttagtaggcccttgcgccagcttctagcttaaatactaattccagcaaaagaaaatgttgtgctgagtttggggactaatgtgcttgttgtttctagcattttaaagcagcatggaaaactagacttagatctccctggattctgtatagtacctttcttcttctgacacattaatggatgtgtcagcatccatcctgatgctattggcccttcccttttttgatcagtaattgctcgtttagccagtcttgagttttcgatggagcttatgctacctgtgttctaatcttaaagctcccggggttgggatgagtttagaagacaagtgagaataacattcaggaagtatgtatcagcttgcatcctttcctgagacaataagtggcagcagacaccagaaaggcagagtgatggtgatcagatggcaagaaggatatggggtcaggaggattgttgagtgggagacaatgggtgtaccttctctccatactgaccgaagtaggtgtttttgtatgtacactataacttaggcatctgatatcccagaaagaacaacacctgcattaccttgtctgaaacacattggataaaggattggtctgtggtctactgtctaatagatggcttttgaggcaaccttcaaaggatacaaggaaaatagaaatagcttgacaaaggtctatgtgggaacaggagaacccataatggtatcagacactacttattacccgcttgggatgataggacattggcacaagctaggtaatgaaggaaagattacagtagaaatgactgcaaggaatccacagaccagaaagggagggtagagaggcagtggcagtaagaaaagtggcttctaaaatagtgtgtatgtttttt

SEQ ID NO: 24340 - DNA, 1136 bp, Mus musculus
atgcagttgtggtttttctattgctttttatactgtatcttgaaagacatcgggctgcaagaatttattttgatgtcaaactctatccttccattcatgtaactatttcaaatgctaagaaactaataaaaaacagtaatcactttttgcagtaaacagttttttagagaatgtttatctcagctagcaggcagatgtttagtgaaataaataggtctttcaccactgtaaatctttagatagtagagatattcttgtaaatgtttttctaattgtactaatttttacaagtatagaaagctcattgttttttgtaattatttaagatgcctgcttttttatgcagttgtggaaagaatgtaaacttttaatatattctttgttaacctgcaaacttgttattgttttctttatgtggaaaggattgagtacctaaaatatgtttttcccactcaaagtaagcaatagagttagcatttccaggttgctagcaaaatatccctttaaaactagttcagatacatttgtagttctgccagggctgcatgtattctgcttttatgttttagactctgtccttctctttcaaaagattgcctggtgctgagtcactgaccaccagaacctgcatgtagcccccactggcactaatgaacgtggtgactgagatgatgaggcctggagataggcctgaagttggtctctgttccctatagttgggttcgtgtgtgtgtgtgtgtgtgtgtgtgtgtgtgtgtgtgtgtgtgtgtgtgtgtgtgtgtgagagagagagagagagagagagagagagagagagagagagagagatagattggtgcatttccttagtacaaaatgagataggcctgaagttggtctctgttccctatagttgggttcgtgtgtgtgtgtgtgtgtgtgtgagagagagagagagagagagagagagagagagattggtgcatttcgagagagagagagagagagagagagattggtgcatttccttagtacaaaatgagtagctttcattcgttcagatttcttcataaatcccatccattaattttattggaacattcaaagtcaatttgttaatttctgatatctgactggtgttttgggggtagttgtga

SEQ ID NO: 24341 - DNA, 1138 bp, Mus musculus
aatgacctcacagctttctggacctcagcagcaggggtttgattctattactattgaagttggactaatgttggtgattgaggtttttggtttctgagtagtgggatgcttgggaagtgggttttttgtttgtttggttggttggttttggtttttttttgttgttggttttgttttgtttttgattattgcagacacctaaatttgaggtaacctttagccatgtttctaaggccaaaaaaacatacaaggaagaaggggagtcatttgcagtattgagtcagattttagactactttagcaataagaaaaggcaagccccaactttagtaaagtatcctaacacttgataagaaaaaaacttggtattttgtggtcctataaaacttcctttttgtatgaaaattgtgagactttaaatcagcaatagtcacacttagattttttttaataaaagaacaatctgtcaattacatcatacaatcagtgatggtctgttctaagggaggcagagcaatagaagcgtgtttgtggggtcctctacagtcagctgcaacagcttagttgtgaaagccgctaaagtctgtggtgtgttcatagcatggctttcaactggggctttagaactgacaatgtctgctctctgtcagcttgaaactcgggtgtcattgagataagcagtgctagcatgaggttagcagagcatagccttaccacatcctagaccaccattctctctctagaggcttcagagattggaggaaatgccgtgttgcagtttccatgtgctttccaagaactgtacacacaacatagacatttcctgcctgtcttttgtgagtacttctgtggggttattggagtggacagcagtggaaatgtcactacatgatatgcaagcgtggattaaagcactagcaagaggccaaaattagtttttgctacttgatttggtaccttagggtttgggctcctctggttttttcttgtttttttgtttgtttgtttgtttgtttttttgttttttttttttttttttttttgctttttggtttgttccttgcaggttataattaaatctctccataggcagaatccaaagttcagtgaaatatttcaaaagacaaagggaagatca

SEQ ID NO: 24342 - DNA, 1112 bp, Mus musculus
tttgtatattaggcctctataagatatggacttggttaaaaaacaaacaaacaaacaaaaaaacctttccccattccttaggctgcctctatgtccaattgacagagtttccccccacttctaatctgctttctattattggcaaagaggagaaacagaatacacaggatgagtattggtctgtaatttcttaatttttaaattatattcttataactcatgtttaaaagacttatatgtttgtctttctgtctccttttatttgtggtgctatctatgttttgtgtttttattcattataatctaattatgttgttgattctctgaaaaatgatagaccctcacctattttcgtcttctgacaacttattatgagtttcttgagtttttgatagtttgggaaacagtttaagtttcctcttcttgattctgaagacttgcctctcctcatttcttggcagctctgtcttcctgttgttgcaatcagcaatttttggagttttgctatttgagtgattgatatggttaacacattttatttgtgtttttaaaactttctgatgtattattgtctctgtgtcctgattagcttcagttgtcaacattttggagcctacagtcatctgaggaagcctcacttgaggtcatgccctcgtcaaaatggctggatgctatgttagtgagagattgtgatgattgatgtgggaaggctcttccactgagggtggcaggatccctcagcaagtgggcctgggctacataagaactagctgagcatgagacagtgaccaagcaagagggcaaggcaggaaacaatgtttgtctatgggttttgccttattttcttgaagtttctattctaagctcccaaaatgatggactgtgttctgacaggaccaaacaagtgaacctgttcattacctgagttgcttttggttagaggatttaatcaaagtagcagagtatcgagtcagaaccaaggggaaaaaaaccttcaaaaagtgattttgttgctgaaaagaaactggacatgttctcctttggaggaatgtgggagatatcaggacttgagatggcaaacagcaaagaaatctgcactcagagcttaactt

SEQ ID NO: 24343 - DNA, 1146 bp, Mus musculus
cctatgaaggcattcagtctggtgaagcctttgtacatcaaaatagtctccaaataatacatactggagagaaaccctacaaatgcaatcaatatggtaaagcctttgcacaacacagtactctgcaaattcataaaagaacacatactggagagaaaccctataaatgtaatcaatgtggtaaagcctttgtatttcataatactctccaagtacatagaagaacacatactggagagaaaccctatgaatgtgatcagtgtggtaaagcctttgtagctcagaatgatcctaaaagacatgagagagttcatactggagagaaaccttataaatgtgatcaatgtggtaaagccttggcatatcatagtactctccaagtacataaaagatcacatactggaatgaaaccctatgaatgtaagcaatgtagtaaatcctttgcctctcatgatcaacttcaaattcatgaaagaagtcatactggagagaaaccttataaatgtaaccaatgtggtaaagcatttgcatatcgtagtactctccgtgtacataaaagaacacatactagagagaagccctatgaatgtaagcaatgtagtgaatccttttcctctcatgagctacttaaaaaacatgaaaggattcatcctggaaggaaaccttatgaatgtaagcaatgtagtaaactttttgcctctcatggtcaacttcaaagtcatgaaagaattcatactggagagaaaccattcagatgtattcaatgtggtaaaacatttgcatatcatagttatctcaaagtacataaaagaatacatactggagagaaaccttacaaatgtaatcactgtggtaaatcctttgcctcttgtggtcaacttcaaagtcatgaaagaagtcatactggagagaaaccttacaagtgtattcaatgtggcaaagcctttgcatatcatagaagtctccaaggacataaaagaacacatactggagagaaaccttacaaatgtaatcactgtggtaaagcatttgcacgtagttgtaatctccaagttcataaaagaattcacaatggagagaaaccttataaatgtgatcaatgtggtaaagcctttgtagctcagaatgatcttaaaagacacgaga

SEQ ID NO: 24344 - DNA, 1161 bp, Mus musculus
tgcctcttgtggtcaacttcaaagtcatgaaagaattcatactggagagaaaccttacaaatgtaatgaatgtggtaaagcctttacacaccatcataatcttcgagagcataaaagaatacacactggacagaaaccctattgatgtaagcaatgtagtaaatcctttgcctctcatgatcaagtttgaaaacatgaaagaatttcatactggagagaaaccttacacatgtagataatatggtaaagcctattcacaatcatcacctccaactacataaaagaacactaaagagtaaccctatgaatataaccaatgtggtaaaagcctttacagtggtcttgaaaggtgtgaatatacttggtctatggcaagtggctgtattaggaagtatggcatttctggagtagatgtggcatttgagaaagtatgtcatggtgggggtggactttgagattctatgcttaagctccacccagggcagcagagtcttctggttgccttctgttcaagatgtagaactcttgtctcctccagccccatgtctgcttgggcactgccatttttttcagccttgatgatatcagactgaacctctgaatctgtacactacccctaattaaatgtcttttataagagttgccttggtcatagtatcttttcacagcaataaaacccaagttaagacaaacagcataaaagataccacactggagagaaactcacaagcagaaagttctctgcatgtttgataacagaaataacatgttttaagtagtctcttcttccttctcttctctccttccatttttcctcgtctatattcctctacatttccttttcctttctgcttctttttttccccatgaggacagtgatgtattaagatagaatcttacggctggagcacctggagggggccatgttgggtcctggatccctcagatactagtctgcacaggtgagagtatggactacagaagcaacacagcttctgggacagaccccatttcaggctccagacatctgggcaccttccccgccagaggagaggtgtcttcctgggagggctctgctggagcacctagggagccatcttgggtcctagatccctcagagactagtctgcgcaggttagagtgtggaatacagaaactcca

SEQ ID NO: 24345 - DNA, 1147 bp, Mus musculus
gattctatgcttaagttccacccagggcagaagagtcttctggtcgccttctgttcaagatgtagaactcttgtctcatccagcaccatgtatgcttggacattgccactttttcagccttgatgatatcagactgaacctctgaatctgtacactacccccaattaaatgtcctttatgagagttgccttggtcatagtatcttttcacagcaatgaaatccaaattaagacaaacagcataaaagataccatactggagagaaactgacaagcagatagttctctgcatatttgataacagaaataacatgttttaagtagtctcttcttccttctcctcttctctccttccatttttcctcgtctatattcctctacatttcctttttctttctgcttctttttttccccatgaggacagtgatgtattaagatagactctctcggatggagctcctgggggagccatcttgggtcccggatccctcagagactagtctgcacaggtgagagtgcagactatagaagcgacacagcttctgggacaggccttgttttgggccttcatcttcagctaggaggcaggtccaaactccagatatctgtacaccttccctgcaagaggagagcttccctgcagagagtactctgaccactgagactcaggagagagctggactcccaggtctgctgacagaggctaacagactcacaggaggaacaagctccaaccagagacaactataacgactaactccagagattaccagatggcaaaaggcaaatgtaagaatcttactaacagaaaccaagaccactcaccatcatcagaacccagcactcccacctcagccagtcctggataccccaacacatccgaaaagctagacctgaatttaaaaacatatctcatgatgatggtagaggacatcaagaagtactttaataaaccacttaaagaaatacaggggaacactgctaaagagttacaagtccttaaagaaaaacaggaaaacacaaccaaacaggtgatggaaatgaacaaaatcatactagacctaaaaagggaagtagaaacaataaagaaaacccaaagtgaggcaacgctggagatagaaaccctaggaaagaaatctggaaccata

SEQ ID NO: 24346 - DNA, 1146 bp, Mus musculus
gtgcctgagtcgtccgctcgaaaatggcggaatacttggcctccatcttcggcaccgaaaaagacaaagtcaactgttcattttatttcaaaatcggagcatgtcgtcatggagacagatgttctcggttgcacaataaaccgacctttagccagaccattgccctcttgaacatttaccgtaaccctcaaaactcttcccagtctgctggcggtttgcgctgtgctgtgagcgacgtggagatgcaggagcactatgatgagttctttgaggaagtcttcactgagatggaagagaagtacggggaagtcgaggagatgaacgtctgcgacaacctaggggaccacctggtggggaacgtgtatgtcaagtttcgacgtgaggaggatgcagagaaagccgtgatcgacttgaataaccgttggtttaatggacagccgatccatgcagagctgtccccagtaactgacttcagggaagcctgctgccgccagtatgaaatgggagagtgcacaagagggggcttctgcaacttcatgcatttgaagcccatctcaagagagctacgacgggagctgtatgggcgccggcgcaagaagcatagatccaggtcccgatccagggaacggcgttcccgatccagagaccgtggacgcggtggtggaggtggaggtggaggtggcggaggacgggagcgtgacaggaggcggtcaagagaccgggagagatctggacgattctgagccgagccctttttaccgtgtgtctgctagacagtgttgtagttggttgacaagccagttcataatgggatttttttaaaaaaaaaaacaacaaagatgggtttctgaataaactttgtagtgatacagtaaaaaaaaaaaaaaaaaacaaaaaaaaacaaaaacagatgtctctctatacctgaacacgaatgttcatgtaagctcccctatttgttctcatccaacagcagctcctttcattcctgaggcatcagctagccgatatttgggagactgtagtggagttccacctgcaaggcgacttcataactttcaccccagacaaaatacatttcatttaactagtcctgtgttttgttctgttcccttccttccatgttccccatccatgtgttccttc

SEQ ID NO: 24347 - DNA, 1177 bp, Mus musculus
cctgtggacatgagggagaatcttgtgaggccaagtctagaccaccttggtcgaagagaccactttggctttcccccagagaagccttgggggcctagagattttgatgagagagagcatcgagttctgcctgtctttggtggtccaaaaggcttacatgaagaaagaggtagatttcgggctggaaattaccgatttgatcctagaagtggtccttggaacagaggatttggtcaagaagttcacagagattttgatgaccgcagaagaccctgggagaggcagagggatagggatgacagagattttgatttctgcagagaaattaatggaaatcgtcttggacgagatagaattcaaaacacttgggttccccctcctcatgctcgggtttttgattatttcgaaggggccacttctcaacggaaaggtgataatgtgcctcaagttaatggtgaaaatacagagagacatgctcagccaccgcctttaccagtacagaaggaccctgaactctatgagaaactggcgtcttcaggtgacgtagacaaggaggagagcggcacagttgctggtgtagagagtgaagcggtggtagaaagcacagagactgaggggacataacatcactcagtaggtaaaagaaaccttttgtacagttgtcatctctgtaagaggttaatggctgactgcaccacacttgttcatgtttatctaccagaactaagttaatctgatgttcatgttcacctttctcttaaaataattgtacaactgacttgtatagacattgttcttaatatgaacatggtaggtaaacactttttttttctgataacgtataaatgttgccccagattcttttaacgtcaaggagatgctaacggcttgtcggagacttcctatggaagagaaggttttagacgctgtcattgggttgggtatggcaatgacatatttcagaacagcaaggtgtggcccatttcctccataactctaggctgctgcaggattttaaggagacagacaaagctatgacattttatgcaaggactggctctagattcttgaggagcataatacagagattttaaaaagtgattttgtaaaaatctccacgatggtctctgttactccaaagtaagtgtgtgtgatttgttcctcatactgcaataag

SEQ ID NO: 24348 - DNA, 1125 bp, Mus musculus
tgaatggaaggtccaagtagtgtaagtggcccattcagagcacaaggtaatttcactaacactttattcttatcagagtacttcctctcatctgggaattttgctgctttattaaatttatcttcactcctatgaaaaattatactttgatagagactgggagcattattgttaaagttactttaaaaaatactttttaattaatttttcaatatattgctcactgcccccctctcggtcattccctcccataatccttaccccttccctactccccttctcctctgaattggtggaacactaccccaccccaccccagcctcccccaccctggcacttcaagttgctgcaagactaagcgctttctcttcccactgagccagacaaggcagcccagctagaagaacatatcccaggaacagacaccagcttttgggatagcccctgatccagtggttcaagggcccacatgacgatcacctagtacatatgcacagagaggcctaggtccagtctgtttaggttctttgactggtggtttattctctgataacccccaagggttcaggttagttgactcggttggtcttcctgtggagttctatctccttaggggcctgcaatccttcctcctcttcttccatgagtccccaagctccatccactctttggctgtgggtgtctgcatctgtctaggtagagcctctcagagaattacgtgccctgtctacaatcataacagagtatcattaatagtgccagggattggtgcttgtccatgggatgggtctctagttgagttcgttattggttggctattccctcagtctctgcttcatcccttgtgcctgcatttgttgtagacaggatatatttggggttgaaagttttgtgggtgggttggtgtttctatcactcccctggggttcttgcctggccacaggaggcagcctcttcaggcttcatgtccccagtgctgtgagtcactgccaaggacaccccattgattcttgggcacctcctctatcccaggtctctgtgtcctcctggaacaaccccccccccccatcagttgcagatttccattaattctcatggccattcagcaatccccctacctctccc

SEQ ID NO: 24349 - DNA, 1144 bp, Mus musculus
gagccttgctttcctccccactccccaaatactttcatctgaaattgctggaatccaccagagtagaatttctgaacacaggggacttgagtacaaatgctctgtctactgccctctctgcctctattgggatgggttttgcctttcccagcagtcctggctatagtggggcaggccaactgaaaactggctttcactgaaggtgggttggtttctctgtcctggtctttaggctgcttccagcattttaatacttgtggaatgttgtagaacacaggccactcaggagtctgaagtagtaagatcttgagttcaactggagtcacataactagtccacgcctttaaaacaacagcaacaacaaaaacagataataagcactattttaagttttctgttttgtgaatgataagttgaagaaaagagaaggtggctgtggggacaaaacccaacaattttggaacacattttgaaataatgcatttaaaataataatttaaaattaatgctgttcagttttaaaaactggccttaacagttgctagaatgtctttgggcaaggtacgggacctctagtccttaacttcttcacagctaaacagtcttcatcactgaagagacctgtagcactcagcgcctgcactgtgctgggaagctgagtaactgcatcgtggtgtgatgcaaccctgggaagtaggctttgtagtatctgctctgcttaacagaaacttagctcacagttgtaagtggcttccttaagtctcataatacgattttgagcaaagtttgaaatcctgttagcagatttaggaatgagtgtattccacttcagcaaatgccaggctatttaggatttacagttgccttagccactgaagttccccttttgtggtcgcacgtgtacattgctattcctccttttgcaatatgtaagaactcactctatatacttgatggtttttaagtgatgttctttcaactgatctgaaggcagacttacactgcaccaacgctaaataaggttttttttacaaaacactttgctcacagataaaatgtgaaagctctctttcattttcctttcctccttatggatgctttgtaactagtgaggacttacgcagatatgcattgaggatgtgag

SEQ ID NO: 24350 - DNA, 1152 bp, Mus musculus
tgatgaccaaacttgagctcaacacttgagctaatggaatgtgcaaagaaaatcaagtagttattgttagattccaacaagcagcctttagttgatgagctgggagctcagtggtgaagtgcctagtatgtacatagctctgggtttgattctccagaatgaaagggaaagagtacaggtttgtaaaggtggagaggacttagtgctctataaaactgtgcagccatgtctgttttcatttactctgtcgtgttcctcctctaccactaccacccccacccccctccaaaaaaaaaaaaaacctggcaatatttatattttctgttttatttgcttattgaacagtgtgactcattcttcactatttcagtggcttaatagacataggcttttaaaagtatagtgtaaccttaaacctttctcaaacttttcacacagttagccagcagtatcaagttaaaaacaaaacaatgtatgtctggctgaaatctgagttaagtgagcatggatgaaaagatccagactgggtagatgtcttaactgtggcctggtaactttcacagaaaccggaactgaacactccgcacttctacacagaggcactttaagttcattatggccagtgtagtcctgggtaccttatggtaattgcaacacctgaggaattccttctgcagagttagttgttagaatatagagtcagagagcaaatggcagcagcgtatggttgttggagttctataggtttctaaaagctttgtagccatcacggattcccaactgtgttgcaggtagaggggtgcctagaaagcttcctccttcagttcattgcctgaatcatgtcctggaagtaacagattcttgaatcagtattgctgaatttcttatgcaatatagtgacgaaatcaggtttttcaagtagattccccacccccaccccctttacaaaccccacatggtacttgaaaaaggttgattcttttgaaattaagaaaaacaaagacttggccaggtggtggtggctcacgactttaatcccagcacttgggaggtgcaggcaggtggatttctgagttcaaagccagcctggtctacaaagtaagttccaggacagccaggactacacagagaaagaaaccctgtctcaaaaaa

SEQ ID NO: 24351 - DNA, 1104 bp, Mus musculus
atggtgttggagaaagagctgacaggcatggcactgaacctggctcgagcttctgaaacctcaaagcctcccccgaccccagggacacctttcttttgactaggccatacctacttcagtaaggccacatctctaatactgccaccctgtatgagcttatgggagccactttcattcaaccaccacactctcaattactcaaatcgtgagaacgagtatagaaacattaatttacacatttgatctccttgttacaggagccacgtgagtcctggcatgcagttatgccaacagtaatagtaccctagaaccaagatgatgagggcgtggctgagtgagcatagcactccactatacacatattaaatattcttttagtctttgtgaccgaaaccattgttagagaagtgtggtcttgatactctgctatctcatttctgtccaccgatggttttagatctcttatcagctgaggaactatgtggtagatatttctttagtttacttactgatttcatctactaatttctctgtctatttattatctatctagctacctaccatctatctatcttatctgtcatctatctgcccaccttatctatcatctatctatctactatctatctatttcatgtagatgagtgttctgcctgcgtgtatgtcgtgtaccacatgtatgcctggtgcccgtggagaccagaagagagcaccaaatcccctggaactggaattaaaggtgtctgtcagctgctttgtgggtgccaggaaccaaacccaggtcctctggaggaacagccactgctcttcactactgagccaactgcccagtgcccagaatgccaggccaggactgcctctctgagaatttgctgaactgaaatcaaggggttgagctgctcatgccccttaacacttctgcagagagatggaagactccccctccccaacttatcctattggtaatggccctggaacaggaaaatttaaattctaaaatacgtctggcaactaagacaggcaacacatagaaaaaattagcaaagtctgttgtaaaatatatattgtaaaatgcgtatgctgtctggcctattgctgtatgta

SEQ ID NO: 24352 - DNA, 1172 bp, Mus musculus
ttgcctcgcccatctccccagccccaccaaatagctgtgtttccttttaattcttaattttgtattttatttttatgtatctgtgtgttttgcctgcataaatgtctgtgcgccatgtgtgtggctggtatctttggatctctcggaactggagttacagatggtcatgaacgtccatgagcgttctgggaatcaaacctaggtctgatctggaagcccagccggggctcttaaccactgagccatcgatccagcctatttttgataaggtgcagtggttttcaatgttggttgaaatacagtccatacccttgtgattgttgaaaagggggtttaagtatcccacactgccttagtgtcagtgaaaaacaaccgatccaaagcatataacccacgctccaaatcaggcctggcttgcccctctttaatgggaccatcgcaggcatgccaaatactacagctagtggattgtatacatctggtaagacttttcataacagctaaggtttgcggcaatgtgattttaattacagacagattgactagctggaaaaatacacgggaactaaacagagagcagagctaaacacaagccctttcataaatggtcctgctttggttaggatgactttaagtgactgctggggacagcaaggatgatgtgtgttttggggggagctctgagggtgggatgtgactcatcttcaacctgggggccagtcgttgtctggagggggagttcacagtggtggtgattagactccttttgaagttcaagcaggctgatgcttgtctcctgttaccttgatccttgggagcacagtgtctttgccagacaaaattgctctggattggaccacatttgctttgaaggcttgtggggatggctacgcagaggtgcagttttgagtctttccccctaaacagactgtattagaccgtgttcttctttctctgaagttcattccgtgtaaagatgtcagatgtgcaagcaaaggcgcaggaagccagctgctgtgtcaagacagtttccctgcctagagcacagggggaccttttccatgggcaggggcacctgactctgtgtgggctggagttatgacccccacccctcccaccttacctaaggtgttcactggaggatgaaaaacctgaccaaaatgcaggccctg

SEQ ID NO: 24353 - DNA, 1755 bp, Mus musculus
cttgctgggctcgctgggccactcactgctggaggatgttctgaggaccttcaaggacctggatgaggctaccaagaaaaaaaaagcacctaagataattaaaatgcaattttattacaagactaaatcatttgattgctgctccaaagggataggtgctagtactttacagattctgaccaactaaatctagttttcggattcacaataaattaaaataacttaaatctttacaggttttgtggaaaaaatatactgcgtaaaactcaaacatgaatagttttcctgcagtttctcttttccaccaatttgaaaacaaatgagcattgtaagcacactacacaaatcatgatttgccatggctctgtgtttcataaaaaccctcctcattgacgactgaagttaagctctggacactgaattctctctccaggaccaagtttagatcaatgctggcagtttctgggtggctgtccagggactggtgacgagtctgcgccttgagcaaagttcctctgcccctcttggtgctgtttgctttccgtttaatggggcaaaaatggcccctgaccagcttgggctgttcacctgactctgtgagaggctgctgcccaactgggtgcacgtcggattcctcagagattttcagtctctggaactgaatctcaatgtccttagtagggctaccctgtttcagagggtggtggaagtcctcatcttcatcactcagaatgtcgctttctttgataagaccatctggaaactccgccaggccctcctgagcgtctttctccagctcggtgctcttagagtctcgcctgctctcggctacggggcagccgctactctgggtgccactgctcaggctgcactcatctgagtccagtgagttgcccttgctgggctcgctgggccactcgctgctggaggatgttctgaggcccttcaacgacctggacgaggctaccaagaagaaaagcacatttttctccacatgacacggaacagagtctgcaatgtagagttaaggccccagggatgacacttgtgtgaagattttattatggggagtagtaggtggcaacaccatttaggtcaaaccatgagtttactgatgcctttacggttttgttgttgggtctcttacatagctccggctggcttcaaactcattatctagctgatgaccatcttaaactctgcctctctattcgagtgctgtgaccccagtgttcaccaccatgcccagttttatgcatgctggagttcacagaatgctgggcaagctctgtgcccacttagccacacccccagacatgtctgaaatgaagttggaattcagctgctttttagattcccagagctttatcatagagatagtacaataaagttccaactaccataagggctagagttactagtttgccaatgagttgattgaacagttaatcactaataaaaattcaagttacattcttttaccttgtaatctggaaatactataccacacctctacacatagcttccccgtttatttccctagatgctgcattagaacctgaaaaaatatccttaccgctcttgagcactgtctatgctggaatttataatcaacattaagagaattaacattatgagcattcaatcatgtgggggagttggggagtgattgtgttctctagaattggaaagggaattcttagttttggatatttctataagccattagcacatttttgataaccacagaatatc

SEQ ID NO: 24354 - DNA, 1168 bp, Mus musculus
tgtgcttaaaattgtttaactcgatcatttaattagaataatatttccttatagacttgcagttgaactgcttactgcttgagcctgtttggggcagttgcattaattttgcatagctgttactattctctgagaaaatagcttgaggggaaaagatttgttttggggctcacctcatgtgcctgggcagagagcatcgtgcctctgaagtgtgtggtggaggagagctgcttacctcatggctaaaagggagccaaagaaggggccaggcaagatgctctcacaggttgcctcagtgacctgctccccacagctcagtcccacctcgtcaagtttccagaatctcctagaatagtgcttctcgctgggtccaagccttcagcacatgagctcatggggtcatttcatagtaaaaccatcccagaggttctggtaagattaaaagtggagataagggtgcctaggagcattgacggtttggtaggaagctggcttctaaagtggattgttcttcctgttaagtcaatgctttcagtggatgtttgcaaagttgagcgttgtggaaggctttggacgtggaattatttcctgcttatcatgtgggaccaggctgtcctgttcatctctgtgacctgttctcattgtgctgctggggtgtgggggagagagtagggtctgcggactgcacacagcggccatgcctgcagcctcttctcagtcatccaccttcaccctgccacctttctagactctggaaatctccgttgctacagacttcctggggattaaaccacccatacatagtagagcaaatgaacaggaaaataatgagtttgaggctggactgcagtacatagtggaaatctttctgaaaacagaacagccccccaaagtaaaataagtaaatgaaatgctgtgtgagtacgcacgcctagagccgcacagtcttcccgctcagtgcttataaaaggcgtgctcatttggtgtgtttcagctgactggagcttgaatcctggaacactaattctagctgtgggtctggcatggcttatcttttgtgtgtgtgttgctttgctgatggtgggaacagaggctcctgccatggtgctttggtaagtggtggcttgcgttctggttgtggtgattctggcagagctcttgtaaatgg

SEQ ID NO: 24355 - DNA, 1152 bp, Mus musculus
ttcaaatacatggttaccaaaaattagcttactcaataacactagcttttctccttattttcccttgatgactgctagctaactcaggatccttacaaggcccacagactccacagtcaactgggagcaattcgatggcagaggttccaggtgacctgaagccaccaaccccagcctctacccctcatggacagatgactcccatgcaaagcggaaggtatgctctgaggactcttgagatataaagcctagttttgttttggtttgggggcaaacttaatagaaaaagttcttccctgattatttttaagtgctcagtactgctcctttcagcgtgtagtttactttgggtggttttgcatccaccagtcgcaagtgtggcttatttcctgagctctgtgggtatatagtgtcacagtatcactcagctttcccgctctgtgtctctcagaagcagtacagtcagtgtgcatgacccgttctcagacgtgagtgactcagcgtacccaaaacggaactccatgactccaaacgccccataccagcagggcatgggcatgccagacatgatgggcaggatgccctatgaacccaacaaggaccctttcagtggaatgagaaaaggtacgtggaggggcattctccaggagacttcctttcccagctgcctggcagcctgttcacctcttcagttgggacggttctaagcccctgccatgtagtgacacagcctccttcctgcttaagccagagcctcaggagaacttggccactctgagtctgacttgcctctttcggaaatggtgaaagcagcagattaagtccacacacaggaagccagtagaatgatggacagttgtggtctggaaagcatccaatggctgccatgatcgacatggtgtgaacagaaacagggcacagtgctaagtacaaaatagtgttcttacattcatgattctaacagttaacagacataggagggcagaaaagcaaagaccctggtgggtaggagagagcaagcagacaggaaagcgtggaaatagcagcggttttgagtgaatgcattggagggaggcagaggccctgcagattggtgtatctgtagcaatgggatctacctgcctctgtcttcccaatgcaggggcatgagag

SEQ ID NO: 24356 - DNA, 1205 bp, Mus musculus
cactgcaccataagtggctgtggtaagtgggtagatcaggaccctctctgccacaggtcacatcgcaagcccctgcaattctgaaaatctcccagtacagactcaggatatgaggagtccccagtgtacccccatcctcagcaaagctgatgtcatttagtcatacttttctaagggcaggagtaggaagagtgacagagagcgcagactttcagtctcctactcctaggcacagccacagccgggtagaggtgagagaagagagaccttcctctgaccttacactgtttggggggctacagtttttttcaagccagctctgctggggttggcccagttatgcaagcctggtgcacccttaccaagtggtaaaagaaacacctaagacgacaaaggccatgcgtgctgcctgggtacttggggctcctgtcctaccaccaagcaggaaggatcttaaagaacaaagtagtgtgttgagttaccatctcctgctaacgtcagatgaagctgcacagctgactgctgccgtcagcactctgctttctcctccagagccgaggttcataatacccgttctccttttcagttactcccgaggcgtggcgtgtgatgatgtcccttaaatcgggtctgttggctgagagcacgtgggctctggacaccatcaatattctcctctatgatgacagcaccgtcgccaccttcaatctttcccaggtgaggcagctgcacacagctggcaacaagttggcacgttataaaatgaagtaatgcataatgctgtgctggtgcagtgaccatccaagacttggaatctttgtagctaatataaagcagcattagttaatatgtagccgcctatgtactcagtctgggataataattcatttccatcttcagggtgcgtgcgtgtgtgtgtgtgtgtgtgtgtgtgtgtgtgtgtgtgtgtcaaagagagagataggaacaaagaaattgtttcagtaggaataattaaacaccaacatgaagttggaactgatatgagttacagaaagtacttctcagtacaacttaatatctttctttttacgttactgatttgtaattatttgtttgaggcagagtctcatgtagtgcagccttcaaccaactatgtgatgtagacctgctcccgtgtgctgaggttgtagatgggtactgccacatcccatgctgtgtctttt

SEQ ID NO: 24357 - DNA, 1168 bp, Mus musculus
gtactgtttcagattgggcagttatgacatccgtgaaggcacacatgtgtgagtgaacattagagggtcacatataactggctgttttctgttctcgtttatccagtgtaagaagaaggaaaagaaaaatctttgctcctctgccccgtttactatttaccaattgggaattaaatcattaatttgaacagttataaaattaatatttgctgtctgtgtgtataagtacatcctctggcggttttctgtttcttttttttttaaccaaagttgccgtctagtgcattcaaaggtcacaatttttgtttgtttgtttgtttgtttgttttttcataatttttttcatgttgtattgcagtctttgggaagtgaattgactttataaagaaaaacgttttggcaaaaagtgctaagatagaaaaatgtcaccacactgggtcaaaaacgtgaaaggaaaaattgattcttaaattgatttcctatgaattttattcttcacagaatgataaaagctaaactgcaccccgtcacccaaagctctgtgcaatagaaacttctagagatatagtgtaggggctgaaggaggtatggcagcagtagtcagggtcaatgatactgctttctccaccggaaagtggttacgttaggcctcgagcaaaaaacagcgctctcagataggtgcaaaaatccactcctagcagccaacagcaggatcgcttcctcaccacgaccgccatgtctgctgtggctcagcctccacgggacaaagcttcaagatttctttcatcatttttttaaatattttttttactgcctatgggctgtgatgtatatagaagttgtacattaaacataccctcatttttttcttcttttctttttttctttttttctttttctttttttttttttttagtacaaagtttttagtttctttttcatgatgtggtaactacgaagtgatggtagatttaaataattttttatttttattttatatattttttcattaggaccatatctccaaaaaacaagaaaaagaaacaaaaaatacaaaaaataaaaacaaacaaaaaaagagggtaatgtacaagtttctgtatgtataaagtcatgctctgttgggagagcggctgatcccagtttgcttcatgaatcaaagtgtgga

SEQ ID NO: 24358 - DNA, 1196 bp, Mus musculus
taaccagcagccagactttgaccgccaaggccaacccaagctctatcttgttttgacaaatgtaattgtttaaggggagataaaggtcctgtttgcttccttgtataaagccagcctggagcatctttaatagactaaggtgatcctgaaggggggctgtgtacttttgtgcgtggttagctccctggggactcagatgctctcaaggtcccatgtgcgtagcctgagggacctaatggggcaagctttgttcctgatagacacaggtggaattttgggagctggagtaaaatgaaaattggaggcccttatttaaaaatattagggattgtgagatagcagtgtggcacattaaatggaacacctggcctctatccctcgactgtacaggccttactcctgcagcgccagctggcccaggctacacaagagctctctgtcacctatgagcgactgaatcaggatgtgttaagaaagggtacatttaaagccgtatcttgaaaaacagggttgtttgtttgtttgtttgtttgtgaatggcttggacaagactcaactttgaaataaacaagtacgttatagctcctggtgtcaggaaaaccaggtttcctgggaccgaggctgctgtgtaacactcaggctaaaaagacaggtagagggcagatcctgtgctttggaaggcaaatcccacaggggtacagaggtcaagctggctgcccactctggtgaggagactgtttaaaaggctcttctgtgtttggtgacatcttctcacagaagggttatgatggctctaccctgaaatggctcctcacaaaaaaacttgagatgaccaatagagtccataggcagctattggtttgtcctgaactgacgtcctaggtccagcaaactaaaccgaagttcatactgaagtcctgcacagctgagccacagctgctttatctgagcttccaagaagacaaaggccaaactcaataaggggattcggccagcctgataagggagtctctacctatcttacaaattctgacacaggaagtgaccttaaaatgaccaatcagccttttgttctgtttcccctttcctctgcccttttctgtctttaaactcacccacacacacacaaatacacacacctcagcttgtcagaatattcagtttatatttataaaatgagaagttgcctaggattg

SEQ ID NO: 24359 - DNA, 1207 bp, Mus musculus
ggtcttcaggcctgacagcaagcacctctgatgctcagccaccccttgggccttaagccataattgataatctatcttattctcttgcttttcaaccaattgttgagtcccaattgttgagagattgagagagagaaccaaaacagcatgcagtaagaactatctattgcatttgatatcgaggaaggctggccaaaagaatccgaggagccccttcagatctgaaaagactcaattttaaaagaacgaaaacatctaacgcatccaacatgagaacaaattaccaatcaagatacactgcaggctttgactggtcactgatctctgggtataagtttccctttccgacaaaacgaccatttgaaagccagcgctttaacaatgtgtaattagcttacacatgtcgtcagggagattttttttaagtatctcaaactagcaactttaaacctttgtatttcagtcaccttaacaaatatctttagctctgggaaatgagtctatattaccgtcagcgagactgaacttgtcagcattgcccctgaaatactgtgctaaaaacgtgcagtcatcgtaactaaggcagaccaaaagccaaaacagactggacacaaaatggaatctttgggtggtggttgctcactgctgaagtcattcaaccaacagatgctagcttaaaacgccctacagttaaacattggtttaaaaataaggctattccaactgttgtcctgttccccacccccacttgacacccttacactgtcttgaaactgggtcttactatgtagctctggctgtctggaacaatgtaggccaggttggccttgaactcacagagaaccccctgcctctgactcctgagtaatggattaaagatgtatgctaccatctggcttgttcaattcttaactctactttttttgacgcacggtcctgggtgtaggttctaggtgtggtactttgatttcagattctcaggggcagctgctggcttaattactatgtagaacaaggaaaactacaagctggagtttttcccatgctgcaagcaatcttgtagagctgacctccctgctgcctttctgactggggggttacatttatctgctgtcaaattcacctccaacgtggcaggaaaagacggtatatacaggaagagggcatctgagcttaaaacatttttctgttcctgactgcatttgcg

SEQ ID NO: 24360 - DNA, 1172 bp, Mus musculus
ttcctctttgcgatgtttaatttcacagcttaaagactttggacagtttttgtgtctttaatgttaagtaactgctgagagtgaatattctttgataaaatggttagaatttaaaacttgtaagaaaatcactcccgtgttttctcatattattaaatctccaatttggagttagctctaaaatgctgtcctgaccaggcatagttgttaatctcactactcaggaggaagaggcaggctagtctctgagtttgaggccagcctggtctacagagtgagttccaggacagccaggttcaaaggaacctgtcttaaacaaccaaaagggaacaatgagaagctggcctagtctcctcctcacagggctgacatcatggagaatatgcaggacaactttctagaatcaagggagactacagagaagttaccaagtcctgctttaaaacatctttaaagacattttacagtgaatatttgaatgtggagtttgcctggatttttgattttttgtgagtgctcttggatataataataacatcatgatatttgtttgttttttgaaacagagtttctctacatagtcatggccatcctagaactcacagaaatccacctgcctctgcctcttgtgtgacccaacaataaatttgttcttaggagatgcagattgaatctgaaagggttaaaagttgtcatgtctgcataggtggcttacatgcacgcaggtggctcagtatggcagagtgacagttgctgctgctagctggaacaagcatgtggttttttatattacatctgcttcaaaaattttttagtggaaaagagaattaccatataataaaagttatagaatattaaataaataagtacacatataatacatgttgtaaatataaaaatatgatatgacagagctaagatcaaacgctaggtcacttgtatctgcttttaatgttcccgttacaattcccaactatttacagattaccatccaatataacagtgaatattaaaatattttggagctaggaagatggctcaatcagtaaagtgtttttccttcatgtgtgaggatctgaatttagataacttagaacctacattaaaaaccagtgcataattacagcgggagcctgtaatctcagcgcttgggaaacagagataggagggtg

SEQ ID NO: 24361 - DNA, 1385 bp, Mus musculus
tggtggccggggaggcaagagaggaaaccagtcagggaagaatgtgatggtggagccgcatcggcatgaaggtgtctttatctgtctcggaaaggaggatgatcttgtcacaaagaatctggtccctggagagtctgtgtatggagagaagagagtctctatttcagaaggagatgacaaaattgagtacagagcctggaaccccttccgctccaagctggcagcagctatcctgggcggcgtagaccagatccacatcaagccaggagccaaggtgctctaccttggggcagcctcaggcaccaccgtctcccacgtctctgatattgtcggcccggatggtctggtctacgcagttgagttctcccaccgctctggccgtgacctcatcaacttggccaagaagaggactaacattattcctgtaattgaagatgctcgacacccacacaaataccgcatgcttatcgcaatggtggatgtcatctttgccgatgtggcccagccagaccaaacccgaattgtggccctgaacgcccacaccttcctgcggaatggaggacactttgtgatttccattaaggccaactgcattgactccactgcgtcagcagaggctgtgtttgcatctgaagtgaagaagatgcagcaggagaacatgaagccgcaggagcagctgacgctagagccttatgagcgagaccacgccgtggttgtcggtgtgtacaggccacctcccaaggtgaagaactgaaactcagagctgtctggattgaagagatgtgtgttgttactgttgcacgtgtggcttgtgattttttgggggcgggggagttgttttgtttttctattaaaagactcatctgtcaaaaaaaaaaaaaaaaaaaaaaaaaaaaaaaaacctcatcctagctgcctggaagccagtcttctagcagccttcagaaaatgtagaactctcagctctttctgcatcatgtctgcctggatgctaccatgctcccaccttgatgataatgaactgaacctctgaacctgtaagccagccccaattaaatgttgtccttataaaacttgccttggtcatggtgtctgttcacagcagtaaaaccctaagacaccacctaagtagcagaatcaagaagcagctttaaagcacttctcaatgccaaacccatacctgcccccacctccaaaacatgactgctgtatagtatagcctgctttttagtatgatcccactacagccttttgaaccctagtaaagccattatatctgagatcagaaaactgctaactgcacccaaaaactgttacagctgcagccaacactggtcaacagaaagggtctgaatgttctccatgacaatgcccaacaccgcatc

SEQ ID NO: 24362 - DNA, 1351 bp, Mus musculus
cactgggcagtgacctgcttctcaggctccccaactggatctttctgtgactctattctctagggagtgagaacagtaaaacaaacatatgaaagcattacaaataattgcctggctgcagtaaatgttggacattgctattgttactttataggcattctaccatttataaactctggactaggagcagcgccttggaggtcccgtggatctgtgtcttgcttcaacagtgtttgaacggaacagacccggggattcccactgtactcgcttccagccgcctttacaagtctctccagtcgcagcctccgggaccatctcctcgctgccttcggctcctaggaccagtctgcaccgtctcttcgcggttagctcctactccggatcagccatgacctctcagattcgtcagaattattccaccgaggtggaagctgccgtgaaccgcctggtcaacttgcacctgcgggcctcctacacctacctctctctgggcttcttttttgatcgggatgacatggctctggagggcgtaggccacttcttccgcgaattggccgaggagaagcgcgagggcgcggagcgtctcctcgagtttcagaacgatcgcgggggccgtgcactcttccaggatgtgcagaagccatctcaagatgaatggggtaaaacccaggaggccatggaatctgccttggccatggagaagaacctgaatcaggccctcttggatctgcatgccctgggttctgcccgcgcggaccctcatctctgtgacttcctggaaagccactatctggataaggaggtgaaactcatcaagaagatgggcaaccatctgaccaacctccgcagggtggcagggccacaaccagcgcagactggcgcaccccagggatctctgggcgagtatctctttgagcgcctcactctcaagcacgactaggaggcctctgtgccttccaaggggctcccccctctgctctgcaccagcccgccctgggacctccacctgaatgaacctctcaagccactaggcagctttgtaaccgccctggagcctctgtcaagtcttggaccaagtaaaaataaagctttttgagacagcaaaaaaaaaaaataaataaataaataaataaataaactctggactaaaataaaaggatattcgaagactattcactctgctctattctaaacgtagggtacagaataatgcagaaaggaaggactactccaattccaactaaaatacaagacataacacttcttcctggatggccttaatatgatggtgaattactgaagcagaagctgagcaagatctaaggatttctgcatcaccttcaccttc

SEQ ID NO: 24363 - DNA, 1792 bp, Mus musculus
caatcagtggctttatcagatagttgtaatgtaaaagtctttagtttcaggtacagtgcttatttattagaactttgatttgctactttaaaatatatatacacacacacatgcatatatacatatatatatacacacacacacatatcctcttttttgtcgttgttttacagagttgtaagagtccatccaggaccttccagtcatgaataatctgatggctcctgaattaaccgggaaaacaaacatatcaagtgccatttgaagactctgtctatctatgtaaaaccttttctgcacatagaagcttttccataagaagacattctgaattttgcaactgatgaagattaagcatcagctggagcacctttccactgttggggttgggagtctgtggagaacagtctgtcactaatgtcagattttccttacagtgttcataaacaaaagccagtttgcaaaagaaaaaattgcacagattaaccctaaagaatagctccagtgtaaagcaggggcagaccttaaaactctgaaccggagctcagtgacttttcctgtggttgtagcaggagtgaggggactgatctgaaaggaacagattcctttgtgtcttcagctatcggaagttttttatttattgtttatcttttttcttttctgcatatatatgccattttaaaatactaattggaactgtcagttacaaaataaatatcaagaaaagccttttttggtccaaaggtgtgaacaggcttgcaggtgaacaggaagacatctttggtaaagcttggaccggtcttgggagatggtgcatcttggagggctctgctacacgcctaggtggctggtttaaaggcttgcatcgcagacggagactaattaatagacacagttctaagattgctttttcattaacatagaaactagagaaaggagaaacagaagcctgcagcctagtctgtgtaagcaagaagtaggaccaaactgaggaaactacttggtccatttagatagcagtttattcatactcagtgacccgcaggcctccacctctgcttgagggaagggctttgctccagtctctgtggcactgagggtggttccagcccatggaggagtcattctaggaagccctgtgttcctagggacacagggccaggctttgagacaggaagcttctggctgtgagcagtgggggaaagagtgattttcttgttaaagctttgaccattgtctgcatgagctctggtgtgactttgcacgttagtgtgcctttccccttatgcaaccttttccagcttacagcagaaacttgccgagttcagaaaacgtgccagagggtggcttcagagggaagatgatcttgtgtgatcagtctctgcacttgaactattgaatagagaaatccagctagaggaattcttaccgccttaagttacttgaaatctatgtgtttgtaaccctttgtctctggaattacattacaaaaaaaactggaatctcaggctgagaataacgaggctgagtaaaagcgaagagaactgcctcttcatcatcacttactaacagctctttctccaaaggattggtgtggtttcccgctaagaacttgaaaatgagaacggaccctgtgtatttttaggcattacctttcttcgccgactgacgtcttttatagaggagttttttcactatgcatttggtggagctttataagctattgacctaattggactctagatcagttgtaactaaaggagaaaaaaacaaaccaacggaacccaaccac

SEQ ID NO: 24364 - DNA, 1151 bp, Mus musculus
tctcccagtgtatatctttgacatcttggtcaaaagttaggtggctgtaactgttggagtttaatttggggtctttctgtttctgggccagcctcatgctgtctttttcattgtagctctgttgtgtaacttgtggtcaggatgtaaatacctttaaggttgttggttctgattagaactttgactgtggatggatttttctgttgctgtatagatgttagttgttgtttttgatttaagttctgtgaagaatgttattggaattttgatgggaattgcattgaatctgctgatttctcttgttaatattgccatttccatgatgatagttaaaataactatcatggcttatgtagttggacttgctgttgtttcacttaataaattatagaattagatgaattgggtggtgattatcacaggattgtttgttataaggctttttaaaaaaaattgttcaaattgtgttcttcttagattaaaggtaaagtccctgaaccctggtaatgcggtcgctccctgatgtgtcatttcctgtgggcacgcccaccgtttggagggtgctgcttcagaggcccagcattggcactaattggcacttactttgctttccctagaagtaattctattagaggaagtgaaccagcatgcttgcacctcagcttagaatccgaatatgcttccagaggtcctgtcctgtgcttttattctgactttaataatttcaataaatatttgttagctgccatgctataaaacggtaggctgcatcttatacgagacagccataggtttttctttttgaatactcaaaggcatgaattaaaacttagctcactttttccccctcccagatgaatgcagccttcagctaacaccctagctgggggaggcttttggtgcacagactgaatgaatcctgttccctttagaagggcaggaaagctgtggctaggatgcctaggtggatccatagcacctaactacacaatctgggcagctgagatcccagctgaccctgtctggtaattcctcaacactctggtatgtcctaaggctgccaagcaggctggcaggctgtagagagcaggaaataagctactgggagataaggcaggcagctgtgcagtgcagacaggagaggaaatgag

SEQ ID NO: 24365 - DNA, 1191 bp, Mus musculus
cacggggataggggtgactttggccaggcccctagggtgcctggcctccttttgtccatctcttaaatgaaaagtcatacctggagaagcttaaacactgcattctggctctggtagcctgagagctcagaattcagcagcttgtcttccctttcacgagggtgggagtatgtgtcaaaacgtggcacctgtgtagacaaaagttttcatgagtctgtaagctgtctattgtctcctgaaaagaaaccagaagttttcccctaaatgtgtttagaatgcttattctaataaaatgatggaagcatcaaatccaagtgtagtggaagtccccaaggagtccccaaggagtggggggtcctcaagtaaaacaaggcactgtgtggctgtaaaactgggtgtgggttgccgcctttggtgtgctgtcctgtgagctggggacaggttggccacagtagctgggtttgagctggcatttgctcctgggagtttttggtaacatacagttcagaagactacaccgctgtgtatcgcctcatctctggcagatgaactctggaggattgtgactgacttggtttccattttcttcagctttgtgcagttctcctgtgactttgtatccgtgttttctgtttacaagtcaattttaaggggaagggtaggataagatctagtttattgtagatattctttctcgtgttgtagaaaagcatgggttatacatttgagtggaaacggcactgtattatttaccaaaggtgtattgtttgcatttgtttataaatgcattattttagtactgtaaatttgggcataatttccgagtttactactattgctactgctggcatctgtctttctccttctctgtcatcttttttatccccataaatgtgcaatgtggggtgcatatgtcacagaccaaacaagaccaccagcatgttcttgtccacactttgggaacagcgtgcactgtttcatacacatcggtccctgcagtgttggtttcttcatttcctttgaaaagtcagcattttgctttaaccttccagacaagatctgttgagagtcaccattgcatctcaatgagctctcccttatttgcctatctttgtatgtattttgtatactagattgtccaggaagtattctagaagggagtaatggtttgcattcaaaatgatgtaattt

SEQ ID NO: 24366 - DNA, 3575 bp, Mus musculus
cataaaacagcacaagccagaccccgtggtgcatgcctgtaaccccagcactggggaggtgggaacagaaggcttctaggcctcccaggcagccaccccagcagaatcagtgagctccaggtcctgtgagaaaccctgtctcaaaccctgaggaggtgagccattgaggaagacaccgatgttgacctctgacttccacacgcatgtgcatgtacagagaagagctgccagagtggccgagggtcacaggtctcttttgccacaggagtgactatgaagaaatgcccctgcagaacggccaggccatccgtgccaagtgcagggaagagtcggacagtgactgagccccgggcagcagatgggacagcagggggccagaggcctgcctgagtgacacattctggccccttctatctgtttgtgtctggactcctctgtaagcaaaggtttcctgttccttatttgtttacatatttttaaaagaaaacccaaatggattgaaatgtggggcggagtttgctttgggggcagccccactctttaagaagaggggctgcctggtagagaattcaaaggcatatcctgtacaccgacatcaggtgcgatggagcccgtatgcagtcatgaggagaagttacccatttttaataaaaagaattatgtactttttctttccttttaaaaaagcaattgagtctgtgggaggcctgacgatcaaggtcccagcgtggcagtgatgactctctcctctctgtggcaccgttcttgagtgccctaccctcaagggaagtctaagctgtgcccgcctcaggtgggcggtctgcctccctcttctccagcacatgatggggtcagtatgctcactcaggcatctgctgtgagactttgattgggtttgatgagccacattcaatagcatcttcaggaatggcaagtggccaggttcccgtccatcattgccaccccccacccccagcagaattgccatccaagttgagtccagagtgggctgatagcctggaggaagcccaggcagctacaggccagtagcgctgtgggcaaggtcctgtgtcatggtgcttttcaagggtctgtgtacagttaggattgggtctccctgtgctggaggtggaaaacgaggaggcccttccgaccaaaatttcttcatcttcactgagtgtgaaccccccggagagctctattattattttttttaaatcaaagctacataaaatacaactgtattagaaatactttattgccagaaagactttctgttttaattaggaactaaagtaaagagaaagtaagacattttgaatggctatagagacagctgcagatgaagggagtccccccaaggttgttctgggtttggagtgtggctctgtggaaaacggatgtcacccacactgaagttcagcattggaagtcctcagggccaccgccttccttcccgctcctcagtttccccacacagcgtctctgcgaacacctggtaaaggtagcatcctgcctgcctctgtcttggcaaatccagaggcccagttccggtagatccctcttctgttcccttcgtctgtgcaccgactcagatttccgctctgagctgcaggttactgtccgtgtgggcccgactccagggtggaagacgttcttcagtctgcctgtcttcttaaacttcatactttaatatggattccatgtgcattttttttaaaaacaaaacaacttgtaactatgaacattggaatggaaactcactgcgagggtaacgggtttacatgagtttgcacttgctgtgatcactgagtctgttggggaagataccagaatatcttatgttaccagcccttcccttccagtggagccctgcagctgccatcttatggacgctgactcgtactgatcccaagatgttcgaatatgtgagagtttacatgtcttcatcattataaataagtctccatggtttataacactatgtatcagtcagtgtaagatattttaagcatttaggtacagacttcagaacttttaaaaactgccctatagaataattataaactgatcctagtgtccgtaaaactaagggaatattttttttgctgttgaaatatgaattataaagcagcactcctagggtcgtgtgcatcctgtattagatgctgtgcaaagctctgcttacagaactaagacttcagtgtgtaggcagcagctcaggggtgagcttaaaacactaaactccgccaggacttttgatagtcaccagaagactgttctgttctgaggggattaaaattttgtaaacttaaattataagttcaaagggctgacttagttctttcagggtaacggtttgaatcctcctgtctttggggtattttttatattggtccaatccaggggaacctggaaggtgacggctcccagattcccggtgagagcttcattttccctgtgggtagtaaatctgcgtgatttattgtcattcatggcagcagtgattcggtgccttcaagccccatcgaaaggctagagaagagggtatgtaaacttacatccgaggctcgtgaggcgcttgctctctgtacagttagactgaagtaagcttaggtatgtaaagccatcctgcagatgggcagtttataaagcaaatctcgccagcctcaagtgctgaaccattgaaggcacagttaggatgaacaggttcaaatatggttactaatctttataggaaaaacacaagcacccacaaaagagagaactaagtccctccatgaggaacagatatgaggcttgatatgtattgtatatttgagcgtttgccttagtgattacatttttgggggttgggggagatgtggctcttttttttttttttttttttcaggccaaaggaaaatggatgtcgtcagaagccttgctgaatgtttctcttggtggctcgggtgctgctaggtgctaccattctgtgatctgtcctgtgacacagaacaggttaattccattgtatgacagagggattttctgctcctgaaaactacctttttacaaatgtctgtaaatatctgttaaataaaaacactaacctctaagtccagaaggaacaccgtttgaccatcagtgcaccactgttgtctgagcagtcagtcaaggaataaatgcttatttatgaaaaactcaataaaagtcacattttgagattttgtatgagactttttgttgctgtgaccgaaatctgatgaaaaacctcacaggagagagtcactttagctcaccggtccatggctggctccctccaccatgagcccgggatgaggaacacagtgcctacagagtgtggccaagtcactcacctcctggtagccaggactcaaagcagaatgacgggaaggggccagaacaaggcagagaccctcaaccactagggatacttgctgtatcctgcttccttcagcacgctccacctccaagttcccagatcctccccaaatgtcactgccagatgaagagcaagtgtttgacacacaccttgtcttagggttttgtagtcttttctctctcagcccgag

SEQ ID NO: 24367 - DNA, 1242 bp, Mus musculus
gaggcccttccgaccaaaatttctgcatcttcactgagtgtgaacccccggagagctctattattattattatttttttaaatcaaagctacatgaaatacaactgtattagaaatactttattgccagaaagactttctgttttaattaggaactaaagtaaagagaaagtaagacattttgaatggctatagagacagctgcagatgaagggactcgccccaaggttgttctgggtttggagtgtggctctgtggaaaacggatgtcacccacactgaagttcagcattggaagtcctcagggccaccgccttccttcccgctcctcagtttccccacacagcgtctctgcgaacacctggtaaaggtagcatcctgcctgcctctgtcttggcaaatccagaggcccagttccggtagatccctcttctgttcccttcgtctgtgcatcgactcagatttccgctctgagctgcaggttactatccgtgtgggcccgactccagggtggaagacgttcttcagtctgcctatcttcttaaacttcatactttaatatggattccatgtgcattttttttttaaaacaaaacaacttgtaactatgaacattggaatggaaactcactgcgagggtaacgggtttacatgagtttgcacttgctgtgatcactgagtctgttggggaagataccagaatatcttatgttaccagcccttcccttccagtggagccctgcagctgccatcttatggacgctgactcgtactgatcccaagatgttctaatatgtgagagtttacatgtcttcatcattataaataagtctccatggtttataacactatgtatcggtcagtgtaagatattttaagcatttaggtacagacttcagaacttttaaaaactgccctatagaataattataaactgatcctagtgtccgtaaaactaagggaatattttttttgctgttgaaatatgaattataaagcagcactcctagggtcgtgtgcatcatgtattagatgctgtgcaaagctctgcttacagagctaagacttcagtgtgtaggcagcagctcaggggtgaggttaaaacactaaacaccgccgggacttttgatagtcaccggaagactgttttgttctgaggggattaaaattttgtaaacttaaattataagttcaaagggctgacttagttctttcagggtaacggtttgaatcctactgtcttt

SEQ ID NO: 24368 - DNA, 1210 bp, Mus musculus
gagcaatgttgaaggtccttgtggcagggttggagcagagctgtgatggagaatggtctcagacctttgtaggctgcacagccacatgccagggtgaggttttgctacatagtagggccccaagtcatcctgaaggactgagcaggggactcagtagactgcaaagcatccacatctgccacccacagccttggcttctgttgtggggaggagaggcataagggaaggagatctgtgtagaaaacagcaagctgaaagtgaagagaagcagctatggtacacactctgtctggtcacagcgctgcatagggagcccaagacatgtagactgtgatgcttgtgtggtggctaagcctgcgactcctgtgcagtagagattaccgactggccaggctggtgttcctgcaaagttagcttttctatgcaggtgatgtattcagttgtctgctggagattgattccgatcactgtaagtcccattgggtgcttgctttctaggaaccatccttggcaggcagctgctggcgttctctgagcttttggcggcgagttctcccattcggctcatctgttgttgaaatgagtcgctccgggctgtgggtggcaggggtcctcttcacttgcttttgtgacgtggacctcctcctttcagaaatgtgcagaaatcatcgtggcccaccttggctacctgaattacacacagtacagggttactgtggggtttgagcacctgaaccagcccatcaaggatatgaacttcacggtgagtgtgccgtgcagccagcggccagcttctgtgactcccttgttaggtggtttgatgcatcagggtctcgtacagtttatctcggaaaaccagcttaagtgtgtagaactcaagaatcacttaatcaaacagcccggacactggagaagccagggtgcgctcagccagccagccatcccacgcttagctagctgcctgtgatttaaggctgcagattccgtcctcacatactttacttattttaggagagagagtcttcccacactcagatcttacacacaagtctgtttctttgcatgtagatattggtgttttctagtgaaggttgacttttgatagaaaattaataattcagatgataatttatctgctagattcaccacttaaaaccatttcaataaatgttgatacttaagattttggatctgttcttcagtatagaag

SEQ ID NO: 24369 - DNA, 1172 bp, Mus musculus
cttgctctttatagtattcttgggaactattttgttattatgtattggtgatttatgcccattttattatttatttagaaaaatagtacctttgtaatgccttgtttggtggcaatatattttgctgcaaaaaataaagagaatatgacagaaggtttttgggggggacggggaggctaggtgctttgcaactttcttgagagttggagaaaatcttattgatcccctaaaaaaataaattcactctttatctcagtattgattatatgcaaaataggcaatatctttgagatagcataccctaagacagtatttcttattttgaaaatgttaatttaaaataaaatgtgataagacacaggaagggcaagacatctgagataagagtctcaaaagagtcccttagtaaatgatcttcaagttttagggtttttttttttggttgttgtttgttttgtttgtttgttttgtttgtttgttttgtttttttagttaaaatttaccttttccagaccgcaaaagttatacttacaactttgctaaataagaacatccctaaaagatactctttgtctgtggagatgcaggcttctggccttgagttgcttgacctgtgagctgcaggaacaggcggagagtgagtctcaggttccacatgggcagaaagctgctgctgcagcagttgtggcatcgtatcatttaagataatggcttcttccagtcaatatcacttgattaaattctcctcaaatgaagacttttaagtaacagaattttgggtacttcatggttattaatagcaatttgtgaatgtcccaatgtctcattggatactgaaattaaaaacagtcaactatatagagacccataggaaaagagtatattaaccaacatgaaaactagtgttagatttatttggctctagtatatatagagacccataggaaaagagtatattaaccaacatgaaaactagtgttagatttatttggctctagtatcatcaaaacaaaagttatgggtgaatatacttatttgaatgtatagcctgagaaaaactgggaccaccacagctagaaatactcggctctaatgagcatacaaagcgaaagcttttgcatgttggttttgtccatccagagactggccttctgtgtaatactcactctgta

SEQ ID NO: 24370 - DNA, 1099 bp, Mus musculus
tccaagaagtcctctctctgacagaaagccctgtaccgcagagaacggaaaaattcggaaagaagaaccggaagcgcctggatagccgagcagaggaaggaagtgttcaggccatcactgagggcaaagtgaaaaaggatgctaggactttgagtgactttaattctctcatctccagcccccgcctagggagagagaagaagaaagtgaaaagtcagaaagaccaactgaagtcaaagaagttgaacaagacaaacgagttccaggacagctcagagagtgagcccgagctgttcatcagcggggatgagctgatgaaccaaagccagggcagcaagaaggggtggaaaagcaagaggagcctgcggaccgccagtgagctggaggaattcaagtgccgcaaagccagtgagaaggaagatgggcggctgggcagccagggcttcgtgtacgtgatggccaacaagcagccactgtggaacgaagccacacaggtgtaccagctggacttcggaggaagggtgacccaggagtctgccaagaatttccagattgagttggaaggacgacaggtaaggagactgtggtactgtggccactgagcaagtagggccagtgccttgaactctgggaacaagcatttaaaaggcctccacatgtgctttaaatccaatgacgcgtaccctgttaggcagccggttaggaagggaaagcacagcccccacgcattccctcaccacctgcttttcagttgctggtctctggtatctctttaaatttgcaaaaacatgttttttatttattgatacttttaatttagccatcatgtgttgccttcctcctgagtaactctagtggattgtgctgtctgtttccctgaggagttggcaaacttacttaactgcctctttcctccttttccatttcatgactttgtttcccaccaccttgacctcaagacaatgcagtttggacagactgactgtcatatgtacagtactccttcctagcgtttcattgccagctatggaagaaggttatgtttgtcagccctgcctcccctacctcattagcacacacgagagctagccgtactttc

SEQ ID NO: 24371 - DNA, 2458 bp, Mus musculus
aagaagggtcaggctgacctagaaaggggtgcaggtggatgaggctgggtctgggcccctggctgacactcttaagagcgagatccatgcagacctactccaagtggtagcacttccagtcgctggagaacagagccgatgagcatgtacccggattacaggcagagagaaatggttgtgctctcgagtgtccagggtccggaatcttgagttttctgattgcagtgtatgtgctgtcactccagccaagagccaaggggaggcgggattccccgggctcctagccggccggcagaccgttccatgatgggatgtgtaagggtcctcacttgaccagcattctcctctccaaaggctaaagaagcccaggacgacctggtgaagaccaaagaggagctgcacctggtgatgacggccccaccgcccccaccgcccccagtgtatgagcctgtgaattaccacgtgcaggagggactgcaggacgagggagcagagcctatgggctacagtgccgagctctccagtgagggcatcctggatgaccgcaacgaggagaagcggatcacagaggcagagaagaatgagcgcgtgcagcggcagctgctggtgagtgggcagggacagcagacattatgcagggccccacccctggtgccttctcctgccctaacctaacatacccgcatatcccagtcagtccacaaggagtgaaaccctgacctcacgtggcaagcaggccaataacagataacttgcttcctgtttcagaccctgagcaatgagttgtcccaggcccgggatgagaacaagaggacccacaatgacatcatccacaacgagaacatgcggcaaggcagggacaagtataagacgctgcggcaaatcaggcagggcaacaccaagcaacgcattgacgagttcgaggccatgtagaggccaggctgggaccaagggcagagggcacctcactgcaggcaggtgtcacacttggctctttagttctcttaagtttagacacccccttgctgtgttccagtcccttaaagagcagttacggggcctgcattctgccccgagacccagtgggctcctccttggttccttctaattgtatcacatagtgccaaacaggtcagatttaatgacagttaccgaatcacttcctgtttggagcagggattcggagggctggccctcatgaagcaagattcattgtcactgggacagcactgtggctcacgggtgccatacttttctctagttttacaatgagctcaaatcgattttgttcttgatttttatgaaggatccatctctgtgtattgaggggtaaaaatgattttgaaatttgagtctaaagcatgcccccacagagtctccttcctccagaccgctggcagagtctccaggggtccttcagagtgtacggtacaggactctccgatacaaaattctcatgcttatctgttagcatacattgttggacttatatatctaatgatctgctatagaggatagtatttatatataagcgataatatgggtttgtaacattagttttaaaaaagggaaagttttgttctgtatattttgttaccttttacagaataaaagaattcaacattaagaaccatgtaaccgagacacttgatctgacacaggggcagtcgggaaaccgatgactgcagtaatcaccactgtacaaaaatgttagtgggttttgtgcacgtaaaatgcacacttccatttcctgtcagtttcttatttgaaaaaaaaaaaatacacaccgagagcatccagactccagccctgaagggacgccggcctctttattgtgagcaacttgttcccgttttcagtttgtcttccttcctttcgcggactagcctccttggttgtgatgtctgtcctgtgcgggtgactccgcaccagatttacacacaataaaagctctccaaggccttgtgtctgattgcatggggggggttggggtgggagtggggggtctctcagacttgtcctcgggattcaggaagcatgctaatcagagaggggtcttccccagctcccctgcactgggaggtttgccacccgagaggagcacacagcattcaacctacttctattttcctctgaaacaacatataacaaagctaaaaacgtggttgttaataaatgctgggagttacaggacagtgttgagcgtttattgagatcagaacatttccacatctatctgttgacagtagcctccccgactgcctgggtaacagtaattgttccgtgtcctaacgacacacattactgtagtcagttattggtgatccagtgtgtctgattctgccatgatcccacttcctgttgacctttgtgggttcgcagtcgccttgggcttcacctcagtgcaggacgagggtcatgtctgtccacaggtttgggctggagaggactctgtgcc

SEQ ID NO: 24372 - DNA, 1193 bp, Mus musculus
atgtcattgtctcaaaattctttggtttggttggttggtttttggttttgttttttaaaacatggtttctctttgtacctctgggtacactgaaattcactctgtagaccaggctggtcttgaactcagagagatctgcctgcctctacctcccaagagctgggattaaaggcgtttgacactacatctggtgtcttaaaattcttaatttttagataaggggctctgtgggtttttttggcactgagctcctcaaattgtgtagtcacactgaatcaggccctcttggatctgcatgccctgggttctgcccgcgcggaccctcatctctgtgacttcctggaaagccacttcctggataaggaggtgaaactcatcaagaagatgggcaaccatctgaccaacctccgcagggtggcagggccacaaccagcgcagactggcgcgccccagggatctctgggtgagtatctctttgagcgcctcactctcaagcacaactaggaggcctctgccttccaaggggctcccccctctgctctgcaccagcccgccctaggacctccacctgaatgaacctctcaagccactaggcagctttgtaaccgccctggagcctctgtcaagtcttggaccaagtaaaaataaagctttttgagacagcaaaaaaaaaaaaaaaaaaaaaaaaaaaatgtccaggagggagagagctccccgggcagcgctagggagtctccaggatgtttgtagagtgccgtccaaccttctgtctcactcctgtatttggcaagctgatttttcttccataccactgatgttgacccctatccaacatggcagggcagacatccccatgactagccccaagtcataagtggccttgtcatctgcaaccaccatggccagtctaacccactggacatcagtgtcctgagaactctcactggacatctggtccaccatagctgagaatgatatcattatgctcaactcagttacatagaaccaagagtaaaaccacttgtagaatggagtggtcttctgtattccagcagaatattctgccaatacaaaggaggttgcttggtcacactaggcctaagggacgaccatatagagccttttgaagcagttggtggtcattttccctttaaaggacactgtgtgaaactgaatatagctggcttctgaca

SEQ ID NO: 24373 - DNA, 1182 bp, Mus musculus
ccaactctgctgtgctagagaatcctacatttaagaaagccttgtaccatggctaacttgtgtgtgaagatgcgactgcagagaactgtctgttgagtcacagataagctcattcagaactcagtgtgcggctctcctctgtgaggatggctcacatggtgacaccaaattttgcctgtgtgtaaccgggtttgtgcaatatgtagtaaatgtataaaatgtattattatatgcaaggtattagatgcaaagggtgtctgcgtacatcccttcatgcatgcacttctgtatgttgtttttttgtcctcaggcacttgtttctattaagtagaaagagttttacttttcttaatgttacagcaaatgtcatgcctgtgttcacattagccgccagctgcatgtaggtggaaatgtctgagcctctgatgcatcttctcctaagcaggcttgagacgagtcagcatcatagaagggaacagactgaaagacactgtacttggtgtgtgacccatcagccgcactgggagaaggtctttcagtcatctaatggaatgtgggtggcctggtggaaatgcattctgtcagtagtaactcacgcagagtactttgagcctctgcagctcagtcatgtcttgtgcagctgtgtagtggtaagcactgttgtatgcattggggagtcttgtataagacttcagtagagtttatttattagtcacaataaactgccctcctcctttagacagtttattacttgccgatgttatatcctttgcctcaaataaaaatccaccaagaacattatccacacactgttccattcagccagtgtctgttcactatacactcattgtgggccaacgcatacctcaggaaggtagtgtccaggagatgtagtctctgttctctggggatttgagccacttttttcagcaagcagtcattcaggggacagggaaaagtataggacacaagataacctggcacatgtaaagcttgcatctgagtgaaacagactttccagtgtctatacacatttcggttctgtgatgtcctttatcattagcaagcataaggagggatgtttgtatattagactcttactactcaatgaccaatatgtttatgtacatgttttaaagcatagggctccaatcttcctaattatatccatttttataagat

SEQ ID NO: 24374 - DNA, 1192 bp, Mus musculus
ggcctgggttcctctagatcaggtggatggcccagtctttgaggggtcatcatcttggggtacgtggaaccctggaatgagatcttctttcccataggttgtacttcaagcccagcacagggggtagagctcagggtttgttttgcccaggctagttgccaagttgtaggctcaagcagtccccctgcctcagcttctgaagtagcgctgtgataagttcatgatctgtcaggtctgttgatgtgtaaactagttagtactcgggttttattggcaactatttctgaggtttaagcagagacttaaatatattatattataaatttgctctaatcaggtggtctgcatcacccagttagggctgctaagttccagaccttaggtctttgtcctatcttgactgatcccacccaaccagtttttagtttctcaaatggctctcttgtgtttcagtgcctcttctcccacccagcaagccaatcctggactatcctcacttggttccggttcacattgcctcacagatggcctctctctctctctctctctctctctctctctctctctctctctctctctctctgtgtaatgtctttcaatcttattgtgttttcaagagtttgtttttgtgtgaattactgagcaagagagttcaaagacatttctagcaaatacagcttgcgtgggtctgaacattccttaggtctttgagtgctgggctgtgtgtttccagagatgtttgagatgtaggtggtgtggcctctttctactgtaggtcagtatgggatactctggaaactggaaaggcagctcctatcttccatgccttaaactgatggaggtgaaacagaagacctgagggtcgaatgactgccgaaatggagcatttccacaaggcaagatcagctctgtttccactgacctccagtctagagttcccctctcagaaggaagaatttttgggatcctggatgtcggatgttgggctggctttttttttttttttttttttgtatgtgcattagtgtgacatgtagtaacttaggatctatgttcttatgcttcttcacatgaacttgaactgggcagatggagcagaggccaaggtgcatgcactctgcttctggctgagctatggagatgagctgcacacggactcctcagtctctgctgctggaggaagagactggcc

SEQ ID NO: 24375 - DNA, 1168 bp, Mus musculus
gtgaataaaaggagggaaagaaggccgagtgccagcatccatcactgtctgtgtcctggctgtgagcacagcacaagcagctgcctcctgctccgaccgcggtggactgtaccttgaattgtgagcccttccttcccggagatgcttttcttcgttatcttgtcccgtagtgggaggtggtctctccacacagtgtgtgtttctgggcagtgagacagcacaaggacaggacattgagaggaaaaaggccgacacaaggttcatttgtagtgattctagtttcttgacgccgagaagaccaactgagctggcttggcggacttggcgaaagggagagctgtgtgccgaggaaacctcatctgagaaaatgctgcgatgagattggtctgtaggcaagtttgtgggggggggggcattgctcttgataactattgctgtaggagggcccagcccattggggttggtgtcagccctgggcgaatggtcctgggttgcccaagaaaacagggtgagcatgccacagggaacaaaccagtaagcagcactcttccacgctctctgcatcagctcctgcctccaggttcctgccttgacttcctgccctggcttcctgcagtggtggaggatgtgtaagccacacaagccctttccttccctagttcctgtaggtcttagcacagcaacagaaaccagacaggacactgactcacagaggcagctcttgcacctgcggctctagaagagaggttggaaacataagcttgaattcttcatgggactagactttaagggtgaagaaaatgttttaaaatagaaagtatcaaaggtgaattcctctcagataggtccggataaggggccctcttgtaattgaagacaaaggaaggtaggtgacagcggctgctgatgtcattggtgctcagcctgaggagtgtattgttcttgaaggccacatacctgcctcactttctgcttgactccatgttagccttcctggtcttaaagtgacacctaacggtgccttctctgtccttcctgtccctgacatcagttccctccgcagtcacgtggtgaaagcctgcagtcatgtgacaggaaggaggaagggaagagcacaggctgcctgtggtttcagaagattcagtctggggctgtttgtctccgtgtg

SEQ ID NO: 24376 - DNA, 1229 bp, Mus musculus
tccagggagctcgcccacttagtgtgtatcaggcgggttagcccagagttggtgaactgacctggtaagtccatggtgctgaagagtatcagtacaaggtaaattgatctatgaactttattttgtatctccttccatttggaaggtttgttagaccattacggttatattcaagtactctgtactcttagttttgcttgttttaaactagaaatgattagtactcttaattcatagacttgtcaataacagttaccagttaaggtcacgttcttcctgctgtctgtaagcagctatagtcacagattacttcattacagtcgtaatttattatttttaaaaatgccttgaaacattcaataccaaaatgcatctgaaaccattaagcagtgcttttatttcagatctgtaagttgattatatttaaatccaaattggagtgaaatagtagtaatggcctaagaccatgcatattcagtttgacaaactttgtatactgtacataattgcattgtagttctttaaaaataaagccaatagtagaattcgtggcagatctaatgtacactgtttatgtagtactgcagcgatataggacagtggcgtctgtaatgttaaagtattgaaaatgtacagatagaaactcagcccagtgcatgagtcataccactaaaatttgggactgtgtgaaacttaggtgcattttatttcaattatgactattaaaagctacctttattattaaaagagaaattggacatcactgatccatggtgagtgagtgagtgagcaggtgctgtggtttgtatcagtgccactttccagtccatagtgcgtaagcacatcgacgtttatcaggcgtaagtgtagaggaagtgaaaatatagtaataaagactcgggctctctgacaacagagtctggctttttaaaacttaagtgaaactgagctataatcatcaagaggaagtaggacagaaacagaggtgtcctggaagccctgggtacttaagttcttagtctgccccatgcttgactcttcggatcagcactggatgaagatgctgtcgtcgtcttgttagataatgctgtgccctgtcatctcttcagtactgtggaagagcctggggctgctgagcatctggagtctggatcagatgtgtgccttaatatttggtaggcactccagttagtgaactggcctgcaagcatggcaggatgtggctttgt

SEQ ID NO: 24377 - DNA, 1113 bp, Mus musculus
actgaagcagaactgggaggcttgaggtagctctagaaaacaggttggggtggggagactgaaaacagacttgaccaagagtggtgctcaacattattgccactgaagtgaggaggagctgagggcctgataaggagcctgcgaggcaggccaggtagcagctcctaggacattgcttatttttttaagactagttttcttttgtgtatatgactgctttgtctgcatgtgcaccatatgcatagctgatgcccactggggccagaagacggccttggacacctggaacctgaattgggaacggttgtgactgccatatgagtgctgggagttgaacctaggtccagtgtatctaaaagtgctcttagctcctgaaccccagccccaagactggggtttttgaacaaggatttcagagacagaggaactgcagggaagaaggctctggcagtaagtcaatgggtaggatgaaagagaaaagccactgaagatggattgaagaacagaacggatgggctgtccatgttgaatttggagaataggcaagatctaccatgtaggtaggattggctttgtggccaggaatcctgaaggacaggaccaaggaagctggttaggggcaactggggggcaaagtggctttctacctcataaatcccaggaggagaggggacaagcaagtgtgttgctcggaatagatgtgaggagcagggccttccgcttctgccgattgctgtctttttacatgccagccattgtgggagagatggaggggaacgcagaaatgagggctttcactacattgaaagccacagcaagtgttctggaggcatgggctctgggctgtgtggctgtaactctccctggccctgcaggtggtgtggccctgggccttagtctatcatcaagtacaggtgcaaagctggggttactgtgtggtgcatccatccgttctcctcattgcctgtgtggctgaggagtcagtgtcaggggttcatctttcagccctgattccttgctgtgtcttctcagtggcctcctggtcaaaggctttactgtctcatgtgacagcaagaagttctgaagatgaaaagtgaaaattgtgtgcatgta

SEQ ID NO: 24378 - DNA, 1201 bp, Mus musculus
atcaatggcaggcgctccatggggctctagaaggaggctctaggtaaagtgtcaaggagattcctcctccatactcgggagccctatgggattagaagatggcttccctatatatagcaagtgcttcttcattgaccagcttacagcagggtggcccaatccatggctgatttggaccttctggtcaacctctggattcagttcactctatcagacactgaggggacagagcgggcactaattgctatgtagccaaggatgtagctaaggtgcattatttgactgcagaatcttgggaacccactcacctttgaccctatggtaaggtttgaactgtctactatggtgctaatcctgtgctcatagaacacagagcagtgctcaagggaagtcccgctactccagccttttgacactgtcacactgtaaaaaccaatgagatccacaaaggtagaacaggcagaatctggccaaaggtgcttcccagtttggagggcccatactgctggtcacaaaagggtgagagtctcctggatctgtttgtggctggttcccacaggccagctggactgagaaattaggattacccttgtgtgtgttcgtgtatgtatgtgtgtgtgcatgctcatgtgtatgtgtgtttgtgtatatgtgtgaacatatatgtgagcatgtgtgcttgtgtgtgcatgtgtgtgtatgtttgtgtatatgtgtgtccttgtgtatgcatatatgtgtgtgcatgtgtatgtgtgtttgtatatatgtgtgagtgtgtgtacatatatgtgagtgtgtgtgtgtgtgtgagtgtgtgtacatgtgtgtgatggttactattccagttcactctccagagctaggattatcccacagagcatcacaccactaggagaagcaaaccatgagaaaccacagaattcagtttccaaataggatcttagaaaaagactgaagaaaaggagccgctgacccaagcaggctgtggaagccatagagaggaattttcccaggctgctgcatctgcccttcagcttgtggttggccctgtgtgtgttggtcatgtgcctgcaccagttagggacaactgttgaaaatgtcatgctgccattattaagaaatgtaagttagggggctggagagatggctcagtggttaagagcactgactgttcttctaaaggtcctgagttcaaatc

SEQ ID NO: 24379 - DNA, 1118 bp, Mus musculus
tttactaaccctgatgcttacatcttagcaactcggtacttcaaaagtcttatgtgtgaagtggacataaagccgttattcacttagtcaagtgtttggaaggatcatgcgggtgatgtgtttattgtagcaaatcctgagaaacctcctgccatcaacattgttaagagtaccatttctgccatgtacgtattttctatgccaagaggcggtaaacttgtcttgtcaattataagttggcatataatgaattagaattgtggtagacaatgtaagcaggttgattgcaacattggagtagttaagtatcaaatttcatgtagcttttaaatttccacaacagcttttctttgcattttctttagggactaggaaaggatgtccaagccgaaataagttaaagaacccctgattttaacatttgatagaaccaatgattagagaaataattgtttctattttagaagtctggtaactgtttctttgaccttccatgattactgtgacttctgccttgtattccttcctggatcagacccagaaatgtctcaaaaagaatccatgatgacctaaagcagataggagatttccaattctgtgtaacctcatttgagattccccaaaggtcatttccaatcactttacacaataagcccaagcattgctgtgcttcccatcatccatacagtaaacgtctctgggctgagcttcaatgtgtagctgttggtgactggcgagctgcactaagatctcgaatttggcagaaacaggcagagcactgtgagctggaccaatccaacctcaaatgtcatcatgggaacactacctttcatttggcttgatttgattttctgttactgatgcccatgaaagaataaagggctaagagtctgctcctgtgagaggggagatggcagaagactggaggttgtaaggcatccaccagcttaggaggtagcacaccaatgatgccttctcagatgcgctaggacagaaattctgaaactcacagaaggagttttatgccttgctgtggttgaagataaagaatatgtaagagtatagccaagaagtttcagctgtgtgtggtggttaagaataggaattccagagtgctg

SEQ ID NO: 24380 - DNA, 4118 bp, Mus musculus
aagtgccttatttttcttcatggtcatttagtcaagtgtcctgtaagatcagctcctccctcagaataaagttactgcatgttcctcagtcgcccagtatgtgaaaggagatatgagaggagacaaatgagttgatggtctaaattataagatttgtgtcacattatcttgatgccagtttgccaaatctgatactgtgaaaaaatttgatagcttttctaatgtctgactagtaaattttaaaatgtcattcttttacaaatcataattagtacttttggttattaccgtcttcagtgttagcccaaagattctgaggtttagaaaaaaattatgtaagatctgaacatcagtttgcagacaaaattaaattagagctttattttatttggagaagagggatacaatggaatttttccttaccaattagaaataattgtaatgcctaaaaaactttttcacaaaaatgaatctttgaaattttttattgttgaaaaagtgttaagtaacataaatctaatcagatatcttatgtagtccatctctgctggctttagtaactgctcctaaactttttaactctaaaggagcgtggaaagcccgcatcacagtgttcagtgactgctctgctccattctttctcctctccagtttctctcttgaaagtcaaacagttttgtagttgaagcagtccgtgtgcaaagcctgcatctaaacacttgcgttaataagtcattaaccgctcagtaccagatgtggcaaatctcaagtgattgtggactcctggctcatcaactcatgccctcttccataccctcatggcttcacagtcaaggtcagcaggaagctcattggtcaccttcatggtgacctctccattattctgtctcacttggaaccattttcagtttatttactatgcaatagacagtccttgttttgtactcagctagctttgatttaatgtaccactgctttgtctttctgttacacatatggttttgatttatttacaatatatgctgtgccattttgatttttattttggttggttggttgaataaatatgcgacactcagaacacttgaggtgatagttttaaaaaaaacaaacaaacagtaccagtatttgatccagtctcatctcagctgtgttatacctggacaatttagatgtttatcaaaggtcttttatggggaagaaagcaaatgtgtaaaacagtagacgtgtgacgtttatgagtaatgctggctctgaacaaacttttgaaaacttagttgacagtgttttgagtcaactgaaaaaaagcatgacttttggaatctctgaatgccttggttctcagtattatcactctattgaatttttttttcttattaaagtatgtagtttaaaagtaagacttttttcctgacagtattatgtaatttttagcgtgggtagatgggagtgtcgcttgtatgttaccatacagctgacatgtattttttgtctattctttattatcttagtagtttcatgctgtgtatgtaccataaccaacctattgcctatgagaaacatgtaagataatgtatttacagccattgttacaagtttataatgtatttttctatcttgttttatatgtatgttatataacattcaaaagaatttttttcttgattgagaaaaggatacaaaatgcaaaatccacaattttgataactgaaaattgccaattgttttgcagtactttattatattgggtgtcttgtctttcttgggcttttagttagctgatgaatgaatacattagacacttctgggttttagttgggattttacatagcttgcattttagttctttggttctttgctgtttctattaacccatagcattattttaataaatgttataataccaacctactaactctggactatgtttgtttattaacctttccgtgtttaatgaaaacaaacagggataaataaagtcttgagttcctggactaacactgaagaacgtgatcagagataacatagtgtgacttgttttctatgttgtttgtcagctgacagttgtgcacacctctgctaaaatggctttgggtccttggccttttaccatggagggtaagtgccagtggagatgggagcaggctagcatctgtcagtcatttctcctagtcatgccactggcctttcagcatctgcaatactaattccacactttatttttcctgctccaaaataatcactctctgctcacagcataaagagtcaagaaatttactgtaatgatgcaccttgagagaccagtttgattctttgttgagtcttttgcctaaatttctgtgaacaggccagttttggtctcatagagttcatagctgatatttctcctgtgttgtttagctagctgctcctattagagttaagtcggcctctctaggtcttgcagtcccatcctgtctgtgacacacacatacacaccaccccctcttcagtgtcttgaagagctcaacttgggtagctttccccttacgcagttccagaacagcctagacaactacacaggaagcacggcagagacaaacactgtaatctgacgtgtgtgtgtttggttaaattctacagagaagtagatctaagatccttctttctcccattcttcacttggttgtgctctctgtaaagagacctcttcttcagcacttgagtccatttttgtgtcagatcaacagtaccttgtctggggggaaaaatcttacaggatccagaacaaacaaacaaacaaaaaaaaaaaaccctcttagaatgaattttacttttgaagtaatggtttatattttgaaattgtatttaagaatcctaaaaattaagggttgagttctatcataactttctgaaaggacactgttaaaatactgctctgtgcatatatgaagctcagaatagtgagcttagtttaattatctctgatcatttttggtcctgcacatacggaatatctctgttaagaggaggagaccgtgtcatatcactgggtagacaggtacccattaccttagcaagtatgtttagtgctcagtgagcgtttcagacactgtcaagcttctgctgcacaaaagctccaatggtaatatgttataacagttgaggaagaacttatgtgctgtttaatgttctctgaagcctgtgtatgcagtctcatcctgttttcagtgagggcacttgatttatgtctcatcaccaccattcctattgaaaatgttgctcaaagactcacatggtgcaaatagtgtggtatgccacattttcatgtaagtgcagtagtatcacacagcctgatgatgggataggaatgttctagtgtcactttcttagttgatgctgtttggtgaaatggttatctgtgttttattcaaaaggctggtgatattgatgtacttagtgaagtatcttttatttttatttttctttaggaaaaatatctaggaaaacatgatatgaaaattatattcacttcattgtagtgtagcattttcatgtatggcagtgcctgtgtgaaggagttgtagaaatgccctgtccattaaaaaaagaaaaaaaggttttgtgtgcacacaagaaagctgtttggttaaatttatgggtgtaaaggatgtgtgtgtgtgtgtgtgtgtgtgtgctctctctctctctctctctctctctctctctctctctctctctctctctctctctctctctctgttcgcttgtatgcctggactaggatgcctgactcttccttgatgacagctgttattctcgacctcagggttttggtggaatgaaacatgttgccaaagtaacggttaagtttcttggtctcccacatttttcaaagtacataggatactgtgcttaatcacatcttgtcacattttgtcacaaatcatttaatacctgtacagtgggaatgataacccattttatggacatatcaatttagacatatccatggtacatgtagtacctggtttatcctgtataaaattaactaaattgtgagttgtctttattttaaagaggcctgacaaaagtgtgtgtatagctggtgctcaatgctgaatcaaactggtcaaact

SEQ ID NO: 24381 - DNA, 1065 bp, Mus musculus
ttttttattagttgtgattagttttcatgttgtcattaagctgtcactagctgaaactaatctcttctctatcttttcttttctttttttgttttgttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgtcctccaactcagcttttccccccctgtttgggtgaaagtggttctagaacctgcactgaatagtagtaaagcaataaggcccgattcatcccacagcactgatcatctctcaatgccccaccccaagcgaacggtaagaaggcctctcttaagaaggggagacagatggccctaactactcagtgacagaggcagttactgtgagagacttgtaggaatttttttcttctcctagcgaagtcaaagctctctctgaatgtactgtgtgacaatgcatcatgcatgaaccttcggtcagggatgtcgttggggaagtgacttcaaaagtattcaaaatttgacatgctgtttgtttagtcactacagtgccctcaaagggcagacattgcagcctttttatattgcctgccaaaatttgaagtattagaacaaagtgtgccatgagagaaaaacttaacaaggagttttgaaaagaaatgcaaagaacaaaactacaacactattttttaaaaagttgagtatctgagttaaaatttccaaatctttattttacaccaccttaaaaattatatgagaacaaggtacatgcattatgtgtcacattactgggcaaactgttcaaatattttttttaaacctccctgtatagaaaatatcattaaggatgtaaaagccatgcttgcctatttgctgtatacatgtaatgaaattgtagataaagtgtagtgcattgaaacaaatgaacaaaaaagtagatacttt

SEQ ID NO: 24382 - DNA, 1062 bp, Mus musculus
gatactttgaagctgcatcatactgcaaaagtctaacataattattttacagagtgttttgattttgaagtaatttttccccctctttggtttttctttccccgtgttccttttaaattttttcactaacacaataatcctttctcactttgtactccagagccttcagatagttgagaatattagactaagatcttactgtatttggaaaatgacaacacattccatgcatggctcatctggagctgtgtttattttgattagttctgtttgtgttcaaaatgcagtgtcagcaaaccaaaacggtttttatcccccctgctccatctccaacttttcctttcttctagagatagatcacttaggaacacgatcaccacatgtactcactgggtccaagggagaggaccgaagcccttgacttacattattttatgatactactgtttctctctctctctctctctctctctctctctctttctctctctctctctctctctcatcttttgagaagattattattagcattcatttgatgcaaggaagcagcccgaggacatataaccatgtaactgtctgtatgtaagcacttagagtatctagttgcttactaaaaacaaacccacttccatagttatttcacaattggtttgaaacttaaagaccaactgactttatagttgtaacgaactatacgtgattttgcacagttaacattacctgtgtgtactgtaggagtccaggacatggcagaggatgtattttagatgtactggatatgataatgtactttgttaagtaatccacactcaaatataatcagaaattatctaagtaatgatttgaccaaaacattacttacacaaatttaagactatgggacaaccgtttttgttttaaataaaagtctgcttccttttaagaaattcagggaagatttgattatattgaagatacaatatttttgtagtatttataaactgtcctaattgatagactatagaaaccatttttgtcatacaaaggtaaataggtctattatatagaacatttaaaccc

SEQ ID NO: 24383 - DNA, 1197 bp, Mus musculus
ataccatttgtcctcaggacactgaccataataatcagtttctgtgtggtctttttatctgttttttagattaaacactcaaagctgaagtatttaaattttcaaggctgtataattgattcataaaatagataaagtattatgggagcctactgtaagtaactaggttgctgtttcattacgaaaatagtgaaatagtatagtaataataatctggatacctgaaaatattgttgcatctttcaaaatacattattagggggacacagttatattagaaaaagaataattatttagttgataagtgacaaagtaaaatatttttaaagtaaaatgtttttgttaatctttattgcatggtgtttagttgcatgttggcatgtctgagtagcatcttgtattcctaatattttagttgacccatgggtgaaacttgaatcaatggtgggtacatttttaaaggtgtacttgagtgtaaagtaaaggtccatagaggagtcctcccccaccagatctcagagtttcagtagaggtccttagaatccaattggcataagactgtgctgtgtatgaggccctctgctgtgtgctgcttaagcacatgtgacaggacagaaaaggacttacagaaattgacatagactggttgctcccctcccctcccctcccctcccctcccctcctttcaacttttaaaattatatttaattcatttctgattcagttatcttttataccacttcacttttagatgtgtgttctacttagggcaagaacaactagaatcagggttacacatagttttttcttttcttttgttttttggtgttgttgttttgtttttttcgagacagggattctctgtgtagcctggctatcctggaactcactctttagaccaggcttgcctcgaactcataaatttgtctgcctctgcctcccaagtgctgggatcaaaggtgtgtgccaccacgcccggcacacattgttttcttcagtcattggctattaacaatctggttactgtttgtcctgtaatgctatcaggctcaggcttcttaaaacaagtgggagcacctttctgcacacttgggagttttgtacttggtgaagctctgtgttgtctgtcgctcagtgtctcatctatgataatactgaacagcttgcacaaagagccattcctgtgtcaacttattg

SEQ ID NO: 24384 - DNA, 1211 bp, Mus musculus
cactcacaaggggcctgaaacccttggtcgctaattgagaaaatgccttacagttggatctcatggaggcatttcctcaactgaagctcctttctctgtgataactccagctgtgtcaagttgacacaaaactagccagtacaattgaccccttgtcaacttgacatacaaacacatcactagtaagcctcaacccttacattcttattcatccccaaggtctaaataactttaaacgtcccacagtctttacatattcttaaaatttcaatctctttaaaatatccatcgcttttaaaacccaaagtctttttacaattaaaagtctcttaactgtgggctccactaaaatagtttcttccttcaagagggaaaatatcagggcacatcacaatcaaaagcaaaaatcaatctccaaccgtccaatgtctgggatccaactcacagtcttctgggttcctccaagggcttgggtcacttctccagccatgccttttgtagcacacgcgtcgtcctctagggtccagatgcctgtactccactgctgctgctcttggtggttatctcgtggtactggcatctccaaaacactccatgaccccttcagtccagggccgtcaattgcaactgaggctgcaccttcaccaatggccttccatggcctctcacagtgctgagcctcagctgctctgcgtgaccccttcatgccttcaaaaccagtaccacctgggtgacccttacacattaccaagtcccgctgcaacaggagtacaaacttggctatctctggaacacagcctctttgtgctttcagaaaacacttcccagaagatgtcaactcaatgatgctggtctcttcttaatcactgctaatttcttagcttcagctaaccagcatcaatagtcccagtaatgcaaaggttttgctttagtagttttggtatcttgttaatcacagctgattcttcaaccccagataaccagaaccacagaataatcaaactccaaaatagcaatggccctgaaaagagtctttaatccacccccccccccccgaaatttcacaagccaggccttcatcttctgcactgttctcaacattatcttccaagctcccacacaacatctgacagagctcttaacaccaaatgaatcttctagcccaaagttccaaagtcctccccaaaacatggtcaggttgtcacaggaat

SEQ ID NO: 24385 - DNA, 1099 bp, Mus musculus
aacacatataaacaaaagcactaaatataattaaaaaccaaaaccattattctaaaaactgtttctgacagtttgagatgttttctggattgttcaaataattgttcatatgtacatatcttttatagacagtaaagtgaatcatggtaattcatagttttagatttctctgcagtgttataatctgtccttgggtattttaccaagtagttgagctatatgctgagggatgtgaaaatacccctatatgaaattccaagtaatattaacagtatgcacaatctaaaatttcctccatttttagaggtctaagggttgaggggtccccccccatccatttatttatttatttatttaaaacctttttttaaaatgaagttataattatttcaacattttgaaagagataaattagtttagtttgggattactatattccattagttctcaagaactcttaaggattttgctagttaacattttcatgatggattaacatttgtctctatctcaatggcgttaacatctagtggcacaattatctaacacaaagacagctccaaagaacttgttttattgattctgttggatactcagttcttggtaaattataccttaagcacagatatgaatttttttaaacctctttttattgtggaaaaaattgaaacagcaggacaatcagctgcctaatggactgttatttgtctaccaaccaccactacttctttcaggagggcacttctcattcattgcctttcttatttctccccactgcatgttagcttatttgagtagtaaattctggacatacagttttaactttaaatattgtattaggtagctctaaaatagactcaataatagtaatatgttaattttctttatatcaccaaatatgtactcaatactcaaagttcatgtcccatgaatgttcttttttaaatgcttgttgaagttatactcagggttaggtatgttaccatacccttttaacacagcagcattacacaggcagtgaggcatgcaggtctctcaatttgagggcagtctggtctgcacagtgagatcctatttcaaacaatcaatccccccacaa

SEQ ID NO: 24386 - DNA, 1227 bp, Mus musculus
atagctttaactgctaaatgtgtacactacactcagactttggctaaacttggctatgtatttagtctgtgagcatcttgagtgcattagaaatatctaaatcattcaataaggtagtatccagtttaaatcttgctgaggcagattgttcatgaagaaaaaagagctttttttgtcttatgtgttttatggcaattacataactaaaactatcatttaaaatgacagacctcatttttaagcttgaaaatattaggtaaactaaatctatatgattatggctaagagtctgttctgaagttagttttaataggatgtgtaatttgtctagtattaatttgatttgtggtaaaaatgaaggctatcatcttgttagcaggctcagtccagagaatgcccgaataggttgacagctcctcactaaagtgttaatattttatcagtgaagaacccctcccccctttcctggattagcaagaatattttttgtctaacgcatttaaaatttttacttttaacagaaattagcagagtacggaaagacatgtacaatgacacgttaaatggcagtacagagaaaagaagtgcagaattgcctgacgcggtgggacccattgttcagttacaagagaaactttatgtgcctgtaaaagaataccctgatgtaagtatatcttgttgttttgttcatggttttctgcttcacatactatatggagagataacttttgagtaaatgtgtaggtattatcagctgctttaaaaggattgtgtatgaagttagaaatgggactagttttatgtggctaattgttttctctttaaagtatattcccattagaattttgctatgtcactttgggaaataatcatgcagaagactttggaatttcaaaaagaggtcaagagttgtgggaagacttttatactgaatcttcaagatgaagtgcaactctgaccacagaatccatagcttgaaccatgtcattctttctgtacgagagtgctggtcattatggttgcttccagctctaacgtttccgagaaatactctttttagtgtgattcctccttatcctccaagtattagtgagttgctcaaccagtttgtagtatcttgttggaaatagtctcctcctatacgtgctgatttttaagttcctccaggctctgctttttgttacaaaaccctatatgataaaattgattctatttctctgctctcat

SEQ ID NO: 24387 - DNA, 1099 bp, Mus musculus
tgttcaaagaatagactgccagaaaaaaaaaaaaatgaaaaggcagctaactctacaaagtggtcctttgttgtgggcatggtacaagaaggaatgcttgagagtgcttgtggatctgtaaaggaagacaccaagtgagtgctggccagcctaatggagctagctggtgaacttagaggaaagacaggaagcagtttgtggaggtagtgacaataatctgctgggcccagggttgactatgtttttaagccttgttctggatttagtacaaaaccaaatcattacaaagtcagggcacggtcaatttggtcagtagcaagttattgggagctagttttatgatttgaaatacataggacaaaatcaagcatacatctgttaaagtcttaagagcatacttaggaaaaataatacagacttttgggggctggagagatggctcagcagttgagaactggctactcttctagaggacctggattcaattcccagcacccacccgacagctcacaaccatctctaactccagaccaggggcatctgacatcctctcctagcctctttgagcactaggcacatacattcacacagtgtacagtatatcatatgtgcagaaaaaaatgctcatacacacataaaacaagaaaaagttaaaaaaataaggatttaaaaaatttgaaatgttgtataaacttcaatgtcatattctttatccagtttcaaaatttcctcatagatggtgtggaagagaatatagaaataactccaagaaagacatttcttggttgagtcttggtagagggaaaattagtgcaaatcaagtgatcatattcagaactgctaggaccagagatcagaaaaatgtagacatagcagtctggagagggtggggacttgctcttatcacaagtttggttgttgcaaaggtggtgcagggttctttctttattctgtatgctgatctgttttatgatgtgccattcatgtaaggactgagaagaagagatttacaacatatttccacacactgaaaaaactgttagagcttccagttgtgaacagaacgaaaatggaagtaattttgccaattctgtgctat

SEQ ID NO: 24388 - DNA, 1193 bp, Mus musculus
ggccgctcgggcgggacggccggcgcagggccgggccgcggcggggaggacgcgcgccggtggccgcccgcgcggggccggggtcgcggctgagggggacgcgggcggcggcgctggctcgtcggcgcgctgttgctgaggcggcgggcgcggtcgggtgcggcggctgagaggaatcccggcgggactctccgcgacgcgctgcgctcgccgccgcccgggcctcgcgtccgcgcgcgttactatagtttgggttttttttttttttcttaaacctcttcgtccaccttcctcgctaccccctcaaaaaaaaaaaaattttttttttttaaacgtcctgttgcttcactggggactctcgggtgggcgtcacgtgtccagacacgtagccgagaggctgagagcgcgtgcgcgcgtcgaggactgtgaccacgccccttccgagggtcgctccgccccacctggcggagagcgcgccgtgggggcggggggtgggggggaagcgggcctggagcgcgcctgcgtgggggtggagcgggacgaagatggcctgcggacggaggagcgggaccgaaccgttctggcgcggcgcccacctcgcggggcgggaaacccggccgtcggatcgcttggggtgcgaggtggcggcggactgagttggcgtgggcgcccacaccgcaagtgtctccggcggtagggactccagtgaggtttcccctggagccagcgccacgcgtgacgggcctcgcgttgccgtgggctgcgaggcggccccggaccgtgggcggagacggcacacgcgtgcgcacccacgggcgtgcgggcgggctctgttccatgcggcgtgacgcgcggttccgttaatcctcaccgcaggttccagtccctggtggcggaggcgctggctcctcagcggtgcggcccccgcacaagggagcctgtgtgaggagtacatattcggggaaaaaacgaagtggccaacgcctatttttacctacttgacaaaaataaataaataaatgacaggcagagggccaggacaggggctttctatggcgtgtagaggaagttctgccggttacatttgtttcggaaacaatgttccgaattgcagcaatgaagtcctgcgatttatagaagctgtcggtcattaaatctgcatcatccctgttttgttgcaagttctctataac

SEQ ID NO: 24389 - DNA, 1147 bp, Mus musculus
attgttgtcgtctaacagatttacaaagcacatggcctcaaacagaacccttgtgttgtcctcagactctggagcccagctgtccagagcaggcctgagtgtgttaaaatcacaggcctccagagtggtgctcctttctataatccctgtgtgaaggtgcacatccttgcctggccttgcatccgtcccctacacagtccttccctgctgctgcagagctggccgtaggacagccttcagacacttttgctttcatcgattataagactcatggtaattacagtagagtgtcccagatggcagaggccttcagcatctcaagaccatgatattcataggaatgtagtcccctctgccacatatgtgccatgttcatggactccaggaattaggccaggggcttgcatgtagaggaagagaaatgattctgactggcaccccgttactagagtggtctttctaatacacatcttaccctgctgcccttatttactaacttctgctacagaatctggtgttgcagggtccgcatcttctgtgtcacagcctatagcatcaccacttagaaaagcactcccatttatttgtcccatgacaccatgacatcatgacaacacgggctgtaggctggtgtgtaactttgtctccagccagtgtccagcctttgggcagctttgctagaggtgagactgtgcactctctgctcggtgccagttctgtctgtcagtgcctctgtcttctgtcttctcctccacttcactgtaccttattgatcagcctggcagaggtccctcccatgggaaggcgagccctcaggagcagcctgtactgtgactggaccccagcctttggtgcagttactgcaaatgtcagctgtcagtgaaggaaggagtgcagaacgcagagatgctgccctgacaaagatgcccctgcccttcctccaacaatacagaccagtcatctgaaagttcggtaaactaccgtctctcctaataaagagaaaagacacaggccaactctttagttacacagcccaccggatagtgaaaagaaaaaaaaaaaaaaacccacagccctccatcagcccctgtgctctgtctctcctcatcatttgggccactttatgcttttgccatgtcagctcttc

SEQ ID NO: 24390 - DNA, 1162 bp, Mus musculus
acagggtgggcgggcgggacatggactcgtttgtgggctggctacaagagatactggggacaggtgatgaaggaacagggcttcttagctctgaagtcgatgaaatatattgccctgaaggagctgtcctgtgtgcagctcagccttccataagagcagacattcaggaggtctgagttccctcacatgtcggaggctggtgccagggacccactcggccttgcctgtgggccagaggccaagcatccggacacaggcagatacaggaacgtgcctgcgccagctggggctcagcattctcttgcttcctcccaggtttgcacagatgaagagtgaagtgaaccagtccgtggcctagtagtgtgtggacagaatcccgtgatcactactgtatgtaatatttacataaagactgcagcgcaggcggccttcctaacctcccaggactgaagactacaggggtgacaagcctcacttctgctgctcctgtcgcctgctgagtgacagtgctgaggttaaaggagccgcacgttaagtgccattactactgtacacgggccaccgcctctgtcccctccgaccctctcgtgactgagaaccaaccgtgtcatcagcacagtgtttttgagctcctggggttcagaagaacatgtagtgttcccgggtgtccgggacgtttatttcaacctcctggtcgttggctctgactgtggagcctccttgttcgaaagctgcaggtttgttatgcaaaggctcgtaagtgaagctgaagaaaaggttctttttcaataaatggtttattttaggaaagcgaagtcagcgtctgttactggctcacggcttaagagcaggacggcctgcagaagtctgcccttccccgctccgccctgcacttgattccactcagcacagccaagcttgcccactgggacgctgagctgggtgcgtctaacctgcagcccgtgggccatgtgcgtcaaaggatagctctgagtgtggcccaaggcatttgtggatgacagcacatcagtgtttaaggtatggaaggggaacagtgccgcgatcttgtgataggccggccaccatggtttcagagcataacctgactccgcaggtaggactctgaagtagctggatattgtcgtcgctggtcttggtgctt

SEQ ID NO: 24391 - DNA, 1198 bp, Mus musculus
aagcactgagagcttaaattaagacatgttcctcagcctttactctgttgctattggggacggtgattctttgttgtatggtgtagtgaggtgtctcctgttatatgaggtggttgtggggtgtattctgttgtataggatagtggtggggtgtatcctgttttatggggtggtggtgggctgtcttctgttatatggggtggtagtgggttgtctcctgttataggtcatagtggtagggtatatcctgttataaggagtggtagtgggttatttcctgtaatatcaggtggtggtggagtgtttcttgctgtatgggatggtagggtgtcttctgttgtttggggttgtaaggggatgcctggcgcagtccttgccgcccgcggagacaagaacaacacagacaccaagacagacgggttcacgcagcttccgcagcttcctctttacttacagcttactccacagctttttctacttagggcaagggctatatttatacagtagcagcaactgacctcatctcgctccacaccacctcatccaatcagaatcacacactctccaggcacgcgctcaggtcagtcacagataggctgacagatctggatctaacttggcaagcagcttatgcgtgcagttttactgcgcatgttcgggcaaggcagtaaacatgtgggtttcaacaggcctggcaatgggctagggcaccatcttggcccatgcggccgcacctacttcctgtatctccccctttttgttttattagtagctctgggattggcatctgtcttaggttgcccccatctgtgccacatccttacctgtcatgggagtgacaaactcactttcgccatcctgtcttaggttggtatgtgcatgttagggtcttacccatcattgattactgatccagcatgtcgagccaacattagggggatgttcctgcttccaaggctgccatagcctgcactaaggctcgtctatcagccctgtgccaccttcgcatatgtgccatccatcaaagcattcctccacacacaacagtcagcaggagcgctcaaaaggccatccctccccaattttttaagaatcccacagttccctggatgatctccagccattggtttgcagttgcaatctccacacgggtgttgttcacagcaacaatcgatgctcgcaattccttcatctttgt

SEQ ID NO: 24392 - DNA, 1226 bp, Mus musculus
ggagcattgccttctccagcaatggagccggtttcaacgggcccttggtagaaggccagtgcagaacccctcaggagacaaaccgtgtgggctgctcatcgtaccacgagcacctccagcgccagagggtctcgtttgagcaggtgaagcggataatggagctgctggagtacatggaggcactttacccatccttgcaggctctgcagaaggactatgaacggtacgccgccaaggactttgaggacagagtgcaggcgctctgcctgtggctcaacatcacgaaagatctaaatcagaagctgcggatcatgggcaccgtgctgggcatcaagaacctatcagacattggctggccagtgtttgaaatcccctcccctcggccgtccaagggctacgagccagaggacgaggtcgaggacacggaggttgagctgagggagctggagagcgggacggaggagagtgacgaggagccaacccccagtccgagggtgccagagctcaggctgtccacagacgccatcttggacagtcgctcccagggctgcgtctccaggaagctggagaggctcgagtcagaggaagattccataggctgggggacagcggactgtggccctgaagccagcaggcattgtttgacttctatctatagaccattcgtggacaaagcactgaagcaaatggggctaagaaagttaattttacgacttcataagcttatgaatgggtccttgcaaagagctcgtgtagctctggtgaaggacgaccgtccagtggaggtaggtttcaatgggggatgtcccgtagtgtcacgtctcaaatccctcttgccgtgtagtattgatcatatggactttaatattcttagcatttcaaggcataaatgacagatatgaattgcgttataattgctgctgtaagttaaagtgttatggcaagtggatcaaatttaatgaatgaagcacaaggtggtgtgcggatgaagacaatcgtataaataccagttgggaaaggacaaactaggtgtaaagtggggggcggggcctgggtgaccacaagctgcaggtgagtcagtaatgttagtgtcatacacaggtgatgagctatccacccacccacccatttagtccccctagccctgagggaccttgtgcgagttaagcaggtcctccacctctgagctggatctctggctctttggattctttgaaaaagcttgg

SEQ ID NO: 24393 - DNA, 1207 bp, Mus musculus
gtttctttggacaccacactgtgccagggccgtgcctccctgtgtgggccatgggaaatgctgtctgctgctgttgagcctgtgcccttcaggaagagctaggctaggccctacaatcctggcaggcgggactgtgcttgccccttcattagtgtgcttgccagagcgggtgcacaggtctgtttttagctctgtctgatttgtaacttctagtcttttgctgtttcctcttttaatttgtagttttaagtttgaagctcagttagatttgaaagagctccagaggcatcagacacaacacacagattgtgcccacactgcacctgacagttcgcagcttgtggccacaagcactgccactactcccttgaaagaaagaaggatgacgatgctgaggagacaggcagagaagttttgcagcattcccaaagaaagctgtgaatgtagctcctgtgatactaaccagctctttctgcatctgttatctttcataggcaggagtgcatgttgggagagtcggctcgcaaaagtatggaatccgatccagaggacttttctgatgaaacaaatacagagactctctacggcacctcacccccaagcacacctcgacagatgaaacgcctgtcagccaagcaccagaggaacagcgcagggaggccggccagccgatcgaacttgaaaggcgagcctgtcacttgcaagatccacgggacagggcgtgacacctttatgagacaagcctttgacagcattagtgattcctttgttttaaattgtatctcagtgttggcggtagggttgttattttgacttagcaccacaggctatgctgctggtagaaggggcaggtgattatcagtgcaggaggttttgtcctgagttgtgttttaagtcttttgaggctatggtagaggctgcaaacccaaggtggctagatactacacgggtggcccacagttaccctttctagctctcaccgaggtttttgagttcttttctccagcagtggtatattgggcatctggtaggagacagccaggctaaattctggaaccaaccaaggtctctttcttctgccagagactcagtgtgtggggctcttgcatgctaagctgctgccagatgggacttcatatctgaaagccacagagggaacctagatggtacccagatcctttcctctttgtgtagcatctcagagccc

SEQ ID NO: 24394 - DNA, 2200 bp, Mus musculus
gaggctcttgccacaggctctactttgcaggttctcatctcataccccagagagaggccctggggtggcctgtatcaggagagctctcctgcagcagacaggtctctttgctgagtctcatggtctctgcttctgttccctgttaggtcagcaaggaggaggagacagatgagaatgagacagaatggctgatggaagagatccaggtgccagccccaagactaggcaaggacgggcaagaaaatggccatatcaccaccaaggcggtgaaagcagaagctctctcgtccctgcatggggacgaccaggacagtgaggatgaggtcctgaccgttccagaggtgaaagttcactcaggccgaggagcggaggtggaaagctcacagcccctgagaaacccacagcgcaaggtcctgaaggaaagggagggtgagaggctggggctggtccgaggtgagaaggccagaaaagggaagttcagacccggacagcgcaagccaacagcccctgccaagctggtgtccttccatgatgacagcgacgaagacctcttacacatctaactccgtggtgcctacagaagaaggtggagccatggacagccaagcacctccaaccaaataagacttcagctcgatgatgcgtctgtcattttgcctttaacaaaactgcttcaaagggaagagtttctgtaatgggggagaggatgggggaggtgggcaccactccttcatgatcgtttacagtcaatggaacaaggtgttgcttgaatcggccaaagggcggtacttcgtgcccaggggtttgccccaagtcctcacttacgatcatagctgctgtgtgcttccaacaggtgcccaagccacatgcatctcacaacagagggctgtgtttgaaaaaaacccttgctgctttagaccctacggggtgaccatttatatttttagcattgtaattctctcccctatttattgactttgacaattactactcaggtttgcgaaaaaggaaaaacaaaaacaaaaacaaaaccagtttcttttgccagcaagggcataaggtgaagctggccgtctgccggagccgttgtccatggctcctgaactggtccttgatgcacacttagtgagctgcagtattctattcttcgctttgcattttgtgagggcacacacacatgcacaggtccccgagtgcctaggtttgggaaggcccacctgctccgtgccctacctcatctctgtagttgcagctctttgcacgaatccctctgggtgttgctcttgccagctggtgactcccagcagctcacccaggcgggcgttcgcgcacacggtggagtggaggctcttggggaggagctgcgcttcaggtttgagctgtaggtctcatctcttcagggtctcatagtgccacctttactgtgctttttgctttttttttttttttttttaagggggaaaatgtttatcacccattcgacctataagaagccttaatttgcacagggtgacttattacagacaccgtgaaacgcggtgggccagtgttggtgtagggccagtgttggtgtaggggctgtgctagggcagtgtcccaggatggaagggcaggcccagtccactggctgtggattcttttcttgatgtgttcagtgacttgtcacattatagagttgtatataggtggcatttacatacccaaaagcaaagtaccccgcagaatttcttggtttatgcctgattttgctagcttatttgatttcacattgagtgtatttttaaaaattgatttttctcttcatttttaatcaacttgactgtaatatgaagtattcaatttcaataaagataaattattaactaggtgtaagtgactcaccccacccccaacccccctgattatgataacttctgagctagtggccaccctgaatgcctggcttttccttctgtttacctttcagaaggcattcgcatttggttttttaccacagtgtcctgtaaagctactcctcccctttcctggagttgtctaagtctgtcttcagctgtccctggatctcagggctacactctccctatgtgagcctctgctgctctgctcttcccgtctgccaaagcaaaactgccattcatttctagtgaccagaaaggcccaagtgaatgcatcaagtgaatgcatggcttgcttgccacct

SEQ ID NO: 24395 - DNA, 1128 bp, Mus musculus
tccttgcaggttactcgggatgcccgcacatacagtataggggtgtgcacagcagcagctggcttaggccaggaaggctgcaaggatggcggtgtctgtctgctctctgggaacaaaggagcttcttttgggcgccttgcatcgatgcagctggattacaggcaccaagatgaagcagtcattctgagttatgtgaatggtgatccttgccctccaggtaactcttcacagtatggtcaagttcaaatttcttgtaaatagattgacttagcagaaaaatacttgaggaatgaagcttcagacctgtgagcactgtaccctgccacatctccttccctggtatgaatgcctgtgtctggaacatgatgctgtctgttgcttgtctgtttgggtgaatcctgtctagcagggcaggtacacagcttcttagggagtctttgggtggcatctaaggcatggctgattcattgacgcttgtgtataatccatgcctctttccttccagaaacggatgatggcgagccctgtgtcttccccttcatttacaaagggaagagctatgatgaatgtgtattagagggacgagcgaaactgtggtgtagcaaaactgcaaattatgatcgtgaccacgagtggggcttctgcagacagagtgagtgggtagctgaatttgggggaggggagcaggtgttgttctatgggtggccaagctaattagtgattattatgtaagttttgttcttgttggctaaggatgatgttcatggagagccaaatttgagcaccatagctcctttgcgacttaggggtggaaagagagtggcgtgaaggcccacactctgtagttctctacatgatcgaggacaagcatttgactcatgactagctccaagtcttctatgggtggccctgaagttttgaggttgttacagatgcttggctgattctttaaattcttgccattattaatgtgtaggcaagtattgaatgctttcccaggagggattttggtgtggtctgaggaactgagtttgtaagtggatagattaaggagtgagacaaactgtggctggggctgcacttggggaaacagccaggagtaataaagaggtgggagaagtcaaggtt

SEQ ID NO: 24396 - DNA, 1183 bp, Mus musculus
gacgcagctgcacccactccagtttgctggttcctagcagtccaaggctgggcggtcttggtcagtattccttaggtttttatttattttattttagtttttattttaatactacttctttttttccttcttttgggggtaaggttcttttttttttttttttttttggttttttcgagacagggtttctctgtatagccctggctgtcctggagctcactttgtagaccaggctgacctcgaactcagaaatccacctgcctctgcctcccgagtgctgggattaaaggcgtgcaccaccacgcccggcggagggtaaggttcttacactttatccaaagttggccttcaactcactctgtattccaggctagcttgaactgtggcaattctcctgcctcagtccattgagtgctgctggaactgtagacatgttctatcatacctaggtttagcttttaagctgtcattcatggtcattagaaaaaaagttacttgtagactcaaatgtagtcttttcttttgaacagacggagtgtactgtgcggaatggaagctcgattattgacctgtcccctctcatccaccgcactggtggctacgaagcatacgatgaaagtgaggatgacacctctgacaccacccctgacttctatatcaacatctgccagccactgaatcccatgcacggagtgccctgccctgcaggtgcctcagtatgcaaagttcctgtggacgggccccctatagtaagtgtgtaaggtcggggttggcaagtttctagtcatagcctgtgtgctgggctcagacagctaagtgtgagatcgaaagtatgagagtgtacatggagcgggcggccaaccaacagtactggccagggagtctgagctgcttgaaaattgaatagttgcttccatttgcattttgaaaatacatgtgtatgtgtgagtgtgtgctgtacatgtatttagcctgtggaggctagagcaggggtttgtgtgagtgtgagctgtacatgtatttagctgtggaggctagagcaggggtttgtgtgagtgtgaactgtacatgtatttagctgtggaggctagagcagggtttttgatcttgtggggttggagttacaggcacatgtgagctgcttgatgcagtgctaggatggggacctgagcatcctctggaa

SEQ ID NO: 24397 - DNA, 1399 bp, Mus musculus
aagtaaaagttaggactcagctgagtaggccatgaactgcagggccacagagtgtttctgaccctaagcccataggtttttcttgggacacaccacatgaggtgatgatgagtgcctccaagcagtctatcccagggctgcatcaaagaaggttagatggaaaactgacaaggctgtacttggctcagtagttaagagtatggcctgctgttgcagagaattgggattccattccagcacccacatggtggctgacaaccatctgtaactatagtcccaggggatctgagacccttttctgactttccaggcataaacatacatgcaggcaaacacactaacacacatgacataataaacctaaaactgacagagttgacatggtggtgtctgtttttgcatgtacactgtcacaggtcttgcattagcaccgcagcccaggagccttacagatgtgctttgtctggagccttacagatgtgcttttcttgagcaggactccttagccagaagctgactttcgaaaacggactgttgaaaatgaactatactgggggggatacctgccataaggtgtatcagcgctccacaaccatctatttctactgtgaccggactacacagaaggtgagcccctgtggcactcccactgccgtcccactccagctgctgttctttcagggctagtctactctcaacgtctataagatgcattatttactgagcacctgtttgcatggccatccttcacctgggctcccatgtttacatattttctccttaacctttccagccagtgtttctgaaggaaacttcggactgctcctatatgtttgagtggcgaacacagtatgcctgcccacctttcaatgtgacagagtgttctgtccagtaagttcacatatctattggctttttgtgtccttccttggcaaaattttgcttcacaggtagtgtcttggtcagttcacccacttcttttcacactgggtagatggctccagatagccacatgtggggctggtacatcagacgcacatggagaggaggagtcaaggacagaaacagaggttcggagccttcctggtttgtaaggatggagtggcttcaggtctagagagcaggaggcttggtgaggcagcttttggaaatggctgtgggtgcatacgctccgagtgccagggggtggcttctgctggccactgagttataattgtcactggcctgtgtgtggacagacttttccaaacttggcttttcagatagctcattttgttgaagtgaacatggactcatcaaagctcaaggctgtgccttgctcactctgcatttggaaagttatgttctgcagtaaagcttgattcacaggacatcagggacacattgatgcttgagccct

SEQ ID NO: 24398 - DNA, 1156 bp, Mus musculus
tggacagagccccaagcgtcttcttgctgtgtgcttgagctgcggcggcagtgcccatcttgaatttgtggctctgctggatttactggttccagcacaggaggattccccccctacagtcattcaaaaggcttttagatgcggcctcggacagaccccctccatagtggagtttacaagaaggccatcatagtgtggttgcttggctatgccacatttgtgagacctggagctacaggtttgaacagggttgtagggctcacacagtggaaaagggcaacggcgaggacctgtgtccaggtaggagatagtcactgcaggaatggtagcttaaaggcaaagtgacctttctccttcagcgctgttttgctctggcagtagtttctgtctgagaagcttgcgtggtccgctgtcccctgtgccatgactggcctgacatacctgtgttgtgtttatgttactcagggttttcctttgatttgtcactcctcacgaagaagaatggtgcatataaagttgagacagagaagtatgacttctacataaatgtttgtggccctgtatccatggatccttgtcagtcaaactcgggggcctgccaggtagcgaaaaggcaagtaacctgattctgggtttgctctttgggattgtgggctagcaaatgtttcgtacagaggtagttaggtttctcttggacaccattgcttgacaggcatctaactactgagaagacctggtcagaagaatcgcaggaccccagagaaggggccaagccttatccttaggctgagagaggcctgggcttattgatgctcacctgggaacttgagctttactgttgttgcatacttatgtatgtagttctccttactgtatagaataggtttagttgtaatgaattgagctgcactacaggccaggagtactgagagaaagttgtgtgtgtgtgtgtgtgtgtgtgtgtgtgtgtgtgacttttctctttccacagccaaaagagccacatatgagattcccagggactgcagtgtcttggtctggccttgcttttgcccctatttgtgtagccttagagaacagaactcctgccccatggcactcactcccagagtgacatttctgtgttcattttagtggtaagtcttggaacttgggg

SEQ ID NO: 24399 - DNA, 1135 bp, Mus musculus
ggggattaccctggcattcagaactagagacgcatctcagagtgactgaggtctgtttttgtcttactaagggctcaggcatagacatcttcagaattcagtgtggggtgccacagtggggtgagtgccacacaggtgtgagtttctgcttggtcatgagtaaagcttgtgacttgggccgtgctcctcagctgcccacgtttaagggcagctgaggctctagatgcggaatagtgtcttttacagataatgatggtgcccacacaaccctgtccttcagatgcctttgggggaatcccatgtatcattttcagcatggcaggaggtggcctcgatgtgattgataaattttttcttttaagaaaattggtttccatcacagtcaggttaggtgggctgaaagaaggtcctggtgacccgctggcattcggctgagtcttggtatactttcaaatgtttacatgatgagaattttctactccaccttcttttttttcccccagataagaatgggagtaaaaaccttggaaaatttgtctcttctcctacaaaagagaaaggacacatacagctctcttacactgatggtgatgactgtggcagtgataagaaaatatcaactaacatcacacttgtgtgcaaaccaggtaatgtcacagaagaagagacatacccacattttccatcatttctgtagtagagctgggagcaagggcggtgctgagcactgctagtactagtctctggtgatgggaatcaagtcgtttggatttcagcctagaaatggagaaaccatatgctctccacagagagttgtgctgacacactccaaaggagtcgtgagtctctgcatgacatcctgttcataaggactgtcagaagatcaggggtgtggagtgctgagtttcctccacggggggatcataaacggcttagaaatattttcttgattgcagcatctcacccgtggctgtccctcccctcttgagtttctgcatttgtgcgtgtatttcagtgttcccaggatgctgtgttccacactccacagttctgtttatgatttctagggatttccttgttgacatggcatagttttactattttaaagcattttactgctgggaatttagatgtt

SEQ ID NO: 24400 - DNA, 1218 bp, Mus musculus
aggagacaaaggacaggggtggttcaggagtttttctctaagctacagagatgggaaggtagctgagggagagccaggaactagaaaagatccttgtaagtcagtggatgtttgtagctgcaggaagtggtctaggactgggaaagaagagggatgtagatgggaggaggtacttgcagacataagccttaagaaggggagagagaccttgggaatggtacagagggctgaactgttttttgagacagggtctcattcactttgtagccctggctggcctgggaacttgctgtgtaaactaggttggccttgaacttacagagctcctcctatctttgactcttgagtgctgggattaaaggcttgcactaccatgtctgacagaaccatgtttattctatatataagggacagaaatcactgttctgtatgttcatcacaagtttgagatctatcagccccatggggtgaaggaagtgtctcacttcttctctgcttcctcaggtaccatgctatgcatttgatgacaagttacagaagcatgatttaaacccactgatcaagctaaatggtggctatctggtagatgattctgatcctgacacgtctctgttcatcaacgtgtgtagagacataggtaagagttggtttaggaagaagggtggggtgtggtcagtgcctgccctgacccctttgacatgcacatcctcattagatctctgagaacgctattgtcctgaaagtgttctctggagagcttcgtttgtctccctcagcaaatctgatcctttccttccaccaaatacaaattctactcaagctattgatggaggttttctctgccagattatctgaaaaccttctgtttgacatttcctctaccagacactctgggatttggggctccatggtgagctttgtttcaatttgctgtgtttacccaaaccttctggctttaagttggagagtgggtaaaagggctgagggatgacaaagactctaagagtgtggttgtggtgtgtgcttggggtgggataacccctctggtgttctccgtagaactatgcgagaggccagcatatctctctttgatagacagaggctgtaaatgaaggtctctatcttagaagaggggtacagttttactatgtatttatttattacctgctaacctcactagtttttgtgcttcccttgtgggttcaatactgggagccc

SEQ ID NO: 24401 - DNA, 1190 bp, Mus musculus
gctagctgctgatttacttctgttgattgttcttaagagcttggtgtttactgtaggagaaacaggacttggaggtgaacaccttggtctttctcatgggctggggaaggtagaagttaactgttgctctgcaggggttaactagagttaactggtctggttgccagaaggggctgtctggggtgggatctggtgcctctgcccaggctctgctgctcgtgggctcctcggggacctccttacaggatggatgaagtcatactttctggccctgattttgctgttttttggttcagagaccatttggctcttgagaagaaggcgaaggataatttcccatgagtttactctgcttgtggaattggggcagctgggcagtcagttagacaggatgtctggagactctcatctcccaacttacttttctgtttgggcggatattcttggtgaacttgttgaagtaaggcagttatgtttcctcttgttgcacccttattttcaggagattttacaatgtttcaggtttaaaaacaaacttgtattactgagtggtgtgttaacattctttttttttttttttttttaatagggaactcctgaatttgtaactgccacagactgtgtgcattactttgaatggaggactactgcagcctgcaagaaagacatatttaaagctgataaggaggtaatggggtttgagactatttggtcatgaaatctactctggagagcttgaaagtcagggtgtggattctgctggggaggaggtgagagagggaaaccataatcagaatgtgtcctgaaaataaaaatctatttttcaataaaagaaaaaaagatagaaaattaaaacaacctcttacaaagaaggttgtgactttgcgatggaaagatttaaatgacttattacagtctcttgaggtgagagtttgtttctgtggatgtgaggttccatttgcacagaggtaccacgagatttaattgttaaaaacgtctaggccagcttctggtgcacacagcacagcacagcgcagtctgttttggctttagggtttgccctgcaccccttgggccctcaggaacctgactgcttcatcttcctctgtacctgctccctacccatgaaacatctcacttggatgattcgttctctgccagtttcttttcttttcttttttataaaattt

SEQ ID NO: 24402 - DNA, 1137 bp, Mus musculus
ggagggctggcattttaactgctgaacagtcagctcagcttgttggtttgtgatgttaataaggttatcagaggctacacatgctatttcttcacaaaaaccacgtaggcagaccaggacttgtacttgcaatcccaggctggtagcctgtggcagaaggactactttgagttcaaggccaacctggaccaccatatgacatgtctaaagagtcctgctctgcaagtactgggatcataccaggggctcagcaagaaactccactgggcaaagagaacctcccaaggcccaatcctgtgcagcacagctgcacctcacttagaaacagtgacacacctggggcatgccatccacggcttctgaacataatcacttagtcctcaccgtctgtcaaggagcacaccaacctccccattttggagacttgaaactagagcgtgggtgtaacttggcaggcagtcccagatcaccaagtgaccaaacacagcaggaagagccttgccatgccctctgctcccagcacggaccacttcccactgcattctggctgcagaactgtcaccaacttcagtacctgaacgataagaagccctctgcacaaaagcaaagaaatcagaactttcgggcattttttattttgtcgtttttcagtctcctttaagttcaggctcatccacttgcctcagctgccaaatgattatcgatatgagccattgtgcttcattccaattttggagctgatttccaatagctccaaagtcaatatggtcgcgtctgggatccagccccagctaactcttgacatctctcctgtcccgtcccatcccatcccgtcctgccccgccccgccccgccccaccccatcctgtccagtccctgtccataccccctccaccacccaccccacttcaaccacattgaccctttggtctcaaacaggcacacttagatcctgcaaagactcttccccattacatacagtaacacacatacccctcatttccttccaggccccctttagattcgcaccttacagaagagcctaggcatggtgagcccttttggacccacacccttgtttattcccaaaagctcctcaatcctctctctcattattaagggatgccaagcctcatg

SEQ ID NO: 24403 - DNA, 1181 bp, Mus musculus
ggtacaggagtagtcccttgatagaagctggagttcatgtttgtcctctctagtgttagaactaatgcaggcaagtgttgtcagtgagaaaaccgctaaatgaagagttagctgtgaaccagaatgtaaacttccactcaaagtatcatccccaaaatacattttctttggatggctttggaaatggagcaccccataaaccaagcctttggtgaagtcttgtgtccccaggtgatggcattattgagaggtggttgtatcacgaagactgtgacctgatcaatgaagtaatccattcattgattcatgatctgatggcatctcctagttagcttcagctctcaatgtgacacagcccagagctgtctgaggttgtctccatgttgatggccccatgggcatgtctgtggagcattttcttgatcaaaaattgagcgacaagggtacagcccactgtgagcagtaccatcccctagacagggaatcctggactgtgtaagcgagcaagctgggcagaagctaggaagagcaagctggtaagcggcattcttcagtggctctgtttcagttcctgtctcagtcctgccctgagtgcctgtcctgagttttctcagtgatggactgtgacgtggaatgtaagccagtcctgccctgagttcctgtcttctcagtgatggactgtgacgtgccatgtaagccattgtaaccctttcctccccaagctgcttctgctcagagtgttccatggcagctggtatcacaaatttggggaggggaaaaaaaaaaaagacttcattatctcttcttgaagtgatgccataaaaattcagtgaagcggagttctaaagcacagagccacctcacaggtacagaattgatgtgtcaaaaaaatatcccttacgttattcaagtaagaactgagatcatgttaaaacagactcaaagggaatttaaaaacaaacaaacaaacaaaccctaatacagacaacggaaagttgggaatgcagaagagaaattagccaatagataaagggttggttaaaaatcaaatacttatctgactcagacacagctttaatttctcaagtcaaacaattggatattttactaacagtattctacaacttacagagttgtaaagtacctcgtgacaatgaaaagctcgggtgccatagattaac

SEQ ID NO: 24404 - DNA, 1084 bp, Mus musculus
agcaactttgtagaccaggctggcctcgaactcagaaatctgcctgcctctgcctcccgagtgctgggattaaaggcgtgcgccgccacacccggcttgatttttttttttttaaatagtaattacagactttagattttagcaaatcataggtagttgagtgtcatagtttatgtgttgttctaattagttttcactgttcatctacagttatggctgcagcttctattgccaacattgttaaaagttcttttgggccagttggcttggataaaatgttggtggatgatattggtgtaagtatatatctaattgctcttgcttgccttgataaaagtacattgttttaaatttcaaaaaaaaatctttggtaaagtctttgtttttacctgagtatggatggcatcctagagcttggtttctgtgttgaccacttattccttcatatttcttaggatgtaaccattactaacgatggtgccaccatcctgaagttactggaggtagaacatcccgcagccaaagttctgtgtgagctggctgacctgcaagacaaagaagttggagatggaactacctcagtggtgagacgctaccaggaaatggctagagaatagtcaatttattagagttgaatccatgagagagtcatactctaggtcagaaataagtcaccttttaaggcagtctcacaaacttttgaaaactaaccattgtaactagtttgtgtaatttaagtaagggaagaacttaaggtgattaaataaatacaagcttgttttaaatactggagtctcgtgaatttggagccttatttaaacctacttaaccatgatgatgttcatgtagaaaatgttaccaggtttggacttttttctttgttgtttaatagatacttttgtattttaaatgtgaacaagaaatctttggaattcaaaatagaaatttgcagaagttaatttgctaccatatagtgctaatggctagtcagcaaacatggcgaatagtgtaacattttgtgagttagcctgcttaagtagtaaaatactgtttggtgaggcagattttagacctggcaaaataa

SEQ ID NO: 24405 - DNA, 2083 bp, Mus musculus
ccaaggagagaattcagaagatcctggcaactggtgccaatgttattctaaccactggtggcattgatgatatgtatctcaagtattttgtggaagctggtgccatggctgttaggagagttttaaaacgagacctgaagcatgttgcaaaagcttctggaggtacgtcctctcctggccgggacacgcggctgcttagagatagatgtcactgggtcagaagggttggagtgaaatattgacactaaattttagaaatatttttcctctttgctgtgctctaatagatttatagagccattttctaggtagttgaaaacattctttgatgctgaatttattggaaatgagtaaactaaggtatttttaccttgaaggtggcagtattgtcttgggttacggtagtggcttgtctggaaccttgagataatgcactgcttttccatatactaaaactatgagaaaaaaatgtatcttacatgactcttatagcaagtatcctgtctacgctggccaatttggaaggcgaagaaacttttgaagtgacgatgttgggacaagcggaagaggtcgtacaggagagaatttgtgatgatgagctgatcttaatcaaaaagtaagaagtgcttttgtaagttacagagcaatgcagattgtgttgtaaaaataattctttcccattaatttgctgctctagtctgtcagtgataggagcggttatacgcatgggataaaacaatattgggccattgtacatggagatgaaatgtgttttgtctctcgtacatggtctagacattgttcctggtgccttatgcctaaatacctttctttttgtttgtttggtttttttctgtctttttgagacagggttttaccgtgtagccctgactgtcctggaactctctttgttgtagaccaggctggccttgaactcagaaatctgcctgcctctgcctctgttaagagtgctgggattaaaggcatgcgccaccatgcccggcatgtctaaatatcttattagtgggatttaatcaacgtgtctgcagttactgttttcactaacaaaaatgctaatagcctcacgtttgttttttgtagtactaaggctcgtacatctgcttcaatcatcttacgaggagcaaatgatttcatgtgtgatgaaatggagcgctctttacatgatgctctttgtgtggtgaagagagttttggagttgaaatctgtggtcccaggtggaggtgctgtagaagctgccctgtccatatacctggaaaactatgcaacaagcatggtaaggctgctttcaaaggcatagggtgcggtgttgggttcaccgtagggttttaccctgtcaggcccgctgtaggctttgactcctttcatgggcacacctcatggtttcttccttagggatctcgggaacagcttgctattgcagagtttgcaagatctctgcttgtgattcctaatacactggcagtgaatgctgcccaggactccaccgacctggttgccaagttaagagcttttcacaatgaggctcaagtgaacccggaacgtaaaaatctaaagtggtgagtatatgatttccttgtgttctattgtcaacttccatgggtctattgtaagttcataatagtacctttgtccctccctccacgtttgggaaatatatgaagggacttgtcacatattgaaacatcacaggcatcgttttcgagataacatctttacataatggtggctgataagttttagtgctctgccctaggtgtcgcaacacttggtcccattctgactccttgggtagtctatagaaagggccgagaggatgatattggggtagggctttctcattttaggcagctctcagcttacagtgaatacagtttcagaatattgtatccgtagacaccctggtgtttataaagattcataaagcatatttacaccaaccagaacagtatgcaacatgtcactatttgctaagtgttcgatagatgaggtttccctgctacactgtcagctattcttctcccagaggcaagcttgttgtaactcccacagtcttttggactag

SEQ ID NO: 24406 - DNA, 2083 bp, Mus musculus; identical to SEQ ID NO: 24405

SEQ ID NO: 24407 - DNA, 1442 bp, Mus musculus
ctgacttaggctcttcttctctataggtcaacatcgatggaggagccattgccttgggccatcctctgggagcatctggctgcaggattctagtgaccttgctgcacaccctggagagagtgggcgggacccgtggtgttgcagccctgtgcattgggggtgggatgggagtcgcaatgtgtgttcagagagggtgaactgcatgacagccaccaccttggacagttcttgttaaatcagtgcaacactaagcagaaagggaaaccagaggaccaaactgaggacaggaacccaggtggacagcttgctgtactttaatgtgagacacccaaggctacggcattgcacctgacactgttataaataagagggaaatccaatcagtcatcaagggctccagagtgaacagcattttcataacttccatgtttatcgtctttactttctgggtgtaattttctctgatcattgttttttgttttttttgtttttctttgtttttgagttagggtctcaccatatagcctcaaaatcgttttgtagatcaggttgactttgaactcccggagatccacctttctgtgcctcctgaatacttgaattaaaggcatgcaccattatgcagggcccccaaaatgatccattcaaaacatggggattcggcttctgttacgaacttcaggctcttcactttaactatggttggttcaaacgcccctgcgtgcctgtctctcggtttcccattgatcaaatcaagaccaatcctgtagtgaaagtcggattcagtgacctcttccaggctgaggtggggtaggtattccagctgttctagtcagaagactggcagtgccaacaagtgtgcctctggattgttgaaaggtgggcagcaagcagcatccacgtacttatttctctgcttgacgggatgggatgttacctgcttcagatatctaccttgacttccccaaaatgatgactggaactggaactgacagtcaaataaactctttcctcccttacattgcttcttgtcagtgagtttgatcataacaacagaaacaaagccagagcagaggatgtggtgagggcagccagcttcaacagaaaagccacagtttacaatatgttcatttgtgatcgtttctaataaacaatatgttactcagatgaacctgctgggaggtatgcatgtactatggaaatcataagcaaactatagtagagatagcttgcaaaagtcagctatttaagccaggtgtcacacctgcatgactggtcaggtgatgggccaagtgcacaacagccatcccctaagagtatcatggatagaaagtacctacccaagggatgtcccagcagctgtagtcagggtggtgcatccctaacaaacaggactacagccagcatggtatgcactaacctccatagccggatgtgtcgct

SEQ ID NO: 24408 - DNA, 1959 bp, Mus musculus
gtgagtgggtgtgtgtacatacagcagagaaatgttttaaaatgttaagatattagccgggtggtggtggtggcggtggcggtgcacgcctttaatcccagcacttgggaggcaaaggcaagtggatttctgagttcgaggacagcctgtctacagagtgagttccaggacagccagggctatacagaaaacaaacaaacaaaaaattaagatactaaagtttggctctcctttgcacagaactgaatgacttcatcattcaacttgatgaagaagtagagggtatgcagagcaccattctagttcttcagcaacaattgaaggagacacgacagcagttggcacagtaccagcagcagcagtctcaagcttcagctccaagtaccagcaggactacatcttctgaacctgtagatcaggcagaggtcacaagcaaagactgcagtcgtctggcaaatggaccaagtaatggcagctcctcccgccagaggacgtctgggtctggatttcacagggaggggagcacacctgaggatgactttccttcttcttcagggaatggtaataaggcctccaacagctcagaggagagaactggcagaggaggtagtagttacataaacccactcagtgcggggtatgaaagtgtagactctcccacgggcagtgaaaactctctcacacatcactcaaatgacacagactccagtcatgaccctcaagaggagaaagcagtgagtgggaaaggtaatcgaactgtgggttcccgccatgttcagaatggcttggactcaaatgtaaatgtacagggtgcagttttgtaatatttttccagaaaatttttatacagtgtcatttaattggggaaaggatactgtcaaaaaattaatgcatacttttgtcacaatttacctttttgtgggtgtgtttttgttttgtttggttccttttttttttttttttttttttttttttttttttttttaattgcttcaatacctctgccactttgaaaattgtaacagttaattactttgaacattgctaaaaggacattttgtgtagggtcaagttatttttatatgagttaatgtgaagttgtaaatgggaatctatagcaatgatgtctgtataaatctgtcttatctagaacttgtgctgtcagggcactcttcctcacgctgttgttactcatgcaccattcagacttgttagagtagatgtgggtttaggactgccaggtttgcccagtatagtagtttttatcactaaaaagttggacttggagtcctatagtagtttcagcgttagataaagtttttccaccatacatctttaggtgcattcatctttaggtgactgaatgttaagaaatctgtgtgcatagttactaagtttttatgaactgttgtgtcctgttaatgcatattgccctgtgactccagtatatctcacctgtactgaccaaacctaaataaacatttttattacgactcttgtttgttttttccttttgtcttgggtgtgtttagcaattgtcctttcttttcactgaatggctgaattgctacttactctgtagtatatacaaagatcacattaaaacagtctatgcattaagtctgactatccacctaattttaatttgcacttttctttgcagaatgaagtgggagtttgactacagctcaaggactttggttttggtttttttccctcttgacgtaaagatctcattttttaaaaaaactaaccaaattttaggtttttgttgaagagcagtttgttcttcagatctgatttcagggaataggtacaaagatgtttgctttaaagcattggccaaataatgctttttccagaaacagcatccttgcatgtattgtaaggaggtctatgggtctggacatgtgaaacaagtacccttaacagctgtgccatctctttgtcaccactccc

SEQ ID NO: 24409 - DNA, 2209 bp, Mus musculus
gaaatatcccatctctgttttggggggcctgtaggagagtctgtaatcctgttctactgcagttagaaaaaaagttgagttgttcccccctgccccctgagttgttgaatagtgaaatagagaaccaaatagttctcttttctattaaaaattgctattttttgtaagtaatcctctatttagtggacatcacctagtagtctttgtttatggtcacagtttcacagtacaccatttttttcactcaaactctgtaactcaaggctgtgaatggagttcagtggtagagccttgcctgtcttatgcaaggccctgggctctacctcagtaatgaaaaaaggtcaacagacatagctttgctcctgcttgaggagtgcttattatgagaggaaggtaatggtgcctctgggttttctataggcagacatgcaaaaacagctaatcttgtctttacaaaccaacagtgtgctgtatgaatgtgttcaagatggacaaagtaggtagggcctgtccgatgatgtcagccatgggcactaggccacagggcattctgggaagccattcagccccatgaattgtatatctctggagaactggaccctgggtgtggtggcacctttctcagtagcggcaaatgggtttctgagtgaggtcagtagggtgtcttcagaacattagtttttagagacacagatttttcatttttctttagtttcaagaacttacagtcacaagagggcctttgtattgttattcaatagaaggctgccctttccctgacaaggtgacacagtgcttctgactgtgttcctgtgcactgtggagatatctgtcacaggggtccttagtgaatttgccttttcacattcgtctcaccatcttcctgtcatccttaatgtccatgtgatgttttatcggttgctcaatagtcaatagtttgttggtgtttaattgttgtttattaccaaaaaggccgtgggcgcctctcatgcatgcaaatccttgttagtggagtattttttaaaggtttgttttctttttaattatgcatgtctgtgtatgttctgttcattgtgcccatggaagacagaagagcttgttgggtctgggtcccttagagctggagaagttacaggtggccttgagcggggacttggatcatctgtgagagcaataagcacttgcccgctgagccatctttccagcccccggaattttttttttttttttaatattgattgttttcttaaacgtattttgtaatttgtcccaagtttttttttttttttttttttttggctttttgagacagggtttcattgtgtatccctggcagtcctggaactcactttgtagaccaggctggcctcgaactcagaaatccgcctgcctctgcctcccgagtgctgggattaaaggcgtgtgccaccacaccctgctctttttctttttttaaaaaagatttattttattcatatgagtgcaatgtagctgtcttcagccacaccagaagaaggcattggatcccattacagatggttgtgtgccactctgtgtttgctgggaattgaactcaggacctttggaagagcagtcagtgcttttaaccgttgagtcatctctccagcctggaccctcttttttttttttcccctaattgaaaatacttctttttatacaatatattctgatcatgttttcccttctccaactcctctcagatcctccctacctccccacccacccaaatccacaccttttctttctccctcccattagaaaacagttaacaacacacacacacacatgaataggacaaaacagacctttttattattttaaacagagaatctcagtgctcactcgtgtcatcttttcctttcttagagtagattttgataaaaagatagtcatacaagcacaggcagcttttatatgcccaaacctatcgtgtccatttggaattttaatacttggatttctgactggcagcatttagggttcccttgcttttaatctagtggcaagttgtttcataacagtacagcatactgttaattcctgagtgtgtatacgtttctttggctcattgggtccttgttatatttaatgttgtagacagcattactgaactgttttgatggtgtactatttttaaccatttagtgaaataggcttactattaaacattaatttataaggacattac

SEQ ID NO: 24410 - DNA, 2227 bp, Mus musculus
aatagcggttgcagatgctcttaacaaccgaagagcgagagagaattctgttagaggctagaaaaataacccggaagccaacggcggtctacacagctacaaaatgagatgaacatgggattccctttgactcgccccacttggaactgcagcatggctaaaggtagggagagcttaaaaatctatcgccaggctccggtctccaaggtgcctcaagatgggcccactaatttggctaaggtaagaggtaatgcaggggtggatcgaacctctctcaatgttccttgaaaggcttatagaagccttcaggcggttcactcccttagatcttaccttgaaagcccagcaggcctcagtggccatggcctttcataaggcagtcagctcccgatattagaaagaaacttcagagattggaaggtgtattacaagagggagacagtgatgtgatctagtgaaagaggcagagaaagtgtgtgtgtgagagagagagaggcaggaggcaaaagaaagagaaaacaagagggatcatagacaagaaagaaatttgccacagtggtaggagaaaaaaaaaagacaggatctagacaggaaacctgggcaactgaagaccgagcctcagctaaagaggctcagctgtgtcagactaaagtgacttatttgggatacacccttcgaggtggaaagcagtggctaaaagaagccagaaaaagactgtaactcagatccccaccccaactacaccaaggcaagtaagaaaattcttgggcactgctggcttctacagactctagatacctgggttggcgactttagttgcccgttgtaccccctaaccaaagaagaagtgtctgtgtggaccccagatcaccagaaagcctttaagaaaatgaaaaaggccctactgatggccagcctttgcctgacctaaccaagcctttcactctttatgtggaagagagatcaggggtcgccagaggagtccttactcagactttgggactttgaaaaaggccagtggcttacctatccaagaagttacaccctgttgccagcgggtggttttcttgcctgatggatgatgaccaacgctcctgtgacacatcagagctttttgttgtctgaacgagtgaccttcgcttcattccacctgctgtcccactgcgtgagactgcacctactcatcactgcgctgacattctggcagaagaaatgatctgaaggatcagatcagccttggcctgagggcagtagcctctcggttgaaggtaagcagaaggcggggacagcagtatggtggtgaacagaaaacaagtgatctaggccagcagcctccctaaaggtatgttggcccaaaaagctgaacttgtgactttaagacaagctctataaatggcaaaagaaaagtctacactgacagcaggtatgcttttgccactgtacggagcaatatacagacaaagagggctgttggcatctgcagaaaaagacctaagatgctgtggctaaagaaaatcaggtggcagatctaaccgccaaacaggtggcccaaggagcaatgatcctggcagtcaaggagcctaaagattattaagacatcagagagaccagctttaaatacaccgctgagcactatcaagttatggacagtatttgacttggcctgggggccaagaaattcaaaggtgtggttaggtcctttgactactatgttacaggactctctgacttggcagaagaaatagtcaaaagctgcaaggactgtgctatgacgaggtagaatttctaaaagaaaccttcccaaggtaatggacctgcctttgttgcccaggtaaatcagggactggccaagatattggggattggttagaagttacattgtgcatgcaggccccaaagctcaggacaggtagagaaaatgaatagaaccattaagggacccttaccaaattgacagcggagactggcgctatgattagatagctctcctaccctttatgcccttcagggatagaaacaccctggacagtttagactgacccccctataaattactctacagggggcccccctccactggtaaaaatagcctttgtacatggtgctgacatgctgctttcccagcctttgttctctaggctcaaggtgctccagtgagtgagacagcgagcgaaaaagaggctccagaaggcctactcaagagaagaagacctgctacattagacgt

SEQ ID NO: 24411 - DNA, 1171 bp, Mus musculus
actcaggacctctggaagagcagtcagtgctcttaaccgctgagccatctctccagcccacatttcttgttatttgaactacatcccaaatgaactacatccatgcctaacccattttcagactaacaaaagaatatgaacccagatccaaatgtataaacatagagcccagagccaaactcggggaacactgaggagcctgggccctaacctaggagcacgagagggcccaaagccaaaccaaggagaatggatcccagaccccaacctgggatcgtagaagagcctaggtccacacctaggttcatggaggagaccagacccaaatccaggagcataaatcccagacccaagcaagaggctatggagacaaatgggaggccatagcagagccctgatccccgagtcagaacggtcagacagaccctgacacagggcttatgacactcctgctttactccatgcctctgttcacataatagttcctaacaccagtcactccccatccccacaactggcaggcagtcaagctaactgcttctttggatactcctccctaaggaaggttcccaggccgcagcataaagcttacattgaatatacgtgtatgacagcctctttctaggccgtctgttgtagactctgaggcatgagctacttgattaattctagagggcgtttcagcccctccctctcccagggttggggtggccagtgagggccgctcaggaagatgaacttacttggagctcaggcaggaaaagaatatgcctgtggctgccacctctccttggagtcctttccctagggtgggtacaggcctcagagacccgggcctggtttgtgctttgggcaggtgaccatgtttgtttttgtttttgttttccccatacgtgttctggcccttttagtgcagaggacatacaccttttaaaaaggaagctgcctttctgtgaagtggtagtcatggactgattccatgccagcctcttagattccatcagggaaatgcctttaatgggattcaatgtctaaggaatacggtagcttggtttcttcagagtaaatagtactggtcacgtggttctctggtgtcttcagctgcctcctacttggaacctgagaaggaaccaggctggctcaagtcttttccatcttccaaaactatata

SEQ ID NO: 24412 - DNA, 1169 bp, Mus musculus
ggaaatctaaattgtccttcctacctccaggcccctcagatgactgtacacctacatataaaattagtttatagtgcctaggattgaaatagccccaccatggtggcaaatgcctcatgaagtctttggattaagtacttgaggtcttctgttttctagttcacttttaaaatactggtttgttgagtgaaattgatccttggtgtatttgggctctgtttgcttcagatgaaagcttcaaaagtagaactggaggaagcaggtcttgtagttacagggttgaggaagttggaaacgggaagagaagtacaccacagaagagtgtcgtagaagccagccccaggtccacactggatgtatctgcaccactgtggctggtgctttcctagtgacagtcagtgtcagcagcctctgtcagtgacctaagatgaagatgcactcaaagatgtaaaattctttcttcaggtggaacactgaggatatatgcagatagtttaaaaccaaatattccatacaagacaatcctgctgtctactaccgataccgcagactttgctgtagccgaatctttggagaagtatggtctggaaaaagagaatcccaaggactactgtattgcccgggtacgtaactacaaatcgacttctccccaggattgttcataataagacttggcttttaaaggaaagattgttttttaaaattttggtgtgtgttcactcatatttatggcccctatccccttacatacacagaggaatagtaaacaaatgtaataaaaacaaatttatattcttaaaataaaagataaatttaataaaatgtagcccaaagttgttttaccaaagttaacctcattattaaagttttgataggcattcttccaatttttattttgtgcatatattatatgagtcaagaggagtataaccaattttatgtatgtataattacataatatataaataaaatagtctcagcagtgctgcacattggagactgagagaacctggtggctgttaagtctaagatgtaaggatcgcatagatagagggtccagttgtgcagtcctggtgtgaagttgaaggtctgacaactacctggaaagtcactgttgtgatcctctgttgaaagacttgaagaaacttgggtgtgaagtccaggcagtg

SEQ ID NO: 24413 - DNA, 1213 bp, Mus musculus
atagatggatactttaaaatacaaccaccccccaaaaataaaaaaaaaaaacaagaataagtgcatttctagcttcatacataatttgcaatattctagacagttaatacagcttaattttgaaaattgttttgaattttgagttaattcatttgaattaaataaaaatcaggtcagctgacatatttgtatatgtgtgtgtgaatgtttgctgataaggctatccacagtgcaagttcatttatttttaaactaatgtgccatttactagttagtatatgctgttcttgctagctatcttgctttgtttggagtttttcagagcacacagactagactagtttatccttcactgagtaagatatcagttgtgtgagcttttccttgctactccttggcagatgttactaaaatatgtcttcttggttttgtttgggcccatggttgtcatttagtgatcatgcccctggtttgcttggctgataattgccatcgtcactgttccagggattttagtctttcagttgaagaggagaccaccggactacatcccaaagaaaatgaagaaacatgttgaagggaagtcgttgaaggggaaagacagagctgacgggtctggctacggctccgctcttcctcccgagaagctgccctacttagtagagctaagcccaggtgagaacgctgggtagagtaggaatgtgtttttaaccataaatgtttctactttctaatgtattaagtggccattcattgaagaaataaaacattcattaaatggcaattatttttcaaaaagctaaaaaaacccttaaggccatagaattcattaattcatgaacaaaaattaagttcacatgaacaaaaataaatataacacaagttttaaagtaacaagtagtatttaaacattttaaataatcagttccttttaagaaaacttttccaaagtaactttagttaatgtactagaaacaaattgaaattaactcttcctggagtcaacctctgtatgtatgtgagagagaaagggagaggttaccctaactgtttatgacatatgtacagtatttattagatttaactataactttgaaacctattatagtaactagtaggctattttaaaataacacatttattttcatattactcttctaattatatcatagaattcttgcaagctgaagctgttgtcataagttagtcacta

SEQ ID NO: 24414 - DNA, 1172 bp, Mus musculus
aagagggcatcagagtccatagatttggagtttaagcagctgggaaacaaactttggtcttgtggaagaacagtgctgctgcactgcaacaagtgctcttagctgtgaaactgtccttccagccccaggcttgtttcttaaatgactgccttattgtagctttgagatgacttccgaagaactggctgtcagacttaggagtcattttcacttttgctttgcttctttaaaaaacttttaggtaaatttatttgaatagtggttagaaactatgtgtttaagaccacacccctgctttctgtttgaatttggtatttgtaactggtttgacacatttgttaattgttataactacctttgtctgaagttggtatgactcagaggttctgctgtgaccctgtggcccctgacgatttgtcccatatcctgaacagatgatgtgctgcacacactcacaggagccatgtccttgctgcggcgctgcagagtcaatgctgccttgaccatccagctcttctctcagcttttccacttcatcaatatgtggctgttcaacagactggtgactgacccagattcaggcctgtgctcccactactggggtgccattatccgccagcagctggggcatattgaagcgtgggcagagaagcaggggctagagctggcagctgactgtcacttgagcagaattgtacaggtgtggacagtggctgtactccattctccttgcttctccctcttccctgccagtacatgaactttagattgacatgatgagtgacaacttggggtgatagagcctcagtgtttttcccatatgcattcagtcaagcagctactgtggttgtagcctctgggctgctgtaacaagccagctaaaactaaatgtctcagccgaggtttattgtctctctctcctggaaaccagaggttgaaatcaaggtgctggcctctgagggacttgaatataagttggttcttccagcccttggtagtttatacccaacttaggcattctttggccagtctttgccacagacttcatgtggtattcttgggtacatgtctgtccaagtccctggtttgtacaggggcatcagtaaaactggcctccttttaaccaattgtatgcacaaggcccttcctcaatagtactccagcctccagca

SEQ ID NO: 24415 - DNA, 1191 bp, Mus musculus
ggactgtctccaggggcagctctgctcctcatatagaagttgtggggaagtgcgctgggatcttcatgttaatgagcctcagaatggagagctttctttctcgccactccctgcactcccagatatgtgttagtaatatatcttgtaatgtaaatcatccacagacccccccccccgcctgccccccactcagcagttcttctactgattggcttccaagctagatattttacctgtgtttttatttgcttttgttattttctcattcattttccctgtgttattttatgtactataaaaataattattcacaacttcataacaatgtgttaaagagttatacaaatcacctgctttggagaaaagaacatcaggtgctaaaacagtgttttaaagccttctgttctgtctttaagtggtgtgtgtctgacatgcaggcactctgtgaagccagctcctattgctcccctgaggtcacatctgtgaggtggtgcttcccgtcagtgagcatctcttgatgagtccatgtttgtcctctgcaggatctcatagaaaatgttgtggctgttgctgagaacacagctgatgagctcgcccgcagtgatggcagagacgtgcagctggaggaagacccagacctacagctgccttttcttctgccagaagatggctattcctgtgatgttgtcagaaacattccaaatggtttacaagaatttttagaccctctgtgccagagaggtaaatactacttgtcacacttcagttggagctccaactgggttcaagtgggctttgtactgactctctggataacaggcctgcagaattgtgccagctctcctgaggaagctgtgctcctatgactccagaagagtttcactgagattaaagatcttgcatgtccagacatgaccccatgtgggtgtgttgtctcccttgactttgtgcctgctctcttcccacacggtgctgtaacaaagcatctgtaaccacacctttctcctggcatggagagcagtagaggatccctgggttctgagggatccagcccactgccagccactggactgtcatgggcaggtcaccccttaccttagctccttccttataaatcagtgcaagagctcagagaattggacaggttgcctttagggggagggttctgtgtagattctcaggccaccacat

SEQ ID NO: 24416 - DNA, 1235 bp, Mus musculus
ccactcagcatttggcaagctctgcgctgggtcttgtatactacaaaggaaaacaaaacagagaagccttaagttctatatttcctgttgtagacatgatcttttcacctgatactgggctgctagagagtggctgttattcccagttgaaaaagccttacagtgcatttctgtagactctgtctgacttatgtttgatctcctggggtgctgtcttgatgctaaggaccttgcgttctgtcatatgatgctcaaggtcggtcttgcatccttgtccactcttggttcctctgccaggtatcatgtggagaagtagggcatcaagccaagctcagagtcgtagtccagcctgtgttccctgaaacctgatttacaagaacaggcgtattagttcctctctgagattcaaccttgtgaaggtgcatcttgtcaaaactgtacgttttagtgtaagtgagagagggctttgactagggtatagtatgataactgttatgttgtgtggggtggggattgtaggctttgatgataagcttttgttgtcaccatggctggatttagaatcaccaggagacacccagacccctttgtgttgtctgaggatgttttcagagattgaactgagaagggaagacccatgtctgtggccaaattgtcctattgactgggttcctagacttgaacaaggaaggaaagggatggagccagctgagcaccagcatttgtccccctttgcttcttaactgtggattcagtgtgaccaggcccctcttcttctcgctgccacagcttttcaacagtgatgatggacttaaccgcctcaaaccatgagacacgaacaaaaactatcttttaagttgcttttatcattttttgtttgtttttattgttgttgttttgagtttttggcttttctttttatagcaggagaaaagtagctaattcacagggtttctgcactcattttgcaatgaaagatcctagtagcagaggtggcagaggtaatcagtagcagaaatgtaccagacccttgtgagggaatgtgttatctcctgccttgatgagtggcaggtagttccttggtcatggtcagtggtggtagatacttgctgcatggcagtgctcagatgggatgaattgaggggagaaacagagaatctggttctgacttgagccgctgggtcctgaaggcaaaactgtcagaaaaagaacaggcagaagttggtggaggttaa

SEQ ID NO: 24417 - DNA, 1172 bp, Mus musculus
aggataaactgggaatctacgttaagtcggttgtcaaaggaggtgctgcagatgtggtgagtatttgattttttgtttgtttgttttgtttttgttttttttcgagacagggtttctctatgtagccttggctgtcctggaactcactttgtagaccagcttggcctcaaactcagagatccgcctgcctctgcctcccaagtgctggaattaaaggcgtgcgccaccacgcccagcgactatttgttttaaaggaaactgtgaagggcattatgcgctccagctttgtgaaatactgtgcagatgcttatagctgtggatgctgtatggtgaagaatgctgctgttcattgactgtggtgggaagactgatgcgcgctgaccatgtggtgtgaagaatgctggtgtgcactggctgtggtgtgaaaaacactgctgtgtactgactgtggtgtgaagtacacagctgtgcactgactggtgtgaaaaatgctgctgtgcactgatactacctctttttcttttctctctacactttcatctctctggtggctcaggatggacgattagctgctggtgaccaactcctcagtgtggatggacgaagtctggttggactttctcaggaaaggtatgactaattggttagtgttaaagttagtcttagtgtattgaagtgatattttacatttaattttgaaatttgtattcaaaaagtagtgctataaagtcctttatgctctgtgagtacaccttcacctataatcctagttcttagagcacataaatctcattttctgttcactcatatgtgttttagtatagagcatttctttaagtaattctataaatatgtgcacatatacttaaaacttgtgaaatctttaaatatatcttaatggtatagcatagaacatatttaaatgtttttataattaactttcaactgtgatgtgaacaggagattatctttctgaaagccaggctaatttctccaacagcagtcaggctgaggaacaagagttctgaacacagactgtcatctgacactgagcgctcagtttctttatacttatattttcttcctagggcagcagaactcatgacaagaaccagttccgtggttacactggaagttgcaaagcaaggtgccatctatcacggcctggccac

SEQ ID NO: 24418 - DNA, 2394 bp, Mus musculus
tgcaacaatgagtaagtctcactgagacggtacagtttttctgaaagtttacttagttacttgtattttgatgcactatctttgtgtttcctcttgccagccaagacgcagacttacctggcagttctggagcccctgaaaatctgacatttaaagagcgtcagcgccttttttcacaagggcaggatgtgtctgacaaagtgaaagcttctcgtaaattaacagagctcgagaatgaactgaacacaaagtgagaagagagaggtctgcccttggcgggagctttgtgggggcgagcctgaagaggaaggaacagtgctacttctaagtgatgtttattttctgtacctgaaatggttgcaatttagagatgttccaattccaagaaacttcgttttactttaccaagaaaaatcctgtctagttctttgtgatctgactcacatgaagttacctgtttctgttagcttttggggagactcttggactcatagggcagaatgaagggctgtaaagatgagggggtatttcttctaccctatcttctttcattgtcattccaagggcagtaggccaagaaattatctttctggtttttttcctctaaactccatttggttagcagacagtgacagctgagcaggtctgagcactactgtgtcatagtggaccctgactgcaggagtcaggcctctcagcccagggcagatgctgcctttatcttctatcatttgtatgacgtggctggatggagtttcttttgtaaggtgcacaacacattcttgacaaatgtgagtctcctgatcaatttaaatgtttgagattgaatatctaattaataattcaattttgaaaattctcaaaaaaatttgaggatttaagcctagggattttatttttataaataccaaatcatcattagactaatcactggtggaaattaaatatggcagttatgttaggtttcctaatatttcaaaggttccaaaggatctagagctctctagttacatagcattcatataggaatgagcagagacatctgagaagagtgggagctcatgggtgacagtaaaacttaggtgtctcagaacttaacatttagtaaagtgatgtagatccaatgtcaggaaaggaaggactgtgttactgtgcctcctctgactcatgtgcttttcagcataatagacttatttaatattaattcctaaactttgcactgtcaatcctctgctgagttgtgggaggcagacctcagtttgcttgttttttgtgaaagctaactttatgatttcaagcacactttctacatgagaaacccctaatgtgtgtccatatgatctttctgtacattctattctcttacaaatctgtgcatcaggaaaatatgcatactttcaaatagaacagaggtatttgcaacctgaaaaaccacttttaataagagctgtatgataaattgttgaaatgcaagtgtaaatattttttatgttaatccagtttcctattagaaagtgtgtctttgctatttcctctgtaagagaatagaatggccttgagagtttatgaaggatttgcacactcgtcttgcctaggaagtgcaatctccttgtgactggagcacactggcagccttcaggtgtcataatcatacatcccagagaagagcagtcacctgctgtcactagtgcatgggaagacagatgcacagaagagccaggtagcacctgaaaacgctgcacgtgtgtttgtgaaacctgtagtgaagtagacttggccgtccctggacagtgaggtcagatgtgaatacatattgtaagagcacgttgaatagtgtgcattactgtggggaaacaccgaaactgctgttgtttttcatttctactgtattttagttgcagcctatttttaataaactttgtatctatttaagtgtatttgctattgttttcaaagtgctgacaaagtttatatttgtaatgccagcattcctcttccccatttccagctgtcactccttcattaaactgctgagtcattccttcctttgtcccttggttgtttttctgtctgtgggaaagtgttctttaatgacacaaccagctgaagactagggtggcattttcacaagagtcccttgtgagagctcggtcacctctatctacatgtctaccccttatgccttcagcatcccaaaggagcactgggaccatgtctcctttcactaccccatctggtccctggactccctgaacacactcacggataagctcattgcctaaacagtctcctggtcatacacagtcaagattgctggaatgaaggtatgttttattgtcatggcacaaggtaccctgaccagctggaactggtcagtgggctggtgtgcctccc

SEQ ID NO: 24419 - DNA, 1233 bp, Mus musculus
agccatacagttttgttacctcagtttactccccaagcaggaaaagcagcaagcacaatattttagagattaaaattcctataaaaaggagtctgctcaataaaatgtttaaatgcattttggttagtcaggtgagtaagaagattacagtaacaggctgtataaatcagattaaactttactgctggtgcagaagttgatgactgtagaatttatagacatttaaatgaagtacagcacttcgagttttaaagtctttaacattttaaagccaggtggaaaatgcagtgacaggttcgctcttcccagagcctctgcacagtaggggtatggtacctgatacccaagcaagctctcctggcagcaagtattgacaaactgttgctgtgctggtgatttagagtccaaatcctgttgtaccagatcttgggccatttgccctttcctctgcttagccagattggagctttctggttattaggtaactatgatactacctaatcaggtcaagacagagtcataacaagtggtaactttgttatattcaagaagaaatacttcaaattaagttgctactacctctttctgctgatctctggaaaaaacaacactatgaaattaaagcctggggaaatgagccatttctctgactttgtttcaagggtagaagttgctaataaagaaataaatcaacttgatgtttaaggtcatcgttaatttcaaaaaagtttttattggcataaaaatgaaagtgttgtaaataaattggcaccaaatatcccaaacatgagggtcaaagcctattttacccctctttgctgtttttcccccttctgcccactttcctgggtgttgggggagctcgctgacaacagtcacaaatccagcgacctaggagaaaaattgttagttaatatagagtggaattttatttttataggactgagtacaaaccatctaatctcattcctgagctatctgtagtgataactccctgggatttttcagtgggagggagtacagactggttccttaagccaaggaagagaatgtaaacaacccttaatcagtgtaaccaatgcagtgtgaacgttagtgcatggccaaacggcattgtaaaaatcatttgtaccttaaacaaaactactgttacccttctgaaaattcaaataccatcatgcttttgaaagctcaacaacacaattcctaatgtagaacatgttaaagaagctg

SEQ ID NO: 24420 - DNA, 1148 bp, Mus musculus
ggcctactatagaggtggcctactatagaggtggcctactatagaggtggcctactatagaggcatctgtgtgtcaccaggttcttaaggggcagagtaagttctaagactataggtgtgtaacatcatacctacttgaagataagcttgaaaagaaaatcactttacagccaatgtttttgaatataaactgttgctctgtgacctcaggaatggagttagcatctaagctgagcttgcattgtaggaagccattcttaatgagctgccctaatgtagttaagtgcttaactttgggttgttctaggttttagtttttttaatgtttatttcttgaatttgtaagatttgtgtgtgtgtgtgtgtgtgtgtgtgtgtggttacttaagaacacttagaatattcaacaacaaatgtgcttaaaatagtttttttaaggctttagaagttctaagatgtacagtttcagtttttaatagttcttttgttctgcttttggagatttagagcgacgagatttatctcacaaggagaaactatacctgagagaattaaacgtcatcacggaaacacagtgcacactgggtaatcagcacctgttgtgtcttttaagctgaacacttgtaggtggtaggcaattagatcagtgatccatctcctaaaatattttacaaaattaatagattatttaaataataacttgtttacttcattttaattgttaaaatgtaaaaggcatgattaaattttttatactacaatataattttctaatgataactttaacagagttgtcaggtgttttgggtgtagaatttttatctaagcatagatctttatcgtttgtagtactggggactgaacccatagattctttggcaaatcttgtcaaacttttagctccttatagcatatgctttcttgataatttatttttggtgagtgtgtcaatgccaacaggctcttcccagcagtagggaaagatgttgtgaaagttacatggcgtgtgtagactggcgaatgttttgagatgtgactcgatactatttctgatatatagatttggagactaagaaagatatactgagaaataatttttacatatcctgtgttaattattagtggttagtatatatcattcataacta

SEQ ID NO: 24421 - DNA, 1266 bp, Mus musculus
agaacaatttccctgatcatgacttctattgtcatttattttgtggttttaacatttaaatatttcgtgcatttagatttcttttgaaacatgctatacggtattgtagggtggtagatgtggttgtagctctttttcctctccaaaagctgatcacagtcttccttcctaagcttcctgcatggacggtcactggtatctgctgcttcacctaatttggaagttcatcatacttatttttatgaacagctgcatagttgccaaatgccacattctacatagtaatttttcaatgataatttgagttgtaacttaatatcctaatctctcacatcttttggtgttcatcatagttttatgctttctcttaccctttgccttactttatatctttcttttatctactgcaacaaagatttaactattaaaccattataacttaaaaattgacagagcttcaacctcccctctctggactctggatttttctgtctcttcctgaagtttggaaccaaattcccagcagtgaaagcatatgtaaaaacataatgatcataagagccctcaactagtatattttttcaagtgtattagtctatagactgtgccagggagaaagacctcttacaatgtccactccatctgtccaaagctgccattgttcttgtgctgacttaaatactcacgtgtggaaatttttgggtgtctgaatttcatttcataaaagctttcactttgacgttaggcttattactagagatgtcttttctttatggctgtgtggggcattcctttacatcttcaaagctgttcattcctatgtccatttcatatgcagctctggcaatcattagattttctaatttgtgtgtttttacttgattttgttttttaggggtgggatattgctgagatagacgtaattgctatcatatcataggattatttattttttaatgctggatttcattactatttaagattctatgagtctaatactactttttatttttggacccattaaaaggtagaattacctctaaccagtttttgaaataattttttaaagttcttgaatgtgatcttgacatctttatctattctcattactatgcatcatacaaaacccagtaagaatatatattatttcctaaggtacctataaccctgttgagttcctctcaatttcatttgacaaaatattgaccataactaattacacattaattactaattaattatgataaagcttacattcttccctgc

SEQ ID NO: 24422 - DNA, 1173 bp, Mus musculus
aaccatgcatgctatttgcacagtaaaaagtacgtcagtaatttccttgtgagtgaaccgtggatgggtggaaagactcactttgacatgttcagatttgactgacaacaccagtgcagagttcagagtgagccaccagctgcgcgtgggacagcaggggaggcagggctccagggccacatttctgggtttggctgcttttcatgcctccacttgcttagtgagcctttgatacaactttaaatggaaggcaacatgatttttccccccctgttgatggttttcctggcgctccagctgtagttaaatggatgtagcagaagatctgacagatggaaatgctacttcatacgaatgactgtttattattcataaagttacatttccagtaattaaccgtctttgtgtctctcaagaagggactgtcaccaagtcggagccacttttcctttaacggaagggtggctaagggagatcttgggcttaaccgaggcttacctctgttttttccccctgctctcagcttttcctgggctccagcacggagttcagtccactgactgttcactgaacttcaactttcctgcaagtttcaacaggtctgggctcccaggatcaatttgttgactgccctgaaatctatctccacagaggggtccatgaccttcagaaggtgcttgggaccaaggttgctaccagctagagtgtgttccccctggagcacaccaaataacggtatcggggtccatggcctttggcacggaggccttgccagccacagctgcctgtgacggtcaccccttcttcctgggccctggtctggctttgaaatgacctcattaagaagacactgtgaccatgtttcttctgtctaaaacactgtggttccaggaaacgggtagcccaagtctgaactgctctacctgggtctgttccactttagacaccttctgtgctaactccacctgagtctcccttctttctggaaccttcttatacttttccttctaggacccaaaagctctccagggcacctgtgacacacccctgttcttgcctctgtacactggcttccctccctccacactcacctctagccaagatctttcccttcctcttggtcctctccagaccctggaacggtgcctgacacagcaccacttttgaatgttt

SEQ ID NO: 24423 - DNA, 1155 bp, Mus musculus
atggggctacatggggctcatgtctccaagctccacagtggctcatatgtctgttgagttgggttctgcagaagggctgaactttctctgagtccaaagaatagtcctttggtctttctcaggctgaccaatatcaagaggagcaaactcatgaaaacaccaggcagagagtcatatactacatgcctactcccacccccagtggattcatacatagagatctggaaggggacatggcctctcagagtgtagaccaggagaaaccacaaggatcacccttcaagaggttcatcatgtccctcttgacacctcatgtcctttcagtgactgagaactccctggtggctccgaggctcagtgtctgccatgaactaaatgttggagatagtcccaggttctcggctcaccagttctgggataggagcctgcaggctagggatggaacacttaagttcccaaccactcccagctggctcgggtaagctggcacgttagtggaacatttcatatatagagaagcaccttgacttaattaggcaaagaggaattagccaatggggtaaactctgagattctgttgcctttgaggacacggctctagctgaggctgacgtaggcttagatgagatactgtctgtttacaaacacaaagcctggccaactccctaaattctaagatgttccagatgcccggaagactcattgtcgctggtcagatgctcagccaacccaggccagccacccttctcaggctttggaacttccctcctcaacaattttcctcaagtagggattaggggcaggacacttttgggaagccctgggaactccccagtggaattctgctcttgaattccaagaaagttcatcatggaaccaccaattcctgaacctcactaagtggacacatcaccttcctgattcagcagtgcattctggctgaatgctctatagcttggggaccacatagctctgcacctggtgggttgtcctctccaggccaaccagtacctgtttaaggattcaaaagtcacaaacctccatgggaaatctgggaagctgaacccctggagacacttatggggtctctgacatctgagaatgtgggcatggttcagtgacccagcttgacaagtgaaggtgaataggaagagc

SEQ ID NO: 24424 - DNA, 1189 bp, Mus musculus
gaccaaaagcaacttggggaagaaactcagttcatttcagtttaagagcttgtactctgtaatggagggaagttgaggcaggaactgaagcagagaccctgaaggaatgctgcttactagcttgtaataactggctcaaactgcttccttactcacctgcccacagtgggctggggcctcctacatcaagcattaatctggaaaacatcccacagacttgcctgcaggccagtcttgtggagacatgttctcagctcctagataaccctgcctaaatttttctgatggagctgcctaggccccttcttcctccttgttaaattttttacattatctgtatctgcctccatgtgtttgtgcttttgagaaattgggagcattgccccatttctgttgtatttaagctgggactagaatatccttaaactggaagacatcctgatgtgacttgatacatccaattcaaatcctgggacatggggatgttgtatgctgtgggaggttggggccttaggtcttggggacacgtgatgctccatgtgagtttctgtctctccaggttggcttcaaaaatatgcagaatgtagagcacgtccccctgacgctggacagagccatgaggctggtgaaagatgtcttcatttctgcagccgagagggatgtgtatactggagatgctctcaggatctgcatcgtgaccaaagagggcatcagggaggaaactgttcccctgcggaaagactgacatgcgggtcatatattggagctgtggcacaagtttgttttattaaaaagaatgtaaagtactcattttcttacactgtgtcttctctaagcatggcaaattgggaagaatttcttccttaggggtcggagagacaactctcagtttaaaaagtatggctcttgcagaggacctaagtttgattcctagcacccacctgtaactccagttccaggggctacagtgtcctcttctggcctcgacaggcacatgcaaatacccacatacaaatgtatgtaatgaaaaataaaaccactaatataatttctttttctttatctggatatatttatttattttgagatttacttttcatcatgtgtgtgtttccgtgagcatgtgccacgtgcatgcatatttatgtgaacagggtatgcaggtgcccagggaagccagaagcaggcg

SEQ ID NO: 24425 - DNA, 1099 bp, Mus musculus
aatctgcctgcctctgcctcccgagtgcttggattaaaggcgtgcgccaccactgcccagccttttcttttcttttcttttcttttcttttcttttcttttcttttcttttcttttcctttcctttcctttcctttcctttcctttcctttcttttcttttcttttcttcttttttctttctttctttcttctttccttccttccttccttccttccttccttccttccttctttctttctttctccccccctctctctttttctttctttcttcttttttgttgttgttagcacagttgtttttaaaagacctcttctaggggccggagggatggcttagtacttgctactctttcagagactgcaggggttaagttcccaggacccatatggcttctcacaaaggtctgtaacttaagttccaagggaaccccgccctcctctggcctcactatgcacatcatatacctacaggcaggcaggcgggcaggcaaaacactcagacacagttgttaaagactgtctaaaattgtagtgatgtgttctttgataaaaattccaggtctatatacgcatatggtactgtcttagttagggttttactgctgtgaacagacaccatgaccaaggcaagtcttataaaaacattatttaattggggctggctcacaggttcagaggttcagtccatcatcatcaaggtgggagcatggcattatccaggcaggcatggtacaggcagagctgagatttctacatcttcatccaaaggctgctagtggaagactgacttccaggcaactagggtgaggatcttaagcccacacccacagtgacacaactactccaaccaggtcacatctattccaacaaggccacacctctaaatggtgccactccctggcccaagaatatacaaaccatcacttgtaccttccagtttttctcaatagtagaaattttaaaagttctgttttaaagtcagttccttggatggggtgtgtttgccctggtgcagatatgaaagtcagaggacaaccttccaaagctggttctggcctgtcacaaggtaggttctggggatcaagttcaagtcaa

SEQ ID NO: 24426 - DNA, 1185 bp, Mus musculus
ggcgccgcttatattttagttgggtcttcgctcctcaattaaaccttgaaacacccgcatagacgcatccatgggttttacctacatgatgctaagttctgtgaaattaacaatattaaccatcatattctggctaaagaaatctggtattgcttcctgggtctcgtggctgcgtacaccacacagttgacatgcgtcctgattggccttgaatgcagcatgaactactaacccgtctcaaacgctgtgccacttcgccaatgtgacatccgagttgtcgttgctctgtaattgggttaatttttttggtatggtcagacttttaattttctatccgccatgagtaaatccaaacgttttcttagggttataaaacaggtttctctgttggcaggattggcggatccaggttgtgcgctagccggacgcaggcgtagacctccaagagcaacgacgagtgcaggctagaggagcctaggggggcggggcgagggaggcggaagtggaccggtcccggcggccattttgccgtgagacagcaggagttaggcgcgatgctttccactgctgcttaccgagacgtggaacgagagctgggaatggggcctcacggctccgccggccctgtgcagctgcggttttcgccttatgccttcaacggagggtaaaagcctgggcctgctgccctcacctgggtcgagcctggggtcgcgacgggcgggtgtgggaatggcagggatgtagcctgcagcccagcactcagttgtgcatggacgccctcggtgccgtttgctccagcaaccgggctcccacctcaatcttccgccctatggcctgttgtttggtagggcttgaacacgtttctaaagccaacgggcgaacatgaagttatgatttgtcttggttgttagacgagtagctgtttctgtcgctgggccgcctgatcacttgttgttttaagaggaaactaacatgattaaccagacttaatttcagggatgaaagtgaaggttgttttgttctgctcttgagacgtagcctgctgggcaaggtctactgagctgcatccacagccttaggcagtcggacccttgtgtgtgtttatttttactctcaaattactttagcattttaattatccgctttattcgaagatatttttcctttgtatttaggaccgttgac

SEQ ID NO: 24427 - DNA, 1109 bp, Mus musculus
taaaattagagtccagatttgttattttgaatatttgtgtattttattagtttgctttctgtggtaaacactgaccaggagcaaatgggaaagaaagggcctctatttcatcatcctttcctgtcctgaaaggaagtcagggcagggacctggcgccagggactgaatcaggctatggacggccactgctcttcaggctgacaggggctttttgtttgtttgtttggttggtttttcaagacggggtttctctgtgtagccctggctgtcctggaactcactctgtagaccaggctggccttgaactcagaaatccgcccgcctctgccttccaagtgcagggattaaaggcgtgagccaccaccgcccggctcaggctcacactttacctgcctttcttataccttccaggacctgcccatggtgacaccacatgagtgggctgggcccttacaccccagtcatcactcaagatgatgcccacagacttgtctctaggccatctgatggagtggctttctcattgagggctgttctccccaactgaatctcactcgtgttaactgggcgcgcacgcactcattcacatgctttcctggcctgagttattcccacttggagtgtgttattggaatttattaattttcagtgcatatataatatagtactatgtattctatagtgaggtagtctactctgtcagtacacatatttgtgtatatatttgtgtattctagtgtcaacacacatataaaagaaattttactttttaagagataactggcatgcataccactttttttggtaatattcttttttatgtgtcttagttaggttttggttgctgtgataaaaacaccaagaccaaagcaatttacagaaggaaggatttatttggggcttaacattcctgagggataaagagtccatcactattacagtggggaagtgggacagcaggctggcatggctcctggagctgagaactcaaaccatgaactggaagcagagaggtaaattgggaatagcccagttttcaaatgttaaagctggctccagtgatacttcctccagccaggacatacttcctccgcccacccaaagagtac

SEQ ID NO: 24428 - DNA, 1099 bp, Mus musculus
ctgtggtttttttaagagttggtgctggtttgcttttattagcttttaggtttattatatgttaaatttgatatgtcagtagtatttcaacatattacagttaatttacttcaatataaatcagccctttatcattagaatttgttgtgtgacttgtacttgttaagagaaaacattactgccacatctcaacccttcctgtttttatctgaagtgaagtattatgctgaattttatgtttgttattgctacatggctttatgtgttgaaatcttgtttattgatcctcatgaagatttacatattagttactgttgttgtttacatgttttgagggtggcgcccagagcgttgtgctttttcatgtgcactacttgagccacagaccggcactacttaatttttaatgttgccattcattttaatagtatcactaataaaacacttcaagttcataaagtcagttgtaaaatgacttggagtcatgttggtcacagcttagatctgaaattttgtatatttaaaattccttgcaggatttctgctttttgctttctacccgagctgggggtttaggcattaacctagcctctgctgacaccgttgttatattcgattctgattggaatccacaaaatgatcttcaggctcaggcaagagctcaccgaattggacagaagaaacaggtattttaatttgttattggacttgtattatatttttctaaatatagtataaaaactgcaatctcaagcttgactgggataatggagactcccgaggcccagccatgccgtctttgtcgagcagctggactccacaatggacagaaccaagagaccctactatcagggtctgcactcagtttagattgtaactagagtgagtgtcaccttttcagtatagaaacttcatttgttggcattctttatcaacgtttgatagttcaagttcacagttctctgcacacaggagccagccccatctgaccggtctttgtactactaactgctgctgtttgaacaaaacaagggcaggtgttcctttggccagtgacacaggaagttaaagctttgttcacagtggggcttctcttagc

SEQ ID NO: 24429 - DNA, 1052 bp, Mus musculus
agggatcagttgaagaagatattcttgaaagggccaaaaagaaaatggttttggatcatcttgttattcaaagaatggataccactgggaagacagtgctgcacacaggctcggctccgtcaaggtgggtactgctctgtaagagaaatgctgtgggggaggggccaccccaaacccaggtaaataaattgcactgtgctgtagtgtggttaattttatacttttaaagacgttagactgatttgtgttagaggcatacacacaggtaccttgcttgactgttacagatagatcgcacagaggaattctaatttccatgtttcgtagttttaaaataactagattaaaacttcacccacatgactccctcatcacttataaagcaactatactgaatatgctctgcaaatattactataaagattgaatttgtgttttacatgtttccagttccacccccttcaataaagaggagttatccgccattttaaaattcggtgctgaggagctctttaaggagcctgaaggagaggagcaggagccacaggtcagcagcgtccatctcccatcggactccgtgttgtctggtagagcagggggagtgcacgtgtacttaaaataaccacacccttttaatacaggaaatggatatcgatgaaatcctgaagagagccgagactcacgagaacgagccaggcccactgagtgtgggggatgagctgctttctcagtttaaggtaggcctcttcctccttccttcttcacaactgcacactgctgagggttgagctagtgtttccatatctttctttaaaaggaagtaacaagatagttttcatgttaaagtattctgtattgtacaaaagtttgtgctcagtcaaaccatcagcacctcggatgaccagattggttatgggtaattacattcattatgtgcagtgggttcctaatttacagccaggatgactcttaaaacaacagcatgctctgcatattaagggcaatacatgcatgagtgtgaactttattcacatttccatgactcagctgct

SEQ ID NO: 24430 - DNA, 1105 bp, Mus musculus
ataactggaagaaaggtgtaacatctcatgcttgcacattatttattgttacaccacttgtatattaaaattattttccctaactgtagttcaggatgaccctttgaacaataaaagtacatgttagcacagttcatgttacagctacattcccaggcattactaattttgcaggtgattaatttagctatttttcttgttcaacattgaggtgattgtgtttttgaaagtagtcattcattcctggggctgggatggaactcagcagtagagctcagactttacctgtgtaagatcctgggtgcatcctcagcaccgctaagaaggcctctggtctaggcaagtagaagtggaaggcagcctggccaggaggctgagcccgcctcttcccagagcacccagagtgcgcaggtctccaagggagagaagagcttagctgggcagtggcttcacctgtaaagtttgataaaagcttgtgcatttttatgttttagaagtttgtttctttcaagttatttttaactcttttcctttaaatcatagacctgacaaagcccttcctcattgttcctacaagaaaactaagtgcattgttagtttttattaagggaacctttatggccatctgatttgctggactttctgtctttagttgaagaagcatttcatcttctactttctggatattttccctcatccatcaaccacttaagttgctttgttgtgatgtaaatttttgtttactgttgttggtataatagtcatccgaattaaacccttcaagtaaatcttggccagcttaggatgcgatgaggtgtgatggttggtaatcattttggagacaattcctcttgtggtagctttgaacattttttttgtcttataaaaataataaagtaatttctaaaataaaaattagcttctattgttttatttatattgatatcttagcttcttgggtgattcagtgttatgtttgctgtaacttaatgccctaacaatttatagcttagtttcttcttttcttaactcagggaacaataccttagattaagttttttgtttgtttgatttggctttgttattttgacatagggtctcatgt

SEQ ID NO: 24431 - DNA, 1178 bp, Mus musculus
tgaagtaattgaatttaaataatctcatgattttgctttatttctgaaatatattttgttattaagacaggtatcaattatttgcataaaacttttccgttattaaagtaaacaaaaaggaaacttaaatttcttataacaccgttcttagaaatctataatcttaagtaatgtctcgttggttagaactcttgatcctcctgacatggactcactgtgccctagcaaatcagatattttcagaaaatatcaactaatgttacaaaattgggtgactttattttgttgcctgcctgcctcccttcttccctcttcccctctttctctctttctctccttctctcgttctctcgttcttttgctcttgcataaaatgtaaaccttggaagcatttctttgtgtgatcttttccctgctttttttttgtgtgtgtgtgtttggatgggcagctggtcatgtttgtggaggccagaagacagcactgggtatcattcttaggaagtctgtctatctctttcaagatacagctttttattgtttgagaaatttaccattagatgagactgactggccggatagtccccgtatcctcctgcctcctctgtagtgttcatgggacacttatagcatgaaaggtcttgttgccttggtgtgtgtgtgtgttttgaggctatgtgcatccctgtgtattttgacatgtctcactaacttgttcacccaggttggtttaggcttgtgatttctagtgttggttgtactacttagtacttgggagacaagaggattggcacaagtttgaggccagccaggggtaaacataagcagggagactggatctcagtaaagaagagaaaaatggcccggcagtgggggcacgtgggaggcagacgcagggggatttctgagttggaggccagactagtctacagaaggattccaggacagccaggcaacagtgaataagcaagcaacaagaaaaagaaacagaaaaaaacagaagagaagaatgagtttgcttccaaggaaattaaagctgtttaatggcatctgatgttctcttctggtattcatgaggactgtgtactcatacacacacacacatgcatgtatgtgtatatatgcactcatacacataaaacactatctttaaataaaactattttgtgactgcacatagt

SEQ ID NO: 24432 - DNA, 1537 bp, Mus musculus
gctgtaaattattgtaaatggattaaatgagctgccctgccctgcccttctcaggcttcttttgactgttcctttccctaccaactcaggccttcttattaaaaaaaaaaatcagtgtaataacactttttaatgatttgtcttgatggaatcattgtttagaatgtaaaaatggggaaaggggccacttatttcttttagtcctttttatattgagtatttttattagatacatgttttgcccctcctttttaaagtcaatattgtgtttgtagttttacagaagcagtggcgagggttacatgtgagacaaactcggtgctctgggagagtccccagtgcattgggttgaaagggtggtaggtgtatgaacacttaaaatccaaacggccaaacgttcttgtaaatgcattgcttttccctttcatgtgggcaataatgtcaaacgtgctatgcagccaggttaacatttgaggtaaacttgattggctttaatataaaaactgttacagtacacactgattgtatataaaaaccttatatatgacaaattaaattttaagaaaaaggatatgtgggctcctgtagttttctgctgcattcttgtttccacgagcatttaatctttgctttaagtaacagctgccagaaagaaaggtattttggtcagcaactgagaactgttgatatgtaatcctaaaactgcctacgtctgtatagatgaatcagtcttctatgaagtaaaacagattctagcagtctcggcttcctgtagacattcctctaggatgtcttactcgtcacctcgtttctccttatattcagtgggaattttggatgtatgttgtgtaaccattaataacctttactcctggtcatgtctccatggagtagctgtggggctacctaaagttagtctgtggctttgtattttcatatctttttttttacatggataaatataaaatttatgctgtgtatacaaacaaactttttttttttaaaaggaatttcatctttggcctaaagttatcctgaagcaaacaatgtctttttatttttgatatgcaaggtaatgtgttggggaataactcaacttttaaacgtctagttataattaaagataaaaacgatgatacgattcagtgctggcacacgacttttaaaatttttcattttcctccacgtttaatgtaaatgatcattttattcccaaagaacacttcccataaatcctaatattaacacagcaaatagctcagggttggcgctacatgcctttgtggctaggtcatttgcttaaaagcctgttgtaaagaatttgtagaaaaataatgcaattttgaagaatgggctttttttttttttttaacaatttgccatttaattgagttaactagctgagttgaatgaagcattcttaaacctgtatgtaacatttgagtgttaattatatgtaaaaagtaacaactacatagtaaaggagcaagccatacagttactaagatgcacggacagcgtcagtccttagggataa

SEQ ID NO: 24433 - DNA, 1232 bp, Mus musculus
caaggaagggaaaatgttggatactttgaaccactatttctgtgcaaatataaaagtaaaaacaatagacgtttctacaaggtctgcctttagagtgtgtgattgctacaccttttatccttttgaggagaacaaagccaccgtgtccacccaatagtttggaaaagaaagtttccttatttagctgtattgtttagctggagagggtgccctgagatgtcctacagcagtggcgttagtaataatgtgttagtgttctccttcagaattggtgtccctgtgtgtcctttacagttcccacagataacttttagaaatcaagtacttttgtagagaagggccaggttttctttggggtttctaaggaacataaattgcttgaacttgtcctatgaagtccaaagccagaagaatttcagaccatactgccaagcaaataggctatagcttttcacgggtctcctgggagagcttaaaacttggggcaaaaccctgattttcacagatcttcccatgtctctctttggaaatactcaaaaccacattgccccctctgctgtgcttgacccccccccccattgtgtcgaatctttgcagagaaacctgtagatgtggttcataggtatattgagtaagtttctgtgtaaaaacagtgagtgtgtagtatgtaaatacgttaaattattatgctagaaaaataaaggttccagaccatgctgcccgatgtttgttctctgcttatagtgacacctactggacgagccgaggaacctctgcagaagaaaaaaaggaagggaattcacaaaaccctaatcgtttttgatgggatgtactgcctgctcccctagctcactcttaagcaatctcaaataaagcagtgtccgactggtcctaagatctgtctttaaacgagtacctttgccccttgaggacactgcactccaggtcttgtgaagaccaactggaaatcggcaacttaaccataccgaaaatatgtgggaggtaggattggttttcttgtctttgaagacttgcaaaccctcatttcttgggtgttttaaaaggagatgtcctgtgactataagttatctgtgttgaagaaatagagggtagaataattgggagaagaaacaggctcaggaaagcgccacctggtgccaggcgggatgctgagtggagtaagcccgggcagagggacccagagttcttgagtagagagcttgctgtgtgtt

SEQ ID NO: 24434 - DNA, 1490 bp, Mus musculus
atgcctgcctggatgctgccatgctcccaccttgatgataatggactgaacctctgaacctggaagtctcgtgagcagctggccgctggtgccctctattgtgaaggaggagagcagcgaggaggagattgccatagctgctacttctgctaaagaactcggacatgagcctgtccctgctgatctgggagaagtgcgcaccccagagcccccagaatctctcaagcgtgaataccaggagttctcctccccggaaacgagcctgccctacaagtgggtggtagaggcggcaaacctcctcatcccggctgtggggtccagcctctctgaagctctggacttgattgagtcgtttctgaacttctggaacaaacacgataccctggagctggagagcccctcactgacatccactccagtgtgtagccaaaaggtggtcgtcaccacgcccctgcacagggataagacacccctgcaccagaagtatccatcatcagaagtactcccagatcagaagtactccatggacaacactccccacacgccaaccccgttcaagaatgccctggagaagtacggaccgctgaagcccctgccgcagactccgcacctggaggaggacttgaaggaggtgctccgttctgaggccggcatggagctcatcattgaggatgacatgaggcccgagaagcagaagagaaagcctgggctgcggcgaagccctatcaagaaggtccgcaagtctctggctctcgacattatggatgaagatgggaagctgatgtcctctatcatgcccaaacccctgtccttgccaaccagtgtcacacccagctcctgtggcttcacctcgccaggtagcaaagagggtaacagcctgctcaaccagggtttcctacaggccaaacccgagaaggtggtggccgcccagaagactcggagccacattccaacccctgcccctatgacccatgcctggaagacggtggcctgtgggggcaccaaagaccagctcttcatgcaggagaaagcccggcagctcctgagccgcctgaagtccagccacacatctcggaccctcattctgtcctgagggacttgaatggcaagagccggctctcatgtttacaggggtagggtgtggggtaaggttaaagtcacattaagtgaccagcttcaggatgtcttctgccagcccctcaaactacttaggtggcagaagtcatgtggtaataccccttccctgagtctagctttgggaagttcctggtgctaatagaacaaggtcccactcctgggcctgcctgtcctctacccaatgctagaaggaaccctatcagggtctcccaggctctcatccagtctggcctcatctcagactcctgcttaggatgggggtgtggctaggggtgcgcctttcctcgtctcctgttggtacactgtccccacaataaaatgccattctccctctgccaaaaaaaaaaaaaaaa

SEQ ID NO: 24435 - DNA, 1207 bp, Mus musculus
aatgtcctctattatcatcatgagaagtgattttaaacctaaaccttgcttttccagtgtgatggggtatccaggacttgctatgctgggggagctgggtgcagatgatgccagatagccttagtttctgtggcttatgttcttgttcttgcctctctccatctgattatctctattgctacttgcactcactgtctctgactggagcctgtctctcctgttttgtagttgtgtcagaactcagagtccagctctgtctgtgatcctgagatcctgggtgtaagagctcctgggagtcaagatgcctttgggatcctgaaatcctggtgtgaccaagttttgccatcctgtgattctattatcctataatcctgggtgtgttagagcacctgggagtgcagcttcctctaggtgttgtgggattgggtgcacagctagcagccaggtctgctcagggactggctcagactaaaaaaagacttaatgtattatatagtgaatgtatcatcaatactctgtaacattaaagatgattttttgattgtttgtttttattttttcattttttggttttttgatacacagttttgtgtgtgtgtgtgtaccctagctgtcctggaacgcactctgaagaccagcttgcctggaagtcagaaatctgcctgcctctgcctcccaagtgctggaattaaaggcttgcaccaccactgcctggccataaagatgtatttttcatttgaacattaattcaacattaggttttcttaaagggaagcaagaatattttagaatttagtgagcagttacctttgtaattccactattccaactattgaaaaataacacaagaaaatgacatgagtaagttttatgttatatgttttgtgtgtgtgtgtgtgtgtgtgtgtgtgtgtgtgtgtgtgtgtgtgagtgtgtgtgtgtgtgtgtatttctcactttgaggtgggcaaaactttgatttcctgcattaagttaggacctaggaatgtgcttgtcatgaactcctgcataatgttcatcttgtacccaaacagaatgagaactgtatctgtcaaaataatgcttcccttgtctccattttatgctttgtttattgttgtttcccttcttccatgaattttcacttaggaaatgttggactcatttaattggaactagattcttctctcatacagtgtaccaaggc

SEQ ID NO: 24436 - DNA, 1099 bp, Mus musculus
atggtttttgtcctgggagctggaagtatcctttcaagctctattactatctagttttctaattttgaaggggatcttatgcaatttgtacattacttttggcaagatgggtattaatcatattaatctatgagcatgagagatttccccatcttcttatatctgcttcagtttcttcacatagttgaactattttattattttttatttatttttttgtttgtttgtttggtttttttggttttttttgtttttttgtttttgctcaagacagggtttatctgtgcagtcctggctgtcctggaactcactctgtagaccaggctggcctcgatctcagaaatccaactgcctctgcctcccaagcactgggattaaaggcgtgtgccaccactgcctggcgtagttgaactttttatcatgcatgtacttcagtttctattttaaattactgtaacctttttacattatttgaagctgttttgtttctctgatttttctctatttgtcttttgtataaaggaggcataggagaggtctactgatttatttatttatttatttatttatttattgacattgtgtcaagccattttcctgagagtatttatcacctatataaagttggtactggaatttttagagtcactaatgtatattattgtatgatgaattctaattatgatactttcacttattactttccaaattattgtttcagattgtggttttctcgatttttaatggatttatgtttaagggcttgaacctattttgctatattctcctgtatatcttttttttcattatatctatcatatattttattattatttttattaggtattttcttcatttacatttccaatgctatcccaaaagtcccccataccatccccgactaccctacccacccactcccacttgttggcctggctttcccctgtactgaggcatataaagtttgcaagatctaggggcttctctttccactaaggaagactattccatcttctgatatatacgcagctaaagacatgatgtcgggggggggggtaactagttagttcatattgttgttccacctatagggttgcag

SEQ ID NO: 24437 - DNA, 1162 bp, Mus musculus
gcaccaggaaacacaggctggctaaactctcagagttccttctgataggacttagcttgaccatcactgtgattctgttggtagatgtacaaacatggccttagacattgagggtcatttaatgtggaattcccctggagaacaagagactctacagctctgatcatagaaatctgtgttgcttataatataatatcactgcccagtatacatgacaggtgtaacttttgctattcattgggaagaatgttattttttttaattttttgttaggtactttcttcatttacatttcaaatgctatcctgaaagtccccataccctacccccacccctgctcccataccacccactaccacttcttggccctggtgttcccctgtgctggggcatataaaatttgcaagaccaaggagccgctcttcccaatgatgaccgactaggccatcttctgctacataggcagctagagacacagactctgggggtactggttaggtcgtatttttttttccaactataaggttgcagacccctttagctccttgggtaccttttctagcctctccattgggggccctgtgttccatccaatagctgactgtgagcatccatttttgtgtttgccagacactggcatagcctcacaagggacagctatatcagggtccattcaacaaaatcttgctggcgtatgcaatggtgtctgcgtttggaggctgattgtgggatggatccccgggtgcagcagtttctagatggtccatcatttcatctcagctccaatgggtaataacacatgctccactatgtttatagcagccttatttataatagccagaagctggaaagaacccaggtgtccctcagcagaggaatggatacagaaaatgtggtacattgacacaatggagtactactcagctattaaaaacaatgaatttatgaatttcctaagcagaaggatggatctggagggtatcatcctgagtgaggtaacccaatcacaaaagaactcacatgatatgtactcactgataagtggatattagcccagaaacttagaatacccaagatacaatttgcaaaacacatgaaactcaagaatgaagaccaaattgtggacacttcaccccttcttagaattgggaacaaaacaccc

SEQ ID NO: 24438 - DNA, 1575 bp, Mus musculus
catacactacctcagagtaaaaggctagaaaacaattttcccagcaaatggtcccaagaagcaagctggagtagccattctaatatagaataaaattgactttcaaccaagttatcaaaatagataagggaggacacttcatactcatcaaaggaaaaatcgaccaagatgaactctcaattctgaacatctatgttacaaatgcaaaggcttccacattcataaaagaaactgtactaagatttttgcgaacggcgagcagcggcggcggcgcgggaagtgcagcggaggtttttgctggtttcggaccccagcggccggatggtgaaatcctccctgcagcggatcctcaacagccactgcttcgccagagagaaggaaggggacaaacgcagcgccacgcttcacgccagccgcaccatgccgcttcttagtcagcacagccccggcggctgcagcagcgagagttctagggttgcccttaattgctgtagtaacctgggtccggggcctcggtggtgctcctgatgtccctcacccacccctgaagatcccaggtgggcgagggaacagtcagcgggatcacagtctttcagctagcatcctgtactccgacgagcggctgaatgtgacagaggagccgacgtctaacgacaagaccagggtcctgagcatccagtccacgctcacggaggccaagcaggtcacctggagggcggtgtggagtggtggtggcctctacatcgagctcccagctggacctctgcctgagggcagtaaggacagttttgcagctctcctagagttcgcagaggagcaactccaggctgaccacgttttcatctgcttccccaagaaccgtgaggacagagccgccctactccgaaccttcagctttcttggctttgagattgtgagacccgggcatccccttgtccccaagagacccgacgcttgcttcatggtctacactctggagagagaggacccgggtgaggaggactaggtgccagccctgcccagtgtccctgtgccctctcctgggttagtccacatgtcgtgattgtgcagaataaacgctcactccattagcggggtgcttcttcgagctgaatgctgtgtttgtcacactcaagtgttggctttaattctaaataaaggtttctattttacttttttattgctgtttaagatggtcaggtgacctatgctatagcagcctcctttgaagtctggaaaaatagtgtcacctcccctggctcaaatccaataaagtgatctcgttaaaaaaaaaaaaaaaaaaaaaaaaaaaaaaaaaaaaaaaaaaaaagaaactgtactaaacctcaaagcacacattgcacctcacacaatggacagatcatgggaacagaaactaaatagagactcagcgaaactaacaggagttatggaccaaatggatttaacagatatctgtagaacatttcatcctaaaacaagagaatatacctatttctcagcacctcatggtaccttctccaaaattgaccatataatcggtcaaaaatcaggccttggctggacagtggtggc

SEQ ID NO: 24439 - DNA, 1278 bp, Mus musculus
gagttcacttcccagcaatcacatggtggctcacaaccatccataatgagatctgacaccctcctctggtgtgtctaaagacagctacagtgtacttacataaaataatatgtgtttaagattaaaatatggaaggccggctgaactcacttcacatttattagagtggtgctattcatctcagatatcttttttctgtgttatttaatgctgataccttcgttctctaggaaggaggattctcttgatgttgaggtctctgccagtggttacacaaaggaaatgcaagcagatgatgaactgctacatccagtaggcccagatgataaaattactgaaacagaagaggactctgacttcacgttttctgatgaagaaatgttagaaaaagccaaagtgtggaggtcagaattggaaaaggaagcagacccagcagatgaatcaggtggatcctggtgctgctcgtctacagacagcaaacaaataaaggatggcggcttaccagaggagagtgctcatgtgtccagtttcgaagtgacggcattaagccaagctgtagaagagatggaaaggcaggttcttccccacaggtcggttactgagttctctgaggagagcaggagaactgaaaatgatgggcagccaggtcagagaagccctgctggctctgaggactgtgacgatgaacccccccatctgattgccttgtcatcagtgaacagggagttcaggcctttcaggtacagaggtgttttgtttgtttgtttgtttgtttgttgcttttacctttaatcttgagatctttgattctgtcaagggaggatatttgaaaaaagaaacaaacaaaaaaaaaacccactgtgacaagattgtgtcgtgccattatcatgtgtaaaaatgaaagttaactttattgtattgaaacaaatttgtcttttgaattaatctaattcccaacactcgattgactaaatttcacagaattttaccttaaacttagactcactgaattaatgtaggtctcttaatattaggtctgtttttagaatgggtaaagtgttctgtttcattgatatatttaaggtatgtttaaactatgaagtggatgtgagtatgtgagacatgcagtaaatgatttctatgttaattatctacagagcatgtttcctggagctttggggcttccatcattttgtttgatttcttatgtgcacttaaagccacataatagtattatgttttaactttgtgtttgtttgttgtttgttttttgtcttg

SEQ ID NO: 24440 - DNA, 1543 bp, Mus musculus
gtggcactctagcagttgataatttaaactgaccacttttgctgtataatctgtatttctgggaagaatataaattttaaaaactttcaacagcttctcctgttttatctactagttcatatagtgtccttaggattcttaaaattcatctttaacatgtaaatttgaaagatactaccagtgtaaatcttggataataatttgataatgatttctctgctccttatcaagatggttgtcagtgatactaattcacaagatctttgcaggaactggtgaagcagaaggtgaagcgtcagctgacaaggcagcagaaggcggctgccagacgccggctgcagaaaggagaagccaatgtgtttaccaagcagcggagggaaaacatgcagaatattaaatcgagtttggaagcagccagcttttggggagactaatagatttctgatatgtattatttttttagatgctataattttatttttagccagtatattggtcttttttggaccaaagccagtaaattatggaaataaagcctctttagactcagagcttccaaggtctgattaatagtaaatctgccaagcactctgtttcttaaaatttttcaggtaactaatttaaatataaaataacgtgtgaaaaaaacttcattggcagtaattgcaaaacatggacatcatttttatttcactgtgatgttcagactctgccttaaacaggtagaaaaatgacttgcctcagattctggatttacatgtaataaataatagaacaacttaatgcaatctgtagttctctcttttctccttcagtcggtcacacttgggcttttactacattggtgagttggctttaggatcacctgagacagtcagtacacagttatttgaccattggagtgaaactgatcgtcttctgtttctttagacttctggagtggagatgaatcagtaatgggtagacgagcagcagcgggtcttttggtgccgttctcattggccctgtggtcgtgggaaaaggaagtttaggttcctaccagtatttttgcagttgtcagctttccccaggtttcagcagaagtggggggagggagggagggagggagggagggagggagagagagagagagagagagagagagagagagagagagagagagagagagaatgcatgactccaggatgtgttcctacctcagtgttaacaagtctctagaacaacactctggtgtgattcatccctcaagcgcattctaattcagtcagtggaagtgagtgtaagtatacaagcactgtcccttcagcttccctgagcagatctcgaatagaagatcgtcttcagcaagaagtgaccaccagatggcagtgtttgccagcagtgacatgataaaaacaccagcttcccttttaccttagcaaaattcattctgactatttgtaactgatcactatctaagcgcatttaaatgtttggatatatgaatatgtcaagtgcagtttctttgaaaattagactgatttttggaagtgttgatatagcc

SEQ ID NO: 24441 - DNA, 2526 bp, Mus musculus
ttagtttcataagatgacagcacattgtttcttgcatatttcctcatttagtagtaggtagtacagctgatttgtggttttcctggttattctgagatatatatatatatatgtatatgtacacgtatatgtatatgtatatatgcatatacactatatatgatacaaatattatactattatacatacatatttaattttctcccttgctctcattgtttccctttaatacttatttccttgaaggtttttacatgtacctagagaaagaaaacaaaaaaacaaaaaaaccaaaggctcattacatgttgagtgtctgactgaaagtgtagccctgggactccatgtgtaacagtagcaatgggattgcagcaaataagatgggagaagacactcaggtatggctgcattgaggaaactaatcatatccagcatttctggtgttgaattaaactgacatggtgaaagtcaagctttggttttgtaaatgccagagaaaaaacagagaacattgcacagtaaacctgagtttaaatggcctcagtgtttgaggcaagctttgaagctagggtgtcaatatctgtgttttctgtaactaatctgaagagccctcgagagtactgtgtctgtgaggcctgaagttcagatttctctccagagttcttttgattgttcttatgtacccaggagaagtcattgtgattcttagaatggatcatttgagtgattactgctcctctggtggctgacaaacaacatggtcccaaaagaatttcaggggtaagacctttcggtcttagaacatccacatgtggcagggcacattggccctttcttacccagaactcttttgtgtggctgcatctctttctccagttctctcttaactggagcatgcctattctttgtccttttgtctttagtatctttgttgttgttagatgccatctgaagttacactcacaagtttaagcaaatgctgccttcttgtcagccttgtgattctgtgtgcatttcatgcaagggaacctgtatgtttgctctctgcattcttacatttcatattgtctcttcttccaccacatggtaaatgttatgactacacatttgtcttcatcaacgaaaatgcatgtgaaaacctctctgtccttcttgcatcttagctttgttttgttctcacatttttactgatattccacaagaaagatttgccatatccatttaggaaacattgagcgatagatagttctcctagaaattctcaaagacatgttatttaccatatcaaactctcaggaatgtattggaaaattatcctagtaacattgctgttacttatacctgctgctggaggaaaaaagtttattcatgacacatttacctttgatcataaataaaagagaaagggccacctttttggagttagtcatggtagtcattagtgatatttttgaaccgtttttaatttgaaatacttcaaaggaagtaaaggtcatggcttagctcaaaaaaatgctccagaagttgggctgcttaaatcatcagtacaataatatactgtgtgtgcgtgcatgcgtgtgtgtgtgtgtgtgtgcatgcgtgtgtgtgtgtgtgtgtgtgtgtgtgtgtgtgtgtgtatgaaatgagaattgccacataattggagcatttgcattcatccgcaaatcatgttgagacaaactgtagctggccgtcttgattaaagccaagtggtccctgtggctgtgaggaagagtttttcttgcaaaaactttggcaagtgatgacttcgaaacttacaaagctattgcctttttttttttttaacaccagtagtgaccttcagttccttcagtctgagtttaagggtagaattctaaatttgtattctaatctgtcttttgtggaaaattttgaaaatagtatgtatatgtaatattgtatatgcaaattgtgttgttttacttgttttgcatatgaccagcactgactgaaaggcatgtttaactataaacactgttgctttctttgtgaaatgaaaataaaagtatttaaatacaaatattgtatggattcatctgataagactgattatatattaaaagtatttcatctcaggttctaagttccgtcagaactgttcccatatatattatctaaattgcttcctgccttactccagagtccttaacacataaaactcaaaggaacccaaactcacactgtgaacattttgggttgcgcaattatttgctttgagagactcttgtgcacactgtagaattttcaacatatactactgatgctggttgcatctacgggtaaccaactgcccatagcaacccctcactattctggcccttgtgagaaacaaaaacgttacttcatagatagaaaactgttccctggactggcagttaaaactgtgtgtgggtgtttggaacaacaggctcagtaaaggggttgctggttttagggcagttacttccttgcacaggtgcaatccttatgaacactcagatcctg

SEQ ID NO: 24442 - DNA, 2738 bp, Mus musculus
ctacagagaaggggtgttcttgaatgcaatgtgaaaggtacgtcttgattaggaaaagtagaattggaattctagacttgagaaaaagaatcgattgggagatctgagagtttattaaagctgggaattggaggagacaagtttcctctgctaatatgacattagatataataaagtagtggtcatgcccccaccccagaggctcatgctctcttctgtctcattgtattagtcattgtttcagagtgttcaaagactttcttgctatcataggttctacttaattttctttgccatatgtgtttttatttttatgagattttagccaccattggagcaaaagctgccagaagagtcctgggtataaacaaacaaatccagctgcatgaggtttactgggtacccaacaattcttgctgattattgcgaagcaagaaactaaaattaagtcctgtgttgttgcatgattgttagtctgttgttaaattggattgtaaagatggttacttaatctaaagaacctgaactgatgatcttcagccagactgctgagcacttatagagaccatgtgttgtgtgggctctaggatagcacggtctgtctcaggtgctctgttgccaaggagtgcaatgagtttgcatctaggaatgcgttgctttacatagcctctaaggattgggaccatgggtataatgtaggtcttcttacctttgccttacttttgtttatgtggaattaaatcttcttctactacttcttcttcttcttcttcttcttcttcttcttcttcttttttggtaatgttctgtcttctcatgtttgtatttcttgaaactcaggtatatatttttgctggggtttttgttcttttattttgttcttaaagctctaaaatatcaaaaaagtttcaaatgaaaaatggaggtcccaaagtatgacagattactctttccccatcctttattgcccggttagtcaacaactagtagagtaagttattgacctttagagagttgtagaggtttttgggcggggcgtggggggagggtgttagtgttgatacatattttgaaacatatacatgtatttttagatgtttttatattttataaattttgtcctgttaatgaaagagtgaagtactgctttctgataatctctcctcttcccatattgcctactataggcaaagttgtaaaataatttaagttttgaaacagtgtgagtttcaagaggggaacaaggtagcttcttttaagagtgtgtagaaatagttttgctgctatttggcgcttacttaatgctgctctctatacatttttcttgtggacatgtacataagccatgcaaggacacacagatgtttggcaataacagaatgataatagtacctgttgttttgctctagtcttaggaacttaggttgtcgctcatcctttcaaacatgttgtaagtgcagtgccacttgtatttcactttgacttgtctctgcataggcacgtgattaccatggtgattgagaatgactgattcttccctttttcttgttgcctcttaaggcaagaactgtagaagagagtagaatagtgcttgctatggccttttattactgattcattaggttctatgcccttcaaacatatgtgaaaatacctgatgaaatgtggaagactacatgtgaacagtcctctcttctctcacctcttacggcctgttggccatctgagtggaagatggagggaaatgtacttaatgtctgtatatatgttcttactactgtattgctttagttctctgggtgatcacagtggaagatccccaatgtaccatggagttaagatgtacagcagtgccctctttccctttattgcctcggtacaatacttcttaaaagtattttgaatgtttgaaagttgggtttgggtttctggtggtggttggttggttggttggtttttgctaagctggaaaagtagtttggaggcagagtgtatacttttcaggtgtacaaacgtgttgtcgctgtgcttttccttccttgttttccctgtcctttctatggctttatgagtaaagctagaaatctctccaagaggtttcttccttatgttggccatgcagtatcattgacagtagcattgacagtgacctggagctgctcctgggggctgaggagctggcatctgcttttcctatgtgtgtccctaggtgctcttgcttcttaatcacttaagccatttcattgggtgcctgtcctgatgaactgtggagctccgaatttagtgtcctcccattcctgttccatctctgtgagtaggcttttctttttaggttttttttttctcttagctttactggggactaagggcgagaaatatattctttataaatataaataattttgttactatactgtattatttcatttggtactgaatcctttacatgggcatttaagtacctaatgaaacgtggaggtccggatgtatgaaaacttcctcttttcccttttcctcattgcctctgtgggcaatagctgtagaatagcatagattttctaattctcttccacccagtaggtggaagtatgtatatactttaaaatgtaaatataaattttttaaactttttgttgttacttcatttgtacctaaatctatttgtggacacttaggtacataaagaatattgaggttcattctatgaaaaatctcccctttcccttccctcattgcct

SEQ ID NO: 24443 - DNA, 1099 bp, Mus musculus
aaactctgtctcaaaaaactggggggaaaaaatattcctgtctgatttttatcagacaggtgatgcatttgggtctaaggccacttctgttgacctagttcttgctggactctagaattcactcaacatatatttccctgttttcttttttgtgttctgaggatgcagtattcaagagttcagggaccattgagaagagagggtggaaatatttttaagggccagagttctaggaggactagacaaagtggtgtgtcctggacatgttctgctgtacataaagcagctgtggttgcctgcacaagatcaagtctgtcgacattccagcactgtgggggaggggctcacaagccttcacctctatctgaggccatacttacagtggatggctcttgcaggaattagagccaattattttcaagggtgcatgcagtccatggtagatctgtaggctgatcatgctctagtggatgttcagcacagcttgaactgagtggtttactatagtaaacaaacaaacaaacaaacatgaagagggttgggaggagtaggaggtaggtaggttttgaagataggagcggagataaatataaaatatattgcaggcatgtatgaagttcttaaagaacaaaaagacattgattaaaaatatatcaaatgccaggtgtggttgtgtgtgcctttaatcccaccactggggaggcagaggtggtaggcagatctctgagttcatagcctgcctggtctacagagaagtccaggccagcctggaacatagtgagccactgtcttgaaacaaaatgccaaaaagatggacttaacccattagcatatgtaagcatctaaattacatatacatctgtgtagctgcaaactggtggagcctatgtacactgtgtacaatgagagataggggtgggggactttagtacagaagtggtgtgatcaaaacccttgcagtgataaataaggtgatagagaatggtggggagctgggcaaaagatgtttataaattaaagagttccaggtaacctagagatagaaagtgggcaagagttcctcaacagagaaataggaaactgaaccagcatagtaggg

SEQ ID NO: 24444 - DNA, 2058 bp, Mus musculus
accataccttaccattcaacctctgttgaatgacagctgggaacacagacagaatctgatcctgacaggtcctgctgtgtagaaaaggagagccaagtaatcatggctgctagcagcttaggcaatttgcataacctgtgtacttctgatacttgctctttgattaatgagggcagtattaagactgttttacaagattcacatagaaggtgtgataaaaaggtgagcaatgcaatagccttgcctagttcatgggtattgaagccctattatcagtgtttactgtacattgagagctacacacatggacctcctgagagattcttataggaagcttgttatcccaagaatttgggtgagagatcagaggagtctccagtcaggccatgaggtagggttccacagtggaaacagtgagaaaaacactggtttctaactttgtgttcttattacagccaccccttgagtcactggccacagtggaagagacagtagtgcgagacaaggcggtagaatccttgcgggccatctctcatgagcactcaccttccgatctagaggctcactttgtgcctctggtaaagcggctggcgggtggagactggttcacctcccgcacctcggcctgtggtctcttctcagtttgctacccccgagtatccagtgccgtgaaggcagaacttcgacagtaagttctcactcccatcaccttacctaaccttcctctaagcctcagcccctttaggtcttccatgacctaatgtctaatgtccttgatgactccctcctccctcctcagttctccaaagaggcttgtccttcacagtgatcactggacactgtacttcagcagtgaatttgcctggtctgccttcatggaaatttattcctgccattagttacacattgtgggcttggagcagaatacagcataacaaatagtatctggtattatttccagcctgctccaggtttagacccctcatttgctgactgccttgttgctcataactattaagcagaagttgctgagatgtcacttcataccacatgctgcatgtctccaattgtttcccatgtatctcttaatgaggcaattgctcctgaaatggaaggcaagttttaaaccgttcttagtactgtgttgtactgtttgactgatacgtcaaatcagctgtgtggggacttgctattgccattggtccgtataatagtttatagagctgagaagacagagaagtcatgagttatacaaagtcaccattgtcagcaccagaatttactgcagaaccagcagtgctctgtgctgtgccgggacactagcagttaggactttccaggattctaagtctggacctccatccaatcccaggtacttccggaacctgtgctcagatgacacccccatggtgcggcgggccgctgcctccaagctgggggaatttgccaaggtactggagctggacaatgtcaagagtgagatcattcccatgttctctaacctggcctctgacgagcaggtaagtcagtcgtcagctttcacaatgcaagtaagcttagaagggagtgcacccttaagactcagtgggcctgtgtttccctacccctctgctgttttccctaggactcggtgcggctgctggcagtggaggcatgtgtgaatattgcccagcttctgccacaggaggacctggaggccttagtgatgcccaccttgcgacaggctgctgaggacaagtcttggcgtgttcgctacatggtggccgacaagttcacagaggtaggttgccatagttccacaggtgtggacactgaggctctctgaggggagaagggagcaacatacaggaactgacatactgtattttaaggatagtacggtcctgagtcttaaagagaaacccaatgatctcccagagccagtcctgggtgggtgattcaaatcagaccgctgtgttgagagtgattctgaagccaagtttcaactccatgaaagcattttccctaaacttataacctctctaagaaagacacagccccagtgatagtggcagcaac

SEQ ID NO: 24445 - DNA, 1194 bp, Mus musculus
caactagatgggtggatttctaagaggcagaaatgggcccagagcatcaaatctcactaataccttcctctccctgcccacagagttctgtgaaaatctctcagctgactgccgggagaatgtgatcatgactcagatcttgccctgcatcaaggtaatagagtatttggttgtaggatttggttttagatacaatcagatccaaggccttttgagatactgtaactgtttaacagtcatggattaggctgtaggcaaaatctgaaggttgaaactgaccctcagatctaagggatgtatttactgctcagagaccagagttcccttatccacagagttttggggaatagggcagtggccccaggatcggggctcacataaccatctctttaaatgtagtgcagccctgagatgccctgcctatgaaaagcagaagactgtggtcttagaattggggctactgtctatgtggccagttatcattaaaggggatttttctgaccttggctccctccttccttctcttctgaaggagcttgtgtcagatgccaaccaacatgtcaagtcagcactggcttcagtcatcatgggcctctctcccattctgggcaaagacaacaccatcgaacacctcttgcccctgttcttggctcagctgaaggatgaggtaagagtggcaggaaggttttcaaagtcaatcaaattatccaaaagtattttaaaagtttggcaccacactctacactctctgctttgataagttgatgacaggcaaaagtgtctgcttgttcactcgttcttgtcagacatgcctcatgtgcctttaattttgtactcatccgttccctgagtgttgaacaaagaccaagacaatggtgatctttagggatctatagaatgtgccagtagagaggacagatggataaattgtcccataattcaactcagaaactaggtactgggagaagtgcgccatagtttaaagcttcatgtttccactgaaatagctctagcttgtgtcttctacatgctctgttggccatagccagtctggtcaccatacttgcctgtgcactgtagtaacagtttagggaattggatttgaatctgtaggcaagtgctgcagctgcaagagatctttctgttaggaaaatatagccagtgttagtgagagataggagagatggccagaga

SEQ ID NO: 24446 - DNA, 1304 bp, Mus musculus
gaattttccatgtgtatgctttgtgtgttcatgttctatactctgccttatgatttggtgtgttcctgtcttgatacttaccttcaccggagccctctttctacctgtgggcacaactcctccaccccacccacccccgaacacacacacacacacacacacacacatccatccatccaaggcaagactatctcactatcttcttttcccttcactttccagcaccctgcagagtgaagtcaagcccatcctggagaagctgacccaggaccaggatgtggatgtcaagtactttgcccaggaggctctgactggtaagggcctgagagtgtagagcctctggcagaagggtgagggctccggggaatggggcagcactcagaaatgtggttggagaatgtggtgtggttctgaggcgtattgttcttgtttccccagttctctctcttgcctgatgctggaagaagaagcattgccggcctctggtgtccaccctccaacccccacaaagttacctcccttagggaggtggtgggggcaaatgactgtcactccctgtgcatggtctgaccccaggctcctcccccagcacggttcggttcctcctctgtagcctgggaagacttctctgtccacctcccaaggggctggagcagtacaagttgttgcaggacagcagcctgaaaagaagggctggttgttcctgcccatattgggagagatgggagcatcctaggtcactggcttttgctgctgtaatggggacccctcccccatctacttaccaccaccctttcccaaccccaaccatgttttttgtgtgtcaattgtgccatttttattttattcctttccctactgtacacggagaaataaaggtgtagaaatacttggttctctagtcttagtaatcggaatggaggaaagcccactgccttgtggcttgttctttgctttctctgaggagaccttcctgcagatgtcactcctgctatcacaagagcgtgcacttgggatccagcaggagggcagcaggagacacagcagtatccagagactgctcagggcaatgtcctgtgatgcagttcaggttttcaggcactggcagagcagagttctcagatttggaccgcataactgagatagcacctgtgagtgtgtgtggagctccccatttcctgtgccgtcactttgggtggtgaatccatatgtagctctgcaggccaagcctgcctaccaggagatttggttagggccctgtgaaaagtctccgcacacacctacaccagtgctttgtaggaagt

SEQ ID NO: 24447 - DNA, 1192 bp, Mus musculus
gacaaatctattaccaagtgctcatatcttagaacatatcagagagttcatactggaaagagaccgtatagatgtacagaatgtgacaaattttttactaagcactcaaatcttagacaacatcagaaaattcatactggagagaaacctcccaagtgcaaagattgtgataaatcctttctccggatttctagtgttagaatacgtcagaaaattcatgctggagagagacgttatcgatgtaaggaatgtggcagatcttttacctggttctcaaatcttagagtccatcagcgagttcatactggagagagaccttacagatgtaaggaatgtggcaaatcttttactacgggctcaaatcttagagtccatcagaaaattcatactggagagaaaccttacaaatgcaaagactgtgacatatcctttctgtggatttcaaatcttagaacacatcaaaaaattcatactggtgagaaaccttacaaatgccaggaatgtaacaaatctttcacaaggtgctcatatcttagagaccatcagaaaattcatactggagagaaactttacaaatgcaaagactgtgacatatcatttatgtggatatcaagtcttagaagacatcagaaaattcatactggagagaaaccttacaaatgtagaggatgtgagaaatcctttactcagtgttcaactctaagagaccatcagaaaattcatactggagagaaaccttacaaatgcaaagactgtggcatatcctttttgtggatttcaagtcttagaagacatcagaaaattcacactggagagaaaccttacaaatgcaaagactgtgacatatcctttctgtggatttcgaatcttagaacacatcagaaaattcatactggagagaaaccttacaaatgtcaagaatgtaacaaatcttttactaggtgctcctatcttagagtccatcagagaactcattctggagagaaactttacaaatgcgaaaactgtgacgtatcctttatgtggatttcgaatctgagaagacatcagaaaattcatacaggaggaaaacattcccttgtaaataatgtgacataacatatatctggtattctctgcttgcaaatcaaatgagataagtgattgcaacataaagataacataactagatggttaaagcctttaatgagga

SEQ ID NO: 24448 - DNA, 1136 bp, Mus musculus
tcttccattcatattgctaatcatgtatttgtaccaatattaaatgactttcctttctataattttaatgtagttctttactaggatacttgatgcttttaagtttctgcttcaaaatttgggagcttattgcattttccttggttctaaatcttttcaagttattttcttcaatccataaaataatgccagtgtaaatttgacaagcattgcttagtatctctctgaagtattaaactccatcttcactgtcttcccattaactctctcctgttgttagtcttcattacagtactcaacagtttgcatcgctataattttaatgtattttgaaatctcctctaggtttgatccttctcttataattttttaagtctatggtttctcataagttagtgaattttagggttttttctaattctacaaaaataaatgtaagattttggtatagattgcttagcatatttataatacatagacctcctctacattgtctttctatgtttgaattagaatattctagcactgtgtcttttaatgtattctgttttccatctgctgatggtgtctgtgtttcagattcagggagaatttttaaaacattgatatttgttatttttttaattctggtatttctaggacacggccacactaacaaatatcttttgaagttagagaattctgcctgggtgtctcctactattatgtggctgatatttgtggatacctgctagacaattggttttctgtctgatttcattgtgcctcgaagactggtggatgctgaagcttccctgcatcgctgtctattttctccttacagttctacattgattgcttctcgtatttggatgcttttgtgaaatgcatttatatcgaatgcaatcctgtttgtcagtttgtgttcttttgtcataatatgtagttctgttcatgagtaagtccctatgtccccatatggatgtgtttttactttctcttactatacaagtttcattttacagatcatacatgaaggtctgattcattgtacactgggagagaatttgacccaggttcatatttctgtgtggataaatagttgtctcaacatcattagttaaaacagctacctcttatgcagcacataggtgttg

SEQ ID NO: 24449 - DNA, 1112 bp, Mus musculus
aatcttagaaaacatctaaagtttatagagaaatattatactattggaagcttttcattaaaacattatacttgttcaacctcaaaaaatttataatgaagacaatgtgttaatctaaagaatgttaccaaacctttagttattccctgaaataatattagagagaaatcatatatgtttgccattgtgctatattcatgcctcactgcacagtagaaattcctctctagagaccccaaagaaatatcattgaatttggcaaagcctgttcctactagacttctggaaattcttcctgaaggaaaacccaagaaagtgctttaataaaggcacccttggttttttggttttttgttttgttttgttttttgtttttgtttttgtttttgttttttgcttgtgtgtttgttttttcaccttcaaaatactcattctggagtaaaaacctgtcaatcacaagatggtgagaacttaacagtgatgatctgtgtgctcatgtacagttagaaaatcccccaagaatgtacaggaaaattatttttcagtactgaagaaagttgacgtatttagtagaactgcagagcatagtaacagtagaaatttcatgtacaaataataaaacacaaaggtttgtaggcattagagaagccagtgtactacattagcaaatggttatatataattggtatcaattgctgctccttcagagctgatgaacccaagtcaggagtcacgaaagttagtagggactgacaataaccatcaagggacctcaattgtctgcataatcttaatgccaatttcaagcactctatgtgtcagggctccttggtacacagattctgcacagatcaaagcccatttaatgatctttcagtagttttcttcattatcatttaaaaacaattcttagccaggtagcagttgcacaggcctttaatccaagcacttgggtcagggaggatagaggtgggtggatctccatggaagctagcctggtctacagagtaagttccaggacagccaaagctacacagaaagaccctgtctcaaagacaaacaacacacacacgcattcacaaagggagagagttcacaaagggagagagaga

SEQ ID NO: 24450 - DNA, 1095 bp, Mus musculus
ggatttgaactcaagacctctggaagagcagtcagcacttttaaccgctgagccatctctccagcccccggtgggaagtttttatgttgctactctgtggtgacaataagggtagcatattttctgaatgtagccacaggcagaggtcattaagtgatgtacaaaatgaaaatatcctgatttttctcttaaaagttctggcatagctttgaccatttttcttaaatggcatgttattgagcatgaatctcctgtgtatggaactttaaatattgtaaattcatgccagcattattattttttgagaaagtctatccctggcaaccgtgaaactcattatatagaccagactggccttgtactcagaaactccatatagttatgagaagtctaacacaatgcgcctgtaggtaacaatgagttctaggttgatctattttattatttatgggtagatgtgttttgccagcatttggctatgtataccatacttgtacctgcaaaggtcagaagagggctttagatccctgaaacaggagtacagactgttacaatccaaatttggttggtgggaatcaaactgtcatcctgcgcaacagccactgagcaaactctcacatcaatctcaaggattttgagcaacagtttcatgtaattcagtagtgcttagcattgaaatttatatagaaattaccctataaaaacattttgaaaaatgactttcgtttgggggttttatttatttttaaattttgagacagtatcaccatatatttcagatgtcttagaacttcctatgctggccttcagttcacagatatcctctgctttctgcctcgaaggtgctttgtgacacctgacactgaactttttttttttttttttttcgagacagggtttttctgtgtagccctggctgtcctgcaactcactttgtagaccaggctggcctcgaactcagaaatctgcctgcctctgcctctcgagtgctggaattaaaggcgtgagccaccacgtccggctacattgaactttttaagataaacattcttgccagatagtgatggcacaagcctttatttcttgcactcagga

SEQ ID NO: 24451 - DNA, 1282 bp, Mus musculus
agaaatacatacttcagaatagctaatgaaactgacagccttctgtgtaactcaaaataatttactcagacaaattatgcttcttaaaagaggatttgacaaactgagccataaagataggatgctctttatcctgtagatattcttatagttatgtattttgctcccagtgtccagtattcataatctgtatcatatgctggttttaagtttcaggatggcaattgtctttgagtcccttgggctctcatttactctttcctcttagtcatgtatgtaactccaataaagctcattggttcaacaactcgaacttggttgtgctcaatttccacttggcatgggtagatgaatatatatgttgcatcaccccaaaaaatgtctcccacaaaaaaaaaacacatgttgaacccattaatattttctgcaaacttgtaacataaaatgagtattagaacaatgtttttcagcgcatgggtagaaatatcattgagggtggaatgaaactctcacagggacaggggttgtttaaaaccataagaaaacacatattttcagtggtcttagaactgaaacaccactttttttttgtctcctcatgagtctgcctgcataaaactgctttgaattatataaaagttatgtagagctcttccagccagcaccttctgccaggcaggtctgcagcttgtctgctcccctgaggacatcacagcctgaaggcataccaggagttctgctgaacacagggcaactggtaagggaccctctcagaggcccaaagcctcggggagcccagtggacttgggacccataacccccataaaccccttgcccacagaattccactcaccttccgcctgggcagatcaccagcttgtctgctcccctgaagacaccagagcctgaagtcattctgggactttcactgctggcagggcaactggatagagaccctcccgaaggcctacagccactgggagcccagtgccatcattgcccaggtaagatttatattttcaattgagacaatttcttgagcaataatatgttcagaattagtgaagaggatcttggttccgggactcagcagaacttaggaaattagtatgaacaggttagagggtgcgccagagaaccggacagcttctgggacgggcagaagcacagagccgctgaggcagcacccttggcgggcagcagacagctggccaccatccggaccagaggacaggtatccgcctggcttgggaggcagcctcagcctcagcagcagcggtcg

SEQ ID NO: 24452 - DNA, 1193 bp, Mus musculus
agattattattaaaagtgtaaatttactcattacacttgatcatgtctagagtgccaccaatgctcctaaggctgtcaccactgcccattacaatgctgctgactttatttaaaaaaaaaatacattaaaaagaatacaaattggtcgccagagaccagcagaacgatggggctatggccggcctcaactcactggaggcagtgaagcacaagatccaggccctgcagcagcaggcagacgatgcagagaatagtgcgcagggcctgcattgcggaactggaaggcgagcacgagcggcgggagaaatctgaaggagatgcagccgctctcaaccgctgcatccaactgctggaggaggaactggacctggctcaggagcagctggccatagccctgcagaatctggaagaggcagagaaggctgctgatgagagtgagagaggcgtgaaggtaatagagaaccgagccatgaaagatgaggaaaagatggagatcctggagatgcagctcaaagaagccaagcacatcactgaggaggccgaccgcaagtacgaggaggtcgctcataagttggtcatcctggagggtgagctgaagagagcagaggagcgggcggaggtatctgaactaaagtgtggtgacctggaagaagagctcaagtatgtaactaacaatctgaaatcactggaggctgcttctgaaaagtattctgaaaaggaggataaatatgaagaagaaatcaagcttctgtctgacaagctgaaggaggctgagacccgagctgagtttgcagaaaggacagtttctaaactggagaagacaatcgatgacctggaagaaaaacttgcccaggccaaagaagagaatgtgggcttacatcagacactggaccagacactaaacgaacttaactgtatataaactaaaccagaaaagtctgttttaacaccaactccactccagggagtgtgccctgtcttcctcttttgtaagaagttctgcttattaccaggtctccaccttgcaggaaatgccaagcagataattaattcatgaccaaatattttgttagacaagctttgaacaccaattatgtttaattctttccttttccattcaaatggtaccagctcctctgattattcttattcttaaattgcatttattcctaaaataggcagggaattttaca

SEQ ID NO: 24453 - DNA, 1193 bp, Mus musculus
cactacagtgatgagctgcagtctgtcatctcacatctccttcgagtcagagctagagtagcagatcgactctatggtgtatataaagtacatgggaattatgggagagtttttagtgaatggtgtgccatcgaaaaagaaatgggggatgggctgcagagtgctgggcatcacatggacgtgtatgcatcttctattgatgatattttggaagatgaagagcactatgcagatcagctgaaggactatatgttttatgcagaagcacttcgggctgtgtgcaggaagcatgagcttatgaagtatgacctggagacagctgctcaagacctgactgccaagaagcagcagtgcgaggagctggccactgggactatgagaacattctcgttgaagggaatgactaccaaactctttggtcaagaaactccagagcaaagagaaaccaggataaaggttctagaggagcagataaatgaaggggaagagcagctgaagtctaaaaatctgggaggcagagaatttgtgaaaaatgcatgggctgatattgaacgcttcaaagaacaaaagaaccgggacctaaaggaagccctcatcagctatgatgtcatgcagatcagcatgtgcaaaaagagaattcaggtttggaccaatgctaaagaatgcttcagcaacatgtaatcccatgaagtgactttctctgcaatcaaagtgccccaaaccaagcacaagtaaaaaaatctatttctaccttatacataaaagcatacagtacattgaacaaatccgctttctttaagcatagttgtgttcatatagcacaaaatgatacattttaatgaagaatatatattataatttgaagttttggggactggtgctgattccaaaaaaaagttaatttaataagataaccaacagattgttagtcaggctcctgaaccagtgcctctgtcaggatgtgagttaatctccatgtgtgcatctcagtgccccctgtccagatctctttacaggcagttcttcccaagaccagatgccaagatttacattgtaggacccacttctgctgcacagttattttatcttgccttagagttgagctgtttggattgacaaagctcagcagaaacttgttgtgacgtctaaggttttcttctgtgttcctagatactgtaccatctgccacacta

SEQ ID NO: 24454 - DNA, 1174 bp, Mus musculus
ctctctctctctctccctccctccctccctccctcccttccttccttacttcctttcttgttttgttttttttgttttttgtttttcgtatttttggagacaggatttctctgtatagccatggctgtcctgtaacttactctgtagaccaggctggcttggatcacagaaatctgtctgctactgcctctcaagtgctgggattaaaggcgtgtgctgccactgcctggcactcttttaaaagtttcgagtagctgagcattgctttgtcagtacctaatctctgcagagagacatgtctgtcatgttgaactatatgattgtattatctttcagtcaattttattaatttctatataaccctcgaaatatgtctttaaattctacttgcatttttacattttaaaaaaggtttatttattttatctttatgaccactctctcttcgtgtacacgtgcacacgtgcctgccagaagagggcatcagattacattgtgcatggttatgatctaccatgtagatacaggagtgatgtgagcacactagatatggtgctgtgagcagtggagacagctcaggtgatgtagtgatacaaaccatgtaaagcaagcaaatcaatagtacccctccatggtctatgtgtcatctcctgattccaagatcctgcagagcattttcagtatttatacactatagcacagttggagaatcatttgtagaatcctcttttgtttttcttttttaaaaaattggttattttattaatttacatttcaaatgttgtcccccttcctggtttcccctctctaaacccactatcccatctccctccctctgttttctttttctttttttcccacattttttattagatagtttcttcatttacatttcaaatgctatctgaaaagtcccctataccctcccactcccctatgccctgctcccctccccactcactcccacttcttggccctggtgttcccctgtatggagcatatagtgtttgctagactaaggggcctctcttcccaatgatggccgactaggccatcttctgctacatatgcagctagagtcacaagctttgggggtacaggttagttcatattgttgttctacctataggtttgcagaccccttcagccccttgggtactttctctagctcctc

SEQ ID NO: 24455 - DNA, 1177 bp, Mus musculus
ctcaaatgaagaaactcagaaaaatcatatttgttaaaagagggtttgataaactgagccaccaaaatggaatgctcttcatgccagtattcctacagatacagtttgccctcagtgtattcaaaatctgtatcatgctggtttcaagtttcaggatagcaagtgtctttgagtcccttgggctctgatcaccaactccttccccatagtcctgtatataactgtaataaatattgattgaacaagttggacttggttgttttcagtttcaacttgggattggtggatggatatgtgtgttgcatctctgtagaaaatgtctctcatacaacgtgttgaacccattactattttctccataattgtaacataaaattaatactagaccaatatttttcaacctatcgatagcaactcctttgtgggtattatgaacttgtaacaggttacacaagaccttaggaaaacatgtatttcctataatcttagtggaacatcatttctttgtctctaggtgaatccacctgcattagtatactttggattttatgatagtgctgtagtattagaaatgttagaaacactgtattagaccacaattgtgttaactaaaataaggaatactgtgctcaaatctcctgctttactgccataacagtaattttaaattaaaatgcctccacacagaattgtagaagctttaggggtctgagaggtaaggctgtttcctcttgaattcaagaagattgagaaaaagttctaccaagaacaaatgaaactatggcttcaaggttgtcagtgacagtcaaaatcatctggattgtgtcactatgtgactcttaactcaataccacgtgattcagctcaactctaataatcctcagtacaatgctacccatgggaaaatattagagaccattgtggtagccggtcctggtgtagcttaacacaatatatataccacaagaaattcatcagatttaaattatttttgtcaaataatttacagattgataatatatacatctgagaacatttaatactgaaacaagattcaataattggcatgcagatgaaattgagaaatccttggaaagttgggttttgagtaatattaatttattttttatttatttgaaacacagccttagaacctgaatttatgcaactttctgtt

SEQ ID NO: 24456 - DNA, 1132 bp, Mus musculus
ctggccttacagctagtagaaaaagctattgaagagcagtttgtcacttatatagattattccttgccgctgcacctgttaatttttaataggactcatgtgcctacaggactgctatagcaaaaaatttcctataatatagatacactcaaggatttctcctaaatgtaatatcttaccatatcacaaagcagtgggtcaaatgattatcactggaagaaggcagacattaacttatttcggcaaagagccagatatcattgttcagccttttaagagaactatagacagctatatcccccaaggtcaccaaaggctcatcttccctttaccttatttgttctaaatattttgcaaactgatattaaaggtcagtctgcagtggatcgccactggcatctagttacttctaattcttatgcattgttaaaatggaaggacccactgactagcgaatagaagggtccagatccagttctaatttgaggtaggggctaggtttatgttttttcatgagatgaagatggagcgcggtggctgccagagagatcaattcgtcagataaacacagattctgactcttctcgtaagtatcattataaagactaaaattcctcttgtgcttagaattcagctgggaacgaaagctcccagaaaagctgttttcctgctactatctgggcctgctacccaacaggaggctagagattaacctcagctttactatttacatttaaataaagtacctggacttcccccccaaaatatctgctttcctactttctcacggtcgagattttgtttttcaagcaggttaatcaacattctccagctagatcagcgatgtgcatccctgcccccctagagcacacaggtggcagctgttatcttcagtcccaggacattccagcacgtggctttcagactgagttaaaaattaggtttaccaagagggctagaaaagtagatatttctaatattaatagagattggtttttattctgatagatgggtttagtcccttagctggcctatggcttttcacccttgctgttactgcaaggtgtccttagttcctcaggctgtgggaagtacagggatgaggaggaacgactttcagctcctattttag

SEQ ID NO: 24457 - DNA, 2142 bp, Mus musculus
tcaggaccccagaggcagcttgacttccaggagctatgacaaacccaggatcacagaatcacaggatcagagacagctggactctgaggagttttgacacaacccggatcgctggagggataggcttcagtaagagatagcaagggcatgtagcacaagagataaccagatggctagaggttcaagaacataagcaacagaaaccaagtctatatggcatcaccagaacccagttctcccaccatagcaagtcctggatgccctaccacacaggaaaagcaagattcagatttaaaatcacatctcatgatgatgatagaggtctttaagatggacataaatagctcccttaaatatagggaacaagccagtaagtggcactcttgttccttcaggctcctgctctctttaagtttgggccctcactgcttttgataatgatctgtgacatggaagtgtaaatgaaataaactcattcctcctaagttgcagcaataccaaccctaatgaaaacaaattagtaccaggattgtgagatattgtggtgatagatttcaccatgttttggggaggagtatagaagaactttggacagttgtatgaagaacctatggtgtctggttagctggagctgaggaatcaggtatggtcagtaggaaaccagaaccactaaagtgaaagcgttgctttgctggaacaattgatgctgagtagctggagctgcaaatttagctgtgattgaagtgtaagaggtcaacatcaagggggtaaacacttctaggaagtattttctcaacatcagtacatgcaatttgtattcagaggtagccaaggttgtatctcaagctgccagccaaacatggtactgtaagagtcacccatgtggttttgaagacataaaaggattgtgcagagcatctaaggctgagcactgagaagccagcagaggccattggtgaaagtgcatcaagagtaccaatggattgaaggggtcctggagaaaatgtgagagtttgccacatgaaaagagcctatgagaggatactggtgtgagcacaaaccagttgcagtagaagaccccaaaattttggagatgtaccatagaatgactaccaagtacagcagtagctgtagagtggagccccccaaattgtaagagacaagctttgtgtgctgtagaaggcagaacaggataagtgacccaagccacttggaggaaacaaaaaaatccctgtggacctgggtaaaatcttgtgaaacttccagggagtaaagcctgcctagcagaaataggccccttggagtgttcctttaagaagcataataattcaaaccagtattttcactcaaatatacttttacaccttatcttcaataatggactcagttgatggcttcgcatagacctccaatatcggtactttggatttgtcaggaacagtagaatcaaacagccttggtgaagaccctagatgaaaacaatgttgaaaggtgggaagaacatcttcagagaaaaataaagtagcatgtaggggtggaaggaccacactgaataagagcagatagagtaagaactcttctgatgttccattttttgtatgaaatactctcaggatcttccccatttagcattatgttggctattggtttgtcatatatagtttatattgttctgagatatgttctttctataactcattacttaagtgattttattatgatcatgttgaactttgtcaaatgccttttacatctattaaatgatcatataatttctgtccttgagtttgcttactgaatattatatttttaaattgcatgtattcagctatccttagaagaaaaccaacctggttgtaataattgtaagggttcaggaattcagtttatagagggtccttttagtttttaatacatgtgtttattaggtatgtaaaaggccaaaagtaaaagaacaaattgcaagttactggcagattcagttccagtacaagggccattttctgatctgattcgaacatggtactttatgttcttatatatggagaaggaaaggcattgtgctctgaaacttcttctatgcagtttcttactacattcatgaaggttttgccctattaacagttatttcctaagttctac

SEQ ID NO: 24458 - DNA, 1150 bp, Mus musculus
aagggatgaacttaaggagctgcaggggataggaactataaaggaagaacaatagtatcaaataacctggtcccctcagcgcttctagaaactaagccaccacccaaagtgcatgcatgagctgtcccatggccccttctacatatgtagcagaggactgcagtgtctagtctcagtgggagagaatacatttcatcctgtaaagacttgatgccccagggaaggtggacgctggcaggcggtgggagattggggggattgccctttcagaagcaaaggggagggggctggtgaggaactcatggagggaggaccaggaaggggtgcaacatttggaatgtgtataaaatatatttataaaatgttttttattgtgttaatatgaaaggctatgtggacttttgaggttccactgaatgcattattcatttgacttgcatataggcctatgtgtctcagggtgttgaatgtaatagtttaaaggataaagacctctatgtgcaaatatttgagtatttggtccccagtaagaggaactatttaaggattaggaacagtgtgttttaaattttcagccagatgcccgccaccatgcatcccactcataaactaagccttgaagctataagcaagcccctgatttagtgtttctttttgtatgagaggttttattcatggtgtctcttcatagcaacaaaatagttgcttttaataagtagcctttgttgacttcagttctgaaaacctccctcctattctgcctaccaagtgctgaattttatattgaaccaatccacacctagcttctaaaatattttgtttgttcattttgttttttagttgtttgtatgcatttattcagggtaactcaattttgtttgtccagcacacataaaatttaagttccttccactctaaaaggaacgtactctgcatttgtattatggaaataaatcgtctttgtatgtgtcccttattaactgagagtggatttgtaagacaacgggcagcaagcagcaatggctgtctgtgtaagttactctcattctagaatcttgctcattgacaatcaaaactgaaagataactcttacagctgtaggagcaattctcaatatatgggggtcaagcagtgctttcacagagaccat

SEQ ID NO: 24459 - DNA, 1172 bp, Mus musculus
ctcaaagtatagtgcccctgagcatgtgaatattcaagagaagtctaataaatggaaggaatgtggcaaaatgattcatgaatcctccaaaagtacaccttatcaaaccaacaacagagatgcctccattgaatcatcaaacagacacaaaactgagaatgccagggaaccatgcaagtataaggactgtgtgaatggcttaaatttgtatcccatcacttgtcacaatcaaacagtgtacctagaaataaaagaacataccaaaacactgtatgatgaagcttttctctctaaatataaactcatgctaaaaggaaacaatagtggaatgaaatcacacaagtgcaggaagtctggaaaattcttcacgatgacctcaagcctgagtgggcatccgagagatcatgctagagagaagccctatcaatgtacaaagtgtagtaaatcctttctgcatttgtcacacctccaactgcattacaaaatccattttggaggatatccctacaaatgtacagaatgcggtaagtgcttttatcatgcatcaggctttgaaagacattgcagaatccatgctacaaagaatacttacaaatgtagtttttgtagcaaatcctttatctgctgctcaggtcttagaaaacatcagaaaattcatgaagaaaacaggctttttgaatgtaaccaagatactagatcattctgtacattttcctaccgtgaatgccattaccgtgctgatataagaaagaaatgttacagatgtaaagaatgtggcaaatccctttctacatcctcaggacttaaaatacatcagagaattcatactggagagagaccttacaaatgtggtgactgtgacaaatcttttacccagaagagcaatcttagaatgcatcagaaaattcatacaggagagaatacttacaaatgcagtgaatgtgacaaatgctttacccagagatgccttcttagaactcatcagagaattcattcaggagaaaaaccttacaaatgtagtgaatgtggcaaggcctttgctggtggctcatatcttagaagtcatcagagaattcattcagaaaagaagccttacaaatgcagtgactgtgacaaatccttccaccggaaagaccaccttagaattcatcagagaattcatacaggagaga

SEQ ID NO: 24460 - DNA, 1174 bp, Mus musculus
ttgcctctaagtcatttctccaggctgtagttttacattccaatgcacatttgtcacagaggtactatataactttgtgtggtctagtttttgaaaagcaaaggaagaattatagttaatatttatctatgtaactgacaattatgttagacaaatgagctcaaatactgaaggaaagaaaataaagttgaattggaagtgtcttagtcagggtttctattcctgcacaaacatcatgaccaagaagcagttggagaggaaagggtttattcggcttacacttccatactgctgttcgtcaccaaaggaagtcaggactggaactcaagcagatcaggaagcaggagctgatgcagaggccatggagggatgttccttactggtttgcgtcctctgccttgctcagcctgctctcttatagaaccaagactaccagcccagggatggtcccacccacaaggggacctccccccttgatcactaattgagaaaatgccttacagttggatctcatggaggcatttcctcaactgaagctcctttctctgtgataactccagctgtgtcaagttgacacaaaaccagccagtacaggaagattcaaatttcaattcagtcaatctcatgagcaaaaaaaaaatgtattaaaaattcatacaagattctcagtttaaaacttaatttgatcaaaaatagcttatctacatctattgtcacatataccatttatttacagataatagctaataattctgtagtgaaagatcatggaacttatgaaattgttaatatctgtattttttatgtcatcgtttagaaaaatgtgaatgatttcactgttgtctagtgctgatttttctatttatgttgtagttgtgatatattcccagaaaataaattcgtaaagtagttgactgaatgtgttgtttggaatattggatatgtatcctgatgttacattctctactgcttaaaaagaaaactctgacttaattcaccaaacattctgcattccatattcagtctttttttgttcttgaaaggttgtagcattgtgcctaggcctcaagatgtcaacagagcattttagaatagagtcaggtgagatccagctgcaaacagtattgttctagtgtccatatttgaccaaaattgacactggtagaatttggaa

SEQ ID NO: 24461 - DNA, 1215 bp, Mus musculus
tacaactcccagcattttaggaagttatttggttcttgggtaggtagtgcttacatgttaattttgggcttcacagtatgagagaacagaggtatctggaagggtccaaacttaacctggccgtgacttggggggttgaaagggggagttagggaataggaggctcccaagagaggaaacaggtgccaaggaaacagttatccaaagatgtccactatgatatattaataggcacctcagttagccatttttcctaagctcctttgatatctaacaaggccagaccagcatgcatgctgtggaagggcaatgtcaagccaccttattgttatagatagaaaactcactctaaattaaataaaattagaaagccctttttgaataattatgattgctcacttacatcagaaacgtgtctccttagttcaagaaaagcacatgtggccaaactgttcattatttcatggtctgttgatattgaattctgtgactatggacttcttacctagaccctgcagtcagggctttttttcagagacctccttttggaaaagtgcatcagtttggattctgtgagtcacagtagttttcttggagtcttccttggggttcctgggaaaaggactcttcggcatatgtgtgaactgtgtgtgaatgagtctcacacctcatagaacagagtaaaatcctcagagaaaagagacattttttcatgttattttctctttccttcatgtttatcctcttgggaggtgtcagcatctttcatttttgtggcatgaaaagttccaggtgctttctgaagactctcttctccacatgcaggtccccactgctcagccagatctgctcaccagtgaatcaactaagaaccctggatggtgaagagagaggagactatagtaaagaatccaggtatgttagaggaactgaacaaggggtgaggtgggccttaagtgacaataaaaagagaatgtgacattggtttttccagattctatttcattaagcattcaggaaattttcattgagaataatattagatgttttaaaatggatttttccttataggttgtacagtgaacagtttttttcagtatttaattagctatggatctctgaattaactgttgcccattaacaagtttctctgacatagactgaaagcagcaccaagctatctatgtgaccaagctatttgaacatgtagcaaat

SEQ ID NO: 24462 - DNA, 1132 bp, Mus musculus
taattaaaaaatgttaaatctttattaaaagatacaaaaagatgttttatttagctgggtggtggtggcacatgccatttatcccaagacttgggaggtaaaagcaaatggatctttgagttcaaggccagccttatctatagagagttttctaggacagccagggttccacagagaggaaccctgtctggaaaagaaaatgttttatttagacaggatctcaagtatctgtagttggcctcgctgtggagttaaagatgaccttgaacgactggtcatcctgcctctgtcccacaaatgcaagaattacaggtgtgcgctaccacgcctggctgaatggttacttcccaagtagagaccagaaagacagactgctacccctagtttgtctgtgctgacaaccgtcactcagacagcaatggaatccctttctgaggctgagggggcgctctcctgtaaaatgggcttccctcccggggctgcttgcaaagacttgttaaatccacggaaacttagcatactgacactcttgcacaatgggtcttgttggctgtgacttaagctccttgggctgtgttcttggtgtatttgaatgtatagtgacaggcagggacagattacatgaaagacccccgaggggggaccctcactcaagtctcgggatagatgcggacccccaagaacacacaagagaccaagcttgatgcaaatcacacgagactttatttggggaaagccagagctctggggacgactcgtatcctatgcaggggtagaggagtcgacccagaagtgaaatggggccctccttttataggccctcaagggggaaaaagggagggggaaggtaggggattccaaatcacatgtctttaagcaaacaactcaatctaatgtgatttcacaagaaatagatatgagaggggtacaaggctggagtcatgtgcaggtgcaggggtgatgtaagtctattgctattggctgatatgtgggggaactcaggattggtcctacctgcagttgctggggaaattttcctattttagcccaacaaccaagtcacttggcagagggctacagcggttagcaaatacacgagttcaaagaatcagtcagaacactggcaaacatt

SEQ ID NO: 24463 - DNA, 1457 bp, Mus musculus
gtaaggcaaaagaaccaagtttaggatggagagatggctcagtggttaagggtactggctgctcttccagaggttcagagttcaattcccggcaaccacttggtggctcacaaccatctgtaatgggatccaatgccctctttaatgtgtctgaagacagagctacagtctcatatacataaactaaatacatccttaaaaaaaaaagaacaagatagcaaagcactctgaagagaggttaagtaggctccccaaggtgggggagaggcctaacggaagactgactaccccaaggtgtgtgggtgggtgggtggggggaggcctaacggaccgcttccaatgaggggttttatgaatatgaggtaggtggaatatttattgggcaatgcgcccttattttcatctcaaactatggtggaccagatctttcattgttaggtccacaaaagggaaggaatgaaaaagcattaggaacttttgtgacatatatgatatttcaatattatatatatatcaaaatataatattgaaatatgtattcagcatatattgaatggtcaatattatatatattgaaggtatgtaggctgaatgtccttgtggtttagtttcttgtattgtggagacaatgtaactgcagcttcaaggaagcacaggtgccaggggtactctgacaaccaggggacagccaccaagatgcagctgtcctcacctctctagttccttggctactggatggtctctgctggaacctcaaggatttctgagaagccattttacccaccactgagtctgttacggagttaggagagtgtgcgaaaggtgtgtgagtccctcagccctcatcggttcggatcagagccttagactgagaccatagttactggcttttctgtagagctgcatgcttctgagtccgtcagcttttctgtttcatatccaattacaaactctattatttttcgccttcagtgttttgttgaagaccaggatggtctcatacagagataatctggcctctgcctctggagtgctgggattaaaggtctgtgccaccacaatgggatctaaagtgttctttatcttcacaacttcatcaaattaattcactttaactcacacatttgctttttaccataatgtgggggaggggtggggagctgggaactaagcctgactcaggaagagaacgaaacgggattggagtggctggagaagtgctctctagacttgcagaggattctgttttgtttcccagcatcggaatggccataactccagtcccaggggatctgatgcccttttctgacctctgtaggtgtgtggtacatttgcaagcgaaacactcatgtacataaagagtcaatcgttttaaaagggtggtcagagaaagcctttatttcttgtgagcgtgatggatctggggcagctggaataagatgtcagtcactgtgcac

SEQ ID NO: 24464 - DNA, 1145 bp, Mus musculus
ctacaaagtttcctgagaggtgggattgctgggggtgggggtggggtaccccaggcaagccataaaatggtcatcatatatatggttatttgatatatagagtccccctgcatatatcttatgggacgggaagatgcagccccttgcccagccactcactgggtcagacagggacattagggaggggaaaagatcccttaccatgtcacatctccatcccttatactttctacccttgcaggcccatggttttggcgcctccaaccctcaggacagctggtatcaccccgccctgctgggttgcaccgcttttgggaggggctgccaacccatgtgaaagtcatccaggctgcctatgcccgacccctagatggccgaatcatcctcttcagcggtgggtaagggtcatgggtactggatagggcaggtctagggagctctccctgcccccttaccaacatgccttcttccaggcccgcagttctgggtgttccaggaacgacagcttgagggtgcagcgcggccactggtagagtttgggctgcccccaggagaagacgtggatgctgtgttctcatggcctcacaatggcaagacatacctgatccgaggtcaaaagtactggcggtatgacgaggtggccgcccgcccagaccctggctacccacgtgccttgagtctctgggatggggcgccctttgccccagacgatgtcaccatcagcaacacaggtgtggagagtcatttgcaaattgtgatccctgggagagaaaagatggagacgaggggagggcagatggggtggggtggggtgggcatcctgggagttggaatgaaaaaaggaacattggctttggggcaagtctagaccaagactctgaggcgtctcctcccctacaggtgacacttactttttcaagggcacccatttctggcgctttgcggagggcagtgtcaaagctgagtcagattccccccagcccattgggcccaagtggctggactgccctgcccccaactctgaccctcgagtcaccagtcccccgaaaacgacatccaaaacccgaagctgtgattgtcactgcgagctcaatcaagcctcagagcagctgtcgcccctcctgctgcctctcctacccctagtg

SEQ ID NO: 24465 - DNA, 1181 bp, Mus musculus
ttcctcttagcactggaccctggtcatagcacataggtctaccccacctcctctgttgctgggtctctgatgcaccgttgtgcagtggacatgcatgtgtccagttagttatcattgcacgcagaggtctaaggctgacatggattcccctacgttgtgaaatcaggacagcattctttgattgccccatcccctgcccccacatcctgcttctgggcaacacctcccttccaggtgcgctctaaggaagatgggcgactctatgctgttaagcgctacatgtcgccattccgcggccccaaagaccgaactcgtaaactggctgaggtaggtggccatgagaaagtggggcagcatccacactgcgtgagactggagcgggcctgggaggagggtggcatcctatacctgcagacagaactctgcgggcccagcctgcagcaacactgtgaagcctggggggccagcctgccagaggcccaggtctggggctacttgcgggacattcttctggctctggaccatctacatagtcaaggcctagttcaccttgatgtcaagcctgccaacatcttcttgggcccccggggccgctgcaagctgggcgactttggactactggtggagctgggttcagccggtgctggcgaggcccaggagggagatcctcgctacatggccccagaactgctgcagggctcttatgggacagcagcagatgtgttcaggtgaggcctgggtgaggactgtaagagccctttgttggtggctgatcagcagacagaaagggactgcctgatagaggagctccttcctggcacagggtaggagggcaatccagcctgggaggtgctgtcactccctgctagctgaaaggtttccagagtaagcagcaagcctgccagaggccctttatactgtaggctagccgtctccttgcagcttcatggctgtgctccaggacagggagagtaatgaggtggagggacttgttaagtccacagttaacatctgggactacagccagacccagggttttgagaccatactggctactactaccctgcctcagtgtattctgttcatctctacagaatgatgatgccaaccctagtaaccatggaaccatttgcatgtcagtgtggttctgatgggctagctgcttgagtgtggagtccata

SEQ ID NO: 24466 - DNA, 1207 bp, Mus musculus
aatcagagccagttaatgacgaagatgaaaagtggggagttgcctgcccaggaggtgcccagcgtctcaagaggcaaacctggcctttgcttgggataccactttcatctgtggctctcacttggggtaccgcttccatttgtggctcacttggggcactgcttccatttgtggctcactataactcattctcatgagctcagaagaactcaagctgagaggtagtacatggcccactcttcaagccttccccagggctggggatagctcctcagcaggtcccctccaagtcttgatctaggccaagcaaacaccattgcccatgagttaccaaccaaatccacaatgtccccagcacttggcaggcggtatgtggtttgtggcagcgcagactattactgacacacagcagctctgtaccatgagactacacagggtttattgagggaatcagatgagcagaagacagcggcaggcaccaggccattactatcccacaggggtggctgttccacggcttgtttgctaagggagaggagcatgcagctctatgacatgatgaggacagctctggccagggtgcagcacgcaggaaattctgccgttcctggggacattagagtgccactgctggcatggctcctgagtcctgctaaactcttctacaggaggtggctttgatgccatctaactgacctggtgcatcatgcgacaccaggtgagcaaccctcagtggtgccgctgccactagagcatgcctacatggtgtcacctcctcctgacatctgggctggctcccaagaactgtggacacaggtttaagttgggaaagaacgcagggtgccaagtctgccagggaggtagagcgaagcctttagcctgttccgctctgccacagtcagagctgggtgagccttagcaagcagcaagagactaaagagcaggcaggcctcacacctgcccctaaaagatgccacaaagcaaaacaaaccctgctgtgacttgcactgtcttcagagggtggcaagaagttcctgcacatatcctggcttggggtgactgcattttgctgaacttcatggagcgcacacgggatcacgcccactggaaagctctgagcaaggcagtgtgctctgaaagcagatggtgctgaggcctggagagcagagcagggcagaggtatatcatccagacacagttctccaca

SEQ ID NO: 24467 - DNA, 1158 bp, Mus musculus
tgtggccaaacagtaaagggatagtgtgaagagatttgagagaacccagattcttgttttcttagagaatggaaatataagtaaaaagaagaatggcttagaatttgaaagtacattgtgaggacttgtaagtagatgctgagtgaaaaggatgaagtgtggggaggatgaaaggagggatttgtttgtagactagtggaatgaggaaacattttgttaatggagattcagtgtgagactaagtgttgtactaagggctaagtaagagagccagggatgtgggagatgtggtaagtagttagattggagccaggagcctgactggtatctacccgcgccccctcaggagcggtggtgccccctgggcacagggccatgtacaacgggatcgggctgccgacgccccggggcagcggcaccaacggctacgttcagcgaaacctgtccctggtgcggggccgccgtggtgagcggcctgactacaagggagaggaggaactgcggcacctggaggctgccctggtgaagcgacctaatcctgacatcctggaccacgagcgcaagcggcgcgtggagctgcgatgcctcgagctggaggaaatgatggaagagcaggggtgagggaatgggtggggagattccaagcactgagtgcttagtttgggtgttaggtgggatgtgtggaaagaaactagagctggtggaaagagtcttagagaagttgtaagggaggaagaaaatgagcttgaagaattgagaagaggcatgggtcagtgcatagtgggatgtcaaggaaactttctggagaattaatagcagtgtaagggggtttgaattacttagctgaatttatgaaggggaaggggaacatgaatgaacaaaagcatgctgtgtgggaaaggagcataaggtagaagagccaggtaacctgataggtgttgttattggtaggaggagaaaggtaggtggattgaaggattgtggctgtggaagtggcaaaggcagaagatcggattgaaagagaatttgaatagaggatatcatgagttgtcagagaagtgatattttggaaaaggagcacattcaggcagaaaactgtttagagcagtggttttcaaactttgagcagtggtatccttttatacattttgtcttcct

SEQ ID NO: 24468 - DNA, 1170 bp, Mus musculus
gaatggagggagagggaatgatgggttaatcaatttaatatttattgagcgcccacggtgtgctaggcgctgcacagaccattccgaagacacggtccctgccctctaggagctgacaggctaaagcaacaggatggacagacatatacatttccccttgtctttttttattttattttatttttattttttgtttgttacgatgtatatggactgccagaatagggcgggggtggtttgctggtttggtggtgtctgagggagaaaggagtccttaccctggcttccttaatcggggaaggcttcctgaaggaggtgggctcagaggtgagttgtgaatgaagtgggtagggaagggcctgggtggaaggtttgggtatattggagggtggtgaataatggggtagagggacttttattatttgggattatattgggaagagagagaacaacaaaaaaggacttgtattttcatttttgaaaatgaattgagtcatgtgactaagaacgtttgtttattgttttgttggtttttttttttttggtttggttctttttttttggaaaaaaaaggttgtacatacaggaaagtggattgctaactgggggtggagggggttttctattcttctttgagctgattttcctggtctcccctgccctccattaactcacaggtctcgaagtgctgctgctaaaattcatacaacagccttgactgggcaaagtcctccccttgcttcagggcatcaaggggagggagatgcaccttctgttgaaccaggtgccaccaacatacaacaacctagtagcccagctccctctacaaagcaatctagcagtccttatgaagacaaagataagaaagaggtatgttctgagttggtagtgttcattgggttgcagggatttatttactcagggatgtgccttaaatgggcaagtgtggtacataatgtagtttattagacaaaaatcttgtcctttagattatggtcaggttcagagatcaaggttgacaagcagctatagaaagcagttacatgtgtgggggtgtatgtgagtggattgggtggtagtttcagagaaaccaatagtgtaagcaaatatgaagatttttagacagtattcaaagaagatacagaatgagagaaagagttctcttcagtt

SEQ ID NO: 24469 - DNA, 1286 bp, Mus musculus
gaactaatggaagtagaaaagtctgagcaacctttaagccaagttctacccagtttatctccagaacataaagaaatgcctggaagtaacattgagtcatctcctgaagtagaagaaaggcctgctgtattgtctgctcttgaccaaagccagtcacagccttcaaaagcagcagaaacccctgcagtggcttcatgttggagtgggccacaagtttctccagagcataaagaactatctcattctcccccaagggagaatagctttgagtcatctttagagtttaaaaactcaggccctgtttcagaagtaaatactggcttttctcctgaggttaaagaagaattgaatggatcattccttaatcaaacagaggcagatccatctgtggacatgaaagaacagtcaaggtcttccaggcgaagcagttctgagttatccccagaagtagtggaaaaggtaggattattttcaagtcagaaagtatcttcgcctgtacttgagactgtacaacaaagaacaccttcaagagaaagaagtagttctgcatctcctgaactgaaagatggtttgcctagaacgccatctaggagaagccggtctgggtcttctccaggacttagagatgggtctgggactccttctaggcatagcctatctgggtcctctcctgggatgaaagatacacctcaaaccccctccaggggacgaagtgaatgtgactcttctccagaaccaaaagcattgcctcagactcctagagcccgaagtcattctccatcatccccagagcgcaacaacaagagtgtcacccctcagagagaaagaagtgggtcagaatcatcagtagaacagaaaaatctggctaggacctctccgggacaaagaagtcgatctgggtcttcccaagagcttgatggaaagcccagcgcgtccccacaggaaagaagtgagtcagactcttctccagattccaaacccaagactcggactcctctcagacagaggagtcactctggatcatctccagaggttgacagcaaatctcgacactcacccaggctcagtaggtctggctcatctccggaaatgaaagataagccaagagtgctacagagggctcagagtggtactgattcttctcctgaacacaagatacctgctcctcgggccctgcccaggcatagtagatcaggttcatcaagcaaagagagaggtccttcccctgaaggaagcagtagttctgagtcttctccagaacacgcccccaaatccagaactgctcg

SEQ ID NO: 24470 - DNA, 2537 bp, Mus musculus
gagccaactgaaaagtcaaggtcttcacggaggaggcgctcagtttcttctccccgtaccaagacaacttcgaggagaggacggtctccttcacccaaacctcgtggactccaaagatcccgatcccgctcacggagagagaaaaccagaacaacccgacgcagagatagatctggatcatctcagtcaacatctcgaagaagacagaggagccggtctagatcacgagttactcggagacggaggggtggctctggttaccattcaagatcacctaccagacaggagagttctcgaacctcctctagacgcagaagaggccgctcccggacacccttgaccagtcggaagcgatctcgatcaagaacatcaccagctccttggaagcgctctagatctcgagcctcaccagctactcatcggcggtccaggtccagaacaccactgataagccgacgtaggtccagatctcggacctcacctgtgagtaggagacggtcaaggtcagtgaataggcgtagatctcgatcaagagcatccccagtgagtcgaaggcgatccaggtccagaacaccaccagtaactcgtcgtcgttcaagatccagaacaccaactcgccgtcgttctcgttctaggactcctccagtgactcgcagaaggtccagatccaggactccaccagtaaccaggaggcgatctagaagcagaacttcacctgttactagaagaagatcaagatccaggacatccccagtcacccggagaagatcgagatctcgaacatctccagtcacccggaggcggtcccgttcccgaacctctccagtgacaagacgacgctccaggtctcgaactccgccagcaattcgaagacgatctaggtctcggacaccactgttgccacgcaagcgctctcgaagccgctcaccacttgctatccgccgccgttctaggtctcgtactcctagggcagctcgaggcaagcggtccttaacaagatctcctccagccattcgtaggcggtctgcatctggaagtagttctgatcgttcacgttctgccactcctccagcaacaaggaatcattctggatctcggacacctcctgtagcactcagtagctctagaatgagttgctttagccgtcctagcatgtcaccaactcctcttgaccgatgtagatcacctggaatgcttgaaccccttggaagcgctagaacgcccatgtctgtgctacagcaaacaggtggctccatgatggatggtccaggtcctcggattcctgatcacccaagatcatctgttccagaaaaccatgctcagtctagaattgcacttgccttgacagccatcagtcttggtactgcccggccacctccatccatgtctgctgctggccttgctgcaagaatgtcccaggttccagcacctgtacctctcatgagccttagaacagccccagctgctaaccttgccagcaggattccagcagcatctgcagcagctatgaaccttgctagtgccaggacatctgctattccggcatctgtgaaccttgctgactcaagaacaccagctgctgctgcagctatgaacttagccagccctagaacagcagtggctccttcagctgtgaaccttgcagatcctcgaacccctgcagcttcagctgtgaacctagcaggagctagaacaccagctgcattagcagctttgagtctcacaggctctgggacacctccaactgctgcaaattacccctccagttccagaacaccccaggctccaacccccgcaaacctggtggtgggtcctcgatctgcgcatggcacagctcctgtgaatattgctggctctagaacccctgcaggcttggctcccacaaatctctccagttccaggatggctccagcattgtctggtgcaaacctcaccagtcccagggtgcccctttctgcttatgatcgtgttagtggcagaacctcacctttaatgcttgatcgagccaggtccagaacaccaccatctgccccaagccagtctagaatgacctctgagcgtgagcgggctccttcccctgcttcaagaatggttcaggcttcttcgcaatctcttctccctcctgcacaggatcggcctcggtcccctgtgccatctgctttttcagaccaatctcgttcagttgtccagaccactcctgtagcagggtctcagtccctttcatccgggacagtagcgaagtccacatcctctgctagtgaccacaatggcatgctttctggccctgcccctgggatatcccatgctgaaggtggggagccacctgcctctactggggcccagcagccttctacattggctgctctgcaaccagctaaggaacgtcggagctcttcctcctcttcatcatcatctagctcctcctcctcttcatcatcttcatcgtcatcctcctcttcctctggctccagttctagtgattcagagggttccagccttccagctcaacctgaggtggcactgaaaaggtgaggcaa

SEQ ID NO: 24471 - DNA, 2975 bp, Mus musculus
gaggtttggtcagctctgtgccactgctccagagaagtactactcactggcctgccttcgtgttttcccagggcttttctcaggcacccctcccccactgccgttcctccaggccaaggaaggtagggttggggttggggcatcttgtctccttgtgacacctttcttctctcacagggttcccagccccaccccagtcccaaaggaggctattagagagggacgtcctcaggaaccaaccccggccaaaaggaagaggcgctctagcagctccagttccagctcctcctcctcctcctcttcctcttcttcctcttcctcctcctcctcatcttcctcctcctcttcttcctcttcttcctcctcttcttcctcctcttcctcctccccctcccctgctaagcctggccctcaggcattacccaaacctgcaagccccaagaagccaccccctggcgagaggaggtgagtgctttcttgcctgttgtggaaggggggttggggtgagttctccagaaaggggaccctgggtgaggttcctgctggggtgcctcgtgtggacgtctgtgactggttgtacgggagaaggagtgccggactcctcccatcctcccacagtgttgtattctggtcaagggctgcactatctaactgaggtgtcccaggccatatctgggaagtcataggattcttcctccctctcccctcccctgacaagcagcctggtctcagagatctagctctaagtctccccattgctgctgcagggctctggtctggccaccgtcatcttctcccgactctgtccacagcctcctccctgtctccctgcctccacgccattctcttccacacgtagccagagggatctttctaaaacgcacatctggttacttcccttcactccacaaatccttccggaacgccctgtggcctgcaggataaagtgccacctctgcgggaatggcgtgtgaggctcttcaccagctgcccttgcccgccctgtgctcctcctgcccgcccccacacatgccccgtgctccggccatacccagcgccttgcagtctaaggagagccccatgcctttggacatgctgttccttctgcctgggatttccttgtctgcctggtgaactcgttctgcaagactgcattcaaacagcacctccgagaagactgccctgccatttccctgtcctgcccaggtccccatcctttctctggatccccaggcccatgcatatccatcctgctgggctgtttcctatgtagggggcgtgtgtgccttcattgttaacctttactaccaaacaaaattcttccaagggcagggactcttttatctttgcatcccccgctgcaccctgtgccctgtccactggggtactcggtggatggtgtgcgggcggatgggtgagtgcggacaaaggtgggtctgaggctggccctgtgtggtgtgaggtttggtggtcaggacctgggtgggtggtcctgaatgcttggctggtgggtttgggaggatgtggagctatagaggcctactctgcttcctaggtctcgaagtcctcggaagccaatagactcccttcgggattcccgatccctcagttactcacccgttgagcgtcgacagccctcgccccaaccttcaccaagggatctacagaggtagggcctatagcaggtgctagcaacctgactcaactagctaccattaatttgtaagcaaaatttaaaagtttttggtattgttctgtgacctaatttctcctcttgtagcagtgagcgagtttcctggagaggccagcgaggggacagtcactctcctggtcacaagaggaaggagacacctagtccccgttctaatcgtcaccgctcctccaggtgtgtctccttggaagtctggcccttctgagagctagtagttagggatagggatatgtgtggtgacccagaatgaccagtcttctctattccaggtctccataatctggattccactacacctcatactctggagacatgagtattcctcatttttcccagaagaatcatggaaggagtctttgtatgccttcccttgaaccttggcagcatcttgaggggagagcgtcctctcccacccaccctttttttttttttttttttttttggttcctgtgaaatgttgatctctgtgagtttttcctggttcttgtgttttgggggttggagtgggagggagggagtctagggagggaggggcacagctcaggacatctaggcctcagattgtgatgatccagggagttagctccctaaattcttgggtgactgatggtttaacttggtaagttgtaatctttcctgaaagaggaaggagctgaagttggttggccctgctgcacccccttacaaggttgtgaggccctctcccccccaactttgtttaaggcattttggttttttaaaatctgtacagtaaaagcaactttttctgtcaaataaaaatgagaaatgcagtaattggtctgtagtctttacttggggttaagagttctgtgaacaagagggaacagaaaagtcaatcaggtagacagccaaattttttttattggggaaatgggtctctagggggtaggcctaggccctcactgcacagcttgttcattggcactgcctccagaatcctgtggcttcatcacatctggaagctctggagggctggaaaagggctcgatgcggagagcttcgaaggtgtcatctggggaaggggtatagaagattctcagcgtttccattcattgacttgtatcaaccatcaaggccataaccctccccaccttggttgcctgacttggcaatggtatgatgacttctgtcctcagaggcctaactttgcctctgaccccattacatgtcattgataaagacccccaacccccagctttgtgcttgtctggcaagtatcaacctcagaattctttaatcctgg

SEQ ID NO: 24472 - DNA, 1791 bp, Mus musculus
tggtctcactattctttctgagtgctacgtgggactgaggcaggatgctgctaaccagcccgtgcattcctgaagatgatttgaaggacagggtccttggtgctacacacagtctgcaacaagcagcctggaccttgccaggagggaggggcagccgccgcaactcctgtccagtgcactgtggctttgggggtgggtgcctgctcatcactgactgagcaccaggcgcacatccttgagtcagggaggctgctctgcctccaggcatgattggttgatttctctcgacctcagctgaggctcctgacaaaggtggcctccacgttatcactacttctgggcaccacccctggacattactccttcagagccaggctcttgttctggcctgtcagcttggcccaggatcatcaaggcttcttaatttgtattttccaggcaagaggactttgtatcccttttttaaagtgtggatagaccacccggtgtttatactctttagaaatgcctaaaagtgttgctacattttggattgatctgttaaatcatttatgctcccataaatagaggttttgcctcatatgtctcgcctgtgggctcatgggggagctggcgcctaccagtgcctttgttgtgcctgggatagaggctggggtgggaggcctgtccacctggcttctggaactgacactccaggtcatgttaagcattcaggatgtttacagtgcaaacatgtctccttctcactggctctcatttccttgtataactatgcagttcttctctcgtatttctggagtgtttgggactttgcacaatttgcatgggctctgttcatctgatacgacattggagctgctaaggttcctgcagaggctgcgcctgctggcttgaaacagaccttctcagctggttaggggattgtagcaggccacaaacttggctcaagcaagcaagctctgtgcttcttgaccttcccaagggagctgtgcaaactgaccactatggctgcccatgtgcaggccagggcctctgacactgcttgtttcaaatgcttccggaaacttcttgcctagaccctcttccttctcctctgccagtaactgattagtcaagttctccagcatctaggaccgacctcctcctttcctaaggtctgttgtatgttgttaaggtgtggcttaatcactctggggcagtagctctgctgttggccatggggatgctctggggagtggctggacactcagcattgcttcatttatgactttgacaatagataggcttctgggggtttttgtttctgtttttttaatttaatgatattaaaacttaattcactaaaatcctaaggggatatttatacttttatacttttttaggtatccatattttatcagcttaccgtttaatgcctaagtttcccctggaaatagtaaataaaattgtgtatttatgactgtgttcagcaactgtgaatatcttgaagtgtgtggagaagtgttgtcaatccggaagtgtgtcctggtagaccaggatggtgtgctcctgcttctagagcaaagcctcttccaggttcccaacagggatgtctctgctgtgcagcccctgacccttgtatatcctgtgtcctgttgtgcagtcaacccagccagattgctggcccaaggctgtcctgatgcccaagctgagataagcatggggctcctgtacagtgctcagttatctgggccgtgaggtaccctgtgaatgcctgagaacaagtagggttaagggtctggatcccgctct

SEQ ID NO: 24473 - DNA, 1182 bp, Mus musculus
taatgctaaaaatgtcattactgcagattcctttgtgacagattttttttccaaaagccagtcttttcatttgcattgcaagaatctgctcctgcatgttacttcttttccatctttgctctaaggcttccaagtgcttggtgatgttttcagaatcttgtactttgtgtccacgatggtactgaatctgcttctacacagtcagcagagataaagtgttgaactgaccttgctacatgcctaatggataattcataattaagtttatagactcagaaatgcatttgggccatttgggaatcagtagcaaagcagaatagcaaagctcttcttggaaaagaaaccacacagatgattgagttttactaaaagtacagctgtgagtgttcttgctccacacctcaggtcttggttcaggacagcacagtggctaggctttgtcattgccaaggatgggtatccccactgatgcttatgtaaaccttcttgtgcgctgcagtgctgcacggaactgtagtgcccacccaaatcagatagtagctttatctgtgttgggtggggcctgctggttcaatttggaaacatgcagcagagattttctgtgttacttgactgtcagagcttagggctggagatgtgtagaaatcagtttcctgccctcctctgcctcaaggcttctccccattgttctatagacctggggtgttcatctgagacttgggaggccacagcaactctgaatatggtgaagatactcctatacacgtttctatttgttttaatgcaaaacccaacataaactggtgctgatgccagtgggtgtagcacctcgtgggtagaaggtaagacaagggccctgacattgaacagggctggaaccactctcagaacctctgaagatacctagcttctggcctaacacttcagggttataagtcagaatgtggaaaaatggcctgcaatgtgagggaagctgtttctgtcaaaagcacttttgcagcagtaagcaaatgaattaaccaatatgaatacctgaaaattccctgtaactcatttcttccatatgaagaatccaaactgaacaaaagtttttacaaatagcaaaattttccctccccatgtagtccaccctagtttaatcatctgggttaatgactacaagtaggtcattgtgcaggttaa

SEQ ID NO: 24474 - DNA, 1044 bp, Mus musculus
cacaaagctggctgtatatgggagagtcctttgttgcttccttccctggagagcaacactacctcctgggctttaccaagcaccaccctaacctctaaaatcagagttcagctgagctattagtagtgggtggtcaccatgactgcccaagctacaacagctgatctcttcccaggtcacctttgtccttactgcccccttttccttgatttttttttcctttaatgaaccatgtacattcatttcttaacctggcttaaatcaccttcatttttccagtcatccttagagccgtcaccctgtgtgaaggtgccttactttgtaggacaggatgtggatgtcagtttgtacaactcgtgtgtgtgtgtgtgtgtgtgtgtgtgtgtgtgtgtgtgtgtgtgtgtgtgtgtgtgaaacagtaaatttgggatgtatgtaaggagagagagaaataccctgttagtacctctagaaatcatgtgtcctaggaatggcaaggatggaaagaaagttgaagactgttctctggcttctcctacctaggtacagcagactgtagtacctcacagcccacttgagccctggcttctctcagcatcacagatgaaacttagcttgaatgggtcaattccacctgtttttctgtgctccagctgggcagtgggctccccatgtagagctgagcctctccacttcagggtgtggcatcatggctcagatgtcattttgagctaaaacccagttagatgcagtaaaaaaccactttgagagatggcttgtgttaggctgaaactgatagaaacgttaactgctgcagctctctttgggccaccctagtgtttgtgattcatgcttgaagtaaccttgccgacagttgtgtggcacagactcccagtaccagcaagggggccgtaggtaattgtgtgctttcttaaagaagtgtatgttttctgaaagcaaaagaataaaggaaggcccgtcattcagagaccactgtgaacatttggatgtagatgctgttctccctaactctttgttccagtg

SEQ ID NO: 24475 - DNA, 1184 bp, Mus musculus
ggggcagtgccttggtctgaggcaagagtcctagttaatcttgacttttttctgccatggcatgaacaggcctggggatggaccacagtgtcccaagcctttccagtaggtttcagggcttgaaaacacttccacaaaataaacaaacaagtaattacatttcaacccttgccttgacatgtcttggctatcatttaaggttttagatgccacaaagcgtttaggctgtgaagagatggaagggtacgggcctctcaaagctcatccattctttgagaccatcacttgggagaatttgcaccagcagacacctccgaagctcacagcttacctaccagccatgtcagaggatgatgaagactgctatggcaacgtaagctggcagacatggggtgtagcccaggcaaaagaaattctgcttgccatgctatgtgaatatgactccttgggaccctaatttgtgttattactggttgaaatgtgtgagtgattgttgtggacctggtgatggttgactgctttgctgtaataagtaaatgcccagcataccttgtgtaggctgattcctgttcttattcctcagcggatgagcttttacctgtttgggggatagatgggaggcaggatgtggtctggacctgtagatgagaaagtagtgccctgctataaccctcactgcctgacactgggtcttctggaaagctcagcgttgctagtttgtggctcggagattttctgattattttttaaaaatgctctggaatgctttttcattttaccaagagatcccagaatgctattgatttagtttccaggaatgtgatgtgggaagatccctgtagcttgatgcttagcagtaggtgcctactctgtttccaggggtaccacctgggtttgtgggcagttgctgtcactggcttcaaagcagcttgtcttgaaaacagacacaagatcttaaatatactttgtttttaaaacttcctctcttgataactgggaaataccagcaaaaaaaaacagataaaagaaaccacagcgtgcttccatggtttcagttttacttgcccagactcttctttcattatgacctttatatatttttttaatagtttattgattcaaatcagttttcctcatttgatttctgttttcttggcttgttttaaccagttgccatgcataga

SEQ ID NO: 24476 - DNA, 1174 bp, Mus musculus
gtagagggttgtctgtcagtggtgacctcccctgcctggacctgtcaggtgctgctgagagagccctgctgtacccacagcattagagtaagtggtcatttgtggtgggagatgtggcctggacttctccttccctcctctcccaccacgactcttctccccacacttcaggtctccttagagaaagctgccaagcatgtttttctgctctttgcacccagaataatgtgtccataggttcccctgttttagccacctatgattaatttttgtcactcattcataaattaatccagcaaatctttcttgagtccatactgtttcccagatagtggaggagtctcagggaacacagcaatatatccctgaccatgtgggtgtcatgctctggttgtcacgatggctcctgcaactccaaatttctccacagttctttttctgcacccagcttctaggatctcttgtatgaagaccttgcatgtgctaaagctggccaacaggtgtgtctgcactattgcaagctgacctcggctttccttgtctgatccttcacaccagcgtctcacagtcctgtgggggttagcctcttacttgtccagctgaatcaccttctgacttcttttttttccttttaggcatgctattctgtacaatgtcttgtcctcccattacgtaaagaaatccttccagcctctgatgttgctgctgggagaattccaagcttcgtctcagtgactgacccttggtctcccttggacttaactaaccaagttttcagaccattgttctttaacgcatccttgaggcctccgtttcatgctaacaatctaacttccctttttttcccttatgacaaatatcctgttctttcctcatcatgttctccatgaaactgccagttacttcttttctgtattttctgtgacttcctccctgtatttgttgatttcctggaagtgcctccagaccatgctgtattaaattagcattctcagcaggtctcccttctgcagcctatcatgcttgctcttctgggtagctgctactgtctgggcctgggctaaatttttttcctccttttgccctgatctccgacagtgtccctgttttccatcctctatcttcttgtcacccatcctcagctccatgatctatactttggggaaggacctga

SEQ ID NO: 24477 - DNA, 1174 bp, Mus musculus; identical to SEQ ID NO: 24476

SEQ ID NO: 24478 - DNA, 1852 bp, Mus musculus
gagatgctgaggattgaacctaagaccttatacattctaggcaagttctctaccactgagccatgccctcagccctacatttatatattgaactgattttcagtttacatcagaattgctgagatggaatttatagactctcatccacttgtctactataaacatcaaaaaacaattggcctagtggcagactcttaatcccattattcagaaggtagaggtagggggatctcagagagtttgaggccatcctgttctatgtaacaggttccagaccagccagggctacataataagaccttgtcttaaaaatatatatgtatatgtgtatatacacatacatacatacatacatacatacatacatacatacatacatacatacatgggctggggataaagagaaggctcagtaattagagcactgggccttccagggtacccaagttcagttttcagtatctatatgatggcttacaactatctataactcagttcctagggatctaagccctttcttggcttctgtaggcactgtgccaatgtagaacacagacacagtcaaaacactcataaacataaaataaaaatgaagggaaagataaaacagacattattgtggtgcagtgcccctgactgtacaggaatacatgcagttttacagagacctgctctctcatatcttcactaaatctagaaagttacagattgtactagttgttttgtttttaagtcactattgaggttgaagttctgtagcaactacctcagagagggctagctcctccatagctctattcaggtctgtgtgacaaagttgttatgtcaagcatgagtgccaaacaggctttacacttctttccccacagtatttccatcaggctggaaagcatatgaagtgtaaaggataattttggtattaagattcgtatctgggcctggtgtgtgtctataatcccagcacatggacggtagaggcagaaatgtcaaatcatctttagcaacagaacaagttcaagctagctatggctacaagagacctgtctcaataaacaaacaaacagacaaataaatggagtcttttatgacttcccttgttacatcaatctttgattgtgctgtaggtgttagatgcagtgtctcatggctacgttgttacagacaaatgatacttgtttgaaggcttggtcatttattgatctgcatggaaattgtgaatactgtatgtaggactaaggaagcagccagtggacacatggataggctaatctgtgacatgtcaggaaccaaccacaacaaaaggaaggcatccattggtgtgctgcttgtctgctctgcagttgctgcctagcctattttcctatgtgaagagaccagagcacctctgctgtgcattataccaccacattggagatgcgctcaggagcttatatgctgaactcgatggctcataagagcactggctgagtggtgccttagttccagtactcaagagccaaaggctggtgggtctctgagttcaaggtcagcctggtctacagagtgagttccaggatagctagggctaaacagagaaaccttgtctctgggagtagggtgggggagcattgtctgcttgtctggataatcccggtttgatttccaacacctaaattgtggttcacaaccatctgttactccagttccaggggatctgacaccctgttctgggctatttgaacactgcatgcaagtggtgtacagacgtacatgcaggcaaaacacaataaacataaaattgaaatataggtttaagccgggcatggtggcacacgcctttagtcccagcactcgggaggcagaggcggcaggc

SEQ ID NO: 24479 - DNA, 1166 bp, Mus musculus
ctgtctggcgtgcttgagagtcagcatgtgtcaggccagtgcttgtctccacgctgagattcactttcgctggggaaggtccatccttccctgttccaccaattcacaccagctctctgcacggccacagtggcagaagaggcagggcagaaaggagcctcatgcatctagaactctggattctgcacagtggacaagttcccccaccatgctggcttccaggatgggttcgcgtgactctatagagtgaagaggaaccactgttgctcacctctacagaaggttataagcctcaatgcccacttcccctgagcccactgccgaggcctagacctccaactctggtgttcatttaacaccatcttgatttttgtttctggcaagatcttactagttaacctaactggcctggaactccctatgtagcccaggctagcctggaaattgctatgtagcctaggttagactcaaaaatcatgatctccctcagcctcctcattgctgggcttctaggtgttaggcccagctgagcgctttgagtttgactgcctccgttctgagtcgggctcctgccagaaggcccccaggacgttcccaggctgagctcttgccgctcacccatgcattaccactgagactcagaagccttcagaagcaatgacgttaattgggagtatgtgcggggctctgcagggttccagactggtggtggaccttgtgttctgtgtggcccccactggcagtcccaggggtctagcccaaggagactgatggatgctgagtcatgatcacatcacaagcaaagttcttagcttttctcccacaacatacccagctctttaaatttaatgtcctttttttttctgacttttctaccaaaaggtgtgtattgttttctttatatttttattcttatcactgttcttatctgatactactaagtgttctcacttagtatttattttattaatgttttctattatttattagcttttgatgttaaaaaaaaaccaagccaaaatgtgatggcattgtataagaagttatattttagcagcattcaaacatttgtttttaaaacaaatacttaatccaatttaagcccattcgttaaactaaccaagtttgttaatatatagcatatgccgtcggagcctcagaagctc

SEQ ID NO: 24480 - DNA, 1229 bp, Mus musculus
agggtcccaagttctaatacttaagctataaacaccccacattttctcagtcacagctcccagcagactccttgatgtcactgtggtctacctgaacccagaagaacattgctgccaggagtccagtgatgaggaggcctggccagaggacaagatccacccagcaccaggcacccaggcacctccagcctcagctcccaggccccttctctgcaatcggggagatcgggccaaggacattacgacctcaggatactcctctgttagcagctcgagtcccataagctccctggatggtggcatggggggctctccgcaatctacctcagtgctctctgtgggcagccactcaagcacaaagccttgccaccatcaggccaagaagtcatgtttacagtgtcgtcccccaaactccccagagagcggtgttcaccagcagcctgtaaagcgccaaaacctgtctgtacacagtgacaaggacatgcacctggcttcctgaagctcggagtgtgttagccttcactatggtgaatgtttactgagggagggctgctgtttctctaggacactgcctatgggtactgtgtagatccttaggggagttcagtgcaagctgtcaggacactgagctcagtgaccagctcagcctctacgtgttggacagcagccacccagctgtcatgcgcacctgtgaaacccatccctgtctacccttctgtgtcctgttgtctccgggagcatgagcctctgtgttggcattcactttctgaggccaggagctgacagcctccttggaatactagcggcccaggtggcctaacacagttcaaacccttgctggcaagtcttgttttagaccagtggggagctctcaagtgaagacagcactctcctcccacaccccttcagcctagggagcctgtgtccctgcatatcagtgttgactgtagcctaatggtgtgtgaggcccttaaagctggagttgcaggcatccctgtccctcccaaagtggtttgtctgtgtcccattgtatccatgtgaccgtatctctgcactgaatttcaaggccattctttgcctgtctttatttctacatttcttctaatggggaacaaaaggaagcatttgaaatagagggtattgaataaaaagataacagatccccaatattactgtgcttcaactgaaaaaagaaaaaatctagtcctgcacagtgcctctcccgactg

SEQ ID NO: 24481 - DNA, 1135 bp, Mus musculus
tgccatgagagaagaaggaaaaggagacgcagagaggaagaggggagctggacggaggggtgccgggccaagagaacagataccaacatggctgggttatgtaggggtcagagctgctggaagggaaggccagcccctggactgtaaaaggttcagggtagggttggggcaggagtgctgggaggagctataggtattcagtgagacttgtcccaggcttcttcgggacccgacacttgtacattcttgtctgtgctctgtagccatgcctctcctgctgggtctgaggatcctgttctgaccccctctttgtagcccctggatgctctttgatagtcagaagcaagtggattcgctccatagcttccttttgccacctgagtctggagccatcccatcatgcttttgccttgaggctttctgagctatggcccctcagctcaggcctgagagcccatctctacgttccaggttcatcagcaaagagattctgacgattagagaggctgtgtggctcacagacaacacgtataaatacgaggacttggtgcgcgtgatgggggagatcatttccgccctggaagggaagattcgggtaagtagggcttgactttctcctttgagcaaaagtttcttctgtttgaggtcacgggggggggggggggggcgggcggggggcggggtggctgttgcgggaagctgaggccattgagcgctactgctgtggagaaagcaccaggaagccatggctgcggtgtgtcattagctgccctgaaaccctgagcttggttgggccccagcatgagcacctaggccaaaaccctgctgggctgtgcctcagtgtaacactgatggatgagacgtggcattttcctccctcttgtctagatccctaccgtggttgactataaagaggtcctgctgacactggtccccgtcgcacccagaacccagcacctgtgcagcttcctctgtgagctcaccctgctgcacaccagcctgtccatctatgccccagcccgcctggcctctgcggcccttctcctggccagactcatgcatgggcagagtaaggagaggccttcttgggggctgtggagggtgacctggtatcttggggaagtcttggatgaga

SEQ ID NO: 24482 - DNA, 1128 bp, Mus musculus
gcgtctcctaagtgttggcacatctcagtccaccctcatctgactccaaggccatcgatgcgccatttcataacagagaaaacttgggactggagagataccctgtggttaagagctccgcctgctctccaagaggaccttcgggcatttcccgtcagtcacatggctacttacaatcacctgtagctccagttttagggacctgacactttattctgctctccttgtcaccagacacacccatggtgcagacatacacataggcaaaacactcatatatataaagatttgtaattatttgttttgtttagtttagtttgaaaagtaagtcctagagctcttagccatgctgctaaggaagcccaggctggccgtgtgtactgtgtggctgcctgctgagcccctctgagcagacaggccaggacttacactatgccttatctctccccgtagctggctttggccaaagcctgtgcaggtggaagccaacttggactggaagggaaggcctgcagtgagtcggtctgccagctcttccaggcctcccaggctgtcaacaagcagcagatattctctgtgcagaaggggctcagcgacaccatgaggtgagaccttcaagagctgtgtttgacctggtggcgagcaaaacttgtattacctgtccctgggcaacaggccattgctttaccaactgattacaatctgtgagcgggtgagctgtttagtaatttgatgaagaaagtatttccgctccacattgattgatattttttttttacttttccccccatttctatgtgttcatgtatgtagggtgcacacatgtgtacatgcacataagacccaaacttgatgtcacgaatcttccattgtttcttctactgcattcaataaggcagggtctctctggcaaaccagagctagcctaacagtgaactcactgtattgctctggggctcccaacccagcctcacacaacagctggagttaacagttggtcaccacacacagcagctggaattcacagttggtcaccacacacagctggcactttcatgggttctggatccaaatgccagtgcttgtacttgttcagcaaatacttaaccatcttcccagtcctgttgt

SEQ ID NO: 24483 - DNA, 1182 bp, Mus musculus
ggagccgggtaggcgataggtcatacggaacggaggccggaggagcatggactcgggcccctgtgacccgggagtgcgcgtcgcatcccccaaagcacggggtaggcacgtatccccgactgcgagcccgcccgcgcggtttaaatgcccgcccggcgcctatgcctctcctgttaccccagggctatttaggttctctacttagcaaactacgattttacttatctgtgaagtcgtgggcaatccacacgatatagagcgatctcaggccctgtccggactcttgtgggcggcttgatcacctgagggttggctgaggccacaggatctgccccgtgaaaacgtctcacgacctgggggtgcgatttcacttgttagagtggttaaacacttccagacatgctctagagcacacgagtcaagaaactgttatgataatattcttagaatgtttgggaattatagctctctgggtatacatttggcctttgctgtaaatttggtttccaataagactcaggtgaagagtttgggagtggacagtctcttagagacctcctgatggaaagcccgaggtcagccacttttgcctcagtgtgaggaggaaaaataggtagaaagataggcgcatttataagtaggaaggcaggaccttggggggggggggtaatgtgggggccctttgtgaaatagggaaaaaagccataggcgttgaatgaagaatgaattgctgaagtaaatattggaacaacccactgtggaggagaagagctcatctgaagagcatgtctgggtccagttgctgtgtgcctgagttctcaacatgtgggcgcgactccattgggggggtcacacgaccttttcacaggagttgcagatcagacatcctgcatatcagatatttacattaagattcataaccgtagcaaaattacagttatgaagtagcaatgaaggtattttatggttgggggtcactgcagcatgaggaactgagtgtattaaagggtccacggtgctaggaaggggtgattttgcactgtaagctgagtgtggaagacccctctgtttggggactggggagctctcaccatctgccaagctgagagctgctctgggatggatctggcctccatgttctacagaacggcctgctaatttgagttcccagtctatgctatg

SEQ ID NO: 24484 - DNA, 1189 bp, Mus musculus
acatttcaaagataaaaagcagagacactgagctgctaacctgatggagaagtgggtggtctgaataaactcaggtaaagccggcaacacccaatcaggagggtaccatgcgtcaaagaatggaagtcaggtgtgacaactggatgagacagaaggtgaaggaagccccagggggttcctgagagcagcaagtggagaaagcacttcccagatcagcctctccacatgggaacaagcctggtgactcacgtggacagtttacgtccagtttacgtccagttcagcggctctatgttcatggctaatactaaccaaacagcagctctcagtcagatcattcatgagtcactcattaatgtgcaaacgctaacctgctgctaacttagcagctggagactgcagagcacatggggggaagagctaagccctagccaggcagtggctgtgcacatctctatgcctagcgctctggaggcagaggcaggcggatctgtatctgtttgaaccctgtctcaaaaccaccaaaaaagtgctcgcttcggcagcacatatactaaaattggaacgatacagagaaggttagcatggcccctgcgcaaggatgacacgaaaattcatgaagcgttccatatttttagggcccccaatggaggagctagagaaagtatccaaggagctaaagagatctgcaaccctgtaggtgcaacaacattatgaactaaccagtaccccggagctcttgactctagctgcatatgtatcaaaagatggcctagtgggccatcactggaaagagagccccattggacacgtaaacgttatatgccccagtacaagggaacgccagggccaaaaagtgggagtgggtggctaggggagtggggggaagggtaggggggacttttgggatagcattggaaatgtaattgaggaaaatacgtaataaaaaatatttaaaaaaaaaaaaacaccaaaaaacaaaaacaaaaactccacctggccaggagcagtggggtgtgcctttaatttcagcacttgagaggtggagacagaggcaggtagatcaccatgaattttgggccagtcagggccacatagtgagatcttgtctggaaaaaaaacaacaacaaaaacaacaaagacaataaagacccacaaccaccaaaacccacagcacaccaataaacct

SEQ ID NO: 24485 - DNA, 1163 bp, Mus musculus
ttccttaaccccacctgatgagaataaagacgaaactgtcccttgcaaccagtatgatagtcagtccctactgagggagcgtggcagtgttaacctaccagtccagagaagctttaaaaacatctacccacccttggacaatcactcaaggtccctttcacttgggggttttacagaaggtctctgggtctctttagataaaaccaactaggacagggaagaaaatagcagctgtttgggacttcactatgtctttaaaaaataaacacagaaagctctttactttctggatggtaaaactgagcaactgtctcacctgtggtggtagccttccattgatcctgcatatttggcattgagaatatgatactgctaggcatggtagtgcagccctttaatcccatcccttgagagacagaggcagatggatctatgtgagttcagaacgattggttgtcaattctgtttctacaggtgaaataccacctgcgcttcagttacacacgaagaaattacatgtggacccaaacaggaaatattttcctaaaagagactgaaggctggcataccacttcactttttccactttttccaagccccggaccgcgggaaccttcatcacctgatggcggtgaacctggtgagaaacataaggctgatactttaggatgggctttcacatctggaaaattaactaagccgtgcaggaggggtctgagctgagcaaggaaggccttacacttgtcagtagacctgtgtcaggagaagctgcggctgtcacaacagttgccgtgtcaaccagctggttctggctgaccacactgggatgtagttccccaccctgtcctgtttcttgaaagcagaaaagaatctcctaagccaggcacagtggcacacgccttaagtctcagtacatgggaggcagaggcaggcagatgtctgtgctgtagagatcagcctgtcttgtatagtaaattccaggacagctaagagatcctatctcaaaaaagaagatctggaactggagagactgctccgaggtgagagcactggctcctcctccagaggactggggtgaattcccagcatgcatgtggtgtctgaaactgtccatagctccagtccaggggatcagtgtcctctggtctctgcagacaccaagc

SEQ ID NO: 24486 - DNA, 1356 bp, Mus musculus
tgagccagatctccctggagcaggtctttctgagctttgcccacctacaaccccccaccactgaggatggccggtgaggagctctgctgcctccagagcaccaggcgtggaaggggcaaatcgtgcttagccgtgcgtcctctccctcccagtttctcctttctttcatttttaatcactcttttctatgatggacatgaaaaacaatcaaggtgatatgcacaaagtggaccatgtgtgtctgtcagtgcctgcaggcaggagtcagcatgcaggtttccactcctgaagtcaggtctctggaaccacagtcccagaccccatcctgctgtgcacacagacaggccttggtcccagctggtactgcagctagcctgggggattgagcttctttccagtgcttatccagagagaccccagggacctgtctatgtttacatatgacactaagctcccctagggggggaaagaaagccaacagggttgagcagcaacaaggacttccaggctgccaggaatgagcagcaaagttgcaaataccttcatgaagggaagatactggctatgactaggtgctgagaccattggctcccaatgcaactgcacaggcatccttggatgtcaatgttccttccagtatggacagtggaccgggctgatctgatcctgagccagatgtcatcccacagagcatcggcagcacaagagagagctgtggccagacttgaagcacatcctctgttcctagctctgtgccttcaagaagtcactggccacaggattgtcagggaccactacagggctgagtagtgtcatctcttgaggatacacttaaacatattgtgattctataaaaaataaaggataaggggacatgaccagtctttgagtcatacatatgatatgaggaggggtcatgggactagatcattaccttccagttccacatccaatatggctttcataccaagtttcaaacaaaagcaggagttggctttcctagcagagaggaagcttacaggattcactgctgtgaagtgaaggattaggcatgaattactttccttgtgataaaatacttgatcgaagtaactcaaggaaagctgtgttttggctcctgattcaagggcacaaagggacaaagctgtggccctggcagctaggagggattggccatgccgcatctgcaggtaaggatgctggccctcacccttgactcccttcttttcagtccaggaccttagactgtggaatgttgtcacccacatttctcatagctcagtctgccaaggcagacactggcactagaagggaaagggaaattgcaggtcagacctctcacctcagtacaaccta

SEQ ID NO: 24487 - DNA, 1204 bp, Mus musculus
cagggtggcatacgcatttaactctagcacctgggaggcagaggcaggcagatctctgggagttcgaggccagcctggtctgtggatctagttccagaatagcctgctatatacagagaaaccctgtctcgaaaaaccagaagggggcggggggggggctttcgggtgagacatagcagaagccaccgtttggggttgtgaacagaaaaagaattgtcttagaaaggccagtctgtcccatagctgtgctgtttgaatattgcactcttggctgaccaggcttctcttcccacaggtctcgatccccaagacgcaggtcccctgtgcgtaggaggtctcgctctcctggccgccgccgccacaggagccgatccagctccaactcctcccgataagcagggacattgattcgtacctctgtaacttatgttccccagactctgttttgtccttttctctagccaagtgagggtctgtagagaaggatcccttactgggtacagcagttgagatatctcctctacagaagggttctggcttgtagagctactgttggttcacggctgctcccatagaggtgccctgtagttttctggctagaaagttcatcccttcagttcttgataggctggtagcagagccagctggaacctatggcagcacacggatttccacagatgacccagaaccagacagcctggtctagcccccgctgtgccacacctgtgcaaaggaccacactgctcttctgttcggccgaccatgccctgctgagtacgcttcaacttagagggctaaaacctttgaaggattcctccacaaatggttacctttctgtccccgtgtctctgttactttctagaatttgtgagccagttctacagggtcctcatgaaacctaccccaccccgttgtcacctgccattcatggtgatgttgcaggttaaccttggcagtgtgtacattgcccctttttgcttttattgtacagtcagtactataaaatttgttttgagttttataactttgtagcattttagataaggttgtgtttgtacttgtgtagagtgaaaggactgttgaataaaacctaggattagaatgcaaattgagtgctggttttactgtctgtcttagtccagaagagtcataatttgtatgactcaactaagaactcactttgagtttaatccccaaagtggca

SEQ ID NO: 24488 - DNA, 1150 bp, Mus musculus
cagttttttgttgttcctgttgttattactccatgtggccattgtcctgtcagccctgtctcttctgccatcctttacccacagtagagatgacccacaagcccactgtacccagtctcattcgaagcatctgaatcagtcatgcatagtagtgcacctttaaccccagcacttgggaggcagaggcaggcagtctctgagttcgaggccagcctggtctacataatgaattccaggacagccgggtctattatacagagagacgggatgttggtggtggggctggggcttgtgattagcacaatttgagtcttttaccttacagaaaagggatgcatttcataaaagcactgagatcagcccacaagtattgtgggtcagctcatacccaggaaaaatggactcagctgcactgtggactccagagtcacagatgttgtctgtctgtctgtccactccctcacctgacaaaaggtgcaaattatctagttgctgctccagcactgcccttgaacaaatctccgagccgagcctcaagccctggctgagagcccttgtagagggagctccccagttgggattctcctgagccatttcccaggatttggtcctgaccccaacacatggctctgtccttgccacttccctgtagccactggcgcttcctccagctgtgttctccccatacctactttggtagctatcagatctgaaacatgcaactgagggtctacgtgtgttgctatgttgttctagatctttcttctgccctggcactttgtttctgcccttgctcaaccttgggagttagatcagagcctgcgcccctaaacccagggatgacagaactgagcacgagtgtgctctggtgtcaaacagcttggtacctgtgtgtctctgagcagtacccaatgttacctgttccagtttgaagttaggaaaggacagacatcccagaaagcagtcagtccaggctgtgtccttgacccctcagttctggactccatggaagcaccctcttaccagccaaacacggccccaccctgccttctccccgcaggaatgcccgggtatcttctcagctggcctggacttgctggagatgtatggccggaacccagcccactatgctgagtactggaagaacgtg

SEQ ID NO: 24489 - DNA, 1200 bp, Mus musculus
cctttgttttttatttcagggtccttccccaccccctattcccagttgcttcttttgtgagattggggcttcttatgtaacccagcctggtaaactcactattttgtagcttcaaattcatggtgatcctttggcctcagcctccccaatgctagaattctaggtgggcccctcatgcccaactcatcctctctcttgacatttcgtcactcctgcattctctggatgctggcttttcaactcctcctcagtatatcttttgagagaagtagtccaggattcttggcttatctcttccctgaaagctctcaagttcaagccttgggctaaacacacacacacacacacacacaccacacaaacctttaatcctagcatttgggagggagaggcatatctggtctacagagtgaattccaggacagccaggaccacagagagaaagcctgtctccagaaaatgggggtgggggctagggagggagggagggagagaaaaaagcaagcaagcaagcaagcaagcaagaaattaattgagcatgtccatgtatgtgacagagacagagacaggaggatcactagggttagctgccggcctagccaaaaactggtaagctctagatataagggtgtagaagaggatatgtgccagcatcctctctggcttctaccttattcacatgtatacatgagtacccccctcattcacatgtatacatgagtaccccacctcattcacatgtgtacatgagtacccccctcattcacatgtatacatgagtaccccacctcattcacatgtgtacatgagtacccccctcattcacatgtatacatgagtaccccacctcattcacatgtgtacataagagtacccccctcattcacatgtatacataagtacccccctcattcacatgtatacatgagtaccccacctcattcacatgtgtacataagagtacccccctcattcacatgtatacataagtacccccctcattcacatgtatacataagtacccccctcattcacatgtgtacataagagtacccccctcattcacatgtatacatgagtaccccacctcattcacatgtgtacatgagtacccccctcattcacatgtgtacataagtacccgcctcattcacatgtgtacataagtaccccccattcacatgtgtacataagtacccc

SEQ ID NO: 24490 - DNA, 2065 bp, Mus musculus
atgttgacagcattgccgacctcttgcctgcccttcaaggttaaagatctagtgtctttaatctctggaataaaaaaaagaaaaagaaaatcagctacctaaattaatagtggggcttagaaattgctctgttaggtggctgcaggttaactgaagttaataagcaaaggcagtagttaatcttgtaagtaaacgttggggggggttgtttacagagaattatattttaagatgcacttttaagcttggaaggcattatggggtgggcatagcatgtgcccaacattcaggtaacctcaggccctgttgctgagactgaaatgggtcaagggttgtgtgtcatgctttttactgaaatgtaatcagggatcaggccctaaggtgggcagagttaaaaagggctcttaatgacacagagaccaaaaactggggtttcccctaatgatcctgcggcagaggcgcctgctactgcgtcccagttcctcacctgtggggtgggagcgctctatagctggggtttggatgccaaccccgacagcctccgctactctgcctctttgacatcacaattgtctgttctgtttcagatgctcagtactgcagaccctcatgcacagtaacagcccaactaaacttgtcttttgtgaacttggcctaggtgtcttaagtgtggcctgctgagcagctcccaacaccatgctgctttcccgggagctcagaacagttgggttgtttggggttttgtttttttcaaactagtgaacaacactgtcaagtgtgaaattggatcttacgcgtgtggattaatagttgtgctgtcgcaacggtaaaccccactaaagaaatctcctgtcccagtcagcagcatagccagtgtgctagccgaggattgtcttgtttcccagagtcctctgggtaggcaggagtcagtcctgaggatagttaagtctctaagaaagcagccaacccccccccttgtccaggtcagttttgttgtagacaggtggacttccttgttggtggccagccataagacctactagccagttggcttctcagcatctctggccttttcccctgctcttccagtccctgacctttcagtgttctgagcagactgggaagttccttttggctgactcctttctggcaccatgccctgtaccaagtggctatgctcatggccacaggacttcgcctgctcaccaagttctcagagcaataaaaggtattcatccatgccggaagctgctcccaggtcaggggtgggagtggaatggtgccatggatcaacaggacctactcaccaagttctcagagcaataaaagatatctatccatgcctgaagctgttcccgggccaggggcgggagtggaaggtgccatagatcaacacgactgtggtagtgcctatgacattggtggtgctgatccttggagtctggataatgaccaggcttggcaggtgcgtagccagagagaccctcctctggacaaacctggagaacctgtgtgtgtgtgacatttctagcttgtcttgctgtgtgatctcaaatgcacattaaactctcaaacccatgatgattaggtctgccttcctctaatttctttgagaagcagttgtctagctatgagtgggagcaaggcaggagcactgaaggcaggctgggattccaactctaaaatcattcccagtgggcatgcccacctgcagccccaccctgtctataaggaacaggtgctaaagaaactggaaatacaaggtgtaaagtactgggatgtgtgtacagctaggccaccaagtcacagagataagtgaccaagacaatagagctagagtaggaaaaaacatgctagggaacagaggctggcttaactaatgtggagcaaggtacttgttcttggtccagcctgaagcacacgatcgtgcacatagaaatatcaacagccccatctgatgctaatgggggtcttgaaagaagcttgggagtttgtgagggaaggtaagaaagcaatcggcctcacactgatggttcatacacatttattgatagttccggtgtct

SEQ ID NO: 24491 - DNA, 1226 bp, Mus musculus
gctcactcactaagccagactggactgggagtctttgctcctttagagagactagacctagaggacttgggactgttgaggaggtcagaggttaatgcctgtattccaggtatgttaccccgacttgcttcagaaattaccattatggccaggcaatctgggtttattaatccctactgtcagctgccttccataggtactggtgacctggccagcttactgacctgtggggacaggactggcctatggaaccaaaggccaggagggcttgggtagggggtcttagtctgggaggtaataaaagcagacagacacacagatgttgctcgggaagcagatgtcaatgcagaggtagatcagccgctgtctctggggccctggggagaagggaacttcgtgaatcccaagggccccctacccagtactgtcctacaggagccatagtcctcttcacccaacctatcccaatttaccttctgcccattgggtccagtagatgggagtgtctgcacaaaggtgttgcactgaaactcccacttgggtagggtccacagtatggccccccaaaactgccagcagctcctgggcatagtgggtatcccggccaggtacatgtgactcttgggcctgcagaaagactctggtggaccaccgtatagtacttccttgctcctggctgggaagggtattggtgcccaccccaggctgatggcccctccacctgcccttgtcaacagccttagtcaggggaaaatagagctttctgttcccctgaaaccagagccttggctggcccagctggactgcacagaggaccttttgtttatcccctggccttgggggtttgtgggtggcaagccaagtagtactgctcaccctggaagtgttcagcagcagctgcagggtctcccaatcttgggcttccatcagacggaggaagcaggcttggtgctctgcagggcggtaacagatgtagccctgggggtggcggggcagataggtaagtcgaggccacccctgacacctccactctctctctctcccaagcccactcacgttctgcccgtcaaacagcacagcccagctgtggttgctctgaaacggagtcaccacgatggttgccatgttctgggccacatccactagagtagtttggttgggccagggtaccctggagctcgggaaggtctttcggagcatctgcagcaacggctaagggatatttg

SEQ ID NO: 24492 - DNA, 1265 bp, Mus musculus
agggcaggctctcatatcccatgccccttcctcccctaggtctggagtatggacaacatgatctgcacacagactctgctgcgccatcagggcagtgtaactgcactggctgtttcccggggccggctcttctcaggggctgtggatagcaccgtgaaggtaagtgtctgtggcttgggctgatgacggctacataggatggagcttggagagtgggtgaggggcaagagaagaggcccaggcaggttaacaggagagggctgggagacagactggctagaagggactcctggggccatgcgggatctgaaatagaacccttttttttacaggtctggacatgctaacagaatccaggccaggcttggctccctctgggtctgtaagtcaggctggacctccattggaatgtctgcctgtctgtggagacaggtagacaggctcagctaggcagtgtcctctctgcctatacttggcgagggatctttccaaaggccccgctgttacttgtaccagagaaacacccaggccctcctctgggcaccaggtctgatgcttgcccagccccaccgttcatatcactccatagactcttgttctgagacagggtctcactatgtagctctggctggcctggaactcgctatgtcaaccaggctgacctccaactcacagatctgcctgcctccacctcccaagtgctgggagtaaaggcccgcaccgccgctcctggcaggacccagatgacccaggggtcctttttactcaccttttctactggttttagactgtatatagattttattactttcctgttgaaataaaagctgcacagactgtggttgtggagacagcttcttgggaccatcattggccccaaggacgttggtatgctcaggcacaagatgggaggggaagaaggttgggtggatctccttccctgccggactcccagcttccaggctgagctccattacccccctcccccccacacccccaaagagtgtgagccaagcagctctgttttctgctgtttattgacagctgacagcagctccctgtccagaccccctccccacttcctagagccctagcctgggcggcccacacagaggaggctgatgagcggtcagcatgttcagatgaggaagcgccaggagtgacagctgcaagggccccgtggccacactcttagctgccctccaccacaattacggttttgtttggggtttgtttctttttgagggggggaggtaaagaaatgc

SEQ ID NO: 24493 - DNA, 1102 bp, Mus musculus
tgctgctctcccctacgacctcatcaaaggttgctccctttaggtctctggtagaacattcctgtcattaccgtgaacccccctggctaggactagaaagcagctcagccttgcgcacctctccttgcccaggcttctacactactctgttcagtgatctgggctcttagctgccccatgattggctgctggatgcagcctctctgcagcccacattccctcacgggaagcaggaagaagcctgagcatgtcctgtaaaattgaatagcaggaaatctctccatttacacaaagaaagttggcaggcaagaacgggcagcccagcaccaaaggccaaggctggccaccacaggcagcgggattgaggccataccagcctcccgcacacaatccacagccttgtgagcttgctgaaattggggtggcttaggggcacccctgcctccacagggctcaagcccctgaaaggctgcctccatctgtgcagccccccatcaacactcctcgccgctctgactcagccatctctgtccgttccctacactccgagtccagcatgtccctgcgctccacgttctcgctgcctgaggaggaggaggagccggtaggtgtggtaggcttggcaggaatcatcttccagagttgtcactgctgcggtggcacggggcactttccccttagactgcacctccatagctcacattgagggtaggtcagacctgattagggcctctagttaatgttgaaatccccgcctcctgtggaggccgcctggggatgaggtgtgggcaggtggctcagatagggcgctttgctagtctgtaagccaggaagagaggccagtaaggctgtctgactgttgcagatgctgtgtgtgcggtttcttgctgcttacagcctgcccctgaaccacaccccttgcttcagctccttggtcctctcgtggctctctctagtcaacggtgccttctaggatagtcccagtgctggtgaacagccctggatggggcggacatgcaggcggcctgggcagttaatgtgacagggttgctcctgaagcgcccacccgtgtcctgaccgtgtcccccactctgtctaggag

SEQ ID NO: 24494 - DNA, 1099 bp, Mus musculus
gagagatagctcagtggttaaaagcactggcttttattctaggggacccagattcaattcccagcaaccacatggtgtttcacagcaatctttaactccagttccagaagatccaaagccattttctggcttccatggtaccaggcacataagtggtacacagacatacatgcaggcaaaacactcatacatataaagtttttaaaaagcaaaggctggggatctcctgctggtgattggcatgagccaagtcctgggttctctacaccaaaggaaagaaatacacttaagtctcctgttggtaagcagggtggggcagctagcagtccattctcagttgtctgcagatccagtctgatgagccagggccatactgctggtacttggaagacaatcctggataaccatattccagtctagtccagggagactgagagctagagataatctgaagggctccatagacaagggctcttccagctgtctctgtcactttagcctcttcctccactgacagccatgtcttttcagcagctgatgggactggcacatacaaacagcatcgcaggacaccttcctcctctagcacccttgcctattcgccacgggatgaggaggacggcatggtaggtgtccacgatgtgggagcctggtgtagtttcccacctcctaccctcttccctgaggtcctaagagaagcctgcaggggagcagagctgggatagagaggcaccttgctggcagagctcttgttgcattcctgaacctaagaggaggctcctgtagctgagtggtagcaggaagcagccagtttgtgggactgcgctttagggtgtggcccctgaaggccagtgtcaggcagtttgggctccatcttaaatgaggtgggtgccacaaaaggtgctctcaggtgagttggccagtggaacagaggatgactggcaggaccaaagtccttgctcaagaggcagaggaaccagacttcttttccccctttctttttgcttttgtgtgtgtgtgtgtgtgtgtgtgtgtatgtgtgtgtgtgggttttgttgtttttatttgtttgagacagcgtctttatgtagtcctcatt

SEQ ID NO: 24495 - DNA, 1159 bp, Mus musculus
tatgaccacatctgtgagacaggatcaagtgattgcctgttggttctttgtggtcctgatagcatctgctatggcagagaacacatttgtgtgctctggtgggtcctcatatgactaagtcctggtgtgtgtgccacaccttagacccagtctaatagatgggtagaaagcaagaccccagccttagccatagggacatttaacctgcaaagaagtaggccttgaagtgatcggctatgatcaggaccagaggattagccagcacaggggggattttttactttggggctagagctagttggcttcctcaaaaggtccaggcctgaagggatggcaccactaaagatcgactgtacccggagcctttgccacttgagttgggtaggcaggaaggcccttgccactctgggtctgcagtatggcattagaggcagggagaagttaagacctatcctgagatggactggccagaagtctaccaggtgaagacgctttcaggaacccagaatgctacctctaaagccccccatctgtgttcttcccataggggacactgcccaaggaacctggattcctctctagagcatgagctcagccaagagtgcccgctacgaccgcttctccgggggacctgccaacctcccctcctcagacagcagtggggtaagaggagcctgtaggtgagggcctgccctctgcatgccacaccccatacccccagcatgacgtatgtatatgtatttgtatatgggtatgtatatgtacttgtatatgggtatgtatatgtatttgtatatgggtatgtatatgtatataacttgccactgaggacagagctacagccgtcctcttcctccttggagagtccctcaggatagcctgtgcctgttgatggtgtgtccctgcgtatgcactcagatgggccaccagcgggtcagcatgtcagtatgtgtgaccctgtggatattgcattaagccttttccattgtcttagaccaggatggaaacaacctttgggcctaccttttcgaccgtcactaccatcaccaaaggtgagcctgactgggaagaatctgtattctactgggatccaggagcacttcctggaagggtggtctcctggcttctttctgtttcttcccatgtctcagcctccagc

SEQ ID NO: 24496 - DNA, 1247 bp, Mus musculus
tcacggacttcaggaactctaggtgctgcttcacgctttgagcttcctaaactacgacttccggcgacctctgtactgaaggaccggattggtagcttcagaatcactctatgttgcacattggaatttgattggctaactgaactcgtcactcatggactcaatggctctacaaccgggaggatattcgagctactcaaaataccgcctccaaaacaaaagtcgctgtacgattggtggaaattgcaggacagctcgaggagcatatcagcagtggaggaaggtgggcacttcctcagaggtggcccaatcacataaggggcagttctataaactcttgagcctcgcgagcagtcgctctttttgggagtgagtgtgttcgtggtccctttcatctaggttttgtaaggaacgttttgggagtagtgctcgccgaatggaactcaaaggacctctgctacagatctgccttcctcccgagctgaagtgctttagtcctaagggtttaacccttccccatttttcttctgactccatttttgcaggtatgaactggtcgggcctggcttcccttttcagccccaagcccgtgatgaattaatttctgacacctcgtatgaaaactgcatgcgtagtctgattacattataagactgaggcttgggcgcgacgtcactaattggatgggttttgagtgaaaagttaaccaaagtaaagatttatgtttgattttttttttttcagggcatgttgagtcggctgcatctagagatccaacgagtaggagtgttggctggtaagctgggcatccgtgtatctgagtttcttagcaataaagtgaaatgcaatcttactgtggtttcagacgttgtgatttcatgtgctgatagcacagtgccgtagaggccctggtttggcgtcacacagtccgcaaaggggttgactaagatattctgtttgaatcattctaatctagggtgaccttataagccagcactacttaaggaataggctgtggggcaccctaatcttgatagtaaactattcctgtgggaattttggtgacggtatcagcgcatgtgtaaattaagtgtttccccaggtgaagtacctttacccccccactaagccatttttgccccaggaggtggttttccacagatgacacaaactccagaaacacctttattaatagggacttagaggacaggttttcactcaacatttgtggcttggtgactttagta

SEQ ID NO: 24497 - DNA, 1150 bp, Mus musculus
cctctctgtctcagtagtccttctagtctttattatggggatgtgatacaacactgcctccctcttctataggtcaccctccacagccaggatgttcctatgctccctggtgacctcattggcttacagcatgatgctggcccaggtactctcctacagtgtcccctggcttccagctgtcctggccaagccctgtacctttcaaccaatgcctcagattggatgaccaacctgcctgtccatctggaagaagcttgggctggccctgtctgctccctacagctgcttttggtcacagagcggcttacaccactgctgggccttgggcctaaccctggactacagcatcctgggcactatgaggtccgggctacagtgggcaacagcgtatccaggcaaaacctgtcctgcagcttcagtgtggtctctccaatagctgggctgagagtcattcaccccatcccccttgatggccacatctatgtgccaaccaacggctcagtcttggtgcttcaggtagattctggtgctaatgccactgccacagctcagtggtttgggggcaatattagtgctcccttcgaggatgcctgccctcctgaggtggattttctcaagcaagattgcacagaagaggccaatggcaccctgttctcagtgttgatgttgcccaggctcaaggagggggatcacacagtggagattgtggcgcaaaatggagccagccaggccaacctcagcctgagagtgacagctgaggagcccatctgtggcctccgtgctgtgccaagccctgaggcccgagtgctacagggcatcctggtggtaagtgtcctacaacccagccctctaaatggtaaaaacaggaagcctcctccccattgaggagggatgaccttcaggtgttttctagggctgatagcacctattacaggatttccagtgggacctgttggggagcccttgtcttcttagtgattatatctctccttagtggtgctgggtatggaacctagggactcgtgcaagatagacaggttcttttgttgtgagtacacctgagccccatttaacaatttgtaagttactgaaggtcacagttagaacatctgttctaaagactcagatgtttctactcttcagattttag

SEQ ID NO: 24498 - DNA, 1076 bp, Mus musculus
gccctgtgcctgcctcaggacgctgaggccctggctgcactgaaaccagtgtgatactgtgcctgcgttgcttggcctctctgtagagggaagttcataggatccttagggacccagcatcctttagagaagtgacagaggcatgggatatttgagaaacaagaggtgacaagcacgtacgtatacctcaaggacttggtctggggagatattttggtttgtattttcaggcaaggtcttactgcatagccataaaggaactttgattttggagtcaaaattgagaaatcatggaaatattcttaaatacctcattttcattttgaaacttaactatttgaatgcttacaaattaacagatttcttggttttcttgattcagtgacaagagtttgcatagaattatatattctttttctcatctgtatctatgtcaatatctatatttttgcttaaattttttgtttgtttttgtttttcaaaacagtttctttgtgtagtcctgactgttctgaaattcactctgtagaccaggctggccttgaactcacagatctaccaccctctgtctcctgagtgcagggattaaaggcatgtaccaccaccaccaccaccaccaccaccaccaccaccaccaccaccaccaccacctagctcattctaaatttcaaacaccagaaattagtgatgtgtgaactatactggaatgtagaaagggagatgtctctgaattactgaccatggtatgggatttcctgtgatctaagagtcactaccagctccccaccagaagctcttctacagcccagggccgagtcccccagagagattctgtccctactaggtaactgagacaggagtctgtactgtgtgactctttgccatcattcattaatagattctctaagcttctttccagattcggggactcgtgtgttcccagctgtaccttccatctcatgcccttttcctttttttttgttttgtttttgcttttgtttgttttgagacagggtttctttttttttcttttttcttttttcttttttctttttctttttctttttttttttttt

SEQ ID NO: 24499 - DNA, 1160 bp, Mus musculus
aaaaggctgtgtggccagccaggacccagggtcccctccccacaggaggacacagcagtattggaccaagtgagtacccagcctccaagatgctaatttattcgccccccctccccccaagtcctcaggttcagcgggctgcgcccagctctacccctaggtggccatctcctcttgctaaaaatctaagctggagggagggctaagctacacttctcctttatccgtcccctaagttattacctctcttgtttctgcagcatacttgccctctagctaccatctgctttctatgtccaccatcaataatttatatggggttaaaatgtatatatttttgtatgtcagtattttctacttgggctgaaaatgggtccattgttacccagggcaggggtacaggggaagctgcagctattactggatccgagtctggcctcgggcaggtgctggacagcaattggggccaccgtggccttgttttcctcccttgtctggggccaggcagcacgcagatctgctggtttcagatctgagcaagggcaggactactgtgggatgaaagatgccaagaagttactggacaagcccaccaatggggcttgcccccatggcgggtgggggaaagagaatgtatgtgatggcacctgcctgcttctgtgggctcatctgcagctctagcctggattctgccccaaccccaaacagacaagacaaagtcaaataaagaagctgtctgactgctgtctgtgctgctctctgaactccacgggccagatgtgcgtgtgcagtttatttcatgtaggagtacagtcaggatagctacatggctggccacaggactctagtcatggatctgctggcctcacacaaactctgtgaagtcatccacggaggaaatgaggcgcttccgctggcctgtttcataggtgggtgtagcctcaggggcttgagctggggctttggtgtgggctggagggtgcatcagaggcaagcttgggttggaatagtgcacctcttcacggatctagagagagagaaagctctggcagtgagtccggaagttctgttcaaccagactcagacatcgcatctctgaagcctgtcctccctaccctctggcggagacgcttaatgtggcggagtcttgcgatccactt

SEQ ID NO: 24500 - DNA, 1150 bp, Mus musculus
tcaggtgccagtggagccccccgaattggaggatttcgaggcggcgttaggtacagacaggcactgccagcggcctgacacctacagccgggtgagcatcatgggagccatagggaaagctggggcaggcagcagcgtctaactcagacctcctggctctgtactgacttgctgtgtgagctggataggccttccccccatgtcgcttctgctcccaccctctgggtctctcaccctctatctgggtggcatttattgtggtctttttcagtttgtcagaatcgggatggcaggtgctgccagaggcctgaaggggaagccagaggccctaatgtttcagtgcctcctaacagtgtttcttccaaattgtctttgcagtcatcctcagcatctagccaggaagaaaagtcccatttggaggagcttgctgcagggggtatccccattgagcgggccatctcctctgagggggctcggcctgccgtggacctctccttccaaccctcacagcctttgagcaagtctagctcttctccggagttgcagaccttacaggacatccttggagacctaggggacaagattgatattggacggctgagtcctgaggctaaggtccggtcccagtcagggatcctggatggggaagcagctacctggtcagctacgggtgaagagagccgtatcacagtcccacctgaaggtcctctgccttccagttctccccgctcccccagtggcctccggccccgaggctataccatctctgattccgctccatcacgaaggggaaagagggtagaaagggataacttcaagagcagagctgcggcctccagtgctgagaaggtgccaggcatcaaccctaggtgggcacaaatcccaggttgctaccaactccaggggatacactttcttcttggctggagctcccatacactgcacgggagaacaggcagtcatgaattgtgtcttcctgtagctggtgggagccataaggagggtgggtccttggccgtagagtttaggtcctgccatcggccccgccctgaccaatgctttctctgtagctttgtgttcctacagctctaccattcgcccttttttggtgatgagtccaataagcccatcctattgcccaatgaggtag

SEQ ID NO: 24501 - DNA, 1070 bp, Mus musculus
ccttggctgtcttagaatttgctctgtagaccaggctggccttgaactcacaaagatccacctgcctttgcctccccagtgctgggattaaagacatgcaccaatactgcctggttttttgttttgttttgttttgttttgttttttaactttttagtgacttatttatttttattttatgtgcattggtgttctccctgcatgtgggtctgtgtgagggtgtcaggtctcctggaactggaattaaatataattgtaaattgccatgtgggtgctgggaattgaacctgggtcctctcaaagaacatccaatgttcttaaccactgagccatctctctgaggctaccactcttgaagggccaaacccagggcctggggctgtcctgtttcagctttccttgggcatgggccaggtgcttccagactggctggactttgtgtctgctctgtgctggagactttactgggcaagtggtcaccaattctaaactcccttgtttttagggggccatggccttcgagttggtgtcctggatacttcagctccctattccccaggtggctctgcttctctgggaccacagacggcggtggcagcgaagcccgagaagccccctgcaggagcccagcttccaacagcagagaagacgaatctggcagcctatgtgcctttgttaacccagggctgggcagaaatcttagtccgcagacccacaggtactgagagagcaggcagcctggagagtgcccagtggtcttcagagcataggggcattgagacattcgctctgaggctgctcttcagaggggtggtggctgaggcacttgcaaaagtgccaaacagggcagctcacacttcagacatttagtctccgggtgtagaagaccagaagatgagactgaatgtgggcagggcagattccttctgagtcctgagcctgcaggtggctcgcgtctctctgcccttgtgcttgagcccataccctttattatgtgcacacaggctttagacagggccaactttcataccctttattatgtgcacacaggcattgacagggccaacttt

SEQ ID NO: 24502 - DNA, 1746 bp, Mus musculus
gtagctagcatctttctgtgaattgtgtctgtctagtgatagggcatctttccctcaccttccagcccttcctgggtgtggcttcagtcaccctgagatctagccccgtgtgagtgcctgccttgggtttctacctctgtatggcttctgagagctggggacagtgagtgcccagtagaaccccaatcacctctttctttctggtagactccttataaccaaaacgtggctaaagagctcagaatcaaacctagaaaaggccttcctctggttcctgggcatgagtggaacttgaccagttactccagttcactcagcctgtccttgctaggaggtggccctgtgggcagaatgcaatcttgctctgtcctcctgtggtctctgaagtctgcatgactaagctgtgggctgcagccatggctgactcctgtgtgctttggggagaggatgttctgtcttcccattctctcagctatgctccagacagcgggctctgctgtgaggctcctgcctcccttcctctctgggatgacgtggtccacagggcttgtgaggttgtagctccattagccactgtgacctgggcctggtgggctttctgagcaaggccatcttggccatgcatgcattgagctttggctcctggtggtaggtgactcggcatggtccttcccttagtcctgacctcaaacctaggcatggtttctccctctagcagaatacagacatcccttacgagcgccagcctggggtctgcggatgagaactctatggcccaggctgatgacaacttgaagaatctccacttggagctcacagaaacatgtctggacatgatggcccgatatgtgttctccaatttcactgcagtccccaagaggtgtgagggcctccaggactggggtgggtggggcagctgtctacttgttctctgtggctgaactggatgcccagggtggcagctgctctgggttcctgaggtcctgctggccttcaggagctgagagcctgcacatacaagcaggagatagacactcttactcttttaggtcccctgtgggagagttcctcctggcagggggtaggaccaaaacctggctggttggaaacaagcttgtcactgtgacaacaagtgtgggaactggtacacggtcgctgctgggcctggactctggggacctgcagggtggctcggattcaaggtgactgtccctcccttctgggtatactgtgctcctagaaaccctgggggaccatggttgactctgtatggtcacttctgtccttagctctgatcctagcacacatgtgaggcagacaaaggaagcaccggccaaactggagtcccaggctgggcagcaggtgtcccgtggggcccgggaccgggtccgctccatgtcaggtaagactatacccaagccatctcctgacacgtgcccattatccctcacctacctctcagtttgccccagtgtgcagaagagctgaaagactgttggctagctttgtgactggccacttcctgatgactcttggatgtggtctttgtggcataccagtctgtgtatagaggcatggtaactctgctcatcggggagcgaggctcctgcagttcaagagcctggaagtcagctcacccagggcactctctgttgtgattgaggagttgtgggtcagtgggtgagcatcggggctctttgctgcttggttcacaggaggcccccactcctcctcctcctcctctcc

SEQ ID NO: 24503 - DNA, 1180 bp, Mus musculus
gaagggtcctgtgcaaggcacatggctccttcccatctgctgtgtctgccctgccaaggacctctgcctttccttggcttacactccttgtacctgtgtggcgtgttactctgaagtcacacagtcgtccaaggtcggggcaccttggcctccaggcttggcaacggtcccagtgcttctggtgctgaagagacccccaagaacctgaaagaggggctcctttggatgtagctagtggggagaggggaggacagggatggacagctgctgacagctggtcaccctgatacctctgctgagtagaagtcactaagaaggaagccctgaggtctccaggctcagtggataacctgttctttaaggatcccagcctagtcagtcactgtggggaagccgtggggctgtgagaatattttgctgttagatgtcagcgactgtctatagctcctggggagaagtttccttctgtgcaggacaccagctcagaggctcaggccttgttgtatataaagtgctaagtgactaggatctcccctcctgccctggagtcaggctcgtggcctgactgaatggccactgttctccctgctaggcctttgacttcctgctgctactgcgggctgactcgctgcatcgactgggcctgcccaacaaggatggggtcgtgagattcagcccttactgcctctgtgactgcatgtatgtgtggcaggccctccctcgggctccagggtgggctggtcacgagatgaagctgggtgttgtctgcctactcagggttatttcataggagggactgtacagaagggatgtcagcggaagctggggccaggaggggccgtgtcagtttaacttgtccagtgtccatctgcctccacagggaactggatagagcctcagagaagaaagccagtgggcccctttcacctccaactgggccccctagccctgtgcctatgggccctgctgtgcggctcggctacctaccctactccctgctcttccgtgtcctgttgcagtgtttgaagcaggtgagaagtatatcagattcttgaagcaaacccagtttctcacccttgtatgagtgaagttttacaacaggacttaaatatgtatccagataacagtagccctagaccagcatgcacctcatagggagggcacaggtggacggacactc

SEQ ID NO: 24504 - DNA, 2085 bp, Mus musculus
ccaggctgtgtgccaagaacacacccagctagaagtcttctctcccagctggacggtggttctgaaagaaaacaggcccagagagaaaacaggaaagggcatggcactcattgtgtttgtcctgtagccattaagggcctactatgtgccaactagtggtactcagggagtaattatcagcccgtccccgcctgggacttagacataagtggctagagcaggagtgtgcgtaggcagcaatggtctcccagaatcggttcagtagtagagatccgctgggatccaggctgaggcttggcaagggccaagggccacagaaagtgttgatactgttaaggcagcaaatgttttatagtagtagagtttggagctcatcctaaatgcaacgatttctgaaaggggagttgcactgtccagtttgggtgtgaagagagaggttctcttgaatgtaactcaaaggacttgggacaaaggagagaggttatattatcctagaggctgttactagtgtcggtgtgctaacaggcactttgtcagactgtcatgtactgttgtgacaagggcagagcacagcacttctgtacacatcgtggtagataatggacagttagttgcacaaacaagtgtggggatgtggattggcaggtaagcagcacccttcccccaccctcatataaaacccactccaaagactgaatggcacttttttgcagaaggaagaaaaagccacaggcccgtgagacatccacggagaacacagaaaacgcatgtggcctatgaagcggctaatggtgaggaaggcgaagatgctgagcccctcaaagtgcccgtttgggagccccagaactggcagcagcaactggccaacatccgcatcatgagaagcaagaaggatgcacctgtggaccagctaggcgccgagcactgctatgatgcaagtgcctccccgaaggtatgcaacacctccgcctatccagcaaggtgcttacttccttttaggtctctaccagaaaaagagcaagacctgccagctctccctgctgccatacaggaggatacatacatacatacatacatacatacatacccaggaagatgcgctcctcccataaccttagaacatgtacaacgtacatcacctgtcaatcattgtggccaccgtgcatggcagagtgtctgagacttgaagcctcatgcacagtggtggtgcatttgggaacatccaataatgcaggagaagcagactcccttacattgtgttggttccttagactaaccatagggctaactaccttcggatcctggtatcctgagtatctctaactctggcccttcttgtctataaaatgagtagtgttacactgtaacagtagcagctagctatggtctaatatccatcccatacaaggtatgattccaagcaattcatccaagcttcggctactctatagaagtatgtgacaagacagatgggtaagggacttgactgggacccgtccttgcacaagcaggtgaggaggtaccaggtactcctgtcgctgatgctctccagccagaccaaagaccaggtcacagcaggtgctatgcaacggctccgggcccggggcttgactgtggagagcatcctgcagaccgatgatgacacgctaggcagactcatctaccctgtgggcttctggagggtaagcattacctttggcaacagagccaagagggggcactgttctgaggatgtgaggcgggcatctctgacgacagagactcttcatgcttctgacttgccacaggtctatcccatggggctagtaccctgcccctgaagttcctgggatgcacctctacacatcccttcatttctctaccctcctacccagctgcctccacttcctttccttcccttcccctcctaggctccccagactgtgtcactccacagaaccctgggaggtgggtggaactgtggggagggcgcttccccttggcactgcgtgggccaccgtctatcagattggttttaaatagccctctccactcaggcacaggatgggaaccacccagctgttctgtcggttgcctgggggagtc

SEQ ID NO: 24505 - DNA, 1545 bp, Mus musculus
cccaaaccctgaggtggcccctggcttaaggtccttggaaaggtggctaccaccagtatggctcactgtttgtaccttgcctgcccccaggatggcagtacctggaagcgagaccccttccaggaaagtggcctccacctgagtcccacagcagctgaggccaaggagaaggctcgagctactcgggtcaacaagcgggcaccacagatggactggaaccggaagcgagagatcttcagcaacttctgagtccctctttgcctgtccaggggttccagggtctcttcctgctcggaccttgggcctctccagagctccccaagcctcagcagactggagggtggtcacacaccacccagaaaccaacccatgaccccatgaacccttgtcttgtccactgggtgctgcggtggtcatagcaagatcagagaggagagaaacccagagaagagagagacagagatagacagccagccaagacagacacggagacagaaacagtgagagagggaggagctgtgcgtggtggtctgccaagggcctctgccatcctgcctcgggcctgctgactgaaaggaattcatgttttcgctttttttcctaaccggtctccagctccacatgtttctagttaatagtggagccccctcccccaaccccttgggactcactctaaataattgcaataaaacacaacctttctctgcaaaccctttcttacccaccctgtcagcagcgcctttctgagcagagaccagggaacaggcagtcagggacctcagggccagctgtgcctggaggagctgtccctctgccccatccctcacatgggatggtccctaggccaggcctctcttctctgcctagctacccctgtgctacctcccacatgctgggttctggaatgcagagcctaggctctctgaggggccagaggatgggtgttccatgactcaagagggcagcctccggacaagccccttatcctgttctgcagctccagggcctggaatcgtgggtctgtgtgagccattctcaggtatgatcctgggctcctgggcctgtcccctgccttatgcctacctggctcctaccctccacccttgactccccaaactcactcactggcactgcagtctgcctcataagccatagcgcacgcgcgccctcaaattaaacaggccttgccttgaactctggcgcctgtgtgttttctgaatcttcagttgaggggtagtggggaggagtaaggcccattccagacgacctttaggtgagtgaggaacaacgtcatcctctcctcccactgtgtcaagtcctgagtctagagttcctctgttaacatggggtgggttccaggcacaggccaagtgtgagtttggaagctaggtccagaggagtgctgggccgcaggacagtgtgtgagagttcacagggatgcttcccccataggcttcccagcagctggctgcagctggctctgtttcctccctcctcggtttatgctcccctcccatccctccctccctcactgtccccacgcag

SEQ ID NO: 24506 - DNA, 1148 bp, Mus musculus
gtgggactcaggtggaggccactttcctggaaggggtctcgcttccaggtactgccatcctgggggcaggcaaggtacaaacagtgagccatactggtggtagccacctttccaaggaccttaagccaggggccacctcagggtttggggaactagccccaaaggcttcttggaggtggtagccctaccatcctggtaggtgtctccacagagatccactccaaaggcctctgaagccccatgtgtgagcatcacggcagttacctcattgtccttctctgagcctggcaggtcacttcgggatgagcacacagagccaccattgagctaggaaaccaaggataggttgtgctttcagcatccccatcctggtgcacccagatctacacacacacacgcacacgcacacgcacgcacgcacgcacgcacgcacacacactgctgcagctagttcttattcaacagtgagcacacttcggtcactgtctgggccagggcatagctggcacctaacagcagacgggcaagtccaacctgagaagtcacgatacggggagcagctgtggagatgggaatcagctacgtgaattcacctgttgtcaaagcaggatggtgtcccaagaaggtaaagactactcagtagtcatgtagggacaaggcacggaaagatggcccaggaccccagtatctgcccacactgtgcatctgagctggtgctaaccccatacaagatccacagtggctatttgttttgttttgaaacagagtttctctgtgcagctctggctgcattagaactcactctgtagaccaacctggccttgaattcagagctctgtctgtttttggttcccaagtgctgggagcactgcctgctagcacagagggtatttttgagggaaccaggccagttggtttcacaactgtacatcttcaagggcagaggtctccagaagcagcttctatcatgtctggggacagaagtagaggtatagccagtcgtggtggcacatgcctttaatcccagcactcaggaggcagaggcattcggatttctgagttcgaggccagcctggtctacaaagtgagttccaggacagccagggctacacagagaaaccctgtctcaaaaaaccaaaagaagaaga

SEQ ID NO: 24507 - DNA, 2179 bp, Mus musculus
gtgcatacagttgttgtattcctgagttggggcctggcatgtggctctgctctggacaacacgtagagccaaccatgtgggtggctgtggtttctccccaggcagctgctgcagcatgagtgcccacggtgccctcacctgccacccttcagcctcttcggggacttggagcagcacatgcgcaagcagcatgagctcttctgctgcaagttgtgcctcaagcacctcaaggtatcctgcactggggaacccagagactgccaggccccacagagccttaggttgctttaaatgggcatgggggacctccaagtagcaatatggctcctccagccttcagtgggctctagggcagagctggtattatcagggtccactcattgcccctaatgttccactgcgaagtcaggaggttgggagccccaactctgtgtccagccctgtgttctctgcagatcttcacctatgaacgcaagtggtactcacgcaaggacctggctcgacaccgtatgcagggtgaccctgatgatacatcccatcggggacatccactctgtaagttctgtgacgagcgctacctggacaatgacgagctgctcaagcacctgcgccgagaccactacttctgccacttctgtgactctgatggggcccaggactactataggtgggcggggctgggctgctgcagggagtgggacctggaggtactataggtgggcggggctgggctgctgcagggagtgggacctggaggtactataggtgggcggggctgggctgctgcagggagtgcctcggtgattctctcctaggacttttctgggagttgtctggttgtacagtagatgatctggcttctgctgactctgtctgccagtgactatgcctacctgcgtgagcacttccgggagaagcacttcctgtgtgaggagggccgctgcagcactgagcagttcacccatgccttccgcaccgagatcgacctcaaggctcataaaacagcttgccacagccgcagccgggccgaggcacgccagaaccggcagattgaccttcagtttagctttgcaccacggcactcacgccggagtgagggtgagctaggtggccgtaggctcagccaggcttaggtactggggccttccttctgtgagtatctgcttcccagacttcagacctaggtcccagttagattccttctacccagctgagacacaggaggcacccacctggctatctcctcaccattccttgctccaagcacctgagccgagtgatagctgtgagctccttgccctccctctctcaccctctccggtgctttgcatttgggctctggagtccttggggtgcttctgtgcctcaggagactacagactatcactgaagcccatatatcccatccccaaaggtggggcttaggcccctgtccttgtaccaattgggaactgatttttagaggttacggctggtttggattctgcggcgtctgggcctacccttgtggatcgtaagctgttgggggtggagaagcctctgccctccagacaggagcgctggcctcagtgtggtctggacagcagttcttttgtcctattggttgacccgggaaagtgacaggctatgtactgaccacaggagtcgtcagtggtgaggactacgaggaggtggacaggtacaatcgccagggccgagctggccgggccagcgggcgtggagcccagcagaaccgccggggaagctggaggtacaagaggtgggaggatttgcataccactgacattctcctgccgccacctctccatggtggcagccgccagcagtcaagctgggtcagtgggctccagccagagctcctgggctcctgagggtggcaacagtgtttgcccagcaagtagaattttctttcttctttaccacttgctagggagaaacaacagaatctggggggaggaatggccccgagagcagagcacagttttgccaggaagtacctgcaaagcatgcatgtgcccaggctgcaggctgagctcagacactgcccatctgaggtctttcctcacctctactccatcccagggaagaagaagaccgagaagtggcagctgctatccgggcctctgtggctgctcaacagcaagaggagactcagagggttgaggaccgggaggagggt

SEQ ID NO: 24508 - DNA, 1173 bp, Mus musculus
gaacctacccaccccggggtcccaggctgtggttggtggcagccagcctccccggaaggcaggaaaggggagcaggggtggcagaaagggtggcccagccccagtggatgaggaggatagcggtggcctcactgtgcaggggctgcggagtgtgcccaccacggtagctgtgtcttctttgctggcaccagccaccaaccagagttcagccaaggttggcaagaagaagaaggtgggctctgagaagcctggggccacatcatccccactgttgccccctgatcataccccaaagccctctggggctgagcaggtcctggaagcccctttgagcaaagctgaagtgccagtaaccatcgttgtcaatggacattccgaagggtcagccctggtacggagtgccccaaaggaacctccagggcttccaaggcccctcggtcccctcccctgccccataccacaggaggactttccagctctcggaggcccttgtccacccaggatgcctcctcccccaggtatgtgtgcctaatgctgtgggttccttagaagtttcggagaagtgctggagccgtagtgtcaggctggaagcctgcacatggtgggcacaagatgcccacttctattagagatgtctatgctgctgagtacagtctggatgcaagtgccaccttgagcttccacagttagctactttatggtactttgtactgcttaaggctccccaaagtgggcccacgacatagagctctggccctgagcctgctgaggctggatgtgaatgggccccagcgcttactggggctggacatgcagaataacagggctagttgggatcacactgaagctcttatgtcaccctgcaggcttcagcaccgtggtactcttgaagggcacaccacctccacccccacccccacccggcctggtgcctcccatcagcaagccaccccctggcttctctagtcttctgcccagctcccactcagcctgtgctcctagtcccaccaccacaaccaccaccaccaccaccacgaaaacgtaagtggggtgagccactgggagccggtgggagggtgcagcctaagccaccctaaaggctcaagcctccatctgacctcagacccgggctagcacccacaccacaagcctacttagttcctgagaatttcc

SEQ ID NO: 24509 - DNA, 1180 bp, Mus musculus
aacgccccgccagagatttacctctggtcttctgaggttgagggctcgttctctcttcctgaatgtaaaggtcaagatgctgggcctcagtttcctcttacatactcaccaaaaggctctcctgatcagagaagcaggatgctgcacttgtcctcctgtcgatgctcttggctatgacaaaatctgagcttaccttctcttgcccacctctaaaccccataagggcttcgttctgtgtctcttgagaatgtccctatctccaactctgtcatacgggggagagcgagtgggaaggatccagggcagggctcagaccccggcgcatggacctagtcgggggcgctggctcagccccgccccgcgcgcccccgtcgcagccgacgcgcgctcccgggaggcggcggcagaggcagcatccacagcatcagcagcctcagcttcatccccgggcggtctccggcggggaaggccggtgggacaaacggacagaaggcaaagtgcccgcaatggagggagcatcctttggcgcgggccgtgcgggagctgcctttgatcccgtgagctttgcgcggcggccccagaccctgttgcgggtcgtgtcctgggtgagtggtccctaagctggccccttccctgtcccccgcctctcttagcatcccttatcctccaccctcacccaccccctgcccatcgcccctcaccctcctctccgccggtccctccccccaccccccgcccgcaggttggggtgacgtcacatggctaggcgcgcccacctgcgggcgggggaagggacggcggctgttaccaatagaccttgagaggtcaccactggtctccccctgccctcaattcctcttaaggtctaatacagtccccttcctaggtcttttcatttttccggttcccacgacctggaagtaggcacagagttgcggatgtaattctcccagtatatcagggacttaattccacatggaagagggggtataggagccaaggagaatgcgcagtttcttccctttgcctgataacatccgccaggctcatttggagggagcggttcttcctagatccctcaggtctagctgtgagttaaaggagcataaggaggctccctgctgctgtagctagaaggggctcatctgggagggcttcctggaaatggcatggaagctag

SEQ ID NO: 24510 - DNA, 1161 bp, Mus musculus
cccattcagtgcggtccagctgcacctgcatctcatcaacccagttcaagagatcttgaacaaatttcatattgacttcctcttctgtcaagttctgatccagcaaagacgacttgagaaggggctttcggatctgcattagcttcagagtctgtaatgaatttggctctacccctaaactgaagtttggagctacaactgaagggaacccaggtgcatacaccggagtaactgatggcgtcaggcgggaagtcatcccggacgacaagccagaagtcacgctagaagacgtcaaggaaggggttaaactctgggttagccctgagttcaggctggggtgtaaggtttgtgcaaatcctgagtttaagctttgaacactgcctctgggaaccctgccacaggattaagaaatggaggtgcctactacagacacttgggtggcctcctcagcgaaagccccatgagactgaaggtgagaggcaggagtggtccaggtgcctcgtacccttcatttgggacatagttgccccaaaggaagatgggctagatgattgccttactactacacagccctggctgcctacaagaactgtgatcctggcaactctgccatttcagaattgaagcagggttccccagctccagcagggtttttctcttagggtgtaccaaccatggtgcccactgtcagcctggcacatggtcttctgcagctatgacaagcatgtcagcagagggtcctgggaacagcttccttagcgtttgaggccaaaataaactgaagtgacttaggggctggtttctgtgtgctttgtgtttgggcttacagtggtggactggctcggtttggcctgtctgtgattagttgggccctcttgtctggagttggcagaagtcaccatggtgcagctgagacacacatttcagggagtgtcagaatttccagggtgatgaagaagctgaagaagactaggggtctgtgggggtacaaatggggagtggtcagagtgtcgccagctgggattgtgtctcggtgaagttgagaactgctgagtataaactctgcagctgttgagcatctctggatctgctcggctggatcgatccttgaggccagactcccaaccacagcatcccagcagcatgtgtgccccagtccta

SEQ ID NO: 24511 - DNA, 1165 bp, Mus musculus
ggaagccgccgcggccacctaatcctgggcccccgggtcctccgggccctcccgctgcaccggcgtcatccgccatttgctagtgacaaaaagaagaggaaaaaaaggaaatcagcagaacgctaggctgtgcggtcctgccaaaactgtgtctgtccggatgtccacggattcccacggcccaggccgcaaagccaggtcccagcaacatagactcacgtgttctcccgaagaagaagaagagggaggcgccgcggaagggacaatttatagtgctccaagaagcgcgagatctcgactgcctacgcacagcacccgcaggctgtggttggctgcgtcttgtcccgcccccgccgtgatctgtctgcgcctgcggactttccctcgccgaagccgcgccctacaccagccggaaggacgtataaatactcgcgcccgcgctgggccgtcccgcttgtgtccaggaacccgtggcgacgttggcgtgttcgggtaagtcgctcctcacgggcttctccaggcttacgcagttgatccagtaaatgggcgttcgttgaaaatcaccctcggctttggcttgtagccgggggtgagattcggcgcccagagccacagaggcctcagctcaccgcccgctgccccggtgtgggagggtgaaacccaggcccctacattccagagcgactctgctgccccgcggtccgccctgtggccacagtcttaaccgcctcatttatttcgcaggttcccctggatatggacgttgccgccgcctcccgcaagaattgtcctcttttctcaaataaagtgatttaacctaacttatcgtatgttggtgttttttggttttggtttttcgagatagggtttctctgtatagccctggctgtcctggaactcactctgtagaccaggctggcctcgaactcaaaaatccgcctgccgctgcctcccaagtgctgggattaaaggcgtccgccaccacgcccgacgagacatttttttaaaagatttatgtatgtgagtacacactgtagttgtacagatggttgtgagccttcatgtggttgttgggaattgaatttaggacctctgcttgctctggcccaaagatttatttattattttaagttcactgtagctgtcttcaaacacaccagaagag

SEQ ID NO: 24512 - DNA, 1165 bp, Mus musculus; identical to SEQ ID NO: 24511

SEQ ID NO: 24513 - DNA, 1137 bp, Mus musculus
tctgtaggagacttggttcaggtcatctctaaatgaccctcaaactgccaccaatctccttggctgtccacactgacccctgtggcgctctgaggatgtgccttggccctcactaaagcttgtgcctgtctgttctgggctctgcaggacatggactgcgaatggcctgccccctgccccctgccccctgtcccctgccaaccgctccagcctcagtcaccgaatgatctgctctggtcaaatccttctatgccagccagggtggtgatgacccgtgacctttgaggaggggagtaggctgataccgggaactcttggatccttgccttctggcagagaaaacaaaactccgtttcataatctgcaaactcatcttgcctcactctagcttggggaagtgacagttgttgccccattagctggccagcgtggcagggaccctcttctcaccactttgtccagcgtgtacctcccaagagaaagccactgtaccttattggtgtgtttggaagctcttgacacctgggagagtggctgaagctgagacccactcccccccttgattgctctctgggatgatcaagtagaagtcaataaacatgcagcctgagccgtttccgtgtttgttgtctcatgctaggattgaactaggattacaagcgccactgtactggatttgattttaacagtgttcaaacagtgcccagcgtctgctagagccctagggagatgttagtctcccctcatctgtctcagagccaggaggattcctcagtctctgggaagagggtgcatgtcaggtttgacggtcttgaagcttggaagagccaggcagaggccagggctgcaggagtttgaaacagttacctggagatgctctgggctcaaggccttcttgtgaataagactggctgttcctttgtctggcccactgttgagatgtccctcaggaatgaagggaggtggggcctgctctggtgatactgcctgctgaccagccggggcttggtgtggtaataaattaatattaattgggggttactaccctagctttgatcattcagttcccagataaaagacacaaatctttacaggtataataagccttaatagcactaaagctggatggatatcaac

SEQ ID NO: 24514 - DNA, 1128 bp, Mus musculus
tgctagacatgtcaaaaaagatgaatccttaaaaaataacgtgatctaaaagacctgggactgaaatagaaacaggaacaacgaagctaaaggatatagaatgcttcccaagagggcaatgttaaactaaactttgagaagttgtagttttcttttctaaaactgaactgaatagacttttcaataaatcattctgaagtctatacctccagacttaaaagtgcaaaggaagtaactcattaatgctgttggcctttaggaaagctgtttgtacagagcactccagttgatttttacttgggaaagtcctccacctcaaagccagataagaattttgttaagtgagctcttgctgcagccctgccttgtttactttgggtgtggcttctgagtttggaagataattttgaaattgttttccaaataaagaccatttctgtgtgactgaaaagagcactttcttttcccagggtggggagcacttcttcctctgggacttaggaccttggcctttggtttcctgagcactgtgcctctttaacttattaaccacataaaccaatacttccacctcaaagacacaggccctagggaactgacaagcctggagatgctgtgtgtgttcatgcttgcacccctccctgataaaatgcctgtcaggatgcacagcacagttgtcagggcctagtggagtcttgtagaattagatagtggcttttgctgagagggtacataggagcctgctggtccctttaagaaggcatgttacatcttgttagtagtttatcattactgtaaggcaatatgccaaccatagttcattccatatttctgtgtattctgggtttcttgtttgttttttttgtttgttttgcaaagctataccactggcattattattatttctgatgacaatgcagacttagaagatagaactgaagtagagccaagttgtaatgaaattgtcacaaactcagaacctgaagttttaactacagcataggtagtgtcatataagtagatatataagaaaatttaagcatttaggtattctgtgagccccatgcttaattatttattatgaggtcccatagtgctatttgataaatatgaaatatgatttttaag

SEQ ID NO: 24515 - DNA, 1137 bp, Mus musculus
ttttttagttttcgcttgtgttttgacccagggtccctgactggcctagaacttgccttggatcttttgaggtcttcagaggtagaagaggtgtttgcttgcctcttgttttcttttctaaacgatgccatgaagaaagccagagcctctctctttgaccctgtcctgggaactcccagtgatttcagtgatgtaaggctaacctgtgcctccctgtcactctgtctttgtggctgacttatcagggtctcatggccaggcctctgaggcccgaggctccttggggacggggagtttagccttagtctcgacctgtgcctcgcagcatggctgctgtttttcaggctccttccccggggctccctgtggctgtcacttacccctttggggatcttgtgggagctgcctcacagccaccaagcccttcccacactttgccttttctcttccacctcagtaactattatttccgatgcctctttcctgataacgtggagggttctggatttttctatcaccttctctcagtgccaccattaggtctatggctgggcctcaggtttggcctgtggcccgcaggactatcaaattgtgttcttacttcttggtggtgacaaggtgatgaggccatggttcaccctggcctgtgtgaccactgtcctggaggcagtggagcagagggctgagtcacatgtcccttcctgttaaggagagagaagcctgctgcttcgtgagttgttttggagtaaagtagccaaggggctgacgggacataggtttttccattcctcatcttggagctgagggtgactcacagtgtgactcacagtgtggggatattcctagctgtacctgaaatcatggccctgctctctgctgctgtcttaaaggtgaaagggctccctagggaaccatgggactccctggtgtctgtctgggaggtgcctccaccctggctggcctgtactctgcatgcaaatctcccccaggtgggcagggctgtacttctacaagttcccagcatagcctttgccaagcgctggcccaggctgggctttgcattaggattgcctgggggaacttcccaacccacatcccctccctgtgcttctgtgcacctgggagctctccaggtga

SEQ ID NO: 24516 - DNA, 1213 bp, Mus musculus
gttcacctacaaccccttcatgagagtgaagtaagatggtagtggggctctctcttgactgcacccctcctgtggtgtagctcatgccttatgacacgagatgaaccagggctgagcccatcctgaagtgtgcgggcctgaccctcacaccccagctttattaagagtacccaagaggcaggctttgtcccataaatatgatatgcttttcttagcatcttgcaaggatgtgagggacccaggacccattcggggagtggctttggagggcttctttaaggatcggtgaagctctgggtctctgggctaggtaggcagtgtagagctggcggcttccatctgtattttgctgggagcgcctgctaggcttgcttaatcccagcggttttcttcctgcggacccaggctctgggaacgggctgtttgtgtgttgcctgcagcctgttctcttgtctcgccgccccagggagaagactgtgcaacagcatgctggcgagacagaccctgtgaccaccatgagggccatccgcagggagaaggaccagttcaaggtgcctcgggactgaggcacacccacgctgggacagggacttctaaccgactggcctgctgctaatgcaggacagtctacttttcagttaattcagagcccttagcttgtgttatcaaatgttctaatgcatatttataagagaaaaaaggtttaaagtatttattcccataacctctgcttatggactctttattacctctggctctcccggtctataacctcagggtcctgtggtcacatgacatccagtttgccccagtttgttagaggtgcttgctctgggagggactgagcctgggtaggcctcttgacatcctggctctttgggaaggagatgcctggcacctctctgagcttttcctccctttttgactagcctcaagggtagcaactacttccaggaattagtacctgtgtgtgtctgtgttgacattttcatgagatgcttctgtgtcagtgtgagtggacttaagtctttgagagcaagttggggcacagcctggatctcaggttgccctgttagaggcctcaagtctggcctcagcgaggcaggcttctgatgtgtgtgaagctagccatttgccaaggcccttctttaggtcagactgcttctgggttggccaccatggaggctgtgctcagcgttgtgaattctcagca

SEQ ID NO: 24517 - DNA, 1258 bp, Mus musculus
ctggatatgaaacctggcttatcacacttggccgaagcacctttacccagtgagccattttgtcagccttttcctggcctttgtcattgcaggctctgtccccctggattcccaacttaccaggagcttggaggaagggcgtgacttcatccaggaatttcccaaaagcactgcatattccgcactcacgtccatagcccagagagttgtgcacaggatgtctgccctgtgctcctgaccgcctggcagccttctggtgctgcatgcctgtaggacctttgggagcagaggccctcaggactgttttgggacctgtagttgttggcctgggcaatggctggactatgcgattacatccatgcagagatctgcaggcccccatgtccttggctgacactagcttcaccaaactagtctatagctgaggggatagcctgcgtcctgattccttgagataatagcagccttaacctttagcctataggctttcgtccagccctagtcacttctgccccaggtcaacaggctgctctcatagccacaccacacaggagctggccagtgctttctcatcgagactgacccacacatgctgtgttgtgtgccttttgtgacactgtggtttaccggcacatctggtaactttacagaactctgctattaaacataccgccccgtcttaggaaggacccagcatccaagccctttgtcctcagcgaggtgactcttgattcccctacatttcatgtctggaacaagcagtattagtaaagattataaagggcctgaagatgtggtcaaggtgtctgtcttgtttgggggaatggggttggcacattgtgtttttggaaacctgtggatctgctagcaaatggctgagaccgttggaagcagaaggctgagtgttcaagtgtgagctgaggcacagaggccctacttccctccttcctagagaggtcaagggggagagatgattcctgggcaaagctgaagtcttcaagggatatggggtccaggggaatgtgcaagggggtgattcctgtagtcagatggcagtcttcaactcccagctgcccccatccccaatgaagtagtgagcaggtggtgacctcacacctgggtgctgatgacttgggccctggacacctgcaggaacccaacctggccccagtgtagtgccctgagcagggatgcagggcctggagggagcgggggagagggtcctaagaagcccaagaggaaatgggccagatccggt

SEQ ID NO: 24518 - DNA, 1206 bp, Mus musculus
gtggatccgggaagggaatcgggacggtctagggttggggccctggtataggtcgctactcctccccgtaggcctccgaagagctactgcgggagcattatgtcgagctgcgcgagaaacccttctacagccgactggttaaatacatgagttctggccccgtggtggccatggtaagtttccgatgacctgcaaggggagagcaaggccttgggagctctcatcttgctgacagtagcccctacaggtgtggcaagggctggatgtcgtgcatgcttcgcgagccctcataggggccactgacccaggggacgccatgcccggtacgatccgtggggatttctgcatggaggttggcaagtaagtcttaccatcttccctggccacccctcatccttctccctccccctgctcacttgccattcccgcacaggaatgtaattcatggcagcgactcggtggaaagtgctcacagagaaatcgctctttggttccgtgaggccgagcttctgtgctgggaggacagcgccggacattggctatatgagtagatgttattgcagtcagcattaccaatctggaggttgttggtcttctgtgatcttcacagagctcagcatcagtaacagtgctgtgtgagtgcaggtcaacccaacctagtcggtccagggacaaccactcccaccccttgttgcctttcataataaaactgcagaaaacccttgtgcgctggtgaagtttcaagacaaaagtagtgttaagacatttattacatacagagcagatatgtgagttcacttgcaaggccaaagcctgaggaaagttgcactggccccttccctccagttgcaccctcccaactaaccctggtcacgtcacactcatgtgggaacagacaagggacatacatcacagtggagaggtggcagggtggtggggagaagcctgcagctgcacactgctgcagcttgttgtggccagacaggctcaggggcagtgcccctggatctgtgcttctctggtaggaagcgtgcagtagaggccaactgactcagtgcccctgacgagcaaggccagagccagggcagcacctgctcccacacacttgcttagaactgtgcccatcctggctggtcctcagctcttctggcctctgcctggaagcctcttgtcagctgctctccaagggagcaggccacagccggc

SEQ ID NO: 24519 - DNA, 1191 bp, Mus musculus
attgggacaggctgtgtgtcattaaggtgaaacctgcatcaaatcacagcaagcacatgtcccttactttttcattacccatccgttgactggctgcccttacctcacagaaatcatttgatgcccacccaaggcgggaaagccaggtacgtcagctggcctggatcggtgatggagtgtgggtctctattcgcttggattctacccttcggctctaccatgctcacacccaccagcacctgcaggatgtggacattgagccctatgttagcaagatgctaggtgagttgggcatggagccacatgcctgtgctctcagcacttgggaggtggaagcaggaggctcatctttagctccataaagggtttgagtcaatccttggctatatgagagcttatctcaatataaattaaataaagatgtaatgttaggggatgtgccaagcaaaagcacccattactgactgcactgaccctcttcctgtcccactcaggaaccggcaagctgggcttctccttcgtgcgcatcacagccttactcattgcaggcaaccgtctgtgggtgggcactggcaatggggttgtcatctccatccccttgactgagagtaagtttccaaccctagatggcacctctcaagaaagcagcagctgtgctagactccccgagtaagtgtactggggagccgcctgtctgggcaagctcacccttcctttttttcttattcagctgtggtcctgcatcgaggccagctcctagggctccgaggtaagtgctgggtacttgcccactggtgcccccagtaatcaccatctccagctgcctgctgaaaataacgtggcccaatcttcctgtctgttttcccagccaacaagacatccccaacatctggggaggggacccgcccagggggcatcatccatgtgtatggggacgacagcagtgacaaggccgccagtagtttcatcccctactgctccatggcacaggctcagctttgcttccatgggcaccgtgatgctgtcaaattctttgtctctgtgccaggtacacagctgatcttaacccactttgcccactgtgctactgtggcatagctatgaccttttcaggatgccacagtcctgagattcctctgcccataacaggaaatgtgctggccactctcaatggcagtgtgctagacagcc

SEQ ID NO: 24520 - DNA, 1180 bp, Mus musculus
ccccaagtgtcctgagtctatccactctatgcttgaagttggagagcagacttttaatattctgtactgtgggacagaagttatcaagagcaggaaagatgacaccttctctctatgtccactacccccagcaaaaactagtcctcaggttctgtctgaatgacttttagcagggactgcagttccaagaaaccattctcttagactttgaagactgtgctgggtcccatcatactcttccctcctgtgtctgaccttaacgtctgagcactgccccaaacacttagttaagcttcttggggccacttttgtgagaaactactggtaaactcacctaggttacacagttgctgaccagcaacagagcaggccccagaacagctggaaatgacctcttaagcacaggatcacaccccagacataattgggaaaagccaccttctgtcaaatactacccctgtcccagaaaaggcaagggtagaatcaggcaggctctgaggaagaccagtgagagtctgggtgctccagcctcaccccgacagctcaccttgaacagatgtaacctgtcattttttcacccagtgactgcacctcttctgcccggcgggagcagaagcgggagcagtaccgccaggttcgtgaacacgtgcgcaatgatgacgggaggctgcaggcctgtgggtggagcctgcctgccaagtacaagcaggtacttgagacagggggtggtttctgggtatggagaggatgtgagaaggacacagtggtagtgcagagccaggaggcacccatttcctagctggtgttggtggatctgtgactctgagggttttctagtttgctttctgttgctctgataaaaccctgagcagaccagcctgggtgaagaatgggattatttgacttaacttccaccatcaagggaaactgaagcagaaatcactgaggaatagtatttactggcttgtttttcattgcatatgcaacttgctttcttacacatcccaagatcacctcccacacacatgcctatggaccagtctgatggaggcagttcctcagttgacattccctcttcccagggggttctagcttatgtcaggttggcaaaaactaaccagcacagagggccagcagagccagacccagtgcactgtgtaccagaagcccgcaggcaact

SEQ ID NO: 24521 - DNA, 1135 bp, Mus musculus
aagtcctgtggcacagcacactttacttcataaatgtgtctatagcaaacactcaaaccctcagtcctgctgtacttctaaggaaaaagtactgtggccttgagtcctgactgatctttgtgaagctcactgttttagtgatagtttctaggagatctttaggttttcttcttgtttgcaaatactagccatttgtctactactcacctcaaacattgatcctcagcataagagtccctaagtttcagccttagagtaagtcaggaccaacttattaagccagttttctcctttccagaatcctggccagctatatctgtagggaaaggtaaaaaggtgcttttgaaaattaagaaatagggactggagagatggctcagtgattaagaacactggctgctcttcaagaggaacaaggttcaattcccagcaaccacttggtggctcacaaccacctataatgggatctgatgccctcttctgtcatacatgtgtacatacagatagagtagttatatacataaatctttttaaaaatctgtgcaaaaatttaaaaaaaaaatgccagttgtggtagttcacaccttttatttcagcactgtggagacagaaataggtaggtctctgtgagttcaaggccagcctagactacagagtgtattctaggacagtcagggctacacagagtaaccctatcctggaaaactagatgataataataataataatagtaataataataataacagtaacaactatagaaacatagcttgtaaggctgtgcctaaggggctggagattagctaagatcatgtactgctccttcagaggactgagtggttcccagcccctctatcaggcagctcataactgcctgtaactcaagctgtaactcaagctgcagcaggctctgctgtccagcttcctcaggcccctgcactagtgtacacagcccacccaccccaccccaccccacatactcataatttaaaataatacaaataaatctttaaactgtacttaaactatagtgttgctgttacagctatcattcaatttttttgtttttatgctttagtatttcagtaactaaaacacatttgtcactttatgtggttacctcgagaaatagcta

SEQ ID NO: 24522 - DNA, 2996 bp, Mus musculus
ctactccaacagtgccacaccttctaatagtgtcatccctaggctgagcatacacaccatcacaagggttttgacacaggttgagaaccaccatccaaagtgcttcctgactgattggaccagttggcttcagaactttctggctatgccgcggcactgactttcagttagtgcagcttgctgcacagtgtagtggactatgcacttgcctttcatggacttttgttgatttttatcctacagctgcaacagactccacacccagaggagagcagagtgacaaaggaagctcaaaagaagtagagcatgcaaagataccggagcccacacctacagttgacagtcatgaacccagactggggccacgacctcgctcccacaacaaagtcctgaacccaccaggaggcaaatccagcctctccttctattgagaagctcctgctctgcctgtaactagaccagacagagatagagtattgaatgttagtgtttcctttaactcaaatgagctggggtgggagagggtttgtcatgcgtgtggggttgactgctcataagccttgttgtcatgggcagagctgcacagaggactgccaagacatacattgtggggtaaactgggatgctctggtccctcctctctaactgctctctatgaaacacatctgtaaagttctggggaaggcagaagagctgggccattaacagaagggttccagggtctttcttgtccttgtgttagcaggctgctggctgttgggcatctaagtatggtttggttgaaaaaaaccccacactactctcactgtgggctggaggagacacacacaaacagaaactcttaaagacaaagtggagtctgcactaactaagcctttcaggaaatgcctatcactaaatgcttccccctctgagatacctcagaaccctaatgtctcctctccttctcccattatgtcactctgtagtattgaaacatgactgctctttttggtagcagtcaacagaaagtcaggccgttattctcagtcctgtcctgggtggaagggttttttatacaccaatcttctgagttgtcccatactgcacctaaaatcatggccaggtctgtggtagcagcctgtcttcctctacagctggcttagttcctgatgtgccagatttgcatgtgggttgttccttttgtttgtctcatcagccttaagcataggccttagttctgcacctgtgaggggttctccctgttcatggttcttcctgtacagaaggtctctggcctctgcagggccatatatgtccaggtattgggtggattcctgttctcctgtcttgctttgctcctataattgggaggaaagcctgctgaaggatgttgggttcgttggctgctttaccaatgtatggaaaggtgtttttagtgtcagcttcttataaatacctgtgcattgcttcaacgcttagaaaagtgctactctctacaccaaagcacaagagctgcctttagaaagctttagacttcttgaccctgctcataaacagtgctccttgagccaggatactaagtgttttggcaggaaggtcagaacagtcatttgacagcagaggtagagtcacgtcacttcctgccaggcagatgtccctgttcagcccttgcggggttccttctttcccctctggggtgcatctgtggaaagggattctgagtgctgctgcttctgcttctcccgcccacagagcgcttcacagtaggtgccaaaaatgtcctcagtaaatcttggaaaagtggcaatcctgcattcacacaccgacacactgacctacaagtgcctgcaggagccacctgccgggctctgcatcctacccggtctgttgagggctctgaccatggctttatcaaccaaagagttttcctcttcagatgccctgtatcctgaagccaagtaacaggtcttacatgtatgtaattctctaacaactcaaatggtttgtggttcagtcatcatgagctctattttggaatttagagcatttttttccatttaagaaaatgtcataaatgatgttgactttatttagcccagacactaacttttttagcttataaggaaataatacaatgatagagataaaccttttataactgctctcttaagtagaaaatgatttgtgagttccaaattggattgtctcgaggaatctaacatcactatgctgattctgctcttagccctgtgagagaaaagcttcaagcgccacctgctggcctggatggctgggaggatatggggacctgcaacagtggtccacagcagtggctgccttattcatctcccatccttctatcttctgctacagctggactcagagtgtgaatctgtaaattagtgcccagctaaatccagtaatatacaattgtcacctacattaagcattaaaactttttttaagtgtatctggtgccaatatttttctatcactgtgtcagagcaagaaacctgcccttacattataatactttttttttgttttgttttgttttgttttttttgagacagggtttctctgtgtcgcccgggctgtcctggaattcactctgtagtccaggctggcctcgaactcagaaatccgcctgcctctgcctcccaagtgctaggattaaaggcatgtgcaaccaccacccagcgataatacaattttgataggaacattttgttaattttttatgaggcagaactgggtataatggttgaattaaacttactaaccacatacagcctgtgtgtattttgtgtttgtgcttctccatagtccaattgaggggttgggaaacaatgctgaactttgacccttttttatagcttctctttagtaaagttcacttctcccttccttgatctagaaatgcccaggatttaatatttgaacagaattaattgggaatatgctgtaatctatttagtgttctgtagtcggagtttattctttaggacaagtac

SEQ ID NO: 24523 - DNA, 1076 bp, Mus musculus
tacaaagtgagttccaggacagccaggcgatacagagaaacccagtctcaaaacaccagagagagagagagcgagagagagcgggaaagaaagaaagaaagaaagaaagaaagaaagaaagaaagaaagaaagaaagaaagaaagaaagaaagaaagaaagagaaaagaggagactagacccaaggctgttagacctgaccgcccagaagaagatggtcagaataagatctaaagatgggcgtggaagtcaggtagtcttaacttacccatcaactgctttgtatggtctacaatcttgttaagttctttgtagtgggccaagctcccccatccccacctcctccccccttttcaaaggaacttctatccctttctaagacccttcaagaaatagtaacggttggtggggtaggtttgatacatcctctttccccttcctcctaagaagacagtgacctggcatctgtgactggcacactttacacttccctccctgccttaggctgactgagaacttcacacccattacattgcaatgatagacagccttttagctctttgaatgaaacaaacacattttaggtacttttgtttttaatgaagtctttgagtggtcactgttttacgtagctgttcagtcagtcctaacctccagtcttgcttttatgtggtagtctttgattttaaatatttttctaaatatttgaggtcatgcagtctcagtggttaggcctactgtgagaaggtgaaactaggtgcagtacacacacctttaattcttgtagtgggaggcagagcagagctttctgtgagttggaggctagtcaggtatacatagagttctaggacagccacagcttcttcagctgcgtaggtaaccatagatcagagcagggagggaggcaggatgaatataggccattcaccgatttaaaattcactttcaagtggcctctcttcaaaattcatgtcttattttttagatggtctctggtagcctttactgactttgaattcactctatagtggaggatcagttttggttttagttttgaggcagtctctttacgtaggt

SEQ ID NO: 24524 - DNA, 4149 bp, Mus musculus
ggattccaaaattcctcatagagcagttggctccttccactgacattctgctctgggggtcaagagcctctctctggatggtaagccgtcctcagactaatgtctccttgtcccttctgtcctacaggtggtggattcccagttggtgtgcatgatgaacgagaacagcattgactacatatctcggtttaatgacctggcccaagaattgtccatcactgagcctggccgccgggaggttctttttgatggtggaggaggtggtaatcctgttggtgacctctctcagtgactatgctttgtgacacgggcatcgtggaatccacaaaggaggtctacggagctggtcccatgaatctgtctgcacagtagagaaagtcaagcccagaatcctgagaagacagtgaacaggagcacctctaacagcataacaatatccacatgcaaaggacagcctgtgcaacaagtaggggttgtaccatccacagaagccaggacagctgacccgagaagggtagacctcagaaatccttttggtatcagagcccttgaagtcctgtagcctgtgtggcgtcctgactgtatgtctgtctgtgtgttgagccttccagggggtctcctccttgcaagaggagttcatttgcctggtgttcattttgtctttggagctgttatccatgcgaagggaggccatagccactgctgctttctttctgatatcttttttccacttggctgttctgtctgcagtgatgttgcaagggactgtgagtatagtccagtctattgcctggtggtatcttcaacctaagatacttcctggttgccttgaccatgaagcagagaagggtcccagagccatgtagataatggtatcttcccaagactacttagccctcaactagtgcttcctacccaaaccatccagaggtgtggttctgcctggcatgaggaagggggaagaaattttgtttcttggagcttgtatggatgttttgtatggtctttcaaagctggttgggaatggctttcttgcggtttaagaattgagagatatggacaaggaatagtaagagtcctttatttaggtggctctgctttctacctatgcttaatgcctagttccttctctctctctctctctctctctctctctttctttctttctttcttttttttttttggttttttgaggcagggtttctctgtgtagtcctggctgtcctggaactcactttgtagaccaggctggccttgaactcagaaacccgcctgcctgtgcctcccaagtgctgggattaatgttgtgcgccaccactgcccagcctagttccttctaagtgatctgagataccatttctctctaatggcctgaccctaccccaacccccaaatgcactgcaatgtctacagattttatccacacttaaaatttcatgtgttattgctggtatctgaggggtgtctttgccccaggctatctctcttcctattctgggacccaagccaggtttagatgtcagggtgtaggaagagctcacagcttgatgatgttttagcagccctcttcaggagcccagaggtggtcagtcagttgtcatgctcaggccatcggactcagagtggtgccaaaaatacttccattccccttctttgccctttagtagattcttgtaacatggtcactcttgctggacctagcatatcaggtagccatggctatttcttgttgaacaggtgacccctgtgctagccacgtcactgctcactctccacatgctagccagggctgacacccctcccaccccaccccaccccactccaccccctttcctttttcttctgagacagggtttctctgtataaccctgctatcctataacttgatttatagactgagttggctggagatctacctgcctctacctcctgagtgctgggctgaaagtaatgtgctaccacaccaagcttggcaggtccttgtaactcctaaagctgccacctctgttttccagctgttctagcctccttccttgcacagtagtacttaagatcatcctaggcccttacgtctctctgtctgcaatgaagaaagggatgggaatgtccttttgggacacttgatccagttgcctctctggctactacaaaccctagagtgcaggctctgctccaaagaccgtatagggctctggtactggtgaaggatctgtcccagatgctgacatgcagaccccacatctggtaagagtcagactgttagatgagaagcgcaagcatatggtgccgtcaagagactgtggtaaggtagccaatgtgtctctacccagttgtgtgctttcagcaatgccttacttagctgaaggcatttagatcttgggactgtagcctgtaccaggctaggctcaggccactgctagctgctcttcctgtgtttcaggtagactctcccacaacattaataagcatgggtgcttgtagaatcctggtaactgcgcatgtagaactaggtagttgggctcttaagctggtttccatgaggcagtgaatgctgtaggcacatgttagtctgtgccggctaaaaggagttgagacgtcttgaggagcagagactacagcccttgtctcccagtagcaagcggcatcagatggactggtgcgttactgtaaggaagctgacaagattccagaaggttcttcaccagccatactggtttgctcatcatcgccacattaaaggacaaatggtggcatttgtagcagagaatcagtggatacaacgtctcccagcgtaagcaaatatccatgcataaaacctgaaaactgctaaaggttagagttttttaaaaaacaaaacaaaaacagcaaggcaggctcctgggttctacatcttccttctcttccttccatcagtttggatggttggcgttcactcgggcttcctctcctcattggaacttagtgtgacttacatgcggtcattctttgagaaaatcttttgttaatattaatgtttcttagacatgttgattcatctttttaaaagatggggaacctgtatctttggtgcttggcatggattgtgtcctagagaagatgctcaggcgagctgaagtccatagatcctgtcgggcatagtacttgctcagggagtgggactttgggacatttcatctgttggtcaaccttttttcctaccctcctcttctttttcattccttgtgatagcctctgctaggggaggtgtcattcagttcaatagcatttttaaccaaaccatattattagaaatggtcaaaataagtttagaaggaaattgttttatgtactttaaaaacaaatctcccagatgcattcatgaggaaataccgtactttgtcttaatttaaaaaaaaaaaaaaaacactttaaaaaaggaaagaaacccacagtatacctttcccagaggctagcctggtgtggtcagtccagttttggaagcactgccccagccagacccttattctttcgtaagatcactggctggaggggtgcccccagcaggcagagctcagtgctgtttgctttgataatcgttaagccatatcatctgaggtttccggcttgagatgtgaatttgttttatagactataaatatacagtgtatgtataaagcagaatgcctgtccttctgattattttttgtaccatattgtaaattacattatttattctttaccaattttttgggaataaaaggtgttttggttatttaataaacaagaactgttaaaacttcggctaaaatttccagttcggcttgtaaatgtttttattgtgcataaatacatactaatacttcatctaatgtctgtcttttgtgcctgctttcaaagccagtatgcttagggtattccaacaggcacagtgtaatgagatgagctctaaggcctggaggtgccctggaggtgagggtgagcaaacaggtaggcatcagagattcagcgattgagtgaccgctgaatgcggaattcattacagaattcgctgcttctgttatgggtatgttgtgcgcttccatgaacctttcctcccgaaggtgctgtaaccccaaagaagccttccgctaccaccggccagaaacttcctagtgccatccagcccgggat

SEQ ID NO: 24525 - DNA, 1186 bp, Mus musculus
aagttagcaagtgtctgcagtgttgagtggcttgctatgaccctagctatgtctgtgaaggaaaccttccatagctcattgtgcatggtagagtgtggaaaaaccaggtgatatgcctacgtttgccttcctctcacagggagaggctggttccggcccatccagtcttctttgaccaaagcagctctgtctcgaccgatagtgcccaaggtcctcccatctcaggccaccagtcacctgcccagtaagtgatgcacagtgacagccactatgtgaggttccttagttgcttttttggacatacatctttgtaatattctcttcttctccaaggcataatgtcttactgctttgctaagagtatatcaaattgcttggctcttcactgaagagaggtgtgagggagaacctgtcctaagctctctgggcatacatcatggagtggagtattatggaacagaggtttgatatatcactcctgttgctaggtgccatcgacttagcagctcaaagtgctggcatcatccctggaagtcccttgccaattttagatactgatggctcatctggcatctctccactgtcttcagaacaagcaaccactgccatctcggggcagggtgacactggaccacaccagaacagagaccctgttactgctgtaagggtgagaacatttacaagggctgtttgttgttcccagtagcttctggagtgaggtcatacgtctgggtcacactgaaccctgttgcacctttggaagcctaatggttagagaaaacactgaaccagagataccaaggtttgaacacctaccatggagcacagagtgggaggcagtgaagagacatgtttgctgtgtggttctaaagaagccattgctaaaccatgcatgggggtatagctttgaatttcatcctagtaggctgacatcagcccatgggtccccacttaggaagtactgagtgcttggtatctctgtggaaaacagttcgtatggccttgaccactctttttcatgtatctccaaatgctctgattcctttgcttgttggagtagaggctgggttttgtagaccccatggagctcggagattatgtggtcaggctgttactgaactgtgtagtttcctcttaaaaatcaataaatggttgtaagtgcagagccgacaatctgagagttgtt

SEQ ID NO: 24526 - DNA, 1198 bp, Mus musculus
gtttattattttggtattaggaaaacacgagtttacaaacttgattgttttgtaaagtcccttttcactagaggatacaggtgtgctggagcttctggggtctgtgctaagttccgacgtctacagtgactttggtggtggtgtctcaggaaggcctgcatgtgcactcccaccggtacctcacctgccatgccttgaccactcagttctctctgttcattcagatctgcttttctgtccaagatgcacccacttgagaaaagaggaacaactgcagttgttgatgcctcttaagtttggctgctggggttcctgtaagcacgccagctaactcataagtaactgtacatagtaagggtgctgaagctagagttgagtgggttgggagctgggaaatgatgagagcggttcgtttttgtttgcacaagaagaagaggttccccgttaacctctcccatagatcactggtgcttctggttctgattgctgtccactatgtggctgtagtaaagtaagctatcctagtgcttctaggagggagtgagaatctgtttcctctggcagcttctttggcagtgcctgccttcctgctaagttctctcggtagctgccatccactcgtgtgctgcacaggccattcagatacacctcaccgtgccctggacatccccgggctggccttgcagaaacttgtgctcagtcatcagtcacctctgtccacgaccaggagagatcaggtgtggccacatgcctaagcgcactgtgtcacaaccctcagaaatggctctctggaggagcgcttcttccgcacactggaaatgtccactttggctggccagcataggtcagtaagaagtgaggagtgcctgagtgtgcagctctgacttggaaaaaaccctggtttgcatatgtgaagggagctgacagctgaagcagtggcagtttctctgctggttccatcttctaagtctcattgtgatgggagtttgggaagagtgacttatggagaagagggaggccctccttgtttggttgtctctgcatagctgtgcttttttcctctgaggacagaagagtagatactttgacttgaataaaaatttttctagtatagttctacaatttttttttgtgataaagagagagacggcaggcatttttcatttctataactttgctcttgaatggctgtagaggc

SEQ ID NO: 24527 - DNA, 1205 bp, Mus musculus
tgccaccatgcccagcttgtcagcttctttttattttgtgcctgtgagcagcacatgtctcaggggtggggggtggaggtgttatgtagttcacctgaataagaaactttaagatattatttttattctatttatgtgtttgcctgcatgtatgtatgtaccacatgcatgactggtacctgcaaattccaagagatctccttggagttggcattatagatggtgagtgctatcattgtaggtgcttggaatcaagcctgggtcttctgcgagagcatcaagtgctcttaaccaaccactcatcacttctccagctcttgaacaggaaatcttgtattccttgtagataataaagtcctctcttaggtggactgtcccctgcagactacaggccttctgtggttctaactggactttttttttttttaatggttttagagctttattgtagaaaggcaggaagaaagagagaagatagaaagagggagagaggctgaccatggccatgtgaagagagggaggaagggagggagagaaggagagctagagatgagagtaagaaaggtgagagcgggctggagagatggctcagtggttaagagcaccaactgctcttccgaaggccctgagttcaaatcccattaaccatatggtggctcacaaccatctgtaatgagatctgatgtcctcttctgtggatctgaagacagctacagtgtacttagatataataataaataaatctaaaaaagaaagaaagaaagaaagaaagagagagagagagagagagagagagagagagagagagagaaagaaagaaagaaagaaagaaagaaaggaaggaagaaaggaagaaaggaagaaaggtgagagcttaaaaaacctaactggacttcttagtcatggtgttggtgactatgaatctgccagaaggtgctggtgaggggtgaggccagctaatgttgacgcccttggcccaggtcttagcctgctaggatgtattggacattggcattgatggcctgaaagaatataaggaacacacttgggctatatcttgctactcgttgatttctttctcagcatgacttccatgctctgttggaaggcttagccctgtgtcagatacttgagggattagcaggattgtgtgagagatgctcacttcaatgcctgtacttagaggtgaccgtggaatagcagcc

SEQ ID NO: 24528 - DNA, 1180 bp, Mus musculus
ggactactatgggctgggccattacctaacaatcactaattagggaaattgcttgcaggcggcatgatcctatgaaggcattttcttaattgaggctcccgccccttccgatgattttagcttatgtcaagctgacataaaactatatagtataaccttacatcaaccaagatccactgggacttggccagctaaaagatgtagccactgttgttcccaacaacgatggtttggagcttactggttgccctcgccttcccggaccatccagccacagaccacagaggaagcccaaggacacctgggcagttcagccgacagtgcccaatgacatctggatacgctacatctttttgacgttgctggggcccagtactgacttggactaatttgaaccagttccagcagggaggagtcaagaaatgttaggtttgagcaacttgtcccaccagaccctgacactgagttgtggatgggggcatgcagtagtagttcctgagagtgttaagaggcctccagatactgccagtgacattgaggagtcattgggcctggctcagcctaaaggccatacctgaactcttggaggagaaagggggcaaatgacagagagatgtaggagaatctgtctgggtttgtccatctaggcctctccctgcccaggccagatcatctgggtcctcatcccaggacaccctctaaggaatcctgtctctggaagggactggtcccagagctgagatgggggaggagggtgcctccaaacccaggtcctgcagagggtgatgagcatgtatgaaccccattgcacagtgtgtgtcctttgtctccacttggcctttgaccatagcaatgaccattaaggaaaacaggccctgccacactacccctcactggacagatgtcaagagcttgtgttccccagcagaccctccgaagtctcccagatggactcagaccaaccgcatagtatgccttgtgttgctcttggccacgccctgtccagggcctgctgcttctgccgcccctccagcttggtcctacaaaaatgagcatgtgagacagcggctcttaccccttggtgggagaatgcttacctagcatgcacaaggccccggattcagtctccacacctgcttaaaaccaggaatggtggcacttgcctgtaattccagcattt

SEQ ID NO: 24529 - DNA, 1335 bp, Mus musculus
tgcccaggccccatgcagctccatcttcatctggttctttgtaaataggactgtgtacagggatgtgttctgttctccccacctggatctttgggccttaaggtaccaggcagcgttgagagcctcatgaagttggaatccgcatccagccttcgtaaacccagaaaggtgaaagactggctgatccagaccaaggctgaggccaggtgagagccaaggacaaactggcctgcattgatctccctgcctgttagctgtacagtgggccctgctgtggcctgaatgctagcttcaggccttttggtgccctgcccttgtacctggaagaggcagctctgccaccggcccgggcaaactcgggtcctctagagcacctgagcacacagctcctacacctcctgacctgcattcaactctgccctacggcccaggagaccagcctgctgtggcctcggcacaggatgacctcaggtactactgtccacatactccgcttgctggagctgggctgggtgaagctgctcttggcagtggcccacctgggctgggctgggtctgtgatcttagggcttacagaacacagggaggtgcagtggacataggcgcagtgatcagtctccatcagacttgttcctgaggcccctggaagacccctgacatgggaaccaggcaccagtggctcaagttcagggaccaatcaaggggtggccaggtctgcagccaggagtcttcactctggaattggaggggcttgtgctcacacagctggtggcacctggatgggctgggttgccagtgccttgtgggcacgtttagccgccagtacagtcgggagccgagcttggatgaacagtttgcagcacaaggcctcacctggggagcttaggctggtgtgtgtgtgtagcctgctctcagaatgtcttattttgtaacaactgactacatttagtaataggtacacatgtatatggttaatatatggaaattcaatatattttatagttaaagtattctaaagtaactgatgtttctagcaaactgtagtgaccccagctatgaagtgttccttttgtaccacagtccttggattaccagagatgtgaatcttgtaacataagaatgtggtctgtgaccatcctgtgttaagagggtggggtggagggtatcccagcatgaagcctcattggtaaggaattgtgggcaacagattaaccactgtatctacaaatgctctaattaaaacatttccacaaactgcagccctcgggttgtgtcctctgcttcctcctccctgcctcctagtttctcagtcctagtaggggttctccggtaccc

SEQ ID NO: 24530 - DNA, 1189 bp, Mus musculus
tccctccccagagcagcagtagttgtaagtctccatacgagccccgatcctctggaagaacagttagtgttcctaacctctaagccctttatccaaccccacctcacccctgttttgttgtttgttaaacaagatatcactaagatgcctaggctggccttccattcataatcttcttgcttagcctacagagtagttggtataggtgtgtagttgatgctgctgctcagctcatttgtttgtagtactgggaactcagccaaaacctgatgtataccagggaagtgtgctgccgcagagctgccccccgcccccccagaccccttcatttactaaaaaacaagctgcctttagacttgtacttttgggggtgtacaggtttgaaaataaagcgaaagaaggttgcctagatcaaagtgaggcaccttctcaagtatcagctatagaatagtacctgagtttggagtagatttttctactattgtagagaaatgtggtgtacttgaagcctgtgtacactgaaaaggtctttggggcatgcattctagcctctttcctcttcctatgaacatgagaagagcataggcttagtccctctggctcctgaccatggtgtcttctggctgctttgtctaggctcagctcctcaggaaggaaaggcgtactctcctctttctggaccctctgctattgagtttctgagtttgtatcttttaaaagagctctagtgtcaggaagaccggtcagggccagcacaggatggggacagcatctgcctccaaaagtattccttcccctccctgtcctccaggtaaatttgagcccccactgtttcatccaaacgtgtatccttctggcacagtgtgcctgtccatcctggaggaagacaaggactggaggccagctatcaccatcaaacaggtatggagtagcacctgactgccctcttaggggtttgtcctggtcacagtagccaacagtgtttttcacaagccctctcaatgtaagctgattggtttgctttggtttttggagacagggtttctctgtgtagccctggctgtcctggaactcactctgtagatcaggctggcctcgaactcagaaatccgcccgcctctgcctcccaagtgctgggattaaaggcgtgcaccaccatgcccggcgagctgattgtttttgtttctct

SEQ ID NO: 24531 - DNA, 2314 bp, Mus musculus
tgcccttgtccagcacatgtaagagggatggtctcctataacttcaggcattcaccaaacccagacctctaggtcagcttagtgtctgagcaaaaacatagtttgggttcatctatacaaggctcagttgcagagtatgcagtaatggtggtgtagggcagttagagaagaagcccaaaggacccaggtttcaggaaacttctcctgggcttaccttggcaagtgagccactggtctaaccttggttccctccccacagactccatgggaaggaggcttgttcaagctacggatgcttttcaaagatgactatccgtcctcaccaccaaaatgtaagttgtgcaaagagcctgcagtccacttcccagcactaccaccaccctttgggagccatgtctgtgagtgcttggcctagtaggcaggtgccagtgctgggatagtcggtcctggtgagttgtcttggatgacaagtcccagggtagatgcgcatgtaattagtgtggtctctaatcccagcctattaggatgtaccacacatggcagagggagagttgtgtcaggctgaagcttctgggtgcttttgtgcccacaggagaactcgagtctgtaagttcccatagattacgtgagtggttagcatatatcagctgagttccattcagagcactaaaggagagaggagactcttactcatccccatctgctgtgttctgtgggatgctcatggccttcagaccatggggtcagaagagaaggctggactgatctctgttcagctcagcagaacttgcttgggggtacagtgcccaccaccaccattctgcccaggataagtaaggccaggtctgagctggtttataaatagatgttacctgatgcagagttccccaggagtactaaaacatagtttattgggaaccactagatggagtcttgcctgttctgtttgggatttccttgtctgcctgagttcttttgttagttttttcttttaaggggtatgtagctaggattgaggtagacagagttgttggtctctttcctttcgtgtggtgctggaatcctgagcaaatacaatgagacaagtctctcaaaactggctaggaaaaccaagaagcatgcttaggaggaaaaaggtgaacgtgaagaaatggagcatagcctgcagacgtttggaactgagctgttgtagtggtaccaaatgccatgggagagaggtcttgtactcggtgttggccttggggattggctataattgtgaccctggagttaagtcagtcttagaagacaccagctagggatgcaacggagcagagtacacgtttgtcaggctcttctgggttatcgagaaggagacctgaggcagccaagggctgggcagcagaagctcttggcccttgctgggttatgtgaaggctgtttctctggaagatctctgctgtcaccagtaaagctgacctgccactgttctgtagaactaccagtagaaatgctcacacatgttcacaaagacaggaacaccacggaagccaggttggtaagaatcagaagtcaaagagttggtgcaggtgtgtattagtagcagcctgggaaataattgagattaaagggaagcaagatggagcatctaaacccccagacagcaaaatggtgggttccttaatgtctgatccatgcagctcaaagcagcttctattgctgagtgaggctaaaaacagggaggggctcatgggccagctgagattcatgcaaggtatggctggtagaagtaaacatggttggcaaggaagagtaaacttgtgtttgcaaagtacaagttaaaggacacaaagaagagcccagaattggaaagatgcctgctggagcagacttgtgttgagaatcactgatgagtaagggacccagagataaggtgagctttaaagcagaagtgttggctctgggttagaatactagctgctcctctagtggaccaaggttggattctaacatcccatgacagttccactacaactcccgtcctaggggatttgacacccttttctggcttccatgagcgctacacatacatgatccacaaacatatatatctacacatattaaacatatatatctacacatattaaaaacagggaaaaaattggggttggggtgaaacaggttttcctgtgtagccttggctgtcctggaagttcctccacataccagactggcctcaaactcagagatctgcctgcctctgcttaccaggtgctgggatcagaggtgtgtgcaatcactcttcagtgggttttaaaaaaaaaaaattaaggtg

SEQ ID NO: 24532 - DNA, 1202 bp, Mus musculus
gcaatggaagcaagcaagagctaaggctggaagggcgccgcctagtggacagcgggcgccagaacatcgacttcagcaatgtggacatctccgagctcagcagcgaggttatcagtaacatggataccttcgatgtccatgaatttgaccagtacttgcccctcaatggccactcagccctgcccacagagcccagccaggccactgcctctggctcctatggaggcgcttcctactcgcactccggggcaaccggcataggggcatcccctgtgtgggcccacaagggagctccctcggcttcagcttcgcccacagaggcaggaccccttcggccacagatcaagacggagcagctgagtcctagccactacaacgaccagtcacatggctcacctggccgtgctgactatggctcttacagtgcccaggccagcgtcaccacagctgcctctgccacggctgccagctccttcgccagcgcacagtgtgattacactgacctgcaggcttccaactactacagcccctaccctggctaccctcccagcctctaccaatacccttacttccattcatcccgtcggccctatgcctcgccactgctcaatgggctctctatgccacccgcacacagccccagcagcaactgggaccagcctgtgtacaccaccctgacccgaccctgaggctgctgcatccaggaagtctagccagatctttgagttcttccggagtgtactcggtagaggttggaggcagccagcacggccttactccgtcaagtgcctgctgaatgtgcaggaagccaggctttgtcatcctgtgtccctttgcttctggatatccaaacttctgccaggggacagagctctcttttccccctcttctttctctgaggtgactggtggtttccaaaacaggcattccgttgctctccggtttggataagtgtacaccagctcccgagttttgcatctcagtagataagaagatagttatgcctaaggacaaaggagagaatgggcttcatgtccttatcagcctacccaagacctccctgggaccaatggatgctgttcccacggtgaaagcatgaaaggacatctgtggatgctcgaggatacatccaacccggggactctcttgggaccaatgtgagattgaggggtttctcattaccaccgttcttcccagcaagg

SEQ ID NO: 24533 - DNA, 1196 bp, Mus musculus
tagagggttaagggtggttcatccaggtcacactgatttgggatcctgctgccgaggttgctgctgagacatcctgagtcaagtcttgctcccctttctctatagatggtcattctgtggaacccctctgcaaggaaggaagggctgccactcccagtggttgtatagcacggggggaggttcattttattctctcagatgatcacccagcatccctgtgctcttttctgtgcctcatgtctgtgattttccccactggtccccgtgccctaaatggcccatcctggaggtttctctgatggtgctcccacctagtgctgctgggtgctccaggcacacacatttgtcctgtgccagccatggattcctcctgtggagtcacctgcagacatggtatgggatgtgtctgctgtctagccagttggtggacagagctaggaaatatgaggttaacaaccccacacaaaggagaggaatgaaatacgggtggcagctgagggaatgctcctgctgtgtgccccttgctttgtcctcagggcagccgtggtgagaggggacaggctgtgtcatcaggcaaggactgggaggaagctgacctggggatgatctgtcaacactcagatctggggtgaggctctaggggacttgtatgttcatcgtcagtactgtagacttgaacctacactgtcacatcatgtctgccagatggttagttttagcttctctttgtacatttgtgcagaagccgagcaggaaatgcatcagagaaatggcctgcaaaccagtagtatctgataaacacaagtggaaggcagatagtgtgtcacactgaacacaggtgaaagagcttgacgcaaatggttctctcttctgccagggcattttgaagcacaaactacaaaagctactagagaagcccagtgggcaggggctagggtgatagccccattggtagaatgctttatctttcaagcatgaggacctaatctgatcccggaccccatgtaaaaaggcggccatggtggaactcatttgtaatccagccagcttaatgtacttgtcaaaccccaggtctcggtgagagaatatctcagaaaatagaagatggctgtgagctgaggaatgatacccaaagctgatctctggcccccacgccatgtgtgcacatggacacgcacagatacacaaacacagag

SEQ ID NO: 24534 - DNA, 1972 bp, Mus musculus
ctgtccctaccattacgtggaagtaatggcctgcccttcaggtagctcctcctagtaccgcaggctctgcttgctgggataatacagcacctttccaccagtgggaggtggaaggggtaggacaggaagagggcatgtccccctctccacacccagggggtcagagggctaaccctgacatcctgtcaaccatgcccctgccccaccacaggttgcttgaatggagggggccagctcaaggctccggatacagagggcagcgagctccttcagcagctggaaagactgtacagcatggtgaggactgaggcgcccgaagatgcaccgggggtccaggagctgtaccagcactggctgcaaggagaggactcagagcgggccagccgcctgctgcacacacaataccatgccgtggagaagcccagctcaggcctgagcatcaggtggtaggaggccttgagtctgtgagacccccggggccagcaccaagactcacggaaagactagactgtgtgggtatctgaaacaaagcccacaggatacgcccgagaccctcaattcaaggagagctccaaggatgtgttggactctgtgctccagtggggcactggctgcacgtgggtccttggagatgcgtgacccatgtctctggctggtaatgttgcctgcagcccacataaagtgcaggcaggatcagaagtagccaagtaggttcactgaggttccagactcttccactggcctggggccatggacatcttgtgagccctgccctctggctgtagttgtctgagtgtgaggggtttcatttctatggctaatccccaaagctgtaacacatagggcaggtacctactgaggcacccaggcttctaaaaactgttctcaggaccttgggctctgggcagtctgtcagtaccaagcctttatgcctatgagaactccatagctgggtctcaccactaataaacagacctgcacctctggaaggatccactgtgtgtctggtaccacactgggcctttcaaagttttattcaccctcctcagtccccaggatatgtctctggacccacaagagctcctacagatcccacttatagggctccatgagcagtagagacaagacaccacttgctggttcttcaaagcagggtggcaggggtccctgggggagtgtggggacaagccggttccccacatagttcactttttctggtgtgtgctcagaagcccccactgtaaggccaggagtgcccgaacctgcggctgtggtggctccacagcaggctggaagcgcgctcgctccctgcagagggcctccaggacctgggctggggccacctggcctgtgaacgcacggactgcatcctctctgcagggaagaatatgctggggaattgtggggctggccagctgcccatgggggtggggcccagcagggcggtggatggaaggagggcccttaataaatgaccttctctggtgccagggacattcagctcaataaatagtccctagataccctcctaactactcaaatgactgccaaagaggccctgaggaggccaggctagtcctgagactgctccatggggagacttgtcactggcagtgcacacagcctcgtgaggttgccctacccactgatagggcccaggccccaccacaggaagacccaggacacagatgtactcacgtcaccctcaggaaagggttgtacatgagctcctcgcccagcgtcgaaggcacagtaggaatatcctcgtcatccctctcctgcaaagcacagaagaaccaacggccacggggaggttacggcacagcagggcaacccccaggcccagccagctgaagtcagcagaagcctcattctgactccccagagattccctttctaactgaccccaaacttcaggaaggctacttccgtcccccccccttccccctctcccacccaactggcaatggat

SEQ ID NO: 24535 - DNA, 1147 bp, Mus musculus
cgaagcgttgactgagctacgcgagaagcggctgggcttgctggagatagtgcaagcggcggcaggctcgggattggccgtctatactatatgggcgctgctgctgcagccgggcttccgccgggtgcctctgaggctgcaggtgcagcgttgaaccttggaaggaaaggggccaatactggtgcaagccaaggttccatgggtggggtcaaggctactgtaggtagcgtaaagatgggcggaatcaattatggcgcgggacctaacccgggaacccgatgtacggagagttgggaccaggaagttgcggagcctgggtctttcgtcaagaccaagtctaaatgaatgaagctgggattgagttacttagggggtacgggcctatgactggagagtgggcggggctcactggatggtatcaatttaagaaaggaaatctagtaggctcccatcggcccccaaactggtgcttctgcctgtgtgatttctagcctcagcccaccaaattccttattcaggtgccctacgttggcgcgagtgcccggcaggttgagaacgtgctgtcactgttgcgaggccgccctggaaaaatggtggatctaggctctggtgatggcaggatcgtaagacctgtgtctatatattcgttgtccctctggtggtggccccattcccttcatccagatcccacactcttggctcccataggtgctggcggcccaccaatgtggtctccgtccagctatgggatatgagctgaacccgtggcttgtgggacttgcacggctgcatgcctggagagccggttgttctgcgagtgtctgctaccatcgaaaagatctctggaaggtaccctaccaaacttgatacccctccctccccctcccactctctttctttccaaacttgattttctttaccctccctcttcctttcattttttttttttttttgagatgtgtgtccaggcttatctcaaactagccttggattataggcatcagacctagtttatgcagaactggagattaaacccagggatatgtgtatgctaggcaagcactctgccacctgaggcacacctccagctcctgatatctttatctcccaagtttcatgctctgagtggctattatgtggatatctg

SEQ ID NO: 24536 - DNA, 1169 bp, Mus musculus
aaggggatggagggattggtcccccaggacttaggggcctggaagagcccccaagggcctcccacatcttccactgcaccgcgcctggagccctccaaagggtatgaggcgccacaggccactgccaaagccatggccccctgaggagcccaactccccatgcccacctgacctagtggcttcccttcttccttgttgccatataggtcagttcttgtcctctgtatcctgcgcccctacccccgtatctccttctttccccctggcctacagatccttgggccctggccaggttgggacagctttaggaggacgcagaccttggaacaatcaacattagcctaaccggtgcccatccacctaagtgcaagggtggaataggcacctggcagaccccaatctggagccacccacagggctatcaggccttgggatcagcccacccatttgagcccctaccccagctgagctcaggcctctcagcactgtgcttctccctggataggtctcctcaggtggaatctgcagagggcctggccatgagtcagggtcagtactgaccagcgattctgatctcccagtggccagcacccccttcacaccccagggaaggagggctccttcccagtcctcctttagttctcccagcttccaaaacctttgcctgcccaaagggtttgtgaccatgttctgtcaggtctcaagaaatttggaagtcctaggggatcctggcatataggtgacaataccgaggaagggactgggaaccttccctcccaaccttgaaccccaggagacacagcacccacaactaatcttgggacacccctatctggttggaagagagtaaactaattcccagagagccagagggagagagagagagagagagagagagagagagagagagagagagagagaggagagagagagatgctgttgacgaaaagtaaagattcaacagcccaaagagttccctgcccctgcagtgttggccagggaggccccaggctgaagtggtcaggagccagatttgtcagcccctcttcccacagtcccccaacagggagggggaagctgtccatttgcccaaagtattaatgcaactgaagctgtgatatttccaatgactgtaggaggaaaatttaaggggagagaggaacacaaac

SEQ ID NO: 24537 - DNA, 1193 bp, Mus musculus
acacatagtgaccttacactcctgcctccagcgctggttcctctaccctcctgagaagacacctgagttccaccctaacaagaccacattggcctggctgctggaaatatacccatctctagccctgtcagcacggcctctagaatgtaccatccaggctggtgaagtcagtagctggtaggtgggggttgggctaactcaaaaagccatgaatcaaaattttttttttcttttctcccaggtactgtattttcctgatcggtggtggcatgccacactcaatctggacaccagtgtcttcatttctaccttccttggctagccagacaggcaactggcaagcccactgcaccagcacatgccaatgtagtgctcacagactttattacaggacagtggcagcagcagcaacctcagcccaccctcacccactctccagcccagaagggggacaagggaggctcatggtccagcaaggggtatgctgagaaggggagcagttcagaacccatcagcagggccgatgggggcaggcccagggacacaaactatacagggactggagcttccgtctccagatcctcctgggccagggtgccaggcaggacatggggcctcaatagtcctctacccagccgttctcagagatgaaagcgtcaatgacttccttcatggccaagttggggatgagctgttcctgggtcagagggctccgggtcacagggtcaaagtggcccacacgctgcaacagagtcaagagtgttcaatggcctgagtataccgatccgggtaccaaggctctccatggcccggtctccatgggccctccttacctgcaggtgctcctcaatgtccttgcggtcataggtgataccactgggtgtaatgcagggttcccgcatcagctcaaagctaatcttgccacacaagtagtcagggatatctcgcttctatagcacaaggggaaaatgtctagaactggagggggctgtgggggtcaccataccagcagcagccgatgagcttccgggggtcctcacctttcttttctcgtccacctgagagaagagctcatccatatctgccatgtatttatcctgcagagttgagtgccatgtgtgggcaactcctgtctccacacagacacacacactctgtccaccagggcactcatgtcatgcatgggccaacag

SEQ ID NO: 24538 - DNA, 1234 bp, Mus musculus
gaatgtttcttttttcctggcagcgttattacatggatgggcagaccccctgcctctttattgcctccaaagctgatctccctgaaggtgttgcccccccagggctgtcacccgctgagttctgccggaggcaccggctgcctgccccagcttcattctcctgcttgggacccgcaatgcccagcacagatgtctttacccaacttgctaccatggccactttcccgtgagtataccgcagcctcaatgtgggtggggcttagtctgtctgggtacaaaggtgtcagagctgtagacccgtggcctgtggcccagagagctatgctggatggcctctggcttggcctccgcctgcctgggacgggttttcagcagtgagcttttcgcaagcacacgtcttgagtattattctttccacagacacctggtgcacacagagctgcaccccacctccttctggctccgaggagtgctggtggctgtcggcacggctgtggctgctgtccttagcttctcactatacagggtcctagtgaagagccgatgacaaaggacccatgagcctctcctgcccccaggcacagcacactgtggtgccttatgtgggcccacacggcaaagaagtatgggctttcggcctgttggagtaatatctgtgtggctggctacagggtccctgggactgatgtgggttcctgctcaggaacttggtatttagatcttggcttccaaaagtctgttgccctattccaggcctgtcctgctgagcctgagagtactggtgccaggtgtgaggccttagccttggagggagggaggattgtgtgtaaggggctgggctgtgggtaaggaatccagtgaccaggacccgaagttctcagggtgtgttccccccccttcctggttgtgcatggccagtggacatgtagagggcaagaggtagtggtcaaatcagggagggacccgatagtcacagaggtcccacctttttgtcaggtgtggagccttatccacactgcgccagctgcagagcaagcggaactgactttcctgattaaatttcacttgtcttttccatctcttggattttgatctctcaatgcaacttactttctctctttctctccctcccttccttccttcctttcttccttcttcctttcttctttctttctttctttctttctttctttctttctttctttctttcaaaaatatgcttatttttatgagt

SEQ ID NO: 24539 - DNA, 1103 bp, Mus musculus
cagaagcaggtttgtgcgatcactgctctgtaggtggacatccagggctgtgtcatagggttagaaggccatggagcctgggctttgtccctggcaggagacctcagtgtcatattgttttcctacaggtgatacagaagacacctctgcccttctttgccatgtctttgagcctgtccccaggatctcagctcatggtggttggttttgctggtgagtgctggtcgacacacatagagagggcagctttgacagtcctcagccatagcaggtttgggggcgtagatgtcatggccctgctcccctcagcaaggttcccagcaaggtgtcagtactcagagcaccctgtcatctacccacagagtgcatgatgaggctcctagactgtgcgtcagggactgcccaggacttggaaggccatgatgactcggtccacctgtgtaggttcactccatctggcagactgctcttcacagctgctcacaacgagatcctggtgtgggaagtcaccgatccctgagctattgctaggaacataggcagaaaagccagactgtggattgctgtatgccgagccaggatggctgggacaggcttcagaactgcattgtttggaatttgggtgaaatctgaaaagattcaaggaggctgagggtgtggcagtgacttagaatctgtgaagtgtggttttgaccctcagaaccactccctcctacacaaaacttggcatactgggttgtttttcacatgaaggttgttttattgtttttattttgtacagtttaaggaaataaacactggcatttattatagcgatacattgttttattgtcccataaattgtgtctttgcatcacttctggcctgagctcaccctttcctcccgaggagcccgttgagtctgagttgtttgcaccacctgcagagtcaggaacactctactggcaggcgggcgcgggcgccttgccttagcccaaccactagctggtgctgtgtgggcgggaccggaagcttgggtgagggcggtactgaagacaggaagtgcgggggcctgagcgggttgaaggagagggttggggttgggattgggtctacttgggccg

SEQ ID NO: 24540 - DNA, 1103 bp, Mus musculus; identical to SEQ ID NO: 24539

SEQ ID NO: 24541 - DNA, 1172 bp, Mus musculus
ctaggttctgtcagtgtttcccggggttttccacgccctacctatgacgggttcatccctaagtctaggagcagtatgtacctcacacggaggtggttgggtcaagtgggcttgggcagaagacagttgttcccgtgtgggcagcctggcttggagatctgagtgggaaaggcccagatgggcatcccctcaactgtcctggggtcccacaggtaaacgaggtggtcttcagccccggtgagtctcactgtgccacctgtggtgaggatgggagcgtgagggtgtggtctttggccagcatggagctggtgatccagtttcaggtgctgaaccaggtaggttgggagatctggtggggggggggagggtgtcggtcatgtgctcggctccctctgtcctcttccttcctggggccatgctgatttctcctccatgcaacactagagctgtctctgccttgcgtggacgcccccgtcctgtgaactcccagagcagcagcaggtggtggccggctacagcgatggcacacttcgagtcttcagtatctctcgtacagcaatggaactcaagatgcacccccaccggaccgctctgacagccatcgccttctccaccgacggtgagcagacgcggccacagagtcacgtgcccacctcagctagcctgcaccacacttccaggttgtgggttgggctcacataatggcatcatagtctccatctgccacaggtcagaccatcctatctggagataaggacggacttgtggctataagccacccctgcacaggaatgaccttccgtgtgctcagtgaccaccggggtgctccaatttctgctatccagagcacgagcaaagaagtaaggcaagctcaggtgatggtggggaggggtttggggtgctgtgggcaggcagcagattctcacatccctcatttctcccagtatggagacctaggggtagagggtgtagaactgtggctggctgcaagtggggaccaacgtgtcagcatctgggtctctgactggctccgggaccgctgtgaactcctggaatggttgagctttcctgcacctgctgtctcagaggtaagagttccacggtcatgtgggtggggattggagtctgcacaacccagcacaacatactgctttccacaggctccaggcctc

SEQ ID NO: 24542 - DNA, 1071 bp, Mus musculus
gttcaggctctagactgatcagtgggagcaacacaaaaaggctgcgcctttgggctgtgggggttgtgccagagctaaggcgcaaaggctccagtgccaggtgagctgccgtaggcctctggcctgcatcatccccctggggtttggctataaagtctcaagtccttgacagatcctgcaagccagcactggtatagcacagctcttagtctcgggctaccctacatatctgtcttagttgggctcctctttatgggtgcactcaggcatagatagcacgggccttgcacactgcagaccgaggataaagaagcttaaaatctctgacctgtcgggtcggttcctttacccacgggagcacaggaccagactgatagctgccagtttccctgtcacctggcagactccgctggcttgtgtctccagcctcaagactcctttccctgttctcttagatccagttctgttttcatggagcgtgagctgaccctggatggggctgttgtgagtgccagttttgacagtggcatggacatgggtgtagtgggtaccacagctggcaccatctggtacatcagctggacagagggcactagcacccgcctcatcagtggccacaggaccaaggtgagctctctgggctgtgaaggaagacaggattgccagcccaggtagggtaggctagggcagcaagcccatttactgcctcgatctcttccaccacagtcatcgtgtcttcagctcatgagtaacactcggagactcaaaagactgtagtcttttctttttgtaacttattaaagaacccacatcacctgcttagcccttcccataggctggctctgctgacatcgtcaggatcctagtgtggaatcctggcggtcccgccaggttctgattgtatctgctcatacgcagttggaactggtctgggtatttcagatgtggtcaggtctaggcaggcctgccatttgataggactatctggatttattcatgcctgattgtcatgtgatagatcttgcctatggccttgtatgggcttccttcattgtccatcagatttctagg

SEQ ID NO: 24543 - DNA, 1183 bp, Mus musculus
atctgatgccctcttctggggtgtctgaagacagctacagtatacttacatataataaatacatctttaaaaaaaaatttatgtagccaggtggtggcagcactttgatcccaacatttggaggcagaggcaggcagataactgtttgaggccaacctggtctacagagttccaggacagccaaagctacacactgaacccgaggccctttgtaaaaggaaccaagttctttatactgctgagccatctctccagtcccataaagatttgtttattttatatgtatatgtatccttactgcctgtgtgcagaagcccacagagatcagaaagggcatcagatgcttcgaacaggagtcacaggcagctgtgagccaccgtgtgggagcttggggcagaacgtgagtcttcgccaagagtactaagctgccttttctgccgccatttttccagccctggtgatgtctttagaccttctatgagtgtgggtctctctgatccagaccagatgtgttggaattgggtgtgatgtgggaagtctgctctagcatatgctatgcagtgggcctctaggaaagacctcagttagaaaggagtggtgtttctcttctttctgggtactctctaggcccttctgggcgtggtctttgagtctttgatcttttgctaccaagatcaccagtcttttatggtgaagaggctttagttgatttctgcacatatgcctctgtgtgtgtgtgtgtgtgtgtgtgtgtgtgtgtgtgtgtgtgtgtgtgtgtgtgtgatgtgtgtgtgtgatgtgtctttgggtggccaaatgcctgtgtgtgctgtgtgcatacatgtgtgtgtcagactccccttctaagcaaccaagagggacctggctgggtttctgtggtgactttggtcctggccctcctatgctaggccctgtggaccaaagatggtgtggctgttgtttacccctgccatgcagtcataattgtcctgcagattgacactggacagcagaggtttttccttggccataccgacaaggtacatgcctgctgggcctggagagggagaggtgaacctgcaggccatattacattcccttgcttattctacatctccaggtctctgccctggcgctcaatggcagtgatacgctgctagcctcagctcaggtgcagcctccc

SEQ ID NO: 24544 - DNA, 1545 bp, Mus musculus
gggtgttgctcagaggccactggggaacagtgtatttcagatgcttctagcagcaggcttggctccggcttccatatctgacaaaggtgatcagtatgctgggcataggcaaggtttcagctcctaagacctaggagaagagccgttgatgcacctgggaaaccccactaatccctcctattgtgccctggccctttcagtgatgtttactatacacatctccagccggggctacagagcttctggcgggctccgtgcatctgggcatgggcacagggcctaggaccccagtgtctagcagcttgtactcatcaacctcggctgtgtttcatagctgcgacttgcctcttgtggcccttctgcctttaagttcatgtcactagaatctctttgacctgtttcttagtgacactctctggaacaccaagcccctccttagggactcactggcctgagcaacttgtgaagccatggactgttcccccacaatgctcctcctctcccagtctgggctgggcagccttctcccctgtggggatgctgtccccagtggatgtcctgtgtgactgcttccctgtccttgcctggtgacacagccctcaggcacgctggtgcttaactctacctcctgccctcagggccctggccataacaggagccatgacccctgactggggacctctaagtgcacgtttcctaagatcatcttaccatggatgttactagggcactggtagacgctgcgccagcctgctgttctgggagattgagtcaatgcctgtagggagggacggggctatggttgtgggaactgcctgataagcagcagcctgacctgggagcctgacccagaggctgggtacaatcaagcatcacctttccccaccagtcctgttgctgttgacagagaccttttctctggaatcgcgatagaatggtatagactttgaggacctggattggcctgcgtgcacaccatcaacactacacttgctgctgtggactccactattcctggttctttgttcttacttctttgtacagtaaatgtacttcagcagtgagcttgtgtctggcttcatctgactgtggtttgttgggggtggtaaggggtgtctggcggtgtgttctgccacatgctccagcatggctttgtgcctgacagaatgatcccaggctttgttaactttccccgcagctgaccctgctgacctgcagccatccatccactgggttcacattcccagccacaaagtagccaggcctggttacaagccacactgtttccggaggtcagatcttggccaggttagacagagcctttactcatacatagcccagggcacatagcttaccacaacatgaaggatatctgtgagtgggacctggcgttggtgcctttagcaggaaagcatctagcaggtcatggcctctgcaggccatgctcacccagggttctagctcatacactggaaggcaaatcccactgagtgggattggacagttcactttagagtggcctctggctcaggtgtcacctgcatt

SEQ ID NO: 24545 - DNA, 1906 bp, Mus musculus
tctgtatatccctggctgtcctggaactcactttgtagaccaggctggcctcgaactcagaaatccgcctgcctctgcctctcgagtgctgggattaaaggcgtgcgccaccatgcccggcaggactttattattaattaattttaactaatcttattatgaaatctatgtgatccagagctcagggattggccactcctggacaaaatgtagccaggaaaaaaaagaaaagaaaaagatacaggtactacctctgggatcctttggagagtcagaatgagctgagaagttctgttggaaggccttagggtggttctgccttccaggactcaggagcctccaccctacacacccttgaccaagagaatagcaggaaaacctgtccctgaaggcaggtgaggagagctctgatgccatttctcaggcaccatcccctcacaaatatttcctgaatattgtgtcaaaccaagtggcagtgttcacagggccaagacgctcagtaaaggctctgtcttcagcttaggagggaggtagtcacttagtgtggggctgctggaatgaaggaagggtacctgctgctggagaggaggcctggatctaacagtcccttggagaaaacaccccttgtaggtttttttcttaattctttctttcttggagactgggcctctgtaggcccagtcttgaacttgcatcagaatcccaagtgtgctgggattagaggtgtgagccaccatacctggctggttgtgtgtgtgtgtatgtttttcacatttcttaagtagctggtgggatataacctggaattactgaattctaatttcacctttgaacatttaatgttagtttttagcatcagcagacttgttaactgcctgacacaaacttgacatccaccaattgattagtcagtctgtgctaacctgacatccactgattgattaattcagtctgttttctcctgagggattgtccaatgactcccattctgtacaatctgggaaaaccaactgaatagtgtcactgaagtggtcacacagctaaagagacagttttcagtatgtgagtcaaatggacttcttggcctttccacatgcttgtccagtcacagctccctcaagttctgtggccaccacacatggcaactcagcttcaccctgcttgtctattgttgacatgactgtgagtgagtacaggtgctcagatgggcagaagagggcattggatcccctgaccatggagttgtataggtggtcatgtgctgtggtactgagagccaaattccaatcccgcccaagtacagcaaccattcctaactgctgagccatctatccagtaccttcagtaaacctggatttgtcatgtagctcaagttggtcttgaactcatggcaatcctcctgcccgagtattaggactataggcgtgtgtcacccacctaacctgcttaggaggaggtccttgccttcccagcagccaggagagctgtcagctgtggacacatctgtgctcagcgggcacctcatcactggtggcacactgcccagacttgtgttcagtggtcatgtgaaggagcagcaccgagtcggcactgatgttatcctttcttggcctcctgtctcaacatcccaagcagctgggcttataaacttctgccatcacagagttttggggtttttggttttggtttttttgtttcattttgtttttgagacagggttcctctgtgtaacaagctctgattgactgtcattttgtaaaccaggttggtctcaaactcagagattggcctgcctctgctttcccagtactgggatttacatgccctgtccaaattcattcttggggctggagagatggtttagtggttaagagcactgactgttcttccgaaggtcctgagcaac

SEQ ID NO: 24546 - DNA, 1101 bp, Mus musculus
tgaagaagggtccctcagttgctttctagcctgggactccacaaaggatcagtataagccaactggggagtgccatagggccctgtgtgaccctgtgcccagagagagcctgctgaaaatggctgtcacatgcaatactaggtgctccactctaggcaggccttccacttgtctcttggtccctttggactcagcagcacacggattactacttctgtgcatgcatttttccctactctgcctggccacccttacccatcctttagcttcctgctctcatcctttcactcctgtactcacatcaggcagagcttctgacctcagcccagctggccctgtcatgagattagtctggcagctgtcctcgtgtgcagcagagtactgggctgtctgcccttctgaggaccagtcagggcctggcaccagagctggccaaatgaacactggccattggagccaaaacagttgcctcttgcagagagctgtgcccatggaggtttttctgatgattctcagacatagctcatgtatgtctaacaacaagggctgatgtttgggtgggcattactttgatggacaggtgcctttcccaggagctgtcagggttcctatcacaatctgccctcctttgtaactgaaagaagcttgtctgcaggtacttgggacatgaacatggcccgacttcattctgtctccactagctgccatgtccgtcactatgtctgaatctgtctacttatgagaggttctagggcttcttgtttccagtcttaaggccaggacctctgagtaattgaaacattgccttttttgtttggtttgtttgtttgttttttgtttggtttgtttgttttgtttctctgtgttgccttggctgtcctggaactcactctgtagaccaggctggcctcgaactcagaaatccacttgcctctgcctcccaagtgctgggattaaaggcatgcgccaccatgcctggcggaaacatttcttttttgaaatatgtatcatgtgtttcaggctggtctcaacttgctacgtagctaaggatgaccttgaactgctgatcttcctgcctctacttcctgagtattgggatta

SEQ ID NO: 24547 - DNA, 1180 bp, Mus musculus
tgtggtgaccccaaccataaaattatattcattactacttcattactgttaattttgctactgctatgaatcatgatataatataaatatctgtgttttctgacagtcataggtgaaccctgtgaaagtgtcatatgacacccaccccaaagggttgagaaccactgctctagtatcacctatgtagggacccacatggtttttgtagtcattacagtgagcctgattcctaggagttcccggaccccgtgggatatgctggcaggtgctcttggctgctttattgggtgggagcactcctgggcacctggtgtacttcataagcctccgcagaacatttccattgggaaacaggcagctgctgatcccttagcccctcgaactaatccctcaccctgtacttcattgggcttacttgctactctggagattgctttgtgaagttgctgttaataggcctttgggtaccctttgcttgaagttatatcaactgaggtgattggatacctgccaacctggctagtgctccatgtatgaataggccctttggcaaaatattctatgttctcttatagactccttatgggaccagatagcttccttctggacaggcacttcatggctcattgtgtgaatgatcttggggtggtgaaatggccagggttggttccctaacacttagtgggaccccatgtgagctagtccctagggggcaggaaacctcactgcctgaattgtctactgtgggcaggaggggacagccggcccagcctgtctttcaggggcacttgggactattgacattggtctgtctgtgcctgcttcctcttgctataggtcacagccactcttaagcagccagtggagggttttggtgaagatgaatcctgatcctgtgatgacaataaaaatctcatgaatctggagtaccagcttgggtgtcctgctcgtctggccaggctctaggtgggtgggctaggtggggcactgggttaccccaggtgactatcatcatttcctgcctaaggcctctgcagaggctctgctgagttgcagccctaggtacttgaagacgtcatagataggtgaacagagctagagcctcagtgcctctggccatagtttcacccagattccgggagctgggatacagtctggaagggctggggttgtctaatct

SEQ ID NO: 24548 - DNA, 1206 bp, Mus musculus
agtactgagactatagtcaaaagccatctcccccaaccccttcctttgaaggctggtcttgaactggcactccttcctccacctctccactgctggaatcacaggtgtacattacacagctggctggcttctggtttgctaaagttatcatttgtgtacatgctcatatgacactcataaggaggcctttctcattaaagccctcaggctcagccccacactgctgtcagtcaacagcatctgtccagtacctcactctgccctgcttcaggctgctggccttagaacgtgtggaagcactgccctgccatcacacatacagctgctgcttcctggggcagtgatgggaagagttcagtccctgggagatgcacagccatgacccaccgaatccagaactgtgctttcccaatgtgtggctgggtgaatggttcgtaagcagggtacagcatcttgcaggcactatgctgccagccacagcagctctaaaccaaccctttctcgtctcttgcagggcccccagcatggtgctcaaggtcttcttccccacgtgctgtgcctcggcagacagtggcctgttagtgggacgatgggttccaggacagagcagtgctgtgatcctggccgtggtgcactttcccttcatccccatccaagtcaaggagctcctggcccaggtgcagaaggccagtcaagtaccagtggctgtgctagggacctggtgccaccgtcagcaggaaccgcaggagagcctggggaatttcctggagggcctgggcaccatcttctcccatgacccctggttgcagctctgccgggagaggggtaccagactctggagctgcaaggccacttacccgcagatgtctaaccctctggacatgcaccccgaagagcaggtcatgctcatcttctatgatcagcgcaagctgctgctctcctggttgcatccgcctccagtcctgcctgcctgccagatgggagacaccacagccagcaccggaggcctagctgacatctttgacacagtggcacgcagcgaggtgctcttccgaaatgaccaatttgatgagagacccgtacgcctgagccactggcaatcagagggagtggaggccagcatacttgtggagttggcaaagcgggcctctgggcctgtctgcctgctgctggcttctctgttgtccctgatctcagcagctagtg

SEQ ID NO: 24549 - DNA, 1165 bp, Mus musculus
ctagggcaagggctgtgtgcagatctacccacctgcccccctacatgcactttatgagggagacccccaatggaggatgcttgaaccagaatctcaggaccctgcccagggagccgccagccacagggtgcagcctcccttgggcctccctcccctcctatcccaccccaagtaccctcagtaccccaccaggcctcccagctgccatgcagaatacctcgaaccgggtgggcttcattccagtacttctgtcttgagccctggggacagcttcagatggccaaggcccaaagggggcggccctgtgaatatggggtcacttattatggagaggcagcccagataaatgttcgcagaaccagtccgggttttagaggccatgccctgctcgccgtgagaacctgggcaaccctttgtggggctcagatctgctgctgctccccttgtttgttcccaagcccagctccctgccctaatgatcagggtcctgatagccctggcatatgagcagtgcattgcaggaagcagatgcctggtggccatcggccagggcttggggacagctacacctcctgcaacactatgcaattcctggagcacctgccaggatcgaagccatgatggagccacaggacaggagccagtcccagccctgctgtctggagaagtgctttgtccttagtttccctggccacagtcagctctgcccatggcctcagtctgtccacaaagagggataccccctactccggtcctatcacaggcacatgtaaggtgtgactgactactccctcccctagatgagggagccaagctgcccacctgcccagcattccctcagctgcttgtcaaaatcagagcccttacctgccacatggacgcctgagtcatttcctgggccactgttgtgcagccccctaggtaggggcagctcccaagcccactgtccctgcctccatggggcttgctagggtttttatacctagagaaacattccccttccctctgggcctccttttactctgagctgtgaatatttttaaccctgtaaataggaccagctcttcgaacacagagactattttatcagctgtcagtcccttccttgttcgatgatgcaccccataggccatttccactcaggctccacggaccaaataaaagt

SEQ ID NO: 24550 - DNA, 1135 bp, Mus musculus
aaccttttctggaaagatgctggggctcctggggcagggagggagtggtaggagacagcctgctatgagtgctagaagctgagcaccaagggccctggtgtgagtgagcagggcaccccagagcagccccattgggttgtgctctgctcagtcactctttccctcactgtttaggtacttcgactctgtggacatctgcaaggtgcactcagactggcaagaggcacgggttcagggctgtttcccaagcactgccggtgggcctgtgggtgtgacagcactcacagtgctggagcgtgcctcactggagtttgccctcttccaggagggcagcaggtaggtaacaggatggccactataccaagctaggagtccatggctgtggccacatgagcacccagcctattgtttctggccctcaggcgctcggattcagtagacagccacctcctggatctgtgcatcctagtgttccgggccacttttggcactggtggccgcctgagcctgggccgcctcttggcccacagcaaacgtgctgttaagaagtttgtgaactgtgatgtcatgctggagcctggggagtatgctgtggtatgctgtgccttcaaccactggaaccctgctccaccagggccccctgcccagggtaagggccccagccagatgaggcccacaccctccttcccaacctccgagccccaaagcccacccacgggaaagctgctggctcccttatccacaccccccacagcctccagcccctcagcaggggtcccccgaggtgcccccgagccacccggccacgtactcgcagtgtacagctccaggctggtcatggtggagccggtggaggcgcagccaaccacactggccgatgccatcatcctgctcactgagagccggggcgagcggcatgaggtgggtggggtcctgatgggggagggcagagggtgggcaaccaccagccctggcccacccaccctgtgcctgtgcccagggtcgagagggcatgacctgctattacctgactcatggctgggcgggactcatcgtggtagtggagaaccggcaccccaagtcctacctgcatgtgcaatgtgactgcaccgacagcttcaatgtggtgtccaca

SEQ ID NO: 24551 - DNA, 1193 bp, Mus musculus
gtagctttgtttttgaggctgagaaccagctttgcccaaggtaacttacgtttatctccactactcatgtcacttcccctcagctcacgtgcctaggagcgtcccagagctcccatgtgtaagctcacagagatgaggatacagtgaggctgttctacacagggcagcatggagaccctgttaaagctcaaggctggggcaccctgtgttctgtttaagctgcagagcctgggacctaggtgacatcaccattgggtcagctgaaagagcagctggagccatgccataccaggctaccatgctcactgtggcctgcttgccactggcctgcagtgtcatagtcagggagtacaggtgtccccttgcccactcaggatcatcctgatggtgagcccttcaaacctccaaagttgcctagccccaaggttggtttaatgtgcaagggccccaccccaaccttctgccgctcccttgggagggtgggtcttcccccaaaaggtagagtgggattattctgggcctgaggctgtcctgcccagcctgagtgtctggccatggtccctgcagaatagtgtgaactttgtggatgacagcttcccccccgggcctgcatctgtcggcttcccagtgggcgacagcgtccagcagcgagtgaaacagtggctgaggccccacgaaatcaactgctctgtcttcagggaccacggcactccgtggtcagtcttccacaccctgaggccctctgacatcctacaggggctgctggggaactgctggtgaggctccaggttcccgtcagggccagacaggctcaggggaggatggaggctgctggtccagttgtgggcatgttgtgaagttgcctggctccctccaggttcctgagtgcgttggcagtactggctgaacgtcccgacctcgtggagagggtgatggtcacacgtagcctatgtgcagagggtgcctaccaggtgcggctgtgcaaagatggcacgtggacaacagtgctggtggatgacatgctgccctgtgatgaggctgggtttttgctcttctcacaggtaggacagcaaggtgggaggtagggttagagaaaccaggccatctatgactctcatccttccccaggcacagcggaagcagttatgggtggccctcattgagaaggcactggccaagctgcacggctccta

SEQ ID NO: 24552 - DNA, 1731 bp, Mus musculus
aatcagctctgtctcccgagatgaggtaccttgccccgccttggtataaccctaggcctctttctcctgtacaggccccttcctttccctgcattgaccctctgctttcctgcagctcatggaagcaatccagaagcaggaggagatcaatttccgcctgcaggactacattgacaggatcattgtggccatcctggagaccaacccatccatcctagaggtcaagtagtccatcttagcccagtttgggctggttagagactccacagcacccaggagtggccctgtcttgccacaaagagcccgaccagcaggtcctgcagcttaccaagcccagggtgtgtggggccctcacgcagttcgactgggaaaatacagaagggctgcagaggcaataagaaggaagaaagggaagtccacggcaggcaaagggtgtggctggctctctgaacatcaggaaaccagggcctcccaccacaagccagcctcaccaacaacaccatgtctgctcagcagtatgcagatatgtggggatagtctctcaggctggcatgggcccctttctgctatgcgccctattaggaagagagagagagagaaagagagagagagagaatgagtcctccctcagttgctgcctctcactcctggtgacatggtgccacccaagcttggccattcccacatagtcagcaagctgaggacccaaagttggacacagaaatggtagtgttggaaagacagacaggcaaagacggcacacgttgggtctgcttccagtccataggccaccaattctccttgcgctgctcaggccttctctcaccagatgggcttccattcaccttcggacccagggcctccaagccacacagctattctttggccagaccctcactacagtaactcatcaactctggctcttgtaggggctggagcagctagttcatgctgcctgtggaactcacttcctggactgatgagcacggtcagcctctgtccccactgcaggtgctgcttctcctcaggtgtggcctacctaggctcctggacccacaccctcctcaggctgactttactgccttgggagaagtctacatttcccagacaatagtctaggcctctggaacagtttccttctctgcttttgactttaaatccctgggtgtcccccaggagtcagtttgctagtggataatggaggaggttctacactgacccagaggcataggaaggcttgctgtctgccctgcaccacccacagagctgcggcacccatagcagctgggcctgagcctgagcactagccggagtctgggcacagtgtctgagaccacaccataggctgcgtgagtgtgagtgtgtatggaagtgtgtgcgcaagtgtgtgcgcatgcatgagtgcgcacacaagtttgagtgtatgaattcttgtgcccacacatgctgccctgcatcccttcactgcctatccccctgcccccgcctcacactacagtttaagatgttgcctcgtattgtacattttggggaaagccttgtgtgtaaatcagtgtaaacttggaggagagatttttctatcatgtagagtaggtattttttatagattgaaggttgatcaatttttttaatactttccagagagaaaactatctgtgtatacatatgaaatatatatatatatatatgtataatatatcaatactggagccccgcctttctgtgcccagg

SEQ ID NO: 24553 - DNA, 1417 bp, Mus musculus
acctggggctcatagcagcttctcctgttcccttgcccttacacactccctgtaagggctggactgggcagcagtctccctgtgtctgctgttggagtcagcctcttagaactggctctgtgtggcctcctgcctaactgtgatcttgccagcccagtagctcacatggagaggagagagggtaaggaaaaggtcttgctagagtcttggtttttgttttttgggggagggtttttttttttcttttggtgttttgtgtgagtttttttgttgttgttttgttttgtttgcttttggggacagggtttctctgtgtagccctgcctgtcttggaactcactctgtagaccagactggcctgcagctcaagagatccacctgcctctgcctctcgagtgctctgattaaaggtgtgtgccaccaccttgtagctagctcttgctagtcttaaaggccagcttttgactttggagtttggctgctgtcatcttcctgctatagaaggtgagttgtgcttatgcctgataatcggctcccggccactcttcactgacatccttgttcggggtctgaggctctgacacccttcttaaggcccggctcaggcagtactgtgtttccttctaagacaagttgctgctgagtccgtggtcactactgtcttctgagtctatccagtctccactggccagccttctcctggggtcatgggggagtattccttcctgtttatacagagtatctcctggtttcacaactagggtcctccctacaccttgtgaatctgtttcagagattgagtcacacagctccctgccccagccttgtcttttgttttgcatatcttcctgtggcttccggagctgggagggcctggaggtggaactgagaccttgagtgggagtgtcctttgcctgatttgggttaaggttatggttttccttagatttttctggagtcattggtcacagcctttggtactagagttgctactaagtctatcaacttgtttctttatggcttttctctctctggaagcttttaaaatgttgtcttggcttcagaaaatcataattttagcttgtttggttagctacagacctataatcacaactacttgggaggttgaggcaggagattcaacttagctgctatttcaaaattttacaaagattctgggaacacagctcggtgatagagtgcgcgcctaacgcgtggtccttggttcatcccccaaaccgttcaaaacaaagaaaaaggaacggaaacaaaagataataaatttcgtgagactttgttgcgtggcctctttctcatagatcatgagaagcatagcaaagctgaggcgactgacctggctgctgcgctggctgctagcatctctagtgcagttgtcttgctgtgtctatacatcctc

SEQ ID NO: 24554 - DNA, 1176 bp, Mus musculus
ctggccccaggaaccagacgcattctgtcacttgctcaaggaggtggaggaacctgatgcccttcgctgctggcttcaagggccagacgcaccgtgccacttggccaaggaactggaggacctcgactcccctcgctgctggccccaggagcccgacgaatcctgtcacttggctaaggagctggaggaaccagacgcaccgtgccacttagccaaagagctggaggaacccgacgcccctcgctgctggccccaggagcccgacgtgccctgtctcttggccaaaaagtgggaggaatccgacgcaccgtgcctcttgacggaggagctggaagagcctgacgcccttcactgctggccccaggagtcagaggcaccgtgtttgttggccaaggagctagaagagcctgatgcctctcacagctgtcctcaggaggcggacacagggtgcctctcggccaaggagccagaggagcctgatgtctctcacctgtggcagggggtacccgatgcaccgtgcctcttggtcaaggaaccagaggaggccgatgcacttcactgttgttggcccgaggaatccgaggagccggatgctctcaacccaccgtgtttctgggccaatgaaccagacgagcccgatccatcacgatgttggtcagaggagccccaggtgctgtgcctctggccggaggagcagaacacaaagcggtgctggcaggaagagcccgatgcaccctgcttctggcccgaggatcgagaggaacccatagtttcgtgtcttcaatttaaagagccagagaagcccaaagtccggagcagttggcctgaggagctggaagactgctgccctacgcggggcctaccccttgagcccttgctcgccgacggcgagctgctgcaggcatgtcccgggccaccctcggacccaggaccagcgttgtcgctgcccagcgagcccgggacagctcaggaggagggtgcacgcctcagggcggtatttgacgccctggacagagatggggacggcttcgtccgcatcgaggatttcatccaattcgccacggtctatggggcagagcaggtaacaaactgagtacagttctggtcgggagagatgtcgctgatttctcagggtagtttcccacgaatcccctcttacctctcagaggaaggtgt

SEQ ID NO: 24555 - DNA, 1234 bp, Mus musculus
taggatataactttttcttttcttttcttttcttttcttttcttttcttttcttttcttttcttttctttcctttcctttcctttcctttcctttcctttcctttcctttcctttcctttcctttcctttcctttccttttctctctttcttcctcctcctccacgttcttcttctttctccttataacttcatctcaggtcaacgtttattcagtgatgattaatgattacttttctattaattaatgaattaatcaattttctttacatcatgactgaagcttcctctccctcccgtcctcccgtcccccaggggagtcctcccgtggatatccaccttcttcttctttgaagataggatctcatgtacactatgtagctgaagatgattttacaaaagagccaccctgccaatttttgcagtgtttgaagatcacacccaaggcttccagcaggttcaaccagcagaatcaactgatctgtacgtcctcccccggggatcttctgacacataaacttcgtactcaagatagttgttttgaggaggcagtgttcttcatggggaatgcctcctgccttgcataggtctatagtcacacaggaagtgttgagtctgacttggaaatccgagcccactcccctgcctctgggatcaagctctttgcaagctctgcctctcctccgcccacatcttgagtaggaataacccgatcatgcatagctgaaacttgcttacagtatctgaggaattcctatggttttaccagaaaaaaaatgcattttcttgtaaaaaaaaatttttttttttgagacagggtttctctgcatagccctggctgtcctggaactctgtagaccaggctggcctcgaaatctgcctgcctctgcctcccaagtgctgggattaaaggcattcgccaccactgcccgggtttttttttttttgttttttgttttttctactataaaaatagctatgagttggaatttgtaaaagtttctagagggctggcaaaatggttcagcaggtaagagcactgactgctcttctgaaagtcctgagttcaaatcccagcaaccacatggtggctcacaaccatctgtgataagatctggtgcatctgaagtcagctacagtgaactcatgtataataataaataaatctttgggccagagctagcaggattgagcgagcagagcagaccagagcgagcagaggtcctaaaaattca

SEQ ID NO: 24556 - DNA, 1254 bp, Mus musculus
aggcttggtggctcacacctttaatctcagcacttgggaggcagaggcaggcagatatctgagtttgaggccagcctggtctacaaagtgagttccaggacagccagagctacacagagaaaccctgtctcgtaaccccccaccaaaaaaaaaaattaacaataagagggctggagacctggagacatggtttggtttagtggttaagagtaaccacatggtgtctcaccactatctataatgtgatctgatgccctcttctggcttgcaggtgtacatgcagatagaacattcataaaataaacaaataaatctttaaaaaaaattaataataatagaatcaatgtggagtcttgcctggtggtgcaagccagcgctcccaacatttgggaagattttttttttttttgtggtgggggagtaagattttaaaatcaagggctgccttcgccgttgtgccgagcccgcagaggagtcgccatgagcaaagcccaccctcccgagctgaagaagtttatggacaagaagttatcattgaagttaaacggtggcaggcatgtccaaggaatactgcggggctttgatccctttatgaaccttgtgattgacgagtgtgtggagatggcaaccagtgggcaacagaacaacattggcatggtggtcatccgaggaaacagcatcatcatgttagaagccttggaaagagtctgacctgtgctcagcaagcagtgtccacatccctcctcaaaggcctgtttgattgtgatgtagaattaggtcatgtacattttcatatggaactttttactaaataaacttttgtgatactcaaaaaaaaaaaaataaaataaaatcaagggctgtcaggataacctacaggttaaaactcacctcaaaataaataaataaataaatagatctggggatggtagaaaacttgtctagcatgttcgggcactgggtttgaacttcagcaaggcacagacctggtgtggtgacccttgcttgtaatgccagtacatgggaaattcaggaggaagatcagtttatctacatgatgagtctgaggacggcttgggctataagaaatcctgtctgaacagcaacaatcgtagcaatagatggtggatatctggctcaatgcttaagaacacttgctgcagccgggcgtggtggcgcatgcctttaatgccagcactcgggaggcagaggcaggcagatttctgagtttgaggccagcctggtctacaaagt

SEQ ID NO: 24557 - DNA, 1128 bp, Mus musculus
ctgcctagaaacttccagagggtgctgacttgcactggcctcgctccatcctgccatttgctactgtcctctccaccctggggccggtggttacaagtgacatttgagagcctggctgaacctcatgtgacagtgggctttactgctaaagctgtctttacaggtgggctccatgggaggggagtggggcggggtggacgggctctgtctacctcccccagagctctgggctttcttccggttgagccccttgtctttttgacagtatgtaggccatggagtgtgaccatccatcatcttatacaaaacaacccaaaccagacttatgatacctctgcaatccagctgtcccaaagcgctgtccaccgggacctgggcaggagtagcagggtggacagtggccccttctgtctcctgaactatccagtcctgagggaggacacagatgtggtgtctgtacacttccagcccctgaatggggccttcgtgctagtgcattcaagcatgccttctgtaatgcagctccgccttgatacaggcatggacagcggaggctccttcatcatcgtcctgaggactaacaaggtatcctctggaagcccactgaagcagtctacagctgctggtagcctgggcttggctcagggtacagggtgacttcagctctgagactggggtgaagggacctggtaggtgatagcatgctatcaatagcatgggccagaaggggattcctccaagataaaagacttcccctacccgaagccctgtccctggtagaagttataattatatctgtgcaaatggacagggaaatggccagaacaggagacagctgaagataattcagctgaagaaaatttggaccatgatgaactttgggctagcaggcggcctccctcccctcaaaaaaaggacccagcatgaccgagctaaagtacaaggtggggaggcaaactgctccttagatgtctttgaggggtgacaatggctaacctaccctacttccccttccagacagaggtcacaaatggcaccttggtagcagcttgtgtgaatgctgcctcccctttcctcagcttcaacacttcactcaactgcaccacaggtattctgggcaggcagttt

SEQ ID NO: 24558 - DNA, 1148 bp, Mus musculus
tggatacacgtgctcgtccagaccctcccgtgcctacatgcatcttccacttttgtccccacttgcccgtgcctgcccactcttgcatataccagtatctattagtgccgatttcctcctcctatgcccgtggattccctcaggcttgtctacacagcatcctctgggcgaggaagggccctaaagttcagaagctcatgcctaggtattgcgtggcccccaggttggcgtgggtggagctgcaccgacaacagcacagcgcagaccgtagcccagcagagggcagcagcgcttctgctcacgctcagcaacctcatgttcctggcccccattgctatatccctgcaccgttccttcctggtcgaggcctctgtctacttttacaccatgttcttctccacggtaggcttggccctaaccctctcgggaactctgggtggggaggtcaggtctgcttgctcatcgcttcacctcatagttctaccacgcctgtgaccaacccggggaggcagtgttgtgcatcctcagttatgacacgctacagtattgcgactttctgggctctggggcgtccacctgggtgaccattctttgcatggcccgtctgaagacaatcctgaaacaggtgagtggcctctgatgccaagcctgggctccagggaagcaggggccctcacatacagtacatgacgtggcagagagggatagaccagataggactgggtatcggatctcacaagagaactcgtcatccactactggaggacgttgtaggaagctgtgagggaaaggtgtagccgtcaggacgccaggaaagaagatggggaccgggaccctaatctcaaagaggagtcagggcaggcctccctgagaagctggagccatgttcctgggttccttgtctaagggcacttggggattttatgcagcatctggacaatagaggtgactcttcggtgcttgtgagctgtgtcctctatagcctgggtactgcccatcaggggcacccatatcatctcaaagagtgggaggagaaagttctggaatttggagatccagcaggctgagtgtggagggcatgaactttcaggcagtgggcagatagaaacttaggcatgggtcccctcccaggttgcatctaaggccac

SEQ ID NO: 24559 - DNA, 1726 bp, Mus musculus
cagctacccatagagccccagtctggctatgtgccttaggtcttgtgccgataaccactaggcatgaggccatatgcacttctcctgcccagatctagatagaccccatacctcttggctctgggtctgcaccaaccaaccaactcccatgtggctatccactctagatataccgctgtgggcaccggggacagtgctacccaacctcctggcagcgctgggtcttctacctcctgcctggcatctccatggcttccgttggcatcgccatgtatacttcaatgatgaccagtgacaattactactacacccacagcatttggcacatcctactggctggtagtgcagcatttcttctgccaccacgagaggaaaaagctgggtcctgggcctgtttgcagaagttcccttgtcactaccagatctgcaggaatgatcgggatgagttgtacacagtgacctgataaggctggttcatggacacctgaaactctaatgacctcttcagctaggacaagcgagagaggtgcttgtctagccccaaccaggtttccatctgaataaaattgtcctgagacgcttggcttctttctccagagaagaccccctccaccccaaaaaatctttatggctgctgccaattcctctgaaggtcacagctgtttccacctggagcccacaggtgccacgtgtgggctgatcacgctgttatggatggggatacagataagggattcctgtggtccccttcctttggaaagccgtgatatgagacccacaagcaaggaagtctgagtgcacagaggtcactcactgtctctgacatcctgtacccttaatgccatcctgccttggcatggggataccctcctgctgcagttgctatggtagagtccagggtcatcagagagctgattaagacctggagtgctgtgtgctgtccctccctcattgtctgttggagcaggaggccttcgggagagcctgaggtagcaggctgctcagctgtatgaggtctggctccagaaggcacacaatgctcgctagtgttcccttctctcttaaggggtccaaggccccagtctggtgagcattctcctgtgctggccctagacacttggatgaggctgacccctactggatcaactgaggattaaggagtgggttctggatccccagcccaatctttctggtctcctggggtcactgagctggtagtgctgtgtgcccaggccatttggttcccactgtgaggctcatctgctctgagtactgggattgcaggtgtgggcttctgggctccttcccaagctactaacatcctttatttggcaccaaagcacactttagcccctgaaaggggaaatgtgtatattctgttgggggtggggggcaggtggtaaaatgttactgttctaagatatgaaggcatatttttatgtaattggtgaatttaatattctacaataatttttcaaatcaaatgagtggtcttttttttttttttccttgcgtccctggagggaaagggaggttgagctcagggtagcctttcccaacaggcttgccaaagctgctggggaactcctgggctgcacttggcagacggtgccttgaacccattcgcagtagataatttttcatggtccctaaaggaggcggagggaaagggattagtttagatggacgggcgttgctgccaattggcagcgagcgaaggcgcacg

SEQ ID NO: 24560 - DNA, 1191 bp, Mus musculus
gcctcaaactcagaaatctgcctgcctctgcctcccaagtgctggcattaaaggcgtgcgctaccaccgcccggcactaggtgttttcttaatcccttggcagcccctaggatgttccatttgtgtctgtttcccagaatagtcaagagcctgtggcggccagcagttacagggaagccaagggtaggcatgtgagtttgtgtgaccaagggaaagcagtcctcttttggcggtcaaatgccctccaggatgacaagcagcaacatccccagtccttctacaccctgcttctccccatggtcagccagaagcagctggctgtcaccctccttagggcgccatccctgggctacgttgagccttaccatgccctctccccttcaggaccctgtacccctgttcaaggtctacgtagaggagctggtccagcggcttcaggagcaggttctgtccaggcccgcagtggtgcagaagagagccggtgaccacgcctgagcactgggctcagcctcccctgtgggcagtgggcgaaccccacttggcatgtgccgagcacacagttcctgtggtagacttttcagagaacccttctgtgccaggactcgtggaagcctggagcggagcagatgcctgtccaagctggtcaagtccttctagttcttgggctgaaataagtaacagtctgaggcagcctgcgccacagtaaagtgtgttggtttgcttggaagtctggagtcctgtgagttctttttttttttttttccccatcctgagacagggtagtcctggctgtcctggaactcactttgtagaccaggctggcctcgaactcagaaatccacctgcctctgcctcccaagtgctaggtttcaaggtgtgcgccaccatggccagcctcagttctgtgcattcttgtccggatcattcctttgttccagaaacacgcagactgtttgcactgtccagctgtagctgctgacttctgcgctgtgggcactgagggcctttttgctgcttatgtccctcatgtgtgaggcatcaggacatagagagttgggttacatccagtgtatgctcctgcctgctctggaatgtttttctgggcacaggaagggagcctgggccatgggtcaggcctgggaagggtctctgcagtatgccctgaagagctaaaagtgggaagctttctgg

SEQ ID NO: 24561 - DNA, 1644 bp, Mus musculus
ccatgtggatagcagagctgggaccccaagacctctttaaataagaaagctatcaggaaagccaggcatggtggcgcacacctttaatcttagcactgggaaggcagaggcaggcagatttctgagttccaagccagcctggtctacaaaatgagttccaggacagtggggggggaggtacacgacacggacaatggacataaataaataaatagggagggagggagggagggagagagagagagagaaacaaacaaacaaacctacctatcagattggggctcccaggttttgtgttttgttttgttttgtttttgcaattcccaacatgctattaactcagcccatcagtggtcccagcccttccccaagtgttgccactgcccagcaggcaccaatcaggagcccagcccagctcgacttctgggagaagcctactctctagggtggtcagacttctagaggatcaaggacaggcaggtattcttatcttggagcaggtttttctcactatctccacacttttctgtccctagatactactttaagaaagtgagtgatgagtttgactgtggtgtggtatttgaggaagtacgggaggatgaggccgtcttgcctgtctttgaagaaaagatcatcggcaaggtggaaaaggtggactgagcactgggcagcacacccggagcacaccatcactactgtgcactgtcatcagtcaggtggacagccttgtcctcaggagcctggtgtggggaacaacacaagattgtgtcatgagctcttctatcggggtgaggctggggaccttaggtgtctgccagcctctgtccctctggctttgggaaagtgggggtggggggtcgtcctactgagtggttccttgggtttctctgttttgctgttcaagaggaaagttccacttaccaccacattaccccctgaagcaataccaggagccatctcatgaccctcagcagctcttgcttctgaatccagtctgacctagggatactttgccctgggcttgtatcccactgtcctcttctctctctctgggacctatccactgcacctggttgggctcaggtccaggagcaggggatcctgtgggggcctctatatattgtacatgtcactgagtgccttcaacatagctgtctcttgcctgccactgtgtgaatctggcagctgagtatctcaggcccctttgcctgtctctagccaccagcttggttcagcaggagggggggcggtgtgtctggtcccttccaagtgtccgtgtaaatatgtacatttctcaggccagggccagcagggggataccctgagcccatttttcatgcaatgacttgtacaattatcttttcaaaggtacttggataataatgaaataaaaacgtttttgaaccttccttggatatgtgatatactatctgtaccagtggggcagggccagtggctatgcggccctcaagccaagtagtgaaggaggcaagatggcctcttaacatgttatccattcttgcccaggcaaagccctaaaggccaggggccaaactaggcagaccagctgctagccctgcttatgaaccacacaaagtctgggacaacatgtttattcatagtacacagctccctccagca

SEQ ID NO: 24562 - DNA, 1196 bp, Mus musculus
tttttttaaaaaaaaaaaacaggaggtaggatcttagtctcacaaagaccacgcttccacagggtagcctgacacccaggacgctggccttgaactactcaagcctgatcctggggattacaggcataccacgaccggccaaaatcaagcttagttgatctagtctttagaacgatttgcgaccgttccactcagcgactcctgtacacttcccgacaggccttgcatcaacgccaaagaacttcctcccagcattccccgcggccggaaagcgccgtgcgggcttcaggctgataggagcgtctttcctcgtcgctgtttgcggcttctctggtcgagttgtgcggagcttctcggccgtccccactggccaccatgtccgcccaggcgcagatgcgggccctgttggaccagctcatgggcacggctcgggacggtgagtctgagcggtggcccaggctctgggcggggtgggagcaaggcgaggccgcctggaagcctgaggtgagggccgtgacagcgtgcgtctgcgcggggcgccatttttctcccctgcttgctgaccccaggctcggggcctttgtctgatctgcttggcctgcgagtctctcgcagccgccgcgttctactggtccgggctgcctccttcctgagagtccgatccgacggtggggctctgtccccttctcgttttccgtcatgcgagttcctcttggtcggcacggcggctcggcgccgccgggcaaactggagcgtcggcgaagggctggaaccagcgcgggctccggggtgctggctgccgggtggcggaatttctctgatactcttcggaggagaggcgatccccgaaggagctggacgggtttcgaaaacccgggcgttcttgctccatacggttacacggggagccgcaaatgagcatttctaacgtgggttccctccgcgtacttttctagtcttccctcccttcattcccctgcctcacagattagcctcggtttagtcacctctcggcattcattaggtagttggttcagtaaggaggcgtgcaagatcatggtggtgtctcaggaaaaagcagttgcatcctagcaaagctagatccctgctgtggtttgtgttttcatttttactaaagtaataaagttgtaatttcacactggcacatttcacagggctgtgcagattctttgcac

SEQ ID NO: 24563 - DNA, 1889 bp, Mus musculus
gagcactgtgaccttccccatggcagcttgcttttttttttttttttaaggtttatttatttattttgagtacaccattgctattttgagtacaccattgctctcttcagacccaccagaagagggcaccagatcccattacagatggttgtgagccaccactatgtagttgctgggaattgaactcaagaactctggaagagcagtcattgcttttaaccactgagccatctctctagccctaacatgatactcttagagagtcatctttttgggcaggtatagaaagcaggtattgtgggctgtagaaatgacagtaccggatcaccagatatcagggtgggaacctttatgtgaaaaatcctgatgacggtattgatgatgagcgtctccggaaggagttctctccgtttggtacaatcaccagtgcagaagtaacgatggagggtgggcgcagcaaagggtttggttttgtatgtttctcatcccctgaagaagccactaaagcagttacagagatgaatggtagaattgtggccacgaagccactgtatgtagctttagctcagcgcaaagaagagcgccaggctcacctcactaaccagtatatgcagagggtggcaagtgtacgagctgtgcccaaccccgtgatcaacccctaccagccagcacctccttcaggttacttcatggcagctatcccacagacttagaaccgtgctgcatactatcctcctagccaaattgctcaactaagaccaaatcctcgctggactgctcagggtgccagacctcatccattccagaatatgcctggtgctatccgcccagctgctcctagaccaccatttagtacaatgagaccagcttcctcacaggttccacgagtcatgtcaacacagcgtgttgctaacacatcaacacaggcaatgggtacacgtcttgcagcagctgctgctgcagccactcctgctgtccgcaccgttccccagtataaatatgctgcgggagtccgcaatccccagcaacatcttaatgcacagccacaaattacctgctgttcatgtgcaaggtcaagaacctttaactgcttccatgttggcatctgcgcccccgcaagagcagaagcaaatgttgggtgaacggctgtttcctcttatccaagccatgcacccttctcttgctggtaaaatcactggcatgctgttggagattgaaaactcagaattactttacatgctcgagtctccagagtctctccgctcaaaggttgatgaagctgtagctgtactacaagcccaccaagcgaaagaggctgcccagaaagcagtaaacagtgccactggtgttccaactgtctaaattgatcagggaccacgaacagaaactcgtgcttcaccgaagaaaaatatcttaaacatcgaaaaatttaaatattatgaaaaaaaacattgcaaaatataaaataaataaaaaaaggaaaggaaactttgaaccttatgtactgagcaaatgccaggtctagcaaacagtgctagtcctagattacttgatttaaaacaacaaaaaaaatacaaaaaaatagtaaaatataaaaacaaattaatgttttatagaccctgggaaaagaattttcagcaaagcacaaaaatttaaagcattcctttctttaattttgtaattctttactgtggaatagcttgggacatcagctctgttttaaggagcagaactgatgactgagcaaggaaacataatttgcattataaaattcttgctttaataaaaattccttaaacagtaaaaaaaaaaaaaaaaagaaatgacagtaccatatgtcctgccagcacttaataattgagaatacagggatacaccttcatagacag

SEQ ID NO: 24564 - DNA, 1142 bp, Mus musculus
gtgcagaccatagagcaggttctgtggatgggagaaggtggccatatgacacagttattttcctaggaagagctgtatctgttgaaaccttagctcaggtcagctacactgcagttccatcttgttacttaagtggaataaagacatagatgacctgctaatcaagaagtccttgagggagagttacagcttaggtcaggtattctgggaggtttatactcaagacaggctaactgttaccccctgagcatttgttgttgctcacaaggaccaatgccttaagaccaaagtgaagcccaaatagaaaggatcactgaataggagttgcttcccttcacttgtcttggggagggaggcattacagtttgtttttggagggaaccttagttggttgtgttaaatgaaaaagcctccccttctccatgctgtgcttgtaaaaacttagatgctgttcttgagctgttgatttgatggttacacataggatcttgtgattttgtaatgtggctcctggtgatgctgtgaactcccgtctgcaggaggatgtatgtgggtacctgctctgctggtattgtgaaaacaggcttttcttgatcagctgtctccatatgcaagaaagtagggtggactatctctggaggcactggggctccgtaccatatacaggtgccgtgtgtagatttcattcacctctagtcccttggcctccaggtggggctcagtttagctctgctgacttcctggaataaggtttgtacctgggcttcttggtcccaggtagacattttgactagctgtgaccacttatgctgggcacattttgtttcttggactcttttgggccttaactggacagtcctaaccttagatccaacatcagcatgtctggtttggatccctctctaaatataaatgtgtgtatggagaaacagctgttttgctttattttatcacagagtaaagattctggaaacatttctgtgccatggcctgtagtacccacaggatgatccctggggtcacgtggtatacaactacaactactgggtacagtaggcagaccccctgcttacatggcatctttttgagtggtcggctttcccagtctcttgtggagggtgagttttacaaggatgttgtgg

SEQ ID NO: 24565 - DNA, 2209 bp, Mus musculus
tgatgttttgttaacttttcttaagtggagtttcctgtaatttaggtggacatagatgataaccagagatctgtttgtggtgttgttggtagctctggacattatgcaagaaatcatagggtccctgggcagtggtggcgcatgtctttaatcccagcgcttggggggcagaggcaggcagatttttgagttccaggccaacctggtctacagagagagacccaggatagccaaggctacacagagaaaccctgtctcgaaaaaaccaaaaaggaaaaaaaatcatagggtcttccatctgtaacccgaggtctgacacaggtactgattacgaagagcaagcctccaaggaagaattgggagagccagtagttttcaaaaacccagtaaccagtcacccatgggcccagagcacaggaggtgggtatccagctcagagagagtagatacacccttcctgggccctcttgttctttctaggcttttggtgttgcccagtgcactgagtgaagaggttggagtgcactgagtgttggaggcctcttgaatttcccaatgtcccatggtcattgtaacaggtaaaaggctgggtcttcccttggatctgtgactcttggaacttggcccattgtattgaaagaatagccacttaatatccagataatgagggcagatgcaggttgcgcctcttggaggacccatccccagttcagcagtacttggaagtcagtacctgagtcgtgtggcttaggaatgtcactgtctgtcaaggcctgtatggtgagccagaagtatccagagtgggccaggtgaaggttaacaagctgacaattgcttcaggaagctctgggaaaacttggttatcctgatgggggtcccaacagcaggatcagttgtctgcgtttgactttactctgcagtctggtcctagaatgtgtgagctctgtttgtttccaaaggtagctgtggcctggcagctttaagcttacctggactctaaagcctcacattttatacctggcatgcactattagaatacactgaattttagtgtgtactttgtcagtgtcttctgcctactcagttcttaacacacttccttgggtctaaatttaaatttactgctaaaatgaaagtaattctcaagatactgttgttaggtgtgtgacttctagcacatgtttttttcagaacagtgatatttatagaatactgtgatgtattccagtgatagcaaaatgcaacaaagcttcttataacaaactcccattatagccacttctgatgggtataagtcagtgacatttatgtgtccagtgttgtgaagtgatcactgatacaaagttgcaggatgttcgatccagacagaaacttcagcccaccagttgaaactgactagcttctcctgagccccctggcaaccaggaacccgttttctctctatagtttgctcatttggatatttcacaaaaatggactcatgcactgggtggcctttggtgtgttggcttcttccactcaaggtttctacaaaacttggctgtgtgatgtaatctcattacttttatgagtaagaaatactccattctgagtgtaagctacgtatttctcactgtgatggttaacttgctaaactcgatgggcttagaaacgccatgagaacacacccctgcgtatgtcagtgcaggtgtttccagggaattcagtgagagacccaccaaggatgtgggcggcaccatcctatgtgctggtatcctagaatgaagaaaaaaggagggcaagagctgagcaccagccatctctcaacttcctgactgcagatgcaatgtgaccagctgccttaagttcctgcaaccatgacttcccaccacaaggactgtacccttatactgtgagccaaataaaccttccctcagttgctcttgtcaggtgttttgtcactcgtgggcccagggaaaagagactctgatgttactgcccagaatactaagaaccctgatgtagttcttggctggattcattacctccaaggtttgtttttgtctctgtcttttgagacagaatatcactgtatagccctaaactcactgtatggcctacaaacccgaggatttatatgaaagctgtgtatatattggtgctaaacctgataaaccagggcctgctgtgcagggtggatttacatctaaggaagcatttggttagcctt

SEQ ID NO: 24566 - DNA, 1229 bp, Mus musculus
aggcattttctcagttgagttttcccttttcccaaatgtgttgtggtcacaaaaaacaacaacaagaagccgaaatggcacacggtgatggaaacacatgagaatgtgtaatatttaatgccactgaactgccattgaaaacgattatttcagcccccactgaaaagatagaaaacaccctcgggaaaacaccaaatggcagttgactccagtgcagccggagggcccagaggatccgggggcccaggattaggaggccgtgtcaacttctgcggaggactctgcagcagtcattggggctgcagtcgtggtcgaggccgtgaccgtggtcgaggccgcggggctcgtggaggtaaagctgaagacaaggaggtaggtctgggccgctggcggggcgggctgcttgcccctgcaccgagaggcagccctttggtgtcttcttccttcagtggatccctgtcaccaagctgggccgcctggttaaggacatgaagatcaagtccttggaggagatctacctgttctccctgcctattaaggagtctgagatcactgactttttcctgggtgcgtccctaaaggatgaggttctgaaaatcatgccagtgcagaaacagactcgggctggccagcggaccaggttcaaggctttcgtcgttattggggactacgatggtcacgttgatcttggtgttaagtgctccaaggaggttgccactgccatccgaggggccatcatcttggccaagctttccatcgtccctgtgcggagaggctactgggggaacaagattggcaagccccacactgttccatgcaaggtgacaggccgctgtggctctgtgctggtgcgtctcatccctgcccccagaggcactggcattgtctctgctcctgtgcccaagaagctcctgatggccagtatagatgactgctacacttcagccagaggatgcactgccaccctgagcaactttgccaaggccactttttatgccacctccaagacctgcagctacctgacccctgacctctggaaagtgactgtgttcacccagtctccttatcaggaattcactgatcaccttgtgaaaacccacaccagagtctctgttcagaggacgcaggctccagttgtggctaccacataagggtttttatacaagaaaaataaatgaattaagtctgtttttaaaagataggaataataagatggatgctatatatgc

SEQ ID NO: 24567 - DNA, 1197 bp, Mus musculus
gtctacagaaggtaaccacagtatctgaaactgtctatgggacagctccctctgtccctccctagtctgtggcaaccaccactcacttctctgagcttgcctgtttttaagagtttacggagaggagtcactctatgtttgtcctgtggctggttcacagcatttaacattaagtccctctacaggacctccttttttagtgctgcgtagtactccgatgtgtactcacaatgctgtcttatctcctcatctctcaggggaccttgaagttgttcccacagcttggctggtgtgcttaatcctcagcgaacagagatgtggagacacttcttcatgagattccgactcaaacttgtggagagtaatagatgccaagtaacgaggttgctggttcaggtagtctgtttttaattcccacggtggttatgctgttgttagtcccagcaacctgactccttgccctcaccagcctttaccttttgtctttagatgtcgtcatgcagggagatatgaggtgaagctccaggacttgtttgtaaccatgaacttttccattcatgccattttgttcccccattttgttggttagactctaagattttatatatatatatatatgaataaatgcctaggctaaaagccttggatctttccctgactagctcataccttaaatccctttattctagtctaagttctgccaggtggctgtgaccattgtcctctgtccatggggccgaatcttctcttggcatgactgtccctctcccagaaccccctcctcctactgggtgtcccaccttctaattctgcctcaactcattggccaataaactttatattgacaattgagtctttcagagagtgcacaagagattatccccacacctatttgccttgtcccctctgctcagaccttctcatggggccacgtgtacttttgccgtagagatgaaggactccctgtacgtcttggatatattctccttgtcagatctgtggttggagaatattttcttccatcccctaggttgctttttctttccagtaactgtttcctctgctgattccatattagaataggaagttagagcccagagctgggaagtaactggccaggcacatagctaccaagttgtgtgcaagtctggaatttcagagctcactcataggatgtcctgcttttccagacaccct

SEQ ID NO: 24568 - DNA, 1099 bp, Mus musculus
tgtgcctgctgcatcagcatccccagacggatgtcacccaaaggccatggttcacttgcatcccatgtccccggacgaaccacagatggcactccagtttctgtgactttgccatttggggcagctttctggacctcttatcgacctcccccctcccccaccacctttaaaatgggtctgagtaggcatgaccatgcacagctataatcccagcactagggaagctcagccaggaggattgagagttcaaggccagcctgggcatagagtgaatttgagggcagtgtagtgagttctgcttcaaaaacaaaaataaataatccacaaacgcaggagcgcttgcatcgaattcgcctcagtgaatatctggaaggtgtgcctcacgttcccatgcttgtgtccttggcagacattactaatccatctcagcatgcacacaccaggtcagggctcagcctcagctgcagggcttctagacctgtagacccgatccctttcatggaaacttccctggactccaagtccccattgagctctgcggctttcactcaagcctctgctctcctactgcctacagtgcagtgctccctgttctggtataagtgtgtatcgttgtcaagattcaaggctgaggtcacaagctgattggctgtcctcaagccaaatctgatgcatagatatttgctcagcagttctttttattctttaaaaacagtagttggcagactgttttttaaaaatagtagtgccacataagacctccaggtctctgggtttcccagatctgacaattctagggcctctccagtcacttcagggcctgcctggcccatttctccatgaccaggacctctggagccttattctatatgctctactttggagacgtgaggtgtggttggcttgatgtttctagagggaagattactctcctctctaaacgcttctctggggaattagcactaggcttctggtttcccgtatggttttcttcagagccagagccaggtgagccggaagctgtggaggtaagtgcaggctgtagtgactggcctgcttacattgatgctatctgtgactgtcactgccagcagggccg

SEQ ID NO: 24569 - DNA, 2815 bp, Mus musculus
tatctgaaaataggatcataagtagctgggaaacatgtagtagaagttaatactataggcaccaaggtcaacacagacgtgagttcaaatctcagctacttacttagtgagctttgggaagtgacctcacttccctcacctgtgaaatgggtctgataatccccttcctcctgcagaaagttcatctgggaactaaaggagctgacacaggtgataatcgcttttattgttatccagttcatccaacaagtggttcgctttgattccctgagtaccatcagcgacaaggtggcaaacaaaatggtatcgtgggcagcgtgtctgcatgagtgcgcttcttgtaatgcaggagggtgcccgcctgatgcccctcagcactgatgtctgacacactctgttctctcaccctcttgcagatctgtgccatcatcggcggaaccttcactgtcgccggcattctggactcctgtatcttcacagcctcagaagcgtggaagaagatccagctgggcaaaattcactgacgtcctgtccagcccagtgactgaggaccaggaaccctgctagccctgcctctggcgtcctatctccttctgccttctctggcccagtgtgtgtgggaggagggtgatggttatgggtggcaccaggttccccagctacctctctccccatgttttagataaattaacactgcctggagtcacgtgtctctttccctgcagagccccaagaccagggtcaggcatggggaggtactccagggatgccggtgacctctctgggaaggctgtagtctattctctgttagggaataacttagagtacaaacagataagctttcagacaggctttgacaatctttaagcccccatcatttggacatgctaatagcttgatttgtcccccgggcagccaacctgtgctctcagcctcgggaccagactgcccaaaggtactgctgcttggcgctctcagtatggaatggtacttggcagggacacccataggcccggcactgcagctggaacttgcttctgcctcattgcttcatgcccgacctagagcccggggcttgtctcctaccccagccctgcctcctcctccgggcagatgccagattgcttgacagaacggtggagactcggatttgcccaccagtcctgaggcagctcacgggtgccccttcctctcttgtctttgcttttctgaatcccccaccaatgtgcctcagctgctgtgctatgcggcaatagcatttcttggtgaaggggctggttcccattgcaaagcccccctccccccaacagttacattctgcagtgccaagggatagggccatgtgactggaaggtcatccttggaagaccatataaggcacagtttgtacacttctgtccaaaccagaagcatccttcccaatgaaccacaaatgatcatgtctgacatccacctttggtcccaaggccttagctggggaaatgaagcaggcttctctttccatccctaccttgcagggtcccaaaagatgcccagcatctggaacccacttgctattgagaccccctgttagctgagcacatgccaactcattcttagacccagggggctcccgtgtctcccccacttcctcctgagttagatctctttcttgttccccctcatccttcctaaggggaggggcagtggtctaggtatgaattccatgcagagaattttagctatgttctcaagtccagagagagccgcgggcctgggcttcatttatattgagatggtttgcatacttttgtaatgaaggggtacctgcagtaggaagttttggggttttttgtttttgtttggttttggttttgtttttcttaaatagtctcttatgggtagctggattctctgccatttgtaatttttcctctgattccaattagcaaaacttccctttttatatgagttgattcttattgtgtatgtaaactgcccctggccacttggctagatttcttatcttcttttaaacattctgttccacagtttaagaaaccagtccctttggtgtgtgaatctgtcacctgtggagggttgggcagggtgggatgggacgggaactatgtggcatgcgtatgagttgaaatcccacttttgtgaggacacggtatgccagtttcccatggaagagacgcctctggcctgttgttcttgtaaaggtattcttaaggggacatatgttttgattctttcccactcactgggttcaattagatattaaaaggctgcttttcagaaatattgctgtgactctgccttgatggtggctgggtagcccagagtctagggtgggagtgagagtgaaatttaattctacagaaagaacagcggttgacagtgctgaagagagccaggtgatggcacacgcctttgatctgccttaagctcataggaggcttagccaggcagatctctttgagttcaaggtcagcctgatctacagagtgagttccaggacaaagcagagaaaacctgtcaagaaaaacaagaataataaagccaggtgtggtggcacatgcctttaatcccagtactcaggaggcagaggcaagaggatctatgtgagttcaaagacaacctggtctacagagagaagccctgtaaagggaggacgagcaggaggagcaggaggagggggaggagagaaggtctgccgagaaccaagaaaatcttgcaggatatggttacaaaccattgaccttgaagagcctagttggctttatcccagtcagattatatatgtagagagttgtggaagcttctagagaga

SEQ ID NO: 24570 - DNA, 1149 bp, Mus musculus
gcaccaacgattaagagccttacaaccgtgaagttacttacaatgcgactgtgattcttcacttgcagcagagatggcgattgtgagtagttcatgggctatggaagaatgcaaagcaggagcctagcatacaagactctagaacagtagtccactattgtaggttttacttatttatgtctgcgcgtaaaatatagataaaactgtaaatgacacatcaccaaaatgggcctaagttctttccagaaaactctgctggtcccctccccggtggctggaggttcatctcagtcaagccccatggaaccacagccttgagactagccaggtaagggcggggctctagtctaaggggcggagtccgacggtcgagtcacgccgcgcgcaaagggcggggctttagcgcgccgatcacgtgagcctctgttgacacttccgggtgggacgagagcgaggctccggaccgattcggctgctggggcgcaggcatggcataccacggccttactgtgcctttgatcgtgatgagcgtgttctggggcttcgtgggcctcctcgtgccctggtttatccccaagggtcctaaccgggggtaagtgcgccaggtccaaggtggtgggagcggaggaccccggtgggaggatcacggagagaaggatcgtacgtggaggactacggcgggaggatgaggcggggtggaccacagaggggaggaccgcatgcgctcctcagagcctgtcaacgtccccggctggagggtgaggtcacctttggcggcccctcccggaagtgaattttagggagtgctttttgtcttgatggactaaaagtgtgcacttcgactgaagagaaattagggcgcctcccaagccactgtcgctgctttggttctgtctttgatgcacgggaggctttttgcctaaacctcaaagaaagggatctgagaacagaaatctccctctcgcccccttgctgtcgcagtttcggactcagacaagcttgatgcagagcgttaagttcagcctttgcagctagtgggcccaacccaagccagggtgagcctgatctaaacgaggttaaatcacccagagctgaaggcattgtgtagaaacctctgcgtcataccttccagggcgctcctgcccttac

SEQ ID NO: 24571 - DNA, 1315 bp, Mus musculus
ggcatggtggctttcctactttctcctcgagctctcctctgccttcctcctctgtcttcaacttttacattttatatagtgttttgctgcatgtgtgctctagccctgactacttttagttcttgtccctgtccctacaccccacccgcacccccctttcttaaatcctatatatggatggatgttttcctcagcatgtttgtctgggcaccgtgtgcatgtagtgccctcgatggcctgaagagggcatcaggtcccctaggactggagttagaaatggtggtgagcctctgcgtctgctaggaattgaacccaagtcctctggaagagcagccagtactctactactgagccatctctccagctctttggatgttttgaaggagggtgaaggatctaggcagtagaggaccttaagtgactagaactgttgtgttttgcaggtcgcagacagaagccttctgtgcagaatcacctgcacatcagaccttcctccatagcccacttcgggcgttacctgccttacacttgaagatcttcctctgcatacagtattttttcccttcaccttttttacactctgaattatgtgcctgcgtagctgcctctgagatgtgtctgcactccactgtttcgggaaatgtgttactcttatcttgaagcctgtggctttgaatatggctcttgccagctcacaacatgagagtcagcgatgtgtttaagaattgctgcgagacaaacaagactcggcgggacagtcaggagtgcctgctcaagaggagccctaccccagcagatgtacaccaagctctattttcaggatgaatttcttacttctacatctttgggaataaattatttttcttctttctatggaaatctggctccagtgtttaaaaagctcagttttctaagctcctctgtctctagataatgccttttcaaaatgaggttgttgtctaaccttaggttggatgtataatccatctgggccctgtaatttgagacctgaagagactggtaagtgcttttcttgatcattcattcagtaactgtttgagtgcctatggcaggcaaggcatcggaggaagcagagatgttggaaacagggtccctgcatgctcatgagctcacaggttgtttggggagagattgattgttcctatgcatagagctgtcagatgatgtcatgcctgacctttggtgagaggcaggtacataccgcttagtccctgctccttgggctgagataagagggccacttgagctcaggacctggcggccagcccaggcaacacagcgagaccagttgagg

SEQ ID NO: 24572 - DNA, 1173 bp, Mus musculus
caaatagagcagctgcccctgtgtgttcttcaaagacacttcaggctgaggtcccatcatcagactgtgtccaaaaagcaagcaaacctacttcaagcacacagatcatggtgaagaccaacatgtatcataatgaaaaggtgaattttcatgttgaatgtaaagactatgtaaaaaaagcaaaagtcaagatcaaccctgtgcaacagggccggcccttgctgagccaggtccacatagatgcagcaaaggagaacacctgctactgtggagctgtggcaaagagacaggagagaaggggggtggagccgcatcagggtcggggcactcctgctttgcctttcaaagaaacccaggagctattacttagtcctctgacgcaggatagtcctgggttggttgccacagcagagagtggcagcctttctgccagcacttctgtttcagattcatcccagaaaaaagaagagcacaattattctctttttgtctctgacaacatgagagaacagccaaccaaatacagtcctgaagatgatgaggatgatgaagatgagtttgatgatgaggaccatgatgaagggtttggcagcgagcatgagctttctgaaaatgaagaggaggaagaagaggaagaggattatgaggatgacagagatgatgatatcagcgacacgttctctgaaccaggtataactcttggagcctactaaattgacctttctagtcactgtttgaaataggaagcttgttttggatggttgctatattttagttcggggattaaaaaaataaataaataacttaatgtctttatttggatcaaaagtagctttcttttagccacatgattctaaaatcatttgtgtttatgatcatttgtgcctatgtcatagtttatcttgattctttgagggcttattcttattttttttcttttttcttttgttaagtgatctactttgccaccctcttgagcacttaagtaaaaactccaagagtatgttggtttaaaatcgggtgccctgttttgcatatgcccctcttgtggctaagatgggtgtatgcagaatagagtcaagtggtgtcatctcatgtcactcatgctcagttaacaaagcctgctcagtaaacagtctgaagacaagcattttctttgtctgctgtattaag

SEQ ID NO: 24573 - DNA, 1094 bp, Mus musculus
cagactatcctcaggcctagatacagactatactcagacctagatacagactatcctcaggcctagatacagactatcctcaggcctaggtacagactatcctcaggcctaggtacagactatcctcaggcctagatacagactatcctcaggcctagatacagactatcctcaggcctagatacagactatcctcaggcctaggtacagactatcctcaggcctagatacagactatactcagacctagatacagactatcctcaggcctagatacagactatcctcaggcctagatacagactatcctcaggcctagatacagactatcctcagacctagatacagactatcctcaggcctaggtacagactatcctcaggcctaggtacagactatcctcaggcctagatacagactatcctcaggcctaggtacagactatcctcaggcaggctcagctgtttttctcagtgtgcactttgaggtctctgttacttgactttgctctgcttctcctgggtgcaccttatcacctgaaggtcacatcacccttggttatctctgctctttgttgcttctttaaccttttttatctgctttttatttcattttcactttttcttattcagtattcttgtgtcatgttgtagggtatgagtgcattcgtgtgtgtgtgtgtgagtgtgtgtgtgtgtcttgggcatggaagtcagggtctcagatatacttgtcaagaatactatcactggatgtaatgtatgagaaaaggagaaggaggaagaagaggaggagaaggaggaagaggaggaggaaaaggaagaggaggaagagagaaaaagaaagaaggaaggaaagaaagaaagaaagaaagaaagaaagaaagagaaagagaaagaagagaaagggagagagaaagaaagaagacggtgacaataaaaagaatactaccactcactcctcttgttgctttcattttttttttttaacttttattttctgtgtcctatgtctgtgtttaccatgtcagaggacaacttggaggactggttgtttccttctatgtggatcctggggatcaaactgaggttgtc

SEQ ID NO: 24574 - DNA, 4772 bp, Mus musculus
gcagagtgttttgggtgagtgaatatattagtataatgctgagtgttaaggtgggtttatgctctgaaccacacaaaaataccgaggaagcattttttttcaaagtccatttagattgtttttagaatgactgctttttgttctaattttttacagccattaatctcacatgtacatggcgcacccagcactcacgtgtgtaccatgtttagatgtttttcagaactcaatatgatatataaaaatacatatatatatatatatatatatacatacatatatatatatagaattgtctgtgcaagtaagaaaaagcatactctttgtgccttgtattttggggaaactctaaaactggtaatattttgtatgatgaaaatcctaatgaggaaaaccaagatatatagatgagaaaattatggggtttaaatgtctttttgttccaactctttttcagatttttttgaatgtatataggactatgtcaaaatgtagatatatgccacagagtctgtgtattgtataaaaaaaaaaacaaaaaacaaaaacaaacaaaaaaagatggctctagagaactcctatttcggtacttgaccggaagaaaatacttgcacattattgcgattgttttattttttctaccaaagacaaatgcaactggtatggcagactgccagtctaagtaaagttttgcacagcttacatgatactgtatgaatgtatgaaacagagaaaaaattaaaaggtcagggttagggatcttactcaactgtgaactttatttctgtttgggtccaattatctacagaaggagcatccatacatccaaatattattttgctgtcctctagtttgcttccatagtagataagttggtggccacttaggtgtcttttatttctgcagttattgtaggaaattttaatatatttcatattagtaagctattgataaaatagtttttgactttgaaaattaaagtttatttagcttattgtagtatacttccaccaaacaaccaaaatacagattatttttatcgtattatgtatatatatatgtaaagagataaaaaagctaaaaatatctaatactttagttgccacttttccaattgatgttattgtgcatgtaatattttcaaagatcaacacaagcttaaaacaaatttataaatttttatatttttgtacaggtattttcttcaaacttacatgtgacttatcttgtgtagtttctagacttgagaaacatgaccacgcttagttttaggtgctcttctttgctttagtggtcagttgtagctgtgctcaagctttgcctcttgatgagagattcctatgccccacaggtccttccatcccgtctttcttgactgttttatctcagatcttgtgtttggaactatgaaaactggtggcttcaaaagtaaaaacaaacatatctagaagaaaagcctgagatgtcagacatagttgctgtttctccaccaccttttgatagaactaagatagctgtccttggtctgtctgcacaggagtttctttcctttttctttctccccttttgtaagctatagcacatgaagtttcaattagaaaacacagttacaatccaaaaatgtgtctgacttgcctctttgacatcatgaatcataagaaaccaagacttgtcttgacacgttagctgaaactgtgacaaggttcctgtgtgtttggtggaaatgtacctttagttcatccaccctaacagataataagctcacgtgtcatggttaacagaattaaagttttactttctatgtgggaaaaggcaaaccataggttcacaaatggaagtgtctgaagtctcgaaagtgttccagaacctggcggttttcagtcaaatgactgtcacttcatgatcgcgagtcagttggcgaagtttataaaattgcccctttctagctaccctgttttaggaattctggttttttgatacctttttcttgtctgcaaaccagaatttgatttttggtcttgcatttcaaaacactttgaatctgtttagtagattccatacccgtgcatttcagtgttttatatgtactccttaagttaaatagttgaaagcctttaaatagttgagctttttaatgttgactctttattttgtacctatttatatatgtatgtatatcttaggaaagcactttgttataaaattgcattttatatgattcctgccatttgctgctaaacttgggctggtcagaacgctgcagcgatacttgatctaaataaaaacctggcagtaaaatgtagagtgcaagttaaatcctcttgctgtttaagatgacataggcaagctgtgcagctttacattttaaccaggggactctgtggcatttaaaaccgtctagaaatggttgtacttttaatgccagtaatgaactgcttcctctattgtctttaaaatatcctacacctagtgtatcacaggcggttctcacaagtgtgtaaaaacccagcagttgtatatgttgtattttaaaaaatcgtggtttgtatttttgggtggaaatcgttagagtgagagctgtctagaggttttctgtgttcatacatggtatacagagagctcatgaagtccagagccttcccttaagtgaaggaaggcattgtgaattctcctcagatcaacccaccgttccaaaggcaaccataaactgactacagtactactacagtaaaaaataacaatgaaccttctgcttcctggcttcagatacactggattctttagtctgtgcccacatgagagcatgctgccgggctgctcctacataagtttcctgtgagtcttgcaatcagtgtggttgcttgctgtgctgtaccatgtatgtgggtcctcatcctttccatgtccttcatgagcgagttgggtgtggcttaaccttgtgccttacttgtacacttaaatgatgcatcttcattccttccatcccattcccaaaccttaactctgttctttttgtaagagaatcacaactattccagaagcatcatgaaggatttcagatgggcgtcgtttcatagttccctctctttgtagttgttttatacttgtaggagagaacagttttgaatgatctttgagtaatcgtgttacgtccttctctctggcttctgtgaggctgtcctgcgtctctgatgcttggcttcgctcacaccttagcaagtctgcatttacaggcagatgtgctcacttcatctgctcgaaagtgattcttttgttttccagaagtttttaggagaagagtacctattttgtttgttttttacaacagatgacaagtctctttaaaagaaactgaagtacagtacttttgaaatacaatgctattggtatgaagttctcttttatatataatattcatacaattatctgatgtttgccttcattaataaagctgttagtttattcaccaaaatgtcaagaatggatgtgcttttctttattccatatatttaaacaatattttagctgctaagatttagttaacttcctaagaaatgaattcaagttgccttcaacaagaattaacaaaactcatgtcccctttctttatatagtcttcctaaacttctgttcaactactttctgattaattatgtgacagaatgttagcatctctctaaatcttgaaacttgaattttgagaatgcattgatttcagtgttaatggaaaaggtctcagctatgtttctagtggagtcttttgtggaataccatttcccatggaactgcgaccacttgcacaactttgcacagaactgcagtcttgttcttccctggatcgtgacaaatgagtcccacacagtgccgtcatacttgtggattctaccgtgatttttgtcatcttaaataagggcattatgagaaaatgactccatgtctttttttttttaatatttcaaacacagtgggatgaaacaacatcagaagtagggatggtggtttcgttttaaggaataagcatgttggaggaatgtgatgaaaatgtactactgagagttccacacttccacagcaagtgggattatgtgttgaagcatagtccccatgcttagtaaactgactgaaatagaaattacacctaggaactgcactatgccaaattgccattttgttttgaagagacttttggaggtggcaataaggtgatgaaatcttatagctacttccaaatagtattttggaattgaagactagtaaagagcacccaggtttgtgtctcagcgtgccaagtgtgaactgggcttgcctctttagtcacagtgtaaacacctagtgtagttattcagttccaggtgccagaagcgggactgattctgtgtcttgccctttgtcctttggggtttttttgtttggttgtttgttttcagaactaaataacaaaactgtatgtgtactgtatttgcttctccacatgttttgcgacactgtactcccactgcctgctattgtcttcttgccctagagtctgtcctgtggtgtagcatttgtggttaacaatgactccggagctgctaacacggaagggcaagaatacaaagcatttgctcctatggtttggcagcctcttcgaatagttgcccttagggtcctgtctgtgatacgatcataaatactccgtagttttgtttattccctgcccccagctggagctgtgactctttattggattcagtcttgtcttttgtctagaaagaattgttatctcgttcacg

SEQ ID NO: 24575 - DNA, 1160 bp, Mus musculus
gtctggcgtgcgcaagactcaagagggtatatgcccccaaatcaacaaactgctccaacaagggattttggtcccatgcaaatccccttggaacactcctctacttccagtaaaaaaaaaaaaacagggaccagtgactaccgtccagtccaggaccttagagaagtcaacaagagagttcaagacatacagcccacggtgccaaatccttataacctccttagcaccttgccacctggtcggacatggtacacagtcctgtatctcaaagacacttttttctgtttgaggttacaccccaacagccagcccttgttcgctttcgaatggcgagactccgagagtggacaagccggacagctcacatggacgaggctgcctcagggattcaagaactcgcccactttgttcggtgaagccctacaccgagatcttgctcttttcctagccaataacccacaggtgactcttctgcaatatgtagatgacctgctcctagctgcagaaacacgcgaggactgtgaaattgggacccaaaacctcctgggcaagttaggtaagctggggtatcgggcctctgctaaaaaggctcagttatgccagatagaagtgacctacctaggatatgtcctgagaaatggacaacggtggctcacagaagccagaaaacaagctgttatgcagatcccggccccaaccactgtttgccaggtaagagagttcctggggaccgccgggttttgcagactctggattcccggatttgccacactggcagctcccttgtatccactaaccaaagagaaaggggaattcacctggaccagagaacatcagctagcctttgaaactctcaaaaaggcactgatgcaggctccagcattggccctgccagatttaaacaaacctttcaccctatacattgatgaaagaaatggagtggcaaggggagtccttaccccggttttgggaccatggaagcgcctggtagcctacctatcaaagtaactggacccagtagccagtggatggccctcctgcctgcgagcgatagcagccacagctatgctagtaagagatgctgacaaactgactatgggccagaatgttaccatagtggccccacactctcttgagagcatcgtcaggcaaccaccgga

SEQ ID NO: 24576 - DNA, 1192 bp, Mus musculus
cacttaagagggcggggctaccgggccacttgagggccgggattggccaggtctggagactccgggaaggcagggctgctcctgtcacgtggtgcacactgttttcgcgtcacgtggctactgcaggtaagaggcggccgctccgccggggctcggggtccttcgtccgtgcaatgagcggccattgatttcttcttttctctaccagcgcgggctgcatgaactgggggcgggcgcccggcgtcttgctcggcggaggggtgagtctggccccgccttttccggtctcgaagtctcacccagcttctgcagcggaacagaggagctgtcccaagtttcttttaagtttcagggacatttttttttttcttcctggtgcagaaaaggcagcgcagaggcttggtgtctgccccagaaggcagcccaggtgcaatttcctggggcagttgtggggacactgaatccgccctcccccctgctccaggccactctgctcctgtcgtttctttggatgccagcgctactgccggtggcttcccgccttctgttgctaccccgagctctgctgtcaatggcttctggaagccctccgtcccagccccctccggcctcgggctccggctacgttccaggatcagtctctgcagcctttgtcacttgtcccaacgaaaaagtcgccaaggagatcgccaggtggggacctcggccagatgacctagagagagcgttggggttaggggaagggtgctgtttccgggtcgtgcacactctgatctcgcttcaccctcagggcagtggtagagaagcgtctggcagcctgcgtcaacctcatcccgcagatcacatccatgtgagttgtcagttagaaacggaaatctacccggaggggctgagagctttttctgggagaaatcttcctttcccaagactttgttcccttctttctctgacctcttcagctatgaatggaaaggaaagatcgaggaagatagtgaggtgctgatggtgagaaaattccccccctgcctggctcctttgacaactctggccctctcctgacaccagttctctaccccgttggttgaactatgtctgtctttgccctttagatgattaaaacccaaagctccctggtccctgctctgacagagtttgttcggtaagaactttgagattttcttttggtggtggt

SEQ ID NO: 24577 - DNA, 1263 bp, Mus musculus
gcccctcccactctgctgtgggtcctaaggctcacactcacactggcaccttcaccaaggaagccatcttgctggccctcagtgcgtttgactcatcacctaagcatctcctagcattaatcctgtaggaattcctttctctgttagcatccaaggctgctgtaaaaaaagtcaccgtgaactgagccagccaaagctcttctctcacagatcaggggtctaaagtccaagatgagcaaggccatgtcagttctgaaagctgtcaccttcagtctgtccctctttacatggctagcttccttctgtatgtctctaatgtgataaagtcaccaattgctggattaagagatgacattaatcaagtatgccctcatctgaattgacatctgccaggacactatttctcagattctagagagaaataattcgccactattcgaacccagtgtacttactgctctccttacggccaccatcttgatctcgtgtgctcactgtctttctggtgtgtctgtcttcacccttttatctgccccaaccacttcctcatgccaggacaacagccgccgagtagataacgtgctgaagctatggatcatagaggctcgagagctgccccccaagaagagatattactgtgagctgtgcctggacgacatgctgtatgcacgaaccacctccaagccccgctcggcttcaggagacaccgtcttttggggcgagcactttgagtttaacaacctgcctgccgtccgggcccttcggctgcatctgtaccgtgactcagacaaaaagcggaagaaggacaaggctggctacgttggcctggtgactgttccagtggccaccctagctgggcgccacttcacagagcagtggtaccccgtgaccttgccgacaggcagtgggggctctgggggcatgggctcggggggaggaggagggtcagggggtggctcagggggcaaagggaaaggaggttgtcctgctgtgagactgaaagcccgttaccagacgatgagcatcctgcccatggagctgtataaggagtttgcagagtatgtgaccaaccattaccggatgctatgtgcagtgctggagcctgccctgaatgtcaaaggcaaggaagaggtggccagtgcactggttcacatcctgcagagcacaggcaaggccaaggtgagcactgtggccccagggaaagctggcttgagcatggctgccagcttgtgggcggtgaagagagaataagatcatgaggtt

SEQ ID NO: 24578 - DNA, 1364 bp, Mus musculus
tcttccctggtgtctgtttttcttctcctcctttccttgtctctctcccaccctccgtctctctcccacgtgtctatctcccctcacccctctccccctctccatttctctctccagaatctgttcctctactgtggccctcttcttcagcagcctcctgtctttctcctgcagtccctccctcccggtctctctcacctgtctccacaccctcaccttctaccaccccctcagcatgttccctgaaagctgagggtctctggggctcagtcccggtctctctttctctctttctctctctgtctccccaccccttccccccagcgtgttcccgagggagctgaaggaggtgtttgcatcttggcggctgcgctgcgcagagcggggccgagaggacattgctgacaggctgatcagcgcctcgctcttcctgcgcttcctctgcccggccattatgtcgcccagtctatttgggcttatgcaggagtacccagatgagcagacctcacgaaccctcaccctcatcgccaaggtcatccagaacctggccaacttttccaagtgagggaaacttcaggaagggtgggatggccgtgggcttctggaagggtctcccaagtcaccacagcatctgtgcccctgtccaggtttacctcaaaggaggacttcctgggcttcatgaatgagtttctggagctggagtggggctctatgcagcagttcttgtatgagatatccaacctggacaccttgaccaacagcagcagttttgagggctatatagacttgggccgcgagctctccacacttcacgccctgctctgggaggtgctgccccagctcagcaaggtcagtggaggtcccctctgtcccatctccaggtacttccagaggcacctgggctgagagattatctctgcacagaactcttgtcaccttcctgttcccagaaatgtcaccaccacttccagtacacatcacaaaacctctacccatggcctctgaggccctcttagaactgggcacttactcatcaagtgacagccttgtccttccaggaagccctcctgaagctgggcccactgccccggctcctcaatgacatcagcacagccctgaggaaccctaacatccaaaggcagccaagccgccagagtgaacggactcggtctcagcccatggtgctgcgagggccatcagccgagatgcagggctacatgatgcgggacctcaataggtgagcaccctgcttccatgctgctatgctctaggagcctgaatgctcctggatgcttctcgctgggcctgtctgtatctctagcgctcagaagggaagaagggaaagttcttagggacagtggtaa

SEQ ID NO: 24579 - DNA, 2125 bp, Mus musculus
cccctgcagatgggaagtgctttgcttgcttgtgtggaaaacggtttgcagtaaagccgaaacgagaccgacacatcatgttgacgttcagccttcgcccttttggatgtggcatctgtaataaacgtttcaagttgaagcatcatctaacagagcacatgaagacccatgcgagagctctgcatgcgtgtccccattgtggccgtcgattccgtgtccaggccttcttccttcgccaccgggacttatgcaagggccagggctggcccacttaccactggacttacaaatgactactggtgctctctagtgatttctaggacaagatagcccctgctgctgctggactcttaccttcaccacctcagtcctggattgtataatcattccaagagattatatatattgtcatgaaccccttactcttgggtatgggtctcaccctggtagtccaggtttagacagactttagaaaatcatgcttctggtcacttaacctaaatggccctttttgtattgatagccagtgaaggaactgctgagctcagattaatgagagaggagttggggcatagtcacccagtaactcttaacttcatcttcatgggggggagagggagctggtctccaactaggaatgcatttgattcagagctcaagtaattgccagactaaggtctgagcggcttctccctccctgttagcagtattctgtttctgtactttctgtcattttccagatgctttttaggttctcaccagtatacacctttcccaaatatccttttaaaaatacttgagtggggctggagagatggctcagttattaaaagcactctgctcttctagaagtcctgagttcaattcccagcaaccacatggtggctcacaaccatctaaaatggatctgatgccctcttctggcatgcaggcatacatgcagacagagcattcatacatttaagaaaaatgtatttgaacatgcaacaagtgtggtgcacacatttaattacaacacagaggaggcagaggcaggtggatctcttctaagttcaaggccagccagggctacacatggtgagaccctatctttaggggtaaaaatagtacttgagcactttagcaaactgagcatttcatattctattctgaaagtccatagtagagtgtattccctcagcagccttcaccttgtccgcctttcactaccactgataacttgcttatgatcacaatgacagatatgacccacgaactcaggagatggcaggtgacctacaaagctctcagggtggcatttgctctctgagcagatcgccctgcttagaggaactcagggttgaaaccacacgtggtgaagtctgcagaggagctacaatgggaccgtactgctttcttcacccacacttggtagaggtagaggggtagatagtagaatggaggtgaagggaaatttaaggttgttaataaactctgccctgaaatctaaactgacagtagactggcttgagtgagtgctgtggagatgcagagctgagctgcaggagagctgagctgcaggagatgagtgtgttcctttcccagccagttacatcaatgggagaagagtgagctggtatcagagacttgacatggagagtgctatcctggactcgggcaggccctgctgctgctgaggaccctcaggtgagttactttatgtctcagagtctgacctgctgctactgcttggttctctgtcttggtttgtcgagatctcgtcttactatatagcccagactggccacaaactcaggatcctccttcctcagcctgtgtaatactaggattacaagcacatattgacatgtcaggtttatgtccactttttgaaaggctttgggtcacataatattagcttaaattatttcctaatttctggcagtatgcataatgttagatggcactttgatttattctataaatacttagaacagagcagtgtgcgagcccctggttttccctcattggaacaatgtctcagtgagtaagagtactcagtgctcaaacatgaagacctgagttcagatcctagcactcacggaaaaaaacccaggttttgggctgaacagagggttccacgggc

SEQ ID NO: 24580 - DNA, 1400 bp, Mus musculus
tgaaccccatcctgtctcagaggcactgactgacgcactggggggggtgggtgggggatggagaggctgggccactaattcccagaaaactaggtttgtttttatactaccctttagatacaatccaccctttttctccactgtgcccaaagtcagaacatggagggcttggggactggtggttcgaacctgtgttcccaacactcctgctactttggaaggtcagcccttgagaagagacctgagcacaatccttgccctccctacattggctcccaagaccaactgtaggagactgcatgacctacttcacccccacctcatcgtccatttccccaaccctaccccccacaccccctcccctcctatctcctaccccaatccatccatttttgccttggcggctggactctcagggattctgagcccagagtgagggcagaggtgagagttcagaccacagctgtctgaacacatccatcaggctctccaatcctgtgtccttcctgacccgtgctcccaacctagtgggtaggggaagacgccactttctccccagggctctcaggtgagcctgcctgctggggcggaggccttcctgacagacggacggacagagcctcagactcagccactatgacaggggagggggtgggcactctttggaggtgtccacactagagaactactccagcagaagcaactgtggacctgggtgcagttcctccccggaacctatgattacttgaaccccaccttcactccttgtctgcctaggtcctcctcgggttgggtggggtgggtgtttttctctgtcttgcacaacataggggtgagaagttttgattaagccaaatgtatcggggaagagggggaggcagagggtgctctgtgtctggaaataaactgtgcaatgcccccaacacctcgcctggcatctttacactccactgactgtcctatgttagactgcaggaagctggacacactgctgtaatcccagctccgcgctacataggttctcatgccgagatcgcaagatcctgaagtatgaagctgcagttggggctggagagacggctcagcagttaagagcactgactgctcttaaatctttgggctggagtgagcggggccaaagtgagaagttaaaaaaaaatagaaaaaaaagatcctgggttatgaatctgcagatggttggaaaaccaggacaaatcccaaccaatcctttgtaatgaccccggctcttcaccccttacatcagttatttatttatttatttaggttttttgagacagggtttctctgtatagccctggctgtcctggagctcactttgtagaccaggctggcctcgaactcagaaatctgcctatctctgcctcccgagtgctgggatt

SEQ ID NO: 24581 - DNA, 1205 bp, Mus musculus
taaatcaagtgtctgtcactaggattcctgggaattcatgaactcttagcccctggtctcttacctgacactcttggggcttgctttgtccgggtgcattctcgccccatgtacaccagcgagcattagtttaagggtgcaccaaggtctgtgtgcctcagagcatagcagtagaggcggggcccccattcttggtacccatactgtggaggtgtggggtgcagaggaagaggatgctatggggagtggtgagcagaaagcagccgcggtgtgtggcaccgtcgctcaccggctgtgtcctctcacctaggaactcctacgtgcggctgcggcacctctgcaccaacacctggatccagagtaccaacgcgcccatcgacgtggaggaggaacggcctatccggctcatggtgagagcccttgtgctatatgtggggctggggcctaggctgcatcatggccctggcatcccgctgacccttgtctctgcagttgggcacatgccccaccaaggaggacaaagaggcctttgccattgtgtcggttcctgtgtcggagatccgcgacctggactttgccaacgacgccagctccatgctggccagcgccgtggagaaactcaacgaaggcttcatcagccagaacgaccgcaggtgcactgggatagggatggagttgtgggcagtgtggagtccagggagggcaggctggcagggtcagagtgagtctgcctgcctatgtgagcacatgctggcaggccccctgggagctggcccctcagttcttcatgcttctggtgttacccttcgccaggtttgtcatccagctgttggaggacttggtgttttttgtcagcgatgttcccaacaatgggcagaatgtcctggacatcatggtcaccaagcccaaccgggagcggcagaagctgatgcgggagcagaacatacttaagcaggtgtgtgtgctcttcaggggcttatagctctccagtggggctcatggctctcctgcagtgttcatagctctccagtggggctcatggctctccagcgggactcatggctctcccgcagtgttcatggctctccagtggggctcatggctctcccgcggtgttcatggctctccagtggggctcatggctccccagcggggctcatggctctcctgcagtgttcatagctctccagtggggctcatggctc

SEQ ID NO: 24582 - DNA, 1206 bp, Mus musculus
agatgcctgcctagaattttctatcaggggtctgggaacatggctcaatcatagatgctagaattgatcaatgtggggctcagggtgtggatcaggggtagagtccttgcctagatccagccattggtagaggtagggatttgggtccactgtagagcacatgagaacctaccaatgaggagccaaggatgtagatcaggaatagagcagttgcagcaagcatgcaagcaaggcaggggccgaggtgctgtcccaagcattggaggaaaatgtatctgagccatgaccacgtgccaggcacttccttaagtacccggcaggattcacctcattttgactcctcctgcgggagaactgtggacttcattatggagggaggaccctgaagcccacagaggctgggatcctgctgagtaagacagctccgggcttctgtgaagggaagctctggagttagggtcaggactcctgggacgacgaggggtacagcaggacgggagagtccctcttactctctacacccctcagatctttggcatcctgaaggctccattccgtgacaaggggggtgaaggaccactagtgcggctggaggaactgtctgaccagaagaacgccccctaccagtacatgttccgtctctgctaccgggtgttgcggcattctcaggaggactaccgcaagaatcaggtgggcactgcgcagtccctgctgggcgtgagccctgtcttttctcctcagcagggtccctgtgggcacagagggcagcctggcaccaagtacaggagggcaccagatggtgggactgatttctggggtgcacagagcctgccctaggctctggtgttactatcttaaaatactgcatctttctcctcatcttcttctggttcattgaattgagagtgtctcacggtgtagaccaggctggcctggaactcgctatgcaaactacagagagatccacctgtctctgcctcccgagtgctgggattaaaggtgtgtgccacctcctagtgtaaaattcgtcacttttgaaccaaggtttcactatttattttataccatttagccagtcttgctaagcaggcaaggccctggtagggccggatcacagcttagaatctgtgtaagggaatcggtgtaaggtaaagccgccgccctttagccctggcggctgcatttgcatctccccctgaagtgagc

SEQ ID NO: 24583 - DNA, 1165 bp, Mus musculus
acctttgtcagtctcgtgcgcaagaacagggagcccaggtgcccgctgcacactctctgcctgccctctgcccccttccagcctctggtgctggctttgttttgagacagggtctcactgtgcaaccctggctgtcctgaaactcactttgtagaccaggctggcctcgaattcacagatacccctgcctctgcctccagagtgctaggattaaaggcgtgcgctactgtgctgggtttctgatgctgcttgttaactgcatggtgtatcgcttcctttccagtgcttgggggtgtgtgtgtgtatgtggctcagtgtagccataagagatgcaaattcccattccatggtgagccccaagccctctgctggcgactgagccggtgcctgctctgacccctgactccatctcttggccctgtcccacgggggtgtcaggagctgctgccccctggacatctgggaaggagggtgggtgaagcttctggcttgcggcagcttctgagtctgttgctggccctattgattcaccagattcctggactacctctccgacctgtgcgtgtccaaccgtatcgccatccctgtcacccaagagctgatttgcaaatgtgtgctggaccctaagaacagtgacattcttatccagactgagtgagtagcagccccatcctgctgcggctcgggttagtcctgactttctttttatttgtaggtgtgtgcgcagtgcctgtagtgcccagctttaagagtggggtggggtggggtggatggagggttggggacactgagtgggaaatgagccacagcctcattctgggaagtacagcagcttagagacctgggctgtgctcctcctaccgggggtgtgtgtgtgtgtgtgtgtgtgtgtgtgtgtgtgtccatagtgagactcggagcactgggacaatctcctgacattgctgccacctgcaggctgcggccagtgaaggagatggctcagtctcacgagtacctcagcatcgagtactcagaggaggaggtgtggctcacatggacggacaggaacaatgagcaccacgagaagagcgtgaggcagctggcccaggaggcgagggctggcaacgcacacgatgagaacgtgctcagctactacaggtgcccccgaccactccccacctcc

SEQ ID NO: 24584 - DNA, 1286 bp, Mus musculus
ggctgagacatgtcctatatgggttgtatagaaggctcttgctaaccacagctgtgctccaggtagctctctcacacctcatagcaaccctgggaagtaggtcacactgtctcctgcaaagctggggaaccagcatggagtggaagagcttgcctggtgtttcagggctaagccaccgttcctacccagggtggcctggctccaggaccctgatgggtaaccctgaagtgtgtggaggagggagagacatgacgtcactcacagagaagcctctgttatcgctctcatctgagcctcacgcctttcaccagctggctcttccctctctcccagctacctgcttcctgtaaggacctgtcccagcccagccagaaaacatctaccctcctttaccaggaggggtcacatcctctctgtgaagcgttggtcctcaccagggccatgccggttacctgctgcctctgactcagggctacctacaggtaccagttgaagctgtttgcccgcatgtgcctggaccgccagtacttggccattgatgagatctccaagcagctgggtgtcgagctgcttttcctgtgcatggctgacgagatgctgccctttgacctccgcgcctcattctgccatctgatgctacatgtgcacgtggaccgcgaccctcaggagctggtgacccctgtcaagtttgcccgcctctggacagagatccccacggccatcaccattaaagagtgagagtctggagggtgggaggctagtcaatgtggggcgggggtggggtggggcggggcggggcatggggaccctcatgcctcctgcttccatttttagctatgattccaatctcaacgcgtcgagagatgacaaaaaaaacaagtttgccagcaccatggagttcgtagaagattacctcaacaacgtggtcagcgaggccgtgccctttgccaacgacgagaagaacatactcacctttgaggtgggctgtggatccttggggctggaggggagtggggccatggtcctgcccctccctacctccccacccgaccttgtcggtcagggatggattgtaggatccatgatcccctttttctggtgccttcagcccagttatccttgagatagctaagatctcccccaatggacagtttcccccggttcagtacttggctgaatccactgaacccatcaaccagggtcctgccttcatcctggttttctctgccctatttggaccccaacagagcctcagtctccccctgaacaatcatgacctagggccc

SEQ ID NO: 24585 - DNA, 1107 bp, Mus musculus
ggacttcctttctggggtgggtgtgtggggtgacagtggacacgcacaggtgactggtggcgacaccagatagggcgacagggcgtgcttagtcctccaagctcctgccttcttcctgttggattttggggaggtctagcctacgtcaacctgcacccccatgcatgcctgtgagctcgatgcagtcagaagggtgggcagagccttgacagcctctggcttgatttgcatctgtcattcgtgcagagcttggtgtctgcaggggctgcctgggtgttgggtccagagtcagagaccctactatctgtgtgacagtctctgtgtgagccagcagggccaggagcggcttcctgggacagactagagaaacactatggtcagacagacattgggatccttgtgaccttgttgctgtcttctctagccagccccctggggatgccacacggagctgccacatttatgggcacatgtagtggggacaagatggactgtgtctctgaggtctcagtgcctgagatcctagaaggtgagaccggcgtctacaggataggatggggtgggtggggtggaatgggcagccccgggtccgaacatactgaccacccgcagaggacgaggagcccgatagcacggagcgggcctgtgacactctacttatgtgtatcgtgaccgtcatgaaccacggactgaggaacggtggtggcgtgggcgacatcctccgcaagccctccaaagatgtgagcaccttcccacccgtcccgtggatgctcccacacccagccagtttctgtgacactgtccagagctatcagcttcccaccccagcacactgtagaggctacaagggtcaccacggcaaccagtcttggctctgaggcttggggaggtgtgggccatcagcagtcagtggcttcctcagcctagagagggaggacaaggtggagcctcagtttggcttgggcggccaagctgtgtccatcactgatctctggcttagaccaaggttctggaatgtgagaggcgcggcatccgggctgctgatccgggagctcgcagctgccccccatcccccttaaccaagttagaggcagaaacaagccctgt

SEQ ID NO: 24586 - DNA, 1709 bp, Mus musculus
ccctggtgagcggcgagggggagggggagcagaatgagatccgcatcctgcaggagaagctcggctccaccatgaagctggtgtcgcacctcacctcccagctcaatgaactcaaggagcaggtgtgttcccagtctcagtgtcctaagcttctgtaccatgcagggtgagagccatccaagtcacagggaaccctggttcaggtggagtcttgtgcagcagcctggaagagcctccaaggcctgcggtggtgggaacctcctccgcctgtagcagcagctacccagtgcagctccctagcccctcgctgtggtctcccgactgcacccgatcaagcgtttgacttgccaactgagggtgactgggggcgactggggctgaccatctgccatcagagcttaatggtagctgggccctttggggaggatgcagactttcccggggctgtggggaaggcagctaggccacctgacgtcttgtttaactcagatgacggagcagcggaaacggaggcagcgtctgggctttgtggatgtgcagaactgcatgagccgctgagcagagccaccgaggccccctgcaggaggtccgctgcagatggcactgcccttccttcaggtcaggtggcccaccaccctctggaagccaggtgcccaccccacctccagctctgctggcaatctccctcccccaaggcaaactggccagcaggagtgcttcacagcagtcctgcttagtaccgttgaagagactcagtttaccttagtgccttagaggatgctaggtcctctgactgacattcctcagtggtcctcacaggtggttataggggggctgcctctcacctccgagcactacattgtggctgtcccctgcccgcctgcccgccttctgtcctggatcaggaagatggtagcctgctgttagtagcttcacagggcttttatgtttaacttattcccaggggccgtcccaccctgctgtgcctgcacagttcccagtgcctgtgcctgcgcctgctggggacagtgtggccctgtcccagtagcttgatgactcagggtggaccttgctcccaggacttgtctctccccaggctttgtaggcaagcctcacaagccgagggacaggaccgggctgtgtgaaagtggcttttgacagcttctctctttttggtgtaatgttttacatgtcctgtgtcctggggactaatgtgttaattgccttaaataaattaatagactccaagtccatccacagggtcatacttctgtctcccgcacagctggaggccacagaggccaacaccctgctggccctgtcacctaccgcaccctgcttggtccctttgctcacctgtaggacatcccagtgggatttgagcacctgacagaagtgaggctctaagcagttacagtaaggtggctgtgtacttgggcatgtgcgtttgtggtgggctggagtagcctgagtgggagggccaggcagggtgctcatgctggcctcccttccctttgctgttggccacaggatgccctctccacacacacacacacacacacacacacacacacacacgacagggggctgacaatcctccctggggctgggagggatgccctgggctgtatgctctacagcacccctgctcaggctgaagcacctgaggcagatgaatgagttccaaaccaggagggtgggagaaacca

SEQ ID NO: 24587 - DNA, 1659 bp, Mus musculus
tgctgtggaattcctggcttccaatgaatctcggatccagactgagtcccaccgagtggccggggaggacatgctggtgtggagatggactaagccttcctctttctctgattcagagcgatagggcagggcctgttaccgccagcctgacccagccacccagctggggcaaggacacagacctttggtgctcattcacacctgccttgattgccctccgggtctcaggtctggaacatgtgggcttacttagggtagccgggagaacaggggagcccttcctctatgtcagtattactgactgacaggggagagtggcttgttctccctggataaaaagatgggcagtggttggaaccctggaggtcctgcacacagctagacagcacggtgatcctgaagcccctcgcttggaaggtgggttgggtggtggggcaaagcttggtccatgtgccttttcgcttccagggagcttaaggggaggggaggaacccagcccactcctgcatgggcctctgtccagaaggggacgatgttatagaaggtaggagcagctggaggggaccaagcagaggtggctggggtctggaaggcgtggggagtccagccacagctgcctgtgcctcagagctgctcacaggtcagcagtgccacctgagccagggtggagctcagcctcctcacctacttactgtgcacaggcttcctggctgcttagccacacaggtagggtgcagcatcgtggctgcacactgccctctgcaggccacatggagtagtgtgggccattagccctcggctatggaggacctgctctaaatacacccagtggggggcctcattagctgagagggaggctttcgagcaactcttcaggcgggtctcacctacagcagcaggaggacagcccctggaggtgacgtgcagctgcctccagaagacacaagacacccccttttggacctattgctggtctctgtttcttaataaagtgtggtctccatgtagcagtatgctcatttcggtctccgtgtagcagtatgctcattgccgtgtgtctgggtggtcagcaggaccgggactgagcaggccccagccagaagacaatggcttttgtattgggggtggaactgttggaaaaataaaatatttattgagaacggatgtggttttatttgtggtgcttcctctgtctccctacagcggagggctggacagggccaggctgccctggccctgggagttaggtaagctgcttacagccacttgagttgcagggtagccatgtggactcagcactgagcccctggtcccaaggctcccagggcttctgagggaagctgcacggagctggtaagcccttgaaggaggcagcttcctgtctctgggcccagcattggtgatgggctgtgacagagttggggtgctttcagaaagctgcaaaacaagctataggcattcacctcttagtccgaaaggctagtggcccagaaacaaggtaacctagctatgtactgtggtcatagccagtcctggcctccttcctgtccacacttggccccatctgtgtggacacgggcttgtcagactcctgccacacacacctgcttggtgagctgtagcggggcccagtgcacaactcaggaagaaaccagcctg

SEQ ID NO: 24588 - DNA, 1220 bp, Mus musculus
agtgctgtgtttgtcactgtggctgtgacaaacacctgacagaagttgctcaagagctacagtggggaaggcacagctcaggaatgttaagcagttggtcacatcacaaccacagtcagtaagggatgaagagagggatgaaggccagggctcacccactttctcctttttttgtattcagtcagcacctcagcccatggggtggccacaaacactttcaggtgggtcttctctgctcagttaatgatctctggaagcagccttagagacaaacccaggtgatataaatccagtcaggctgactgtgaagattaaacatccacgatgtctctaaaagataagagctcggtttaaaatgtattacatccatttatcatgtgtataaatgcatgctgtacactgcggccctgtgagacgctgtctctcagcaccctgctctatgccctacctgcctcctcctctaggaacccctaccccgaccctggagccacctgcccctgaaggcccctgacctctgtcctccaaacccgatgccagttgtttgtcctccttgcaaggtagcagtaggttcagagccatcctcttgctgggctgcccccagactgactcccgtcttcttgtagtgggattttttttttgttactttaaaaacccaaaaaatgttatgtgaatatgtttttgttttaatcccaggtttgggatatgggactgcttccgtttgtctgcaaccgatgactacgattgtctcgtgctctaggaggggcgtgaatcttgccagctgcagatagtttaattctggggactctggagaaggactaaatgtcaaagtcttgagaggggtgggaggtgctccaaaaggaggagaaggaggaggaagtggtggcggaggctgctgctccctcatgctgctcctggttgctgttgttgcggtttgatgggaagaagttggaaatagcctaaagataaagactggactggcccaaaggaactctacacccctaaccagcaggaagtggcctatagaagtctgtggccccttttccctctagtctcctctctctcctgtctagtgttgggagtttggaagggaggtacagatgtaagaaccgagaaaaacagtaaaacaaatatgccaacatactccgacttgggtttttttgtttgttagcttgctttggtttgatacagggtcttataatgtttcttggctaacttggaac

SEQ ID NO: 24589 - DNA, 1204 bp, Mus musculus
ccttccttccagacggatgttgtgtcctactccaaagcacaggggctcggtctcgagagcccagtcctggctttttctccctccttctgcctccgtctgtcttgttggtgacccagttggtccccaccctgtctttgcgtttctcttctgtctctgctctgcatgtgttgtctgtttgggctctctactcctgtatttttctttctgctcccgccctttccccgccatctgccctgctccctgagttgccccaaccctaccactgtcattttctcttctgcaccactggacctcatttccttccagcctctccccctctttgcttcatctaccaactctttcacatcacaaaagagaaaaaaaggggggaatcaaccccccaaaaaagcccaaacaaaaactaatcttgagtgtgtttcgaagtgctcgaagtgctgcgtcctcctggtggcctgtgtgtccctgtggcctgcagcctgctcgcccaccctacccgtctgccatgtgtcctgcccgcctgtccgccttgcccttcctgccaacgacacggagttcagtgcctgagtgtttggtgatggtctctgatgtgtagcatgactgtttttataccgagaacatttctaataaagagaaacacatggttttgcacccggcctgcgtgtccactgcgggcccccgtgctcagccaccgctggtggccagaggccagcaggggcagaaggactgtgaactccagaaggctgctgggagcagggccctgtgagggctttagacttggactgctggcatctcaaacaaagtgagcaggacactgcagagtgctgcagtgcctaagggggttggagagatggcgtggtggttaaatatgtcttacagaagacccaagtttgggtcccagcatccacatagcatagatccaggggatcacctgctctctctgggctaacctgggtacacacctacacacacacacacacacacacacacacacacacacacacaatcaaaaaataaatctttaaagaaaacctgcacctctccaggcaaggacgtctcttgcagaatttggctcaggataccagggtccccagtccagtcctgatttcctatcttcaggtgctagggtgcctgggacccatgtgtcggcacatggcactgtaggggtatgactccttgtggtctgtgtgtctgtctcctcttttgt

SEQ ID NO: 24590 - DNA, 1099 bp, Mus musculus
ggagtcagagaggagaggttgagttttgagtcacttgggacactagcctccttagagagagaatgagtatatataaatgtgtttatgtgtgtgtgtgtgtggtgtgcacagatgtaagcagggtcttttgcacgcaggcatggtcagtggtagatgagctatgtatgaggcacacagggacagtggacatgagggaccggtgtactgagggactcatagctttctgcaaggaggagtatgtgtgtgcacacaggggttcaggtgctggtgggtacatacgggtggccatgcagttgtctgaatgaatctgtgtatattcatattcacccagctgtagggacaggatgtcagccagatgtgtgtgtgtgaggtcaggtaggtgtgtgcaggtgttagcaggagtgcatggttcccctgggtgttgtgtgaggcagtctgggctgttctggcgagccagtggtggctctcctgtcttaactgggattctcagggcttaagagctgtgaggtattcctgtgagccatctaatgaggtaatcctcttttgtgtgaggtcactgctcagccagccttgtgcagattgtggctgtagagtcagccaggatagaggaggttcctgggtttgtacagagtctaagcaccacagtccctgcctgagtgaaagccaaagtggggggtggggggactcagatcccctgtgattctcaccgccctggcgcagagacaggggacaatggtccacacatacaactgttgctctgtgctttgtcccctgtcaaaccctattcattgctgggcagtggtgactgtgaggactctacacagaagctgcagtgctggctggtctggtctatcaaagaacaggatagtagcaggctggccccaaggcagtgaagtcacattgcaggctagccctcacttagactgtcccaaggcctccccccacttactctgcctcgggtgccacctgagttctagaggacctctagactggcttctctagaaggagtcactagccaccacttctgggagccacatatatctgtacacaggggacaccggaaggtgctgggctccaggcgggcggccactctcctacc

SEQ ID NO: 24591 - DNA, 1166 bp, Mus musculus
tgactcgaggagtcaccactatgctctcgagactcagtttctccagatgagtgatgagtttgaaactttcccagatcactggtgtccgggtcacacggtaagttgtctgattctaactctcagttagctctggtgaggtccaggtagctgggcttttggccaacgtccggcctattcaggtgtggagatagagagaaggtctgggcgctgccagcatgtcctgaggccagctctgtggtcctgtcattggcagatagagcggatgcagtggccagggagtggccagcagctgccacgctccatctgcagcctgccctgccagccaggcgagcggaagaagacggtgaagggcatggcttgctgctggcactgcgagccctgcacggggtaccagtaccaggtggaccgctacacctgtaagacctgcccctatgacatgcggcccacggagaaccgcacgagctgccagcccatacccattgtcaagttggagtgggactcaccctgggctgtgctgcccctcttcctggctgtggtgggcattgctgccacgctgttcgtggtggtcacttttgtgcgctacaacgacactccgatcgtcaaggcctcgggccgggagctgagctacgtcctgctggcgggcatctttctctgctatgccaccaccttcctcatgatcgcagagcctgacctggggacctgttcactccgccgcatcttcctggggcttggcatgagcatcagctacgcggccctgctgaccaagaccaaccgcatctaccgcatctttgagcagggcaagcggtcggtcagcgccccacggttcatcagccccgcctcgcagctggccatcaccttcgtcctcatctcgctgcagttgcttggcatctgcgtgtggttcgtggtggacccctcccactcggtggtggacttccaggaccagcggacacttgacccccgcttcgcccggggtgtgctcaagtgtgacatctcggacctgtcgctcatctgcctcctgggctacagcatgctgctgatggtcacgtgtactgtgtatgccatcaagactcgaggcgtgcctgagaccttcaatgaggccaagcccatcggcttcaccatgtacaccacctgcatcgtctggctggccttcatccccatcttttttg

SEQ ID NO: 24592 - DNA, 1154 bp, Mus musculus
actttcctactgtgggtcaggggagattttaagtgacctgcttgccaattccaggcactggcccagcccctttggtatgatactgactcacagactaatcctttgttgggccgtggggtcctaggagtagtggggagatgctcaggcgtggagagggggagagaggtccctggttctctttccctttgccttttagggtatgagatgtgggccaattggtgtctatacagctgaggtaaaggacagtccctactaagccattcacagagcacctggctggctgggaacacaaggttggcacaggccacttgctaagtggaggatttggaagcaaggttcaggaggactgaggatgtagtctgggctcccagggatggcttggtgccccctgagtacccacatctctcctggggcacaccctcagaggatcaagtctagcggctcctgcctcatcccgtgacatggtacaaggcctgttttctgtgctcaattctggtgtttgggttttgtagctttctaaagccttgggttggctttagaagaatagaagtcagctcaatgaaagatggctagagttttggtgaatcaggcatggttttccaggattccatggttgttgctctgtggtctggttccttctggattgggccatgcctggggaggagccgttgaagtcagaaaggtatgaaggacctgcttgaggggactttgcgttgccaatgtgacaggttccagagccctcccacaccaccttcgggtgacgcaggcccctcccagattgcagtccgtcccaagttcccttcacaagctcctccatgaagagtatgctctggaacatgcctcacggttggcttgtgagcttgtgagcgatgctacaccaggaaggcaacgctgctctgtccctcctctgtgctgtcgctgtccaccctgaagccagtgggcgggattagggaggaggactaaggcaggggcagtgggaggagcgggaggagaggagggagatgtagccatctgcatctgggggctccttctggggagaggtgcccctagttgacctatttgagtttccatggctattttgaaattactggggggagagagtctggggcctggggaatggacatcaaagagcctcccccttttccctgcaggtg

SEQ ID NO: 24593 - DNA, 1197 bp, Mus musculus
aaggcaaggccacggtcattgtcactgtaggaccaggagagcccagctgatcctgtgggttgtaccaaggcattggggggtggggaggggacacgggccagaggtttgggctccctggctacctttcactttcttgagtaacagaaaccaacccttgttcctactggtcagggtaagacttctagttaaaacaaagccactgccctgatgcagggctgtcttcaggttcaaatacagagatgagaggcagggacttggcttgaattctgcagcacctggcaggcactgtccatcacagatatcgtggccacttctggcccgtggcctttgtgtggccatcgtagggatggagtcctgttctcagctgtggcaggatgcattggatagggctaagcacagggttcaggcagtgctggggtggtggtggcgtgaggtggtgggtttaggaggaggggggcaggacagggagggagcagaagctgaggagaagccaaaacagaccctcctgggcttgggtctcctgcagggaagctggggactatggcagtgttgagggaggtccggaccgtgggacgttggagggttagcatgagctttgaccccctagagaaggcaggcagtgcgagtttctgacctagaactggtgggatggctggctgaggccctggactttggtgaggagactttctgctgacgcaggtgcctgtccttctgggcctcaggtttgttttgccactgagctcaaagctcccatttctctgtctgcacagtggccacggagtcacacttgaccttagccagttaccctctctggcctttccccctctggacctgctctccagacacaaaggctaagcgtcaacctcaggacctttgcccctgtggtcccctcttggcttctgctccgaaatggagcagggtgcatccttcctagctttctgcttcacagtaatgcctcagagaagccttctctcagaccctcttcccaaagggctcctctgggtacctccccccagtcccctgcagcgctgcatggcttttgggccccccttcatcctcagggtcagctgcacaggtgtgagtctctgagggcaggggacaatgtaggatctcagccatatttgattgaatggtcccggccaaagggagtgcgttccgtgcctgagcacacccgagggtctcaggagtttggttcaa

SEQ ID NO: 24594 - DNA, 1166 bp, Mus musculus
ataaattaatctttaaaataaatcttaaaaaataaaatgagagagagagagagagaaaataccctggactacctcagagaagccctggtcattgccatacacacagaaacccatttgttgccttcctttctcgctccccggccatcttggcggctggtgttggttgggggttgtcccgcacctaaagcaggaagatggtggccgcaaagaagacaaaaaagtctctggagtcgatcaactctaggctccaacttgttatgaaaagtgggaagtacatgctgggctacaaacagactctgaagatgatcggacaaggcaaagcgaagttggttatccttgccaacaactgtccagctttgaggaaatctgaaatagagtactatgccatgttggctaaaactggggtccatcactacagtggcaataatattgaactgggcaccgcgtgtggaaaatactagagtatgcacactggctatcattgacccagatgattctgatattattagaagcatgccagaacagactggtgagaagtaaacaagaaagttttcctttaataaaactttgccagagctccttttgaaaaaaaaaaaaaaaaaaaaattgtcccaggagtgccatctttagctccatctgtgtctagtcagacaccccacacacagccactgcccagctgacaccagccctgactccacactgggaggaggcagggggagcacaaggtactgtcactcctgtcccaggtaccctggaggtccgtcctgctgctcttggtcctctcatagccctctagggccaggtcacctgcccctgctgccccaccccacctaccttctctgttcttcaggacactgagccactttccgcaggcccaggggaaagctggtcaccatgaagtgtcctaataccctaggttatgtcttcagcacttctttctcttgagtgattcctaagtgacaggaggagcctcatccgatacccatgctagctactcatccttgctgtccccacggtaggtcactgaatggccccgctgtggactgttagcatgcccaccttacagaaaaggaaactgaggcccaggggagttcttgatcaaagaacacacagctcggtagcatcggaagcttccagaaaggaccggggaccagggctcaccatcc

SEQ ID NO: 24595 - DNA, 1167 bp, Mus musculus
cctcttaagtacgggacacagggtcttgtggctgtcttccaataaacacaaacacacacaccacacgtgtggtgctggacctcagttaaaggacttcttgctacccagtcttttacttggaagggtctattgagaatctgcccttgccctaaggtagttgctagctatcaaagcacaactccagtttctcacgaagaccctcggctgctccctctgcacatggccaccctctatagatcttaaggatcttcatttactctgggtctcaggcttgagctgcggactgggactttcccttcttatttcaacccctaactaagggacaaggtagcgaaaagcctcaacttgccccaggtcgctctgggactctctagccgggtgacacctcaaggtcaccacccttggggtgtgtgtggcaggggtagcgggtggagggaacacctgtgtaactgctattttgtctccgtgcatctcccccagactcactgtgtgctgccccacacatagagaaggagaatgagcgagtcgggctcaaagtccagccagcccctggcctccaagcaggaaaaggatgggactgagaagcgaggccggggcaggccacgcaagcagcctccggtgagtcctgggacggcgctggtcgggagtcaggtgggtgtctaaagctttgctcctgtttcctttcttgggctggggggggggggcgggggtcagagctgactctttgcgcatgtgtatccctgtgtatgcttactgcccagaggtgtccagctcagtgtctaaggtcacagtgaaggcagccatgtcttaacattcacccagaaaagtgggagaatcagaaagaccagaccctatcttaaagaaaaaaattttttttttttttttaatttttttgccctggtcagaacggagccaacaggcaggcttcgactggtggtacacggttttaaacaaataatcagactcttgttcagttgccttcggggctctacatctggtctttctgtttctgcacttccctaagtcaggtggctgtgtagatgtctgcttgcttacccacctacttaggccctggctctgtagtagacattgaggttctgggggtggggggtgtccctgaacgcctggcctgtctgtcttcacaatggagatgcccaccctctccca

SEQ ID NO: 24596 - DNA, 1167 bp, Mus musculus; identical to SEQ ID NO: 24595

SEQ ID NO: 24597 - DNA, 1200 bp, Mus musculus
tagccgcagcccgacctgctgcgcacctccctcagagccgtggctctctgggcgctttgttttgcgggtcccttctgccctgctgttcctggcttccccgtagagggtcctgggagcattccctggccttaaggggccccagccccatctcactctgacaaggcccagtggctgacctagcagcagcagtgtggtcagggcaggggatgcttagatcccagcatgtccccaccaaagtatcaccgggtgggtttctcagcccctcctgccccaccctacagagatcatgcactgggttggctgagccccttgacaacaggaagtaggatgatgttggctccacccactttaatgttctcacctgagactagacagatggggttaccgcccatctccagagtaagggcctgttctcgcctccaccaaaggcaaacgggcaccaacacgcctcccccagtccactctaggctgttccttcctcccgcagggcactaaggagctagccttgccgccccctccttttcgctcctccctgccccccatggttctggttccatcttctcctctgttcacaaactacctctggacggttgtgttgttttgtttttgttccatgttcattcttagatacccactattgctgctgctaccagcgtcagatgttcatcctcctgaatttgcctgtattctctcccccacacaatacactcgaggggaaggggggctggggcgcagcagactggttacctaccccacactaaggaagatggggccccaccccgtggatgctgcagcagagtgaggatgggggcccactttgatgggaaaagggtgtagggccacctccccttgttctgtgggggaggggtggccagtatttgtcccagcctggggcttcctccctggtttcttatttgcagttacttgaataaaaaacaaatagccttttctggacagtctctggtgtaaggagcattcacagtaaaaggggcggggccgactatgacccttccctgccccaccctgcaatggagtccacccaaggagggcaacttgaagccacaaaagtttttatttacaaaacatatacacctatacatctggacctgtcaccgtgggaataggctagtgtggaagagcggctgcctggaaggcttggctcggggccagctgtaggtggttagaatagacagatgctcc

SEQ ID NO: 24598 - DNA, 1200 bp, Mus musculus; identical to SEQ ID NO: 24597

SEQ ID NO: 24599 - DNA, 1941 bp, Mus musculus
tttaaaatagaagacgccataaaggtgctgcagtgtcacaagcccgtgcaggcgtcatactttgagacgttgaggcaaggctaccctgccaacaacggcacccctgtggtgcccaccacctactccagctccgtgtcaggcatcagatgactgcagacttctgtaagagccggagagtggaaagcagactgaagcatggctctcctcaccacccctcacctcacggccttctctgtcacccaggcatggcgggcagtggagaggggacactgaggtgctgctgtgggctgtggcgggaggcgggtgggtgtggcagggtgggaactcttttttctcttcctgagggtggggctgggtgtaactcacaagcactttcctgcatgcccgatcctccccgctcgctcaccctgccctgagagggcacctccctctccttcttgggttccgaagcactcccatttgtctcgtcccggcctggccagatatttcctctgaattttttttttttttttcattaaaagacacccatgtgcgatgaaactttctaaaaatctgtcctgtgctgtgctgttgagtcccttaggttgaccacgctcccttgggacgcacctgtccacacattgcacactgtcacgggacacgtaaataagcggcgtagaacgaggagctcaactgttcaggttctcaaagttttgggttttttttttcctttttttttctcagatatttctggtttgaagcccctcactcttcacatttgtttaatgctagtaacttggcgggcttccctgtcctctgttcccagccatgccgagcccggccaccttgctctcactcctgggaccctggccttctgtctctaggctattcctgtgccaaggaaaacagaagggaacctgttttctttctgttacgaagcctggaaaacagtgagagaaactgaattctgtccgataggctcacagtaggctttaaactgtcaccctcaatgtcgcagaaaccgggcactgtgtctgtcctgctggctggagattctttctgtaatgctatttattgctgacatagcctctcttacccttatatgccttccaccatgctgacctggctgtggccccacgctctgcagccattctgcatagtcctgtccccacgccgagaggccccacgacgtcctgagaatacatggggagcagtgtgagcatgtatgtgccaaggggggaccaagagcttgctcaaaagggacattagctttctgtctgctcggtgtgagaggtcatctggaagaggggcccaccggtgaccctctggctccggttggtattttatagaggttttgtgccgaactccccagccagttgtggtggttagtcgggaagtaaagggtcctgggaggggccttgagcaaggagggcaagaggggagctaggcctggcttagcgtgggtgcttgggactctttgtggcattgcctatgttgaaacgtagccaagatgtgaattgaaaatagtacttctctttatttaaaaactaataaatactcaaactttgaaaagcttttgctctttgttccatgtcaggaatgtgtgtggtgatgagcaccgtcggcattcaacgctttgtggtatcaaccggtagacttaagttctgcatgtatctaatttgcatttttttaccccagcgttaaaacacagatttcctctcagtgtgtctcgggacaggagtggcctcccgaggtggcggcccagtgggtagagacctcaccatgtgatttgagttgagggacaggcttattgtgggtccccctgtggataaacgctctgattcttgttgcctggctcagagcatcctgaagtcccgtgcacatgcagaggaaacttcctctcagaccacagtcttctgggtcagctctccctcagccatgcagcctaatggtactgtggcg

SEQ ID NO: 24600 - DNA, 1146 bp, Mus musculus
caggtggcagctagctccctctggagctgccagtgtctatgagctgcaggatgtgggtgctggaaatcagacttgggtctctggaagagcagcgtgtgctcatgagttctgagccacctctagccccagggccggggaaggtttgaaatggttctgctttgtcaaactccttatgtagcccaggctggccttgtcctgtcagttctcctgtcttcagtgtcctgagtgctgagattacagacgtgtgccaccaggcttagccgcttctctgaatcttactggataatccaaaggacacaggatttctgtcagatgttaaactctgccatcgggaagggtttgtgctgggccgttgtactagatcggtaagcctgctggtgcagggctcgaggccagagggttctctttctgctgacattctggagtctttttgttttgctttgtttttgagaaagggtttctctgtagccctggctgtcctggaactcgctatgtggaactcccagagatctgattgcctttgcctcccaagtgctgggcctggcattgacggggatttggaagaatctgaggatgaattgccctgcagggtggcattaagtctggggtgcagtgtggacacttgtgttggcagcatacctggtttgccgagatggctcagtgggcaaagtcactgtcacatgccaagcctggtgagccgagctgggctgctgggacagccatctcagacagttgtcctctcccctccactgtgtgcatgcttgggccagcactcatgaaataaagatgtaataaagaaattaaactataataaaacaagaatattctaagcggaaaatcttaggctagccaggccatggagatccacaggtctggatacccagttcttggaagcttgcttggctcgaagtgttgatgggaaagaacagcatacctccttggcctagcagagaaagcaggaaggtctaggctggaaggcagaatggactttctctaagaagaagagaagatgctctgaggaaagggttggctagagatacccatgataaatgtccctcttgccacagccacttctaaaaccatccacagaataaccctcaaaaacacctttctgtgctttgactttttgcctcaaactcagccact

SEQ ID NO: 24601 - DNA, 1255 bp, Mus musculus
atggtcattcagaaacgccacagcccctcccatccccaatcactgtgtcagcatcagcctttgtgaagacggtctacaaggctctcacctggccaacctaggagattcaggggctcaggaacctaggagattcaggggcttggggaacctccaccttggcactgtaaggggaagccagcagctcaggctggtgtgaggaaggaactctggatggtcactgtagctttcttccttgaccttttagtccccaacatcccctctgaatgctggcagcacccccacccccacacacacactcccatttctctaagcccgagagtcttgagtcttcattaaaggattctgggtgtgggaggggacacagggcccttgtggttgggaagcaggtggcaggctctcccttgggaggatggggtgggaaacgaaacaggtcaaccaagacctcttacagtggaaagtggtcagaggctgtttctttggacctttgggaacacagatttgagaaagtctcatattcacagctggtgtccgctaggcctctggcctacggacaccctctgccttgtgaatcaggtgaccttttgggcctccagggaaagaacaggaccaccatccatgttctccgggaccctttagctctctgctgcttctcctgacactcaggtcatggacccaagctttggggtcctgaccaccgcccccccccaccccccttctcttgactaggctgcagcagggccttctgttgggtcagtcctccctcagggccaggagcaggaacttagcactcaagagacagggctgtaagcacccacttccctgtcactgtttgcccttggggcttcagctgcagcccaggttgggccctggagccctcagaaccggaagcaggattcaaacctccccttctccacagccccccctgcctccccagatggtagacatcccccagctcttaccttcaccctcatctcagaaaggcaagaagccgccatgtccgcaccttggggcctgggcttccccctctctgtgccagcggcttcccagcacctggggaggggctgtggccctgaccagaccccaggcccaccccacatagtatactagctgcccactctggggcaggaactggaaaatccatcccttttgaacaaccaccttcaatgaccccccccatctgggaccagacttggtcctcaagttattcagcacccccagtgcaggagggtcctccccccaccccccgaagtccctg

SEQ ID NO: 24602 - DNA, 3374 bp, Mus musculus
tccactgcatccaccatgttgcagtggaaagcagaaccgtgagagctcgatgtcaggctacttgaaaggtatgcagcccagccggaagaaagtgggcaccggtgaactgcctatcacaaggcaggcagtgtctctgccgcttgctgtggggttcagtgggaaactgaacagctgttcccatcctggtcctgggtctgatgagatgctcaggcctggggcagtgaccctcgtgcctctgcctggggctggctttgcttgtcaggcagcactgggagactccatcactgactgtcttcactctcttccaggggctccacgggccttaccccttcggccagtcttaaacgggtgtcagcaagaagaaaaactaacaaaagacagaaggcctgactttggggggagagggcaaggggttcctctggattgcagaccacatcgcacggacccctggctcagacccccacctaccccccaatcacagaagaagaggaagaaagagactagttttgagtgaactcagtatgcatgtgtgaatgctgaactgcaggagtggtgttgaggcgaccgagaagatccacgcagccatcttgggttttggtgatgacgtcagtctaatgagttgttaggtcacttgggaaggggaagaaatttaaatgggggaaaataagccatctttttaaacaaaaattattttacctacagagaggttgtagttttgagcacatgttagttcctccctcttcccgatgttcatcttctaagtaagggacagcatgctacaggacagacctgctctggaagcctgtcatagtaaggctggcgtggcacgtttggggactctgccagtcggagttgctgggcacatgctgtgtaccaccgactgcagtctggccctgttcttagtggcatctgccaatgagatatcaccttccccctctcctctttaatctcttgttaaattacccctttgatattggtgtctgtcagcgttggggcttcttagtatcaggacctctctgaggtaaggactttcctgtgtggccacagaaacctgggggcattccgttgcagaggtgtcctctgtcacgtgtgtaacagctggaacacagtggccgtcttccctcggctcttgttggtgtgtgcatgtgctgcgtgcacaccgggttgtatggcgtcagcaggtgtgagctgtcccttgcttctcttgtcacacagtgccccttccccacgtgtcctgtggctccagccattacagagtgaaggtgcaaccccatgtgggagccccactagtgaccactccctgagaggccgcaatcaggtgggaatgaaaaggcctcctccagcggggcaggctgctcagtgtgggtggcaagttgtagcccagctggaggacaggcctttgctccctgggcaggtgcccactggtgtcccatggaatccactcgggttgaaatgtggatctctccatgggactctttaaccaggctagaacagctgtctgccaaagatacaagaatatgcaaagtccctcctcctaaccctccttccctctaagtcggtggcttgagagccggggatgtggatttggtgtggttacagggtcccctgcctgcctccagcctccgtgtgctccagggttgtgagcagagcaggaaggtcaggtgagagtggctgtaggaggtcctccagcccgggtgcgtgggtgcacaggtgcgtgggtgtgtggaacgggtctgctctgcctgcttctgtctctgtctgggtgtttgagttccaaaaagtgtgtggtgtttgttcctcctcatcctcttctgagactgttgattttaaacacttgattgtgaacgaagagcttctatgaaaaccctcacctttccatgtcccaaaaaccaacacaagtccctggggcgggtggagaagatggtggagccccgtgagacggggcttctgtgtgacccttacttcctctgcacactgggacccttgagccaagggcagtccctaccaggtgcccaagccgcaagtctcagggggcttttgtctgaggaccttcttggggccagtctctgaggacgctgccaccctagagcacatgcatgcccagccattcttcctgcttctggcctcggagctgcttgtctccagatgccctcctgaaaccatgagaagcttcagccttgcctcactggcttccccatctgaccccaccaggtaccacactgtcacccagtgtccttgatctcctcttgttcccctttctgcttgtagcagcctcacttggcaaatgtaacggctcaggtaccctggcttccttcccagaaacaagccttgcctgtgcatcctggagagttaggtccttcagaaggccagagctgggacaagccttgacccgttctgcagcccttagagccttcacacgtgagcactaggccatcttagcagaacccccatctggcagcacatgccaagtttcaggaggattggggggaggcgggtgcaggcttgagaagaatctgggtgtgtgggtatgtgtgcacatgtgcatgtgggtgtgtgtgtgcacatgtgcatgtgggtgtgtgtaagtatgtgtgcacatgggagtgtgggtgtgtgtgtgtgcacatgtgtgggtgtgtgtgcacatgtttggatgtgtgcacatgtgcatgcctgtttctttttgccagggagacaactgaatttggggcatttttctacaaacacagcctcctctccccctgtatggactggctataaccataagccaggcgctttcaccaagatggctggtggccaaggtgggcagtaggcatgagcttccagcaggaaaggacaagagagtaggcaggcttacaggtgcagactgagtgcttctccgcctgccctcttccccttgtttccttgggtgagtgtggggggcagcctgctgtccctcccacctgcacagtgatgctgtctggtggggcctcgtggtgcctaggagatgaagatgaggttttccttaccgtgtaaatgaatatttgtatgattaaattaacacacacaaaaaaaaaaaccccgcctttatcctgtgtgcgtgtgattctgttgcatcctcgagctgctgcctgcagcctgtgtcacccacagtgcctgtgggagagagagaactgcgatcctgagaaacatattttggaaagtatattagtctctgtaggatagccatgacagtgtccaacaagggaggagagagttcctttgatggctgaggacctgacccctggacagagagagatgctttgtatctgatggtgacaggcagaccagggccaagctgtccctttcacgggctcatggctggtgagatgtttcagctaacttgacccctgatt

SEQ ID NO: 24603 - DNA, 2752 bp, Mus musculus
gcacccgagtgctcagctgctcctgagtgctcacctgcacccaagtgttcacctgcatccgagtactcacttgctcccaattgctcacctgctcccgagtgctcagctgctctgagtgctcacctgcacccgagtgctcacttgctctcaagtgctcagctaagagcatgatgggtgggtatacagttgctgttttcacagctgtccatgaccggtcactttctttctgtccctgctttcccaggattgctgcgtctctctgcctgtgctgacttaagcacttggtaattgggagctaaatgggcttccgtcaggcctccgaccaagctaaacttagctgtaccctcctcggtgtgctgcctcactcccctctattactatggcgttttaaaatcatgtgatttcaacttaagcaaaaccgaaaccaaagtccttgtaggtttccttctggccctatagaagtttccccctttgcttctgactggcaaagcctggctttgtggtgtgctgtccgggtagaagcacagcaccgggacccgcttgacttggcagatggtccatcctttgtgagctggtgatgccactggagtcctagttgtggctgaggggatggaaggagaagcaaacaggacccattcatggagggaggaggtcacatttgttcagacttgcaggagtcagtcatgctcttcactaaggcaagattcagaacgccacgtcttacaggactgtggtttctccactgaggagactcattacagaattgggactgacatctcctggagacagccttaccaggtgaagtccccccatttcagatttttataaatgacctggaactttaaatgaagtcatttacattagatgtcatacaacttgtagacaagacaatgaaaagcagaccagaggagagaagcagccataaagccacagggaagtgagcaaggctgtgaacagcatgcaggagagggtcagcacagtgcagggctggggtgtggctcactaggggagtgtctgagcagcagctcacccagcgatcacagacactaccacaaaaataaggattatatctgaacaacaacaacaacaactactactactactactacaacaacatactcaggaaggaattcagagccttgctgagggagcaggatcagcatgattctgtggcctaaagctggaggtgttccagcaccacgtgagggacttcatccagccattggcagttctgttacaaaagagaggttcagagaggagtgattaagatgaagacgttgtcctgcggaggtgaacactgaggggagtggggacccaatcttgaaacattagtcctgggggcctgtcactgcctcagagaaaaagcacttttagcaaagtcagaaactggaagggcttgttgaagtggtaccccgtgtttctaacattcttggaagagaagggagagccagtaactagaagacataacttctcagcctcaggatcacttgaattagtttaaaatcacatccctttgtcttctgctcaccgcatctcccacccccgggagaagatgtctgacaaccacggggtgcactgtaccctggagcatgcagtaggaacctattttgtgtggaggaaatgccttaatggctagaatgtcaggtgtttgagctgagggagtctgaggttcttgtccatgtgcaaacagatgtagttttggcttcctttatgctttggccttttgcgtcctgaaaccatccctcaggaacgtaaggttattctgtggcatttcaataatgtcttgtgattccgttcccctcttcactggggaataaacaggagagacttggctataatgaaactggctgtgtggatgtccagggtaagggtgatggaaaacacaaataggacagcacatttggagtttagctgtgaagttgcagtttgcaacatgaaataatacctcaagaagacttcaggagggcctgaaacactgtccctcagagtgtccagccaccgcacgtggccctccatagctgcatcatctgtgattgtctcaatttcccggtttacatgcatgtgctggaaatatgcactggtgtgtatgtagacttagagtggagtccgctaacggggctgcagagatggctgttgatctctaactcattttcagtttactgtaatgatgaacacagtctgttttatccctgaccttgactgtgctgtggactgcactcttcatgggctctgtgctgagaggatggggtctgtgatgtagaaagggtcgattccacatctcacagaccctggatctgcagtgtcttcatgttagtttttccttaggagctgcagagattttgcattgcaaaggaggtgcaaggtctcctgggtgggaacttcctgttcagacccctttctttcaccacccaagctagccaagtaacatctggctcagaccacaagagctgggacgtgacagttgatggagttaggacctcttggagacaagcaatgcacaattgtctgggtgaccagggccttggaggtgccaccacatcctccagtctatctccagggtaggtagggtaggtatggagagtggctggctgttaagaggcattttgcccccatggcacagggaaatatttggtaactgttaagggtgaggccttgctaagtggccaggcctgagatctgagcttcctgctctgttgtttccttatcctgcatcctttatcaaggtagacatagctcctgtgtgttgcagttg

SEQ ID NO: 24604 - DNA, 1173 bp, Mus musculus
ttgtgtttcaaacgatgcatcctagcctcattagtactgaaaactgtatcctgcctttctcttgaagtctaaggagcttttaactgcactgggtatagatgttgcaaaccacacgtgtgtttgtttccttatatgtttatgaccctcttcccctgttcatcccacataggttttgtacgtatgctttttgcatgtgtgcatgtacacatatgcggaagccattgagacagtcttccaggattcttcctgttagcttctccccagccctgggtttccaagcagacaccaccacccctggagttttcatatgggttctggggattcaacttgggtcctcatgcctacagagcaagcactttaacagctgagctatctcgccaacccttcgtgtgtgtgtgtgttctgaaattatagaatactcccttctctcctcacatgtcctgtctctcatagagctattttgtacctgagtcttagccttacacacccatgatggtcctcatacacacagatcttgccagctttggggtggggagcacatactgcctgtcaaatatagtagttccctgtcccatcctttgcttgcttcccttccatagctcactctctttggtctgtttgctggctagttattttgtcaactgacacaagcaagagtcacctgagaggagggagccctagttatgaaaagacttcatgatggatggcggaaggcctagcccactgtggtcgacaccaccctggatggtataagaaagcagaccgagcaagctgtattgaacaagccaggaagcagtgttccttcatgccttctgcttcagtttctgcctccaagttcctgccttgacttccctcagcgataaagtgtgacctgagcgttctaagctgaaataaacccttttctccctaagttgctgtcggccatggtgcttgacagtctatcactgtctccacactgcgatcctcatccaccgagagtatacatcttgagtcataatctcagccaagaaccagcatttacagatgccaacgtggatagtcctgctttccttggagactctggttttcaaaactctaagcctacaaaatactgtgttctcgtgactctcccgtgtatttactgacccgtcattgcagcatacagcattagactggtgctggagtcaggctgac

SEQ ID NO: 24605 - DNA, 1191 bp, Mus musculus
atgtttctgtgggaagatcatacaaactaatttcttctttttaaacattattattgtgtgtgtataatgctgtatatggatgtgcatggcccaatgcatatatggaggtcagaggacaactttgtgaaacccatttttttcttcaatccccagtcttgtgtgtcaagcatctttacctccagaccagtggttttcaaccttcctaatgcttcggccctttaatatagttcctcaggtagtgaccgccaattataaaattattttgttactacttcttaactgttatgaattgtaatggaaatatctgagatgcaaaatgtctgatatgtgtcccccatgaaaggatagttcaggttgagaactactactccagaccctgctcaatggccccaaactgacttctttagtttttaatgctttattccaaaaatattttaaattatatgtaggtgtgtgtgtacacatgtgtgcagccggtatgtgcatgtgagtacaggtgttctagcaggccagaggcatcggatctcctggagttgtgagttccctgatgtaggcggtgggaactgaacttggttctctggaaggagcagcatgcagctgagctaactctatagcaaagcctgttttcatctgactgttggtgctgtccattggctttcgatggacctttgtcactctgattctcaaaaccaagggaggggcacgggaactcttcatgcttctttcaaatgctttacaattatacaagtgtgattgcatgtctgtgattctaacacccaggaggaggattgctgaaaggttgggaccagcctaagctctagagtaagagctgcctcaaacacatgcaaaaaaaaaaagcactgactgcccttccagaggacccaggtttgagtcccagcatcccatagcagctcacaactgcctgtaacttcagttccaggatatctccttttgatctctgaggaccacgtgcattcatggcacacagacggacatgcaggcaaaataatggcacatataaaaaagtcaatctaaacaacaacaaaacaaaatacacagagttgtactggctggttttacgtatcaacttgacacaagctggagtcatcagagaggaagaagtctcagttgaggaaatgcctccttgagatccagctgtagggcactttctcaactagttatcattggggt

SEQ ID NO: 24606 - DNA, 1204 bp, Mus musculus
ctgtttgtttttttgagacagggtttctcaaaacctgtgtagccctggctgtcctggaactcactttgtagaccaggctggcctcaaactcataaagtcccagagtgtgcatcttagtaaagatcactgactcaagactgtgaagggaaactgctctgcactgagatggcttcctctgtgccctcagactgggtgctctgtggggcctgcgagatggctcacgggagaagtgaagacctgggttcagatctctccacccaatggaaaaaaagctgaatgtgatatgacggtgtggaggcataaacaagcacgcgcacacacacacaaagtgtctttttaaaatgttgcagagagaaccttggtctcagaaacttacataaacaagaagtgaattgccaggttttccagatgtctcatcttaaggaaacatttcctcgtttggtctactggaaaagttttcctttgccctgaaatatgctctgtgcccacgtaacttaaaaataaacatattttgactgtttagagtcccatctgcattgagtttgtagctctgtgtaattcacttgggaattgcactgcataaaaataaaggcagaaggtcccatatcctttgactgtgttaagctttgagaaattcctttagagtatttggtgtgtcctgaagcctcccctccatactggctgatcgcttgttctgaacagctcatgctctttgaggcagccgcaacatctgcactacctggaaggggtttgttgctcagggtcccaaccctcccgcttcctgccatgattggatgtagtttgtttgccaagtccatgctggagatttgtcctggggtgacatgttcaaccttgtaaaggtggtggtcagtatctgaggggagccatgattctttgaagcacgtgttagcagagagtggtgacggagctgtgcctcactccctggcatcctgtcctcacacacattcctgctatgttcctgtctgtcactgggtcctaccagagttgtttggatgccagcgccattttcctgaacctccagggacataactacagcatctcttccttataacacactcagcctcaggcatttccttatagtaacaatcacctgacagatgcatcctcctaccttgcttgttgtgtcagagtaaatggctcatgcttaggagaggggcctttccttctttcagatagacacagg

SEQ ID NO: 24607 - DNA, 1507 bp, Mus musculus
gtcaagactgttagagggaatctgaagtcaccttataacgtgggagaaagctagctttggggttgcttcattcccacggctattcaggactgcagtagcaaaggaggaggaagaggatgcggacaggccagtttgtgtctagtacctgtgaagggttgagcatcaagagtatcatgtcttccttttgaggtagatactggcctttgggaagtgtaggtgcatgttggagaagaaagtagtctccacagaaagcagtgtggaagagagaggggaggaaagagaggcttagatttgtatcgaaggataaaatgaggtaaaaagataaaaaaagaatggtttaatcaggttgtggggatttcatatagaaattgttttaggttttcccattgcttcaacaaaatctccaagtctgggtacattaaagaataaagacatttctttggctcacggtttggaataccacgaagccaagaggaagcagctgtgtgctcattagcttctgtgggagtctgactgcatcacagtgtggagggtgtgtggcagagggcatgggggtgccaggctcacatggtaacaactgaagtcatcatgtatgccacataagccacaactcccctgggagaggatttgtttgagaaggctcctaaggaccacacacccaccaggcccctcttttatggtctgcgtctcagcctcatgcactggacatgaagtttccagaatgtcaacctctaggcaagaatcagagctttgtcatgtgccacctgcctctgtccaacatgtctggctatttctgtctcctagggcctggctgtgagacccaggattcagagtagtgctccccaggaagaggaggagcacccatatgagctgctgctcacggcagaaaccaagaagctggggaccacagacgggaggactgaaggtatgcctaccccactcccacagcacaggaaggaatgcgctgcagggacggtcaggccccctgtgctcggtctccttcaatacccggactccatgcccttgaatggatgaagatgcagccctccctcacgtgtagcagggcaggtgagagtacccaggtgacagctgaggtcacctaagtgacagctgtgtgaacagaatccaggacagcagcacctgtatggagactagctggagcctgtcgtgctagctagcaggctaggttgtttgggtccatgatgggctctgagtcctgagcaggctaggttgttagggtcatgatgggctctccctgtaaccgtagtgctttggcacctcggcctgcttgtgcttctggatgtatgttctagccctgcagagggagtgagcaagggcgccaggcaggctggaggtggtgtctgcagagcctgcctctcccagctccctgtagctatggtgccctccactgtgcatgcctcgtgcctcctgttggctgttagctggccataaatagagagagatcacaggcctgtgccaccacaccccactgacaacttctttattg

SEQ ID NO: 24608 - DNA, 1185 bp, Mus musculus
gtggatgtggatctgagtggcccggaggagaaaggaagccgttactcgcttgcggttttgttttgcactttcagttaaggaactccagaagtcgcaggttgcagtcatgacctcccttttcccctagttgctgcttgccagaggaagggcgggcgggcaggcgggcgggcgggcggctctgaataacactgagcctttatgggaatgtatccagagtcccgggagtcactctcactggtccttaccccgtccttaccgtgtcctttctgtctgtagctcgtgcttctccccgccttatatagcaaggtctggtcgttcacgttaacagagatctaacaagagggatggctgccaggcagcgttaagcaggccagcgtttggaatttcataagcgctcaactttgggtacagattgaacgtgaacagtatgaggctgcttttctccctgctctctcctctcgctctcctcagcccggctagcctctctctgcctgaactctgctctaccaccaagtgagtgcttcataggacctctgttgatttttgctacgtttaattttttatttctctttgtccactccaagaccacaggcagagcggcagcggccggagccaggactctgtggaggggcaggacgggcaggtcccagagcagttctcaggtctcctccacggctcctccccagtgtgtgaggtggggcaggaccctttccagctgctcacggcccccagccagagccacccggagtcctcccagcaggacgcctgccacgaggccagcatgcagctagaggagccaggcgtgcaaggcactgaacccccgcagcccggcgtccctgaccaaagcaagagagtgggcttgccggcaggcctgacagccctggccagcagaacatacctcgatgcattgactcacacagtacctctgcgccctgctggtgccgaggaagaagaccagagcgggcccagaagcagagcccctcccaccagcaagcccaaagctgagctcaaactcagccgcagtttgtctaagtctgactctgacctcctgacctgctcccccacggaggacgccacaatggggagtcgcagcgagtccttgtccaactgcagcatcgggaagaagaggttggagaaatcaccttcctttgcctcagagtgggatgaggtaagtctgtcatgacc

SEQ ID NO: 24609 - DNA, 1213 bp, Mus musculus
caagatggtggagccgctgacaacctcttcaggcactcctgcatgcttcacggtgtctctggagtactaggtgcctaatgaagccatttgactctgtggtgtagacagtgagaacaggcggtacatgtagaccatgggtgtcagctgttttgttagtttattttcctgtttttcaacacaggctctcactgtgtagccttggctgtcctggaattgactctgtagaccaggctggcctcaaactcagatccgcctgcttgcttcccgggtgcttggtggtgtgtttgctttccctaacttttcactgtgtttcacaattgcttgaaactcagatgtggaggctgactgtaagaacaaaaataactgcctggtcaggttgtggttcgaggtacagaagtctgtgaggtcagctagttcccccacgtgcctacttttgaatgggattggagattatggaagagaaaaccacagaaggctgcctgtctacttagcaaaaacacgcaagccaggaaacacttggctgaaggcttaagtgataaatttgtgttttgtaatcagctttcataaatattaaagaagtgggagatggtggaaagcagtgatgtgctctgtatgcgtgctcagctccacacttgctcagcaatgtccacgtggagagtgccgtgctctcagtctcaaatggtggctgagggaccctcggctgagccccttcctgagaggggaagaggcggcaggcagagcaccctgtcaggccaagccctgagcttccccttccccgcactgctccttagagccagcatgacgtcatcaagaagagaggtgattggtgcagctccacagaggcattggcttccctcgccacctagaggtgggtgcagacaaggaggtctgccctttacccggaaccctcagcttgccacgatctgcagtgtgcattgtcccttggtatgtacactggcgtgcttgatcctgggcactcccactctaaacaagaatgtggctctcccacctctggggacagctcggagcttggaatgtctatttaagttgcttcctggctcacactggagtagaagccttaccctctgagtttccattggttttaggtttgaagcattgtcctggcagctctgccttccgggctttgtgtcagatccaggggctctcagtatctgccatttacctgcaacttgtaagtcctggctcctcagtc

SEQ ID NO: 24610 - DNA, 2313 bp, Mus musculus
acctccctgggacctgccctcctggcagcagctcctgcttacaccacccaacactgtgaatcctccccttgggctgaggacagctgcgggagggggtgacttgcctttgaagggggcctcataggcaccagagtggggttgaggcccccaaagccaggcactgtgaggtgagggtggtcttccagcagaaccacagtagctccctttgaggttgctctcctcgcctgggtcacagctggatgccaagagctaccagttgtcacctttcctgacccaaccaccactgtgacctcccagtgccaggatgccatacacacagctgctctcaggtgctggtttctctcctggtcaggcccggtgatatggcttcaccagggacagactttctgtagggggaaggttggtaccagccatgcccttgtgcatgagttggctctgatactatgagccgtgaccctcctaactacaggttcccgagggacctgtgtgtgcttggcccctttctgtgctgtgggcctggttccggaatccagctcactgaggtgtgccctgcacacaagtgcaccttcttccttctcggagtggagctgcccttggacagggtggagccgagcagcctcagtggtgtcggggagcgttctcatacttcctctggtggtggggtcctgagacagccatcgtccagcaatccccagcacctgcctgggagctagcgccatggagctgaatctcggaggaagcctcacgtgccctgatgtggaaagatcagtctagatggcaggagacagaagtgatccccgtggccgtggtgcagacagtatagtgcagtgtctgcccgagccagtcagcacccgagccatatgccagggtgggcccttcggctgcctgcctttccttgtgcctttctgagcagatgggccaggagcagcagtgggctgtaggctgtggagggcaccagggaggcagggacctttgtctgctctgtgtccctttccatgtcctccgccttgtgcagactcattggttaactctctcctcccccactgtttgcttctgccaagctgagccactgaggagccaccctgctttgcagaagtagccgtggggcgcaggctcctgccccagccccgagagcctcatctgcaacactgaagacccaggcccagtcctgctgtaggacctcctgtcgcctgctcggcctgggcctgccgacacctgcaggaccctgccctggaggcagcgaagacgccaggcatctagcagaggagaccggaactctggatggcccaagaagtggcctgtccaggacatgtgtttttgataagaaacataatcctttttatacatttttaacacttggctccggcctctcggtaaagctgccaatctttaaacaagacaggacctgagatgggcctgaaaccctcaggcagcctctgccttcacaatgggctcttggcctggctagagccatgaggacacgcccgaggcttcctcatctactgaggtgatgacacagatgtttctggggttcccagtggggataagcaagtagtttctggtgtgggggactccggagtactcacctgtccccattagcactgccgcaggcagctgtccccatgctgctgctgggccaatggagccatgttggaagggagaagtggctttgttggggcattgatagcaatgccagttatgactgcagcttgccagctggggactggatctgcctctctctgatgcttgttgactgttgtatcctgtgtggcaggctgggcacatctgttccagatgtgggaaaggctagtcaggcaacagtcttatcccctccaccccacccccgccccgctacggtcttgaagtcaagctggtgttgctttagctcttctgctagcttgctttgctttttaaagtgacttgggtggagagccacctcctgggcttaaggagcagtgaggggcaggctgctggggtcgggggaccaaccaggcctctctcaccagcttttccagagtagggagcaaaaaagagaagccctggcccacaggtacgtgagcaggcttcagggtctccgggcagcacccatcctggtcctggggacaggaggccaggcctgaacagcggttgtgagctgcaatcctgggcactgccaccttgtggctgctcagagtggaaagcagggtttccctctgtagacctgcgggctgtctgcctgctgcattcagtgcagcagctgctgggtacagctcctctctgggaaggagccagggcctccgctgctaggtgcaggtagtacttcctctcctgcct

SEQ ID NO: 24611 - DNA, 1181 bp, Mus musculus
ctgctcagacagatgctgggcatacgctgaaggcagagtcaacagctggctgtagctgagacactacggagtcaaggatgccccacaggcccagcctgagcagcggaggcctagacctgtggctaactgagctttggggttccaaaggagcagggggaggccctctgagcatgctcagtgtgagctgctgttagacaggaagaggggctgctgagtattcctctcccccacatgccactgaagctgacaactgccacctgccatctcctgcaggacaagaagcttatcaaggccttctttgaggtcctggcccaccctcaaaactacttcaagtacacagagaaacacaaggagatgctgccaaaatccttcatcaagctactgcgctccaaagtctccagcttcctgaggccttacaaatagtgcctgtgggcccgagacccagttcagagctcccacctccctggccctcagagttggcaccccaacctcagacaagaaactgtctctcttgaaggagagatatcaccacaccaggcgctctccctttcggcctttctagttaccttgtcttcgttctgtctctctcctggaagtcattcagtgcgtctctgttccccccagaggtgaaggaatagacaccctctattcctctgccgttatagcatggtgccttgctagccaggagccaaaacaccccctccacagcccccgtgctccccagagtgggtcttcacagcccagagtcctgccaaagaagccttggacatagcagctttgtgccagcatcaggctgctggggcacagagtttaagcccggggtgcccacacagttggcgttctcatctgtagagcttgctctcatctggccggggctgactccatagggtttacaagtgatccataccaatgggatagcaaacccctgccgggtaagggcgaggagcaggcaggggccctggacatataaagctctcagatagctctgcaggacagaaagcgggtttttaaaacattgcccaaaacagaaagaaagaaaatgtgtcacctaaaggaacttcctacagaacaagtggaagccagcctcaaacactaacccttttcttgccagtaccccccgcccccggccgtgccctcaccccacctaagggctccctgggggaggcctacccaccccctgg

SEQ ID NO: 24612 - DNA, 1666 bp, Mus musculus
gtaaagtctccaattgttccttcttgttccccgaggcttagtcctggacatccaccaatgactcctcaggtccaactttaggtaactgccaagagattcaactatcaaatagtctgatccccacacacaccagccagcagcaggcgaagctcgcttcctggatgccttagccaacacggtgggggtgagggtcgggtggggtcagagagctattgcaaagctgttgaatggtttcatgcaagaggggcgaatgggcatttagtgggtccccagaagtgccatagaacagcctgagtcacgagtcctttctccctaacattttgccagctcctggaaagccacaaagtgagagtgcctcccaatgtatgcctttagggcgtggcttctccgcactcccccaccccaccccccaacccccatctcaccatacatacacggacacttcctctaatcatttgttctatggctgatggggcagcacatgagatctatcgtacggagagagtaggccactagacttagctgatatcaagatggatggaggagatcaagcaagggctttctactgccaaccaagttggcagcaaggaatccaggcagagctgttacgaacttacaggggatattggccctgagcgcctcactctgggagctgagtgggctgaaggaggagttaagaactcagggactttctaggactgcacaggttagacaaaagaggtttccaggagaaggggggatgggaagatggtgtgaacaggaacccttcgtgagctgacctagaagcttctctgtgggctatggtgcttacgaggtcatgtaaccccggcgcctcatccatcccagtgcaagacctgctgtgaactgagtcccagcgtgggaagccatttccacatgtgctccaagcacggagtgacaaatgtcaagcaggccctgatatcctcagcagcacctcggtgcctctttagcctctgcctctatttgtgtcattgacccagccagtccccaagcctgaggtaattaggagaaagccgaccagagcctggacgttagctgcccaccctgtgccttcagtgatccttcgaggactgccactggcctcactacggtcatttccatgtggaggtgccgatggagaagatggtacagtctgggctctggctcctaggagtctctgtgaatctgcgaagtgttctccatgagcgcgcctgaggtgacttaaatggattaggaagtcctatctcagtgtgtaagagaaagcgacagcacattgaagggcctgtatctgctgctgagctccagagcaggggagcagaggccaaatgtaactgaccccaagcaggacatggtgccccgcctggttcctttcctaagcagactccacgaaggaaccctttctgtcggccctgtctcaaagctggtgcactctgtctttccgctattattcggactgagaacccgaaggaccagaggccccgttctgcgatcagcttaccaagactaaacaatggcagcagtagtttggacaagctcaaaatcttgttctatgtgagtcggactttcagagagtaattatcatgtggacggctttttttttctttttaacgcagaagaatatcttaaaatactatatttatatctgccttccactgcctctcatacagca

SEQ ID NO: 24613 - DNA, 1158 bp, Mus musculus
accggtgttgttttgtgtgaggctggatagcaaacatacagccatgggcacatcaggtgagccctctgctgctgagctacagccccagcaagcgtctaattattctttctaaggtcagtgcaaaaacaataggaggattcagggtcttaaacaggtcagatcaggaaaccccaactaaagaccctccatacacagagccaggaagagttagggttggggggttggggagttggctggggagggggcagtagcctgtctttctcctccggtgtcccactgattcgctctttgctccccacaggcccgggcctctatgcaggctgagatggagctgaagaaggaagaggcggcccggcaacggcagcgcatcgctgaactggaggagatgcaggagcggctgcaggaagctctgcaactagaggtgaaagctaggcgggatgaggaggccgtgcgcctcgcccagaccaggtaggcacggtggccagggaacctttcctgccagcgcccgcgcggaccctccctccccggctctgagatgtccctgtgcactctggcaggctgctggaggaggaggaggagaagctgaagcagctgatgcatctgaaggaggagcaagagcgctacatcgagcgagcgcagcaggagaagcaggagctccagcaggagatggcgctgcagagccgttccctgcagcacgcccagcagcagctggaggaagtgcggcagaaccggcagagggcagacgaggacgtggaggtgagacaaggccgggaaccgggagaagctgggggagccagtgtgtcactgagccggaccccagagccaagctacctgtctgccaactcgcattatcatcagctggctgtgccatcgcctacagattgcctaacctctctgtctgaagtctcttatctgtgagaggaagcagataccacgttaccactacagaacaagcttagtttaagcatggtatttagtatgtaaatgctgaacacacctgtggctgtgtttgccaatagtattattaacctgggcaggattccccacctcctagcctccaaaacactccccggagcttgaatgcctgtagaaaaggttctaggttgttgttgttgttgttttggttttagatttgtttcttttttaatctcttttaaa

SEQ ID NO: 24614 - DNA, 1180 bp, Mus musculus
gaccgtgcagttacagcctcccactgtccttgccagccttgaaacctcagcccaaacctctgtgtacgcagtagaacagggcaagctggtgctgcacctgagctcactccagcaggacttctgggagagtcctgacagcaaccctggggtccacagagacttgaactcctgggatgggagccagctgggcggagctccgcacccccacagttcccaacagacacactccaccccaccatcatccgggacccactgaagatgctatttacccaaagcccaccaggccccctcctctcccagtcagggaggctgtgagcggcagctgctcagctgcctgcctagcggggcttcccccgaccctgaactggagaggaggctgggcccttgaagcttttccccagtcacacagcccatggctgctgagctcttcagctgagctctaggctgcagctcttccttcccccacctggcttgtaggcctggtagctgattgtttaactgcccctccgtcctgtcttcacagacctctcccagaattcctccccttcctccctgctggaccagctgcagatgggctgtgatggggcctcaggcggcagcctcaacatggaatgtcgggtgtgcggggacaaggcctcgggcttccactacggggtccacgcgtgcgaggggtgcaaggtacagatggactgaggggcgtggggatttgcctgcttcaggtaggaccccgaaaatagctccagcaaagctctttggttccttagaggcctgagctctgggtcatccaagggaagaaaagacaggtgtccaaatggacacctgcctactgacccagctatccactcagacgctgtggatggccagctctggggcctgggctccagcaggcaggcagggaaagagcaagcttgggctgagtgtccattgaagtcagtttccagggccttgggtcttaagaggatctttggcaagagagtgatgcttctaagttgttctaacgacacaccatcagaatttcacaaagcgccatctgaaaggatggcgagaggcggctcagtgctgaagagcgcttgctgctcttctgaggatccgagtttgatttccagcaaccatgtctggtggttcaatctcctattaccccagctccagtcctcttctggcctgaagtcacccacactca

SEQ ID NO: 24615 - DNA, 1263 bp, Mus musculus
ctccaggaaatctacaaggacatgtactaaggccgcagcccaggcctcccctcaggctctgctgggcccagccacggactgttcagaggaccagccacaggcactggcagtcaagcagctagagcctactcacaacactccagacacgtggcccagactcttcccccaacacccccacccccaccaacccccccattcccccaacccccctcccccaccccgctctccccatggcccgtttcctgtttctcctcagcacctcctgttcttgctgtctccctagcgcccttgctccccccctttgccttccttctctagcatccccctcctcccagtcctcacatttgtctgattcacagcagacagcccgttggtacgctcaccagcagcctaaaagcagtggggcctgtgctggcccagtcctgcctctcctctctatccccttcaaagacatgagccatccaaagaaacactacgctctctctgggcccagctttccaagaagcctggcctggaccaactgccatcccagcttgtggtcaccaccacagggttcctcctccagagagcaagtgggcagggagcctgggccgggagccatattcccaggctgtctcagccctaggcacaccactctctgacacttcctttcttctcgccggcgtcctaggtcattgtcacagatgacccttgtgctgcctaggagatgacccctccagatgtcccctccagatgcggtccaacggccccactgaagggaagggggtagaggcaggccggaaggagcagcggcacacttaggtcccagggtcagaagctagacagcgagtgggcaggccctccatcagcacccctcctctaccctgtagcagcatccagactggcagatcccagtaccaggaactggaccatagctgttctttcttctcctgggagatgctggcacacctgccccccccccccccttgcagctgccccggtgtagccatgacactggctcacctctcggtcaccacagagtccctcccattccctccccaaggccactggggtacagctatggccctgttcttaggactggtgatctgtgagcaggcagggatatcctaccaggtcacccctgccagctcacaggcagagttgctagggttcctctgaccctgtcctctctcccactcacttgtaccagtagctctgtggccttctcttcttttgcctggctggtcacctgctcccatctgctgcttcaagtggcttgaaact

SEQ ID NO: 24616 - DNA, 1796 bp, Mus musculus
ggaggggtcacaagtgtctcccacgtgttagcctccatggtagcccctgtctccgcatacattttgggaatagttatccactgtgagctaggcagttgtcatgcctgcttttatagatagaaggtttctccatctgtcttaagatttggagtaatactgagtcttactgatgttgccagcctggggtctaaggttatcctctagaagtgctcaggactgtgccctgtcactgagctgtgttctcaggtgacattatggttcccaggcctgcttgaggcttctcagatagctggccttggtccacctttgacagataatgagacagcttttttcttaagattttattttatgtatatgagcaggctgatgagagcctcagatcccattacaggtggctgtgagccaccatgtggctgctggaaattgaactcaggacctctggaaggcagcactcttaactgctgagccatctctccagtccatagtttgaggcaatttaaatgcaggcttacagtgaatccaaggggtgggggccatcacagcccctcagttctatgcagcacaccagggattgtgggacatcctggtctaagacctctgtgaggacttgagggtggagctactcagcagtcatgggtctgaggaggcaacttggccttctcgttgtaaaggatgggttggttgtttaaaatgttttgttttgtttttttttttttttggtggtttttgtttgtttggttggtttttttggtttttttggtttttttttttttttttggctcaatcctgagtgtctgtgtcttctagctaagaagtacgatgcctttttggcctctgagtctctgattaagcagatcccacgtatcctgggcccaggcctaaacaaggctggcaagttcccctccctgctgacacacaatgaaaacatggtggccaaagtggatgaggtgaaatcgacaatcaagttccagatgaagaaggtcagtctgggcggtgtgtggtggggaaaccagaaagagctaggtctgggtgccttagccctgggttaagccttttcactgggggaaagggtacatgctagcttagcctggtgaccttttctgtccatgcaggtgctgtgtttggccgtcgctgttggccacgtgaagatgaccgatgatgagctagtctacaacattcatctggctgtcaatttcttggtgtccttgcttaagaaaaactggcaaaacgtgcgggctctgtacatcaagagcaccatgggcaagccccagcgtctgtattaggatgctccaataaacctcactgctgccactcagccttggtgtgcctgtgattgggggcagggcatgtgaggccactatcccaaagctgggagagggggtctgtaggggtctacaatgcttctcaggtggtgggagaggtacctctaaccccctcgtgggtagagagtccggcttttctaggtgaagttcccaagctaattcccccgtggttttgtttggggctgtagctgttgtcaggccttaggggaacacccatagtctgctcagtaatggctttaagccctgggcataagagttcctgtctgctgcagcttccaggtaacacccatcttgggcaggcccctcaaagccaggtggggacagggctgagggaaacaaaccagcagatgtgaaggcaggtcaaccagtgaatgtgtaaggtgtccatttgaatcaccttgtgaagatagctctctgagtactgaaactaccccaggctttgtgggtgacagaggtctcttatctaaagacttg

SEQ ID NO: 24617 - DNA, 1199 bp, Mus musculus
gtcccgtggctcgggagaactgggctagcctggaggagtacagtccacccagctgcccgcccttactgagtcctattcccttcctctctgccccataggtggtcacaagtcgggactcgcaggagaccctgctggtcattgcttttgtctttgaagtctccaccagcgagcatggggcgcagcaccacgtctacaagcttgtcaaagactagccagccctcgacctccacaggatgcaaggcggacatcctccacacacctgcctgcctggtcttcccgtgtgggttgggggacctagcccagcccccctgggtttcaggctgggacccaggctgcctccctggctccagcacacatgctccctgccactgttctgcgctttactggagagaagagggctccacggtggggtggcttgcttgggcactgagccacagatgaccaggctccacctggcctcaagtgacaccagaattgtaccatggaggacaccttggggcttagtgtgtggttgctggcccctaggggaatgaatgtgctgggcaggtgagggttgcattgagactggggaaaggcagcttgcaaggaggccctggtacaaggtgtcaggttggggaggttgagaagggcccacacttctttgtaccttctgggtaccagtctgttcccaggtcccttacccagcaagtttgggtctcccatatcagacaatgtgccaagatggaggcccacagaagtggacggagggagctggggctggttcagctacctccctagcagagctgcctatggggcggggaaggggctctgctgggctgaagcctagacagggctctatttcctgttccccccagcataccagccactagcgcccccccccccccccgccctcttctgtgtcctgaagacaggtggcagggaacaggaggctgcctctgccttctccacatccaggtcccaaggtcacctgggtatttatgagtttcaaatgaagtactgtgcccccaatccagcccgagcttccggaaggttttcgccattgctcaggccacctccaaaccccacgtaggttttataacatgtattatatatatatatttttgtgtatttttaaaatccagctgtgatgggctacatcataaatggctcaaggcaggggccactcaaggcctggctcctgctttaaagaaaaaaattaa

SEQ ID NO: 24618 - DNA, 1709 bp, Mus musculus
actggcctgctaagaacacaagcccacagccaggggctccctggtccacagctgggtctcaggccccttacctgccttccaagtcctttcgcagactcttgagtgtggctttctgtcctagccagcatgtcccacagactctgttgttcctccaacgcccgtcattagtgacagctttctctctgagtttctgtggtgtggagagtgggtagaagtaggtttatctttcccgctgtctgccccactcaaggacgatgttagcgctcagccatccctgcccagcacagctgctcagcctcatgctcccacccgcacccttgctgtgcagaacctaaggcttgctcccgtcccagactcgagtggacggacatccatgtccacccaggattgacgaaggaaggaacttcacactcctctatcatgcaaaaatagttttcaatttttactttttagcttgggttttgaaaggcaaactctaggaggcttaaaacgggcagttactcttaaggcgaggtagatacctcatcctgcaccgcagcctctgtattctggtgggagctgtaagggttgcgggcttccggtgtccatgcatcaagccaaagtctccaaaacttgggcattgaattagggcaaatcttaaatagttttggggttggattttagtcctacaggtgatgattgaacgtggctggcttctccacagcctaaggaacccccatggggacacacccaccacccaatgacccatgcacctctgcctggacagctcacttccagccctaaggaccactgtgctcaagatgtgtggctgtagtaagacagtctcatgtcaggcattaagtcaaggccttccttcacacctgcgggacagcgcttctgaggctccagttctgctctgctcgaagcaggagggatgggttgtgaaggagtctgggatgtgactgggaccctcgcatctcacactcggcactctgcctctttccatccatgtttgagagccctggtctcaccaggaagtgcagagcaggagccgactgtgtgtgtaatgctctagtgtttgtagttctcttcactagccttgcagcgccagggaggccgggctggaatttgagcctaacatgttaggtttttacgggaaagctctttttccagctgtctcccaagtgcgtattgtgggccaaggagactggtatgggaaggggggatggtcaaggttccaagccagaaatggaaggtgcccagcacccctggattttacatgttcttgtattcagtaatctcagacgatttacacggaaatcagaagatgtcttcaaatacccttagactggatagagtgatggggaagcagatgatgcattgaaattttggtttttaaaaaatcacttagatgctgggagtaatggtgacacacacccttggtcccgtgacctgggaggccctgtctcaaaacaaaacaaaaaatcatttagatgcattttgtgttccttaaataaattttttaaaaagtggtttttcattgttcatggctttttgtttttgttgtttgtttgatttttgaagtttacttttatctttgtctgctagagttttgtgtccagctgcccttggggaccagaaagggactttgaatctccttgaaatgaagatacagttgttagccagatgtgggtgttgagaactgaacccaagtcctctgaaaagcagga

SEQ ID NO: 24619 - DNA, 1115 bp, Mus musculus
tgtgtgtgtgtgtgtgtgtgtgtgtgtgtgtgctcgctggcacagatgcatcgatacatacttgtataatacacaacacacacacacaaatatatatatatatatatatatatatatatatatatatatatacactaaatagagaaagatttggacatagttattatgtgaaagcagcagtctttccacgtcagatgagtgcattctacacttgtccctcactgagcttggtgtgaaaagactcacctctttagatccattctgtgaaccatggggtttcacttaactgatcctcacaggaagattttcagggcttgtttttattataagggtcataataataaccataataataataaaggcagtggtggtgcaagcctttaatcccagcacttgggaggcagaggcaggcggatttctgagttcgagggcagcctggtctacagagtgaggtccagtcaaagctctcagcaccatcaggggctcaagcttcacccccgagctggagacattttatactaaaatactgacaagtgggtggaccgtggttgattgttgcgtgactcttgtgcatagttctgctcacctccgtgtgattgcgctgcctcagcactgaggtgacaggagcggcagttgtcccttccaacctgtgacctgcccacctgtccttctgttcttaggcccttggactggacagtgccaatgagaaaggcttgtacagaaggggcgaggcccagctgctcatgaatgactttgagtcggccaagggcgacttcgagaaggtgttggcagtcaatcctcagaacagggccgctcgcctgcagatctccatgtgccagaggaaggcgaaggagcacaacgagcgggaccgcagggtgtacgccaacatgttcaagaagttcgcagagcgggacgcaaaggtagtgtgcccacagccccaggcttgtaaggacgctagcctagggacaaggttgggcagcctggctggaagaaataagacttaggaagggactccatgtgggcagagacacaggtgggaggccctggcgtgtccctgagagctgagggctgactcctgaggtggagcagtgctcttcttgttctctgttttgttc

SEQ ID NO: 24620 - DNA, 1317 bp, Mus musculus
acttggggcctcacaccaccatagaagtttgcgagtgagttggctcagctggagtatatctaagaataggactatcagtgtagccttgattttgatttgtttagctgccaggatgccacatcagcaaagattgacttgatcctgtggctctcctgctctgcttttctctgaattcagcgagggctttgggaactgcagtagtgcatgatttactacacttgaatccatgccacgttcttctatggagtccctgaaggaagaaagagccagcttgttcttcctggacctaaaggcagcggagatgactcatttttgcctaactttttcccgtcataaggatagccattagcactgccaagcttagaaccatccggcatgacagtctcctgtgaaaacatgcttcctattatttttagatctaaaattataccataaattcatctcttctatcttgagaaatgggcccctgaggatgcaggagtgctgcctgtgtgcaatggcatctgcttgttgccactgctaagactgagactctgtgggctgccctcaccaaagggaacacagtgcttttgtcctgtctcttgccttggaggggttttgctataattcactctccaataaagctatttcatttttattgaaagagctttccccccttacagagtaggttcttcataacctacagtcactaatctgttttttgtttgtttatgagatgtattcttttatgttgtagccctgactgccctaaaactcagtatgtagaccaagctggccttgaactcacagagatccacctccttctggctcccaagtgctgggattaaagttctctgattatgtttaatctaccattccaaaattatagtagctctacactcaggtatctcacgtatggtcttacagttcagttctttaaagatggctctgtaaagtctgagcattcagaaacacatagcccagatctaagttttaaccttgcggtagatgctttggagagcagacttaccaaacttaacagcagagtgaatcaaactgcctctgtttattagtgcagctagttctctgcaggtgtacagttcctggctgaacgactctctgcagcctaccagtggtggcacctgggcaagtcacctaactccccaagccttgcaaggttgcagaggcccacatggagtaatgaggcagatcacttagcacaccgccccaccctgcccattagctgttactgtctcagcgatggctttcattcattttccccttagaccacgagaaaatagaaatctctgcaacaaatggtatttttcaaatcttttc

SEQ ID NO: 24621 - DNA, 1107 bp, Mus musculus
aaacatgaaaagcctagaatttgggatgagttgttagttaattttgagaattttctttacttttggattggaaaagaatgtgtattgtgttgttagttcctacaggggattcagtttaggaatacacagtaggaacaccctgtggtgtgctttgcagagctccagtctgctgaaagccctgatacctgaaagctgatggaggggctcttccccatgcagagctggctcaccctaccgaagggcctttcattgctttagatgatttaattctactttagtgtacgactgcatgaaattggagggtttataatcttttatcctatggtgctgcataaatgtgccaaatgccataagtttattacttttaaattttttgtttttaagatttatttatgcatttgggtatcttgccagaatgtatgtctgtacatgcatacatgccatttatgtgcacggtgctggtagcagcggaggccagaagaggacactgaaggtcaggagctgaagtgtgagtgctgggaaccaaagcctgacccttgactgcccagccatctccccggccctcatagttcactgcatccagttacacaaaggcatgtggtgtgcgcttgaactagctagtacctttttattgaaagcccattttaaagctgagttttcaggtattttaattactggtgcttgtttattttgtctgtctgtggtaaccccataatagagttagttaccagcctcatttttctgtcagaattaagcacaaatcgcttcttgtatacacgcagaaagattgggctgctgctgctgctagggcacttaccctcaagtgcagctccttttgagtctggacattgcccggaaatttctttactctgctcttccctcctccctgtcttccttttctcctcccctccccctccctccctcccttcttctgtttttttctatcctaggattgaacccagggcctgtgagcactgagtgagtactgtgcccttaagtgatacctgacactaagaacctgctctccgggctgtgattccctcagatcctcctggtttggacactctaagttctgtaattcatgcacactgtgcaaatgtctccatt

SEQ ID NO: 24622 - DNA, 1199 bp, Mus musculus
gccggccgggcaccgccctcacctgccgctcccgagccggctcgcaccgggcaggcaggtgaccggagggtctcggaggtactgaggaggaagggctaattaaaagttgtctcggaggtggctgagcgggtacagccgcttgcagccaagcgtgacgacctgggttcgatcccgggaaccgacatggtagtaggggaaccgactccaaccgcgagttgtcctctgacctccctgtgtacacagcacaaacaccactggctccgatacacattctcatctctcacccccgctctcaataatactaaggaaataaaagttattttaggaatcttcattcccttcgccccagcggcatcaccactcctgttccggccatagtccttgactccaaacccagcattttgtgtgtgtgtgtgggatgaatctaagggagcacgttgcattatgaccatcttcctcctcctcatcttcgtctgtggatgagccaggtggagcgcttgcgcctcattttttaaataattggtgtctgcagccatggcgaaagcgttggaaggtacagatcgtaagcagagcgtgcagaacttgggacagccctcggcggggctcgggacagggtgtacagcgcttggccgccattcagtaaattctgcatgcggcagttgggagctggtggtttggggatttttttttttttttttttcccttcttcttctttcaggagtgtgttttccagcggaccagggcgttgaataggcactttctttgcttcctttaggggaaggagagagtgtttatttctattgtcatcccattttcttagggctgtggacaagggaaaagttaaggtgtgtttgggttaagcattttgtcttttcctccccacttcttgctgttagctttatatgttgttaaaaattatagcttttcctcttggtgtctgaatcaattcaagaaatgacttggaaaaaaatcttacttaaccgttttctgttactctcccagctgatcctcatttgcctgactttttggggggggtattttttttttgtttgatagttgaaacatcaaagttttattcctttgttattgggagtttactattcaattaaagcacgtataaatttctgtaacctaatactctccacacagctttcgctttggagtgctacagaaatggtgtattttaactatatttattt

SEQ ID NO: 24623 - DNA, 2366 bp, Mus musculus
gtggtttctatgctcacatttttttcctgcgacttttatgctacatttttcgatgagcaaccagtttgggtaccattttatcactgttgaaagtattgttggatccctctcatcttctcacaactaagttcctggaatcttgagtctgttgtttttgttttttttttttttttttttttttttttggtttttgttttttttgttgttttttttttttttttttttttttggtttttttgttttgatttttcgagacaggatttctctgtgtagtcctggctgtcctggaactcactttgtagaccaggctggcctcgaactcagaaatccgcctgcctctgcctctcaagtgctgggattaaaggcgtgtgccaccacgcccagctgagtctggtttttaatgtagacaaaagagaaccagtgaatttcagttactgggagcctcaggtgttgtgaaatagtccttttctgtgtcctgtgttgccgtaagaacagtcatttcagtctgtcctcccatttagaaggccctcctggagctttgcctgctcagcttgaatggactgactgtcttgtaacgagctttggggtgatccagacaggagacgaaggtttctgagctgccctgttcagggagtgttccctcccacattccaaggccttcccagacagctctgcttccatccacagctttcctgccttgcctagaattctggccttgactcagtttctccatgtggctgtgctgttctcatttctcagaggcctttgagatcctgggtgaggagccaaggggaggagaggctggcacttttctcaatcgttttcctgttggttttgacatgagtcatcctatgctgctatttccttgtataatgtaaggtttctgttttgtttttaaacatcaattttgagatgattgaaatgtacttgaggctttttcttcttaatgcaaaaaggctttgtgaactttgttttaggcttggcccctcatagacttgattacctaaacattacatgttcctggggtgaagcgtgcacgcatcagaaggacaggattggggtcacgtgacagctgcttgcagattttagcaaggaccaagtgggtcttgattatagcactctggaaacagctcagtttctaacttggagaaagccagagtcgcaagcctaggctcccctaagcaagctcactgaaacgcaccactgcctccttcctgtgtggaagactggagagtcaccctcatgattggctcaccagcaagcagcttcctgtaactcatcaacttcacctgaggaactggccagccattcattggctcatgcttggttatctggaaccagacttgttcctgtagaaagagttttaagtcaggttatctatgcacctatcaagaataaagagagcagatgacatcacataacggcagggaaatcttacagcagttttaatccactctgggttgtcaactgtattgacatctaaagcaatagcagacctacctgaaactccttctcagcaaatctcagttgtgggattatagaaatcctagtgacattaaggtgacctaaccaagaaacacaagccaacagcaggtctgttttaatcattgactccatgggaaattttaatgggggtagaacctggaacctcattccagacataagtcccaccagataagggctttctccttgctgcttgaggagccagagaacctgggagagtggaaggagacaggcgcaaaagctgcccttctgtgggctcctgagcttggccgagcagttggtgccatagaggccaggtctccctgatggactgctgttggctcctggttaaagataaggccccccgaggccctgatacgttttatattctttctactgagtgcgatgtttgtgtcctcacaaatgcagatcaataaacagagtatttaataacctgcttggttccacaagtttggtttctttgttgcccaagcagttaactaaatatgcaatgaaacagtagcataggtattgacctttgtgggggttgtaattttgtttctctaactctttttccttttctctctttttttttttttgtttgtttgttttgtttttcgagacggggtttctctgtgtagcccaggctggccttgaactcagaaatccgcctgcctctgcctccctagtgctgggattaaaggcgtgtgccaccacgcccggcttgtttctaagctctttaattgtggcattaacgtgtaatttgaaaaattgtaagaaaactttccccaattcaggagctggggatatggctcaagacagtgattatttaccacatgaacactgccgtaaaaggccaggtgtgagaatacagaagcgtgaca

SEQ ID NO: 24624 - DNA, 1122 bp, Mus musculus
ctacagagtgagttcctggacagcaaaggctacacagagaaacccttttaaaaaaaccaaacaaaaaagaaaaattgtgtcagaagccccatcttgactctgttcctgactgcattcctgacaacttatttgctatttttctgacaaaggtgtaggttcccatgcggttgttaggaaggccttccatagtgtggtcttgtgagtaaggcaggtctgactttgagttctgattgtaggctgacttggacttcatatctatgttgagtcactcagccacaatgacaggtagtcaggactgagcagtacaagaaagtgttgactggtacaggcatagagtcttctcaagggctccactataatatagccatgtgtattataaaggggtgggttgtctcaatgctgtggattgcctgtaaaaccagaacctaggcacttggagcagtgtgccatagtcctagagctggcttctagggctcctgcctccacaacacagtccctttgggtctttgtgctgtgaggttaagggaagtgaccttgcctaacttgaacaatttcttctccaccctactgttttagatccttctgtcctttctgtttttgttttctgtttgtttatttgtttgttttgggtaagggtggtcaggttctcttataggcctggctgtcctggaatttactgtgtaaattaggctttccttgacctcaggcctgcttctgtgctgggactgaaggtgtgtaccaccatatcctaatagaaaatagacattttctatttattctgatgttaactagttgtatagtgatcagttttgctttgggtgattaagaggtctgtgaagctaggactgggacctgggttgggcgtgctgtcctgtgctctgtggccacatggctagatggtgcgtcctgttgtgttgggacagataagctagagcctgaggggaggggcttcttcgaggtccacctgtgacgcacctcgcctgtgagcattctgatcccagtgtgtgcagcagggcctgccgccttcctgtctgccctaagcttctagactccagcagctcatgacttttagatggtatggagtccagcatcgaacactcatgtcaatagttagcttggagg

SEQ ID NO: 24625 - DNA, 1143 bp, Mus musculus
acagttccataactgaggaccaaacaaatctatgaaccatgggggccattctcattcagaccaccacagtggtgcatagtccatcatactagcactcaggaagtagaggctggaatcagaaagccaaggtcatctttgactaagtttgaggtgacctgggccacataagacttgccttagaaaagagaagacagagagaaagaaggcacttacagtgcacgtgctttctgatagcgtccatccaggtgtctcttcacctccgtgctttctttacagatcaggaaaaggacatagcaagtaggagtggtataaatgtggagaggatagtgcatgtaggaaggcaaggctggtgtggtacttcttaggcagtctttcctgcatcggtatataacatacatacacacacacacacacacaccccttgtgtttccaggtacctggtgacccatctcatgggggcggacctgaacaacatcgtgaagtgccagaagctgaccgacgaccacgttcagtttctcatctaccagatcctccgagggctgaaggtacaggcagtagctttgtcatttggggaagtgagttatctctcccgtgtagtaagaacttagaaaagacagtttttcttatgaaaaacttttaaaagagttacagaatcaaccaaccctgctgctcttgtatttcccaggccagtttactagaaagcaaatattgtccttccctttgatcctttagtctgaatatccaagagacttttagccacattgaaaagttagtagcatcctgatacaacctggtatccagtcagtgtgatactgaggctttaaaatattcttcggggctatgagctgcttttatattccttctcaggacttgagaggtagaaaaaagaaggaccactgtgtgcagcctgagtgccagccaccaaggctgtctggggcggggggacctcttcagaaccacctttgatgtttagcacattggagcccttactgaagtcatcctctagaaagaaaataggctgacaactccagtaggtggagtgggaattagagtttgtgtaatggcccgctgtgagcgcgcacagtgcttgactgaggggagagcactgcaagcactctagaggatatgacaccaaaaagctga

SEQ ID NO: 24626 - DNA, 1218 bp, Mus musculus
cacagtgatgacatagtaacctccatagtttcaaaaggtttgagtgtcccctcctagtgacccatgactctcacccttcattcaatgcaggcagccactgacccaattctgactctggattaatcttgtttcgtataaatggaactgtcgagggtcatgcacattactgaattgtgtgctcatctgtattgtgtgctccagcattcccagttgttcagcagtttccttttcataagcacaccaaagtttgtacgctgctgtcctattagtgagcacttgtggttcggaatataaacctattgtgaacattcctgtgcacacccgtgtgggcatatgtttttatccttgagtaaatgggggggggggttgctttgcttgaagctttatttttaaagtttcttggagtgttttatcatgtcatgcattctaagtgaaaactggggtgccctctttctgaaagtgacttttctgctttcctggttgtgaggtagcagaacttgctgctcccatgcctgacttctgctcttgcccttagattctggattttgggctggctcggcacactgatgatgagatgacaggctacgtggctaccaggtggtaccgagccccagagatcatgctgaattggatgcactataaccagacaggtactgactgcttcagtcgcctccccagatggggaaggggtgctccctaacatggctttcaggtgacttagcagctggggccttacttcttacgtcttccgtgtcattctttctgtgacactacctgaggggagtggtctcttaatcctaacacctatgtttcctgggaggattcaccatttaccagtaacaaagttttgcccctttgtgagttgcttatttcttttatcttaattatattctgagttgcacgacctgtggagtcttttcttgagtgacaattttaataagtttgtttctatataaaaaagattgtcaaaccttgggtgtcttaaatcctgacttgaatctctcactcatagttagagtcatttgtgtccatgaatatgaatagaaaccatgtcggtgcttgtatcctctttactgttccagtggatatttggtccgtgggctgcatcatggctgagctgttgaccggaagaacgttgtttcctggtacagaccgtatcctttaacacgttttggccctgtttctcatgtgtgtgctgtggtagatgtgtgcttccct

SEQ ID NO: 24627 - DNA, 1792 bp, Mus musculus
aaaacaaggcagcctttaggaaggccatggtgcatgtgtgtgcatgcgtgtatgtgcagccgccctccctcacttcaggagcaagctgtttgctgtgcttacccttcacctcagtgcagaggtctccagtgccgagcacaggcacctgccatcagtagttcctgtgtcatcttcacatctagcagagcacggatgtgtttgcatgctgtgctcttggagcttgtcctgtcttctggaagccctggacaaggcgtgtgaaggcttcccagaagttcctgtccacattgcctccgcccaccgacgccatgggcacactgctccctcctcctcctccagctactttgtgttgaacacaattgattctccaggtgctcatggtgcaggaaaacaggacagacagagagcacctgaacccttgccatctgatgtcaccaattcaggaaaacgagtcctctcctaggactatccccggttctggaaatcatgttctcctcactcatggtgacaagctaagaaagctgaacaaagggagagacgagagcgcctgaagccaggagctcctttactatctttctcaaaagggttgttagacacaaaccaagtcatcaaggccccgctcctctcctcggaagggtcccccaccccccggcagcttgacactgaatccagtgtcaatttggggagaaagcagttttgtcttggaattttgtatgttgtaggaatccttagagagtgtggttccttctgatggggagaaagggcaaattattttaatattttgtattttcacctttataaacatgaatcctcaggggtgaagaactgtttgcataattttctgaattttgagcactttgtgctatataaggacccatatttaagctttgtgtgcagtaagaaagtgtaaagccaattccagtgttggacgtgacaggtcttgtgtttaggtcaaggtgtctcctctcagtgcagggacatgcctgctctgtggggcaggcgaggaccctgaatcatttggagcccagaaggaggcagactggccaggtctcaccacctcagtgtgcagttcaactccatgccatcccatcaagatgggttagtagcagtgtctgtttttgaatgccaagtgtgatttccaacaattctgctctggttatttcattgaagacatctttgcacatgtgaccatgctgtgttaggggctgtgttccagggactggactcgaagctagaactggcagaagagttctggcatccacagcgcaatgctgccaccacccagtttcttcatcagaagacaagggaacgagaaaactgctgttcgtttgtatttgtgaacttggctgtaatctggtatgccataggatgtcagataataccactggttaaaataaagcctagttttcaaattcagttggtttctcaggtttattctgttcctcttcttggttgtgggacttttgttgtcagctgtgacctagcacatgtctgacagaccctttctaaagctgcttaggtggacctgaggggaaggcaggtctttgcagtgagtgagttactgtgcagagagaaccgcatggggagagtggcctagtgtgcgtccacacgcactgttcttgtacagtctgaaatgaatgtttttcacatcttcaagtaattggtttgatcagagaatatccacagagtttgttacgtatcttctgtggctactttcctgataccatgacaattgaaatccgaggggcgaagactgcagggctatccaggtagctgcttaatgtttagcaaaagt

SEQ ID NO: 24628 - DNA, 1125 bp, Mus musculus
attaaagccatctcttagtccccttccatttttttttttttttttgaggcaaggcctctcactgacttgccaactaaactaggcttgctggctaatgagccctggggacccttctgtctcctccctaccagcactggggttacagctgaactccaatacacccagcttttatacgtgggtgctaagggttgaactccagacctcctcatgcatctgagcactgtgtcagctgacccagctctccagccccgggactcactatgtagcccaggctgggtttaacacgttgcaatctctaagtgctgggattacaggcatgaactatgacacctgagtcgtcttctgccttcttgcctggtgttgtcttcaaggttactgttgtgcccgacttctgtccccaccccaccctgacctctctgaggtcacacctgggcctgtgggaggctgggaactgtgctaaaaaacactcctgccttccagctacctggtgatgcccttcatgcagacagacctacagaagatcatggggatggaattcagcgaggataaggtccagtacttggtgtaccagatgctcaaaggtctaaaggtgggtggagcctacatggtagccaaggcaacttccttgttgagagccagcccgctgttgtggggcagaggagggttctcgatgctggtgtggaagctgacgtctctgattcacatctctctctctctctcattctctctctctctctctctctctctccctccctccctccctccctccctccctttcagtacatccactccgctggcatcgtccacagggtgagtgctttctctatcatggttccggggaatgagttttggggtaggaacagggtactctggtggccaagggattgggagtgacagttctcaggagacagaggctgtgagtgtttcagccgtgagagggctgatgtagaatgttgagagaatggctgtgttgagaagttggggagatgtttgtgattgtaggtgtgtgtgtgtgtgcgcgcgtgcgtgctgcccccaaaacccctagctggcacttcaggctctaaggacaggaacatggtggaaaaggatgtgtagcccaatgtcattttacagatgaggaaa

SEQ ID NO: 24629 - DNA, 1883 bp, Mus musculus
aaagtagcaatgaaaataagtgcatggctggggatcaccacaacaggaggaactgcattaaagggtcgcagtgttaggaaggttgagaaccacggctttagagggatagtgcttacacaggaaacagatcttttggtgtccattcaaatggacaccatatatgaatgaacgcatatagcaatggatatccagctcacactcccgtggccttctctccttaggtttgccttcgtggtttccagttgccatgaggaagcctcgccgaaagtcacggcagaatgccgagggccggagatccccatccccatacagtcttaagtgctcacccacacgggagaccctgacttacgcccaagcccagaggattgttgaggtcgacatcgatggccgcctacatcggatcagcatttatgacccacttaagatcatcactgaagatgagctgactgctcaggatattaccgaatgcaatagcaacaaggaaaacagtgagcagccccaattccctgccaagtccaagaaaccctcatcaaagggcaagaggaaggagtcctgttccaagcatgcgtccggtacctccttccacctcccccagcccagctttcgtgtggtggatacggggagccagccagaagcgcccccattgcctgctgcttactaccgatacattgagaagcctccggaagacctggatgcggaggtagagtacgacatggacgaggaggacattgcctggctagacatggtcaacgagaagcgccgagcagacggccacagctcggtgtcggcagacaccttcgagctgctggtggaccggcttgagaaggaatcctacctggagagccgcagcagtggggcccagcagtccctaatcgacgaagacgccttctgttgcgtgtgcctggacgatgagtgccacaatagcaatgtcatcctgttctgcgacatctgcaacttagctgtgcaccaggagtgctacggcgttccctatatcccagagggccagtggctatgtcgctgctgcctgcagtctccctctcgtcccgtggattgcgtcctgtgccccaataaaggtggggccttcaaacagaccagtgatggccactgggcccacgtagtctgcgccatctggatccctgaggtctgcttcgctaataccgtgttcctggagcctattgagggcatcgacaacattccacccgcccgctggaagctaacctgctatatctgcaagcagaaagggctgggcgcggccattcagtgccataaagtgaactgctacaccgctttccacgtgacatgcgcgcagcgggctgggctcttcatgaagattgaacccatgagagaaaccagcctcaacggcaccacctttactgttcgcaagactgcgtattgtgaggcccactctccaagtgtggccgttgccaggagaaagggcgactccccaaggagcctcagtgaagtcggggatgaggatgggccgaaagagggtggaggggaggaggagcaggaagaagctgaggaggagggccaggaaggccaaggtggggtgggcagccccctcaagggcgtgtccaagaagggtaagatgagtttgaagcagaagatcaagaaggagccagaggaagctggccgagaggcaccctccatcactctccccatggtcactgtcccacagataccctcttacaggtgagcctcatgagacgctctcttgcaggactcttggtttgttcttcacagtagcccaggtcttccccacatacggctgatggatgcctggtctcctctgctcccaaatggagcctggccctgtgttgtggttttgtccctgccttcagagtaatgtgtctcctttagttctgagtgacataaatcattta

SEQ ID NO: 24630 - DNA, 1099 bp, Mus musculus
cctgagacctggtacctcagaggccagagggggttctctcagcattctctacttcttttatggcccaggttttggttcctttaagctgtcattttcctgtgttgcaaatccctcagcaacagtgcccacttctggaacaggattcactgatttttttttttttaaggtttattttatttatttgtttttttacttctcaagtgtgtgtgcctgtgtttaaacactaagcaggtagtggctgccactgtgtgcaggtgcctgtagagaccagaggcatattcctaggagctggagttagaggaagttgtaaatcagtcctgtgcaagagcggtacccaccctctagccccgcatttgctgattttcactgtttgaccaaactattttttttaaagatttctttatcttatatatgagtacactatcactgtccagacacaccagaagagggcatcagatcccattacaaatggttgtgagccaccatgtggttgctgggaactgaactcagaacctctggaagagcagtcagtgctctaacctgcagagccatctctccagccctgaccaaactattttaaacctccatctactagtaagaacttcactgttttctagccaaggcaaagctgtagggtgcgattccttcaaccccttagtcttactgagtttcttcagaaatgctttccagctgtgagggccatggccggccagcggtgcccctggggctggggaagctgtcagaagcctctcttcagtttgttcttgtagtacagtgctgaagactcactctagcaccaggaagcccgggcccggggccctgagcggtgctggggaagggccttcagcaacctcagggctggcgggaggctgaggcaaaaggaaggagaccacagcccccttgttcttgccttgcttagcgggagcaggacgagaagactagtgcagtgaaggaggagctcaaatactggcagaaacttcgccatgacctggagcgagcgcggctgctgatcgagctcatccgcaaaagggagaagctcaagcgggagcaggtaagcagagccctgccaggccctcgctggctcccctcactcctctgg

SEQ ID NO: 24631 - DNA, 1983 bp, Mus musculus
catcctctgcggcctggcagcaatccctccacaaggatggactggtttctggtaggaactcgcaggtcacatgcgccatgggttaatatcatgtaggcctgcaaaggaaatggagatgcctttgtctctgcctttgtgctttcgtagctccgtgtctgttagacatggaaaagcaagagtgggttggttccaactaaaaactgctcacttcaccctctactctgtgtgcagtggcctgacgcctcccaaacgcagccgtgggaagccagccctgtctcgtgtgcccttcctggaaggtgtgaatggagactctgaccacagtggctcaggtgagactatcgaggcagagctggggaagacatgttccaaggagcaagccgtccaagctgctcgcatctttagcttgtgttgtattttgagtttatgttgctgtgatcgtgatcatggtaaaagcaaacctgaggggaaggggttctcttcacttagagcctgcagtccatccactgtgaagcagagccgtggaggaacgctgcttactggcttgctccccgtggcttgctcgggttctttcttatatggtcctggaccaccagcccggggatctcatcagccacaatgggctgcgtcctgccctcccttatcagtcttctgttaaaaagatgcccactgacttgccataggccagtgatggaagcatttactcaatcaatagtcccagaggacccgtgtctaggttgataaaaactaaatcaaagcaaaaacactagccagcacagtttgaatagttaacatgtgcccatggaggccgaaaatccagaagctctaatggaagccagcattccccactggaacattggctgctaactgtgtggttgttttttcagaattacttaatggatattcaacctgaaacctgtgtgtgtgtttgagagaagtatagagggcccccattcctttcttctaggtcatggtagaccctggaaatcctttgctttcaccagcctgcccagcggccctctgtgtgggaggacttttcattggtttcactgaagccctccacaggagagatttcaagtgtcttccttggtgctgtgatgagtatctgcttgcacaggtcgtcccacccatgcagtgttaggttgcaggaagcgtgtgtttgtagctctagctgttgttgcttcgctttgctctctagcgtctcagtggtaatgtgtcactgataacctggctctgtcgagaatgtctgtttcgcctgatagaaaagcaggcaaggcagggccgcaggaggcctggggtggctcccggatggaacaggtctagagcagctgcttcttacctcacggttgtctgtcacatcactcgggacggcccgtctctgccggtctctctaacacagggttccttccctggtccagctgtttgcttccttctgcctttctcatgtctgttgacagatgcatgcctttgagttctctttcttgtgagtgtctgcacacagacgacaggtctcacgtctagactctgtgcgtctgagcgtgaagtcaggaagtggatctgacacactttgtacttctggtggtgacatttttttccctttttaaatccacatactaaaaatgatgccaaacaatattaaaaaagacttgcactcccgaagcccaccatgggaacacagctgcccgttcctgggttgcttccgattcttttagtcacattttgacaagtgcagatgatacacacactctttttttgttgttgttgttgttttccaaacagggtttctctgtatagccctggctgtcctggaactcactttgtagaccaggctggcctcgaactcagaaatcggcctacctctgcttcctgagtgctgggattaaaggtgtgcgccaccacgcccaacttgatgcacacactcttgtgctcacagtttttgcttgtatatttcctcctttttggctcacagtttttctgtgcactgta

SEQ ID NO: 24632 - DNA, 2779 bp, Mus musculus
acccttaagccgtcagtcactaaatgtcacctgatcctggggatggacatgaccttgggtgggcagctccgtagctagttactggagggagatccagaggcagaggggagtctggacagtgtggtgtcctttatgaaggcttggaggcctgtgcctagtaaagtgttgtcccgaatctctgtagaaaggaggtagagtggctggtaatggagctgtccgactttgcactcctctactccccttgagcttgcctgacctggagctgggtccagaggcccccgtagggccttctgcagctgcacctcagctctgcttgcattctaggcagtggcttccaagggacaaagtcctgcccctgggtgtggaggacactgtggacaagctcaagatgctagaaggccgcaagaccagcatccggaagtcagtacaagtggcctatgaccgcgccatgatccacctgagccgagtgcgtggctcccatgcctttgtcacttccagctacctgtgagagccgagctgggcctgtgtctgccttctttgcctctcctctgtccctgaggcatgagaacctctgctgcccctgccacgtgtatggccggcagcttctttctaatggcaggccctgactggactgggtctccgagggcaagacccaatattgaccaatcatgtggttcccctggagggctgctgtgtgccaaaaaactcccacccgaggtccctggggatattccactgaagaaccacttagaagtagaaacagctgagagtcttagccagccagggagatagacctggcccacaaggcaagagggcctaggctgcttttctggggccagccggctctctccatgtctctcccacctaaccatacctcagggcaggcaaggttctgacattgatcccagagatgtgccagggtccctcgggaaccctcagagcttcccttcccccacaccgcccgtgcttgcacccccctgtctcatctcccacacccaacccaggttctcccttccctcattgctctctgctctcccttgtgccaaactgacagcaacatcaccaaattgatctttttctttgatgtcccatttccttcctggccagctgctacattagatggatgtctgccaggcgcttgagtcccaggtagaagctaccccacctgtaaggaccctcccccactcacagccctccagcaggcatgctgctgccctcccctcctgcagcagccataagcctcactgcatcagcatgatcaccgcggcacgggcggcgggtggcgggtggcgggtggcgggtggcgtgcggcatggcactgccctccagcacccgccctctgggattgctgcccctgcctcccagaacagggctcttttctttcatctcctgccttcaacctcttctccaccatcacctcctcaatccctaccctcaaaaaggaaggaaaaccaaactgtgaatgaggaaagctgactgacaagccaacgcagctctcagaggcttctgctcttgacatttcttttcacttctttaagcaccaaagccgcaggcgggtttgcagaccgccaattgccatgttgacttctaccttgatgttatttttaattgttttcaattttttcataggggagttttgggcaaaaaacgaagtccctggggagatcactgccatttttacatactcaaactttttaaagaaatacaaccaaccaaccaccaacttcttacacttttgggactcgagccagagtttaaaagggaaccaacaaaactcaccaagagggccaggttctgtccagcaaacagcacagccacgcgggacagggcgtggtgtacataactgtaagatagcaggcacacactctccattaccggaaccctcccttgtgcatccatgctgcacagcctaatcaaggagccgacacgtccccctatccccaggtagctggtcagctgtggactctgtgacccttgtctaaacctgtgtcaagatcttggggcttctccctttctgtctccttcccccaacactatctcctctgtctctatttttcagtctcggaatccttccctctctccgagtcccactttaaaaactgctcttttaggacaggatgcggctcggatctgctgtggcacagggcctcttctctgtctggtctgctgtgaagcacatgatgctctatttattgtagaaagtgactttatttgccttctagaattgtttataacagatggttataagagaggtaataaacagaaaaacctatgcctgtaaagaatacaagagttaattttacctaccataatatgatgtcttattttctctccgagaaataaatgttctatgggctgtggtgtgcggtgctgtttgctgtccgtgacggggcctcctgtcctaacaccacccgcttctctgaaggcagaaccattaagaacggacctgtctgtcctttagatctcatggatggcctgaggagggtcctgccaggttgccgcaggttgcagagaagtcattgttcaagtcactgtgtgctgtatgaggccgctagaggctgatggtgggtgctctccttacagaagcagagctcactgatggagctcctgtctggccagccagccatcttctcttcccgtgctgaggttacagctgcctgtcaccaggcaggtttattttttgttgttttgtttttagaccatccctttagaagatctgaactcaactcttgtcatgtttacatgacaagtattttgccagctgaacccagaaaggggt

SEQ ID NO: 24633 - DNA, 1343 bp, Mus musculus
acttgcatattcataaataaataaatcaaaaaaaaaaaaagggggggagaatccctgttatttcccacagccctgtcccttatagggacagaggaggcttgggaggacaccagtcacatgccacagagcttttcttgctgtccttggacttggaagtagatggtagagcgaggagagtctgccaggagtgtgagcactgtatgctttctggttgcaggttaccctacctgtaaagagaagatcaagaggagacctggcgggcggtctgaagtcatctacaattatgtgcagcgcccttttatccagatgtcatgggaaaaagaggaaggaaagagtcgccatgtggatttccagtgcgttcgcagcaaatccctcactaatttggtggctgctggagaggatgtcttagaagaccaggagataataatgcatcacccaccacaagtagatgaacttgaccgcttaaatgctccactctctcagatggctccgaatgactttcaagattagggacaaacggcctctgcccagttgttggagctcttctttgtgtgggtacccctaaccaggcctccctgccctcctgtggtttctcaccgttaggagatgcctcttcctgtctccttcccttctgagttgttactgtgcccttttccgggtctgcctccggctgggtgaagaagctctctggtaattaggcggccagctttaccagccctggcaaacgagcttttgggtctggtgctcttggttgaatctttgcattcacctcctggtgcaggagaggaagtgaactgttgcctcacattcggcacagcagcccactcttacaccgggtgagtggtttcacaatcagacaaattgcttattagcaaaaggaccaaaacgtcagagaaacagtctgtgctggggttgggtgtgcccacctggggaggtgcggggcaggcgaagggaattccctggagctccagctcagctctgctttttactaacataggagcaaaccaaccccctaagaagggcagcctgatgcttcatttggaagtgaaacttgcaaatgaggtggcagaatggctccagattgggccagctggaccctcctctggtgggaagccacagcgcctgtccattaaataggccattagctactggaacatggtaagaaagtaatatgtggtcatcccccaaatcaggtccaggccttgttgttgtgttatctgctcaggcttacacgtgtggtagacggcagcccagatcattccctagctccttcctctcacatttccatggctgtttgcagagccaagagcctgacagcaatgtctgcaattattttacttccc

SEQ ID NO: 24634 - DNA, 1484 bp, Mus musculus
gcccaggcccagggtcagtggtgcttcctgtttctccatggccacaggaatgattatgtgtctgtcctgtgtaatgctcaggtgtgagcacggtcctttctttgtccttcggagttggttcactggctctggccttttatgaactaggtcttcaccccaacactccagcccatggagtttgactgggaggcaatctaaaggccactccagtgacactgggtggtggcaactaaaggaaagactgtgtgcagacataggcttcttgtggggagggaagcttttttgtacctcagccccacccttacctacatttcagtgtcattgtagtttggtgtcttgcctactgttcccagagttgggacactttttccttttgtttttgttttgtttttggtgtgggggaggaataagatggggttacaaaacaaggtttttctgggtagccctggctgtcctggaactcactttgtaggtcaggctgccctcaaactcaagagatccacctgtctctgcctccagtgctaagattaaaggtgttccatgccactgtctggtcccaattattcagtgatggggccttgcagaatcaagggctggattgcagtcatcttttgagttgattactggctatgtgagagagaggatttttctcataaaaagatggatttggggctcagtgtcttttgtaagtgcctgaataagtaagctgggctatgtgcatagaaagtctgatgagaaaggtgactttacacctcagagtctctaattatcttacaagataaagctgaccctgaggcttgactctactgtgtacccttgctgcagcttgtgtagttgacgaggaacacctgcagacacagtatcagaacgaaacaaatgggggtgaaggcagaattggaggaagatggggactgggtacaacaggcaaagctattttaaccagcatctcaggaggtactgtgtaatgtctcatcgcaggcctgagaatgctctgcaggaaatccaggaagggccatcttctcagaatatgtgtgctagggaaaataaatgttcagagcacaggcttcaactcaagtggaaagtttctgtggtggccatcaacagcttctgaggtgggtgacactgctgccttcccaggaggcagggccactctgtgtctgagggaatgaatcattctggagaattaggttttctcctaagggcaaaatgtgtgtggatgttgcctcttacaccatacttacttctgaagttgcacttgttcacctaccagtgtttacggaatcctgtgtgtgggatgctttttttctataataaagtttttttatttgtgtctcttgttatttaatagaaaagaaaatcacaaagcaaaccttcaatgaatttaaaggccaggatagtgggtttctttccttaggacacagactcacccaaagcttgcctgtgcacctcctccctgctgtcctaggatgccctccagttcagtt

SEQ ID NO: 24635 - DNA, 1912 bp, Mus musculus
tcctccacggtgcaccgggaagctgataggacagagacaagcatttttccatcggccataagcagctgcttgcttcttttgaagccccatgagccagtttggtatgtgctgtaaagagaatttgatttccccaagttgatcagaatgaaggggaaaagcagctgcccactgttactgaactgttacacactgagtaccagccaacgccctgtgctgtggtgatgatatgccacctgccaagcccaccaagtatttttctccttatagctgaaaattctgtagttaaataaggcaataatgaaagtctgtgtgaacagccaacagtgtggcagaaggaacaatctcggtctcgcaggtgccggtggtttctccccataccttggccctcacaagtggctttccacagccttcactcatggtgcactttacttatggtactaggacaaagaccctgatctactgacctgtctcccatccaaaagactcatgctgctcttctgttgatgggagaggtactagtgtgatcctttttgatcttagaaagcccataaaggcactgggcactgccaaggagttctggaccctgtggacaacccttactttcccttcacggctgtagatcatcttgaggcacacactgcctaccagcaagcaatacctgcaagtgctgccatgcaagtgcccacagcctccttgggagtcaaggcaggaccagcccgctgggtccttgagctcattcctcaatccatggtgcaaccgtgtttgtcttgatatttccttaccccaactttagccattttgccttggaatcatgattacaaaattttcctttgcagatgccttcttgggggcattcttgtccctccacccaaaagggttgcctgcagcttgggctgatacgcctctgctgtggcgttctctcatgagaaacactgaatttagcacaaagtgccttctctgtcatggctgctgccacctttagaagatttttcgctgtgtcagaaaaatgtggaggttccatataatgactttggttttaagtgttgataactgttaaggcattatttgcacctgtgtggtaacttgcagtcattggccaagctacaactgggatcggccctccgctggtcccgaagtttgtgaagtcagctcagtcttagctcagccattcagaggatagaatttaagacttataagcagaactgctttgggttttcatgtcttagatgaagaaaaaggaatgttagggaagtcttaactctgggttaagatgttagctccttaatcctctattcagagcctgctaatgcaaaggagatagaagggcctgggcgtggctttgtgttctattgataaaacagttgaggctcgatccccgtgtgtttgcaggagtgtgtggtgagcatgggagaataagaatagtggtagagtctgtgtggtggggatgattcatttggggggaaatgttcacattttaactattcaacttttgaataaactgtgaaaacgataatcgaactgtggtggatttcttttatgtgatgtatttttaaatgaacactggtggccactctcaatcccttagaccagaaacactgcaccatcatcttgatacaaaatgctgttctgtgctgtaccagcctgtttgcagggaactggtatcatgaattgccttccatagaagggggggggggttgcgggggccgacacaggacttcccagactgtattacatatacagtcaatatatgtaatacatgtaagggtccaggggactgaattcagcttgcggagcttgttacttggcatcttgtcagaacttttaaagtgattgttacatctctcagtgttctgtctgcatgtatgtatgtatttatgtgcactaagtttatgcagtgctcaaggaagctagg

SEQ ID NO: 24636 - DNA, 1103 bp, Mus musculus
ctcagcttgcttgacacggtaccataagaggaactctctcaagtgggcatctttttcccccttttaaaaaattattattattattctttattttatgtgtgtgaatacaccgtagctgtctttagacaccctagaagagggcatcagatcccattacagatggtcgtgagccaccatgtggttgctgggaattgaactcaggacctctggaagagcagtcttaactgctgagccatctctccagcccaagttgggacttttttaaccgtgttgtccctttgtttcttctggcgttgactcccagactgcatctctgcttatgtccttcctcttcccaatctcagctgtcagctgactctgcagttggctctctagtggcatcagaggtacaactctccactgtgaattggagaaaaatgaaaaatgggtttagatgttttccgggctgaatggaaatcccccagcatggggagggaggaatatgcagaggtctagctgctgttagagacaggggtctcctcagtcgacccaagtctgtgttctgggctgtaaagatccacacttcctgctccttacaggctacccaccattctgctccgagaccccacaagagacatacaagaaagtgatgaactggaaggaaactttgacctttcctccagaagttcctgtctccgagaaagccaagggcctgattctgaggtagcagagtgagcatcttccatgctcatccttgggattggagtgaaccttgtggcctcttgctttcttcttcagggtctgggggtgtcgggaagaacatgcaggagcctggctattcctttttcctgaagaaactggagtgtgctgaaaagcctggtttttttccaggttctgctgtgaatgggaacatagaatcggagcccctggagttgaagaaataaaaaataatcttttttttgaaggtgttgactgggaacacatcaggtatactcccacattagtttccagcatttaggatatgcatgccatgggatgagtgagggtcagagggcagcttttgggcttcgtcctttccttctaactttctgtagttctggggatcagatcaggtgccaggcttg

SEQ ID NO: 24637 - DNA, 1175 bp, Mus musculus
tttgagacagggtttcaagacgtgggccaccactgtctgacacaaagaagaaatgtaatgtgcggtctcataactgaaacatgaccagtgagtgatttctggttgggatttttttgtttttgagataggtctcactatgtagaccaggctggcctaaatcaacctacttctgtctccagtgctagaattaaaggtatgggctaccatgtctggcttcaatatttaattggtttctctaggtagccctggctgaaatggaactctctgtagaccaggctggcctcaaactcagatctccttgcttctgcctcccaagtgctgggattaaagacatgggccacacacttcgctggaaatctgtttaaatttgttgctgtgtgtttttccttgtagtaagctgggtaggagaagtctgttggcggaggtgtaatgggtgctggaaggtaacaatgtctgcctgtccaggagtccacacatcccttgtttccccttcccccacagggccatgtgaaactttccgactttggcctttgcacaggcctgaaaaaagcacacaggacagaattttataggaacctgaaccacagcctgcccagtgatttcagtaagtttgaacagtgatgttagctgccccagtccttaacctggtgggtgagtgagttccctggtgaccaaactatttaggaaacctgagagcgtctcccagcagtgtacagaagagatccagcacttttctgtattgcccatgctgtctgactaggcgagatgagcgcttccaactgtgctaatgcagaagttgaggacagaactctgctaggaagatgctggagtgaccatggcataagcagcaaggatgacaggatgaaagcgctcagaacagctccagaatagtttggttgcaagcattgtctttctacttgagcagtatcagaacacaggaaagcatactaagtcacagttgaggcttgaggagatggctcagtgggtaaagctcttgccctgcaagcatgaagacccgggcttgattcctaggatgcatataaagagccaggcgtgaaggaaggcccatggcaatgatctcaggactgaggagggggacggggaaccctggggctagtgcccagcccgcctagcctaaatcctcaagatccaggccactgaaggaagagaaaaac

SEQ ID NO: 24638 - DNA, 1166 bp, Mus musculus
ttgtaatgaaagcgtcctattcctggtgtgatgatctttcccgctgcagcctgcctgcctgcctgcctgcctgtcttcttcctttccttctctcctctcctctcctctcctctcctctccctctccctctccctctccctctccctctccctctccctctccctctccctctccctctccctctccctctccctctccctctccctctccctctccctctccctctccctctccctctccctctccctctccctctccctctccctctccctctccctctccctctccctctccctctccctctcccctctcccctctcccctctcccctctcccctctcccctctcccctctcccctctcccctctcccctctcccctctcccctctcccctctcccctctcccctctcccctctcccctctcccctctcccctctcccctctcccctctccctctccctctccctctccctctccctctccctcccctctcctcttcctttactttagagacagggtttctctgtgtagcctgggtctcctggaactcactctgtagaccagacttccaaaagagatctgcctgcctctgccttctgagtgctgggatcaaaggtgtacaccactgtttcttttggtaatcttctaggtgtctttggaaggcccaggattcttgtctttctgtggaaactttacttgctgtgccatgagggcaggaggctggtcagataatattttgtgtcagcagttctgttctgtaaggatgcatataaagagccaggcatgaaggaaggcgcacagaggtgatgtcagcactgaggaggggggcggggggaccatggggctagtgcccagcctgcctagcctaaacaggcaagttccaggccactgaacgaagagaaaaacgaagagggagacaagccaaagaattggctacatatggttcccttttgtacagatatgaaaatgtcaatctgaagcccatcgttttgcataagtaatatatgctaataaaaaagaatagtctcgggctggccagatggcgcagtggttaagagcgccgactactcttctgaaggtcccgagttcaaatcccagcaaccacatggtggctcacaaacatccgtaacaaaaaaatctgatgccctcttctggagtgtctgaag

SEQ ID NO: 24639 - DNA, 2138 bp, Mus musculus
tttgttttaggtcactttctagagataggagaagagaaaggtctctgtctcgtgagagaaatcacaagccgtctcgatccttctctaggtctcgtaggtaagtaagatgaatgactaaactattattgaagatatataaaatcttttttgtgctatgtactaagataattttgtttttgttttttagccgatctaggtcaaatgaaaggaaatagaagaccagtttgcaaaagtggtgtacaggaaataacttcatctgacaggagtatgtacaggaaattaaagttttgtttgagacttcataagcttggtgcatttttaagatggtttagctgtttaaatttgttttgtctcttggaacagtgacacacaaaacaatgtaattctctatggttttcagatggatcataagaggcacgtgatatcaagaattgttactttacaatgttcccttaagcaagatttaattttctttgaattttagtttttcatagactgaaataaaccttaggtcctgcccagttttaagtgtgatgtactaatgatataaagcaactggcggaaattgaaagaagctatagtcctctagtagctgagacactgtggcactgtgggtggaatgataaagcggtgtttaagagctgctgtgaacacaagccaacagataagggtaggaaccacactgaagatttgcaaaggggttccttcctggtttctctatggggatgcagagctattgtaacgtctttatttggaaatgtaaaactcagatgccagtgtcctttcagtttaagggtacattgtagagctcaacttttcagttactgtgcaagattgtttttcatgctgtcatttgtaatatgtttgtgagaatctttgggattaaagttttggttacaaattgttgtttaacttgaaagcctgtttttccttgcacactcaaaatctgtgagcttggtatcaagtccaggtaaaacattcctattggaagccatacttatattttcttgtaaagtgcttttgaattaataaagtactagcataattgtgtagtagtcagtcgagcgaaccactgttgccattgttcttatccctgggaaagtagttggttacccagttcattctttgtaagaaacacaactgagaagcactacattagtgaaggaatttttttttcccctttgcttgtcacttatgagagttagccattttttaggtgttgaagccagttcaggattatggctgttagtgactaacattttaaagtaagctccagtatggtaggtatattgtaattcccttaagttgcccataaaaagtggctttgatcttcagcatgaaaacattcaaaattttaaaatttattttataacttgaggtgttgcatgggattccaaattgatccatcatgatgtaaaatccccaatatggttaattgtaatgatgcacagttgaaatggaggcatgcatatcctttctcttagaatctggaggagttgtggtttcaggtatttgtgtgcaactagattaaatcataatgcaacagtcttgtggcttaagtttccttaaatgtgttcttttgagataagattctactgtactgacttggtctatgtaagagccattgcactaagttaaatctgtaagcttataaatctcccccattgttatctttaaacaataaatttcagtaaaaaaggagagagttgtgtctagaaggttccaacatgagcctttgaaagaagtacccatcttctttgaaggtacttttaaattagctacccttgatcattctgagtataatactaaaaggatgattccaggtgtttgctagaggtcattattagtacttaatgatgattaagaaaggcacctgagaatatgggtaacctcagatattacatacacaatgtaggttctcttcatttaccatctaggtgcctaagtgtcatgatggcatctctaccctgtattggactgtaataaacagccatagttgtcttagccactggcttagtgccttgtcttaactgtgctttgcttttctgaatccagatgagatttaggtatcaatctattccagtgtatatttttgtactaccagactcttgtcttctggttttcttttagggtaggaa

SEQ ID NO: 24640 - DNA, 1194 bp, Mus musculus
caggcgctgaggaggcccgaacaaagcaccgacaaccgtctttttatactaattggttcaacatcaaagagtgacattttattctcccatggttaacgccttgtctttcatgccaagcccagaggccaggggtggagaagcagggggcacgacaagtgcttcagtaacctagtgtagtgctggttgagctcatgtgcctaacactggcctcttcccggaacagaaagacacgcaaaggatatggcgctgagcatctctgcacttggttggtgaagtcgagaagtccaactagttcaaggtcatccttggctacacgtcaggcttaaggctgtcctctgtgtctcaaaacaaaacaaaaacgcataggcgatagagagggtgggtgtctaatagaaaaataaacggggccaggaactcatggttagcaagagaaatcgagttgagcaagatcggtaaaagtgcttgcaaccaagcatgacaacctgtgttggagccctgtcttagtcagggtttctattcagcttatacctccacattgctgttcatcaccaaaggaagtcaggacaggaattcaagcaggtcaggaagcaggagctgatgcagaggccatggagggatgttacctactggcctgcttccactagcttgctcagtctgatagagcccaagactaccagcccagggatggcaccacccacaaggagaccttcccccttgatgactaattgagaaaatgccccgcagctggagctcatggaggcgtttcctcaactgaagctcttttctctgtgataactccagctgtgtcgagttgacacaaacccagccagcacaagccctaagacccacaaggtagaaggaaacaaacaactgcttacagctatcctctgacatccataagcactcactggacaggcagacggacagacaaatatacacacacaaaaatcaaatgtaataagcgttcttttattagatattttacttatttacatttcaaatgttatcccctttcctggttttccccctctgcaaagcccctatcccatcccccttaccctgcctctataagggtgctcccccacccactcccacctcactgccctggcatttccctgcactggggcaccaagccttcacagaaccaagagcctccccacccattagtgccagataaggccccttcagctcctt

SEQ ID NO: 24641 - DNA, 1108 bp, Mus musculus
tttgattggcctgatggagttaatcaccaagacagcagggtagggagaccactggacctagcaattcacacgtatttgggatgttcacacccatgaagaacacgttagcacattgattttggctaatagaattcctggggtaaacaggacggtgactcctacttctgtggacatcacccgtgaccttggggtgcagggctggctgaactcaacacccaccttagtctcatggtgtggtggaaaagcacctgcaaggaccagagggagcctgaagactgtgatggggtagtttccatagtgacccgggtccttcttgtgtttcagccacaggcaccatgtccaatcctggtgatgtccgacctgttccgcacaggagcaaagtgtgccgttgtctcttcggtcccgtggacagtgagcagttgcgccgtgattgcgatgcgctcatggcgggctgtctccaggaggcccgagaacggtggaactttgacttcgtcacggagacgccgctggagggcaacttcgtctgggagcgcgttcggagcctagggctgcccaaggtctacctgagccctgggtcccgcagccgtgacgacctgggaggggacaagaggcccagtacttcctctgccctgctgcaggggccagctccggaggaccacgtggccttgtcgctgtcttgcactctggtgtctgagcggcctgaagattccccgggtgggcccggaacatctcagggccgaaaacggaggcagaccagcctgacaggtaaggacaggagcagagaaggagaaagatcctgcaagaggcctggagaggagaggccaccatttgaggatggcctttacagagaacattccagcccttccccaccaccaagccattccataggcgtgggacctcgtggggctcagaggaacagttgatgttcatatgatccaggcatttttctctgcagtgaccgaaatgcccaggatagtgtggtgattggcagtagagctctaagaagggagccgggctgaagagatggctcagcagatgagggcacttactcttgctgagggcctgattcccagcaccggaaatgacaacttcctataactaactctgg

SEQ ID NO: 24642 - DNA, 1845 bp, Mus musculus
ctgttctctctccacagatttctatcactccaagcgcagattggtcttctgcaagagaaaaccctgaagtgcccacgggagccccgccctcttctgctgtgggtcaggaggcctcttccccatcttcggccttagccctcactctgtgtgtcttaattattatttgtgttttaatttaaacgtctcctgtatatacgctgcctgccctctcccagtctccaaacttaaagttatttaaaaaaagaacaaaacaaaacaaaaaaaaccaaaacaaaacaaacctaaattagtaggacggtagggcccttagtgtgggggatttctattatgtagattattattatttaagcccctcccaacccaagctctgtgtttcctataccggaggaacagtcctactgatatcaacccatctgcatccgtttcacccaacccccctccccccattccctgcctggttccttgccacttcttacctgggggtgatcctcagacctgaatagcactttggaaaaatgagtaggactttggggtctccttgtcacctctaaggccagctaggatgacagtgaagcagtcacagcctagaacagggatggcagttaggactcaaccgtaatatcccgactcttgacattgctcagacctgtgaagacaggaatggtccccactctggatcccctttgccactcctggggagcccacctctcctgtgggtctctgccagctgcccctctattttggagggttaatctggtgatctgctgctcttttcccccaccccatacttccccttctgcaggtcggcaggaggcatatctaggcacttgccccacagctcagtggactggaagggaatgtatatgcagggtacactaagtgggattccctggtcttaccttaggcagctccagtggcaaccccctgcattgtgggtctagggtgggtccttggtggtgagacaggcctcccagagcattctatggtgtgtggtggtgggggtgggcttatctgggatggggaccccagttggggttctcagtgacttctcccatttcttagtagcagttgtacaaggagccaggccaagatggtgtcttgggggctaagggagctcacaggacactgagcaatggctgatcctttctcagtgttgaataccgtgggtgtcaaagcacttagtgggtctgactccagccccaaacatccctgtttctgtaacatcctggtctggactgtctacccttagcccgcaccccaagaacatgtattgtggctccctccctgtctccactcagattgtaagcgtctcacgagaagggacagcaccctgcattgtcccgagtcctcacacccgaccccaaagctggtgctcaataaatacttctcgatgatttataatgtcttgtcattagagcaaatggtgtgtgtgtgtgtatgtatgtggtgtgtgtctgtgtgtgttgtatgtgtgtgtgcatgtggtgtggtatgtgtgtgtgtgatgtgtggtgtgtgtctgtgtgtgttgtgtgtgtgtgtttgggactggctacttgtgctgtttgcacccacccggggggtgtgtctgtctgtgtgtgtctacaagtgtacacgtgtgcaataattccccatcccactcccccagtgatggtacttgaacctaaagccttgagcaatataggcaagaaagccatcactgagttgtagaactccatcgctgagagagttgtagaactccatcgctgagagagttgtagagctccatcactgagagttgtagggctccatcgctgagagagttgtagggctccatcgctgagagttgtagggctccatccctga

SEQ ID NO: 24643 - DNA, 1524 bp, Mus musculus
gggctcttgagaaacgtgggtaaggtgggccagtggttagtcaggcacagcacaagagaagctggaggcagaggcattcagggctgctggggtggtgcaggaagagacctttctgcccctaggaagggctgctgtgggtgctggcagtggtgacagagcggggtgaagtcctctgtatctgtgacagtgctgcggctctgccagctggaggggctgcccttcatgctcttctctctccttatgtccccaggggctgggattctcgccatggccaacgcaggaccagacaccaatggcagccagttctttgtgaccctggcccccacgcaatggctggacggcaagcatactatttttggccgagtgtgccagggtatagggatggtgaatcgagtgggcatggtggaaacaaactcccaggaccgtcctgtggacgacgtgaagattcttaaggcgtacccctctggataggtgggatgctgtccccagcactcccaggcccccgggagctggtttccggatgacgtagggtgctgtgtgattctgcgtcatgcatacctactccgaagcagaggggtcgtctctggggacgtttgtattctggccgacagtcacagacttgaaaagcgggccgcgttgatgagcgcactagctgcgcaccccctgttcacagccccgttcagcctccagcgtgagttcttccaggaatatgcacagctcactcgctcttccctctgagcctgagcatcaatactgctgcttctgacactacacatcccacgcaaagccatattgaattgttgccaaatgaaaaatgcatccaacagtcaagtgctgagaaggtgtcaagtggggatgataatgtgtaatgattgggcaatgaatctctgagaggaagcaggaaggagccttggccatttttccccggggagggatgggagtctagtgagcacaaggccgtcacaggcttcccacaggaagtgacatgctttagggctttagagaaaataggtaagaggtttttgtgcatgatgtccttggttttttttttactatttggatttcaagggagtggggcaagaagggtgttaatacctatgtaatacatagaaacttacagaataaaccaccatggtggttgaaatcactgttgtggtctagtattgttctagattttcggccttttctctttttgagacagggtgtcactgtgtagcactggctggtcttaacttcctatgtagaccatgctggcctcaaactcgataagtgtgcatctacctcaagtgctgacactacaggcatgcgccaccacatgcactcgacccagcagagcggaggtggggggtgctgcagcattcctgccttcaagattcacactgcctggtcctggtggtcctgagtctctgttagcttcccccatgcaagaacagctcctgctggagagaggcagaaccaagggacttctcgagcaccaccgcctcccggtgctctgggggagggaggggtggctgagctgcagtg

SEQ ID NO: 24644 - DNA, 1193 bp, Mus musculus
ttacaaagtaaataagaggccagctgggatccatgagccctgtcccagaaagaccaaagtcagcgggtggagtgcttgctgctccagaggacttgatagttcctagcaccacagcagagctcctataaccctaactccaggggttaactccctctctgtcctctgtggccacgcacagacatgtggcacacacacacactttttttttttaaagacaaggctaaccatatagccctgactatcctggaatttactgtctaaaccaggctggcctcaaactcatatagacctgcctctgcctcccaagtgcagggattaaaggcatgtgctaccatgtccaactacatcaataaaagaaaaatttaaataattgtttaaaaaagtgagagtgaaagcagagtccagcttttcccctctgcacccgctgagttgcccacccccactctgccctcctgctgtgggccggactgacctgccgctgacttgtttctgtttcacacctttccaggagaagacctctaaacagatcacagattttacgggaacttttccctgtttttacccaacttccatttccaaaagactcctccttaaacaaatgtttcctgatccagccggaacctgtggtgggtagcaaggtaaggcatgtggggaggacctggctgtgtatgtagagctccccgccttgggatagggactgatatgacggaggccttctctgcatacagacttagagggtgacttgaaggtctccccattgctgctgtcctctggtttgaaggcacatggtcagaaagtctgtctacagatctgtgtcttgctgcttctcctctttaaaggagtgtgaagttggtctggcatccctacctcaaatcggaaggtagacaggctgttggtgtgtagtgtgccatcacagtcccagtcttttctttttgtaaattgagaaatgtaacccgagtgaaaaaccttttacccaaattcaggagaactttgaaaaccccacccacaaacagcattaaggcagagactaggaatggtcagcacgtgagaccctggacttctgaatggcacagaaggcaagcagccggcctgcttctcccaccctctcccagtggtcagggccaggattgggagaagcccttgtccgtgggtctgtctacttttgtctgaggtttttgtacttgtttttcttg

SEQ ID NO: 24645 - DNA, 1185 bp, Mus musculus
gaatgggaagcagtggtggcaaaggcatttgtcaccaaccctgaagatggctatcctttgatatccacaagaacacagtggcacacctttaatcccagacaggcagagctctgtgagttcaaatccagtctggtctacatagtatgagttgcagaaacagctagagattcatagtgagaccgaacacataagctaaaaatgtacttaagcaaatctatttggaggaattttaaatctatttgcaagctgcaagctggtaatccgggtatttaggagcctgaggcaggaagattgtaaactggatgccagtccaaacaaataaaaagcagcaacaacaactgccaggcagtggtggcgcacacctttgaccccagtacttgggaggcagaggcaggcggatttctgagtttgaggccagcctggtctacaaagtgagttccaggacagccagggctacacagagaaaccctgtctcagaaaaccaaaaaaaaaaaaaaaagcaacaacaacaacaaaaacgcaagcagatggttgacatcctccctgtctttctcagtttctgatgctgtgggtctggaatggcccaaatttgcatttctgatcggcttgcaggtgctggggctcgggaggaccacacactttcagaagcttccccttgcgaacccgtgactggggcgaagccgaacggacaggtgcgcaaagcagagaaaggccattttccatatctgttctgagagaggactggaaagtccccacacacctgaaaattccccagaaaaagttctggttatcatagtgggccaacttgtaaacaggttaccggaaagtgcctacattgcctggaccatcagcttgcccccttgccaagtagagcctgtccttactagtagtggtgtctccgtgagcactgaagcagcctgggtacgtcctagctgccatagaattttgacacgtcagccgtgtctctgtgacttggtgtcagtcgtctatagagcagagtgtgagtgtgtgtgtgtgttcctatgcgtgagtgtgagtatgtgtgtgtgcatccacaggcatcttcatgaaggcctgggtgtgaatgggccatggtgtgcttgtggaaatcagaggacaacttcagatgtggcctgggtgcttaccccccacccagagtgagggtctttcttttgtttgctctca

SEQ ID NO: 24646 - DNA, 1186 bp, Mus musculus
ggcaccggcgccgcaccgacaccctggaggtggggatgctcctgtccaagatcaactccctggcccacctgcgcgccgcgccctgcaacgacctgcacgccaccaagctggcgccgggtgagtgtccccaccccaccctgggcgcgcgggtcgttgggacgccgggagacccccgcgtgggtcgagcgcgctgagtgtcccgtgcctctttcctaggcaaagagaaggagcccctggagtcgcagtaccaggtgggcccgctgttgggcagcggtggcttcggctcggtctactctggcatccgcgtcgccgacaacttgccggtgagtgggcaacgccgcctcggggagggcgcgcggagggatgctttgagcaggagggtctgatggagactcgggggtcttcttccaggtggccattaagcacgtggagaaggaccggatttccgattggggagaactggtgagtgagccggagccagagaccctctcatgggtgggtgggtggcgacgggcgtgccggaaccggcgcgctaaccctcgccctcactctgcagcccaatggcacccgagtgcccatggaagtggtcctgttgaagaaggtgagctcggacttctcgggcgtcattagacttctggactggttcgagaggcccgatagtttcgtgctgatcctggagaggcccgaaccggtgcaagacctcttcgactttatcaccgaacgaggagccctacaggaggacctggcccgaggattcttctggcaggtgctggaggccgtgcggcattgccacaactgcggggttctccaccgcgacatcaaggacgagaacatcttaatcgacctgagccgcggcgaaatcaaactcatcgacttcgggtcgggggcgctgctcaaggacacagtctacacggactttgatggtgagccaggccccggggagggagctgcccaaggtgccggcctggaagcctctggcggcctcggctccggccctttgtaaaggtcattgggccgcctggctcagagctggcaggggtggggcagaggcgagcttcccggcatagtacagccggggatttcgagctggttgaacgaacctgcaacatttctggcgtgattggggttttgttgttgttgttgtttttgttgttgctgctggtgtttgcttgtttttcttttcagc

SEQ ID NO: 24647 - DNA, 1999 bp, Mus musculus
caagttttatatacatcccaccccaacccccagaccctgtaaaatctaagtaccagcagagacccagtctctaaacaaagtttaaaaaaaaaaaaaaaaaaatgaaggttccggatagtgtcagtggaaggcgtgaggtaggtaggtgaattgaatcacctcatcttgctcactggtggctcatcaaaacccttgtcatccttcctatttctagtgagtgggtgtcatgggaaaggcccgagctattgaagtctgaaaccacaggtttaagaggggaggcacttttttaactgaaagctgattgctggaggctttcggtatccgttctttcccaccgggcagtgtttggtataaaaagtaccgtgcctctttaaaaaccccagacttgtaggtctggggaagaagacctttgcattacaaaaacaagttgagtcatctttaacctctgtctgccccgccttctgcagagtgtcagcaccttattaaatggtgcctgtccctgagaccatcagatcggccctcctttgaagaaatccggaaccatccatggatgcagggtgacctcctgccccaggcagcttctgagatccatctgcacagtctgtcaccggggtccagcaagtagcagcctttctgctgctgtctgtcagaccctccagggagggagagcttgtcttctggcctcccaacaggaccctgcgtgacgatgcagggacagcaatgacaactcattccagactccaggtccctggaggagcctcccacaagggaaagagactacttcactggtcctgggcccctctttgcgcgccccgcccccagactcagcgtctagtgttgctgggctcccctgaatccatccctggttgggggtgggagtggatcagagccctgtcgatggaactttagtcaccatggagactgggtcaccaagatgggccgggggggggggggggggggggagaggaaaacagtctggggggtgggataaaaactagcaccatatttaagtccctgtcacctcttccaactcctgagtgccttctgtggggactccgcctgtgctgggagaaatacttgaactttacctcttacctgctgcttctcaaactctgcctgggttttgcttccttcctctcctctcctttcccatcccccacttcctatgaaaggtgccatgggagaggctacagggccaactgctgagccacctgccccttttctgtctcctttagtaaaattcccaagcaaactggtcttcctctttggtttcgacttaactgtttcaaaaccaagacctcacacagaacgcacaaccaatgcaaaacaaaaaacaaaaaaaacaaaaaaaaaaccagacaagctgtaaatgtgtgtatagttccggcatggtagcctgcaaaaggactgtagatgataacaattttaaagaagaaaaaaaaaaatgcctttaagttattttatgtgttgggggtttggtttggttttttgttttttttttttttttttttcttttttattcttttttgcttgtttttgaaagatggcacgttctagcccggaagttttaatgtatttatttatttatttatttggttgccttcctgtccaagcttccactgactgttgcccccggtttattgtcatgttctgccttttttttttctttccttcctcctgacttggggaccttttaggggagggctgtgacgcttgctggggtgttggggctccggtgggacagctgctgtagcccccttctccaggggcccccttggctgcttgctggagtgggtctagggtctgctgactgtacataaaacagttccggtgtggtgtgccttccggatcctctctggggctgtgctttgagcagcgtgcagcccgctggttttatctgagtaaagtatactgtacaggggaataaaagagatcttattttttttttttatacttggcattttttgaataaaaaccttttgtcttaaacctttgagtt

SEQ ID NO: 24648 - DNA, 1491 bp, Mus musculus
gtgagcgtgtgtgcgtggtgtgtgtgtgtgtgtgtgtgtgtgtgtgtgtacaagcccatcagcattttgtcacatgtctgaatttgtgtccagactaacccatcagaaccggttgggaaggaccccagggaccaagcatctgatggtccctcaagagggaccagggccggggagggagaaagagggttatttagttctgttttaaccacctcttggaaccctatttccagggtgaagcactccaagatattatgtataaattgtgttattatgtatatgggtaaaggtgtacaaatctatgtcctctttgtagcagataggattttatatttatagcgtgcatcgacacgtgaaagcgagctaggtcatcagcacagatgaagatgcttaggggaggggcctggggcctggaggaggtggctggagggtgtggccaacaatcagtgtctccaccttcccccctctcccctttcttccatccttccgtggcctctgtctttcccttctcctcaccccaggaaggactgtagaggcagaagggctccctcaggtttgccggcccagcctttgtcttctcagtgtaagtcagcactgtggtcaggacggagctggtgacaagtcagtgccaagagaaggtccctgtgtgtccccaagaccgggagctcttcctggaaagtggcattaagtgtcccctactgccaccatcacaccccgaggctcaggggacaaggacacacgctagagttctggcatttggtagtggagaaaggatggaggccagtggttgtcgtccccttggggtgccaggcagagttcccaggtgtgacaccgtgaagctcacttcctgtgtcactcacctcaggccacacctcacccctgtgagttagctccctcagccaggctgtttctcaggcgttcttcccatcccccaccctcccctcctgcacctcagtagcctccttcactctctgaccctccctccgacacactgagtaaagacagagacttgtgttcccaagtggtggttttatttttttagtttatgtctgtctgggaaattgtggataaagtgaatggactgtaaataaatggtgtttcctcctccgtcggggctttggtttcctggtgtggtttggtttgttcgatggtgcttgtaagtattgggggtgggggggtcatcagggctagagcaatggcttagtggtgtagagtgcccactgtgcttcccagcacccacaacagctgattcatgcctgcctgggaacctctgcaaacactgtactcatgtgacatatattcatagacagacagacaggcagacagacagacacacacacacgcatagatagatagatagacaggcagacagacagacacacacgcatagatagatagatagatagatagacagacagacagacagacagacagacagatagacaaaatctgcagaaagaaatgggttaagcctcatataggacagcggcattc

SEQ ID NO: 24649 - DNA, 1102 bp, Mus musculus
gtgtgtgccaccactactgcctggcttttccccccttttggttactgttaactcttttgttttgttttgtttttcgagacagggtttctctgtatagctctggctgtcctagaactcactctgtagaccaggctggccttgaactcagaaatctgcctgcctctgcctcccaagtgctgggattaaaggcgtgcgccaccatgcccagctactgttaactcttaagtggtctcttatcacaacatctagcttttttctatgtggctgcggcggcggaggagaggaggaggaggaagaggagagcagatgaacagtttagggtccacagatgtctggtttcctaagtcaggacttgtgtttgcagctggttggtaagcctgcaaagaacctcccctgttagcatagtgacggattgtgtcttaactgtctttgtctttcaggtgaccataggacggggacttagtgtcacataccagctgatatcaaaggtttgccctctgatgatttcccgaagccactgtgttctgaagcagaatcctgagggacagtggaccattatggacaataaggtataagagctcatacagcctaaggcttctcttgagttgtatggatttttaacaattgtatattattttaacttatgtgtgctttggggagggacagtatgtgaatgtccgtgcatgtgccagcccagcccagcgttgccagattcctctggaactggagttgaagccgtgggccactctgtgcattctgggaactgagcaggagacatgtgatgctcttaaccactgagccatctctccagcccaggattttctgctttaaacatctttttttgattttttatttatttttttatttttgtattatttgcacgtgtcttttatgtacatttgtatgcagaggcttgaggctagaagacaggtttgggttcaccagagctggagtttcaggcagttgggagatgccccgtgtaggcattggaagtttccagaggatctagggttctctggaaaaggagcaagccatcgcttcagttccctttaaatagaacttacagtcactggtttggtaggacacttacagaaccctggac

SEQ ID NO: 24650 - DNA, 1256 bp, Mus musculus
gagctgacttagtgacctgtagtgagagctctttgccatgtcatcagaagctgccatctgtttggaagcacccaggagagctttcccagctgagaagactggccttcccaagtgatgtcagtcctcttctgtccaaagagagaaccgggtgttcaagaacaggcagtgggatgaccttgaatgtaggcccacctcacatttaaatatgcctggtgcatggtctagtgtggagagtgggggctcctgagccctcctgtgtgaaggggaagacctgctggctcaagcgggatcctcttgttgctggaggctgcctgagcatcatcattagcccgcagcccacagtgcagcgcagccaccaggggcaagcgtcctttctccctttacactagtggctgtggagaacaggcaaagaaggcagagatggacggggctgtgagccagtggaacacgggctcctccttcacatttctctttctcttcaaagcaaagagactgtcatgaaggtcacgctgcaaggacatgtgagagactctagggcgatggcggcttggcttgttctagaggattccctggattccctgaggctgctctggacgtcttctggaagccatgcgctgcagagactgagttaggaagtctgtgccactggccttccgtcatgcaggccctgctgctaccaccccccaacgtgtgctgggaccctgctcggactgcctgactgtgcattaaatgagttgagttctgtgtttcttaatttgttgattgtttttgatacctcatgcaccctcttgacatcattgtggacagctgggtgtgagtcctgtggctgtgtggaaggtggcctgcattttgagagcctggtttacctttttatgaaaacatgatgtcatttcttgggaataaaatgtataaaactctcagttgctcagctgggcttcggtgtgtttactttcctttgtctcccactccctcacagtctcccaggtaaacactggcagctcagccgggcatggtggcgcacgcctttaatcccagcactcgggaggcagaggcaggccgatttctgagttcgaggctagcctggtctacaaagtgagttccaggacagccagggctatacagagaaaccctgtctcaaaaaaaacaaaacaaaacaaaacaaaaaacactggcagctcagagcctgccgtcaggagagtcactgtccctgatagactgccagcagccctcagcctgagagctcaagttcagggccg

SEQ ID NO: 24651 - DNA, 1096 bp, Mus musculus
agccaccagacgggctgcttagggagagccgtctatgctcaggcctcctagactccgaccccgctctgtgccagctgctgtggacacttgctgtgtgtctcagtatttcattctgtctgcagtgttccgcttaccagggtataagcaagggccagtgtggtgagggaacgaccctgagacatggagacagcacttagatagccacagaggtgcttgtctgaggagtcttgagtcggcctggctggggaaaaggtgctaaggatgttttgggtgaggaagctccagtgggcagtggtgacagtggtgaccgagggggtgtctgggtgtggggagtgctggatcatgcttgctgataagtacttctattcttttgcctcctcttcctggagttctcctttcttttcctcactgagccacctgtttcccgatctccttttcttctacctctctctgcagaagccactgctgaaggagtcggacattgaccttctctactttgctgatgtgtgtgcaggcccgggaggcttctccgagtacgtgctgtggaggaagaagtggcacgcaaagggctttgggatgacgctcaagggccccaacgacttcaagctggaggacttctactcggcctccagcgagctcttcgagccctactatggtagggacactgagcagggcggggactaggaaataggaggccgctcctctcccatgtggggacttcaaggcccaagctgttgctacctgtgctcttcctgttctgctagccagaattcacagatcctggtgtgagggtcttaactcccatcaagcatctgtcttggtttttgttttttcaaccacaggcctgcactccctaggtaaactcatcaaagccgtacagttctccttgcaggatggtggttcttgtgtggtgacgggggtaatgaaactgcctgattcctagctggaaactggcagttattaacaaagctgggtcataagcccagctgcagccctgtgtgttgtatgcactgcactcactagcagctcggcagttacagcagtccctctgccctgacagacggactgtgctgtgtcagcagatcctgaattcttt

SEQ ID NO: 24652 - DNA, 1112 bp, Mus musculus
ttatgtaaccctggctagcctggaattcagctgtgtagaccaggctggccttagtcttccacctgctttagtctcccaagtgctagggtttgatgttttgagattggggggggggggtctcacattctaagccaatgtaaaactccctgtgtagcccagactggccttaaatttatgggcagtgtttctgcttcagcctcatgaatacctgtaggcctgagcccccatgcctggctaatactgggttttaaacataagtgctttgaaaagcaagatcctctgcttcagttgataactttaggttggtcagttccctatgaactgtggcttctgagagcaggagttggctgttgcaggcttatcagcatagtcaggatgggtcctgcttctcagagctcctggcctggctgctggaagcagataaactcacagttttttgtgtcccatcaggtgagggtggggtcgatggagatggagatatcacccgcccagagaacatcaatgcatttcggaattttgtcctggacaacacagatcgcaagggcgtccactttgtgatggcagatggggtaggtgactgcctctggaaatatactttatgggtgtgttctgaatttagaggtttgttttgtttgttgtgcttgaagttgaacccttggccttgggcatccagagtaagtgctatgctgaagaccccacccccaccccagtcgcccttgaaaaatgctttagttttgctcttgagctgacccaataaatggtaactcaatgttcatatcatagggatgcacatttttatttattttatacattttcctacaatttttataaagattctcctattgtaaaaaacatttgcttgagctcactgctgacggaaaggcctctagttgctgagggactggtggagcgtgggccccagctggggtcagctaggcagaactgaatgggaggcaccctgccggcacttgtcagccaggttgttgctgttggaagctgtctccaggtggctcctgagcctcatgtgcactgacagacacttgagcagtagcagcagcagcagcagcagcagcagcagcagcagcagcagcagcacagagtctacggaggcc

SEQ ID NO: 24653 - DNA, 1204 bp, Mus musculus
gacagctcagaacttatagactgaaatcacttcccttcccacagactgtagccagcaccaccaggaggccagcatcccctatacacgcccttccctccacccaccagcacattctgatttctcctttgttctcaaagaagtgtcactatgctgatattccacaaggcaaaaggaacccacaagagtggctttaaatcactgttaaagaaacaggagttgactgtcaccaggcagtggtggcacatgcctttaatgccagtgctcaggtggcagaggcaggcagaggatctctgagtatgaggacagtcagggctacacagaaatctgtctcaaaaacctgaagggagggagggagagagggagggaaggaagaaaggaaagagaaagagccggtgggcatgcagcactcacgtgtcctgcacaaaggcgtggatcttggccagagctttgatctgtaggctgcagtagctaggaaaaaagaagacacacatcgacatcagcacagtagccagagcagaagccaccggagtcgcggtgaggtaagcgggcccactcagcagttccgtggggcccaaagacagcagaagagaactgagtggaactcgggagacactcagacacaagtcctgctgagaaggctcttccccttcccttaaagaactgactaaggaacaacaaagcccatccccaggacctgaataaacgctggacgagcacgggaactcacctggaatctcagcactctggaggtggctgcccacctccccaagcaagctggcttgctagactaggtgagtttggtgaactctagggtcaagtgagagatcctcccttaatacataaggtgaagagcaactgacaacctgatgtcaacctctggcctcttgaaaacaaccagaggaaacgacacatgatacacaagaagacaatgacaaggccaatggtgggagctggagtggctctgtggttaagggcacccacatcaaatggctcacaaccaccgggaactacagctggtggtggggggagggctttccaatgcctctgacttctatgggcaatggcactcatgtgcacagacacaaaacaaaaaggaaagaaaataaatatttttaaaacccaagggtgagcttcccatcagaagaaagggaaggaggaagtgtggaatggtctaatttaaagtggtcaaagaaaaattccatat

SEQ ID NO: 24654 - DNA, 2108 bp, Mus musculus
ttctgggagtggggagatggcttccacatgcgtgactcccagaagccccaggatccagacaagctgtccaaggaggacgtcctttccttcatccagagtcacaatcctctaggcccttagggtttccacctgatgaatgtcctgtcattcttaaggcagggcccagtgtctggtttcttctgcctcttggaaaggaactgggactgttctccctggtcgtaagggagatgggctcctccccattcccaaggagctctttcggggccttaggacacagctgtgaaactctgctgtctgagaactggagtcaacctgaaaagcagctgctcaagggcaggtcagcgcttaggacttgtcagagtcattccctctggaatttgtcgactcagtgttctgagttccatttactgccctcgagagcaatcaggccattgttttgccccatttctactaggccacccaaatatgaaggccctccatcacatgctggccaggagcagctgtcataccaatcaaagttgtttcttgtggtcttttcttcaccccaatcctggagtttgtcctggcaggtcgggaaggagtgtggacccagtacctttcaaacatcagcgctttgggtactgggtataattgctccttgagtttccacctctggtaagcactgggcagctccaggggaagagcagcctaaaaacctgccctttgacttcctgtctcagcagtaacagaaagttactctagcagtccaggccacctgaagctcttggcagagttctgagctagcagtggctctagctgctccttcctctccactaggaggtacatagcgatctgctttgatttgtctatagtcagtcactccatttcctgtctctgtaagagggaggaatggcaacagctttgggttggggagggcatctgtggttgtttctaatgggaaatctctttcaagagatgttcatgcaggctccctagggccccatgccagtgccagactggtttccatggagatagggcactgaggcacctgtgaggttggaattgattccaccatgggaggtcccttccaccagcccccaaccccaatcctagcagcaagtgctgggatgccatatttgcacctaattctgggtctatcagtgtgtcttacagaatcttggatcattaaacatatttttactgctcatgtggctctgtgctgggctgctgttgtccacagtgctgtgtaactgaggaaggggagtgtttgtggaagccaagcttctccagctcctgagactgccatctgctagacagggagcccaaaggcttatcaaagtacagttccggtataaagcagaacttgggggtgaatgagctcaccacacaactcactgcatggcatggcagcactgtggcagtccaggatcagtctgtgtgactaacatagcagaggcttcagaccaattactgtcactagacgagacaggagaaaggatcttctgctgactctggctagccgcctccacaagaggccacattctgcatgagccccaggtgagaattccttcacctgaacatcgcacatgttggtgagctgcctccagccgattcttcatgtttcacagcctggctttacttggcaggctcctgaatggagcagtgagcattctttctcccttagggccctctactgtgagtggagctaggggagaatcctaggggctgctcctgactgaccacctcctccttctcacccccaccctactcactggctcttgtcaccatgtcagtctggtcattgccagacttgctggccatgggcacctgcaggcctccctggccctgcctgtctctggaagaggagatgattccgcatacccctggaacctccacttcaagcccaggccaccttttcccgtgcatgctgcattttcttcagtggtaataatcacaggccagggcaggctggagctgcgggtggcaggcacagagcttgccctcccagctgcacatctcccttcctcctgaattgtacataagaattttggaacatcccttcatctttgaaataagagtgcctcccttgctcaccctcaccttgtcagcaggaaatagttgccagacag

SEQ ID NO: 24655 - DNA, 1208 bp, Mus musculus
atctccagccactagaaggacgtggtagtgcttccttctgcttagtagaggggcaataaagagccccaggctctgctgtctggcaactatttcctgctgacaaggtgagggtgagcaagggaggcactcttatttcaaagatgaagggatgttccaaaattcttatgtacaattcaggaggaagggagatgtgcagctgggagggcaagctctgtgcctgccacccgcagctccagcctgccctggcctgtgattattaccactgaagaaaatgcagcatgcacgggaaaaggtggcctgggcttgaagtggaggttccaggggtatgcggaatcatctcctcttccagagacaggcagggccagggaggcctgcaggtgcccatggccagcaagtctggcaatgaccagactgacatggtgacaagagccagtgagtagggtgggggtgagaaggaggaggtggtcagtcaggagcagcccctaggattctcccctagctccactcacagtagagggccctaagggagaaagaatgctcactgctccattcaggagcctgccaagtaaagccaggctgtgaaacatgaagaatcggctggaggcagctcaccaacatgtgcgatgttcaggtgaaggaattctcacctggggctcatgcagaatgtggcctcttgtggaggcggctagccagagtcagcagaagatcctttctcctgtctcgtctagtgacagtaattggtctgaagcctctgctatgttagtcacacagactgatcctggactgccacagtgctgccatgccatgcagtgagttgtgtggtgagctcattcacccccaagttctgctttataccggaactgtactttgataagcctttgggctccctgtctagcagatggcagtctcaggagctggagaagcttggcttccacaaacactccccttcctcagttacacagcactgtggacaacagcagcccagcacagagccacatgagcagtaaaaatatgtttaatgatccaagattctgtaagacacactgatagacccagaattaggtgcaaatatggcatcccagcacttgctgctaggattggggttgggggctggtggaagggacctcccatggtggaatcaattccaacctcacaggtgcctcagtgccctatctccatggaaaccagtctggcactggcatggggcc

SEQ ID NO: 24656 - DNA, 1179 bp, Mus musculus
tgcctggagataatgaatggctcgacctgctgatagatcaagttgcctcccgccaccttgctcaccctgtgctcaccctgtgtgactgggcatggcagcggtggttgctgctcttctgctacccacaagggggagctcgcgttcgggacccggtcagagatggtttccgtgacggtaggaccacgtgatcctcctctcctccctcccattcctcaggttcataaatggtcctgattgaaaactgctccccatggaagggcaagagaaaggcttcacggtaagttgcttggcctaggtatctgagccattccctgtcgctcccctgcgatgtcccatgtcttctggccatgctttaaatccttcccttttctctaccttcctcttcctactccctagacgccagttcctccctcaaatagccagtcaagttattgttcttggaaatgcagagtctgattccaagaagagtggggctgaagttgggtgagctgatgagctcttccttcgagctgagcccagcatgaaggttcaagcctgctccagcagccccaacaccagcgggtagagagagcaggatctgtgatggacagccttgtgaggaacctttcctgggattcaactatggtacaagggataagacaggagaggacctgggagtggggttaaagagaatactgggattctgtgagaagagttgtcaagagttgaagcccaagtttcttggtagctcctggaagggccaacagtcatgcagaggagacaaagtcactgactgaaagaaatgcattcccagggacctgcagaacattctgcagggaaagcccagaaaagttcagcggctagttgagcaacctactgcctggcagcgacagctctgtggctaccatcaaactcagggaggaaggttataagagaagactcttagcaggggtagctagcagtggggagggatttcccttcctctatgtcacagccctcttatatgtcttgagagcgaagcaaaccaactggcacacctgctcctacctgaaggaaatgccagcaaagtagctttaagccacaagcaagacaccaggcatggtggcacctgccaatctctatgagcttgaagccagcctggtctacatagtgaaagcctgtctaaagaaagagagaaagacagaaagagggagagagaga

SEQ ID NO: 24657 - DNA, 1099 bp, Mus musculus
tttaaaaaggatgaggctggaaaatgccagggaaatgagcagttgctcccgaagatggttgggtgatgacagagctcccgcccacaccctcacactcggcctcgtgctctgcacaggtctgtgggggtgtttcagttctccttgctcatgtgaaggatgtggtaatgaactggtagctagaaccgaatcatgacatgtatggtctgctgacactagtttagtctgaattctgttcatgggccttttctttttgtgcaacagttttagccaacatgatacccagtgcccagtgcagcacagccctccttgtgttctgtgatgctcacagagtgctgacttcccggaaatgcattcagtaccggttcattaagtgtggatgttagcatgggaaatgtatagatgctcccaagttcaagaatcttgttctgttatgtatgctgttaaaaaaattagcacttcatatagtttctgttggctggagttttctctgtgtgttactgaatcagcttgaacagtttggatggatattatggatagaagcatggtttcatagaatgtcaaatatataattataaaatacacttagtaaatgtgaatactcatgggctgtattaaatcagagaactaacatttgtttctttgcttcatatattaaaaacattcctaaacactttctactgctgtgtccttcttgtattcatattttgaaagatttttgttttttcactaaatttggacaactttaatcttccagatccagaattaaattgagactaaccctccaatttgaacttaagtgattttcttcttgagaacacttaaacttgagctccaagctttagaatgagtatcataagaaaatctcaagtttgtcaaagttaattttccaaaatgtctgctgtgtttcttgcctttcattaagcagcgtggggagaggcaatctgtcgtcttcactcatggaaccttgatgactgggaggggagagcggctgctcactgccttggaaatttgctggagatgtgtcttacttccaaaggattcttagagttaattgagatctgtgttaaataaaggccataaatgctctctaaactgtttt

SEQ ID NO: 24658 - DNA, 1144 bp, Mus musculus
gggtaacagtctgtagtctaagggtctaagggtaacagtctgtagtctaagggtctaagggtaacagtctgtagtctaagggtctaagggtaacagtctgtagtctaagggtctaagggtaacagtctgtagtctaagggtctaagggtaacagtctgtagtctaagggtctaagggtaacagcctgtagtctaagggtctaagggtaacagtctgtagtctaagggtctaagggtaacagtctgtagtctaagggtctaagggtaacagtctgtagtctaagggtctaagggtaacagtctgtagtctaagggtctaagggtaacagtctgtagtctaagggtctaagggtaacagtctgtagtctaagggtctaagggtaacagtctgtagtctaagggtctaagggtaacagtctgtaggtgttaccagaggcagaaataaggataagaaggcaggctcggcgtttgccattttagctcctgcaccagaatgtacaggagagcagctggaatctgagcagtccttgctcctgtgagttcctctggggtttgaggttaggctgtagccattgtactttctggcagggttcacaagtcgtgtgacctcccacttggaataaggcattgctgcccctgatgcagcttcagtagcttttaagtcagctcctccacgtgtctgcagcgtccagtgctgcatatgtatgcctgatggcagtaaatgcctggcacccaccccagaaaaacccatcagttgctacctaagaaaaaaatgaagagctctcagggtggcagtttttataggcaccaggaagttgttagtcatcaccagtgtctcccatgtactagtaatactgtctttggatacatggaggcgtcttagcctgattttagttggtaaaagtaagtgtctctcactgagtaaaacgaaaccatatagaccagagctctgtctcctcaagagttttggatagtgtgctggtggggccgttttttccaatcatttattttcttaccctctgtcaaaattaattattagagaaatgggaaaaatcgctgaagaaagcagacatactgcactgttgagctgtctgccctttcctgaggagagcattctccagctgtggtcggcttctctcagtgta

SEQ ID NO: 24659 - DNA, 1190 bp, Mus musculus
aagcaggcgggcagggggcagcagggaaggtacgctgacccaggggcacaagcatttccagtttcttgtgcctgagtaaagttggtatctgtctgtctcaaggagttgaggactctactaggttccatttcaatgtgtactagattctatttcatgtcgttttggcctcgtaacatttccttttgtgtggaatatggttgtgggaagacactaacctttgatataggtgtactaataagatggtataaaagtttttatatatattgggtttttcaagacagagtttctttgtacggccctggctgtcctgaaactcactctgtagaccaggttggcctcgaactcagaaatccacttgcctctgcctcccgagtgctgggattaaaggcgtgcaccaccacgcctggcaaagttttatattttatcttataacatgcaaagggcattattttatcgtatttatatagcattttcttgataattgacaaataataatactgaaataaatcatttttaatttgtcaaaacactgaataagaaagtgtctccatcatactgaacacacgttcgtgtagaacttggtgctaaaccattcgtagaggaccttcttctgggtcgaggtttcatacatagcagagcagctccctcactgtgatctattaaaagtcagccctcaacacaagggtttgcaaaaagtggggggaaaaaaaaagaaaaaaaattgtctaggagatatatacaggaaagaaacagcacaggactgggtgggcttgacctgctggcccctccctgagtcctggggtgggggctcttcctatccatgcctgctctgtgcctgagggcaggagctgtgttgtcagcttgaattgaacactaattagaaaaccaacctccttgtgtttttatgtctgttgtaaactaaatgcagcccatttcttttcgctgttgtggtcatttcttttacatctatcctcattactgataatatatgtgcacccactgatttctgccatttttaatgtgttttttgtttagggagctatttttttgtgctgctattttccttctgacctctcaccgataggtctcaatctccccctcccctttctactgattactcttaagaacatctttgtgtattcaaagttcagtattaaaatcaatgtctatccttatctgaaccacagagg

SEQ ID NO: 24660 - DNA, 1254 bp, Mus musculus
ggcagcatccagcctggagttgccagtgtctctagcaagcaatactccctgccagcgcattaggaaccccagtcctgtggatgatggagtttgtcgcttttggaagataagtgtgagagcttgttagttttgttggtcatttgcttaaggtagatcctcctcctatagcccaggttagtcacactcatggcagtcctcctatgttaccaccccgagttctgagcttatgggtatgagatagcacacgctgccacaaaacatttttgtaaagacagaagacaagatgcaggcccaggtctggagtccagcagcttcctggggcagtgggtctgagttggcaagaagtccctggtgtctaccccaaaacgtcaccacacacgtgtcatgctaggtgctgggcactcagtcctctctgcagtctcatttcccatctggctagcccagaccatcatcagagacccacaccttgtggcttcctttctgccttcagacccccagtgactgtgcattcaggttgtaagacgttagagctggttaccttcaatgtgcatgctgccatggtgccctcagatacttgggaggggagatgtgacagcaaagtcaccgtggccggaagtggggaatgggggtccattcagagaagcatggcaagcccttggtcacctgggctgattccaaggctatccttgggacaaagcctttcttggattgacacctgctcaggatgcaggaggacgcttatctcccactagacacaggagtgtaccttccgttggctgctgggcatgggatgtgcctagatgtcacagccaagggtgtccttgcaacatctaaggtgaggtccatgtttccaggggacagcgatgagctagagcctgccttgtcccctgcaggattatcctgagccaacagactgcaagtgactcttgagtgctgagctgagcagaagcgctaacagtcatgcagggttgaactgggggaccccatgcaccatacagggtgattttgactctaaggaccctttgggtgccaggaagggccacagtcaaactatgggaggctgaagcagtgtgaactgttgttcccccagccctgcccttgctcctaaaggcaactgtggatgtgaccattgtgggctcagcttggagagtgtggctcccacctgaagcctcatgccacctgtggaatggtacctgcttctaggtacagagcctcctgccctttgatcatgttctctaggatggcagatgtcat

SEQ ID NO: 24661 - DNA, 1183 bp, Mus musculus
ggtagaccgctcactcagcacagacgttgttagtcttctctctagacttgtgccggtcataacaggaaggtgaaatggtgaacgtggttctgcatcttaaattctctgccacacttcaagtccagttttgcctcaggttctcaacggaaatccccagcatccctgggagtgactctttccagccaaatagctggtctctgttgttctcatgctgtgctctcggccttcgctgcagctctctgtatccgtaaggctataaactgttataactaacacacttctttcccactaggcttgaagtcctatgaaagtggaggtcacagtttgtttatatttaccttcttagctcctccataatgtctggtcgataggaatatcatccagttactaagggaatggcccccgagaaggacatctgtaaagtgtaaggccagagcatcttattctcatggctttttaccaggcgcccaagccttcacccttaggttctgtgcctggctttcttgctgtcacctggccattccattctgcctcttcaggggaacctcagagaccctaggacatggtatccagcaggaggtggcagcacctgccgatacctccccccttcacttactcatggtgtggtagaagaagggacaggtggggtcagagaccggcatgtgacacaacagatcacctctgccattaaaaatgctgctgtaaagagaaaggctgccccacccgggaaagtcacttctgctggtgataatgttcttctctcacaagagagcatcatccactgtgagcagcggcagttccactggagagtgactccttgacactccaggtgcctttccaacctgcatctgtgagtttgcccagttagatcgtagaattgcagttgtgttctgaggatcaagtcctgtgaacagtgcggggcgcactgacacactgacactcggacttaagcttgcactttgcggagagtagtgtttggataaacgattgagtgcatgagcatggaaagccaaagtggggccctaggtctctgcttaaaacatctccctgctgctctttggtgcactgtgggcctggtctgtctcttgaagctcttgggcttaggctagctgttccctttacacttcacctttcaagttctgcattaccttgtcctgaatgactttccagaagacagcatctt

SEQ ID NO: 24662 - DNA, 1160 bp, Mus musculus
tggctacctccacactgtaacttctaacatgcactttgaggtttcatctgcatctgtatggatatggtcatggaataagcagttatcctggacagtgcaatggctttgttcacacttggttggttctttcttcccgtctgaggcagccttcagggcccatggcttggttttccctagctatggctcccatgagttcttagcacatgctcagtgtatgagaccaaggcctggcagtggtagccatcactaccactcacactgtagtggtgagaacttagctgatcagtgtacacactggccatggaggctgggaaatgtcttaagtttggtagttccatagcaggtaaagtccactaaagggaaaagtgaaaacatgaagatctgtttctgtgtcatgttatccagtgtttatgtatgatagaattcagtgtcgtgttgccagtgtgtgagagccagtatacaaagtgttcttcctaactctacccaatccctatctctcaaaaacagaggaaggactggctaccttggtattttataccttctgaatcagcagaagtagacagacttgccctgggccctgtggatatttacatattcactaggatcctggccagggctctttgtagaggatggtaagaggatttccaccttaagtgagggagagtaccaggaggcctttacaggggctcatttgcactgtcagaagcatcacatcggtttccatgagtcacatgaccgtcttttaaggaataaaattcatcttgattctcgtacaattctctatatacagaaaatgcaccaatcataaatctgtaaatattctgatttatgtgcaagttatttcttacaatgaaaaataagtgattgggaattgtagtgatccctaggggaataattcctgattgtggttttggtttgtgttacaatggtttaactgttgaggatccactgtgctgatgctgtcggcatgtgtactgtttttataccttgttataaaacaactgtaaactaatagatcccttcagtgcctgtgtcagtattaagtgaggacatcaccaaagctgtgtcacttcttactgagactgagcagacacccacatctagtcgcctgacttccctttgtttgacactgccaatcagctcagagatattgaaccagg

SEQ ID NO: 24663 - DNA, 1207 bp, Mus musculus
cactgtccatctgagcagagcagtcgttaagagggtctgagtggtggcagactccctgagctggcaaacagctctacttttttagggcttgttttctgtaggaaactgaaatttgaggttcatgttgaaggtttttaatgctttgtatggatggcagatttcatctgttaaattgaaaaaagtggtattttatcaatcaaggcatgggagatttgacctacacctctttctgagacttaggtcagtcagtcggcattgtggaacctgtgctgtgctgcagatggcgctcaccccaaccctggcttcagttcacacccttgctgtggtgaatctgtgcctcactgagcatgctgccctcaccaaaaaggagcaggagccgtactctgtgagctcgatagttactgaacgggagaaccgcaccctgtgagcttgatagttattgagcaggaaggctgcttgttttctacagagcagacttttttttttttaatcaccctttgagaatctgagctgttgtttgatcttcagagaaggttggcatctttggcacattggcttttattaagatgccactgtgccttttcctagcagccaagcctgtgagtgcttccctgtactgtcctgagcctgccacaaacagtatcttaataactaataactaatggcttgctcatttttgaatgtttacagcaggttttgtatatttttggttctgagaaaacacataacataacactaggtctgccatgcctctgcctgtgcggggtaaccctggcagcgtccgcctggcatggtggtggttgcgtctcctggcagtaaggaagcgccagcctcacaccacagttatcacttcagtgatgatgagtggaaggaagtgactgacctttctgaacccttgccaggagtggtgtgtgtgtggtgctgttctatgtgcaccaaagttttactaacaccagctcctcctaccttaaccctcagctggagctgaagaaaagcgacttgcagtttatctgtgtgcatctttatcctcagaccaaacctcactgtgtcacttgtaagaactttgcattgataacgacttctctctctctctttctctctctctctctcccccccgtgtgtgtttgtgtgtgttatgtgaattgatactgcagttaagtgttatattgatgctttatgaaaataaaattttaatttttaaatatca

SEQ ID NO: 24664 - DNA, 1149 bp, Mus musculus
cagcaggtgttaagttgaacctgctagcaggatgagttcagcagagggtacatttgtcccgctgcttgtgtttctagtattctctgaattttttttttttttttttggtttttcgagacagggtttctctgtatacccctggctgtcctggaactcactctgtagaccaggctggcctcgaactcagaaatccgcctgcctctgcctcccgagtgctgggattaaaggcatgcaccaccacgcccggctctagtattaattctcagtaatgtttagtgtttggctcactgtggtagtgacatttagctgtggtagtgacattctgtttcgaatgctgaacgctatcttaatcttagtagacagtgtatattttcatttccatagacttgcctatgcagcttaaaatcagatacaggtactggaatcagctagaatgctagaagctctcctttccctcgttacctagttaccaaacacttgctttttctattccaactgtagtacctgaagaaaacattgcaactatgaagtatggggctcaggttgtgaaaggagagctgaagtcggccttgctggatggtgacactcaaaactatgacttggatcatggattttcccggcaccccattgatgatgactgccgctctggcattgagatcaagcttggccagccgtccattataaaccacatacgtctactcctgtgggaccgtgacagccggtgagtccttcctgtcttggagaagctcatgttgtatttgctggagaggacctaactttttcgtcatctgctttggttcctcttcctttttctctcttcactagcagaaggaggacgtttatcaagagaggtcctctgtcttagggttactattgctatgatgaacaccatgccagagcaacttggtgaggaaagggttcgtttggcttacacttccacatggcagtttgtaaccagtgaattactagatgggaactaaagcaggccaggaacctggaagcaggagctggtgcagaggccatgggggagtgctgcttactggcttgctcagcctgcttcttacagaacccaagaccaccaacccaggaatggccctacccacagtagactgggtgctcccccatcaatcactaagaaaacaccctaca

SEQ ID NO: 24665 - DNA, 1101 bp, Mus musculus
tgattgaagggtgctgttctttttctttttaaaattgaatagcctgtgtttcctagaactcactctgtatgtagcccaggctgacctcagatccacagtaattcccctgtttcagctttcccaatgctgtattacacagtggagaagggaagagctaggaagactgaaacccaaggaaaggcttgctttctgtggtccggtcaggctgactggctgtgcatgtgggcgtgctccacgctgactttttatggtccttttttaccctttgcagacagcactcctgaatatcgtcttaagagattcgtttgctgctcctgagaaagatattttcttagccttgttaaactggtgtaagcacaatgcaaaagagaatcatgctgaaatcatgcaggctgtgcgcttacctctaatgagcctcactgagcttctgaacgtcgtgaggccatcaggactcttgtctccggatgctattcttgatgccatcaaagtgcggtcggagagccgggatatggacctcaactacagaggcatgctcagtaagtacctgctcccctcctcacctaggacttttgttggcatcatatgctagttctagctgcagagctgtggtgcaggtctgcaaagcatatgttgggccgagagcacagagctctgcttcctgtgggtgtctgtctctgccatctgtcccaacaggatgagctgccaccaacccagcacagctatttcctgtcattctggacacattcttttatatgctcctcagaatgttgtagacactttcctgaaaggttgcttgtcatttcctccttccttgaccaagccctgtatctaattctttaggtagcacacatagaggttctaagtaatgggtgatgttaataacagtattttgatttttcttgcaaatgaaataatagtaattgacaattacaaaatgctttctttttaaaagatttgtttattttatgtacatgagtgcttagtcttcatacaccaggaggagggcatcggatcccattacagatggacctctgaaagagcagccagtgctcttaaccactgagccatctctccagccctataaaatgctttttgtgtcat

SEQ ID NO: 24666 - DNA, 1143 bp, Mus musculus
caaaatggtttttaaaaacaacttacctattttatttacatgagtacactgaagctgtcttcagacacgctagaagagagtatcagatcccattacagatggttgtgagccactgtgtggttgctgggaattgaactcaggacctctagaagagcagagccatctctccaaacctcaaaatggttttaaaatacttttcttgtttcctttaaagaatcatttaaaagcacttgcatatctggacctggatctttgtatcttttagcagatttatatctgtcagtgttggtaaccgttgtttcatatattttgcagcaaatcatgtttgagatttttccaactgtgtttcttgtttggtgtgcagagcattactgtatggcgggatgcgagagtcgcagcccgaagcagagatccctctccaagacaccacggccgaggctttcacgatgctcctcagatatatctacacggggcgggcgacgctcactgatgagaaggaggaggtgctgctggacttcctgagcctggctcacaaatacggatttccagagctggaggactctacttctgagtatctctgcaccatactgaacattcagaatgtctgtatgacctttgatgttgccagtctctactcgcttcccaagttaacttgtatgtgctgcatgttcatggacagaaatgctcaggaggtgctggccagcgacggcttcctctccctgtccaaggtgtgttctgctctacgctcagtttctcggcatgccttcttgtccttaaatgaccataccacagtggtccaagaatcaaaaccctcgctcaaagcagtcatctggtctagcttgtgtccctggctgctggagcttcagatcttacagggctttggttccgtttttctttgttttcaaggtttctctgggctgggcgtggtggtgtatacctttaatcccagcactcgggaggcagaggcaggcagatttctgagtttgaggccagcctggtctacaaagtgagttccaggacagccagggctatacagagagaccctgtctcaaccccccgcccccccccccccaaattcttttttctcaaggtttctctggtaagttttatgtgcagaagagactggtctgctcagttggattt

SEQ ID NO: 24667 - DNA, 1362 bp, Mus musculus
tttttttggtttttcaagacagggtttctctgtatagccctggctgtcctggaactcactttgtagaccaggctggcctcgaactcagaaatcagcctgcctctgcctcttgagtgctgggattaaaggtgtgcgccaataccgcccggcaggctgcaacttcttatgaagcagcagcctttgcagtgtctggcaagggtcctcttgacttgtggacaggcactttgccttgtggacaggtactgtgccttctcggggcagaagtttactgcaacatgcatcccattccaggaggctccacctaagtaatttgccttgtaggagctcatttccaagtaccattttggggagtgggcctagtcagaggaatttcgaaggaccccagagttgtcccatagcatagtacacagaccttgacaacttggttgtggagggacctttgttctcaagatgctgttagaagcatgggaaggcccaagggcatgcactgcagagttggcctgcaagaagtcctgatacctacagcttgttcatcccgtcacttgacacatatatgatcaaagatggctaaggccagtcagtgctgtgtgtccactaaaaacggccattgaaaggaagtaacctgggattcctcacttgtctaagggctgaaagtgttttccaaggctctgcagccaaattgatctccttacgttctggaagaccaacagttttatgtgatgttacttatttaccatttcccagtggggggggggctctgactttgtgtggtgacatgctgaaatgaggttttgtttctttaagtgggagttgaaatgcaggtgaaatgctctcatcccgaggccactgtatccagcaagatcactaacataactcatagcctactgaggttatgcttgtcaacttctctcctgtaaacttaatctccggccacctccttttctacactgttctcttcagaggaaaataaactatgtgaaactccaaactgaggagtcatgaggctggccatgagcacgtggagagagggggaaggggaatgagaagagaggggaaggggaagggagcaagagaggagggggtgtgagtcaggcacacctggctgttgccaggtaactgtgggcggagcctagactaaatgccaacttgaatgacatcacaccaaccaacatcctcctccactaaataccacttgtcaaaccaactgaaaacgggcccccacacatttccagaatgacccctaggggtcagtactgctccgctgaaaccactggtctttcttaagatttctgattctagtttcttcaaagaggaatgggtcctgatagcgtttccaagggaatgaatgggcagagtcttcac

SEQ ID NO: 24668 - DNA, 1623 bp, Mus musculus
tgggtctctctgctccagttcaaatcctcctgaaacccttttcattgtcctgattcagtgggtttttaaaaatctcccctctgttttgccaacctaattttcaagtagcaatttatcttatgaccttgacaaagttgtgtgactttacatttaagataataattagaacagctccctttagagatcacagttgctactgcctgtctcttaaagactgctcaagtctgtttctgattcatcatttagaattttgtttcaaatgtttctttttggggtctgttaccttctggggtttcagttcctcagaaataactttccataatgggaagtacagagcagtgaacagaaatgagatttttttgtgtgtacttcaaacagcatagtgtttatcttacaaaagagaaggtactcctgagagcaattcggaatcatgctgacaaggacacagatagaaatactaattttctttttttcttttttctttttttttgtatgtataaagtactttcagaattcaaggactaactttacttttctgggaatacggaggaggaagggattagacaatgggccatgctgtagcatcctttatgtaaataatgagtactgtggttacgacagacaaagccacctgattggtctgaaggcttgggcggtcagtgtttctagtagctgggttatgcctatgcctcatggtacctcctgccctactgaggaacctgccgggagtctggcctatgctctctgctcacacttgggcttgaataccacagagaaagaagcacagaggtcaatagtacaaggctgctctaggggacacctgtgagtgagccccacattggagggagtcttccccaccccatggtcttcatgatgcttgtaatcacgtagcatgttatgttcagtgctgagtcagatgtcgggcattagctctgtggtcttccctgctgacaggattaatggattctcagaggtgatttgaagactcaacaactggaggacaaaacccaatttgaggtcagactgcagcgaagtttcctgcctgctgcagtggaagacgggcgtgggcaatgccaagcgctacacagctatgggcacttggtgatctatgtgagcagtttaaacacatcataggctgaaataaagctaacactgtttagtacataaaggtctgggcagcaagtccctttgtgtaaaaggctggtcttgaggcctgaaaggattcaaaagaagtttgcgctgaaccagggatacacatgagtctgtacagactaagccaggtagcttctatggttgaaaaagcatgggaaagaaaatgtcaaatcaaaagatttgggggaatgaagtacattcaggagaaagaccagatatcaaaaggtgggtcacaggaatctaggagggccagtttcaaatgtccaatgctggaatcaccaaatgggattctaatactggacctacccaatttaacaatgtgaaccatatttctaggggtgggaagtacttgctaggtgagtcttgccaggacataatccttattccttaagtgtgcttctgtatgcattgaaaagcatgtatgtggccaggccttggcaggagttgggacagtgcacttgcaaatacact

SEQ ID NO: 24669 - DNA, 1197 bp, Mus musculus
tcaaaagtcaactcacaacttttttttttcttttttcttttgagacagggtctcatgtagcccaggtcagttttgaatgccctctgtaccccaggatggccttcaactctttttttttttttttccagagacagggtttctctgtgtagccctggctgtcctggagcttactttgtagaccaggctggcctcgaactcagaaatctgcctgcctctgcctcccgagtgctgggattaagggtgtgcgccaccactgcccgtagccttcaactgttgatcttcatgcccctaccttcacaagtgctaggatgaaacctctatgcctggtttatgttagaggaccaagcaccctagcaactgcattccatatttacatgtagaattatacctttataaagcacgggatctttctcttttctgtagacattacagcccagaaacacaccttgtcactgaacacactgggcacttcttcataatgtctcattttcttctctaagatgctaccataagcatcgaggggacagtgatgttgaagaaggtggacaatatcgacttctccaagctgcacacctttgaagaggtcacagctgcagcaagcagctcggagatggtgcatcagctggaggaggtgctgatggtgtggtacaagcagatcgagcaggtgggacccctccctttccccttgggctggagtcttgtgggtcctagctatgacattttgtccctgatggttgggggcagttgtaaagcgattatgaatattctgtatatattaatgaatgctggaaattaatatggtggaaattattccttaaccagctagttaaccacacagagaggcctttttagtatttcagagctgaggccttagctgggcagactctcatcagctcatctaagttaacctgtctacctagctcatccagccatgtggctagctataccatccaggcccgtagtcatgtctgtctcctctcacgtctcttggcaaaatcacttgctctttctttttcccagagctcctttctccctcccaggaagtcctgccttctacttcctgcccagctaactggtcatcagatttttattaatgccaatcagagaatgccttgggtaggtgaggaaggacagagacaggactttacacagtgtaccccatcaggcagtggagggagctaatttgttgaagtcctt

SEQ ID NO: 24670 - DNA, 1215 bp, Mus musculus
tactccaatgaaatggagggtggttaggggtttattaggtatatactgatgccaatgttaagagtaaatgatcacctgaaaaaccttcacattagagcctgccagtctaccctcctgtctttcagctgcacttacaggttttggtgagttagatgtcttgtcccaattttttaattcaatgcttcttacaaaggctattttgagttaaaaatttaagatagtactgcagttttcctttcccatatcttaaatcattatttcttgtttatgcatgtgtgtgcagaggctgtagtacaacttccaggggttggttctctccttagcacaaaggctgtggcaccgttatctgccgagccatcccacctgtctgccttttctacattgttaattggttctgatgtgagcctacagcgtgggggcaccttggctttcacagctctaagtcaaagcgcccagcaaggtgacttctggtcccttccgtgctaatggtgctgtggtttttatagcacacagaatgtgcgattgagattccatgacccgttctcttacctttcctgaaaggatatctgcatatctgccattaaggagaaggacatcgaagccaagctgacacaggtgattgagaactggacctaccaaaacctgagttttgcagcgtttaagggcaaaggcgagctcctgctcaaaggaacagagtctggagagattatcaccttaatggaggatagcttgatggtcctaggctccttgctaagcaacaggtaattttattgtctacgggtatgatttaaatttggtgtttatagcatcacaaatgactaggtacagcctagttttgtagctaggacatttaatcagattctgctccactgttcaagcttttgtgcatacctgtacccagtgtgtattcttcctgagaatgtgaccactccatcactcttcagagctaacatctcctgtatgttcccaggatggaggctcttgtacatgttagccccaggctgggcaatcaaccagcactatgctccctacaaagagaggagccacccagtgagagcatttggggttacatttgtaaccccagccctcacagctgatctcaggtttttttttttttttaattacatgtatgtgtctatcagtctgtgtgtatgccacatgtatacaggtgcccatagtggactcctgaagggggcattagatcccctggaaccg

SEQ ID NO: 24671 - DNA, 1749 bp, Mus musculus
gtgtgtgtgtgtgtgtgtgtgtgtgtgtgtgtgtgtgtgtgttttattccatcttaaacaattcgtggcctatcttttatcttaagcttgctcctatgccttgttttattaatctgcctatttaccagttgggagtgcagagtggttggatgaattttgtttgctgtaagtagacaggttcttacattgctggttcccatggccacccaccttcctttgatgttttgttagaaggtcaccagcactcgtgtctgaagaatgacagtgaaattgtcctctggcttccacatgcatgtgcatgcacatcagtaaacataatgtgcattccccccacacatgcacacacatagagatatagagattagatagatagatagatagataaatagatagatagatagatagatagatagatagatagatggatggatcacaggtagcctttaggaaccaatgtccaagtgtcctgtgctttcactgaggggccatctacagtatgctttccattcaggaagaggtgctgacatgtgtacaccaagttgtttacatgatgttcctactcagggaagcctgtgtgggatttggagccagacgatcatgttagagctgtccacaactgtccagactcccagaagaaaaacaggccttcaccatgtatcggcagtttaagctgggggtggagggatcttattaattagtaatggaggagatagccccaaagccaagttcctagataccaaccaatgggaagctccccaaacatgcccttctccaggtcaggcccactgctcttgactctggccagcagagcagcgattgctgctgcctgacaggaggggccagcacagcagcgattgctcctgcctgacagaaggaaccagagctaagcaaactgtcttgagagtcaagttgggaagactagccaatcactggacacttgaaagtattggttggaggggtggagggggccattcttaggctggcagcttcttcttcagggggaccatgaattgctcttgattaccatgctcaaaagaattgcgctcttgataatgtctggcaaacttggaaagtggttgaggagcagagaagagagtactgatggtggtggtgtgtgtgtatgagagggagagacagagacagacagacaaagaaaaaaagggagacagagagagacagagagacagagacagagacagacagagagacagagagacaggggggagagggagaggatttacaggagcacagtagtaaattcacagtgacaattacttaaagcacacaccatgctctttctttcttgtatgctcctcaaagatctccaatttatttgcccgagacgagatggatgaaatcacccaaggcctgatatcggtgatgaagagggagctgcctcgacaccctcccacctttgacaacctgtatgaatacttcatcaccagatccaggaagaatttacatgttgttctctgcttctccccggtgagtctccattgctcatgtggcaggatcatgcacctgataggttaccttcttggacgacatacttgaccagaaacaaaccattctttcatgagactaaaatgacttttttcctagtacaatggatccgtggacccatatcgcttcaccagtgtggccacttaggaatatatgagttatttaaggttgctgcatagtttaccagttcatgaatcatcaagagacattattatttgaattgtgaagactttggtagccgggcgg

SEQ ID NO: 24672 - DNA, 1149 bp, Mus musculus
acatatatgtgtatatatatatgtatatatatgtatatatatgtgtgtatatatatatatatatatatatatatatatatatatatatatatatacacacatacacacacacacaatcagcctaagaggacaaacccagatttatctattagtaaggacacatattacattcttagtacccacatcaggtagctatcagcccctgtacctccagatccaggtgggggggaataactctctcttctggtctctgcaagtagtaccctcatgtgtatagaaccatccacccacacatacatgggcaaataaaaaatatagatgctaaatattgaaatttgctttctaattctgaacttaattaacattacttggctcgtatttgcaggttggtttggttctttttccccactagataccccaaatggcaacacatgcttaagtgctttccattgaaggttataagctctcagtgaccaaccaccacattcctgttctttgagcgggcatcccccccatttcctcctcctcagattggcgagtggggcctgcagggactccctggagatgacttgtcaattcagaatggcatcattgtgacaaaggccaccagataccctctgctcattgatccccagactcagggaaaaacgtggatcaaatcgaaggaaaaagaaaacgacttgcaggtatgtctgacttggtgtgtatgtgtataagtcagtcagtctgacttggtgtgtatgtgtgtcagtcagtctgacttggtgtgtgtgcgtgtgtgtgtgtgtgtgtgtgtgtgtaagtcagaatgtgctctcagagtctcagtagactctaaaagccacccaggaagctgtctgtgcacctcggcttgctgttcctgtaacaaatactcgttttgctagaatttccaaccctaataagcccatataaaagataaacaatctggatattataattataagccacatgcttagactggacagatctaaccttgtactaagttacaccccccccccccagctgttagaccccttgttacttgtggtttctcccagccatgtggttctggtccatcatggcttccacctcctcttcctccatcccctcttgagtcccacctttccctcccactgcccaatcacaggc

SEQ ID NO: 24673 - DNA, 1197 bp, Mus musculus
ctgagtgttacttcctctgcgttactgacgtgggcttcatcaagagtctctctctctctctctctctctctctctctctctctctctctctctaggcttcctcacagcaatgaggcaagaagtgacccgagctcacaaaggctgggcgctggacactgtgaccatccacaatgaagtcctgcggcagaccaaggaagagatcatcacgcccccagcggtaggtgctgtgggcggggctgagggtgaaaccttctctttgagggccagggatgtaagtgcagtaagcagtcaaacaggtgccccgtgggcaaggccctgggttcagtccccagtgccacaaaaacaaaacaaatcaaaacaaacaaaattaaaaactggccttggctctctcagtgaagcctgcctgctcttcagagagctttttctctgttgtaactggacagtcacaaggccaaagcctcccctagctgctgagtgggaggttagtgacaaggggtaatgagcccagggactccatgagtgatatagatagatgcatagatacatagacacacacacacacacacacacacacacacacacacacatacatacacaagttcggtacatgtttgcttagcttagaaggatctccgtgggtctccagctcctgctctgggctcacagattcccttgtagcagctacaggctgctgaaatccactgaactgttgggagctcagttcctacaccgtcccatccctctgtgtattttgagacttctgcgtgcagagagtctgccatgctacggaggtagcaggcccaaagccctctgcttcttcgacccaggcatgggcaagttcttcagtgacttgaaacctatgtgacagttcagcctctctgcaggaagtcacagggctgcaaacgccatctccgaagcttggcgccagatgtgacacagcagctcaacaaacttagtctttctttctccttttcttctgtccattccctcaacaccgaggagacttgaacacacgaatttttgagctctggacagttttctgccactttgtaactgggaatcttccctccggttactagaaagttgcttatgactctccacacaccccgacagtgtatatttcttccatctccccctttaaggtaatctagggtctctctgttatgcattccaaggttcttgtatcttctacctgtt

SEQ ID NO: 24674 - DNA, 1148 bp, Mus musculus
cccagacccgagtagaacaaaggaaaagcctcctcagggagtttagaccgctgggggggggggggtcctcatcagggttaggggtggggtgtgcctttccctttcaattgtccaagccacacagggagagccttttataaagcgagactccatcttctctggctcaacctcgctctcactctccacctcactctttctcttccgttgaataaaactgtgatggattgtaaaaggtacttagctgaatcactgaatttagagatagaaagggccaattaggtcatcaagcccatctctctccagaggagaggcagaaaataggagacaacaataaacaattttattgggatattaatttaggcgcctgaagaccttggctcgtgtcttgtaatataatccagtggattttttccccttctctgctaatgtaataacagggccattttgtgggcagttggtttgcctgatggcttttttttttcttctctctcttctttcccacggaaggtccagatggagtttcggaaatgctgggagcgctggaggctggagcacttgaatatccagagagactgcagcatgaagcccctcaagtgtcccaccagcagcgtcagcagtggggccacagtgggcagcagcgtgtacgcagccacctgccagagttcctacagctgagccccagtgccggtcctcctgtggtccttgcttctggctgggtggccatcccaggtgggagagatcctggggatagggaatgtgaaggacacaggcacaccacacacacacacacacacacacacacacacacacacacacacacaccatgctttctttctctaaacctatgaagcaggcaagtgggcagtgcctcctgggacctaaacacatgtcctccaaggagaacagcctgctaatttaatcaccgtggcaggaagagaggaagaaacaattgctgctaagatgaagaggacttcttcctgtttaaagccgcaagacccttggggttccattggacagaacagcaaatcaacccggactcacactcaagggcaattgctgatgggtggaattggggcttccgagaagaggccatgagagacctgcccttggaacctcagccagtccagagctcagcaaggtgagccggc

SEQ ID NO: 24675 - DNA, 1189 bp, Mus musculus
gagaaggtcaaatgcaggctccgggtgagggagacaccacaccagctgcgctggggcagcagggactaacgcaacgcaatgcaacgcaatgcagacagtgctggggtacttggcaggctcctcccagacttcctttctcatgtgcttcttagcttaaaactcttcctagttttccagccactttcattttgcccaagaaatactcgatccaccttgtggatgtttaaagacccatttcccctttcttcatgaatcacattaactacctccaccgagcctgggaagccggcctggggacatatcgggtgtatccctccaacttgaggggagccgtggggtgtcaaggatgggcaggccggctgagtggaaggggaggtgccatggatgtccccgttaagaaaatgcagctgctcgcctcttccagagcaccaccatctaaggtcagcctcctacaaaagtctctatttttgagggtaggtcagtttaacccctgtgagcctcagtttccccacctgtaagtaattgcactagatcatgtcttgacaggtcctgagattcctcggctgtggccttgatgctttcgtatcttatctgtagagaatgataagggtccgaattttacttaccgcatggataatgtgctttggaactctttagagattctttttattttttacactcctagatcttttttatagagaacacacaattgaaatgcatattatgatgtaattttcggtttgcttgttctatacaaacacggccttgccttctagactcagcttttaaccagggacacgattcgcctttataaaaaaaaaaagtcttcattaaaaaagaaaacaccaaaaaggtcttcatttaatttcaagataattaggcatggcgtccagagaggaactggctgctattagctgtgaagtctgagctgaaaagaatgggtgttgggtggacaaacctcagtccggcacttgatggggttggtgccaaagaacccattccatccatgtccgcacgcatgtcttgacatggtgggtcatgcccggcaggctctgtctcctcggagagctgtgtgctgtcagtcacaggcagggtggtccatgtttcactctggaagggttcctcagcctctggagggattctttcctgtccaggtttctcctagaccctgagacctgcttgtcactca

SEQ ID NO: 24676 - DNA, 1138 bp, Mus musculus
cctgggaagttgataaaggatgttgaccagaacaggcgaggggtcagaggtcacccagcattgctcaagctctgcagactcgaggaaggctgacagccatcctaggggactctgcacccttgtcccttatccactgtccataggggccatggtgtgtggttctacctttccccatacatagcccgaatcccagagatgctgcctggatttctagaccattcccttttcttcttcttcttcccattggtcttagtcatggtaggagataccgggaagtgtgcgcctacctgccacggacgttaaagtcagacttcccttgcagttgggttccctagaaggtgagttccttcagttgaaaggaaggattgcattgggtttaaggctacaccacctcctcctgttggctgataaaataaaagtcctcacgtaaaaaacaacagcccaaggacagaatttacagggctttgtcagagagaggcctgtggggccgtgtcagattgaggctcagaaaaggctgagcataagggtggggctgctagcctctgtctacccctttctttgtccaccccccacccccacccccaccccagtctctcctgcctcctcttctaccctttgtccagagagagttaaactctctggtgttacttctagggagtaggggatgaatcagcgaatgttgcacacagtaggggcaagaatctttcttcttcacctggaggtggagagaggcacccattagaaccagaaaatggaacatgaagcttagaatttctgagaaacccaaacccaaggcagggggcagacaatatctgcaaagcagaaaatacccaagtgtgcccctgacaacagaaaaacagactgaaggcaaacaccttcccttgggaagtgtctgggcacagtgcaatcccttctggcttctccatctagtagtcacccatcaaaccttcattgatctgattttccccctgttccaggccccgaggccagggaagacaccttccttttgggcttactttcatgggcagctactctctctttctctaggtagcattggggcgggaaggggctggcaagatactgagggccatcagagcccctgtcagacatctgagtccctgctttctggcttttccag

SEQ ID NO: 24677 - DNA, 1337 bp, Mus musculus
ttgggtgcagttcctggtccgcctcatacacaaggagttgagctgtccaggcccagccgcagggatccaggctccgtaagtccactgaggcctctctggagagaactcgactctccaggcagcccgacaagaaggaaagaacttagcagtcatccccgatcttggcacaccgcagtctgagtgcctccgtgtgggtgccattctgcaatcgctcctcagactcccagggaggggaatgtgaggaaaacgccttgtttgtggagtttgtgagctgcggcttcccagccaagacagtctcactagcagctgtcttcctgtccttccgtgccactgagaagcaatggggagggcacagggctgtgtatgggtttgtgtgttttgtgtatgttcagcatctgccatgtggcccatctgtcaccgtgtcctttgctttttaggctgaaggaacactgaccatggagtcctctggagtgcctgggcccatcttacacacacagtttttggaaaagatgaagtgaaggatcctgtcccacaaaggaaggctcgccttaccacgtgcacctgggagcaactcggacttgccgtatagacagacgcggagctcaggctgacagtggggagtctgtctgtctgtgtcccactgccttaatgggccaagacccagtggtccagccagccccagcctgacagatgctcactgccctttagctctgaactctagcctgcacagtgacaggtaggactgtcctgaagcacccaggtagcccacccctctcaggtatcaagtgcagaatgttatatagcctgtgagccccagccatcccgccccgctgtttcctgaatgttcacagtgaaaggatgggacatgtcacagatgtctcagcaaccaaccaacagcctctgaatagcatgtgaaagcctggtcacagtcagagactgagctggagtccacacccagccatcatgaaggcccatgctcaggaccagccacgtcaagatgtgaatgtctgtgaagcaataagtccccagcaaggcaggggcactaggaaggccagttccaaagcaccggcgtgtgccgcggtccccagaagaatggagagagcgtggtggctggggaggggactctgttggttaccgagagcaatgggtctcacccagccatcccactcatcccagactggggttgtttctagacccacagggatttatttattttaaatgtatgatgtgttatatagattttaaagagacataaatggcattttgttatttattaaggcaaaccatgattgttccgtggccatctgttgtcttgattgtatctgctctttgaaata

SEQ ID NO: 24678 - DNA, 1397 bp, Mus musculus
aacaaaaaaaaacaaaaaaacaaaaaaattcccaaggccatccagtgagaggaggtagtgctgggccatgttccaagtcactcacctggcatctcttcttgtccttgtcataggttctgttggtacagatgacagcttccgcagcctgtacaaggccacctttgacaacatgacctcttacctgaagaaaaaggaagagagactgcagcagcagctgaagaagaagcggcaaaggagccccttcccagggtccccggaacagaccaaaaaggcgtgcccgggccagtcagcccttagttgctgaccttggacatggccacagctctcattcctgaggccctgtgggcagctctctccctcctcctccctggttcatccctagggagggagatcacggcagctcagtccctaccactagctcaacagtccctgatctccagagtctgcctttgtcactgagaacaggctcctgccgggttgcagggaaggcaggtggtgttagcttagctaagagtctagagctgtgtggaagcaccttcacattgaaggatacactggcccacagcaccacgcatgtctgtcggggcccacagtgtcgtccctggggagctctagggagacctgcaggacaggacctgccttcacatcattgccgggggctctccaggtggagctctgtatggctctgtagctgcttgctgttttgaggcagattcagttggtgctgttcgcactcctgggctgggctgagcagactgagcaagctttggggctctgagggtgtgaccttgccaggccagccttgttttacagggaatgatggtgacctcgtggttctgttgctctgaactctgcatacactgcagaacagaaggaaatgaacagaaatcacagcatcaataaagacaaactttgcatagctttctggaatgttcagcagcagcctccatagctgatcttaagacattcaatgtgtgtatgctcttcaaatgacatggctcttggtggttagagaggggtgttgtccagctctgtctattctcgtgctatttcccagacgagctgcagcagagaccgtcttgggttggggagatgagacccgagtttaggtaccacccaaacatacagaacaaaggaaggccatagcctagcataactgtaaccctaatactggagctgcagactgaggcagcctagcctaaacagtgacattttgggctctgtgagatcctgtctcaagatgaacagtcgaggaagatgcccagtgtcatcgtctggcctccacacgcagtagaaatagtcttgtggccacaagcagctatcagtcgaatgggtggtgttcacggagcagggtgctcacctctgtctaggagctaatgtcacgtgttctggatgct

SEQ ID NO: 24679 - DNA, 1100 bp, Mus musculus
actatttcttagatggcataatttatgaaaactgacagtctagaatcaccacgcataaccttggaggatatccacgcatgtagctcatgaacttgcccaatactcagctgagtggaaagcagcacaaatcttgtggtgctctcaaaagtcaggagcagcagtcacacggcagtgatagccctcgggtggactgaactagacccgtaccttagtgaactgaaggagtgttaacaggcaggcaaccaggctggagagatggctcagtggttaaaagcactgactgatcttccagagttcaattcccagcaaccacatggtagttcacaaccatctgcaatggggtctgataccttcttctggtgtgtctgaagagagcaatggtgtactcatatacataaatcttttttaaaaacaacaataacaaaccagacaggtaaccatggacagcatctgcgggcttttcccagcacaatgggctgtataatcgtctactgtgagtttccaatgaggggcttttcaaggggtactatactcctatcgtactaagtggttttgcacatgtgtgacacctctctgagcagctccctaaagaacagcaattctcgccgggcggtggtggcgcacacctttaatcccagcacttgggaggcagaggcaggtggatttctgagttcgagactagcctgatctacagagcgagttccaggacagccagggctatatagagaaaccctgtctcaaaaaagaaaaagaaaaagaaaaaagaaaagaaaaagaaagcaggaattctttgatttaaaatccgaagttcccgagtcctccttaagatggcagcatcgccgctaacgaggccttcctgcacctgcgagtcattcccagccacgccccctcctcacctaatttgcatcaccatggtgtgctaactatcgctcttccgggatgtttacagcatttatgttttcttcctttaacatttctcctccttcactagttaaccatgtaccagtgcacgcctgacttctaagacctcgggacctgcctttccgaccccgttccagttttcagacctgatctcaactagagatcttaaacctagcacg

SEQ ID NO: 24680 - DNA, 1155 bp, Mus musculus
ctcctgtgtccatctgtaattccagatccttccaaatgcacagtgtgaacccagggcttaaaaatacaaaaaggacgggcaaggtgctccgatcctgtataagaaacgaagcagccttgtcctgtcccctatctgagaggttagactctgccatcttattaacaacaacaacaaaaagcagagagtctcctggcaggcctgtgccacaatctcgggaaaggttagcgtttttacaatggcactgcctccgtgtgctttgtgattctgctcagccataaggttcggcatgcacttcaggtgactcttttacattgcccttgaagatgcagggctctcaaggtctcctgtctgctagttagaaagctcacacactataaactggtagtgtggagacttctgcttcctaagcgccccagacagatttgtgtgtctgacagctgtcttgtcacctttctccacagagcccgagccgactgacaccaccacctacaagaacctgcagcaccatgactacaacacatacaccttcctggacctgaacctggacctctccaaattcaggctgccacagccgtcttcaggacgagagtcacctcggcactgagctcagctcagggtagaccccgatgttggttcccatgaatccttgcctgtgagaataaaaggcagagtcacaaagctcactatgtggttatttcccctcgcacctcccagagaatgacttagcgacaccctgattactcgtatagtctacgtggttctgtggcatcccccagtggccacagtgaagtggtcacagattcttccaggttagagtccgtagctccgggagatgtttaacctcatcatccctaacaaggccagagggaacgttctatttcagagcacacttagggacggctgtgtaccacacccctcttaacttgccagtctacagccagccagagggatccgtaaaaagagaaacaaagcaaagtcgggctcactcagcctcatactggtcggcagcagtttctgccaggtctgagccacagccccagtgagccggggaaggcgttacactgatttaaacatgacacaaaaattgcaggatatttgatcacactgtggaccctgagatttactgggaaaacctgcttttagttgtgctgtggc

SEQ ID NO: 24681 - DNA, 1132 bp, Mus musculus
atgatggtgcacgcctttaatcccagcactcgggaggcagaggtaggcagatttctgagttcaaggccagcctggtctacagagtgagttccaggacagccagggctacacagagaaaccctgtctcgaaaaaccaaaccaaaccaaaccaaaccaaaccgaaacaggtactgacctagcatttgtgaagacctgggttgatctcacccctgagaaataaaaaagacagaaaacccagatgggtatttgtggctttgcaatgctagtaatggagtttagggtgtcacgcttggcaaacacttaagtgctggccccctttatctgggtgttctggaagttttggtgttgagacagtctttctgcatagcctcgactggccttgaactcccaatccacctgccttgtcctaagtgctagggcataggtgtgcaccgtgtgccttgctctggtttgtttttaatgtttgcttgttgcatacagatgcacatgtcccaaaggatacatgtgtagaggtcaggggacaagtggcaagagtcaggtctccttccactggtcgggtaccaggctctgaagtcagcttgtcagtcttggcagcaagtgcctttatctactgcaccatctggctagcccctatatgttgtttggtgagacagggtctcctgctcttggccttaaacttgtggcagtactgcctcagccttctgagtatgagaaagagattacaagtagggaatcctgggtctggagagatggcacagaattaagattgtatattcttgtgctagagagatggctcagtgggtaagagcactgactgctcttaacagaggtcctgagttcaattctcagcaaccacatggtagcttacagtcatctgtaatgggctctgatgccctcttctggtgtgtctgaagacagcaacagcaacagtatacccacatacatgaaataaataaataaatcttttttaaaaaattgtatattctcttacaaaaaattctatattctcttacagagcatctgagttcagttcccagaatccctggcagcttacaactgcccgtaactccagctcatatatatgtaaatcaaaataaaataaaataaaatgggaatcgtatggctttatctc

SEQ ID NO: 24682 - DNA, 1197 bp, Mus musculus
gttggcatttgtgacccattgcctgagagcaagtctcctcaatgcttgatgatgtcacattaaacaggagagaaataattcaagaacaacttgggcatctaaactaggtgaagctttcttagacttgacagcagatgcgtgatccaggaaaggcagagctaggggttgaacttcgaaccccctataggatgggtgaggatgtggagatggagtcaggtgaggccgcagcccggtcatcggcaagcactgagccacactcccagcacagccatgctgaaggaggaactctgctctgtatggcacaggcgcagccagagctgagacagaggccctagagtgccgggacacaatgctgttcatcttctgtcaccagcactgccactgttgccatctaaagagcggtgtgtgccgatggcgacatagggtacggatggacagcacactgtttcccacttaaaagtctttattttctctacctctagatggtgaaagcaatccaggtcctgcgcattcatcttcttgaactggagaaggttaatgagctctgtaaagatttctgtagtcggtacattgcttgtctgaagacaaaaatgaacagcgagaccttgttgagtggggagcctggaagtccgtactcccctgtgcaatcccaggtacttgccttctggcccagcgtgcttcttggtctctgtggtattggtcactcagcgttaaccctcgagaccgccagctcctacacaattgctggcttccttgatgacggagactcttagctctttttcttcactgtaagcatttcagggaatgtagccctagatattaagtgtattcttgctgctgtgtgaccatcgccacctctgggaatccaggactctcccatcttcccaaaggaagtcctcactcattaaatataactcatcctgctctccctggccctgtcattctctcttccatctctgaattgactgactaggtttctcacagaagtaggctcctacagtatctggctaagtgctcttctcagagcacccagaaatctagtcagttttaaccatcctggtgtgtggtggtatttcatcatgaactttatttgtattttatttgtttattccctgatagcaagtgatattttcatgtgctcacctgccctggccttgtctttgttaaaagtctgcctatgtcttttgatcattcttt

SEQ ID NO: 24683 - DNA, 1803 bp, Mus musculus
gggtgcccaccacacacttcagttctctcaggcagcatttgcctgtttcatttgctatatagaaaaagaaactcctatttttaccttgctgggattattggataaaaagctatttttataaatcagttattaattggattatgactatattgaggataaatttctagagaagcaacagcacatgcttgtctttcgattcggaatgttctgaaaggcggccacctgctcatggtctcctgctctctggggaggagagggctcgcctcagctgctaaaaggaaacaactgtcaagtgagcttttgacatctccagtttctgctcatgtgtgatgcagactgctacattttacactcgctagagcatcttacacagtgtactcagtaggacgtacggtaagtgagggctctgccacgcctagtctgactgcagttccatggctgcctggctatgttaactgggtggtaattttagattttttttttttagttaaaacctgttatatagagaatgtttattataaactaatataaagtgtgttctgccccactggctcagagctggtgtaaacagcaaacacctaaactgtctttcttactggcagacacctagaagttagaaccatggctgtaacgtggcggtggggcccactggtggctctcactgtcactcactctccaggctcctccccctctctgttaccactacagactcaggacagtttgaggacctcatttctgagtgtcaaggctgagatttggtttggtttgtttgggtctacttgggaagctttttcttaggaaacaggcatctgtcttcacagtggtacctaggccacctgcagatagggaacagctgtctaggggtccctgccttgggccccacggttaccccacggttacctctttagctaattcaggaatagttcaccatcaccccaaatgtcttgattctcttcagccattgagcacacctgaacagccaagtagtcagcaaaaagaatgggggctccgtttgaaccacttaaggtgcgtccaagacagcaaaataaaacccccagaacttgccagcaactcctttgaggagagaatactatttcaagcagtctttcccttacctatttacaaactgttttaacagtttaagtccggcatacaaaagcctgcacgatcagctggctctattaggtttagagcagaagtacatctctcttgtgagccctgcagagctctgccagtccccaaaatggaagcacagcccctgctgcaccagctggtggcgctctagctgggattcgaacaccatgctctaccgtgtcctttccagttgaaatcatctttcctaagcacagaactctagcctgctaaatcaaaggaatatcatgaagatcgtaagagaaccccaggcacggtgacacactcctgtaatcccaacactcaggaacctgagacaggaggcaagcctgggctacttgaccctgtcttaaaaaaaaaaagctagtaaaagagctggcacagggtcatatcctttcacctccccgtgcacagagatgcttttaagtgctccccatgaggcgagccatgctggttcatagagtccctgcccagcagatttggtgtctgccagttgcacctttgagacacctgcttgctgggcacaatggcatattcctgtaaacaagcacttaggaggctgaagcaggaggattgctgcaaggtcgagttggcctctggtgtgtagtgaaacccagtttcaaaaaaaaaaaaaaaaaatcgagcaaaactcctgctcgcctttccttggcc

SEQ ID NO: 24684 - DNA, 1108 bp, Mus musculus
agtgagttcactgattctagatggttttctcgcaccccaaaaaaatggcccaatggactctgcctagcaagtcctgaagtaggtcaggttggagaagggctaagcatggcaagccagtgggtatcttctgggtgggcgtccagagcccactgctgcccagaccagcatttgttttgtgattgcccacagcatttgggttggttctgaaagctatatcatactgaatatacacacctgttcattttagaggtgcatctaaagttggggtgcacatcttaccttcatgtgtcatctatgcagtcagggctgtcatcttctgcttctgatacattttcttcttcttggttcaggcatagatccaggtcccgatccagggaacggcgttcccgatccagagaccgtggacgcggtggtggaggtggaggtggaggtggcggaggacgggagcgtgacaggaggcggtcaagagaccgggagagatctggacgattctgagccgagccctttttaccgtgtgtctgctagacagtgttgtagttggttgacaagccagttcataatgggatttttttttttaaaaaacaacaaagatgggtttctgaataaactttgtagtgatacagtattggtgtgacttcttgtaacgtctttgcctgcaattgcttttctaaaagtgctagcccggtatccttgaacacaaatctaaatttgggtcataaaatcagagcaggtgagagagggtaaggaactgccgtagtacctttaatgaccaggagtttccctcaaggcttgtggggtctctgcctctctctgctgacacagccaatgagccaatgtcctgctataacctgatcactcagccttgggccaccaaccatacttgcaagagagcatgtcctggggtgaggtgctgcagggtcacatgacttgtgtcttctagctgggacttcagtagctatgcagtgcacgtgccctggtagactggatggctggcgtgcctttctttacatgcccaggaaatgtcccatcagcactcaacgctgtctgaggtctttctgtgtggtgtctcctgtcctaaagcacctgtgctgggagatagggtacagct

SEQ ID NO: 24685 - DNA, 2836 bp, Mus musculus
tccttagggacctttatgtcagggatagagcaaggagggacactgggtaggttcagtaaccttgagagcaatggtgaccaagactctcctgttgagcctgacatctctgagttgccacaacagccaggatgtggggcaggatggctcagggatgtgtcacgtcacacacagagctatgtgaaatcccatctgcagctttgaggtgggtggggcccacctgggcagtgtggaaactgggcagagccaacaagggtgaccgacctcctccctctccgcctctctgttcttcaggctgctccagttacagcaccactcttctaccgccgccgcctcatctggctgccagcagggcccccagctgtccccggtcccctatgtgcttgctccctgtgacagcctcctcgtgtctggaattccactgctgccaacaccccttctccaggctggcatgtcccctgtggcgtctgctgcgcatctcctggatacccacttgcacatcagtgctggcccagtggccctccccactgggcccctgccacagtgcctcaccaggctgtccccaggctgtgatccagctgggctgccacagggggactgtgagatggaggacctgacctctggccagcgggggacattcgtcctggtacagtgagggtggctctggcccacatccccccaacctcgccaccttcaccacccccccccaaccgtggccgattgactcttccaagcaataatttcggagtatgtgaagatggtttccggactcaaaagccaagaactttctagacgtgaaacaagcaatacgtttggtgtatgggctttttaggatttttgttgttgttgttttttgttttgttttctccttgcactgagtgacctcaatgataagtagggaaactttctgaagaaaaataataattgagagtatgtcacgtgggcgggcggacgggagggaagggcagtggggggagagcggcctccgaggcgtgatgagctggggcatccctgaagtgggggcagctcgtactgttgctcatgcctgtgtagtggttggcgttgtttcaggcttgggttcacagctctccacttctgaaacgcgcatgctttagacagaaactgtgaactcgctgctttctgtgtgggtttcagagtagccaaggctcagcccaggggaagacaaacggcatgcattctcggggtctcccgtcagccagaagaccgccttgtcgtggttcagcttgggggtttttgtagctgctcaagtcagtgcgccaggcttattcagaggcctggaagggaggaagttccttccggccttgtacctcgactctgctgctaattatcagatttttatgcatttcattatcagggtcccgctagaacacctgacttgggggaattgtgcaataccaaggggctgtcggcatcttggttatgactaccttgcccttggcctgggacctttcctggtaaaagcctggccccccccccaaggcctgggctctgtctggcttgctttccaggaggatcataagtataggtcagtgtttgtaaagtttctttttaaagcaaatactgtatgtgtatataaataggaaacagacactacttatttttttctattttgtatacatttttgtgtttctggcttaaaaaaacctcccttggtcacattaggaagttgtccccatgtttgtggtgaaaggcctgtaggctacccacctcctgtacagagtagaggtgtcagggaagaagtggccccacctgacaggtctacctgggcagggaaggcccaggcaacagccgtgccatccaaacacctctggaaggaaccagggatgtcaacccttctgactcgcgtctgtctctctgcctcccgggcgacttccaccaccaaatctcaccgcagcagtattaacctgaggtcattaagggagaggaaaggagacacttcaaaagccaaagattgaccgagttacctgaggccaggaagaggcagcgccgaaacctgatgtcccagcgtggtcctccgtgggccccgtggcccatcctataccgcttactctccagacaggcgaaggaccgaccagtcttctgggttggaactggtgccctccacagaacaaaccaaaaagtgtccctcctgccgactcacctgatgtgtgcatcagggaagcaagcactcagtatcctaaggcagccagccctcatctcccatagttcctgtctggataccacagatcaaaggcctgtgcactgctgtgtgtcagaatcgacaagcactttactttctggcagtttttgtgtcttctagttgctatcaaccctctgggggacagtaacatcatggtttttagttcttgggttttggggttttgttttttgggttttgtttttttttttttttttttttttttggtgtgtgtgctatgtttttgtagatcctcacggccctggactggactgtaatggaatcgcctatttaaagacactacgtgatctcagatgtatataatggttttgttttgttttcgttttttttttttttttttttactatgatggaatcgtttcatttctcatgttaatgtgagagacgtatgccaaatgattagttgatgtattttttttaatttaatatttaaataaaatatttggggggaaatcttgacttacccttggttcacctgtgagagcccattcctttgagacactgttgggaggctctacccaggcctgccacagtggcctgtggccccaaatcaacaacaggcatttcctgccttccctccttccaaatgtgctctgaattcctttacaagttctagaagaat

SEQ ID NO: 24686 - DNA, 1117 bp, Mus musculus
tgctcagctgtttagcaaatctgcagtcgagttgggactgggtgatcaggcggcaacagaaacccaagccacaggtgctttccagtggcctacttacaactcagacaggaacctctccctgcagtccgtctccttcctataagcctgcctctgcagtccccccaccagccattgccccttcatctttgcaactcccccattgtcgattgcaaagctaagatgccagcccctcttacacacaaggctttctgtttcataactatgcctagcctcacgtgtaccacaacaggaggtacttagagagatagagcgtctttctctgcgtctggtccccaacatggtggctttcctctgtagcaggggaatctaaaatggcagcttcagacttcttgactgtcatgtgggtggtttttgcctgtgtgaccagctctactgtgggtgtaggaatgagcccccaggcccagttccgcatcctcagtgtgagcccttcccgtccacagactgtgagacgctgatcagacgcatgctggtcgtggaccccgctaagcgcatcaccatagcccagatccgccagcaccggtggatgcaggccgaccccactctcctgcagcaggatgaccctgccttcgacatgcaaggctacacctccaacctgggcgactacaacgaacaggtgctagggatcatgcaggccctcggcatcgaccggcagcggactatagaggtgagcaagctgtgtggtggccggctggctgtgcctagccctcatatcctgagatgctggtgggatcgggttacttgggaaaagcagggcccttgctgtggagttaaaacagagctacagtctagtttaagcgccagcttgtctaaggatattcttgactgcccgggagtcacctggaggagtctcacagggaagcctagtggttagtgaggccgagcgggctcgtcctgaccctaccatccctgctccctagtctctgcagaacagcagctacaaccactttgccgccatttactacctcctactcgagcgcctcaaggagcatcgaagcgcccagccctcatcccggcccacccctgcacccaccagacagccccagctccgaagctcaga

SEQ ID NO: 24687 - DNA, 1232 bp, Mus musculus
ccggaggcgggtctgcgagcgcccggttgtggagcctgtcctgaggagccgagcgttggcactggtggacgggagcgcggtgaaaacccgggaccgtagggtgtccaggagctggcttggggtcgactgcgggtggactgctggcgcgcgcgcccggccgggaccggaggtcggggggcgcgtgcgtgggggctcgcactgagggaacctgggatcgagggggcgcgcgcgtgggggcgcaggctgggggttcgggatagaggagtgtgtgcgtggggactttagccgaggagatactgtatcaaggaatgagcgagtgggggtgtgagctgcgaacctgggtcggggccacactaggagcctggggctggaggaacagagggttgaggacgcacgcgtggtggcctggcggacacagtttcagtggccgggtttggcggggaatgggatcgggaccgagccggagtcggtcggtgctgagcgcactcctcgctgacccgcaggtgcggcccgaagccatggtgatcatgtcggagttcagtgcggtcccctcaggcactggccagggccagcagaagcccctccgggtgggcttttacgacgtggaacggaccctgggcaaaggcaattttgcagtggttaagctggcgcggcaccgagtcaccaaaacgcaggtgcgcgcgcgtgttgtgtgtgtgtgtgggggggggactaaaccagggggtggatccagccagggggtggccccctgtgctgattcagtcctgtggagttgattgtcacaattgtaaacgatgacattgtttagtctggtaaagggggaaaaaagctttgtattatgcttctacataatttgtacaattactagggaagagcaaagataataatgaccagcaaccgcccccttccgagagagagagagagagagagagagagagagagagagagagagagagagagagagagagagagggagagagagagagaaatagagaggggggaacacaacagaagtgagcagctccttgtaataaagctagctgaaaaatacagaggctttaatttaacttctatccctttaaaaaatgttagtggcttcttttaattttttcccccaacttcttgtgacctcttgaagacatcaaatgtttgagaaattcatttgtccaaaaaaaaagtacaaatgaagtaatgaggttacttgaagtttttccccccctttttttcttttt

SEQ ID NO: 24688 - DNA, 1191 bp, Mus musculus
tgcggctcatccagtctgtggttctagaaccagacgtcttctccaaggtggcctctgagctccagagctccttacccttgcagcgcatcctggccatgtccaagagccgcaactcccacctgcagtctgctgcccaggagctcctggaagacctccgcgccctggactgtaatgtttagatgtgctctaccaccaggagcccggtgaaaatgccagtggtccatcccctcccaggcttctaactccatgttcaaaactagatgtcactgtatgtcatgtgttagagattgcaggccttgagggactagagatggacatgatgggtcagcatcctacctcttcctcctgggagtgcacacttgttaggcagctggttaatcttgccagagcagtgaccaaaaaaatgtcacctttgaatgcatggaaactctcaaagtgttttctcagagtagcttcttgctgccccggaggctgcctgcagcatgggagtttagatcactaaacaccatggtcagtgtttcccagaagcatttctgtgatggcctgtgctcttcccctggtaactggaacccctccgcacaggcttaccaacctagccttttgtcgcttactatttcacatgcatcggacagtcgatctctgtcttggtgctgcttttatttttgaataaagctgagtcagtatcacattctcaatataatcttgggtttaggaagtggtgtcctttgtacattaactatgttatttgtctaggaaaacactttccttattttgttctggccccttcactatgaacttaaagcaaatgtgggaaggtagcttgaagatgaacactatgagattaaattccattaaatggtcatccatctgcctgcactcatgtgcctgtgcatgtgtgggctgctgttcatgcagccatgacactacgtagcttctgcttaaagatactggcagaggacaaaagacaacatgctgccctgtcacaaatagggagatgtgcggcaggagatgtccatttaagtcagcatacaccatcccttctctggcaggacaagttgctgcagggcattgagcttagacatcctgtgagggaggaagtgtccctttgcagtggcagcctcggcacacatgttgagctgcttctctgtgtgtggtgttgtagagtgagttcgttttcttgtaagaggatgt

SEQ ID NO: 24689 - DNA, 1195 bp, Mus musculus
tcaggaagtagacagcacactgggaatggcacaagtcctttgagacctcaaagcctactcccagtgaggcacctcctccaaggccatcactcctaattcttcccagatagttctaccacctggggaccaggtattcaaacatgaacctatgaaccattcccattcaggccaccatgcactccggataaaacctatgattagattttagatggcttcattgaacctcaaggacacagtgcacttataaactgagggctgcctgagtaaatgcgggcttgctattacaagggctaagacattgagttgtgaggtttctctgcctgtggtttgatacacagaagatgatgtcacagtgctactgctaaagcttccttcccattatctacggctttctgtagatgaaaacattaaacttgtcttccactttgtaaatgttctacctagatatctgagatgtaaaaatgtctagatccttgagagtaggcaatgaactcaaggtgaaatataatgtggatagcccagcatatcaacactgtattcttttgcatttcagtctaatgctgatgtccctgtataatgtgagcatcaattcaaaaggcttgaaatacatcactgagagtcctggatttatccctttgctgtggtggcttttgagtggtaaggagccctttgctatgttcttgtgtggtcatatgctctccctccacagctggaggagatatcagtgtgttaaaaagcaggagctattatcttagatgtttactctttgaaaatgacttaccagagcagcttggccagctacagtttctctgtgctggagtggcttctggggatggaagaggaatactctttcatagtggcaatgttaaaatctgggcactctcagataattggcttctccatgcctgtctctgctcctcccccaaatgacttccaattttagaaagccatctggtatgtcagtggttttatagttttttcttaaatattgtttttagtttagttgtgacctttgacacaaagatcattttatgaaacagcactgacatgcgccttctctgaaagcagaatagtagctaggtggtggatatggaagaactccagagtctagacaaagtggtgtaggagacacgagaagttccatatggatgtaacttcagagctgtaaataaataaaacttaaccttactgctgc

SEQ ID NO: 24690 - DNA, 1099 bp, Mus musculus
tggcagtaactgatctgagctcgatcctttaatattatgaatgcctttagaaaggaggtagggactcgacccaatgaataaagaatgaaggttagagtttagatcctcagtacgaatggaagtggctggcaggtgtggagtctcatgtctaatcccagcacccatgaagttccaggcatcaaggcagctcacttggttgggaggcagagatgggactcctagagcaagataactagactagccaaattgataaattctgagttcaaatgagagacccaggggagagtggctgaggaagatacctggtatcaacctctgactctacatgcacgtgtgctcacctgcaaatgtgtggacacaccaaaaatggctcttaaagaattccccagtagatggcatccataagttctcgtgctttatagctggacctccaaaggcatgccaggggcttcagtgtgggtactagggctgacctgcctgccccagcgacccatcccagccctatgtacatccctcatagcctcagctttggttatttggtctgatgcataaagagaaccctagtgggcaaacctcccctgaacatagcagagcgttaagttgtctgccttcagaaacaagcgagacagacatgggatctcttggtattgtgtgccactgtgtcctatgcagagctggtggaatggaaagcacctttgtcctaggcttcttccttcctgactcaccgcatccctaggtggggctgtcccctagcctccctgtggaggagagagtgagcactgagtatccggattcccgttttatgttcaaaacctgagctgtgaactctgaacttccatgtgcttttttgttttttgtttttttacaggttccaggacctctgtgaaggtaagaagagttgttctcacccagtacacaccccaccaagggcagcccggccaaatccaagacttcgggtcatagggaaattaatccgtgggtggccaccctcattgcgttcacctaagcaagtaccctgggaaatgcctccatgcaagaccctttgcacatactttccatccatccggtgcctgcagtgtgtgggtaacacccatgtggt

SEQ ID NO: 24691 - DNA, 1826 bp, Mus musculus
agctagagagctggaggtgaagacagggctccgacagcttgcgccactgccaagcatgtgcatggacacaccgagtggaacttgctccctttgatgtatcttaggtgtctcctgcatttcaggggccttgggaatataagccaagagccctgtgtacctggaaaggacaggcatgacacccaactaaataaactgagtaaatagcctcactttcttttgggacagaatttaagaagacagacaagagtatcctggtcagccccacaggcctctccagagtggcctttaaccctgagcagaggccactccacggagtgctgaagaccgccacgagctccccggccagcactcctctgtcgcccatgaggctaccagccaccaccccaaagagaaggccaagggctgcggacttcttctgagagccagaagccctttctgaagcctgcttttataccggatgttctataaattataacttttaaagttgggctttttaattactttacaaatacccatgagtgggacagatgttctgaacctggaccacaggccttcctgctaggcttgcagcccacggtgcacatctgcgcacaccctcactgaggactgagtgctgttggtacacggagccccctcctccatacccattgctgcaccaccactgtggattgcacgcctttctgggtggctgcagtctctgtcccttgtgaaagcatggcagcttcaggcccatctgcgggcatgtggctgtttttcctgggattgactcctgaaatggaatgagcaatagtgtagcttttctacgggtgaccagcaggaggctagacaggtgggggggtaggggaaagccacttttcccggaggcttctcctcctctgcctggcctgttcctgtccctgtcttcctacctctatagcaagcccaaagtgtcttttcaggagggccagtagcccccaggctgctgcccacattagcacagttttcccagggcctccctgactgcaccagtagggtctggaccccagctcttgcctgacctggaagttggctgcccaggagtagaagcctgttagctgcctccatgggttttatacagctcttcttgcttagtgcggaacccagggagctgctcagacttccaccaaagcaaatctggctccttctttagagagaagcctacgtggcgactgctcttatttaaggaaaccaccttgggtctgagaggtggagaggccgtgggattaagcacaataggaggcgcagctcctgcttctaccgttaggcgctgcaggcttgaagtggcaaggccctgcatctcaagcactcagagctctgtgagcttgcctactgtgcgcaggatctccccaagtatgtcctactctgtgcaccctgtgctggagccctacttttcaccccgctgcccctcgggaggactgcagctcgctcctgttgggatcgcaaagctcgggtacctgccccggctttgctccacacagtcacggggtccatttccaagtcgtcttttttgtttgtttgtttgtttgtttgtttgtttgtttgttttttccagacaggatttctctgtgtagccctggccgtcctggaactcactttgtagatcaggctggcctcgaactcagaaatcggcctgcctctgcctcccgagtgctgggattaaaggcgtgcgccaccacgtctggctccatttctaagtcttgaaccaactgactcccgaatgccattcccggaaggaaccaagtggtgactttgtcctctgcctgctcagtcacaaagtatatcactaggccataaaaatggagatgatg

SEQ ID NO: 24692 - DNA, 1509 bp, Mus musculus
ttctttcttcctcctttttaatcttactctcatccctttctctctgtcccagccttcctgcacctctctgtcttgtagtgtgaccaagttggtcaccagcccagacccccagtcttcctttatttataatgggtaggggctgaccttccaccaccttggccccctaagggatctgggacctccttttgatccctctccctgcctcaacttcctcccccccctctttctgcttctcattgtctcacactctgacaagagtgagttattatttttttcttttttacattttgtatagagacaaattcatttaaacaaacttattattattattattttttacaaaatatatatatggagttgctcccttccccccgctgcaaattcctccagcgcccccgtggggctgagtctgtgggcccgtttggccaatccggactctgtgtactgagtacacagatatgactagggctccacgtactgagtatgtggccctcgtatgtaccaagtagccagccttgggcacaccctcccctggggtcaggggacatttgggagcctccttcccctccccattccccttcctcacttcactgcattccagataagacgtgtagactcactgggaaaggggtcttgtctgctcaaagcctcaactccaggctcacctcccagagcctggctcaccttttagggcctggggtgggggggcacgtcaggggagatgtattttgtatgcattccacttctaattgtaaatacagggcagaaggtgggagtggctctccctcttcctgttgttctcttggctcagcctgcctaatagaaatgtttttaggctgtttttgtaatatggcacctggtcacagtcctttgtagctgaattcccaggtcctgcactgtacaaccctcaccttctcagttcccttaccacctaataaaggaatagttaatacccaagtgtctggtttctgtgcaaggtccaaagtgggggtttctgggcctcttcctccacagggctaacttgaactcccatcttggggcagagccatgtgctttgtcagtccacctttgactcctttttggtcaggtatctagcttcatttctgttgctttaagcaaatacctaacagaaaagaaacttaagggacagagggactttttcctaactaaatattccaggttacagtccaacattgtgaagaagaggcaggaacttaaaatagttcaccacatcacaccacagtcaagagcagagagaaagaagtgagtggatgcatgcttgcttccttgtgtcgggctgaatcattacactcttaaacagtttagaaacccttgtttggggaatgatgccacccacagtaggcagtgtcttcccacattaatttgacttaattacgacaatctcctaaagacattctttcaggtcaactcgatgtagacaacttctgttcccaggtgatttgtaagttctgtcattgtgacaaaactgatcatcatatcaggtggttt

SEQ ID NO: 24693 - DNA, 1152 bp, Mus musculus
cagggtgcataatggtggctccaatgtgctgcctgcctgatggatgtcctgcaagtagctgctttgagggagaggctcctaggaagggaaaatacaatatgtcattaaggggataattagtccttccctgtcaatagcatgtctttaggtgactcagagtttttggcgggacaaaggcagactcttggacagataattgacagactctattgggatacctttaaaaatagtctatttatgtttactttatgtgtagggtgtttcgcctgcatgtatgtctgtgcaccccgtgcatgcagtgcccacacaggccagaagaggagagggcatcagatcctctggaactggagttacagaccgttgtgaactgttatgtgggtgctgggaactgaacctgggtcttctagaagatcagccagtactcttaaccactgaaccatctcccagctccccgaattaactcttaaaaggagacagtcataagtagcatgttgggttccaccaaggattggaactagaactcagattctatttaagaagcagctttgcattaagtgggcctcaacaaactcagacactcccagctttttatggcaagttgatgtctctcctaagtagtcttagtcctgtaagactactgtaacaggcaaatgacctgggggtgggggtggggggagggcagtcattcatggttgatattagctaacttttaaaaggcaacaatagaggggccaaaggtagagagaaaaagacttgattgtggatgccaaaatgcctacaggggaagatgggatgtgcctcttataagggaggactcctgtagtccacaaggaaagctgggaagtgtagtccttcagcaggaaactcggtcccaattctgagaggatattaaaaagacgcagggcaggatgtcatagctttttcttttctttccccggaggagagtctttatcagaggggttagttctgggtccagtaaagggaaactctctggccatgttgtatgctagagtcttgattagctgtgatggatcaggccattgtcattccgcattcctgaggagagctgggaaaatatttattagaaggccacaagcagatgatttggttatagagtagagctgagagattttctgggaaggttgagggagg

SEQ ID NO: 24694 - DNA, 1186 bp, Mus musculus
tatttatagaaagatatctcattgcatttatttgcatatataatatttaagcatatgtgtaaatattctaaaactataatttgaactctgaaatagttttagtcccaattatttcaaattaggaacacagaacttgtgcttatgcagccaacgactgcatttgcagaaagcatatgcaagaacatttcccaccaccaccatccccaaccccataccagcactgtccactactgctattctctgtgtgtgcatttaggtgacccgaagaatctctgagtttgtgttctctgtccccagccctgtttatgagaagtactgcgccgaccactttgcagatggccgttgtgaccagggctgcaacactgaggaatgcggctgggatgggctggactgtgccagcgaggtcccggcccttttggcccgaggggttctggtcctcacagttcttctgcctcctgaagagttgctgcgctccagtgccgactttctgcagcgactcagcgctattctgcgcacctcactgcgcttccgcttggacgcacgtggccaggccatggtcttcccctatcaccggccaagccctggctctgaatcccgggtccgtcgtgagctgggtcctgaggtgatcgggtgagtgactgtggctcagggctgggtacagcggttagggcacccgtggtccagaccgtctgtttcacgcttcttagttgagagctctcttggcaaggcgtcttccacaggtttttccgtgtctgtcgggttgacatctttgctatggggggggggggggttcatcctctgtacactacagggagcctcgctgcagcgctgagattttactcttcaaatgcaggtgacagcaccttcttgtgtgcatgatgtgtgtgtgtaggtccccaagtgccatgacgacgcatgcctgtagaggttagaggacaacagtgtgaagtcagttctctcttctcatcaggatgtcaggcttgcatgatgagcatgttgcctgtgagccatttcgctggcttgtttgttgttttcttctcgttgtttgctttgtttgtgttttataggcactaacctgaaattcaatctgtagcccaggttggctttgaactcatggttctcctactcagcccttccaagtactaggattgcaggcatacaatatcgcccccgacactcactctct

SEQ ID NO: 24695 - DNA, 1203 bp, Mus musculus
tttggagtgtaacttagtgaaattgtgacttggctttgttgcctcctggggaggtatggcttatcttcaaaatgaggtcagtagaggaaaggttgctggaattggaggggtgggggtggggtgtcagcatttctcaagtcttgacctccattcttttctctcttttccactctcctgtttcttctcactaccaattttttctctttctgtctcctcacttcaccattagccattctggggtctgcgttgtgagcgggtggcacgctcttgccgagagctgcagtgcccagtgggtatcccatgccagcagacagcccgtggaccacgctgcgcttgtcctccggggctgtccgggccctcctgccgggtttctagggcgtcaccctcaggagctactaacgccagctgcgcctctgccccttgtctgcatgggggctcatgcctacctgtacagagtgtccctttcttccgctgtgtgtgcgctccgggctggggcggcccgcgttgtgagaccccttccgcagcccctgaggtccccgaggagccacggtgcccgcgagcggcttgccaggccaagcgaggggaccagaactgcgatcgtgagtgcaacaccccaggctgtggctgggatggcggtgactgctcactgaacgtggacgacccctggaggcagtgtgaggcactgcagtgctggcgtctcttcaacaacagccggtgtgacccggcctgcagctctccagcctgcctctatgacaactttgactgctactctggtggccgcgaccgcacctgcaagtgagccccctgactctgtccttctgtctatctatatgttgcactgtcagtgagccacatctgtcccagtttgtctgtcagtctgtttttggctcgtctgatgggctgtcccttccagctgctaccaccagggcactggtggtttcatccgcctgtttccacccatgtgcctcatctctgcctatttatatttttacctatatatcttgcccatttgcttctgtctgcctgcagttacacatcccatctgtccacacttaggacttgttcatttgtctttcttaaaattttaaaaattaaactgggtctagttgctcacacattttaatgccagcatttcagaggcatagacagcaggtctctgtagggattcaaggccagcatgatctacatagtgagttctaggcc

SEQ ID NO: 24696 - DNA, 2272 bp, Mus musculus
ggagcagcagcagcagcagcagcaggcagctgctgtggccgctgcctctgccccccaggcccagagctcccagccccagtctatgctggaccagcagagggagttggcccggaaacgagagcaggagcggaggcgcagggaggcagtgagtagggggacctggtgggaacttttgggcgggagtctaccgtggagattctgggaataaaggtcctaggacccagggagagagagagagaggcagtgagcccaggatgggtgtaagggaacagcactggagctatgcacatgcagtatggggagcaggtggagcagggtaccccaaactcagttcttcctccttcttcccctccagatggcagctacaattgacatgaatttccagagtgatcttttgtcaatatttgaagaaaatcttttttgagagcacccaggtgacttctgactttttctggcaaaaatgttgactctccatccatagtgttaggggcagccgtggaagcagcagcagccagggatgtctctgggcctggctctcctgcatgctgtgcccggggcaggcctgacgggcgggcagctgaggatcgcagagcccatctgccttacagccagccggacagacgtcctactacatgccaccccctcagaggacgtcagttcagggcacgtctcaatatgagtcaagtgccagctggacctgaggcctgcttccccgcgtgcggggcagaggcccttctctgcgccaaatgtctgactacacagtatacacaggacattgttgctgccgccaccgagactggttttctgtccctgagaacatgacgtttgtgacgtcctacccattgggagtccttcacaccccagccatcgctgcccactcccaggaggccagggcaagcctgtgtggactggagcagcaaggcactggcccaccccttgctggcactgactttgccttgaacagaccctctcccctcccccacaagcctttaattgagagccgctctttataagtgttcgcttgtgcaaaagggaatagtgccgtggaagtgtgtgtccatggcagtttggacaggggtgactgttcacacgtatggacaggcctcgcctggggagtaaggccaccaaccaaagtcagttccttcccacctgtgtttctgattttgttttgttttatttttttcctatatatatatttttttttgttgttgttgaattctattttatttttaactctcttctcctcagacacagtggcactgcttatctccaaatggtgtgatcgtctcctcagtgagcggcggctcccactgcgctgtgggtagtgtgtgactgtggctgtactgtatagtgaacatagttggcatatctttgtttgaagtttgttggtgattccaccaaactggtgtaaaaaacaaaaacaaaaaaacccacaaaccacccaaaactcacaaaaaaaatcctgcttgtattcagtttcaaactttattagtctcacttttaattataaaaccagaaagctgcaatttcttttccctctaccccttatttgttggcttctttgtttttttaatgtcaaatctgtttgtttttaccaagaaagggagagcctgaggaggtctgcaggctttggtgggctgcgaaccgaggcggaggcccccacccagtacctggtgagaccagtgtgctgcgccttccttcctattagtatttttgtttcgttttgtttttaaattggagcccctggtgaggttacatgtgccatgagaacccactctacaccatagtgctggtgcctcagtgttggccaaactctggagtcactgactggtttgactttcatgtggtaaatatgcatttggtctgtactgatcatggaataaacacatctctcttttttaatgctgctgtctccctgaaatttctttgtgaagcaactaggtattctggcttgcttaggccaggcccaggttcccatgcacctttgtgtaagatttaccaacagttgatgcagagccactctccagtggccagtcctgcctttcctgggcaggagctgcttgggctcagagttcccccacgctgaagttgtaatagggagccagataacctgtaactccctggcctgggtggtgatgaggcagtgagaccacatcctcactgaaggccctactccatcctagtcccttcttcacacaaggctgggggccgcttttcccaccgtgcttgcctctacctaactcctagtttgatttaagctcagggttaacca

SEQ ID NO: 24697 - DNA, 1876 bp, Mus musculus
ttcaaggttgctggggagggacatgcagccccactgccaaaccaggtcaggatctgggaagtgggcaagaaaaattacatggctacttgtgaactgcctacagtgcctcaacaagttccgttgccatcacggccatcctcatctttagcttccaataatgacagcagctgttgaggcaagaatagaccatatcatccaaacctttccagaaacaaaccaaagtaggttggggcgtttgtttgtttgtttggggtttgttttgtttttcttccctgaaatctggccctggcccttttttttttttttttttttttttttttaatcacagatctagcaccccaccagaaaactgcctgacataaaaagccccatttagtgggttctttctgtcttttttctttttttccttaatgtacttctgagagaactgtctcagacaccttggagcttgtcttcccctggggctaaaatgagactgtggtggtgccaagtaccttcccagattccagagtttccatattcaagggttgcttgctgccctctatctgatatgacctttgggtctcagactccctagaacatccagtgaccccccccccccaagatgctgctgctgagttcttaggccattccaagtcctctgtgtgtgtctctatcttcaagatagctccttttgccaaatgtactattttgagctgccctttggcctgtgcctgacgtattcccaatgaacttggcttggctggaattggggggaaaggagacttcttgcccagagattcccacaggacagttgggaaaactgttggcattatctttctgggaagcttttgctatcttggaccaaatggtggcctatattcccaccgtatcttggctatgtgcctcccttgcccctcccaacaccctgtctacacacgtgcatacatacagggcaactttccctgtagagtactctttgctatcatgaatcccatccctggctatgtgtgcctactgtgataggaacactcaggacctgttgaacttgaaagatctttaggcttaaaggttgtacttggtaccctggaaacacaggcagaaaggacagtgtcccacctgttcttccttgttggtagttttctgttcccgggcaatgggaggtccccttggaaagccttagtataccagctgggatcctgttggggagccagcaaggatagtggagggcttctctccttaattgccctgcccttaaacctgtctccttcattcaagtggggccgggctggggttgaaatcagtgttttaatccaagtttacaaaaatcattttactttgtacaataccatcctatgtaaagatgaaatttgtgttggagtctaagattgttatggaataaagatgacacagtgtttgaggccatctccatggaaccctttctagagagttttgtgtggggtgtctgggctggtgtgtcatgaagcacttactgtcctgtcttcttactggtaacccaacccaaggattgggctataggagctacatagggctgcctcacaacacatttcagctccactagtctcacctgggcccagagggcgcatccatttctactctgaagatgagtcccagaagactcctgcgacctttgcagttccgctgagatttcctagaacccctttgtccgctgctcttggtcctacgcctagtcttgtagaccgtaacttgaggcaggtggtgagaggcaggaagtatttttccctctgtgtaagtaagaaaacaatgttcaatgttattagacactaggaaggaagcaagcctcgctcctacccagacatctccccactcagttcagcctctggtgccacctccaaagcttcacatgtgatagagc

SEQ ID NO: 24698 - DNA, 1180 bp, Mus musculus
cttgtggcatttcctctttctcagcagcatgttattcctacagatagatatgctgtgtgttttgagtaaaggtgagatacagacattttctgtgagaatagactttaggatcctggggctgtttgtttgtctacaataatcttacctttgagttagtcaccaagccctagtgtttcagtttactctttacctaacccttagaaaccttcctccgtccttcctccctcttctctgcccttctacccacttcactgctcctctacctctgcacaataaacctctcccacgtggaaccaccaaaaaaaaaaaaagaagcctttatcccggaaacatcctgggactaagatagccaggagatttagcatctgtcaggctattcaacttctctgttgtggaggacggtagcagtccttggagatcaaggagtgggtaagcacaccttagggatctcattaatgtggcaggaagccagcgtgccctctgcttctaccatacccacaactcaacactcaggtatacagttttacatgatacagagctatcctccagggtttaggtagtgagaagaacatttagtcctggtagtgggtgtgttagtttgcatctgaggcaggttcccactaaaagtttggctagtaactcaaagagatccacctacctctgcctctcagatgtaggaagggattgattgtagacctgtaccatcatgcccagcctggttgtaattaattaattagttaatttctctctttctcctcttttctctccctctccctctcttcctctctcctccgctcttttccacagctcaaggccgtgcatgagcagcttgcagccctctcacagccccagcagaacaaaccaaagaaaaaggagaaggacaagaaggaaaagaaaaaggaaaagcacaaaaagaaagaagaagtggaggaaaataaaaaaagcaaaaccaaggaacttcctcccaaaaagacaaagaaaaataacagcagcaacagcaatgtgaggtctgtgtttcccagtttttccatctttgggagtggtgatcccaaaaaatgatttgtagggaggaagacaaccctgttggcttcagtcaccagtctgggttggtgccctatcatacgcacttagctgttccttccccctcagtttttttcccttaacgtgctttggtaactca

SEQ ID NO: 24699 - DNA, 1099 bp, Mus musculus
aattgtatagaaaaagtttaaaacaggatgagctgatgtcagaaccccaactagtatttcaaacctttccgtagctgtggttggtcagcctgtacagagattactgcagcagcagtcacttgaagcaccaccaaagcactccaaagcttgaaagactctctcctcgggagcaagtgcacacaggctctggggcttgaaggggactgctactgtcccctggggatctcccctccaatatacttgctcatcttctcgctttcttggggactgtcccatttgtacatatccctagcagacagctctacaatctgaaccccagtgaatggttaggacaagtgcttttatagttcccttcaaaagccaaggcttagtttctaagttactctctggtatgtattaagttccatgcccttttggcaaatgtgttatgtggtggtagccgttatccaggtttggtctgtgagggctagaactctttcgtgtgtacttagttggtggcctagcttctaataggtgttcatgttcttcaaaatgtgataacccactctggcctgtcttgaaaattattgaccactaaatatatgtcttttggtcttagaagaagagacaagacatctaggtcgtgaacttgatagaaaaagatgtgtgtgtgagggtagtgcccactattaactaagataagcaatataagcagctgccagtgggggcctgcaggtcacttgggaggcctgcttgagattaatggcaatagtctatagcatctaattctacagatgaaaaggtaactttttttttctttttgctatgaagagacaccatggccaaggcagcttataaaataaagtatttaattgggggacttgcttacagtttcggagtattgtgttagtccatgcacatcctaacgggggcaggggggtatgttggcaagcaggtatggcgttggaacagtggctaagagtttatattctgatcaacagagagaatgaaactccccaggcctggtgtatatacttttgaaacctcaaagcccttccctattgacactttttctaacaaggccacactttctaatccttcctaaacagtctaccaacta

SEQ ID NO: 24700 - DNA, 1180 bp, Mus musculus
cttaacttgattttttttttcctgtactacttccatcttctctcttactagtgggtccttgatttttgtgggttactatgtggaaggtaggtagtattagtattaagtagcaacattatttctagcagtcatagctcttagtaaagtgatttttgtttgctactgttttctgcttttaacagttgtcatttaaaatggtatagggtttatttcaacccttactcatgcaggaagttaccaagaaggtatcagtttaagtccaagcaccccctcccccccaactgacttgattagattgtctgcacagtaaaaacaggcattggctgaggactccctgaaggtgcttgactgggtggcttttggctttttttttttttttttggatttttgagattgggtttttctgtgtagctctagctgtcctggaactcactttgtagaccaggctgacctcgaactcagaaatctgccaacctctgctgggattaaaggtgtgtaccaccacgcccggctagctgggtggcttttaagtggtgtctggaagccaagactctactgaggagcttcattgacttgaaaggcatctgtgaaggactggccctctgtgtttgtgttgaatgtgagcatttcattctagacactatcagctgttactgacggctcttctggctctggattactagtcacacccacctttgtaaactgagacctatagtctttgtaagtctgacattaattttgtgttacttccctctccatcctgtatagttggagttcatgatgagaagtaaggcaaggagaggagagagattgcctttcttggagtcacttaagagaccaggggcaggaggctaagctggtcaaggttcagttcccagcacccacattgggattcacagccatttatggctctagtttcagaggatctgatgcccttgttggggcctttgaaggtaccaggcacacatgtgatacctagatgcagacaaaaatattcatatacataaatgaaatatttttaagagcctaaaaattaacccatataacatgttctaaaattcagcttcacactgcctttaatctcagcacttgtgagggagaggcaaatatctctgagtttggggccagcctagtctacatagtctcattatagatagatagtcagagctacataatgaga

SEQ ID NO: 24701 - DNA, 1183 bp, Mus musculus
cccacttggcaagccttaggctagtgagagatcatgtcaaaaaagcccaaccaaaaggtgggttgatcccaaagaaagacataacagttatcctctggccaccatgctgtgtgtgcgcgcgcgcacacacacacacacacacacacagacagacagagactataaatatatggtaaccgtttcctgtattcctgcttgggtcacaaagctgtgttcaaggcctacttattccccacataactgtgataggaagctggcagcattgagcctgagctaagccttctggtgcaaaaatggttgtttagaaactgttgaggaccacatgtgcccaaacacactctgtgttcctgtgggcaaacagacagcaggggatctggtggcttttggcatttgtgctacaacatacttctctgaatgatttttaaagagataaaatggattggaattgtggtaggtttaaagatgtgggcagggaggaaggtagggaagccaccccccccttttgttttttgtttgtttgttttttgatttcaagacagagtttcttggtgtaacagccttgactgtcctggaatttgatttgtagaccaggctggcctcgagctcatggcgatccacctgcctctgtctccctagtgttggtattaaaggcatgcatgcaccaccattgcctggccagtggacattttttttttaaagatttatttatttattatatgtaagtacactgtagttgtcttcagacactccagaagagggcgtcagatctcgttacggatggttgtgagccaccatgtggttgctgggatttgaactctggacctttgaaagagcagtcgggtgctcttacccactgagccatctcaccagcacccatttttttttttaagttgttctctttaagtagtcagatgtcagaatgagggcatcagacattgagaggtcattgaatctctctgcctggcttgctaaggggtctcttgtgtttgattgttttggagggcagagtcctgttatattgcccaagttggtcttaaaatgatagttctacctcagccttctgaatagtgagaactataggtgcctaccactctatgcatggccttgttgcacgttgattagggccttttgtcctgtgtctttcacagggtacagtataataattagccattggatgcttatt

SEQ ID NO: 24702 - DNA, 1146 bp, Mus musculus
gccagcctggtctacaaagtgagttccaggacagccagggctacatagaaaaatcctgtctcagaaaaaaagaaaaaaaaaaaaaaaagaatttggaaagtttaggatgtattttaaagttgcaggttcttttgctgggtggtggtagtgcactcacggccttagtcttagtacttgggaggcagagttaggcggacctctgagtttcagcacagggctatacagctttgaaaaaaactaaaaccagccactctgccccctccatttttcttttaatcttatttttatttcttttttcttttttcctttttttttttttcttttggtttttcgagacagggtttctctgtgtagccctggctgtcctggaactcactctgtagaccaggctggcctcgaactcagaaatccgcctgcctctgccttccaagtgctgggatttaaaggtgtgtgccaccacgcccggctgttatttttatttcttttcagttttctccctatactttcatagcaaaattgaattggaccctcaattaagggtgggttttaagagccttgcacatactaggcaggtactctaccatatatccctcactatatggagtttttatttataattgtgagagaatatgtgactgttggtgcacaagtggaagtcagaggactacttttttagacttggttcttcattctcttttatgtaggctctggcaatctcttgtctagtctaaagctctttgatctgctgaacactggctctggttgcatttttgtttttgagacaaatgacctgagtaaccctggatgcttttgaaatccctggtcagccctgcttttgcctcccaattattgggattactgttgtgcaccagcctggctagtttcttttgttttgccaaattactatacaggtgaacctttggtaaagttaagtacttaaagcaccgtgtaagtctaccataatttctagttgtggatgtggttttcagatttttctctttcatctctaggaataagaccactagatcaaaaagtgtgtatttgaaatccttccattgttactcttctagaaagactacatacatttccatttttgtctgaatttagcagtgtcttatttatactagtgaggttttaacattttct

SEQ ID NO: 24703 - DNA, 1748 bp, Mus musculus
aatgatttttttcttccctgtttcaagggatatgttatatatcatgtgttctttttattttataagatgtactagggtgtgtattatttggtggaaagattgggccatttccttcccaatgtacctcaaggattgatgctatacagtagatggcttcctacctctgttagaatacaaaaagaggtaaaccattttcccaagtggcctttgatggctatctgtgcactgcagttagaataataaaagtagatcttcctggtaattgttaagtcctaaaacggacagaatgtgaggatttttttgtgtgtgtgttatgtttttgtttggttggtctttgtttcgttttatttgctttttctcctggaaagcaatttgttacaaatataacttgtttgagggggaaaaaattaattatttaggggaattcccttattcacatatgaatttattcataaattatgcatggttgatgtgggacacacacgattcaaccatccatgtgtgcgagagctcagattgtgccccctaccaataacagtcctgcctgtttcaataaacatcagaccaattttttgtttgttttgtttttggttggttggtttttcgagacagggtttctctctgtagccctgactgtcctggaactcactctgtagaccaggcaggcctcaaactcagaaatctacctgcctctgcctcccaagtgctgggattaaaggcatgcgccaccatgcccggctcatcagacctttttttaaggcctttattttagctttggcattgagatagcatcttgcttggaccaagcttgcctttgaattcaatcctcctatctcagtctctggagtactaggaccatgtgtgtacagccaagctcagctgggctttggttttataatacactgtattctatgttcctcacctgatgtggcagcatcctgttaactaaaggcataacaagatggtgaccttggcctgtgtataagattgtcagagctgttccataggaagcatgcctacctgggcctctagagtgaagacactgccgaaggcattcgttctctctgttcagtgcttgctaatcagtttgatgtttgtgttccacctctatttgtgcaggattatgggtttttgttttgttttctcttaattttgttatttccacctaaaagtacttaggaaaaaaacctgaaattactcattgatgaaaaacaaatgtaaacttccgtagatgggatctatctgtaaaaagctcacacagttacgtaaagatgtttcattttaagcaaatagtattcctttggcagttctgagtctgagaaagggaggctcagcatgtctgtaaagtagcatgtactaggttttatagggtcagtatgatgggttttcctcccttttgaagttacaatactgtgtccattaactgtacacagatcacatcttggaaatatcaaccagtgaagaattataaaagaggcaataaaatattgcagggattaaatcagcactctgtgaaggagcattactagggggtaggagatgcactttgggaatatcctcgaaacaagcaataaactgatgccacgaagacatttgtgttcattaattactgctgtttagagtgtgtgtgtgtgtgtgtgtgtgtgtgtgtgtgtgtgtgtgtgtgtgtgtgtgtgtgtgtttgatctgagaaacccagggcctcctggcaagcaactcttacatttacatgaatatgccacccagaa

SEQ ID NO: 24704 - DNA, 1205 bp, Mus musculus
agtcaaaccatgtaaaccgttaaactctgtagtccaggtaggccttccactttaatgtcctggagttacatggcctgtgccactaagtccagtacttactatagtttctatgtaagcagatcaggtttcaaacagcaaataaggtgtgggtgatcagatcgaatcctagttccttgcatgcctgtccagactgactggaattacgcccaaggtcacttacagacactaggactagttattggtgaatctgaacctcagctgggtttgttggattcctagagcagcctcaccagccctgtctgccctgcccatagcttatgatggagcagtccaagaagtcctcgcttatggtggcccgcagtattctcaacaacaagctcattagcaagaagctggagcgatatctgaaggtgaggcaaaggcgaaagcactgtcctagtcctgacctttgtgtgagcctggtccccattctatcccagtgattcctacctcccattaaagtctctatccatctctacagggcgagaatcctttcactgacaacccagaggaggaaaaggaacaagacgaggtggaggctggcgctctggatgaaggggcaccaagcgaagcgacagagctcacagagggcgtgccggcacagccccccgtgcccctggagcccgccccagggactacaacaccgccacctccgccaccaccagaagaggaggagagccctgtacccttgctgggcggagcgctgcagtgtcagatccgcgggatcccgggcctcgacatggaagacgacgaggagggcggtgggggtccataacccttacccggcagggctcccgtggccgaggctggaagtccagcctaataaagtgctttcccatctgaggtcttcgtttgtgctgtggtgagggcgggcccctagaagtgcgcctgcgcgcgggtaaacgcgctagaaccgctcacgcgtgcgcggacctggacgctcttgcgcactagcttacccttgaggcacaactcccgagatgctgtagatttgcaacccggaaggctgggcggatcggcgggggcgggcccatttgagcaaccaatggtagcgcccagaaagagacgtacgctcttcgtcttccagtagcagacagcacgttgaacgcatgcgttctgagcgaatctaagacaaggatctgctggcgggtcgcgtcgcagacatg

SEQ ID NO: 24705 - DNA, 1205 bp, Mus musculus; identical to SEQ ID NO: 24704

SEQ ID NO: 24706 - DNA, 1170 bp, Mus musculus
caactacctgtagccctcttttggcttccaggaacacctgcattcacatgtacacacacacacacacacacacacacacacacacacacacacacacacactttaaatatttgaaaacaacattaacaaatccttttgtgaagtaaaagatacatcaagaaggtgaaaaaaaaaaaaaaagccaggcatagtggtgtatgcctttaaatctagtacttggtaacatgaggcaggtgggtttgggcagacttgtctacatggcaaattcaggaatagccagagctatataatgagaccctctctggaaaaaaatgaagtggaaaactccacagagtaggaaaaatacttgcaaatctgagacctgtgtctcaaatctaaaagaattataagatgggagatatagcttagtagagtgctagcttagcatggacaaggtcctaagttcagccctcagcaatgtaaattgagggttgaagttaagaccctcagtttaaaaatattaaaaagcaatatgaaaaactttaataattttagaagacaacacaattttttaaatactccaggaatctgaatagactttcccccaagaatagcactttttactcagtaggacagctagactaagcgttcgatagttaaacatagctaaagggctggggtagagctaggctggcgtgcttgcagagcacgcagaaggccgtgactctgtctctaacataaactgggcaggaagagcaggggttcaggtgcacagagaagtcatcaggctggagaaatggctcagccattgaaggctaggctcatagccatatatagtatatgtagtgtgtgtatgtttgtatacttgactgtgaatgtgcacatatgcataagagctaagattttggtatctgtcctcatcattccccacctattattttgacccaggatctctcactgaaactgaagctcatcaatttagctagaatggctcatcaaagaggtttaggaatctacctgtctctgtgtccctgagacccgagatggttataggtgtaagaaacaaagactggctgtttccacagtgttatgcaatgtgactagctgtctcaaactcttactaccatggttcttcaccatgatggactgtacctttgaattgtaacctaaaataaaatgtaccttctttaa

SEQ ID NO: 24707 - DNA, 1356 bp, Mus musculus
aaaccggcgcctcttggaggccgggcacactacaacctgggcactgggagccagctagccacccttcccccagcttaaggactctggggccacaagggtatccttgagcctacctggttggtctcataggggcagtagccgggcccttggtggtgaccaatctgattgcaggggagaacagcacttccctgtgtctagcaaccaggcagggctacatctgccatccgtggccatttgcaaagaccccaaagaccccctgttccctcttgccccatcaatatctattttcacgcacaggcaaacacacacacacatgcacctcgtgagacctgggatctgccctagccccctcagttcccaagtcaaacgaccacaacatgccacggtgcttgctcaggggaatccatgctccctctgctatcttcctagggcttgggagctcccactgagcccacaatgccacggaaattcttgttggctgccccctcccccccaaaagggtccttcctagcttggaagagctcaaagctgacagctgcctcctgccttgtcagagcctcaggggctccagggctgggagggtagagtgaggggtgggactctcctcccccacccctgctgccctcccccttttcactgttgctttctatgtatagctccctagatctttcacttttttaaaaaatgcgttttgtgtagagaataaggaacgtggatctttttattttgcaatcctgggccagctagataccgggagctaattgaccttttaaccttttcagtggccaccttttggttatcaatgtacctagaaatatgtaaattagattaaatttctcttctggaaatatcccagggcaaacagccagtgtgtttttttctgtgaagtggacaggctggcactggttagcagctggagctcggagctggggatcagggttgtgcctggcagaaggccctggttttcctctgttagccaccaaagagaccggacacagttggggataggtccaagttctcagctgttggccggtggtactgtggctcgtgaagggttctggttggctggcctgggaagggagccaagacagaaaggctggttgggtttaaccagccacaataacatgcctacaggagtgattcttgccttggtgcttttacaaacccttgaagggattgggtagaagcacacatctgctgggagcttgggtgggaatgaggttcagaaatgagactcggctgtcttaagataggactttaaatgtaatactggggacctcttcccaggccttgaacataccaggcaggtgctctgccattgagctgtaccttgctagctctgagataaatgtcaga

SEQ ID NO: 24708 - DNA, 1183 bp, Mus musculus
cagaccctcctgccttcatcccttagggccgaccaaggtggcggccgtgaaccccctccccctgtgttttgtctccgcagctttagatagtgacgggggcagagagctggactgccagctgtgtggtgcctggtttgagacccgcaagggcctgtccagccacgcccgtgcccatctgcgccacctgggcgtcagcgacccggatgccaagggatcccccatagacgtgctccacgggctcatcaggagggacggcatccagatccgcctcccacccgggcggggagccctggcccagctggggcggcctccttccgcctccacagccctctccttgctccctcccccaccgccggccaagaaggccaagctgaaggcctcgggtatggccagtccctgggggaagcaggatctctcggccgccggcattttctgggcctctgatgtggagccgtctcctctcaacctctgtaggttctcacttcagctgcccttcctccctgtgggccctggagcccctccctggggggtcatggccccctccctactccctccctgttgtagtagggagtagacaggggcccttggcagtgggctggctcaacccagagattttgttggcggtgggctgctggtacctctctcttggccttgacctttatcaccatgaccctgcctgagaataaaggccaaggggaaggtcctgccttttggtgtggaaggtgtcctgggtctagacagtatgtggcacctaggctggcttcgtcctgtctcctgccctgttttattgggacccacaaagctgtggatttgtattggtactgctctgccagggcagaggtcctgttagctctctggccccacccctcagctcccttacttacactgccatcaactatcgccctagcttatggacacactgctgcccatacctagctggccaggatactccaacaggtgactatccagatgatgtccataattctaactgaccctttttcttcctgctgcagcttcaggcccagagccaacaagagatatccgctgtgagttctgtggtgagttctttgagaacagaaagggcttgtctagccatgcacgctcccacctgcgccagatgggtgtaactgagtggtatgtgaacggctcacccatcgacacacttcgggagatcctgaagaga

SEQ ID NO: 24709 - DNA, 1195 bp, Mus musculus
gtgtgctgtagatggtgttttaaaatactgaacaatcaaaccttaatttgtatattaatagtcaatgccatatctctgagctcgcaattgcttaaattgttcatccctcagatactattaattctcaaatttacaattgcttatgcatatttctagttaataaataaattatgcacatgtaactcttaataactttgcaagccttctagttacaactgctccttaagaaaattgattaaaagtgcaattagtcactgcccctttacagccaagtatttaaaatgttttgtcaactagttattaattcaaaagtttaggtattgtaaaattttaaaactttaacttcttaaaagacaaaaaagagagaaattgtatccccgtgcatactatttagtgcattcccattcacactatctaagtcttacctttattttcaaaatctaatattttaatgtcaaagagtttaataaaggctttatagtatcttaaagggatctacttattggcttatagattgatcctaaaacagctaccttattagaaaagggaaaaacaggttttctccacagaacgcttcagaaacatattaattcgtgtgatgagctggtaggtaagttgactcatgtcctgattaaattgactaaaaaactaaattaaattcatgttttagatccatccttacttgtcatttttccagtttagactagcttctagccttttaactttatgacaatagtacatcagagactgtatattcagacttagtaaaattagtcatttaatagagtcataatgatttttctcctttcttcagtgtgaccagccattctaactcaatcttagactggtcctaatattcagtccaatgttagagattcctatattctaaattacctagcaagttaattcagagcacatcctccacttcccctagatccctaacctcagaaggattactggccttacagctagtggaaaaggctattgaagaacagtttgtcacttacatagattactccctgccgctgcacctgttaatttttaatacgactcatgtgcctacgggattgctatggcaaaaatttcctataatgtggatacattcgaggatttctcccaaacgtaatatcttgccatatcatgaagcagtggctcagatgattatcactggaaaaaggcaggcattgacttattt

SEQ ID NO: 24710 - DNA, 1149 bp, Mus musculus
aggatcaaaaacatttccagggaagagcggacgtttctgggacgcattactcctgagaaaaggtgccggacttgggacacacggaaggcccctactgaacagtggaagctctgttacagctggggtggctctgcaggcaggcctgatttcccagttactacgctacatacctgtgcttcagtctaggccaacgcagactataaacagatcctatctgcctctctcctgcctgattctctgtctctccgtagccctgggtgtcccttttccttcctgtgttctagtcctctaagtcaccatctctgtccagtgaccatggagggccacctctgtctcctgggcctcaggatctcacttctggcctatctttcttgcaggatgctacagctgggcctgtcctggctgggactggggcctggagctgccttcccatggcaacttctgcagttggttggggcctccttgttcctggctcgaattctgacctggatttgtgccttctatgacaactactgccgtctccgctgcttccccgagcccccttcgcggcactggttttggggtcacatgagcatggtgagtgtggcagcaggtaggtctggtgtgtcaggaaaggctcttaggaacctgggagtcgtgagagggtggagaggtgagggagggaggctgagtgagtctctatctagtcacatacccggcatatctactcctggcctctgtctacaccacgttttgaggcttttttcttttttgccctttctcgttcccagctaacttcggatcacattctgataagaactcatgttttaagatctctttctgttgcttgttcagtcctgttctgtgttgttagtgccccccaccccaccccaccccaggataggttgagggagcagagctctccccctcaatgtgctatttcacttaacgttgttggagttgagcctttctagtggaataaattgggtatgctcctttcttagcccatctctgctggccagagtctcttgagggacagcgatgctgaatggcagaagttgacatccctcctctccaatttttaaaattctttctctctctctctctctctctctctctttctttctttcctttcttccttccttcttcttctttctttttttaaatgag

SEQ ID NO: 24711 - DNA, 1154 bp, Mus musculus
atcatttatctattatgtatccctgtgccatttatttatctattaagtatcacatttataaatcatttgtgtattcatatttgtccagttatctatttatccatccattccatccatccacccatccaggaaatagaggttggagagatggctcaatggttaagagcatttcctgctggcttcagtgcctagcattcacatcagacaactgacaacgacctggaactgtacttccaggggatgcaacaccttctcctggcttccataaacctctgcataaaatatgtaggcacacacgtacacaaataataaatcaataaatcttaaaaagcagagataagggaataggcttcggagagatatgaaaatagatacatggatataaaaagtgatgtgcacagtttaacccacgttgattcagcaagagccataagtgaacgagacggaagagttggagtggtatgggactagattggtaagagagtgggaccctctgagacatcctctcaggatgaaactcaaccttctccatctccaggtcaagaacaacgaggaaggcctgcagttgttgactgaaaggagccaccaattccatgatgtccacctctgttggattgggcccttctaccccatcctgaggcttatccaccccaagtttattggccccatactccaggcctcaggtatttatttctccaaggatcactgtctgttctcttacttttgtcccagctcttcctatccctgcacaggtcaggctgggcaggggaggatggagccaatctaatagaatccactgccactaacctgactgaccctggacaaagtttcaagtttctctagaagagaggtctgttcaattgtgaatcatggaaactcaaccaggtgtggtcttagcaaagaaagaaaatcttctggtgtggggtgtatctttgtggtaaggcatttgtctgccacatataaggccttaggctgcatttctctctagttcttgttctctctctctctgtctctgtctctctgtctctccctccctccctccctccctccctccctccctccctccctctttctttctttctttctttctttctttctttctttctttctttctttctttctttctttctctctctctctctgcctctctctct

SEQ ID NO: 24712 - DNA, 1133 bp, Mus musculus
gcattcaaacatgtgggtggtctgcacatacacggtgtgaatcgagggtcttgttttgtcttcaggatgaacatggaaaggagctgtcagatgaggacatccgggcagaggctgacacctttatgtttggaggtgagagtccctgtgtagggctacagaggaggtagaggtgtgccagtctcaagtaagtattttggagagacctagactccctcccttctttctttccattcattcctttttgtagtcattctgtctggatacaagtgccccattttgctgaaacaggccagggacacaaccctgcttgtctctctacccttcaggccatgacaccacagccagtgcactctcctggatcctgtacaacctggcgaggcaccccgaataccaggagcgctgccggcaggaggttcaggagctgctgagggaccgagagcctgaggagattgaatggtgagcatgatagtctctgctcttggagcttctggtcaccacattcgttgctgcatttcttacagggtgtgtctgtgtagctcaggctggattacagagtcttaaccccatgcttttagggattatatacccagtttggaaatcttcctttagataattatgtctcacatagctagttaggttttgttatggagttttcaaaccgaatttgattcttgattctcctccttccatcttgtgaatttccttctggcttttgcttgattttcttttttatagtttatagacacatcttttttaatcctttgtaatcccaccttatagtcttttctactttttagcaacattttgtacatttcaagataccagggctgctcttccagaggtcctgatatcaattctgagaaaccacatggtggctcacaaccctctgtagtgagatctgccttcttctggtgtgtcagcaacagcatcttcatatacattaaacaaacaaacaaacaaaaaaataaataagtaagtaaataagtaaatatatctatcttaaaacaaagtaccaaggggaaagaaaatattttgacagtctcacaatgaagaaatgaatagataatttcattaacttatagtttcagtgtttctgatatattgagaaaatctaccttatatttggagtggcc

SEQ ID NO: 24713 - DNA, 1171 bp, Mus musculus
tatatacatgggtgcagtgccatcttctttggcatgactagcctctcccttacccagcaggcatcagttgccaatagctactcaggagtgggcctttctgcacacctcccacctccatgctgtcatttttgtctcgcttgtatttccagtcacagctgttgtcagttagtaggtgcaactgtcctgttgtatctagcacacactgtttggctgtaataattcactctggctctcacattctttcggctccctcatctgtaatgatccctggtcctctgagagaagaaatgtgatgtgtgtagatgctccatttagaactgagccctccagaatcacttattttctacatgttgaccagttgtgaatctattcattataatctactgcaaaaacagtaataaaacccatcttctgtgatgaagatacatttttctatgggtataaagataccctttaacagaataatagtaggttagtagaaagttctccacattaatgctgccagacttgggttttatcttgtgggttgtgtgaaataggcctgaaatccagtcacagtggttggttattcttgccgtactcatggctgtgtcttgtcagactgatctgtaattgtagctcagaggcttctcagctgggtaaacacagcatcatctagcactatgaaagctagccagtaggctgaactctctaggtcagtataagctatgatttcttaatactctgtgactcaatgtgtggtgtcttcagtaataaggtcttactgtcaagttctgtgtggtaaccaaggacaatcgcaatagcctataatatttggagggggaggtctatgaaacctccaacttttggcctaattttgatatttcatatatgtcttgaaattctccttgatttcttagtttattgtaatataagttttcaaagtgtcctcaaatcattctctggatttcattttctgtgtattgtaatctctcttttcagctctaactttattcatatgaataaatgtataaaagaaagcataagataataaacaatgaagtacttaattaaagtttgtaactattatgactgcctgaaagttgtatatggagcagctacagggttgaagttttttgagtggtcaccccttctcagtgtactttttggtgatgcaactgactttgagtca

SEQ ID NO: 24714 - DNA, 2528 bp, Mus musculus
ccagttctctcacatcatttgagaactatgaaagtacttacactgtagagagaatctataaaactgagcgttgtgacgaagactatagatatggccaaaatgttgaaaagactttcactgaagaaaagccctttgagtgtaagcagtgtgggaagtgtttcagttcctccaggtattttcgaaggcacgaacgacgtcatcgggccaagaaatgctatatctgtaagcagtgtgggaaagcctttgcttttcccacttacctacaaacacacgaaagaattcacacgggggagaaaccgtacgtgtgcttgcagtgtgggaaaaccttcgctcattctcgttcccttaaaacacataaaagaactcactcggttagggacctctttgtgtgcaattactgtgggaaaaccttacgtcattacagctctcttcaaattcatacaagaattcacacgggagagaaaccttatgtgtgtaaaccgtgtggtaaagccttcattacttaccgctcctttcgaatacatgaaagaattcacactggagaaacaccttatgaatgtaagcagtgtggcaacaccttcatgcgttggattcagttgcgaaagcatgaaataattcacagtggggtgaagccctatgcttgtaagctgtgtggaaaaagcttcacttgttctgggtccttgagaacacatgaaaggattcacactggggagagaccctatgtgtgtgaccagtgtggatatagctttactcggttaaattcgcttttaaggcataaaataacccacaccggtgagaagccctacgtgtgtaatcattgtgggaagactttccctcgatctgcgtctcttcaaagacatgtcaaaattcacaccgaggagaaaccctatgtatgcaaacagtgtggcgttgccttccctagttctgctgacctcttagaacacgagcaaacccatattgacgagaaaccgtacatatgtgagcagtgcggcaacgccttcgtgctgtggagtcagtttcagaagcataaagcccttcacgccgtcccagtgtcctacgtgtgtaagcagtgtgggaagagcttcacttcctcgaggtccctgaaaacccacgagagaatccacacgggtgagaagccttacgagtgcaagcagtgtgggaagaccttcctgtggtcctactccctacagagacatgaaaagactcacacggacgggaaggtccacgtgtgtaagcagtgcggggaaactttcccttacgacagtcatctccaggtgcatgagaaactgcactttgacgatgagccttttaattgtaagtactgtgggaagcccttcttcactctgaaccatttgcatagacatgaattacttcacactaccctggattccagtgttttttagtcatgggaggatttttttcccccgctttgtggttttcatagaaataagagaaatcatactggaaaaagactggatttgtgctagcaatgtggaaaaccttttgatttgtttcattgaaacaaacgtgcgatgtcacaatgaggagaaacctttttttaaaacgaaaatcaatgtacaaatggttttctgagcttaaagctccttggaatgcatcaaagagaaacgggcctgtgactgcgagcagtgtggtcgagtcatctgcagtcctggatcttggaggagacaggagaaaactcaagctgtagagaaacttttatgtgtatatgtggtgttgtattaaaaaaaagccctttctgcttccccattccctctgaatatgtggaaggagtcactggagagaaacccttcatagctaggcaatcttggatagtcttgagttatcacatcctcttacagacatgaaagaacctactgtagagaaatcttaaaaacgggatttgtgaactcttcattatcagcttcatagaactaacaagaatgtacgtggggagaattcctattagtggaaacctctatgaacaccatttggttcaatgaacagacaaggaaagaacttgatccggagtgctaatcttctcaaaagagatgttcaaggtttcatttggcacagatggtaacacatatcggatgaaaacttttgctgttgaaaaacattggaaaatctagagcaaagtcctttgaaatttttttcatgtttaatctgataaatgtcagtattatgaaggactggacatattttattttattattttttttttgtagcatgctccaggaaatgcacactctggtgagaatgttatcagtacagtattttgtatttattgaaatgtttcaggggctgatagggatgagttagcctttaagagcatcttctgctccttccaaaggacattgagttggcctttaagagcatttgctttttagcaccacgtcacagggctcacaactgcatgtgactctagttacaggagacacacttgtacacataaaaataaagcttaaatatttttctagtctttttttttccaaaaaaaaaaaaacttttgttgtatatcatgtttaccc

SEQ ID NO: 24715 - DNA, 1099 bp, Mus musculus
atctgatgagcacttaaaacattccaagaattctgagagaaaagtgacattataaaagtagcatgtgattgacatcagttgttgggaaagctacttccttctttacagttgaggtgggggaggactccatctgaagagcagttgcagatgccaggagaattagaattgttttcttctacatctgtaagcctatgcagtgttaggacagctggtgttgactgtgttttggtgcgttcgataatcagaattagctgtaaatgctgcagtgaacgaatgtacaaggagagcttaacacaatacattggaacagagatggtcctatcctgctggtgctttaccagatggctccaatctgctgtgagaactattgtgtgaaagactcttagtgtgtgtgaaagctaagggtatgatggccaggacatgactgacacaaagagcattgtatcctattaacttcttaggagttaagattagatctccagttctgtgagactcacatttccttgtggaaatgtgtatgggctctttcaggagtcagtggcctttgaggatgtggctgtgaacttctccctggaggagtgggctatgttgaatccatcccagaagaacctctacaaagatgtgatgcaggaaaccttgaggaacctggcttctataggtaagtatgccatcatccctttaatcggtgaaagaaagcatgcttctagatgagtttaaatatggtaaagaggtttgaatgactacttgagatccaccttatactgcaaattttgctataatctattaatgtatttactatgatgtcataatttataatgattcgactttaattgtattttagggagcagtttggagcaccatatcattgaaaatatataccgaaactcctggaaaaaactaaggtaatacggacctcaagagacagccatactctttataaagtagtaaaaaacacaggcatatccagtttcaaactcaactaccctcagggaattttcttcaacactagaaacattaaacatcctgaaaatgttataaggattccaatactggaaataacgtgagcatcattgtgcccaaagtgatttttgtcatactt

SEQ ID NO: 24716 - DNA, 1172 bp, Mus musculus
tgccatgtaacccagactgtcctcgaaccaattataaatcgtcttgtttcaacctctagatggtgggggtgaaagctgtctgcttccacatccagcatcagtcgttcatactccctctacccctttgatttctgcagacatggtttctctgtgtcgtacgggccatcctagaactctagatcaggcaggtctcgaactcaagagattcacctgtctctgctaccctagtgattgggttaaaggtgtgtaccaccaccacccagcattttttaaagatttatttattttttatttatatgagtacattgcagctgtcttcaaacacacactagaagagggcatctgatcccattacagatggttgtgagccaccatgtggttgctgggaactgaactcaggacctctgacagagcagtcagtgctctttactgccatctctccagcccccgcccagtattcttacagaaacctttctggactccatgcttcacatttttgctttagaatattatctctattttagttaatttttaaaattgtgtgtagatgcgtgtgtctgtacggatctgtgcacatccatgtagttcctgaagagggtgtgtcagagcccctggggctggagttaatggctgtgagctgtcccataggtgtgctagaacccatgttcgctgccagacttctgttcaaggaatggcactacgccgtttctctcgcccctagaaaatgatcttgacactgtttgagatggaggattacgtaagtacaggagatggaaacaagaaaagaccttagaaggaattacaaacaaaaagtgtactatcattacagtgattttcatttttatctttttgtatcaaatcaggtagtttttttctttcactttaagttatatacattcactggtgagttgataattacttgttaaatgccaggaaacataaaaagtgagttgttttcaagcctttgagattaatgagtggaggaaaaatgactttttgtggatattgagatttttttcttgccattttctttttaagactgtcattctcttctatgaacaagaaacttttatacttttttgttaacttttctctctacctgatgtttttttctaacatttcttgtcgccatgccctttacacaactttcaaaacacttttaggttatcaaa

SEQ ID NO: 24717 - DNA, 1219 bp, Mus musculus
gtaccaattcatagtagagcagaaaaggatgctagtaaataacatgagaaactctgtggtagttctcactaagtcaaactgcatgaagtaggttattgctagcaatgtggggaagtgtcagacaaatttgagaagaccatatacttttgaattgatgtaggtattactactagaaattctcttctaatatatgggagcagacactggagaaatgctgcaagccacgtgatgaaatcctcagcgttcttttcattgtggagaagatgtgaaatagctcacactggagaaaaaccttatgcaggccatgtggaaagcccttagttctcagggggccctcgagacatggtagttgtcattcagagagaaatccttcatatataatgtggtgatttgaataaggatgctccaaatatgcttatatatttgaatgtttattaaccagggagtggaattgttttgaaaggcttataagaattaaaaggcatggccttttttagagtagatgtgaacttttcagaggtgtgaggtgtaagacttggcggtggacttggaggtttcaaaagcctgtgcaagatccagtttctcggtctttgtgtctgtttttgtggatcaggatgtagctctcagcgactgcgtaagttcccagacatgatgctaatggtctgcatctctgaaactgtaagcaagcccccaattaaatgccttctcttgtaagtgttcctttgtcatggtgtctcttcacagcaatagaacagtgtctaagacatagaatcttacacaactttcagtcatcttaaggagacatgaaataactcactgtggggtagcctaacctacaggatttgtaaagtctccattattactttgttagtacttcaaaaggatgcatcgagaaaacccctagcattggaaagcatgtggggagatttctggattcaactcaaaaattaagaaatagcaaagtttgagaaacaagtttgattaaaagagatacttgattttggtcagacagtctcatccaccaagtctgtgtgccccctctggtgaagttgtccccaggtgtggtggctcaggcatgtgtcctacttgggaagcttgtgagaaggattccaagtttcagagctgtctgggtgtattgaggtcctggtattcccagggaaactgggctcccctttgggggattgtatcctgataataataagtgagcccagaggaaatc

SEQ ID NO: 24718 - DNA, 1199 bp, Mus musculus
gctttttcatggagcaatattcaggagccatgaggttagaaaagtcagatcaacaacctctatcttttgtatatcaaagacaattttattaactattttaacctttttattagatttagataattttagcacagcctacatttttggctgttgaactatttatactttttttggaacagtagtagtgaatttttattttctattttcagtttttgatctgaaggaatttgaggtgaaatgctggacttggtgtgaaaagtcctgatagatagatagatagatagatagatagatagatagatagatagggatatgtctaaaagaaatataaacaacatacaaccaggagctgagcataaaagacatttagttggtaccgtgtaccatgtgcataaacaagttttttgtttgttttgtttttgagtttagaggtcctctcttatttttctccttgttatttgttatttgagaactttgtacaatatatttttatcatattcatcctcctctaattcctttccaatttaaccctcttccctacccacctaacactgtgtcctctctctttaagaaaagaaaacgtcatcaagtagtttgtgctgtccccatacatggactcttctttcttcctcctccacctcctctccctcctctgcctccacctccgcctccccttcctcctcctcctcctcctcctcctcctcctcctcctcctcctcctcttcctcctcctcctccccctcccccttcctcctccttcttcgtcttctttttgagacaggattcctctattgaagctctggctgtcctggagctactcagtgtgtaaaccagggtggcctcgaactcacaaagatacacctgcgtctcacccttatctgagaagctgtgggcacaatgtctcacccctatctgaggtaactgagagctgcttgggagagggggtctgtcttcttcttccttctccttctcctctccctcctcctctccctcctcctcctcctcctcctcctcctcctcctcctccttcttcaccttctacttgttaaattagatttgttgatgtcattttgtgtgttgttttgcctgcatacaagtatgtgtaccacatgcatgcttcctgcccacagaggccagaaagggcatcacgagagctggagctatgagttgttatgaactccatgcggatgttggaaatc

SEQ ID NO: 24719 - DNA, 1134 bp, Mus musculus
ccacagtatcaagtctgaatttggagttcccttctttttaggctcccctgattccttgctaaatggaggagtcttggtagagtaccctgatggcctgaacatagggaatctcaccgttttccttgtcttctacagaaaagatctagggaaaatataatattgtagtttgaggctgctactttggtagtatgtcttcgtgggccccagtttgtgctgggtctaggcagtgttaaaataaaatatgacacctttgtctgggtcagacttttgctagtgattaccagcacactgaggctttgggcaggtggaggaaatttggtaccacagacaaggtgtttcccatggtaacctgtaacaggaaggaggaaatggagaacactgacagcttcctctgaaatgggtgatttcccctcaaagagggaagatcagaatagagattctgggacattccccatgtagtctctgctttggatgctgagcatcttcaggtgtcatgcctggaataaatgccgtacttgttttgtgatatttccatatctctttgtgagttcctccatgatctgtccttttgtgactgcagtgttcctcttgcagacagtggcttttgcccaagctcccggtgaagcacataatcccacaacagatgtatcgtgaaaggcgctgtctcatggattgggtcattgcctgaatgagagttggtggaaaggttatatccatggttaggagtataggcttatagtcattgtaactatagggtaggggctagagggaggtggctcaggggttaagaggtcattttggagaggacccaagttctattcctagcacctacaaccctctgtaactccagtagcagggcatcagatgacctctcctgacctctagacactatattcatgtgtacatattcacatagacacagacatatcatctgtacacaattaaaagtaaagtaaactctaaaaaggggggggggtcctggtaggcaaggctgcccacctagtaagtcagtaaaatgctttgctcctagaatgctttttccctcagggtttcagtaggaagtcagagaatggagatttacaagatgtttatttttcactaatcaagtggtagaatatgctggcttatgataca

SEQ ID NO: 24720 - DNA, 1197 bp, Mus musculus
catactggagagaaaccatacgtatgtaaaaagtgtggcaaggcattcattcattccagtcatcttatcagccatgaaaagatccacactggagagaaaccgtatccatgcaagcattgtgggaaagccttcattcaacggaaggcgtgtcacaatcatgaaagaactcatactggagagaaaccctatgcatgtaaatattgtgaaaaagcatttaggtgttccacataccttcggaaccatgaaagaactcacactggagagaaaccttatatatgtaagcattgtggaaaagcctttacacatcagagtgcccgttaccgtcatgaacgaattcacactggagagaaaccctacgtgtgtaaaaaatgtgggaaagcattcagtgattgtagctaccttgtgaagcatgaaagaatccattggagagaaactttacacatgtaagaatcaagaagcttttatgtgttccacattcctttatacacacaaaagagctgacagagaagagctgagaactttacagcagtgtatctggtggacttgtctgtgcacaacttatatgcatgaaaaaaatgtgagaacagctcacaaagaggctcggcgggtaaaggtgcttgttactaagcttgagaatctgagttccgtcccagggacccatatggtagaaatagaaaattaatcccccaaatttacctctgaattccatgtatacatgtggacccccacacaaccccattatttaaagtgtatatacatatagagaacaattgaaattttcagaagttagttgtatccctgatatgcaagcatatataggataaaatcctatggcactgggcatggtaggatgtgccttttattctagcactgggcaaggtggggatagtaaagagtagagagttataatggatatagtggatttgaacactccatgggaagtttaggatgagctagttacaagcaagcagaattttctttgcaagaagaaaaaactagagagacagttcagctgttcagagcccatgctgctctgccagggggcctgagtttgtctcagcatcaacattgtgtggcttacaaccatctaagaactgtgatgccctcttctggcctctgtagggatagaacacatgggatgcatatacatataaataaaataagtctttttttttaaaaattatgtgtacaaagcaa

SEQ ID NO: 24721 - DNA, 1132 bp, Mus musculus
aaaagcatgaaagacgccatactcaagagaaacagtatacatgtgctcagtgtggcaaagcgtttagacggtcctcaaaccttcacaaacatgaaagaattcacagtgaaaagaaactttatgcatgtaaacattgtgggaaggcctttagcagtgcgggcaaccgttacaaccatgaacaaattcataatgcagaaaaaacctacatttgcaagcagtgtgggaaagggtttacactttcctcttaccttcgaaagcataaaagaattcacactggagagaagccctatacatgtaaatattgtgggaaagccttcacccattcgggtgctcatcacaagcatgaaaaaattcacactagagagaaaccatatgtgtgtgtatagagtgtgggcaggcattcaccttttccaaatcccttcaaatacatgaaagaactcatagtgctagagagaaattctacaaatgtaagcagtgtgggaaagtgtttgcatgcttcttacactttcaaaggcatgaaaaatctcggtcatggaaagaaacccattgggtagaacttgtacctatgtaagctatgtgtaactagtcaacttggttttgagactatttgtttatcatttgtctcatttgcatgaggtttggggcaagaatacactcatgcctcagtggacatgtggggagcagcagacagctttctggattcagttctcatattttcgttatgtgagtcccagtgatggagctcagatcctcagtctcagccacacgacccttctaagccatcccatcagcatttaacttgctttttttaatgaatgagatttcttttttttttaacgcgaaaatatctcaatctttatttttaaggataattgtcattaatacaggaagaactgatattataaaaatcagaaaacattagcattcaataaacaaaaattaactgaaggctgatcaggaacatatgcttggcattggaagaaggatgtatgctaatcttcttaaacaattgctagaaagtaaaaaaaaaaaaagttctaacagggctacagtgtgctgggcagtaacttgtagataaacatgttttagacaatgggtggtattcaaagctcagtctatgacatggtagttc

SEQ ID NO: 24722 - DNA, 1115 bp, Mus musculus
taatccagagttcccataacacttttacatatgtctgcttcaatggttgaggtaccctggaagggccctattaagagctgcataaaaagaatgacatttctacttttaatattttgatgaacttcctcacatagtacctggcatgtgccaacttaccaccacatatgccagcttactttaccaccaacacaagtgtaaactgtaagggttccttttttcacacatcattgttaacattttggtctaataatagccatgtgactagaataagatgaaattacggaatgtttgatttgcatttccctgttggttaaatattttgaacaattcctgagtatgcattagccatttatctctgtaattatgagcactctgctcagttccatagaatattttagtttcttgttttattcctaggtgttcagaaacttgtatattgcaggcactattctggcctattttgctggaaaagttttctgtcattttgtaggttgccttttcacttaacaagctttttttttgttgttgttttgtttatttgagaatatagaaaccattaaatgtgaaaccactcaatgtggtgactcatttataattccagcatgtaggaaactgaggcaagatgactgcctcaagttcaagtcaatccttgactagagtgagaccatatctttcaaaaagaagcaagccaagagtagtggtcaagctaagacatcatgcactaatttgaactgtacagaggagtcaattacctttctttgttcctaatcttttttttgggggggggggtgttgagacagggtttcctctgtgtagccctggctgtcctagaactcactttgtagatagagcaggctggcctagaactcagaaattcacctgcctctgcctctcagtgctgggattaaaggcgtgtgccaccaagcccggctttgttcctaatcttaatggaaatgctttgcgttctttttatctagcacaaaatcagtgataattttgtcatatagactttatccaattgtttctgtcctatcactttccaaggtttttgtcatgaaaagaaatttgaattttcttaaatggtgtgtgtgcagttattgctatgattttgtagt

SEQ ID NO: 24723 - DNA, 1107 bp, Mus musculus
ttcctggtgaattagaagccaccctgagctatataatatcttgtctcaaaaaccaataagcaggaatctgagaggtggctcagtcgtaaggagcgcttgttttttaattatgaggagctcagactccagcatctattattaggtggatcacaaataactgttagtcagagctccaagggcacttctgtgccctcacaggtacccacatacacatgtgtgctcatactcacatagacatacacacagttaaacacatggataaacataagtacaggaagacagtcaaggtcacacatcacgtacacatatgcaccaaaaaacaaaacaaaattaattgttatatagtctgagtgattacactctgcaatcaagctagtatcccgagacatgggttcctctcgatccccacttcctatctgaaatctgcatatagagtagcgatgatctatgacaaggatctcctacctgcccagtgtcagtttcagaagactggggtaggcaaattgggaggcttttgggttgtactggcctgccctgcatagtgctcagacccctccctccctccctccaccaccacagttgggttgtaggaaactggtcacgctgcagccgtagctgtgacgctggtgtgcgtagccgctcagtggtgtgccaacgccgggtgtctgctgcagaggaaaaagccttagacgacagtgcctgtccacagccacgcccacctgtgctggaggcctgccaaggcccaatgtgccctcctgagtgggcaaccctcgactggtctgaggtcagcttccacctttttccccacccaacccactctcagtacagaaagcacacaggaagtgagctgtccatttggaaaagctgttaagacaaccttgtcccaagtcctgctgttaccatactcagaaggagtacattatggttcccaaggcttctgaactctgggcttggtctggcctttagcatatgaaagagtacaaacctggggcacgtggtactttgtgggtgacaaagtagcagagactgggctggaggacagcatagggcccacctgtccactccttgtgacacagtcctagcaccctgaccatccattgaatataa

SEQ ID NO: 24724 - DNA, 1367 bp, Mus musculus
tttattatagacccatttcttttgtgcttgacacatacctgggtacataatcatcatataggtccataagctactcactaagtatacctgtcttacagaaccatcatattggtaatggccttgtgacaagatggttgtattcaatagtcaaccctctagaattctaatctaaagttggctccacagttccctctctctgtaacttgctggagcataaggacaaacatttgaagccatttggcaggttcttcacagcaggttaggctgttgtcatgcttggagaacaatggcaatgtagtggagggagctgtagttgctggcgctgccatacgtggtgttctaagcattcacttcatacgcaagggtctctcctttttgactatgtcaccgaaatccaacaggtgatctggactgagtggagcccagactgaggctgagctctgggtttgcctgatgcgtgtggtctcttcttccctccctgtgccaggccacgtgctgtacgccgacatcaagatggagaacggaaagtccaaggggtgcggtgtggttaagtttgagtctccagaggtggctgagagagcctgccggatgatgaatggcatgaagctgagtggccgagagattgatgttcgaattgatagaaatgcttaagcagttgccttttttaaacatcaataccagacctctgaatttgtattttttcttgttaaccattttaatttgttggctggatgtataaagatgtttaaaaaattcagttgcttttttggggtaatttgaattaattttttaatgattggggttccatttgactgtttgcattgagattgcaatgtgcgcaattttttttgtagttgtggcatcttgttgacatcgaatatgactttgataataaataccagttcctgaaagtggcttgccttttttgtttttgtatattttgtagaggtggccatttgagatctgcagagctgtcaacaccagggatctcaccctcattgttgcttgcgtgtgggccccaaggtttgaagagagaacctggttatacacttattagtaaagattctagaaggtcgtcattttcctaggtgtgataatagcaatcctgaaagtcgtcctgtagctttattctgtaagtcccagcttacttcactttggcttttctttgttcaagcccactgagaatgtcactgtttggggcttgttaggcaggagccccaccatagactcactctcttggcaacacaaatgtttgcagcctacaaggggtttttgggtgcagctactagtcatctaagttgtgtgtggatgtatcctctcatcagctcctttcagttgggagggtaactgattttttccccccacct

SEQ ID NO: 24725 - DNA, 1091 bp, Mus musculus
tttatcttttacatggctgtgtgattattttgtgccctagaagtgctaaaggaattgcagcaatagtggacatcagcagggcattttaagagggacaggttctctcaacttgaaggttgtaagtaactttgaattgtctcctgtcagttaccctgagtatgaagttttctgtgctttttaaagagcattcgtaatgtctgctgatggggacactacaaaggtttttagaaattgaagtatgacaactcatagccagtatggaggtgaagttttattccttctaaattttattgtgaaatttttacctgtgctatgtagtggaaaggatgattgtgtggatttcaatgtgaaaactttcaagaggtttttttttgtttttgttttaatagtaaattactttgagcatgacttcctgatttgagcttaggatctgaagtgcccagccaggcacacattagtatatgaacatctacataagtctctgacttctacttgtgctttttattcctgtttcaggtggagctggaggcagtgtccctgggatcgagaggatgggccctggcattgaccgcattagcggtgctggcatggagcgcatgggcgcaggcttaggccatggcatggatcgagtgggctctgagattgagcgcatgggcctggtcatggaccgcatgggctcagttgagcgcatgggctccagcattgagcgcatgggcccactaggccttgaccacatggcctccagtattgagcgcatgggccagaccatggagcgcattggttctggcgtggagcgcatgggtgccggcatgggcttcggcctggagcgcatggccgcacccattgaccgtgtgggccaaaccattgagcgcatgggctctggtgtagagcgcatgggtcctgccattgaacgcatgggcctaagcatggatcggatggtgcccacaggcatgggggccagcctggagcgcatgggtcctgtgatggatcggatggccaccggcctggagcgcatgggcgccaacaacctggagcgcatgggcctggagcgtatgggagccaacagtcttgagcgcatgggcctggagcga

SEQ ID NO: 24726 - DNA, 1161 bp, Mus musculus
tggacgctgaaggaaagtcaagggtaagtgtctgagagaatttcttctgtggatttactacatgacaaatgtaactgtatggtggcgtggactcgaatgaaatcaggaaggcagtgagtgctcatgttactgtagccatgtttgatttttgccaacattccagtagggtgggagggggcttgcaaacaggagtcccgcttttccaaatggctggccaaagagctttctggtattctgtttggatgcccaatttggataactggggaccaatagcagcattgtctctttgtttaacaggaattggctgtgtgtgaattatgcatggaattttagtggtggtataattaaagtaaaagtgtgttcttgtctagaaaatgttactcttggttgtttgctgatttgaaagttgtgtgaaccaaagattctgaaaagtagcctctgtgccagtaaattgtaaaccacaccttacaaacctgaatgttcaaacttggcctagtttaatgagaacataaactatgttctgttgtgtaatagaatggcttagaataatcaaaaggaggattttagtttatggaaaggatggatttatttagtaggagtatggtaaggattgattgagtataaagggaagcagatcaaaagtttgtgtgatttcttggagaacctgattaggtctgctcaggagctttagtgcagtgctggtaatgtgtaggaagaggagattaaggagcccagctttttacaaggaaggctaggtcatgcacttctgtcagcttccccttagaaggattaattttaaaaatcttcaacttttgttacgtacatcatatcttttaatttgttcctgccattgatatttactgtttgtgttttttgttttttctttccccccttgctcatctgactggtctgtggcgtctttcaaagggatgtgcgtaagtattacttacttatacttactggcatttgagtttttcaagttgtaggactggttttattcatttttttttgacttttttttatagtgttgttgaattcaagatggaggagagcatgaaaaaagctgctgaagttctaaacaagcatagtctgagtggaaggccactgaaagtcaaggaagtgagctcttttttttccttctttttccttggtggtagtaat

SEQ ID NO: 24727 - DNA, 1374 bp, Mus musculus
taggtttggcccatgacaaatgccagggctccctttcctccccagggtggaggcctgtctctacctccccacccactgcaggactgcccccgcaggtctctttccgataccattgccagctgtactcggaatggaggaagacaaatcagaaagtccgcctgaagattcgggaagcagatggctccgaggatccacatcactccttgctggctactggactcttaaaaaaggtggcagaggagacccctgtgtgaaggcctggctggcagggctcagaggtagtagacagaccagagtcagatggcaatgcagctggcatttggaaagatggaggctgcctgacttttcatgcacagctatgatgcttctcaggcccgtagccacagccagcagagcctgctctgtgatcccgtgtgaacatattttcaagggttttgttttgcacattgttgtatatgacaagcacagatggacagatttgagctttggatggagtaggcacctctgtctcattttgagatctgtttgacaccttttgcacagcagctttagcgctggtgtcaagggcgcccgttggactagaaggttccagcaagcttcttgcgttactctgcacctagctggcttgctttactggcactcttgacttataatcttataaagttgcactgcatttcaaaaacccacccctgaatgaataaaaggagcccttgctggctaatatggacgcatcagttatgtttctaagctgttccaagcgagtgattctgtgggggcacaaagtctaaaatgcttggcttgttctgtggggactgtatgaagcttcttttcttctcttctcttattgctatgataaaggacctgaagtggagggacagagatggctcaggggtgaagagcactggctactcgagaaaaggactggggtttaattcctagtgctcttcacagcttgtaacggtctccaactccagcttcaggggatccagtgcctctttaggctcccatagacgctgctcacatatggtgcaatacataagtgcaggcaagatactcatacacataaaatacagtttttttttaaaaaaagtaacttagccctgggactaaaccaccactcaaagaaaacacgtggtgggactcatggctccagctgcatatgtagcagaggatggcctagtgggtcatcaatgggaggagaggcccttggtcatgtgaaggttctatgccccggtataggggaatgccaagaccaggaagcaggagtgggtgggttggggagcaggggtaggcgggaaggggataggggatttttggagaggaaactaggaaagggaataacatttgaaatgtaaataaagcaaatatctaatt

SEQ ID NO: 24728 - DNA, 1197 bp, Mus musculus
gatgtaacctggaacttatgcagaccagatctgcacttgtttgttttctctctctatgtgtattggttagatgacagcttacagaagttgatggtcccctttcccgctctatagttcatggttgtcgggcttggtagcctttacttactgagccatctggccaacattccacttgttatttgagacagtctctctccgtacctggagcctactgttttgtctagactggctgagcagggatctctagaaatctgcctgtctctgacctgaagcactggtgttacatatacattgtacaaagcacagctttttttaatgcaaactttgggggtctgaattcagatcttcacactctcatggcagatactttatcaactgagccatttccctagtccccttgctcacttccctttttgagacagggtctcatgtaggccctcacacttgctgggtagccaggatggtcttgaattcctggtcctcatatctctacttctaacggctgagatattaccacatctggcttatgtactagtgtacattttttattactcctctgttctccacctgtttgtcccgctctcttccaacacccctggtgaccacccatctttttattgtctccatagtttttcctcctctgaaatgtcacatactcgaagttgtacagtgtgacagcatgcagcctattaagttttctccatgccttcttgtggcttgatggcccacttttgttgttgttccatactgagtattgaatccatggatctcatattctaagcaatcatgagctcattcccagccctgtttctatattgttattttaagacagtacctaagtttctcagacaggtcttgaactcactctgtagtcctggcagaccttgtccagtcttagttttctgagtaactggatttacgcagttaatcaggttacattcctacagtaccagatggactctttttaatggttccaccaaccacatgctggacaagcactttaccactgatttgcagctccagctctcactttgtgtgtgtgtgtgtgtaagagtgttgtgtgtgtgtctgtatgtgtgaatgatagtgtcttagttaaggttttactgctgtaaacattagacactgtgaccaaaggcaagtcttataaatgacattatttaactggggctggcttacaagttcagaggttcagtc

SEQ ID NO: 24729 - DNA, 1195 bp, Mus musculus
ctgaccgtgcagcccacgatgagtcccctggcaacaacgtggtggacatcagtgtgccacccaccaccgatggacagagacccaacaagctgcagtgctgccagagcctgtgactgccctgcactttctttttcttttggttttggtttgttttgttttgtttttcttggttttttttggtttttcgagacagggtttctctgtgtagccctggcagtcctgggactcactctgtcaaccaggctggcctcgaactcagaaatccacctgcctctgcctcccaagtgctgggattaaaggcgtgcgccaccactgcccggcttgccctgcactttgacccagcgtgcgtgcacgtcctcgatccttggccagcccttcaccagtgtcctcccggcccctcccttgtccctctaggacaggctgctcccaccctccaagtgagctccgcctgccagcccaatggcccaggaagagcaggagtccagtggcctctcctgtcctgcctgctcaagagaagctaaaagccccttgcttatgtacctgctcttggatattgtgggcatcttgacaggatagggaggttggtaggatggacaaggccagccagaggtgaggaagatgagtggaaggaacctgcttctcctgttttccagacttcagagatcgaaaccgcctttcctctctggccagttgaccagctggccctgtatcctcatcccaaactctctctgagctgatacccgaagagccaggcatcagaggctgagcaggtggacattctgggctctgcctcctgcctacaccaccatagccagtgccagcacggcctccagcattcccaggcctgcgcactcctgctcctgcctgtagatttatgctgggagaagacacccttgcccctctccctcctcctctgcacgcagcgctctcctctgcccatccccacttctctgtctcgtctccgtgtctggtcaggaacctgtctgcaagtgaagcaatatcttcgtgttttgtatatacaactgctcttgtagcctttggtttttgttattgtagagaacagattctttatacactttgtaaaatttacgccaaaccccagctctcgaactcttattctccctgtagcccttgcactgttgcccgttactaaaatgtataagccacttctgtacagaaacctaccactcagctt

SEQ ID NO: 24730 - DNA, 1199 bp, Mus musculus
acagggtttctctgtgtagccctggctgtcctggaactcactttgtagaccaggctggccttgaactcataaatccgcctgcctctgcctcccgactaggattaaaggcatgcgccaccacgcccggctatcagcttggaatcttgtgcccctgtttttggaaggctgaggaccagtttttagattttggaagaaaacaaagaggtcagggaagctgtagatctctgcagctcctgggaggttggagatggataagaggagagataatttagggtccaagaaaggaggtatatctagcactggagcttagtaagcaactgtttgggtgagaattcccataatgttagggtaagcacgtttagtatattgacccatatacagaggagattttctttaaaaggaaggctttttaggttagatcttggaaaggctggaaacttagccttaaagttttgtaagccatgcccttgcctttcttcatatgcatgacttgtaaacttaccctaactggctacttctgttcgctaaccctatcctggggttccctagtttctgacttcttctctcctcccacagcaagacctgcaggcgaagctacagctgcgctaccaggagatcgccaagcggtgagcaggccgtgcttgctgccttcatcctgacattcttccaccaaacccaaggctggccatagtggtacagtctttaatcccagcactcgggaaacaggcaggctgagttctgagttcaaggcctgcctgatctacatgatgggttccaggttaacccctgtctaataaacaaacgtgaaaaaacaaccctaaatttgctgttctcttgaactttccttggagaattgagcagagatctttcttgtcaggctgtgaaagcaaaaatttaacttttaacttcattgggttgtcttggaatagttaggagataggttgtattatttgttggtctcttgggtagctttgcagtcttcattgtgaccacccacatgaaatgctatgttctcaagctactgaagggggaggatgaggcccatgtaggccaagtcattgcttaaagtcagttttgatcacatttatatactgatgagtctttgccttgtcctcaggcttttggatgccaatacaaacgagtgttcttgctttgtggggttggtggctttagcactcagagactccacctcactttgc

SEQ ID NO: 24731 - DNA, 1197 bp, Mus musculus
tgggttttgtgtataaagatttattgttacacataagtacactgtagctttcttcagacacaccagaagagggcgtaagatctcattacgggtggttgtgagccaccatgtggttgctggggtttgacctcaggaccttcagaagagcagtcagtgctcttacccactgaaccatctcgccagcccatatttttcttttttgttttgttttgttttgtttgtttgtttgtttgtctgtttgtttataaagacagaaagaaggcatggagattggaagtagggaggatctgggaggaaatgagagaggaaactgatcagagaatatattgtatggaaaatttattttcaataaaaatttaaaacaaacacaaataaaccaaaagatcctcactgttctttgtaggcctggttctaactggagtttgtcgttttttcttgtagttctgcaatggcagccactgagaagaaggcagtgacacctgctcctcccatgaagaggtgggagctgtccaaggaccagccatacctgtgaccctgccctaggttaccttgctatatatgtctctagggccacatgactgcttttcctccttggactccctctggggagagtgtgacctaatttgtaacaaatatatagaattccacattatttccaatctgtcttttcttagtatttatcgattggatttgatattactgtgtgccgggtgtgtgaatacatgctgcagcatgtgtggacatgtgtgccaggtgtgtgaacacacgctgcagcatgtgtggacatgtgtgccaggtgtgtgaacacacgctgcagcatgtgtggacatgtgtgccaggtgtgtgaatacatgctgcagcatgtgtggacatgtgtgccgggtgtgtgaacacacgctgcagcatgtgtggacatgtgtgccgggtgtgtgaatacatgctgcagcatgtgtggacatgtgtgccgggtgtgtgaatacatgctgcagcatgtgtggacatgtgtgccgggtgtgtgaacacacgctgcagcatgtgtggacatgagaagacaactttgggaattggttttctccttccacttggtttttggtgtcctgtgtactccaggttagctggcccaagagtgtctgcctgaggctgctgtctgtacctcccagcctgctgtaggattagatttgagccactatgtgtcat

SEQ ID NO: 24732 - DNA, 2135 bp, Mus musculus
tgtgtgtgtgtgtgtgtatgagagagagagagagagaaagagagagagagagagagtgagttagggtttctttacatattgatagctgtcttagaactcactatgtaagccggggcgtggtggcgcacgcctttaatcccagcactcgggaggcagaggcaggcggatttctgagttcgaggccagcctggtctacaaagtgagttccaggacagccagggctatacagagaaaccctgtctcgaaaaaccaaaaaaaaaaaaaaaaaaaaaaaaaaaaaaaaaaaaaaagaactcactatgtagactaggctggcctcctcttccaagtgctgggattaaaggtgtgcaccaccgtgcctggcatactgcattttcttgcatggatgttttgaatctgattgactctatgtttcagggattgagtcatgtgctcagaatgggcagtgccaaccacagtctgcccttccttgctcctgtgacaacatcagtggttgctctgatgtctctgacaagaacctcaactgcagccgcccaccctgtcaggagagtgagctgcattgcatactggatgatgtctgtattccacacacgtggcgctgtgatggccacccagactgtcttgactccagtgatgagctcagctgtggtctgtgtcctgggatcttggtatacctgtgtgggtggggaaggctgacagttatttaaggacatttctttccttccatgggtgactagtttgaggatgtaaacacacgcttcctcccaggccttcgtccctgtgctggtggacaggacatcatgaggattagtgatttcccaccaactttactctgtcttagatcaggatgaattctaagagttgggcactggaaaccttgtgtaccagactgctaagccctgggcgcccctcagctactgatgccttgccttgttgcagacactgacacagaaattgataagatattccaggaggagaatgccacaactacaaggatttctacgaccatggagaatgagacctctttcaggaatgtaacatttacctctgctggggactcatcccgaaacccaagtgcctatggggttattgcagctgctggtaagataggctttcccatgtgaggaacttggggctctccacttactagtctgcgatagttcctgccctccttatcctactcctgaccatctgtctgtcccctacaggggtgttgagtgccatcctggtttcggccacccttctcatattgctacgcctccgaggtcagggttatctgcccccaccagggctgttggtggctgtgaaggagtcgctgctgctgtcagaaaggaaaacctctctgatctgaggacacatggttaccacctggccctgagtgcagtcagactgggacaaaggagccgtgaaacacgcaaggagcttctggcttctcagctttgagacctgggctctttggagcacagagaactttgatttttaagcttctacagatatggtcctagagactggggtcctcagacactcccgctgtatgtggtgagcttggctggaaacttgccatagccaggactgaggggctggccccaggacgctctcaagaaatggggctactgtggtttagacactcctgctgctcacattgatgggtggctattaaagtttcttcacccctctgtctgcctctagcctgtttcccttggcctgggcagcctatggtctcggctggatctccttctaccttttaaaagggagtcttcagccaagaggtctgtgtcctggacatttcctcctatactctacttttataaagtgaggacgagtattgagtccacactcaacattaacagtgggcttaataggagaagagacctgaagtaatgtttccttattgggcattcctttgtcatggcttcttctgtgacatggaagctgggctaacctgatttgaacttggctatcccctgttttttcagggctataatcccagcagttgggaaggggagataggagaattagaagtaataggcttgatgtacatgcctgtaattctagcactggggaggttgaggcctgaagagctggagttcaaggaatgtctgtgctattcagggagaccttatttcctttcttcc

SEQ ID NO: 24733 - DNA, 1099 bp, Mus musculus
gacacaccagaagagggcgtcagatctcgttacggatggttgtgagccaccatgtggttgctgggacttgaacactggacctttggaagagcagtccggtgctcttacccactgagccatctctccagccctctcctatgtcctttgcacagcccctctatccctgttcctcatccacccctcccctttcttttccagataatgaaggaaatgagagtcccacatcgccttcagactttttccatagaaggaattcagagcctgcagaagggctcaggacccccgaggggcagcaaaagagaggactgacagagaccccagcatccccgccaggggcatccctggaccctcccagcactgacgctgagagcagtggagagcagctcctcgagccgctcctgggagacgagagtcctgtgtcccagctcgctgagctagagatggaagctttgcctgaggaaagggacatttcctcctccaggaaaaagtcggaagattccctccccaccatcttggaaaatggggcagctgtggttacctctacatctgtcaatgggcgtgtctcttctcacacttggagagatgccagtccccccagcaagagatttcggaaggaaaagaagcaactgggctctggactgttaggaaacaggtaatagtgggtgaggaggaaggcaggcaaggaggcaggactctctgaagggagcctgatgtcctaggtctccctgcagcctcaggccctttctgtcatttttcttctgtccttagctatataaaagaaccgatggcacagcaggacagtgggcagaacacaagtgtccagcctatgccatccccccccttggcctctgtggcttctgtcgctgattcctccacaagggtggactctcccagccatgaactggtgaccagctctctgtgcagcccttctccatccctgcttctccagacaccccaggctcagtctctccggcagtgtatttataaggtgagtgggcagtgtcccctggcactgcattctcaccctttccctttctgtgggtattgcacctcctgctcctctgttttccccatcttcctgcccgcccgcaagtgcgtg

SEQ ID NO: 24734 - DNA, 1200 bp, Mus musculus
tttggtggtgtttgattggatgttttacttaatagtgagcctcagttgccccgtctgtaccatggggttgacaggggtacctgttttttttttttaaatactgtgatggcttaaaatcagtgatgctttcaaaatgctgttattctttttttttttttttccctagagacccccccggccgccctcttctttcctttgttcctgtggctgggggggtatctccttccacagcatggagccgtctgctctgtcacccagtggggccacactcccactgcctctgtcactggctccaccgccactgcctctgccggcagctgcagtggtacacgtgtccttccctgaggtgaccagtgccctcctggaatccctcaaccagcagcggctccagggtcagctctgtgatgtgtccatccgcgtgcagggacgggagttccgcgctcacagggccgtcttggctgcctcctctccttacttccacgaccaggtcctactgaaaggcatgacttccatttccctgccaagcgtcatggacccaggcgcttttgagactgtcctggcctcagcttacacgggccgcctcagcatggctgctgcggacattgtcaacttcctcacagtggggtcggtcctccagatgtggcacattgtggataagtgcactgaactccttcgggagggtcgatccgcagccactacaaccactgtcactactgctgcagccccctctgtctctgtcccttgtgccagtgtcccatcagggaatgggggcactgtcgcccctgccaccgtaggctctgtccgttcccatacctccagcagggccagtgagaatcagtctcccagcagtagcaactacttcagcccccgggagtcgactgatttctcctctacctcccaggatgcatttgtggcctcagcagcaggtagtgggaaccgtcgggatggtggcccggtgttcccagcccctgtggttggcagtgcgggtaccacctccgggaagttgctgctggaggccgatgagctatgcgatgacggtggggatgggagaggggccgtggcccccggggctgggctccggaggtctaactgcatgcctgccagtgcagtgccacagaaacactgggtgtatgtgaagcaagctagaaattgccctgcaccagcctccctggtccaccaagaccccgatctagaagatga

SEQ ID NO: 24735 - DNA, 1145 bp, Mus musculus
tgaatgtcctgaatgtttgcttttctctctggacaccacctaacaggtagatagaatcgtcattggctttccccatttctggtgcttttatgcaaatattctcaccgaactcagtcctttgccttcatcatttgaagtctccaaatggggacagtctgaaactccactggcacctctactcttagctccaccctgtgcaggccctttgtggggacagtagttctcttgaaaccacctgccctcacactgctggtcttcatgtgggatggtgttggctaccttttgccctatgggtcgtttttttccaactgtaagaagtaggatctattttgccagctacttttatttgtggcattgaagcaaggccctgtgcagctatgtgctggtccaataaatgttattagcaccaagaaaaagttaggaccctgaggtccccagatcgacctccagataactagcaaagaacctactgaaagcttgggcttgggaatcacagtgtatggggtggccctgcgtgctcagtgacgggtgatcagatgtcgactcaccgtgcttctcagatctgtcaaagataatcccatgtggcttctgcagggcaggtgtgtgtgcctcagtgactgtattagttatttgcagagttagttttgtatgtgtgtgtgtgtgtgtgtatgggtatatgcgtgtgagtgcagctgcccagggaatccaaaagagcttgttggatcctctggggctgggttacggctggttgtgagccatgtggcgtgggaaccgaccttgggtcctcagaagtgcagtctgtggtttaaagtgctgagtagcctctctaggcccttatctgagtcctagagtgctctggaccagagctgactctcagaagactacttcgcatagacttggggtaaaatcaagttactatggcctgtcttccccatcagatcactttcaggtcacttctgcttgatatgaaaatcatgaaaatgggggtgggggtgggggttgggtagatggcacatcagttaagaggactggctgatcacccagagggtctgggttcacttcacagcacctacatgacagctcaccgctgtaactccagtctcaggggagctggcactctcacagacatacacacaggcaaaaca

SEQ ID NO: 24736 - DNA, 1100 bp, Mus musculus
ggctcatagccacctgtaactctaattccagggatccagtgtcctctgctggcctcctttggtactgcacacatggtgcacttacatgtaggtgaaacacacacgcacacgcacacgcacacgcacgacgaaattttattgtgcccttagagatccgggccatctataggatttgagaatcgtggttggcagtgtgtgtgttcaacacctccagggctgcaaacctctcatcaccttgatttacccctatgatattgtaaatggatgtgtccctgaagcgtgggtaacctggagcttggtcgggccaccaactctccttctcctttccgtttctttccactctccccacgcacgcccagtggtgctgaccgtcctcacccataaccctgcccctcgagtccagctgggaaaggatgcagtgctggacctgcgcttcgcctacgcaccctccgccctggaaggttctccctctctggacgcaggccctcctccctttgggctggagtggcgacgccagcacaggggaaagggtcacctgctgttggctgccacccccgggctggccgggagaatgccaccagcccaggaaaaggctacggcatttgcagcttgggatgacgatgagccctggggcccgtggactgggaatgggaccttctggcttccagccgtgaagccttctcaggagggtgtctacctggctacggtacacctgccctacctgcaaggacaggtctccctggagctgactgtgcacagtgagtcggggaacaccatggcaggggtgatactgaagacagttgggagtcctaggcatctgaaagctttaacatgggattgttgtgaagttctaacggggagacagagcgccccctgcagtattagggaagccagaagaccaactgagggagggagggaggttaattccctcagttacctttcctattctttcttcagaggcccccagagtgtctctaacaccagcacccgttgtgtgggctgccccaggagaggcacccccagaactgctctgtcttgcatcccacttcttccctgcggagggtctggaggtcaagtgggagctcagaggcggcccagga

SEQ ID NO: 24737 - DNA, 1526 bp, Mus musculus
acttccctcccaacacttccaattccccacttctttcttctcttgcagaagtcacagtaaagaagttctcgtctgtggaagccaccctcatctctggcccagatgactccagtagcccctgccccagaacaacagccttcttctcttcttctccctccattgaatagctcggatttttttttttaaggtttttttgtttgtttcaatctttcttgttttgttcttgtttttagacaaggtctctctatgtagccttggctggctgtcctgaaccctcaccaagccaaccaggctggcctcgaagtcccagagatccacctgtccctctgcctcggagtgacaaacggcactggacaccatgcctagaggtcttttttttttttggtttttggagacaggatttctctgtatagtcccggctgtcctggaactcactctgtagaccaggctggcctcgaactcagaaatccgcctgcctctgcctcccaggtgctgggattaaaggcgtgcgccaccaccgctggactcgaactaaacttttaagatgagaaaaaagcgagacttagcgccacactcatttgatgcccacagtcgggaggcagaggcagtggatctctgacatttccatgccagcctgatctacaaatagggagtttcaggtcagtcggggttacttggcggggctttgttgagagaactaaatataagaacacacatgcgtagagtcccagggttgagaagaaccagtgtatgcgccagagaggcgggttcataacctgtggctcacaaccccctttaagtccatcggaaataccagacattaggattcacaacagtagtaaaggcagttacgaagtagcaaagaaaataattttacaacttgaactgcgttaatgttaagaaggttgagaaccactggccaggggattaggacgaaaggtcttcatagcatcttaagattctagagacctcagggacagcccacagcagtagtctagagacggaaaggtccatgtgtctccctcgcggactaaagcctacctctccagctctccattcctaccacagcttttcttttgcctggtccacctttaccatctccgggcctggtgggtctcggccctttacgaatgtccccgtgtggttcgtcctctcctgttcgccggtcctcgtgagctaataaagtctttccgagtttccatgcgggcctctcattctcccgtttccaagcacagccaacctcggtcacctcccggtcctcgtctcgcacccgggagacgacatagccaccgtgggaaccgcgcgcgctcgggcgcacggtgagagccggacgcccggagcgacggacccgagtggaaccggaagcgccgcactagccggcttccgccccctccccgcgagtgggcgggcataagggcggcacagaaaacccggcgcggattcgctccgttgcactcgtgccggggcggcagtgtcattctcgagctgcagtaacggggtcgcgccactgctagggcactttcctc

SEQ ID NO: 24738 - DNA, 1150 bp, Mus musculus
gaaaaacaatcgtgattctgctgtggcttcagagttcgagctggtgcagctgctacctggggatcgaggtgagcaggatggagggatggcgcactgaagggaggcgctcggagagagggccgaacgctaatccccgccctcttctgaacccacagagctgaccatcccacactcagctaacgtcttctatgccatggatggtgcatctcatgacttcctcctgcggcagcgcagaagaccctctgctgccaccccgggttcccacagcggcccctctgcctcaggaactcctccgagcgaggggggagggggctcctttcccaggatcaaggccacggggaggaagattgcacgggcactgttctgaggatgaagtcctattggtttacatagcaactcataccaggagtgagcagccacacatggtggccacaatattagagcagaaaccctgaaaggtggccagccaccctgggacagtgaagtcacctgtttacgaaaccactgcggaagccagccccagccccagccccgtgggactggtgaccacgtaaccatgttggatacctgcatctagcttccacctctgcggaatgtggcattatcatctgtgctgggaagagtactggtccctgccacatgccagcctgtgacaggccaagggaaggcctagaggctgagcctggggcagagggcagtgacaagaggttcttgtcccactctggggattcctgtcactgtgacaacactaagaaaataaaccaaaacactacctgaaccctgtccccatccttcagtgcgcggagctggatactgcgagggcagtgggttgaagttaggtggcccagaccaaggggcagtggttctagtcccaggaggtacctggtatagctcagtagcaaagtgtttggtgggattcgggaggtgggaggccctgggtgccatccttggacccgagaacagatactggtgaaaggtatcccagggttcccttcagtcctggctcctttaaacacccgtttcttcttgtcccctaagaagcaggggctcctggatgacagtgatccctatggacttctctcaagccagatctctttttttttttaaatcattttatttatttatttatttatttatttatttatttatt

SEQ ID NO: 24739 - DNA, 1098 bp, Mus musculus
cagagctgatacaaagaggggggccttcggagcaatggcagaagggcaaagaggcccaggaagagacaacagctatccatgaagagcacagaggccaggcagtgccccttctgtatttaggcagggtgcactggagggtgagacccactcggacaccagagtcccggcaccatgtgtcagaagaactgtggccggaaaactggggtccttttccaccctatgcctcgggcacaggatatgtactgtccatctctgctgtgcagctcatcctgaaggtggccagccgggccccacctctacctctagaggatgtctttgtgggagtaagtgcaaggcgagggggccttgcccccacacactgtgtcaaattggctggtgctacccactaccccttggatcggtgctgttacgggaagttcctgctgacatcccacaaggtggatccctggcaaatgcaggaagcttggaagctggtgagcggcatgaatggggagaggactgcacccttttgctcctggctccagggatttctgggtaccttgaggtgccggttcatagcctggttcagtagctgagaacccacagaaaacagcacctcagagacctttccccaaagttggtgcagaggctgcagatccctgtggtgatctagttcctccattttctcacagcaaactctgaagctgcaaccaaccaagtttaccaagataaacttgggccctggcctgccagctccggggagggataaagccaagggcgggaaggggactcacaagcagggacaagggtccaataaacatgtctctctacctcaagtgcagcgtcttcaccaggcccccagcacacctggagagcccagagctttcagtactgctgcatgttggtctttgcgacaaccacaatggggataacgcccccctctagggtgaaggcttgggcagtggtggggagacaggcagggcagtgagctgagtctagaatagccacacagggaagagcagacctacaggatggtccagacacgtctccagaaaccttgtttaatgcccacacacccaaggagctgtctgctcctacccagttaagatgtaaggcaca

SEQ ID NO: 24740 - DNA, 1495 bp, Mus musculus
cagggagctgggataacatctgcacagcccctctgcttttgagtaatagggtgtgtgtgagggggctggagaggtggcttggctgttagagcattagctgctcttccagaggatccaggttcaatgacccaacactcaacaaccattaactccagttccagaacatcagcgccttctggcctctggtcagtgtgccacagacacacagacatacaatgcaggcaaacataagacacaaatagactgggctagagagagaatccagctgttaaaagctatgacttcttccagaggctcccagtgaccacatggtggctcacaaccatctgtaatggattctgataccctctggtatctctgaaaactctgtactcagatctttaaaaacaaaagtctaatagcccaaacttttgacctcagggcgtggggcggagatatgctcatgtggtgttgaggaaagcagacatcgacctcaccaagagggctggagaactcacggaggatgaggtggagcgagtgatcaccatcatgcagaacccacgacagtacaagatcccagactggttcctgaacagacagaaggatgtgaaggatgggaagtacagccaggtgtgttaggggactggtggacacgggttgtccgttaaaactgggtgcagaatcaggagataaagttgtctcccctgtctcaaaatctaggttctggccaacggtctagacaacaagctgcgtgaggacctggagaggctgaagaaaattcgagcccatagagggctgcgccacttttgggggtaagtgggtgatgaggcttaagctgcccactcccaatcaggctgcacagtccaccggctcgcctcctgctgctctgtgacctgtatctttttcttctgcagccttcgtgtccgcggtcagcacaccaagaccactggccgcaggggccgaactgtgggtgtatccaagaagaaatgagtctctgggcctttgctgttaataaatagtttatatacctatgacctccgtctcagtttgtcttccatctgatagtacttaatgccacagcgatcctgagctctggtagtttaatctggctgcaggtgccttctgggtacagtgctcttggtgcacttgaacggaaatgtccctcataggctcctgctggtgtttgctcctccctttctgttgggtgttcacaaggagactgccttaggtgcagcaaactgggcggcaaccactgttaaaggtggggcagccggtgttgaaaacctccaggggaagcttgggcaggcttcaattgagtctcctgccgtagccgtgctaagctgttgtgaagtggctacagctccgccagatgctgctgctcgggtgagttaacagcagatgctggctgctctagaaaagcagcctggtattccgcgtgctttacagtagggacggaccgggaagggctggacctatgtgaaatgcacgccgcttgtcggcttccggcctagagagg

SEQ ID NO: 24741 - DNA, 1703 bp, Mus musculus
ggtccctgtgcaagtaagaatcatatttacaaaatgaaacaacccagaaaaataaggccgggtgtggtggtgcaggattttaaccccagcactcaggaggcagaggcaggcagacctctgtgagtcccaggccagcaagggctgcacagagagaccctgtttccataaccagaacacaaccgaagtatttgttccctttgctttatcttcaccccattcctgccgtacagtgaaagcccaccccgcctcatggcccgtctgttccccacgcctaggcagtgacgaagatccgggagtttattctccagaagatctactccttcagaaagcccatgaccaactaccagatcccccaggcggccctgctgaagtacaggtgggtgcggggtgggcgcggggtggcctgtgccctctcaacactgcagcgtgggcatccagggagtctgacttgccctggtccttccaaggtttttctatcagttcctgctgggtaatgagcgtgctacagccaaggagatcagggatgagtacgtagagacgctgagcaagatctacctgtcctactaccgatcctatgtggggcggctcatgaaagtgcaggtgagcaaggctggagacatggaggaggatggggaggaggaggaggggaagggggaggagggggagggatgaagtcctcacctgctgctggtggagagtgatggttcagctctgttattttctctagtacgaggaagttgctgagaaagacgacctaatgggtgttgaagacacagcaaagaaagatatcctggagaggagagccccatgagctgggctcatggctgggaccatggcggggacatctggctccagcctgcaggctgtgtttcgtttcgtttcgttgctttgctttgcttttcttcctttctttatttcttttcttttctttttttaagaagatttatttgctttatgtatgtgagtacactgtagctgtcttcagacacagcagaagaggccattagatcccattacagatggttgtgagccatcatgtggttgctgggaattgaactcaggacctctggaagagcagtcagtgctcttaatccctgagccatctctccagcccggggctgtgtttcttacccattctgtggttctcaacctttgaggacatgaaatcgagagctttttctctaagaagcactcgccgctctgacagattttcacatttatttctgagggtttgtaaaaccttgacagccattaagggtgtcaggccaagcaaggctcaggttctggaaagggctatccgggccatatttagtttcctgggactcgggtcttggcttgttgggcctggtgcagttggtctcattggtttccctgactccaaagctgttcacgcttcttctcgaagccgtccctccgaagcaggaacaccatctttacccttggcactcgtggtactgtcatctcaccggccgagctggaggcccccatcctagtgccccatactgcccaacgtggagagcagagggtatggtgaggcaacccctccatggccaggatcagttccctgagtgttagtttggtgtgtgggggggggccggtgtccctggcctgctgtgatgcgggaagttaggagccatggactcagaggcgggcagagggagactggctggggcgtgactgttgggaggcaacagttgaagtga

SEQ ID NO: 24742 - DNA, 1210 bp, Mus musculus
tgatgggagctctgggaatccataatagctcctccagagaaatcttctaggtgcctgagttgtgccatgaaatgaatatgtacatgtacatatgcatatacatttgttttgttttaccctaggctcccagacctctgatctgtctctcccagattgtaaaggtgacactctagggtctgattggggaggggcaatgtggacatgattgggtttcaggaactcccagaatcccctgtgagtgagtgatgggttgttcgaatgttgtcttcacagtgatggttcatgaccctcattctctagcgtgaagacagctgcctggagtggacttggtgacagacaatgtcttctcatatctcctgtgacatccagagccctcagttctctttagtcaagtgtctgatgttccctgtgagcctatggactcaatgtgaagaactgtggagcccagtccacccctctacaccaggaccctgtccctgcactgctctgtcttcccttccacagccaaccttgctggttcagccaaacactgagggacatctgtagcctgtcagctccatgctaccctgacctgcaactcctcacttccacactgagaataataatttgaatgtaaccttgattgttatcatcttgacctagggctgatttcttgttaatttcatggattgagaatgcttagaggttttgtttgtttgtttgattgatttgtttttttgaagaaataaatgatagatgaataaacttccagaatctgggtcactatgctgtgtgtatctgttgggacaggatgagactgtagcagctgagtgtgaacagggctgtgccgaggtgggctcagtttgctttgatctgtgatggggccacacctccactgtgtcacctctgggctctgttccctctatcactatgaggcacatgctgagagtttgtggtcacaaagacacagggaaggcctgagccttgccctgtccccaggattatgagcccccagggctaaagatcagagactcaactagggatcctttaatgtgccagttgcagaagacaatttacccatttcctctcacccattcgttttagctactaatgatgccatgttaacgctcccctgggttctccctgtcccatgctactgtggtggtttctgcttctccttctctccagtttctcttccaggggtctcaggtgtaggatgtgattttttttt

SEQ ID NO: 24743 - DNA, 3552 bp, Mus musculus
gagcggagcaagtagtatagaggaagggcttcaagggacgcggatcccgaataggtagattgagagtcaagtcgagtcgtctcttgttcctccggtcagcgtgatgaccatgggcctgcgggccccccactgggtggctgtgggactgctgacctgggcggctttggggctgctggtggccggacacgagggtcatggtgacctgcacaaagatgtggaagaggacttccatggccacagtcacgggcactcacatgaagatttccaccatggccacagccacgggcactcgcatgaagatttccaccatggccacggccacactcatgaaagcatctggcatgggcatgcccacagccacgaccatggacactcacgtgaggaattacaccatggccatagccatggccactcccacgatagcctccaccacggaggacatggacatgcccatcgtgaacatagccatgggacttctagggaggctggggctccaggcatcaaacaccacctggacactgtcaccctctgggcctacgtgagtcgccaggggatgtggggaagagggactggttcttaatcggtgggaagctccatctttgccttctgattgtgcttctccaccaggcactgggggccacagtgctgatctccgcagctccgttcttcgtgctgttcctcatcccagtagaatctaactctcccaggcaccgctctctgctccagatcctgctcagttttgcttccggggggctcctgggtgatgcgttcctccacctcatcccgcatgccttgggtaagtaacttgtgggctccgcctcaaaggcttaagcggttttgttctttctctttaatgatcccagattttccggttgtcttcaaacacacatcccctgagccaggcattccctcatcaagccttttctcccacttcccgcagaacctcattctcaccacgctccagagcagcctggacatggacactcccacagtggtgagaaaaaccagggactggtgtgctgggaaagggcaacctctccattcccatgcttcgcctcttacacttgagtctgcgtctcccttcatgctttactgcctccgttccaggccagggccccattctctctgtggggctgtgggttctcagtgggattgtcgccttcctcgtggtggagaaatttgtgagacacgtgaaaggaggacatggacacagtcacggacacggagacaggcatgcgcatggagacagtcacacccatggagatagacatggtgagcccgcgttgcctgctctgtaacacactcagggtcaccctgtggagcaggacacatgcgaaagctctgttccccactctgatcaactcctgttctccctcagagtgttcttcaaaggaaaagcccagcacagaggaagagaaggaagtgggcgggttgcggaaaaggagaggaggaaacactgggcccagagatggcccggtgaaacctcagagccctgaagaagaaaaagcaggctcaggtaagggatgagctgatgggttggctgtgggtgtgtgggtgacggtgggagtctaggaaatgggggcgaggggggggctgtatgtgaaccggcttgatggacaccctcaatcatttttgtcttgtctctttgcaaaaagacctgcgtgtgtctgggtacctgaatctggctgctgacttggcacacaacttcacagacggtctggccattggtgcttcctttcgtgggggccgagggctagggatcctgaccacaatgacagtcctgctgcacgaagtgcctcatgaggttggggattttgccatcctggtccagtctggctgcagcaagaagcaggttggtgccgactgcccatccttggttcctaacaagctacactacagtgagccgtttagagtcagggaaagtcgtgcctttacctcttgctctgttttacgctgcagtcctcacctgtgtatagttctttgatggcttaaggttctcaggagatgtctgttctagtactccctcctcaacctggctgttttggggggctgcgggccttaggtgtggtcctgaggcagagtcattgactacgtattagctatcgagggagccccaggcgacagctatctgactgcttcctggagctggtgtctgggacccagattcctgtcctcgtgcttgtgcagcaagcactacctgtgggtccttctccccagaccctcctttccttaacactgctcccacctaattttagctgtcgacagtcatatctttctcttttctgcccaccaggcgatgcgtctgcaactcgtgactgcaattggagcattggcaggcactgcctgtgcccttctcaccgagggaggggcagtggacagtgacgtggcaggtggtgcaggtcctggctgggtcctgccattcactgcaggcggatttatctacgtagcaacagtgtctgtgctgcctgagctattgagagaggcatctccactgcagtcactgttggaggtgctggggctgctggggggtgttgccatgatggtactgattgcccatcttgagtgaggggtgaggtgacctgtccttcccctaactcctaataaaggcagttggtagtcctggccagtgctaatgccagaaggagtgtcagccttggagattagcagagcctctgtttgaggccttagaggtatgaggatcatacggagcatgagaggccagaaggaccacggagtgggagactgcccagcagcgttgttgcttttggaaaaatcaatgggaccatgaagaagactgggaagacggtagcctacccgatggtccctaatctacgatttctcagcgccagcgtgccgcaggggtccctccaaggcccatctccctctgaactagttagtgatggcttcagggaagacctggcagaaggactggggtagacatcaatcgtgtgtcctgatttgaagggggaggggggctccttgggaagatgtctcagcctgattttttgtctctactcattttataccactgtttgaatgggtgcggaggaacggtgaccaggaataaaagaccttggatcttcggccccacatgcagcctttgtctttatgtggggaactgggccccttggctcctggactccctaggtccccaagtggtggtggatggtcacgcccccgtggtgggaggtcgcgctggtggctaccaaaggcctctgactagtgtggtttctattgggtccgtaccgggcctagccacgcccccggcgtgctcagattggcctaggctcagggcacgcccacccacagccgccatggcgtctcagctccggctccgctctgcgctggccctggtcacaggttcaggggttccctctcagggtgggttggggtgcccgggccatgtcagcgagagccaccccttgagtccctggccctgttgtctgagtttcagtaactttgcgccccgtgacctctgacctcctcccttcttctcccgcttccgcggactcccatctcaggtgcgggtagcggcatcggccgtgcgatcag

SEQ ID NO: 24744 - DNA, 3552 bp, Mus musculus; identical to SEQ ID NO: 24743

SEQ ID NO: 24745 - DNA, 1487 bp, Mus musculus
taccctgagcagcagggccggtgagggcctcggggctgtggacacctcaagggggaggtgggggttgtgaagctggggtatgtccagggcctgggtggtgctggctctcactcccttcctccccacctcaggtttgccaagctgctgttacgtcttcctgccctccgctccatcggcctcaagtgtctggagcacctgttcttcttcaagctcattggcgacacccccattgacaccttcctcatggagatgcttgaggctccccaccagctagcctgagcccagatgcacaccgagtgtcactgaggaggacttgagcctgggcagggggcagagccatgggacaggtgcagagcaggaggggacttgcccagcctgccagggatctggcaacacttagcagggttcgtttggtctccaagtcagaggggaccccagatccctgtgaggactatatgtctaccttcagtggccttgagtctctgaatttgtcggggtctcccatggtgcaggtgattcttcatcctggctccccagcacaaagcactgccctgcttccttctcatttggcctcactcccttctgaagagtggaacagagctcccccagaaaggggtgttgtggggcaggccccccaagctgatgatcatgggagcagggctctgacagcctttatcctctcagacttgacagatggggcagaggagggacctgcctctgactcctgtcagccccatttccacagtccctcctgcagtcagactgaagaataaaggggtagtgaaggggctgctggaggtggaggaacccattgctcttttaatttcctgtgaggagagactgggagttagactcaaagaagtactgtacatccccaggttgacttaaatgtcagggctggagatggcatgtgggcaaggaggcccctcaggtgggctgtcccaaagctccctgggctctgcctcgggtggccctacagctcttccctagtcctcagcacagctaggctgggagcaagtggggacattgatgggggtggccagcctgcagagttgggtgctgggctgcatggtttttgccctggacctcttttgggggttccctcccatctttcacttgcacataaagttgctttccagttaaaatagccattttctggactgagataactatatgggcggtgggcaccagggcatctacctgtggggatatccggtgagaaaccctgacatgttccctggatgctgccacggcctgaggttccctgggcctacagagccggtgcagggtgggggacacaaggcgtgctttgtcgggagggggagagggtgtgccaggttgggggcggggctgcccagggaggagggagagcggctgcttttcaaaggcgccttgtttgccggtgcccttccagcgccagcgggcggcggcgtcttggtcacttcagctttcaccctggcttcgccacaggctcctggcagacccgg

SEQ ID NO: 24746 - DNA, 1301 bp, Mus musculus
atcctgccttcgaaagaaaccccggaagccctacagtgagtatcagatgattgatgtccatcagtcaacactgctccacagtagtacttgtgaggacagcaagatgtgggggtctggtgtgtgtgtgtttgtggcaagcagcatccaggatgactgggctgcttcaggaatggaagttggcgactctgggggaagacttggcaatagagtgagtcctgactttccccctccagctattaggaaacctgtgggaaaaacaaaggaggaactggctttggagaagaagcgggagctagagaagcggttgcaggatgtcagtggacagctcaactccaccaaaaagcctcccaagaaaggtatttcagactgctaaacgttatattcactctttctctccttaagttgaatgctgggacttgaacagaggattggctagctagcaactagcccttgtgactacctgacaaatgaaaatgtcacatcttctacctttaactttacagcgagtgagaagacagagtcatctgcacagcaagtggcagtgtcccgtctcagtgcttctagttccagctcagattccagctcctcgtcgtcatcttcctcttcttcagacaccagcgattcagactcgggctaaggggccaggccagatggggcaggaaggctccgcaggaccggacccctgaaccacccttccccactttcccttgctgtgacgcttcttcatctcacccctccataggagagctggctctgcagtggggaggaaggcagggacatggacaaaatacgattgaattcctagccctcttgggtgtggtgtccctgttgaggatgatgggggtggggcaagggtatgggtgggagtggggataggcctggcataaagccccctgagctgtagctgtcctgttcacttctaagggccctgttttgaggttttaatttatttaagctatgtggtaaggctgggggtgtgtagccgtggtcctccctccagcttccatggggagggaagaagagggagctctttttgttttttacattgactttttttttctacttttcccttttacttccactccatttggggcctggggattttagtcacctctccagttggccccaagactgtcttttctttcttgagtctaacatgtaaataaagaaaatattattgaagttttgagttagttttcttagtgagatttgtttctgtgttcaaagtggctcagaagaaatggttgagtattattggtgctggggtgggtggcgattgttctgcttgattcggtgctggg

SEQ ID NO: 24747 - DNA, 1833 bp, Mus musculus
accatccctaaaaacagccataagaagggggccaagttagcaggtaggaagtggtgacctaaagacaaagctattcaggtgacctgaagatacaaatgagcaacacttacctgtcttttgttactgttttgtagcactccagggcagtattaccagtgcccatcaggtgcctgctgtctcttctgtgtcgcatacagccctgtatacaccaccacctgaaatacctaccactgtcctcaacattccccacccatcagtcatctcttctcctcttcttaagtccctgcattctgctggacccccactccttgctgtatcagcagcgcctccagctcagccccttgccaaggtatacatcagtaggttgattgttcaggatgactaggaagaaaggggttaaaagaaatggaccagaatgactgattccctccatctttctactacagaaaaaaggcgttaaacggaaagcggatactaccacccctacacccacagccatcctggctcctggttccccagctagtcctcctgggagtcttgagccaaaggcagcaaggctccctcctatgcgcagagagagtggccgcccaatcaaacccccacgaaaagacttgcctgactcgcaacagcaacaccagagctctaagaaagggaagctgtcagagcagttaaagcactgcaacggcatcctgaaggaactgctctcaaagaagcacgctgcctacgcctggcccttctataagccagtggacgcttctgctcttggccttcatgattaccatgacatcattaaacaccccatggacctcagcactgtcaaggtacccactgcatggggcagatgggctgctcaggcaggggctggagcctggggaccaataaagcaatacccatgtctcctcatgggaacatggcagtttttcattctgtgtatcttacaaagttgtacaaagtcacatactttgaagtccttgttttttacagttaaggataagtgtggggttagggaaatgtaatgggagagagatggccttggtcacttagaaatgttttcttctagacatagatatttcttcaaacctaccccaaatctttggacttcaaacttgaaccccagggcacagatccctaaggtcatccccacttgtttcaagagagggctgcttgagtcgggttggcagggaaagatgagactctgcctgtgcagcttctcatgctgcctccttctgcagcggaagatggagaaccgtgactaccgggatgcacaggagtttgctgctgatgtacggcttatgttctccaactgctataagtacaatcctccagaccacgatgttgtggctatggcacgaaagttgcaggtgagcttaagagctgcagttgaatttactccacagtaactgcctatggggagagtttaatttttgctgtgctttaaacttgtaagactttgccaatcttttatcaagttggagctggtatgctgggtggctgggcattaaacacagttttgagtctccctgtcttttttaggatgtgtttgagtttcgctatgccaagatgccagatgagccactggaaccaggacctctaccagtctctactgccttgcctcctgggttgaccaaatcctcttcagagtcctccagtgaggaaagtagcagtgagagttcctctgaggaagaggaggaggaggaagaagatgaggacgaggaggagagtgaaagctcagactctgaggaggaaagggctcatcgcctagcagagctgcaggagcaggtagatcattgtgttgtgctctgtaattgggtaagaacttggactaagttaaga

SEQ ID NO: 24748 - DNA, 1173 bp, Mus musculus
cccatttttgtttcagatcttctccataaggctagagttgtcatgtgacattggttttgtatttattttaaccaagcagctcgtcaaactacccagtgtaagctaaagatggacaaaaactattgttaactctttgctggttgcaattcacttcactgctttttatttatttacttgttatggagacagggtttctctgaatagaccaggcagaaatctgtctgcctctggctcccaagtgctgggattaaaggtgtatgctaccactgcccagccagtctggctttgcagggttgcatagtgcaagttagcaacattttcttgatctttcatgttattaccacatctaattctgcttcccctttttgcaggctccctggggaagggaatgcagggttactggggctgggcccagaggcagcagcaccagggaaaaggattcgaaagccttctctgctgtatgagggatttgagagccccacaatggcttctgtaccagctttacaactggcccctgccaatccaccaccccctgaggtgtccaatcccaaaaagccaggacgggtaacaaaccaactgcagtacctgcacaaggtagtgatgaaggctctgtggaagcatcagtttgcatggccattccggcagcctgtggacgctgtgaagctgggtttgccggtgagtaagaggctggatgggcatgagctggaatgcgtgagtgggggtgggtgacctagcataggtgctgcggcccctagggagttcccattctcttagagcaaatagccaccagagttgtagattcttggtcctttgtgcttgttatctctatcttggcatttctcatcttgcctccatgtgtcccttaacttttgtgccctggctccattttacagattcccacccctggttgggagaggaccacggtggccaaaattcttagcttcttcctttccctcatgcagcccatggatagccatccccagaggtaatgtcacaggatgggaagtttgcagcgtgggtgggaggtgggtggctagagaaaaggtatcaggaacctcctagtgggaattaaattacctttttctagactagtttaattggggccgcagtgtgggcaatattccttaatagctagggtgtgcgtgtgggtgtgtgtgttttgtctgttggtag

SEQ ID NO: 24749 - DNA, 1130 bp, Mus musculus
gcctgccccctcgcctttgcttctccaggcgcgtgagcgggcgagcacgcgcggagggggcgggggagctcgcgagcagggtggcgcgcatgagcagcgaagctccgcccctccggctatatataaagcgctggcgcggggctcggcggcgccatttcgcgctggagtggagcagcctctaggacgagctggaggattgcgcctactgacccagcgtctcggagcctctgcgggccgccagtacaatccacgtccatccgcttggaaatggacttcgtcccggcccgcgaccgctcccggcggacagtgcagaccccatagaagcccccgaggctcccctttctcgggccccgcccagtcctcggtgtctgtccacccctctactccgccctcaagaggatttcaaagatggaggcggcggctctctgaaacccctttttggtgctcatccgcctccatcggaggtctgacgcggctctcgtgaccccccggcgaccgcggcgggaagaggggacccctgtccaccggcggcaggccgaattgacgacggtgtccagtttcggggactgccgggtttgcagactgcgttctcctgtggctcgccggccggcagaggccgccgccattttcctgctgtcgccgcctgcggagcgtgcaaagctgccggagttgcggggaggacggcgcaggagacagcgttcccgccggtcccgcaacgaggctgacgcctggagggccaagggcagcggccttccccccacttcccgggttatgctgggcccggcggtgaggggagccgaggctacccggacttcacgcagctgagcggcggcggttccctgaggtcaagatgctgcaaaacgtgactccccacaagtacgtctccgccaaccgtgtgtgggaggggggttggggggcggcgttccggggagcggcgggcgggcgaggcgcgcttccgcgccgcagctgttgacgcgagctcgcggagggggctgcgacggttttgaagcggtggcggcggcccaggtactgcgtctgagcagcctgtcggtttccgcgacgcggagacccattcggccaggacgagttggactgcagggtggtgggggtgtgtgcgcagatccagcctt

SEQ ID NO: 24750 - DNA, 1208 bp, Mus musculus
gggctgcacagggatttgtagatcatggtggggacggtgaaatgagtcactgatggagtaccgtgtataatgatgacctcaggaagagaggatggatccaagggacagaaaacaaaggttgggattttcgttggatgagtgaaaaccatctgaaatgtgttcagcatggaaactgggtacgagcccacagatgaacaagtaggcagtctgtatgaattgatcacaagggtgctacagtgatgatggtgaagagatacgggaagcagtgggaatggaagggagtcctcttctggcctccaagagcattcacacacacattacattcacttatacaggcacacattcatacacatagagaaaaatggtaaaaaaaaaaatccagtctaaaaatttttttttaaatattctggggactttgattgtttctttaaatgttagaatatgacacatcatactttactacacaatcccacctgtctgtaatttcctgataatctccagcatcatttcttttatgtcaatttccagttgcacttctgtttttcttgcaggacttcttggtgacttagtctgccggagactggtgatgctgcctcacactccctcctcattggttggatcagaaaccagcctctgtaaaacctctttgtcatccgcgtcttcatttccactttagtggtaagtgtgaggtttaaatgttagagtttaggggaaggaaaacctgtgtgggaagttccccttgtgcaggcgcttgcctcctggggagagtcctgctcttgtgtctacagaactatgtgatttcaaagggagaccatggggtctgcgatgggactaggggacatagagcactctaagccacaattaggccatgagtgctctagcactagctgttgtggaagtaaatgagtattcagtgtcaaccaccttaatgtatgtccctgccagggaaatctaggagacatgtcaatgggacaggtccgactctgagtcaccagcgtgcatgttcctggttcagctctttcaatggaatggaatggctgtagacccatccgctagtagctggttctcacagcttctgagtcaacacgatttcatggtttgctaggcataaggaaagagccggggatggggaaacagctaaagcctccgagatcccaagagtctagtctaggagggctgtagaactcaagaaaaaaaatggaatctgc

SEQ ID NO: 24751 - DNA, 1193 bp, Mus musculus
cttcagccaacaggtaacacccattgtcttctctcagagacagatctgctttccctacagtatgggggctggggtgatggactcagggcacaaaatggggaagactgagatcccagggttggccaggcagttagcactgagccttgctccctgcacttactgaagcctgtgctctgaagcagcaatgattcggggcatgagaagttcctctctgctcactgccatgctgtaaggagaggcctgaagcagtcagagaagccactgcagagtgaggtctggaaacagccctgtcccctgtgctctacaggactcctgagctgagatgaagtaacaaggctgaaggaaggaattccccccgtgtctccatgccatgaaaacatgtcctgcttggcccacatccctccagagacactgctcttccaggacctggctcctcctgattctccaccctggagatctgtgctcctgatggctgtttatccctgacccaggccttgcagctcccaggacagaggccccactcttcacatctcctgtccccttttgtcccttgccttttgtctggcacttctgagccagtctgctgtcatatgcttttttacatttttctcaaataaacaaataatgaaagtcatctgcttcatagagtttcaagcagaagaaacagtaaaaagaaagacaggacccactataagacactgttcatgcataattgtagatgccagcagctacatgaactgggctcctgaaaggaaagctggggctgtatgggtggggggggggtggcgagagaagaatgagaccaagacaaagtttctgatgaaggtccaatgtttacattttgaatctgaacctaaagcggcgggggacccatcccctactatgccaggttctcctggcttgtcagaatctcctcaggaaaacaaactcagcctctcagcagatgtggcaggacaatagatgttccctacgtcagaagactccaccctatgtgggctagcaggctgtggcatgaacaaggtctaaatcagcctgctcaaggctgggagaaggcacacataataagcatgggagttattgtataagaaataaattcagttttaattcattaattgtcaattagagtatttttacaagttggattaaatttgagaataccacctataatcattacagacagagtcattgaagca

SEQ ID NO: 24752 - DNA, 1804 bp, Mus musculus
gggagtaaagactgtccaggatttggttttatatttgtcaccagatttttattattaatgtaaaaaaaggttggttttgtttttagggtttgttttgttttggttttttttttttggaactatcagtagatggacactggcagctttgtgagggacagagataggctctcgacgtctggcaccgtgctgttgggaaataggccttttatttttgtctgataattggggctcagtttttatttttattttacagacaactgttacaatattgtattccttggcattcattgttcagcatagataatgtgtacagtatttctgtgcacataatcttatttaattttttgcataaaataaatgcttttagatgtcttatgtaagtcttatctttttatcatgctttgctttcttaggaatttttatgtgaaagggctaaagtcacagaaggacatgactacagccaactctcccttatctatgtaaaatagtgactgtgcctcaggtgctcagtttgtaggactatggacatgtgcaagaatgaggagacgtttgaaattaattttctcttatcctcctcaggtgttttgcctgtctccactgtttctgcttggcttgtacccaaaatcctagtgggacgagctgctctgtttgcattatgacttggtcttgctgggatgtgtaaaatcactgaagtatcaaaactctccagaatgaaattctttgatagtatgtcaattaggttctcatagataagtgagagttggctataaattgattctgggtgaaaggtgggcttcttttaagtattttacatgtacatgtttaggtgtcagaagatggctagagaacagtgaataccaatgatagaaacaatatttcttgaaagggcgtaaaagccctgctcttcctgttgcctccaatctgctgacagagcatctatgcgtaccgtcagccaggtccctcattcagtcagtgctatattctatttacaagtttgacttagggccaccagtttgtcactaccaaaacttctttgctggaacccagtgaactctatgttgagcagttagtcacacagtgtaaggaagaaggttcctaaatgttaagggcactcgtcagaatacagcagaagcgttcacatctgttacagctctttggagttttgcattgaaacagttactgtcagggtctgttcctcctgagtgcctggtctctggcaccaagagtaaactggttggggattaagcaaattgagagggacttgtttactggaaatgtgtcaggttttctttgaaaaagaaaatgttaaaatctcttaggaatttggtatttacatctcagagaaatacaacacaaaagtgcagacttaaaattgagaattaatgttaaccctttgtgtctagtttgaagcttcttgtatttgtctaaaactacaagccagaattttgtatctcctttgataaaaagtgtgtatactgtaaagtagttttgcatattcttgtgctgcacatgggctggatttttagaattttttaaaagactttaagccgaaccttgtaatttgtgtaaatgacaagtgtaaaatccttccataaaatgcttaaaatatgcactgtttcaaataaaaccaagaaatgcagcattaaaaaaaaagaaagaaagaaaaagaaaatatgtacaacaaatgacctttccctccccagattacactagtttcttacagcaatagaaacctaattagaacactttctttacagaaatgttaacactgcagtctgatcccagatgcagacagaagtctaga

SEQ ID NO: 24753 - DNA, 1294 bp, Mus musculus
tagccagaagattccccaaaaacccaagtccacagatggcaagacaaaggcagaaacagacaaatagcctggcctaaatggcaagttcccagccaataagaggccctgtctcaaacaaaaggccagaggactaacagggaaaatgtcctccgatcactacacaccaagcatatgcgcattcgagtacatacactgcatgacacaagtacgtaatcatcagatggccacacaccatgcacacgcacacagaggcaggaatgatccaagtcgataatcatcagacacctatgattcaatgcatgagaaaggctggagggtaagttggtacgaaaaagaagtgtccccccaaatgaggcaatgcttagtggccacattgtttgggactaaggattttgctctgtcactgaacaactgcatgtcaggtagtactcagagaggctgcaatggatgagtgagaacttcagctgtggaggtaggaggcgggaggtgggaggctggcagaccaccttgagctccacacatccactggctccctctgtgtctccagtgtgccccaggctatgagggacagaactgctcaaaagtacttgacgcttgtcagtcccagccctgccacaaccacggaacctgtacctccaggcctggaggcttccactgtgcctgccctccaggcttcgtgggactgcgctgtgagggagatgtggatgagtgtctggaccggccctgtcacccctcgggcactgcagcttgccactctttagccaacgccttctactgccagtgtctgcctgggcacacaggtaaggcctggcatctctggggcatatctaagaccaggacaatcttgacggtcccttcccaaaagacagcctctctcctcaccctctgccttcacacctctccccttagaagtcccctacatcttcttgcccacatatcatgtgctgaaccgtcaggaggcagccactgaagccaggtgtgacctcctatctcacccccaccacaggccagcggtgtgaggtggagatggacctctgtcagagccaaccctgctccaatggaggatcctgtgagatcacaacagggccaccccctggcttcacctgtcactgccccaaggtatctgatgcaacagtcctttctctcttctccttacactgataagaacaccagacccagaaccctagggccttgagtggggctggagtcaggattactggagaaggcccaatggtgagtggctctcagaaacagtcatgggaaaggcagaatcagacactagcatggtgcaatt

SEQ ID NO: 24754 - DNA, 1117 bp, Mus musculus
cgctctgagaactaaagcctccctgatgagaaaactgggcctcagagaggttgatgaagacactaaatctagtcgatcggtggtggtgcacacctttgattcagacactcaggaggcagatgtaggcagatctccgagttcgaagccagcatcgtctagagatcaagtcccaggacaggcagcactacacagaaaaccccgtctttaaacaaaacaaaacactaaatcaagaaccaacacttgactggcaacagtggcacacacctttaatcctatcaggaaggttttagtcctagcaggaaagcagcagaggcaggtggatctctatgagttctagaccaccctggtgagttccaggacagtcagagctatatagtgagaatctgtcgcaagcacccctttactccatcaccctaaaaaggcagagcttggctaagatggctgcaattctcccaggggcatgctatcattctcttatccctttgatcggccctagtactcattctcatccgcagatggggtgacacccctgatgtcagccgtcttctgtgggggagtgcagtccacgactggggctagtccacagagactggggctaggaaatctggaaccctgggaaccactgctggatagaggggcctgcccccaggctcacactgtgggcactggagagacgcctctgcacctagctgccagattctctcggccaaccgctgcccgccgcctccttgaggctggagccaaccccaaccagccagaccgcgctgggcgcaccccacttcacactgctgtggctgccgacgctcgggaggtttgccaggtcggcacatatcggggtctctaaaggaagtaggagtacgcttacatataaaacagagaggtcttctctggggtttgacaaagaggaaacagactggagacctgaaggtggcaggtagcgactggcttcggagctgatgggcctataaccccagcactggggaggtgggggtagatagatctctatgtgtcccagactagcctgggctgcgtaagaagacattgtctcaaaacaaagacaggcaacaaaagcgtgagggagcctgacctagaagcccagggtaccctaggggtcaca

SEQ ID NO: 24755 - DNA, 2279 bp, Mus musculus
cgagcagatgtaggagccagggataaaaggggtatgcatggagccgctgtgttattggaatgttggggagagcggtaaggaggtgaagttcaaaatacaggcgcagtggggacagactagaggctcttatgctgtggcaggatggagagcgagtttccccatcactgttaagtacacatcttgtctcagtccatgatacgggaatggaagaagtaccggcgggaaccgtaatggggataccggggtcccaccgatccagaacaatacccattgtcctgcccgcgcgcccatgacgtcaccagggcaacacttgcagccgactgtcggttgccagggcaacgcttcccgcctctgaagaatccaagtagctctcccttcctccccccaccaccaaggccagaacccgtgggaaactaaaaggtaggagtctgacccccaactgcggggtaaccagctcccacgtggtaccctaggaaaaactgcactgcactgggccgctgctgtgaacaacgcccgagccgcccgctctctcctccaggctggagcggataaagatgcccaggacagtagggtgagccacgtcgcagcccccactgaacaagccaaaagcaggggaatccaacaggctccaagggggcggggcccagtgtctgacgggagggcacagactcccggggggcggggactccctaacagtccctgcccccgggctttcgggtctcctccgcaggaacagacgccgcttttcctggcagcgcgcgaaggagccgtggaggtggcgcagctgttgctggagctcggggcggcccggggactgcgagaccaggccgggctggccccaggagatgtggcccgccagcgcagtcactgggacctgctaacgctgctggaaggggctggaccgactacgcaggaggcccgtgcgcacgcacgcaccacgccggggggcggggccgcgccgcgctgccggacgctgtctgcgggagcgcgcccgcgcgggggcggagcctgtctgcaggctcgcacttggtcggtggacttgggagcgcgcggagggaaggtgtatgctcgctgccggagccgatctggaagctgcggaggccccaccacgcgcggccgcaggttctccgcgggctcccgtggacgacgcggggctagggcatcacaggatgactggcctcgcgactgggtggccctggaagcctgcggctccgcctgcagtgcgccgatcccgcctcccagcctgaccccgtccccagaacgtggatcccctcaagttgcctggggtcttccagttcaccaagagattcccttaaactcggttgtaagaaatctgaactaggcagctgcgtggaaggaaggaagcgacacgtacgagtctggaagactccggacttttaaggccaaaataaccgttaagctcacttgtctcccccatagagtatgcacagcaatgggaagagggtttaggatgtccggttgagatagaccgtgattttcctggaaaatagggcagcttcaagaggacaaagttgatttcgagaatccctaaactctggaaccaagaactgtgggcgaattgggtgtaaaatgtttcttgtgtatggtttcccaaaaggagcctctgctatctactgcccacaagtagctggcaactatttattaagcacctacgatgtgccgggtgttgtgtagatgaacagtaagtaaccagtggcccatccagctgatgactccttgccctctctctgcctccccacaaggacactggtgcagggatgaggccatgttctccagtcactgctatctccgagaaccccaaactcatggataataaagctaatttgaagtgctactttatcttctgagggactaaagggtgagatggaaaaagtgcatagtgtttgggaaattcaatactccagaatcattcatatagtgaggggttaaatataaattaaaggcaaaccgacaatctgggaattccagttcatctgggatatcactgaaagtgagaatctccaatagttttcaaatatacaaggtgataactgtgtccctcatctaagaccatttagctataacaaagatccctaagggctcaaagacaggagggtctcgaactgctcatacttcattaggctttaccccaatgctgataaaccaggaggcattctggaagattatccaccatttgaagggcattcaccatgtgccaaagtgcctccttaccagtaagccttagtaatgctgtgaggtaaatgacacgcagttgaggt

SEQ ID NO: 24756 - DNA, 2100 bp, Mus musculus
tcctctcttctctttcattgctgcgtgcatgatggggagggcgggcgggtatatgtgcgactgcacacgtcagcgtcacagggcagctctgcggtagttctcccatctttaggtgggttctggggatcgagctcagatcaggaggcgttacctgacagactcctttctctgctgagctgtgcgtgccctgccccacccccaaacacacaagaaccctctgaggcatcccgtgtgtcatgcctttctttgtaacctgcaggtggaatcactccgacactcgatggggccggggagctacggggataacattgggggaggtcagatatacagtcctcgagaaattcgggtgagtgggtcaaagggccttgctgcctccagctttgggttctcaccggggtgggagtgtgacccccacactgggatttcccattctgactctcattctcttttaccaggccaatggtggctggcaggaggctgtgaccccgtcctcggtgacatccccgacagagggaccaggaagtgttcactctgacacctccaactgaccttgcccctcaaggtcgcggggctaggggcttccaccaggcaactcttaaggactctgggcatctagaggacaaaccccacagaagcacaaaacagagggcgattggggttgtgccctccccgaccagacgcttggtgctggggtgctgacaacatggcagggagagtggggtgtccccatttcttctttctttttttcgtctcacctctcaccaaaaccagatacctatttctcagatgtctctcttaaatctacaacctaacaccagttgtgtttgtcttggactcctcctacttctgttccccaccccacttatatactctggaatctggagatgtcagccctgcccgacccagagatgccaaaaatggggactcttggacagaggccctgggccaacaccccctcccccatgcacccccacctcctgcccctccagacggctttattacctcatacgcagctcatcttaaaccaatagaaccgctcggtggacaagagtgtctgactcggatatctacctcggagggagtttctgctactttagaaaactgttgactaggctttggagttggactttttgttttgtttgtttgttttttaagaaaagaaaccctgaatctgtatttctttttaattgtttctgttggtagtggtgatccttaagttttaatatagtttgaagaagtagggttttgggtgtgtgtggggtgtgtgtgtgtgtcttaaataaacatgctgatttatttttgtttacccacttgagaagtaagagccaaaggggcctagtaagagacaagacagatctggtggtggctacttgacccagccccccagtggggaatcggattttgtaggacaccaggtcctcagcctggacacgtgggtttcttagcctgcgcaggcagatctctgctgtatttcctatggagcatgaagccctgtagcctcctgcctcccccacctccccagtaacctttgggcaagactagactgaactcagtgattttgaaaaagtcaaaaggcttttgttttgttttttaaactatttgcagagtggaaaagattgatcggggaggggagttcttgccaaatacgctaaatatgggctgggtgcttctatatgtgtctcccccagtttcccagaagtacatgtttctgttcagttcttaatctcatgccaaaatcaagggggtggggagaagagggcggtcacagaaagccaggtatgagggaaggctaaaaaagtctcagccctgaacccttctatctgaccccctcagacatcctcaggatcttcaagactgtcaccatggggaacccctcccatcaaaggcccaggctggactgagggagtgaagagggtggtgggaggcaggggccaggggcagtttctctcctcacttgtaaacatagattcacagaaaaaaaaaaaaaagaaagaagtggcagttttaaataaagatatttctttttcccctgggtttagttgagatttttttttttcaaaagaaaagaaaacaaaaaaaccaaaaaaaaaaaaaaaaacc

SEQ ID NO: 24757 - DNA, 1315 bp, Mus musculus
gtgctggtcacacatgatgccggtcctcatcccaccaggacgttgtcaggtgcgggtgctgcctccagtgtccacagaagggctgacaccagatgacgtcccagctctggcagacagcgtccggcactccatgctcaccatcttccgggagatctccactgacggcctgggtggtggcgactgtctgaagaagcctgggggagcgggcgaagcccggctctgagctccacccccttcttcctccctgtacctcccacccagggtctgaggcagggccaggccctcttcccgggtccccactccttcctctccttttggaatcctcaacttctgaagtgaatgtcactccatgttctttccctgccccacccttggactctcctgcgtgggtgcagtctccactccaagccccacctgccatcttgtcttgtgggacagttgcctcccctcatctcaagtggctcatccgatacaagggtggaagacattccatcccacccgtccctcaatggtctttgtgtggccttctctccctctccgccctacactggacaatggacttgtctgttgcgttctgaggagcaatctatccttcacccccaagtccacagcctgatggggctcgtctcctagtgaggactcctcatcctgtggctggaagctgcacctgacactcctcacaggctcacctggggactgactgcctcagtactgtcacctccatggggctgacacccaccatggggctggctcgtgtaactcagagatccctgcccgtgccagggctgagcatactccagatgccaatttctgcttccccctagcctcacccctgccccaggtagtggtcttcagggtcctggccgggcaccatctaaccaaattctggagaggcagacgccagaagctgctctctgctccctggggccttagggagaagaccctgaccctggagagaaggagaggagggcgcttaatttatttcttttttttttttttttttttttttgaggtacctccgtctctgagccaattttcatttcctcccagtggcgttggccacccctgcctcccactctagacccattcctaaaacccaggaggtagactggggggaaggaggaacgggtggggtacagttttgtgtggttggtttttattatctggataacagcaagcaactgaaaataaagagaaagagagacgtggggttctctgcggcctgttgtacttcagtggttgatatccatatcttctgatcccaggttagcaggtgtagcttctgtgtaagttggggaccccagctgctgcgggc

SEQ ID NO: 24758 - DNA, 1610 bp, Mus musculus
cttgaaccccagcactcgggaggcagaggccagagtacagagagaaacaacctccaaataaaaaaggaagtgaaaccatagaaacaatagtactgaaagcgaggacgtgagaagtgttgtgccagcacacgggaggcaggccggcctggtctacacactgagttccaggacagccagggctgcacagagagaccctgtgatgaaaagcaaaaacacaaaaacgaaagaaacaaaccaaaaataaaataagagcaaaaccctccagaggggagggggctggagagacggctcggtggttaagggtactcactggccgctctcccagaggacccaggttcaattgccagtgccacgtggtggcccacaagtgtctatgcctctagttcagggggtcgtcttctggccttgtgcacttccaaatgcgtctgcgcatgaaataaagacctctgtgtgagctctgtgactgctgagctgccttggctcggaagcctgccccatcggtgcacagggtctgtgagagagaagtaaagacggaaggggagaaggcagcatgtgtgcgtgtgtgtgtgtgtgtgtgtgtgtgtgtgtgtgtgacaagttagggaagctgctgaagtgagaggagggtcgaggtgggaggagccttagagccttagtcagctcacagtctctcctgagatgcctgcactatggcgtccaagtaaaaggaggactaaccctcgtctcccttcatcttcagtatttatctgccagccaactgctgctgcttttatgatttgtttattttatgtgttgggtaatttgcctgcacatgcacaatgtgtgtgctcgatgcctccagagatcaggagagggcattactgacagctgttagcaaccatgaggactctggggtcagtcttctgtaagagcagtgagttctgtctaccagcgagcatctcctcagctcctgtagccagcactggtgtcttcttcctgccccctcagatatccagaccaagctggaacctgcctctccgtcttcttctgtccactctgaggcctccttgctgtcagcagactctcccagtcaggtgacacaccttgctctcctgagcatccttctccaggggtgcgggaagctctcccttgaccacctgctccgtaccggcactcctaactaatgtctctgggctgccctgcacagccttttataggagaggaggttctggaagtgaagacagagtctccgtcccctccagggtgcctcctgtgggatgtcccagcctcttcgctcggagctgtccagatcagcatgggtccatcccctgatagttcctcaggtaatggggtctcctgacctctggggtccctgttgagaggcctcacagtgttagaatcccttcctttcccttcccttcattcagggaaagctccggccactcggaagcctccactgcagcccaagcctgtggtactaaccacagttccggtgccacctagagctgggcctaccagcgctgccgtcctcctgcaacccctggtccagcagcctgcgggtgaggaagctagagaggggcctgggagtgagctcactgcccccgagggccctgggccttcagggctcgtgt

SEQ ID NO: 24759 - DNA, 1189 bp, Mus musculus
cgccttattatgaaggaatcgccttcaatggagatttcaacagaatcagcagccatacttcctgctcttggggaacaggacaaaaactgaccctgactgaagtatccgtgaggaatccaggtctctgtataggcaccccaccttccactcacaaacacctatgcggacaaattcagtccatgtccagaacagaagctaattactatcttgtaccttccccggttggatggtgggcttgcaatacaggacttactccctgtgtatcaactaaggtttttaattcatctcatgatttttgtgtcatgatacagctgttaccccacgtatattatcaccctgcatccagtttagaagaaagctatgctggccggaggtcaaaaagagaaccaactactttaaccctggctgcattcatgggaataggtatggcagtaggagtggggacgggagtgtcagctttgatagaaggaagacagggaattcagtctttgagggatgctgtcaatgaagacctagcggcaatagagaagtccattgacgctttaaaaaaatctttgacctccctgtctgaggtagttttgcagaacaggagaggtcttgatttgttgttcctcaaggaaggaggactgtgtgctgcccttaaagaagagtgctgcttctatgcagatcatacaggaatagttagagactctatgcagaaactgagagaaaaattagagcgaaggaaaccggaacgggatgctcaacgggggtggtttgagtcgtggtttgaatcacgaccatcttggataacttctttaatttccgctgtagccggaccaatccttatgatatgcttagctttagttttcagcccttgtataataaatagaggaatggctttcatccagagtaaaattgatacagtaaaactcatggttcttcaaaggcaatatcaacctatagttcaggtagatgaagagttaggggacaccaatctctaaaattctatgattagaattagtctaaacagaagaagaggggaatgaaaggaaataaaactgtaattcatgtaatgtatgttaaatagcccaaagagttgtttgtgagctttgaaacctggggctgagaacatagcagaacagaccaggacatgcctgggcaggcccatcgcctccctagctcccacccctctgacctaagttaaatg

SEQ ID NO: 24760 - DNA, 1190 bp, Mus musculus
tgaagaagagtccaagctaagaacaaccccagaagctctgggctgtgggctgagaggctctgaaaagagtataagaccaaagaggaggcctgtctcttagccccacagggaatccttgggagggatgagcagtatgaggaaagaaaagctgaacacttgagttcggagaggtcctcatggggtctctcagtgtggacagcccattctacccaaaacaaacttttctgaggaaggagtaagcaaagtccttgcacacactaggaaggaaccagaattgaccagtgtaccagcaaggtacagaaacattctgatcttttaatttccatgtatttgtgatgttatcatagtcacatctctaactgtgttaacattctggattttctaagccacagtgaggttatggccaccagagggcagagtaagccctggtggaccagggccagggctctggaccccaggtctaacgccactggtgcttcacttaactgtcactttcctccctccttagctgtccagaacagccctaagggttgccatcgagacaagaggacccagattgtgtacagtgacgatctataggaaaccttgtggatggcttctaggacatgaagctggattccttgtgcctcatatgcccccaagctggtctcagtaaaatcctggggtagaagcttttcacctccgtcagcctctagtctttcagcacttgggattggagttaagccttcaaaagcggctgtcagtgttgatgttaaccagtgcacgcccttaccccaaaaagatgtggaacacacttgttattgtaactgctttaatctgtcctcacactctccctgcaggaagctctttatagaaaacccaaatcctcatctttgagcttgtcctttagccagggcagcacctggaagaggttgatgtggaagtcccgggcataagagggtaccagctgttgccgcctctggtctctgcagacatctactactccccagctaatcacaccaacctgtgtagataagggtatgccatgggtcacttgacacactaataatcccagaaagcttccaagctggcctaaagaagtgcactgggagcctagctccccctgtcttctgtggtgcacataagccagacacttggcattcactgaccagttaagaacatagctgtcagatgaggtgggccctgttctg

SEQ ID NO: 24761 - DNA, 1099 bp, Mus musculus
gggcatgaagactccccctcacactgggaccaccaccactcactgtcctggaacatgaaccccactcactcctacttttctcccacagcactgcacgtgtgtggatgactgctccagctccaattgcctatgtggtcagctcagtatccgatgctggtatgacaaggtacgtgaccctcacctggcaggtctgccaaggagccaggaccctgctgtgttggggaagagacacagggtgtggcaggaagccctgccaggaatgcaatgggcctctctgctggagtatatgcaaatgcgcgctctagtgcctgcgcgcacacttcctggtctctgacctcagcctgcagactctgcaccttgctcttctgctcttggctggggtcagagtggagtttcctgtggagtcctctgggtccagggcagctgaaatgggccccacagagaaaccactatcccctccctccgcaccccaggacgggcggctgctccaggagtttaacaagatcgagccccccctgatctttgagtgtaaccaggcatgctcctgctggagaagctgcaagaaccgcgtggtgcagagcggcatcaagtgaggcgcgcgccccggcaccctgcctcgcctccgcctcccctcccctggggccctcccaggtgtcccacactcagtgtgactccctctccacctctagggtacggctgcagctctaccggactgccaagatgggctggggggtccgagccttgcagaccatcccccagggcacgttcatctgcgagtaagttcactgtgaggccgtggtgcatgagggctctgctgaccctagagctccatgtcaggatacatgtctctgctcgcccaccgagtgtatttccaaacatcatgtcccccctttacctgcacgctgcctagatggagcatgcctgtggcagacagatctgtaaagtggagaatagctttttcctgtgcacttcctcccctctgccgtcagactcacctaggttctctgtggcctttagagcagagaagccccttcacctgctccgaggacctcccagtttctctgttccctcaacttctcagacacccacttctcttggg

SEQ ID NO: 24762 - DNA, 1305 bp, Mus musculus
agccaggcctatgtagagagaccctatcttaagcaaaaaacaagaagggggatgggggctagtgtgggttggctggatggttgagtatactaggccctgggcaggctgcatcccacttcccgcagagcctcgggagagtctggtcacaaggcaggaaggctagaagcctgcatttatgacagttctctgggagtgtgagtcaacagagccaacaaggacctggagtccatctgcaggagtggttgggtggaagaaggtggatccctcaagagggctcctgggctctatgagatgggtttgaagtgtctagatccaagggccaagagctcctgtgtttcctctgccagctttgactacggtgaccgattctgggacatcaagagcaagtatttcacctgccagtgtggctctgagaagtgcaagcattcagcggaggccatcgccctggagcagagccgcctggcccggctggacccccacccggagctgctccctgacctcagctccctgccccccatcaacacctgaggactcttaaaatccaggccgggcactgcccttcagacatttctccatcagagaccccagtaaggcctggaaggtcgatggcccctctcccagagctggtttctcactgggagtgcaagtgacttcagggctggccttccccactgagcctggcctcagttagctgattgaagttgggcctctgccagctgattttctgtgttctcaataaatgttgggtttggtaataaactgtctggtgattgtttcaggacgatgaggactatggggctgaggggacagttgggtaggaagcaagctgtggctgtggggtggaagagaacagctgtggggcacccactggccacaggggtttaaggaaaagcaaatcacaacctagaggtttgggtgtgccacagttgaagtactctaaacaattatgcagtgtttccttatcaaagtgctccggtttcttcctgctgcggtccgtagcagacccggtaagcagctcctgggacccagttctgagccctggtacccctgggctggtcaagagttgagatctgaaaaaggaactgtagaggaccacaggcaggggcggggctgtgacgtctgggagggagggcggggcgggcggcaggtgagcggctaggtctccgtggctccaatcactccggagactgagccatggggagaaagcagaatgagaacgaggctcacggtaaggctaggggcagaggcccgggctctggagagaggtggccgggctctgcagccatggcagctgaggttggatcc

SEQ ID NO: 24763 - DNA, 1305 bp, Mus musculus; identical to SEQ ID NO: 24762

SEQ ID NO: 24764 - DNA, 1162 bp, Mus musculus
agtctctgacgctgtccttgatgtcagctataaatctgactcatttggggaacctcttgagattgagcccagtgtgccaacactggctctggtgaggaacataccctgctctcctgtttctcattgtgcccatcttaactctccagggtgagctctgaggacttcacaggggccccatcccctcacctagatgagggctaaccttggaatccagacaaaggtggaagtgacctagatgtgacctgaatgagctaatcatctaatgagagccagccctttgtcctgcccacatgaaggtgggtggttagctcacttttcagggtaataaagcagtaaaggcggggtggaggggttgttgaaggctttgtatgatgtcactagggcctgtaaagttagcacaatgaacccgctgtgcagattgtaaagctgaccttgttggaatatcctggttttagaaacacataaatcagctttgtgtttgctgttcccctgctgaaaatgttcttctgaattttcagggctttgctgctacgcactgacaagttggacggctttttattgctttgttgccagttatctgaacatgagaggctgtaaggtgtaatctgcgagccctgcgcccagactgaaccagggcctcccttgaacatgagtattagacaaatgaaataagaacttatcttgcccagactatataatggcttggaaatgcatagtttcctgaacgatctcaataaaatacttttaaaagtacttaaatagactttttctgtgtcactttgtggggaggtgtgagaagatatatgggaataaggttttaaccttaccacacaggtgtcaccacctgactgcctacatcaaatgcccaggaaggagctagtcatttcatgtgtctggttcctggtcccttaacagcatctgttctggaagtacagatgaaaattctatacagacctgtaaggctgaccatagttttagcagattagcatctgaatcggtcagatctacctgctaggaacaagtcggcctcccctcccctaagctcccactgcagagggtaaaggacagcatcaagcaccccagccttctggagaccccaccagtagactccaggtgtgcttgcctggtgaatgaacttggccagagactcctggtgcctgct

SEQ ID NO: 24765 - DNA, 1162 bp, Mus musculus; identical to SEQ ID NO: 24764

SEQ ID NO: 24766 - DNA, 1167 bp, Mus musculus
gatgtttaaagttgcttctggttttgtttgtttgcttggtagacacggtcttaatctgcaaaccacacgagccttaaactcccagcaatcctcctgccttagccctgcaagagctgggattacaagtttgtgtcacctctgtggtccccctgaagcttcctctcctcctctccttcctcttcctcctcctccctccatcatcgaggaaggcagtatatctattagcccagacttccactctaaaagtgcaagttcaggcgtgtaccacacccagctctgattcaccagatggaaacaatggaaattttcatgactcttacgatactgagataaacaaattggactgcaggaggtgggaaaacagtcctcagaaatgaaaatagccaagcttctgggtagctgcccctcccacctgaccccagctctgcacccagctcacgttctccatcagagaaaatgcaggcgtgcagagatggtagctgtcctgctgtaatgtaactataatgaaataccatgataaaaaaacaggccggtagtggtggcgcacgctggtaggatttgctgaaggaggcagaggcaggaggatcacgagttcggggccagcttgggctacacatttgccaggcgtggtggcgcacgcctttgatcccagctctagggaggcagaggcaggcagatttctgagttcaaggccagcctgttctacaaagtgagttccaggacagccagagctataccgagaaaccctgtctcgaaaaacaaaacacacaaacaaacaaaaaacaacaggtgagaggagagaattcatttggcttacacttccacattgtagtccatcatcgaaggaagtcaggacaggaactcaggggaggaaacctagaggtagaagccaatgcagaggccatggaaggatgctgttactggcttgcttggcctactttcttatagaacccaccaccagcccaagaatagtctcatccacaatgggctggtcccttccctatcaatctaattaagaaaatgctttacagcaaatcccatggaagaactcactcagttgaggttccctcctttcagatcactctagcttgtgtcaaagttgccataaaattatccggctcaagccggacggtggtggtgcacacctttaatcccagcacttgggag

SEQ ID NO: 24767 - DNA, 1143 bp, Mus musculus
gcaattctggaaaaggctaatctacttcctcgatggtagggcctgtggcagccctgccgggagtataccctggcgtacaggtgggcccggtgcatccgctctggtacagttttgtgatgatcggattacacatattttccagttcttttcttttatgatcaaactcatctttctcagccagctggttggcctccagccaggaaaggacctcattgcatttatccagtattttctttttatcggactcgctgatcttgtccttcagaccctcatcacccacagcgctcttcatattaaaggcgtacgattctaaggcatttttggcagcgattttctccctctggccctcatcctccgctttgtagcgctcggcctcctgcaccatgcgctcaatctcctccttgctcaggcgacccttgtcgttggtgatggtgatcttgttggccttgccggtgctcttgtccatggccgtgacgttcaggataccgttggcgtcgatgtcgaaggtcacctcgatctgtggcacgcccctaggtgcaggaggtattccagtcaagtcaaagcgccccagcaggttgttgtcgcgcgtcatggctctctcgccctcgtacacctggatcagcaccccgggctggttgtccgagtaggtggtgaagatctgcgtctgcttggtggggatggtggagttgcgcttgatcagtacagtcatcacacccccagctgtctccaatcctagagacaggggagctacgtccaacaaaagcaaatcctgtactttttcagatttgtcgcccattaaaatagctgcctggactgcagctccgtaggcgactgcctcatcgggattgatactcttgttgagatcccgtccattaaagtagtcctgaagcagtttttgcacctttgggatgcgggtggagccccctactagaacaatgtcatggattttagccttatccatcttggcatcccgaagagacttttccacgggctcaagtgtgcctctaaataggtctgcacacagctcttcaaaccgtgctctagtgatggacgtgtagaagtcgatgccctcatataaagagtcgatctccaggtttgcctgggtgctggacgacagcgtcctcttggccctctcacacgcag

SEQ ID NO: 24768 - DNA, 2217 bp, Mus musculus
gactaagactgtatgtgtctggatatgactatggagtaatgtttacgatccaactctctgcccgacagggcatgcctttaggccccaatccagccctgccccctgttggactcacggtgactcaatcacaaatcacagtccccatttctcaggaacttagacccaggtctgggccatgggacttgcttaaggccacttacctggtattgaataattctaaaccagagcttacaagtaaatgttggctctgcttggatgcccagccaccctattatgaaggaatagccgttcctggaaattataccacctctactgacaacaaggactgtcgttggcagtatccaggtaaagggagactaaccttagagctaattcagggaaaaggactctgctttgggacaataccccacacccatagacatttatgtaatagcatccaggaagccccagacagggatgcttacattataccccccatcaatacatggtgggcatgcactactgggctgacatcttgcatccacacccaggctcttaacctcacaaatggattttgtgtactggtccagcttgcccctagaattcttcgttactctgatgagatggggaccagactatctccattcccagctgctcgagcgaagcgggctactgttgccgagatcctgggtgcatcagccttcgacttccaagatgagaattataaagtgttaagctctgccatagatgcagatttaatggaactagggaaatccttatccaagtccaaaacctcattaacttctctaagggaggccacccttcgaaatcagcgggaacaagacttccaatctctgcaacaggatggactgtgtaaacctctggagaaaaggtgctgcacctttgtggataacttaaagcatgcgagggagttattggctaaggtgaggaaacgtctagaagacaggaaaagggaaatggaacagggtcagcctgtttggattacagttattgcaactctgtctggattcttgggcctggtcatactcattgtgatatgcaagctctatgttgttaaccccctgatggattcatcaaggaccaggtctccaccatccgacacgtattaaaatgctaacccttggattctgctcaagggtttgagatggactcttaaggtgagagagagtgatcctaacttactccattttaagacaggctgctaggtcaggccttaagtttagtctcagaaaagccataaagaatgggcagccaagccaggcgtggtggcacacacttttaatcccagcacttgggaggcagaggcagacggatttctgagttcgaggccagcctggtctacagtgagttccaggacagccaaggctacacagagaaaccctgtctcggaaaaaaaaaagaatgggctgccaatccacagccaccctgacaacggggggtgggggtggggtagctaaagccaatttgaagaaagcccctatgaaagggcgctttttccttcaaggtacagaccagtccaaaatgtacagacacccctcactatgaacacaaacaatcctggtgtaaattacctaactacagttggaaatctaactggctttaaaaggaaaagagagcctgccgtctctttgtggttgccattttatatagatgatatatattgagctttggtctgttatgctttggaatgcttagtgcaagccctggttgccccagagacccaagtgatgttatgtgaccttgaccctaagttacttctggttggtgaataaagatgcctgcagtcgatagctgggcaggagagaccagggtggggtttagggttcctgagcttggggttgtaagagaagcaccaggagggcgagaaggtgaagggaggaggaagcgggcgtggattgggtgagttgtggaatgatggctatgtgggttggctaattggagttaagagcagcccagatggaaacatgaggaattagatgatggcttactggctggggagtaggcatactagtgtagaggatagatatctgcccagctcttgtgctgattaaggcttgttataaataaaaaggttgtctgtttcttttatcagggaagtaaatggtccaaggtagaaacccctgtggttctgcatttggtttctctgctggggggttggactgctgcttggggaggtgaaacgcaggggcaccaggctgcatctctctctccccactg

SEQ ID NO: 24769 - DNA, 1099 bp, Mus musculus
gatctgacaccctcttctggtgtgtctgaaggcagctacagtgtacttaaatacaataaataaatcttttaaaaaaacagacagatattatattacaactcattaccacagcaatgctacagttatgaagtagcaacaaaagtaattttatggtgtgggagggtcaccacaacatggggagctgtagtaaagggtctccgcattgggaaggaccactgagataagggtgtaagcctgtcataacactatcctttcctgttaggctgcccttggggccctgggcaaggccttgaaccccttggaggactggctgcggctgcacacctacctggctggagatgcccccactctggctgacttagctgctgtgacagccttactgctgcctttccgatacgtgagtcactgagcttggggagggacaaatgcgtgcccgttagacctccttacacggtgactacgataattttttggttcggtttggtttctcgcaggttctggacccttctgcccgccggatctggggcaatgtgactcgctggtttaacacttgtgtccggcaaccggaattccgggctgtgctgggagaagtggccctgtactcgggggccaggtctgtcactcaacagccaggtgaggaggatgggagacagcagagggcacaagggccccttttatcttgaaatcctggggccaccatctggtgtggaggctttgtagggtgagggtcaaagatgatcatcaagcctgaggcaagagctttagactcagcactcttcacagagagtccccagcaaccttgagtctgaatttctgtgcttctctccaggctctgaggtcatcgcaccccaaaaaacacccgcgcagctcaaaaaagaggcaaagaaacgggagaaactagagaaattccagcagaagcagaagacccagcagcagcccccgcacggagaggtgggggggccaaaggctgagcgggagtgggtggagccttgttggggaggctcatgtttgggtctgtgtcttcttctgaacagaagaaaccaaaaccagagaagaaggagaaacgggaccctggggtcattacctatgacctccctac

SEQ ID NO: 24770 - DNA, 1141 bp, Mus musculus
caccctcaactcagccatttctgacattgaggtgtgtctctgcccacagcccgtctccctctagtcttccccagcccaggcctggcccacttctctaaacacccatctcacaggtggataagaaggagctgacaggccgcaccctgcttcctgtgcctggctacaaggagaaggtggagtttggggtccttgtgtcctttgcctacaaggtccaaggctcaggtgggagctgaggacaccaggatgtgggttgggagaggtggggaggaggagagagctcagacacagagccttctgtcacctcagacagcgacgaggaggtggtggtggcaacaacccggattgagaccatgctgggagacgtggctgtagctgtgcaccccaaggatcccagataccaggtgggacggggacattcgtgcctgtgtcctgggatggctgctggctcaggataggctctccccgggtgagggcccagccctgtgtcaaccccactgtttccctccctgttaagcacttaaagggaaagtgtgtcgtccacccattcttgtcccggagccttcccatcgtcttcgatgactttgtagacatggagtttggcacaggtgagcaacggccgtggcctgttgggagaaaagactgaaaaattgtcttcagtcccgtaggcaggactggggctggatatgagaactgttcggacagcagagtggtctgagagctgtgcccttcggcacaagaggtgtggaagggaaccccagcatgcagtagaaccctggcacgccccgtgtcctccaggtgccgtgaagatcaccccggcacatgaccaaaatgactatgaggttgggcagcgacacaggctcgaggccattagcatcatggactcaaagggggccctcatcaatgtgcctccacctttcctggtgaggtgtcgggactgtggggacctgcgtgggaggtggagagctaacgtgggcattgccatgatgaagccttttccatccagggcctgcccaggtttgaggccaggaaggctgtgctggcggcactgaaggagcggggcctgttccgtggagtcaaggacaaccccatggtggtgccgctttgcaagtgagactggggcaggcgcacatggggaagggtg

SEQ ID NO: 24771 - DNA, 2587 bp, Mus musculus
catggcaggaagatgagcaagtctcttggcaatgtcatcgaccccctggatgtcatccatggagtttccttgcaggtggggtactcagtgggtcagctagaaacaactttgcagctgtggctagaacgatctgacacctcccatctcctccctagggcctctatgaccaactactgaacagcaacctggatcccagtgaggtggagaaagccaaagaaggacaggtaaggggtgtgctccgggggtgggctgcagcaggtgggcaggagtgggtgtaccccaggggtgggctgcagcaggtgggcaacctgaccaccctgctcaaccgccctgttcctctgcatcctctgtagaaggccgactttccagcagggattcccgagtgtggcactgatgccctacgctttggactctgtgcctacacatcccaaggtatggtctcccgacctccctcagttgcctgttttcttccctgcaacccgtgatctcctctaccttgggccttcagaggacctctctgagagggcaactggggtggaatcacagacatccctcctctaggtcgagacatcaacctggatgtgaacaggatcctggggtaccgtcacttctgcaacaaactctggaatgctaccaagtttgccctgcgcggccttgggaagggctttgtgccctcagcaacctccaaggtgaggatcttgtcggtggccatcggtgacagtgcctgtgcccacacagtctgtggctccctccactcaagtgtcaagactaaagctgctgtcccctgagatcctccttttagtcagggacagacaggtggaagttgatgattgatggggaagtctctgcagcttggggcccatgaggaatgcagattctcctgtgtcccactctactccctgccctggtagtgtgatggcctactgcctgacgtttctcttcccccaagcctgaagggcacgagagcctggtggaccgctggatccgcagccgcctaactgaggccgtgaggctcagcaatgaaggcttccaggcttacgatttcccggccatcaccaccgcccagtacagcttttggctctatgagctctgtgatgtctatttggtgagcagctggggcggggcctgggcacgtgtagctctgacctcagcttggccctgaaacttgaggtcaccttttggtttttccagtcctaatgggggcagcaggggagggggctccaggtgggacctggccctgagccttctgcctccccatctctaggagtgtctaaaacctgtgctgaatggagtggaccaggtggcggcagagtgtgctcggcagaccctctacacctgcctggatgttggcctgcggctgctctcgcccttcatgccctttgtcacagaggagctattccagagactgccccggcggacaccaaaagcgcctgctagcctctgtgtcaccccgtacccagagccctcagaggtatgaggtgtggcctggagggcatgctgctgccctcctgagcagtccttttctcccactctgccccacagtgctccccctttccccactctgccccacagtgctccccttttccccccgtctgactcacagtgctccccctccccccactctgccctagtgctccccttttcccccagtctgactcacagtgctcccccttcccccactctgccccacagtgctcctggaaggaccctgaagctgaagctgctcttgaactagctctgagcatcactcgagctgtgcgctccctgcgtgctgactacaacctgacccgcaccaggcccgactgtaagcctcagtccctcgcatccacctatcccctgacctccacggccccttggggagcccagggtctggctgtacctcggcttccctttcctctttttccccctcttcgctctacaggtttcttggaagtagccgatgaggccacaggtgccttggcctcggcagtgtcgggctacgtgcaggctctggccagtgcgggcgtggtggctgtcctcgccctgggtgctcctgcaccgcagggctgcgctgtagctgtggcttctgaccgctgctccatccacctgcagctgcaggggctagtggacccagcccgggagttgggcaagctgcaggccaagcgaagtgaggcacagcggcaggctcagcggctgcaggagcgccgtgctgcctccagctactcagcaaaggtgccccttgaggtccaggaggcagatgaagcgaaggtgtgtggaggggatggggtatgccagtgggtcgtgtgtggccaggcagcctgtggactcctgcacaggtggggttgtgtgtgctctggggccctttgtcactgtactctcaagaaaagaagcgctctagaggaagagggacttggaagcctgctgccctgacttcctggtcatcctcacccatctcatcaccctgggctcctctgctctctgggtgtttaggctccttgggtatggggtcaccacatacctcttttgcacccccagttgcaacagacagaggcggagctcaggaaggtggatgaggccatcgccctgttccagaagatgctgtgacccc

SEQ ID NO: 24772 - DNA, 1218 bp, Mus musculus
tttgccttttgaatcctgattctcaaagctagccaagacttaactgttcctctgcctcctcccaactgtcaatcactgggatgccaccagcctacctttgctgatccagaaccaaaggagaaaataatcctgctctcggggtagcttagagattgtggcagtgtatgtcagaattagcaagaggttcagagagcagcctggtaaggatggggtgcgccaagcctaatgctgagtgtgttatttttttcaggctggcagtgatggtgccaagattgggaactgccccttctcccagagactgttcatggtgctctggctcaagggagtcaccttcaacgttaccactgtggacaccaagaggtgggcccacttctgaccctctaaacatcctttgtgtggatgcacgtgcactgcatgcgcatgcgcactctcgtgaacccgtcttccttaaaccggttctctctctcgtctgggacaaatctctccattctatgtccctgtttctgacacacacacacacacacacacacacacacacacactcacacacacacacacatcccttttcctttcttgacgtgtgacctcttctccagacggacagagactgtacagaagctctgccccggtgggcagctgccgttcttgctctatggcaccgaagtgcacacagacaccaacaagatcgaggaattcctggaggccatgctgtgccctcccaggtacagggacacttggaaagaaaaggggagctgggaggctttgcagaacaaaggtcgaagaggggagacagggaggcagggggaagtaccccagaaaggacttcactttatccctctgccttccaggtacccaaagctggctgccctgaaccctgagtccaacacctcgggactggacatatttgcaaagttttctgcctacatcaagaactcaaacccagccctcaatgacagtgagtcttatgggtcaggggcttaggtcctacagggttggggcatctgtgagctcggctgtcagggagatggagaggatgttttcagacccccgctgagcctccattaacctcctggctggctggctgtctcattgctaagacttttggagtttagggtttgttttggttttttgtttgtttgttttttggtttttttgagattttatttatttcttatatacatgagaagtatttgtctgtatatctctgcatcaagagca

SEQ ID NO: 24773 - DNA, 1197 bp, Mus musculus
tcagctgtggagacctcaatgccctcttcctctctccaggcaatggcagcgctgactgatcacccctacgcctctctgaccctcccagatgatgcagctagtgactgtctctttctgcgtcctgggttgcctggtgccacacctttcctcctgcaccgcggaggtggggacctgcccaacagccaggaggtgagggagggaaaaaccgccccaccaaccagagaaagcagtctgtctttcccagtgggagaaaggaggggcccatcctcagaagcctgggtgggacccactgggaactggctagaggggggttgtggctctgttatcaaaacatccttggggtcctccctgcaggctctgcagaagctctctgatgtcaccctggtacctgtgtcctgctcagaactggagaaggctggagctggcctcagctccctctgcctggtgctcagcacacgcccccactgctgagggcctggatttggggatcccactggttaggaatagagctgtatagtgggtagaatcagctaatagaggctgggtagttgtggggagatgccccaggatagggaaggacttagtgtggaaaagaatagaagccattgggtgagtcctctctgtcaaaaccaataaaataaaattgaccttttagataagggctgtgactggtttctcgatgggacaaagggataggatggggctgaaatccaaaactggggtcggtgctagagagacagattctttagcttttttttttttttttttttttttttttggttttttgagacagggtttctctgtgtagccctggctgtcctggaactcagtttgtagaccaggctggcctcaaactcagaaatccgcctacctttgcctcccaagtgctgggattaaaggcgtgcgccaccacacccggctgattctttaacttttgttaaagacaatgtttgtgtagctgtcctggagctcactctgtataccaggctctcctcaaactcaaattcacctgtctctgtcttctgagtgctaggattaaaagcttgagccaccaccgcccagctggactctttcattttaaaaaccctctttatgggcttcctgactcacccctaccgtgccacaggactcaggtacaaagagagacaggagaccgtgtctgttgtggggaatgcaggcagggtggaaagggaatta

SEQ ID NO: 24774 - DNA, 1375 bp, Mus musculus
cagctttgccaagccctgcgaccctgttcccagggagtgtcgagaggacgaggtgtgtggtgtcagtgttggcacctcaggtaggactctggtgcgatggcccttctcgaggtggctcctctctttcctgcccatggctgccgccgcaacctcagcattcctcttttgtcccacagagcaaaaggaggaggaagtcattgagcggaaaggctgcctccccagagcccagtgccctctgctgggccatgcgacctactggtcacggtcctactctctccggcaccagtgctgtgagcaggacctatgcaatgctgccgcctcacagccaccccccaaccttcccctcatgactctgctaccccttgcagccatgatcggctggggagtacatgacttcctctagcccatgcgtccacggctgtcaacccaggattccagtgtcaccgtggacatgaaaacacctgcacagatgctgtggagacacgctcaggagcgtgactttgtataaaaacctcagtcaccgatcccagtacctctacagacccggttcctacagccagagttctgttccctgcatgcaagtggccgcaacctcacctcataagagacccccatatttaaacctagatgtcccaggtcagctaccctgcatgagctgtggggtcccaggcaaagggacagaagtgtcactggggctggtgagaaatagagttctgctagggggcatgtagcttggtacccgagggtctcaagaacagagggctaccttggggaaccataaagagtgtatttaataaaagggctattgggtagagatatagctcaatgatagagtgcttacctaccatacataaggccctgggttcaatcccctacaccataaataaataaataaataaataaataaataagctgtaaaagtagttaagagagctgtctgtgagcctggtaacagtgcacgtggtggtggtggtgaaacacacaagggtgcactttgagaatgaactacggtgggcgggcagaacaggtgtctccccgagccccagtatgtgctgtctacgcacaagagccttgtttcggatgtaggcacccattttaagagctcggtgattaagagcactggttgttcctgcagagaccctgaggttcagttctcagcacccacatgattcacacagatctgtaattccagtcccagaaaatcccaggccctttctggcctcctcaggcactgaacacagtgtagtccacagatgtacatgggggcaaaacaccagtacacataaaaattttaaaaaataaaattaaaaagccaggtatagccacacaccagtgcttgtaactctagggccaaatgaggggcagagaccatgga

SEQ ID NO: 24775 - DNA, 1330 bp, Mus musculus
ttccagtcatagttatggaaaagcttaggagatgccaggctcgccttgctcactgagctctgaatgcaagggccaagatgaatccctgggccctgctgaggttggggttcaccaacccatgttccccacagctatctggtggcacacaccttggggcgccggatgctgtacccaggctccgtgtacctgctccagaaggccctcatgcctgtgctgctgcagggccaggcccgactggtggaagaggtgaggccccctacctgctgctggccctgtcttctgaggggtgtggccccctgccccttgtgaccaggtctttgcatctctcttgcttagtgtaatgggcgccgtgcaaaactgctcgcctgtgatggtaatgagatagacaccatgtttgtggaccgacgggggacagctgagccccaggggcagaagctggtgagaggggccagggagccgaagggggtggtaggtggcagtagagactctggggtccccagtgctacagaacctttcctgtggaaccacagttaaaaatgttattttccagcttcacccaaggacctcttcatcagaaagctctgagagggaagtaggtagggggatgtagctcaggtcgtgcacgaagccctgggttcatcccctgtcccatatacactgagaattggattgtgtacctataatcccagcacccaggagtggagagaagaggatcagaaggtcaaggccagggccagggagatggttcagcgggtgcagtattggccatgcaagcgagaggacctgagttctgatcttgagaacctgtatagagcctggcatggtgaccatgagagctgtagtcctagctctcctgtgggagggaggcgggagacgccttgggcaccccctgccagctggcgtatacagcactgccacaggcaacaaagaccccgccttgaagtcggaggcaaggggacacaggggaggagtccttctcaccgccacacacgtgctgtggatcacgtttaaggtcttggctacatggtgagtttgcagtttaaagatgagaatatcatagccgactggggatgtcactgtagctagcgtatgcagcctgatggcagttcatcaccaaagtgaagtcaggtatagagagttgcctagtgttcgggaagctcacctaaagccaggcatggtgcactctgtcatccctgggctgagttcaaggcctgaccaggataaacaggaccctgtcctacagtaacaaagagtagatgggatggtgatgaaggaggcccaggcaagattctgagttccagtccaccctgaactacctagtgagaccctg

SEQ ID NO: 24776 - DNA, 1173 bp, Mus musculus
ataatccagctctctctcctatccccagatcccttgctcctgtcttttctcccccacctcaaggcccaagcattcataacccaaactggactttaccccttggtctttctgccctgctttcgatggctgagtcgtggcacacacagcagtgcttggcttcttcactgttttgattccttatgactcttgctttgtctccaagctctctgaaagtagctcagttctggttcgtaacgatagtttcctctcgggtttggtgtgctgctgcctcttcccctctgctgctctagagggcctcctctgcgtttgtgtgtttacatttacttactgtgaaaagagaggcaggcagagactaaagaggaacacagagaaggccctgccgagcagtcttgctttgtagaagaatcaaaagcccaggtttctgggtcagatgtatagatgatgggtagggcaaggctcagaaacaggtactagagaaactggaggcgccaccttgcaggtaaggtggggttaccctggaaaactaaacaagcggccaccccacccacgtttcagatgaagagctggaagacaaccccaaccagagcgacttgatcgaacaggcagctgagatgctttatgggttgatccacgcccgctacatcctcaccaaccgaggcatcgcacaaatggtgaggctctgctccttctgcaggaagggaaacaggtgcatgggtccgaggcctggttcctacctggcaaggagcgtggcagaggagagagggagagacccagagctgggctgaggagtgaatcctcactcagggtcccattgaaggtgttttaaggaagggagatgaaaccggaaaacgaaggagtttgcagggaacaaatagcaaatggcccctgggctctgcagactgccccacaaaggaaaggcacttgagtttgaggacctatctcgacagagagggggcttctagtcagaagtgggagacatgggggggggggaccatgaaatgagttgagattgcctcttcatgctcacccaccagtcccttctgttttacacaccttagttggaaaagtaccagcagggagactttggctactgtcctcgtgtatactgtgagaaccagccaatgcttcctatcggtgagtgttgaaagccagaagctgccttcctgtactcag

SEQ ID NO: 24777 - DNA, 1119 bp, Mus musculus
ttgaggctctgttcatctttttttttcctcccctataacatatttctttctctgcagatctaccccctcctcgtcccagttctgtgaggactgtggtgcccactttgaagactccaaccaccacacatctactgctcacctgctgtcactgtccaggagaccccagccctccaaccttccccttggggtgcccacttccagtcctggcttcaggctactgctgagaggtggctgggaaccaggaatggggctaggaccccggggtgaaggccgtgccaaccctatccccactatcctcaagagggaccaggaaggattgggttatagatccccaccccaaccccgagtcacacactttgcagcgcgggatacccgggctgtgtctgggagagagagagtccctcgagttgccacactgagtcagagggagaacagaaggcaagaagaaaagggcagagcctgggagcgagatctaagactgtacatgaacctcgagttctgactgatatggactggccctggtctgtcactcgctggacttgggcctctgacttggacacttggacttccgaacccttaggccttagctgttgggctctgattttagagagaagggcggagagttgggagataaataaacttccttccttgtggtttgtttactttcttgaatgatatagtagggaattggaacaaatctgagagtcacatagaagtctcacctgagccaaaaggacaagctctccgggtgacaaaagagagtccccagtcctgctggctgcattctacctgctccttgaatccccgcccccacacacacattaggaattgccccactttgtaaaacacccctctgagtatgtgtctaggccagtcaagtcagtgacaagtatcacaaaccaagtgtgctatgtgttggagaggggcgggcatagcttggttagagcacctgcctaacactgggaagaccctgggtggggcccctctccaagacaagatgcatccaaaagatgctgctgacattgggagaaaagccaaagatactttgctctgctctgcctgatacaaaccttgaacttgaggaagccagctgtgatgaagtgtaataccttgtggtag

SEQ ID NO: 24778 - DNA, 1131 bp, Mus musculus
ttgagagaccatgcatggctgcatgctgaagtttttaaatttccttccttttttcgctttttgtttgtttggttgttggctgtccgggaactcactctgtagatgaggctgcccttgaccacacaaagatctgcttgcctctgcctcctgagtgctgggaataaagttgtgtgccaccgccaccaggcactttttaactatcttaactgtcttgttcagtttaagggtaccctaactgtcttgttcagtttaggggtatcctacctttgtcagtgtgttatagttgcagcctgggatcatttcctctctttgtggaaatgaggagagcatttcctctctgtaaacactgtagatactgtgatccagtttctgccggtcacaggaatgcatagccctgcttttggggagccatttccactcttgtttgatctgcataaagctcaacagcagtaatattttgtgcctttggtgtcctgtctcttcttccaccctcagtgtcgagggggaacccaagctcaggccagtcagccacccccgcagacaccgcagactgtggcctcagagacggtagccttgaactcacaaacatcagaaccagtcgaaagtgaagctcctcctcgagagcccatggagtcagaagaaatggaggaacgtcccccaacccagactccagagcttgcgccctcaggcccagctcccgcaggcccagctcccgcaggcccagctcccgcgccagagacaaatgcacccaagtgagtgatgcaggaagcctttggggacttggactgggaaggctgtgaggagaggaaagtggttgccaggggtggatctttcagtcgtagtatagcggggtcagaggtcagctcatgtagataaaggtgggtaggcctggcagccttgcagaaggcagggtgatctcggatgcccctggagccgtggagcagaggccttgtctaggtttgtgctcctttgcacagcactgctgggggatgggagcactttgccttctcctcttggctgagagagtccctggggatggtaggactctgaggacagcgtcactcactggcctctgtgtccgcagccacccttcccccgcagagcacgtggaggtgctccaggagcttcagc

SEQ ID NO: 24779 - DNA, 2202 bp, Mus musculus
tccagcccaagttatcttttctttttttttttttttttttttttttttttaaagatttatttatttattatatgtaagtacactgtagctgtcttcagacactccagaagagggcgtcagatcttgttacagatggttgtgagccaccatgtggttgctgggatttgaactccggaccttcggaagagcagtcgggtgctcttacccactgagccatctcaccagccccccaagttatcttttcttaacaaagacactggaactgctcttatctcgcttttctccagcaggtctctgggggtgcacccatcgactctcagttacatcccaacagtggaggcttccgtcctgggacaccctcattgcaccagtacaggtaaaactagattatctacagacttggaatggagatagattgcaggggagagaataccaaagaacagtggattaagagtaacacctctcctcccccaattcttttcaggtcacagcctctgtatctgcccccaggtccagcccctccctcggcactgctttctggggtagctctcaagggccagtttctggatttctcagcactgcaagccacagagctggggaagttgcctgctgggggagttctctaccctccgccatccttcctctactctgcagctttctgccccagccctttgcctgacccacccttgcttcaggtatgaggtgggcagctgctagggcagcagagaggatgtttttgggggactcgacctgttctggtttctcttgtttcccaggagagcctggaaaacattatgtagttcagattataaatcttgagccatcacacccacctgagaattggccttttcctcatttcccaacaggtacgccaggatctgccatccccttcagatttttactctactcctctgcagcctggtggccagagtggcttccttccttcgggagcccctgctcagcaggtatctttgatcttcctacttcccttcgttttctgcccctggcttagtttggatttttcctacatggccttcctgttctaatgggctcactggggatttcttgcagatgcttctacctgtggtagactcacagctgccagtggtgaactttggctccctgccaccagcgccaccccctgctccaccccccctttctctgttacctgtgggtcctgctctccagccccccaacctagctgtgcggcccccacctgctcctgctgctcgggtcttaccttcacccgctagacccttcgcccctagcttggggcgagcagaggtaaggtgtaaagatcagtatttcaagtttttgaaggatggcaaggtatccaaagggaaaaagggtaaatggttcagacagcaagttcatagggtaaattgtttctctttccagctgcacccagtagaactaaagcctttccaggattaccgaaagctgagcagcaaccttgggggtcctgggtcgtcacggactcccccatctggaaggtaaacaggagtgggatatcggctctgcatccccagggactttttttgaaacatgggcaggccttgggtttaccctgaccgtcacctttcctcccttaggcccttctctggtctcaattcccgtctcaaggccccaccttccacctacagtggagtattccgaactcagcgcattgacctctaccagcaggtgaaggagaggaccagtaacacccctctccccccagcctaagttcggatccccttctgagctcctgaaggatcgctgacttactcttccatatatacctatcctcaggcttccccaccagatgccctgcgctggatgccgaagccttgggaacgggcagggccaccttctcgagaagggcctccccgaagagcagaggagcctgggtcccggggggagaaggagcctggattgcccccaccccgctgagggagttccccttgacccccatccccggggcttgtatatagattataaatatataagggggaaaggggtgggtggggaggggttgtgggtctggagtctcacttcccctcttctcctcccctagtcccctatccctggggccgtttgttaaaaaagaataataaaagaattttaaaaaaaaaaaaggggggaaagtcatgggtgggggattaactgtaatgttttacactaagtagtgggttcaataagttacctgttaattacttcagg

SEQ ID NO: 24780 - DNA, 1157 bp, Mus musculus
gtcccaggccctcaggaagaatccagagattcaggcacagaggccctaactccccacatctggaatcgtttacatactggtgagtgaagctggtgggggggtaaagattggagtggggcgtggtgatgtgaggtgggtcttagtttctcactgcctgcctcatggttggtgttctctagccacaagccgaaagagttaccagcctggctccatcgagccctggatggagcccctgagtccctttgaggatgtggcaggcacagaggtaaggagacgctgggaccggagtggcagggaggttactgagtgttggtcatgtttcttcacctgttctgaatagacatagcccttgaggccgttctcttggaattgtctcctttcctctgttggtatgtgacacttctcaggtgtccggtgttttacctagctccttctccacctcgcagatgagtcagtctgacagtggagtggacctgagtggagattctcaggtgtcatcaggtccctgcagtcagcgaagttcccctgatggaggacttaaggggtcagcagagggaccccccaagcggcctggaggaccctcacccctgaatgctgttcctggtgagagtgcatctggctctgaaccctctgaacctcctaggagacggccacctgcttcccatgaaggggaaagaaaggtaaagtcgatggatggatgaagaatgtcagcagggcccttcctccctcctgagtttgactgtcctttttttagccaatgtgctttgctttttcttggtttgtttctctgtcacccaaatacactttgtttcccaatctaggagctgccccgggagcagcctctgccccctggtcccataggcacagaacgatcacagcgcacagatcgaggcccagagccaggccctctccgaccagcccaccgaccgggctctcaagttgagtttggcactaccaacaaggtctgaatgggcttcacttggacatgtcctcgtttgggtatgaggtgatgacaagtgggatgggagtctgaattcaactacaatcttcccacacattacaggactcagacttgtgcctagtggtcggagacactttaaaaggagaaaaggagttggtggcatcagccacagaggtaggtgggaagggagctttga

SEQ ID NO: 24781 - DNA, 2072 bp, Mus musculus
ccgtgaattccgaagttaccgagagttccgaggagacgatgggcgtgggggtggttcaggcggaacaaaccatccttctgctccccgaggccgcactgccagtgagacacgaagtgagggttcagaatatgaagaaatccccaagagacgccgccagcgtggctctgaaacaggcagtgagactcatgagagtgacctggccccctctgacaaggaagcccctccgcccaaagagggagtgcttggtcaggtccctcttgcccccccacaaccaggagctcctccatcaccagccccagcccgattctccactgcccgaggtggtcgtgtcttcactccaagaggagtaccatcacgccgtggccgaggtggggggcggccccctcctgtttgctcaggctggagccctcctgccaagtctctggttccaaagaaacctccaacaggtcctttgcctccaagtaaagaacctttgaaagagaagctgatctcagggcctctgtcccccatgtctcgagctggcaacatgggtgtaggcatggaagatggggagcgaccccgacggaggcgacatggcagggctcaacagcaggacaaaccacctcgtttccgaaggctgaaacaagaacgtgaaaacgctgccagaggagctgatggcaagcccccttccctaacccttgcagcctctacccctggacctgaggagacactaacagcagccacagttcccccaccccctcgccgcacagctgctaagtctcctgatctgtcaaaccagaactcagaccaagccaatgaggaatgggagactgcatcagagagcagcgactttgccagtgagcgccggggtgacaaggagactcccccagcagcacttatgacctctaaagctgtggggactcctggggccaatgcaggtggggctggaccaggcatttcagccatgtctcgtggagacctgagccaacgagccaaggatttgagcaagcggagcttctcaagtcagcggccaggcatggatcgtcaaaaccggcgcccaggcactgggggcaagactggcagtggtggtggcagtagcggaggtggtggtgcaggccctgggggacggaccggcccaggacgaggggataagaggagctggccctctcccaagaaccgaaggtgggtaagagtagatggctaagtagtagtgtggttgctgggttgagggtgggtgccagggagttagagtttttttagtaagtcaggcatcagaaaggcactatatatcttccatcttggcagtcagctaaagagttagcagtccccatgcgtgttttgttctggttttctcaacacactgttgtgaacaggaagcttggaaagggttttatcaggagaagataggatgctagtagtgaagcgacagtagatgcttgacttacagaatttagtgagccctggaactgatgctctgctttctccagccgtcctcctgaggagcgacctccgggacttcctctgcctccgccaccccccagcagttctgctgtcttccgcctggaccaagttatccatagcaaccctgctggaatccaacaggctctggcccaacttagcagccgccaaggaaatgtaactgcaccaggggggcacccaaggcctaagcctgggcctccccaagcccctcagggctcctcccctcggcccccaacccgttatgaccccccaagggccagcagcgctatcagttctggtaagctggaggcaagcgggtgggaatgactccatccccaaaggtcaagtgctggagtggggagcaggagtttgtcatggggcccctgctattgggatctgcagagctggaaggactgggaggtggagtcgggagagcaggctagggtcagtggtagaatgaggtagatgctgacagttttccccttttccccagacccccacttcgaggagccagggccgatggtgaggggggtgggcgggactccccgggactctgccggggttaatcccttccccccgaaacggcgggagcggcctccccgaaaaccggagctgctgcaggaggtgagggatgg

SEQ ID NO: 24782 - DNA, 1185 bp, Mus musculus
ttgtagatagtagctaggcttgggtcagccccagctttgtaccacttagagaactaaggaagtggcatctcactctgcacgacctttccatcctgctctcccagttccgatgcctcaaccgctcagccgccggaatcgcagccactgccggcttcacagacgcctgcctccaaccagccgaaacgacccccaacagcccccgaggtacctggagaactcgaggggttggatgaggaagaatgacccttacgatacttactctgccctccctgtgaccatttgtccctttgctcccccagaacactccttcggttccaagcggggtaaagtcctgggcacaagccagtgtcacccatggagcccatggagatggtgagtgtaagagggttggagcatatgggagggaggcaggggccatgcatttttgaggagagatccttcgtcttgtgtccaaatcacccaggatctagagcctcccgcttttatgtacatgctcaggaagtgaccccatctggtgtataccctcatttcaacaggtggaagggcatcaaacctactgtcgcgattctctcgagaggaatttccgaccctgcaggcggctggagaccaggacaaggctgccaaggaaagggagtctgccgaacagtcgtctgggcccggaccaagcctccgcccccaaagtgagtagctgccctcagaccagggtcgcgcctgctctgtggaaaggctgcgtgctgggttactcacttccttccccgtctttctgatgcatccccttggcctagaccagtggtaacttatcttttcctccctctttgcgtttctaaactacagattctacaacttggagggacggaggtgggcgtggccctgatgacctggagggcccggactccaaacttcatcatggccatgatccccggggtgggctgcagccttcaggcccaccccagttccctccctaccgcgggatgatgccgccctttgtgagtgtgcctgtgttgcttgaagtggtgcactgagagccaggtgttaagggttaggacttagtctttggaagacacagaaagtagaccccaatgagatgggggtgggaggatgagggggtagaaggatacgtttaaagggctggtagactatatgtcccccctctaagcagctattgttgggccgttttgcagatgt

SEQ ID NO: 24783 - DNA, 1180 bp, Mus musculus
acttggttttctttgttgggatatgtcagggggaagggggctgtggaagccaagtggatggtggttgcttaagagactgtagtgttttacacaagccagagaaccaagtatttgggccctaaagagaatgcagagagcttctaagcttttgtctgaaaggggcagaacctgaactgcctactgtctggcccacaggcaccggctcgttttgggggaggtgcctgcaggacccaacgtactcaatgagcttccagcgcaatgtccgatcgctcggggccgactgccaaggggaaggatggaaagaagtattcctcgctcaacctgtttgatacgtataagggcaagtccttagagatccagaaacccgctggtgagggtcctgtcctgtaaagacgttcctgatatttgcaggctgagcatgtgtgggatataggctttagagctctccaacaaaggcaactaacagaccagatgaatactggagacctctcagtttcatcttcagtgctgaagggggtgctgggctttgggtgaaacacagcttatcctcctacaaaggcgtgtttttggttccctgtccttggacacgtaagaatcggaggcaaagtaatgtggtggatttgaaaaggtcttggaccagcttgccccccgcaggctcaggatcaaccatcccacagatgattatgctgtatctcacctttcccaggagagcttaagagattattgagtaatggaatggtttctgagagaagcctatagtgaaaagatggtagggttgtctaaacgggatttgttgacgggacgctgttaggtctcccgtgtgaggtctttttgatcctttttctctccaccgtttcttcagttgcccctcgacatggcctgcagagtctcggaaaagttgccattgcccggcgcatgccacccccagccaaccttccaagcctgaaagccgagaacaaaggcaatgaccccaatgtctcactagtgccgaaagacggaacaggatgggcaagcaaacaggagcagtccgaccccaagaggtagatagctgtgggacttcctgaggctcgtagctttgagctggggagtgtgttaaggcatgagactgagagaagcaccttctgcacctagtttgttagatgactaagaattgaaaccttaaactttgatggagagaaaa

SEQ ID NO: 24784 - DNA, 1259 bp, Mus musculus
tcccatcgtctcctacacacccccttcagccacgcagcctccgggtggcacggagctttcagctggagcctctgctcaccgaaactctacatgtcagtggcaggagagcgagagagggacagtcaggtgcagggcctgtccagaagaagaacaaacaaacagcaccatgaatcggcccttcccaacctccaggagcgggggcctttggcacctcagcccccagtcccctcctcctccccacccatacctccttgcgcccatcggagccttggttgatgtgagctggcagcagagaagcactgaggcacgacggcagaaggcagacctgcgagcagcggatggcagccgcggaggccacgggagcctgaccagatgctgaggaccaatccagcctctttttctgttcccggttttttcctgaaactaatgtgctgtaccccattttccccatacttgttgggggaggaagtgtcctgagtggggtggtggatttttttttctctcattttttttaagttgagggttatgggaactgtcgaatgggaagctgtactgacaagcgaccacgtgggtgtcagagctgagactgagcagtgggtccttccacccctcctgggcccttcccttgagaagatgatggctttctcttgggctgggcttggggcagaattaggcagctgtgggacttatttgaggagcctgtcttccggaagaggtttctgtgaccctgccttggtccctggctctgtgtggagagtgggaagtccagcctggggttaactgtcgcagtgtttgctccttccttcccttcaagggttaggggtggggacgcttattttttatgaaatgtaaggtgatttcctttccattgcctttccacttttgatgctaaaagattgatttattagaactgaagagaaaaacagtgcagccaagcaataaatctcacggctgctgccaggaaggagatggagaaaggaagagaagccatgccctttagttaggagttagttagaaagcaggcaggctcagtgatggaggtgtgagggcatctgaggggttggggactcagggtcaggtcaggaggagctgcttagggtattgcctgataccaggagagctgagaagagggcaggctgtgctgagttagggctcagagaggtgacctggcctgacctggcctggcctgcctggccatggcagctgtgggtgagggaggctgcattcttgttgtctgggaccattgtccccgaccccac

SEQ ID NO: 24785 - DNA, 1159 bp, Mus musculus
ctcagccacctgggagctggggtcagtgagctgctgatgactgtctgttatagtgtccattgcaaccttctggtcttgaggacatttgctaaaggacagctaagtagggcggttgtccctgtcctgttctggtgacattactgcctctcctgggtgttctggcatgctctccccttgagcaccatgccctgttatctttcctccatttccacctggcaactggcaccttgctctgtacagagctcccatctctaatcattgtcaattgggcttaaaagtcaattgatgtggatgctaaccagatctagctggaaagagacctcagcagagtcttctttgtggtggggaggggttttcagtcttctctctcctccccatccttccatggggtgtattggagatcagcgtcctccacccccccaggtttaacccccccactctgccctcctcctgcccccacccctcctccccctcagcctatggagatcttcgtggatgacgagaccaagttgacgctgcacgggttgcagcagtactacgtgaaactgaaggacaacgagaagaaccggaagctctttgatcttctcgatgtcctcgagttcaaccaggtcagtatcgagggtctgtgtaggcgagagcactgcagctgtggcagaagcctgtgtagaagtagcctgtgattgacaggccgtgtaggtgaggaggtgaatcggtggatggagcaagtcccaagtggaagttgggtaagagctgaggtagagtacttgatgacgtcagtaagtggagcagagctctgcaggcacctggcacttgcctaagagctgtggggctcttggtattggaagaggatcctttggttctctagactgtagttctcattcttttttttttttttttttttttaaagatttatttatttattatatgtcagtacactgtagctgtcttcaggcactccagaagagggcatcagatcttgttacagatggttgtgagccaccatgtgattgctgggatttgaactctggacctttggaagagcagtcgggtgctcttacccactgagccatctcaccagccctgtagttctcattcttaacatgttgagaggtggcctcacccttgtgtgctggtcttgtgggtttgaggtcttgtgtcc

SEQ ID NO: 24786 - DNA, 1593 bp, Mus musculus
agcacttttgttcttccaggagttcccaagttcatttctctatgtcagctcccagtcatgtagttacagtggcggaagaagatggtccaatgtcctctgctggccctccaggcaccaggcacacatgcacaagtgtgtgcaggcaaaccccacacacttgaacttaaaaaaacaagactgataagctggtgcatacatcatcatgcccgtgctccctcaggtggtgatctttgtgaagtccgtgcagcgctgcatcgccctggcccagcttctagtggaacagaacttcccagccattgctatccatcgtggaatgccccaggaggagaggtgggttggaggcgcgtgtgtgcctgcccgtccatctgggtcctgtcctgtggaggaggcagtgtggagagaagagagtctcaaccctctcatttactctcacaaaggctctctcggtatcagcagttcaaggattttcagcggaggattcttgtggctaccaacctgtttggccgaggcatggatattgagcgtgtgaacattgctttcaactatgacatgccagaggactcggacacctacctgcacagggtaagctgcccgcccaccccacttcccgtgtgtgctgagcaccccccctctcctttgtcttccctgggaggcttgcagtctaacccttctccttccaggtggccagagcgggccggtttggcaccaagggcttggccatcacatttgtgtcagatgagaatgatgccaagatcctgaatgacgttcaggaccgtttcgaggtcaacatcagcgagctgcccgatgagattgacatttcctcctacagtgagtaccacctatgtgtgtgtgtgtgtgtgtgtgtgtgtgtgtgtgtgtgtgtgtgtgtgtgcctgcctgtgtgcgcgtttcccattttgtatcttactgtgacttttttctccagttgagcagacacggtagaggactcgcgtggtcagtctgctgtagaagaggacacgggtcaggaggagacactgccgccccacccgacaccgacgcctctgcccaccctatctatgcttctctctgcgtcaccaccactcctaaacctagtcctgatttatcagagttgtttgtttgtttgtttttgttttttaacaaaactaagaatgaaacaaccgtgtctgtggtgtctgtaagtgctctgttcatggcttgaaccagggtcattctgagggccgtgagccgggttgtggggcagcgtcattgtcttctttctaaggtggctgtggacagggaggctgggacactgctggggcccggaggtaaagagagcaagccccacgtcctggtacctcagctccttcagctgagtttcttgtatctcccaggtatctaagcggggcctggtaggccatgcctgagcgtgtgtgcacaggcatgtgtgcacaggcgtgtgcgtgcatgcgcattcacgcgcgcgcgcacacacacacacacacacacacacacacacacacacacacacacgcatactggcagcttagctgtgtaaagagcctggagtccctagctggactaagtgtcaaccagggcaggggctggaagcct

SEQ ID NO: 24787 - DNA, 1145 bp, Mus musculus
gggaatttccagtgtcaagatcttccttgaactctcacagcttttcttttcacaggtggaaaaggaggggactatgctctggctccaggttagtgtggggacaggattgttctgggggacattggagtgaagttggagatgatgggagctctgggaatccataatagctcctccagagaaatcttctaggggcctgagttgtgccatgaagtgaatacattcatgtacatatgcatatacatttgttttgttttaccctaggctcccagagctctgaaatgtctctccgagattgtaaaggtgacactctagggtctgattggggaggggcaatgtggacatgattgggtttcagggactcccagaatctcctgagagtgagtggtgggttgctggaatgttgtcttcacagtgatggttcatgactctcattctctagcgtgaagacagctgcctggactgtactgagtgacagacgatgtgttcaggtctctcctgtgacatccagagccctcagttctctttacacaacattgtctgatgttccctgtgagcttgggttcagtgtgaagaactgtggagcccagcctgccctgcacaccaggaccctatccctgcactgccctgtgttcccttccatagccaaccttgctgctccagccaaacactgggggacatctgcatcctgtaagctccatgctaccctgagctgcagctcctcacttccacactgagaataataatttgaatgtgggtggctggagagatggctcagcgctgactgctcttccaaaggtcctgagttcaaatcccagcaaccacatggtggctcacaaccatctgtaatgggatctaacaccctcttctgcagtgtctgaagacagctacagtgtacttacatataataataaataagtctttaaaaaataatttgaaagtgaccttgattgttaacatcttgatctagggctgatttcttgttaatttcatggattgagaatgcttagaggtttttttgtttgtttgattgatttttttgaagaaataaatggcagatgaaggaacttccagaatctgggtcactatgctgtgtgtatctgttgggacaggatgaggctgtggcagctgagtgtgaacagggctgt

SEQ ID NO: 24788 - DNA, 1145 bp, Mus musculus; identical to SEQ ID NO: 24787

SEQ ID NO: 24789 - DNA, 1179 bp, Mus musculus
accatcaaagaaggctctcaactaaagcagcagatccagtccattcagcagtctattgaaaggctcttggtgtaggccgtggcctctgccctttcctgtctactgccaccctgtttgtgtatcatattgtctgttagcatgtactattttcaaccagttactattatattgtactacatctgcgttttatatttttatttttgtcttaataaggttatttttcaccatctcttcattctcttctaccataaaaaatgaaatgatagctaggacaggtgaaaggcagaatgtcaccatttaacaacaggaagaaccaggagaaacttaagccagggacagtgtatactttcatctgcaaacttattccactgggcagggtaggatgacagtgaccctggtcccttgtgcctttgctataagagctccataaatgttactgacactgaggaacttcctttgggtagcagtctctccctccccttatcatttgaagaaatttgatgttgggcctatgtccgggagccatttattaatgtcctgtgtgtttttgatgtatgtagtctgatactctcccatatctggggcagtatcagttcaaagggattctgtggagatcgtggcaatttgctggaacttacagcagagacagtgctagcaggaaacatcctctccttggtaaatggggatgtcttgtggaaccatttgatggccgtgttgggagcccttatcctgttcttcccacagcatgggtcaggtgtattctccctcacatgaagaaagtgataacatgttcattattgagcatcctaataaatatgttcatatttcgttttaaatgaaaaaaaaaaaagaaacatagtaaaggctgtatttcattacattggtatagatctgtgtatattgatacagattaaggttatatttccttaggttggtatacctctttgtgtactgatacaaaattaaggttatatttgctctaatgggtatagaattttgtatactgatagaatattaagagtatatttgcttacatttatagatccttgtatattgatagaaaattgacattcatttgattgcattaatatagatctttgtatattgattcaaattaaggttataattggttgcataggtatagatccctgtatattgatacaaagtaaggttatattt

SEQ ID NO: 24790 - DNA, 1197 bp, Mus musculus
ggtcattggagtgaagctggagttgttgggtgctctgggaacccataatagcttctccgttgtaatcctctggtggcctgtgtcagatcttgctatagatatatctttgtatatatttttccctaggcagggacagctcccagagctctgatatgtttctctcaagattgtaaaggtgacattctatggcctgattgcagaggggcactgtggacatggttgtgtttcagggactcccacaatcccctgtgagtggtgggttgttgggatattgtcttcattgtggtggttcctgaccctcgttctctatcatgaagacagctgcctggagtggactcagtgacagccagtgtgaccttgggtcttcatttttctttagagaacagtgtctgatgttccctgtgagcctatgggctcaatgtgaagaattgtggagcccagccttcgcctacacaccaggaccctgtctctgcattgccctgtgttcccttccaccgccaaccttcctggtctgcagtggaaactaagggttctttggaaagtcggttggatggcgttgtgctggggcaaacacatgaaggagtgtttccttaaagtggatacaggtgtgaaatcctaaggccgactcctgaaggaacatttcactgaagcagacacaggagagaggatgttctgttaaacaagcatgtgaaaggatgcgtgatgaaggattctttgctaaagacacacttatattggtctgccttacattgtgtagtggagctgcattggtcggggcgccatagagagaaacgcacccaaaaattctgatagtattctgcagttgatgcttccaaggacatgagcttattggatgcctgtgctgaggcaagacgcttggaggacacatgatgactggagagtataaataggactccatggagtgactgagacagagtttgccttgctggtacagtgtgtgtcttgtgtcttcactgttcttcacttccataagagaggtacagcaaagaacttctcctggtattcctgctggtccttcctgctggccctagctgaggcctggctgtctctgctaggtcctatcacttctgttgctaacctgactctactgaactgaacaactgctatatccctgaggtgttttcaagtggatggagctgccactgctgacctgtgaattgaactgccaacgtccag

SEQ ID NO: 24791 - DNA, 1197 bp, Mus musculus; identical to SEQ ID NO: 24790

SEQ ID NO: 24792 - DNA, 1323 bp, Mus musculus
tgggctgaaatactgggttcacccatatctaggactctagacgggtgggtaagcaagaactgaggagtggccccagaaataattggcacacgaacattcaatggatgttttaggctctccagaggatggctgagtgggctgtaaggacaggccgagagggtgcagtgccaacaggctttgtggtgcgatggggcatccgagcaactggtttgtgaggtgtccggtgacccaaggcaggggtgagaggaccttgaaggttgaaaatgaaggcctcctggggtcccgtcctaagggttgtcctgtccagacgtccccaacctccgtctggaagacacaggcagatagcgctcgcctcagtttctcccacccccacagctctgctcctccacccacccagggggcggggccagaggtcaaggctagagggtgggattggggagggagaggtgaaaccgtccctaggtgagccgtctttccaccaggcccccggctcggggtgcccaccttccccatggctggacacctggcttcagacttcgccttctcacccccaccaggtgggggtgatgggtcagcagggctggagccgggctgggtggatcctcgaacctggctaagcttccaagggcctccaggtgggcctggaatcggaccaggctcagaggtattggggatctccccatgtccgcccgcatacgagttctgcggagggatggcatactgtggacctcaggttggactgggcctagtcccccaagttggcgtggagactttgcagcctgagggccaggcaggagcacgagtggaaagcaactcagagggaacctcctctgagccctgtgccgaccgccccaatgccgtgaagttggagaaggtggaaccaactcccgaggaggtaagtgaagggacttggctgggctggcagaggcagcagtgaagggaattgggaacatgtagggtagccaccctgcctgccaaaggtggtgatggctgccgggcctcctgagaagcacgacgcagtgtggactagaacccagaattgcaagaatcagaaaccggcctggattgtttcggcctggcccttgtcatgtaggtcacctaggcctggcctgtgtcccgacacttgcttcatgccatcactgtctgtacaccagtgatgcgtgaaaatcagcccccccccaaaaaaaaaaacatatcagcccctctggggacttggatcacagtcggacccaggaacttggccttaaggttaggcatggctgggggggtaaaaaatggtgcttatcctggagttattgttactgaagaggttgggtgtgactg

SEQ ID NO: 24793 - DNA, 1154 bp, Mus musculus
agctgcggcccctgctggagaagtgggtggaggaagccgacaacaatgagaaccttcaggaggtgaggagtggcaggatgtgtgcaatgtctgccaggcacagtcccttctgctgcttccattcctggcttgaaactcctccctctccaaccggagctcgcaggagaagttctgtgtccttattctgctgctatgaattggaatccagagccttaacatttgctaatcaatcaggctctctccttctgagtcaccctctgcccccaccagcctgacaatggtccctccccagaaccccgtctagtgctggtgaaggctcagacctaggtctaccagccccttccagagcccctttcagtaacccctggctctggggccacatccagtcaatgctcccttagcacaatcccttagcggtttgttcttcagtcccatctcaaggtggggctgttgccaagtcaaatactaaagttgctcttgtcgcccccatcttcccctgcccagatatgcaaatcggagaccctggtgcaggcccggaagagaaagcgaactagcattgagaaccgtgtgaggtggagtctggagaccatgtttctgaagtgcccgaagccctccctacagcagatcactcacatcgccaatcagcttgggctagagaaggatgtgagtgccaagatcctgccctgtggtacctggatgtttccctgttcccattccccaccccccccacccccccacccccaccgccgccaccgctgactgcagcatcccagagcttatgatctgatgtccatctctgtgcccatcctaggtggttcgagtatggttctgtaaccggcgccagaagggcaaaagatcaagtattgagtattcccaacgagaagagtatgaggctacagggacacctttcccagggggggctgtatcctttcctctgcccccaggtccccactttggcaccccaggctatggaagcccccacttcaccacactctactcagtcccttttcctgagggcgaggcctttccctctgttcccgtcactgctctgggctctcccatgcattcaaactgaggcaccagccctccctggggatgctgtgagccaaggcaagggaggtagacaagagaacctggagctttggggttaaatt

SEQ ID NO: 24794 - DNA, 1199 bp, Mus musculus
tttcctccctccatctggaattgtcaaagctggaccaggcagcctcctacctacagcaactgatggatgaggctcccagtgccagggagctctgagccccactcacagcccagcgagcattcctcctcagacctgcttgctattggtgcaatgggacctcagaggtgacatggaccaccttcctcattctgtaggagggagcaggtcggaaagtgccacgattcgagaatgaggaggagatggagataaaaggataaaccccaagcacgcaagtgtgagcctttactgccctgtgccccgctcgactgtctcgcctctccattgcctaacaacacacgcacaatttagcttcattttggacacaaagaagaatggaagtaattttcccaacttatcaaaaggagtttagcctagctgatcaacaactcaggctgcagcgcctttctgttacagtagcaaagtttcaaacctggtgactttgacaagtgctcctgtttcgggcagaagtacagggtttgggctccgtgtctctcctcctttcagcctttttttccctgccaccctgacacactgaccacatccaaggtccacttgagctgcccccatgtgtctgcactcttcctgaagagaaggcttcctgatttcctccctctggggtcagtgggcaagacggccagtttcaaagccatcaaatgcaagggagaaaaggataaaagggagccatgctgtgctggggtagcaaaggggccaggtcaatcttagaaagattcagtgaagcaaagacttcggggaggggcaagaaaatgtcccacctagaaggaacgctcagaaaagctgacatagcacattcttggcactccgggtaccaaggaggctattgggggcggagagcatgcaaggggaggcccagagatgaagagcgagtggtatggtgaactgtgctggttactggctgcctgccactcgagcctgcagtaataaagacgtctgtgattacagaggttagcattgaaagaaacatggggtctcgtgaagcgttggacttccctaacactaactacttctgtcttgttggaaagcatcatcacatggccagcatagctgcaaaggcaggcaggcattctttagaagccaggtttccagctaagatgtgcatagctcttaaccaggcctatgaaactttacaagcctggcctacc

SEQ ID NO: 24795 - DNA, 1176 bp, Mus musculus
ttattgtgttttgagacaaggtctcactatgtggccctggctggcctgtaactcacagacatacgcctgcctctgccttctgagtgctgagatcaaaagcatgcatgtgccaccacacccaggcagattattcttaaatataatttaaaaagtttaagttattctattgttttgagacgagtcccgttacctaacctggaccagcctaaaattcaatgatttcctgtgtctcagcctcctaacattaggactataggtgtgtagggtccccttttaccaaatcgctctgtggttcctgtataagtccctcattcctgattcatcctgagtgagggaagtctggttaagcctaaaagccttccattctgcctagatgaggaacagcctcttttctaagcctgcgcatcaccaaggccccgccccgatttctccacttccggttggccagggactcatgttgtaccagtgggattgctctaggtagttaggtactaaccgcctcagttccctaggtctcacacagctgtgtccccttgggttcccgttctcactacctcttctctttcttctttcttcccagatgtggtgaacgactcctctgacaccttcccaccagccccctggtggccacctggcccgcctcccaccaacttcagcagcttgggtgagctgtccttgtccttggttcctcctgcctccccaccccccaccgccggtggggtaggatctgctgtggtgctgaccattctctcccatcagagctggagccccggggtcaacagccagtggccaaggcggaggggagcccaactgccatcctcattggctgcctggtggccatcatcctgctgctgcttctcatcatcgcgctgatgctctggaggctgcactggcgccggctgctcagcaaggtgggcggggctgtgtgtgtatgtgtgtgtgtgcgcgtgcgcatgtgcgtgcgtgtatgtgcatgcacgtgcatgagtgtgtatatgactatatacgagtgtgagagtgtgtatgtgtatgagtgtgttgtatctatgcatgtgtgagtgactgcttagcaaggtgggcagggcagtgtgtatgtgtatatggggggcgcacacatgggagcaacacattgtgtgtgtgtgtgcatgtgagtgtgtgcacatgtgtttgaatgtg

SEQ ID NO: 24796 - DNA, 1145 bp, Mus musculus
caccgaaaacgcagccgaagggtgctctaccctcgagtggtgagtatcgcccgagtgggcatcaggaggtcgcgtcgccctggaacttgtaggtaacaactaggcgcagggaccttcgatctgacgtttccctcttttatctgctcaggtccggcgccagctaccaaccgaggaacccaacattgccaagagggtcctctttctcctgttcgccatcatcttctgccagattttgatggctgaagagggtgtgtcgcagcccctggctccggaggatgctaccagcgccgtgacacctgagcccatttctgcgcccattactgcgcccccggtcctcgagcctttgaacctgacctcggagtcctcggactatgcgctggatcttaaagcttttctccagcaacatccggcggccttctaaacgcgatgggtcacagtccgaagaaacaaaggcaccatggatgggtacctggtgcgagagaacgtatcccaaactgggatttctaaggcaacgctaactcagaacactaccgccaagagacaccgcgggtcctggctaggcccactggggacggacagagactttctccgtgtctaattaatatttatgtatttatgtatatcctcctaggtgaaggaggggtgtatgtaatatttattctaacttatgcaggggtgcgagatatgcctccctgctgtaacacagatatttattacgatttatagggtcggtaagacagagttgtgggagggaggacccgggtggtaggactcccagcttggggattagtctggggggggtgtaataagattaggggtaacactccgtcttccagcacttcaactctgtagtctgttgtaaggctttggaagacccttgggaatccggcctttgatgtcttctggttgcttctcaggggcagctgcaggagtcttgggtccatggattgtcagagggcggctgtctggggtcgcctagtatgtatgttctgtgaacacgaataaacttgatttgcctgtcattattatctgcagttctcgaagtgtatcattcaagcgggggggaggggggagtggcgggaggatgtgactaggtgcccagtcctcaccctttcttgggtcctgaactctttcttggagttaca

SEQ ID NO: 24797 - DNA, 3285 bp, Mus musculus
gggaggcatgccttaggacttgagacattgaggcctcgttgctcttccctgtgcagttctgggaggtgataagcgatgaacatggcatcgaccccaccggtacctaccacggtgacagcgacctgcagctggaccgaatctctgtgtactataatgaagccacaggtgagggcagaaatccccacttaacatttattccctgtcccctgtattggacagtgagcccagatgaatgcatcactggctgccctggaactcccatagatcgtctacctctcaagtgctgggtttaaggagagcatcaccacgccctgtttttccacacttctaagtatctattacccctctgcatggttcccatttttttttccctagactcacaccctaagggactaaagattagctctactgccaccaggtggtagtgcctggaatgacaactttagtgctttgtggctgatctcccacccagaggtaatgcattgctgatccgtcaaacattgacttgaattcctgcaggtggcaagtatgtccctcgagctatcttggtggatctagaacctgggactatggactccgttcgctcaggtccttttggccagatcttcagaccagacaacttcgttttcggtgagttaggtggaatcgatttctatttgctcaactgaattattccagtcgttgaaagattaagaagtatttgtgtttctctcatatcttagtgattaaaccttttcccttactgcattccaggtcagtctggggcaggcaacaactgggctaaaggccactacacagagggagctgagttggttgactctgtcttggatgtggtgcggaaggaggcggagagctgtgattgcctgcaaggctttcagctgacccactcactgggtggaggcactggctctggcatgggcaccctgctcatcagcaagatccgggaagaatatcctgaccgtatcatgaataccttcagtgtggtgccctcgcccaaagtgtctgataccgtggtcgagccctacaatgccaccctgtctgtccatcagttggttgagaacacggatgagacctactgcatcgacaacgaggccctctacgacatctgcttccgtaccctcaagctcaccacgccaacctacggagacctgaaccatctcgtctcggccaccatgagcggcgtcaccacctgcctccgtttcccgggccagcttaatgctgaccttcgaaagctggctgtcaacatggtgccattcccacgtctccacttcttcatgcctggctttgcccctctcaccagccgtggaagccagcagtaccgggccctcactgtgcctgaacttacccagcaggtcttcgatgccaagaacatgatggccgcctgcgacccgcgccacggccggtacctcacagttgccgccgtcttccgtggacggatgtccatgaaggaggtggatgagcagatgctcaacgtgcagaacaagaatagcagctacttcgtggaatggatccccaacaatgtcaagacagctgtctgtgacatcccaccgcgtggcctcaagatggcagtcaccttcattggaaacagcacagccatccaggagctcttcaagcgcatctctgagcagtttacggctatgttccgccggaaggctttcctccactggtatacgggtgagggcatggacgagatggagttcaccgaagctgagagcaacatgaacgacctcgtctctgagtaccagcagtaccaggatgccaccgcggaagaggaagaggatttcggagaggaggcagaagaggaggcctaaggcagagagccctgcatcagctcaggctgcttagatccctcagctttctccaactgccctttgtcctccagtttctttctgctgcctctgtcttgtatttgttttgttctgttttctcattgggggtaaatggtgcctggcacatggcaggcactcaataaatatttgtttgtggaatgtctcctttctctttccactctgacaaacttagatttctgacattctggttgttaccctgtgcttcctactggtatcttttttttttttttttttttttttttggtttttccagacagggtttctctgtatatatagcccaggctgtcctggaactcagaaatccgcctgcctctgcctcccaagtgttgggattaaaggcgtgtgccactatcacccaacaagtatccatttttttaaattattatttgactgtccagttaatattccagaatattctccagaaacctgaggtctgctccagatcctgtgtagaacccagcccaattctaagaactcggatagtaaccatcatcttaaagcaaagtagtggatcagggatgctaggtagagaccaccaggaagagaagggggtggggttttccagtcagggccatttagaatccacctatgctttcagtcagcagggctttgttttgtttttctcctgcctcatctctcagcctcaggagaggtattaacagtattatctccatttatatcctcccagctgtcctgagccaaatctgccattggaagtgtcttccctgtattggttctcctttctcggagagatgggggttgggggtgcggcaaggtcttggtcttggtctctgaacactcccaattcccgctgaaactccacacttgggaaagtatgtttccacctgggtctttcagacactgcccagatgggctgtcaccacctctgccccatgctcctcctgcccttggcttggtcatttcctacctttctatttcgtgttgtacctgctttttttttttttttcatattgaaaagttgacatcgccccagagccaaaaataaatgggaattggaaaaaggctgtgaggctgtgtgctcattcaggggtagttaaagctgctggtggaggaaccggtcccaggttgaattatactgttcccaagtgtcttagtcaggattttacctattactgcacaagcatcatgaccaagatgcagctggggaggaaagggtttattcagcttacatttccacactgctgttcatcaccaaagaaagtcaggactggaactcaagcatggcaggaagccaatggagcgatgtttcttactggcttgcttcccctggcctactcagcctgctctctaacagatcccaatactaccagcccagtgatggtcccacccacaaggggcccttacccccttgatcactaattgaggaaatgtcttacagttggcattttcgcaacggaagctcctttctctgata

SEQ ID NO: 24798 - DNA, 1136 bp, Mus musculus
acagggtttctctgtgtagccctggctgtcctggaactcactctgtagaccaggctggcctcgaactcagaaatccgcctgcctctgcctcccgagtgctgggattaaaggcgtgcaccaccacgcccggcttctctagttcttaatttttctgcttcatctcagatgcagggattatagatatatgccaacatgcttttatcaaatagatttttttttccttattggtagtactaagaattgaacacttggcctcacataggctaagcaaacattctatttctggcatactctcccacccctgaatattgttacatgctttagaataactgataggaaatcatcacctcatggttgttcacatctttaatcccagcacttgggaagcagaggcaaggggatctctgagtttgaggccagcctggtctgattatgtgtttcctttacagatcatggaaagcacccaggtgattgactgggatgctgaagaagaggaagagacagaactatccagtggctccttggggtatagtgtggagcctatagggcagctacgtctcttcagtggaactcatggaccagaaagaggtcaggagatattgggaactaaagtatgattgtgggtctttcttagaagaagttggaagttggagggttggtagaaccatttatatatatgtacacacacatacatacatatacatacataagtacatacacatatacatatgtatataaataagtatgtagtgtgtgtgtatatatatatatgtatatatatatatatacacacacacacacacatacacatatgtttcaaaggggatatgaataactgtaccactaaggatgccaaagaggccacctgagttgactgttcgaggctggttctgggattttcttggagtgattttcttttgtcaagagaaaatgaagagcttcaaataaaactacaatgtggggggtgaaaagatggctcagtgattaagagtgcttactgctcttggagaggtttaggttctcagcacctacatggtggttcacaaccacctggagctctagttacagggggcctgacactatcttctgacctcaggataccagcacacatgtgatagacatgaattcatgcaggt

SEQ ID NO: 24799 - DNA, 1094 bp, Mus musculus
acaaagcctaatgtcaggccacggcggtcctccaggatgaccccctccccgcattcctctgctgcccttaagccaaatactacctgccccacaaaccagcctgctgcctctagaccaacatcccgacccactcggggcagggcaaataggtcctctaccaggaccccagaactgattgtccctgtagaccctgaactccagccttccacctccacagaacagcctgtcatcccaaaacttacgtcccaggtcactgagggcagggtacagatgcctgaaccacttctcacaggtcccgagatccagtctcccacctccacagaacagtctgtcaccccagaccgcaaacctcgggccactcggggcaggccaagtaaatctcccaacaagaccccagaaccacttatttctactggccctgaactccaacctcccacctccatagaacaacctgtcatacctaaacccacttctcgggtcactcggggcagaccacgtaagtcttctgtcaggaccccagaatcagttgtctccactggccctgaacttcagcctctcacctctatagaacagcctgttatccctgaacctagggccactcgaggtagaccaagtaagtcttctatcaagaccccagaatcagttgtccccactggtcctgagctgcagcctcttacctctgcaaaacagcctgtcacccctaacctcacatctcgggcctctcggggtagatcaagtaagtctatcaggaccccggaaccagttgtccaaactggccctgaattccatccatccacctccacagaacagcctgatacccgtgagccctcatctcaggctaggacacgtaggtctgctgtcaagactcctgaagcgagtgtccccacaacccctgaactccagcctttcacttctaaaaaacagcctgcccctaagcctacagctctggtcactcagggaaggacatataaaccctccactgaagattgtgaatcagttgggccagtggcccctgattttgagccttccacctctacagaccatcttgtcacccctaaggttacagatcagagcttaacactacagtcttcacc

SEQ ID NO: 24800 - DNA, 2278 bp, Mus musculus
aggtatattgtatcatcgtaactgtttggggaatgtgaataaggcctaaaatgttttggggaaaaaagggaacttttttcctaagatagccagttttttagttggctcacctgagctgggtatggctctctaccgagcacctgccatctgcccagctgtgctccgaggaagctgctccaggctcagtgccctgactctacctcctgtccagaagccagcattttctctttacttcccggggttctactcaacatgaagcagctcccaggagtgcttggttgagaagatgagggtagctcatgggtgtggctaggaaaggctttagttttgctgtacttgctctgctttgcagtgttggcagttagctgtggtcatctccagtagctcagtgctcactctgccttcttggtggcaggtttctgtgtggagacacaatggatttgaacttgcacttcatttattattattattaatttagagtaaattgtatttgttttttaaagttggctactttccaggatgtggagaaagtagaactcatgaatactgctggtgtttggcttgtcctctgcagtaaacagtagcaaagttatttcaaagtaagcagagctagccgtgggcattgcctgtagccccagtgcttaggaggctgaagtaggaagctcaccagtgccagttcagcctgggctacagcgtgagagtcgggcgtggtggcgcactcgggaggcagacgcaggcagagctctgatttcaaggccagcctgggctacagagtgagttctagaacagtcagggctgttaacagagtaaatcctgtctcgaaagagaaggaaaaaattttttttggtttgttttttgccattttctctggacatgtgtaaggtgagtcagtgctcgttgtgcctgcctggtcactctatgacccagcaagactgttctgtaagcaaaaaaaaactctgttttgtttggttttgtttcttcgagacagggtttctctgtatagccctggctgtcctggaactcactttgtagaccaggctggccttgaactcagaaatctgcctgcctctgcctcccgagtgctgggattaaaggcgtgtgccaccacgcccggctgcaaagaaaacttttaaacatgcatttggtatgtaatcccagcagtccctgtaaaggctagtaggatcagaagttcaagctcatcgtggatttttgggtttttgttttgtttttccgcccccaaggtcagctcagtctaaactgcaaaagattcaaaaatgaaaagcacttgatgttttatctttttggttgggctggggcttgaacctggagcttccttcctttatgcatgctaggcaaagcctctaccactaaaccttattcccagcccctcacctctttccaaatatagaaaagctgaagatttttgttcagcaaggatgagcatatatactgtctgcacagaaagcaatgttcagacatgaagtgaaaacacagtatttgaaggtggtcaaagacaccctaacacaagggcgagacaaaagggacaggtttgattccacctgcataataatatataaagtgtggtgtgaattcacaaaggtaagagcaaattgatgcttgccagaccatgagtacacagaagctgttcaaggggtctagtgttcccctgtggggagttgaaagacttggaatcagaaagaggaagtgattgtacataatgcagaatattaagtactaatgtataaaagggttgggttttttttgctttatgaatttcacttcaataaaaaagttgcttactttatattttcctgcagtgaattatgtataagcttagagaactattggtggttggcacaaatgaggcccaactcatgacaggcaattgctttacaactcattcacaccccagttatatgcttgatctttaaggtttttcttttttggtggtgccgggggttgaatctaaggcttcctgaaatgctgctcaaaagcttcaccgctaagcagtagtcctagaccattgttcatttgatgcctgtggaggccagaagtcagccttggatgtctttcctcgggccactttgtttttctttgagatagggaatctcactgggacatggggcacccttaggctgggctggatggacagtgagccttaggcatttgcctccctagagcttgcattatgatttaaggaggaaacaggttaaagagaaaccacacatagtcaactgcttgtttcccacctataagctcttctgggaccacttcacag

SEQ ID NO: 24801 - DNA, 1200 bp, Mus musculus
tgacaaaggaggttcaagacatcacctcgagcgaagtggagactgctgagcagagacccactgaaagctggaaatggaccctaaactctgggaaggctcgagaacggacgacctgggacatagatacacaaactcagaagccagatcctccagcatcttcagagaagcacccaggaccttctggtatggaggctgaagaggaggctgagaaggaggaggcggaggctcagagcaggcctctgagagcccagcagaacctctgctctgggccctcccccctcccaccagagcactctgggacggaaggctccagacagcaggaagaggaagcggcagaaccccggcccccaacaccagcccctctgtctcccccaccctcggccccaactgccccccaaccctctggggatcccctcatgagccgtctgttctatggggtgaaaccaggaccgggggtgggggccccccgccgcagtggacacaccttcactgtcaacccacggaggtgtgcgccccctgccagcccagcccctccagtcaaccctgctacagctgatgctgcagggtctggatctgggaagaagcggtacccaactgcagaggagatcttggtgctggggggctacctccgtctcagccgcagctgccttgtcaaggggtcccctgaaagacatcacaaacaggtaagagagctaccatgcctgactgggtagaagtctctttctagttctgactggatggcttttttatatgtgtgtgttcttgtcttctattctttttattcctgccgactcccttcctccccctgcacacacccttcctctgggtagccttcctttgccattcattttggagccccaaggattctgttctgcactcaactgctgtgttggggtgtgtcgttttcgggtgtgccctgcctgtttcttctttccccactctctcggtcccctctccttttcttcctctgggcttttgacccagttaaccctctggtaagagagaaaagataacgtacctgtgaaggcgtgtgaaaataacccagggggacagagaaggttgacggagaagttcagggaagttggaatgaaggtctcagccccagaaggaggagggggtcaaagctaatggaggacattccagaacagaggtggggggtgggttggggtgatggaacagagctggctgaaggaagaagga

SEQ ID NO: 24802 - DNA, 1165 bp, Mus musculus
cttccttccttcccgtacctgaagcttctggagtctggatgattcagagccgacagacctggcagggagcctgcctggcagggaagggggttgagcatattctgacttgcttttcccatcccatttctggggcagagccagtagcctaaatttacccctaactcagggtgtttcccgtgggtgacctaagagtgagcatcaagtcctgggttggaactcagaagtgatctggaattgagatggagcaccccctagccctgcagccttccttaactcccagcaactcccggggacctacagacacccctttttctaggtcactaccccttcgtttacagcttccttctctcttgatcacagcctggtttacattaccccccccccccagctcccagtcccacctgcgaagtcccaggtttacaagccatgcctacccacggagagcccccgtgggaccctccaccttcccaccgtttcattgagagtgacttgggaaggtgtgtggccttcttcaactttgctcagtattactgtgcctcggtttcccccaagagggaaggctggggatcctaaccctgaaccccatgaaagttatttaattctgtttctctgtgtggttcatattgaattgaactgcagcgtgggggtgctaaggaagtgcttcgcttccctggcgctcctttgtcagctgcctgatttgtatcgtttttgtaactttccataataaaatggagctcttttcaactctcttgctgccttcctttgtttctttttttaaaagattttgttttggggctggagagatggctcagcggttaagagcactgactgttcttccggaggtcctgagttcaaatcccagcaaccacatggtggctcacaaccatctgtaatgacatctgacgccctctactggtgtgtctgaagacagctacaatgtacttacatataaataataaataaatatttaaaaaaaaggagccgggcatgtggcgtgtggtggcgcatgcctttataaaaaaaaaaaaaaaaagattttgtttatttcatgtctatgagcacactgtagctgtcttcagacacaccagaaaagcccataggatcccatcacagatgatcgtgacccgccatgaggttgctgggggttgagctcaggacctctgga

SEQ ID NO: 24803 - DNA, 1199 bp, Mus musculus
taagcagctgaagtctgtcctgtcttccttgcaggtctttctcaggctcacgtaagcgcatgtcagggtcagtctgccctgctagtgagaagtagccaggtgtagaccaggctggcctcgaactcagaaatccgcctgcctctgcctcctgagttgtttttttgtttttttttgtttttggaccgggtgtctttttcttgtcctgagtcagtggggaagaggatcctttttagaccacacaattaaaattctgatttgagccgggtgtggtggcacaagcctttaatcccagcacttgggaggcagaggcaggcagatttctgagttcgaggccagcctggtctacaaagtgagttccagggcagccagggctacacagagaaaccctgtctcgaaaaaccaaaaaaaaaaaaaaaaaatctgatttggaagtaaaggaaccctattgatttctgctccctcttacaggtactggagattgaaagcagctggcttttggaagtggctccccactactataaggccaaggagctagaagatccccatgctaagaaaatgcccaaaaaagtcggcaagacacgagaagagctgggctagagagtgacatggaccaaaccttgcagctcttttttccttccatactttaatatctagtaaataaaattatttttggaatgaagtgcatgggaactctggaacccagagaaagtgacgtgaaaacctgccttatgtcattgcttaaactttattatttacaagttaaattacacagcagctttacccagcatgatggaaagaaggaaggagagtggagggtggcggctggctctggacattctcgtccacccccacctccttttgtgcgtagcagtcctcagtgcagcctttcacccacgtctgcatcaggccttggagcacaggtgtaagctgggctctggttctgacagccccagggccaccagggctcccaccagcagctttttcacaggcgtcgacggtgagtgtgaaggcatcagctgcagagacaggttaatggaggctggggaggaacacagacatgttctaccctttacccctcccaacactcaccttgtccaggtgatggcgacagatgaggccactggaattcaggtagaaggtggaaaaggcatcgaaggtcctgggaaggggagaggcatcgtgcagagggaggtaagcta

SEQ ID NO: 24804 - DNA, 1163 bp, Mus musculus
gagactagtcagttaacttgtcctcgttactgtgctgtgaaatgccttcttggggaaagggtgtccctgtttgaattaaggaccattaaattgaaagtgccgtttcacttggggcgggggtgggggagggtgagtggaagttagaagaccctaaagatagattactgaggagccaaactggttatactctggaggttgagggaagaggattccaagctcaaggactgaacctttcctgctgagttgatgccttcttcttccacctagcttcccaccctcttccttcgctcccatgactacactatatattcaatggatgtggaattcatcaatgagatcctgaacattcgtaccaagtgagagttgggacgagggagggagaagaggacccatgctaaataaatacttgggtcttgtcccagagaaggttctagctgcttcctgagactgttcccccacaccttggcagaatcagttttggttctgcagtcctgatattcctgtccctttattctcacaggggccggacattttatgttatgtccctgaccctttgccgcttcctggtttggaactattttgcacagtttcggttggagattttacagctgacccgccaccctgagaactggaccctgcaagcccgctggcgtctaataggtctgcccatacatatgctcttcctgcgtttctacaggcgtgataaagaggatctttaccggtaagagggaaggggccgaaactacagtggcttccctaatactgctggtcttccagcagtccttaacttaccctgatttggctgtcatcttactgagggtagagatttttagtctatctttttaaattttaaaataacatgtttgtgtgcatgtggtagtgtacattagagcaagtgagtgtttagaagacagcctgtgggaatgggttctgtcctccaccatgcacaccctggggattgaactcaggtcctcaggcttgcctgcaagtacctgtacacaaccatctcaatggcccagcctgcttttcaaaaagttagtggatttttgtgtctgttaagaactcagtggcgggctggtgagatggctcaacaggtaagagcacccaactgctcttccaaaggtcctgagttcaaatcccagcaaccacatggtggctcacaa

SEQ ID NO: 24805 - DNA, 1219 bp, Mus musculus
gaatccccccgtcctccttagtaaatacacttgtgagattgtcttgagatgagatggggatcacccttgtgctaccccgacttctttttccttcatagcaagagcttccttccctgcttccatgcccagggtgtagaaggacccttctcctggccccctattcccccattagatcaggtgcctcaatgtgtcccctaaagtccttgggagcaggacctccctcctccctccctccttccagattccttttccctctcagtgttgtctcaataaagtgtgggttcttctgtgttttctaaattgacattttcagcgaaaaacatcttaaggtttcagcttcgtttgtgcttcatgctcttcctggggtctcagtgctctttgtccctcttagattcagctctgagatctgtagcagagctcaaagcctccagcctccttctgagtctctgcctttccccatacttactgctggttctattctagagttgcagtaactgtagacctctctactaacttggaagccataggtcccctacccccagtaacatatacctccttccctggccagccttggtaagatgtggatttgctaggagcttgggctcactagcctcaggactgtttctggatccctctcctactctttgacctcatcatgtctgcaccacaaaccccacagtgctctctgaagacaagtcctgcctaagatcaagaatcctcacagggagcccgatggtggtggtggcgcacacctttaatcccagcacttgggaggcagaggcaggcggatttctaaattcaaggccagcctggtctacagagtgaattccaggacaaccaaggactatacagagaaaccctgtctcgaaaatccaaaaaaaaaagaaagaattctcacagggtactgggcatggtggcacaagcctttaatcccagcccttgggaggcagaggtaggcggatcctggtaagagtttgaagccagcctacatagcaagttgcagtccagccaaggctacagagtgaaagcctgtcaataataataataataataataataataatagtccaacagggtcaaccatctctaaaaactaccctttcttccttgctactgtggcctgaaagttcttttatttatttgcttatttatttatttttaaagatttatttattgttatatgtaagtacactgtagctgtcctcagacacaccagaag

SEQ ID NO: 24806 - DNA, 1160 bp, Mus musculus
actttgaaacgtttaaaggcgacccgtactgattacaccttcctccttttgtgttccttttaccccaggttgaattttctcggagaaagacaggccggccatcaggaaaacaaacaagcctcagcaacatctaaacccttgaaaggatcctgagaggggggaaagggaaatcagccaccagcccaaccactcgtgtcttctgcccctccccacctatcttgcccaccccaccagcccacgctgcttgggacttgagatctgtggccgaaggaccgtcaccacataacttcaaaaataatcaaccaccttccctgcccaaacctacccaatctcactcatccagcatttccgttttggaatccactcagactttttttttcaacgaccccctctccctaaatggagttgggcgggggggaaatgaaaactgagttggtctttactttttttaaaagagactttttgatccaatgaggccccacaagtaactgagtttgggtcctggttggttgctttattttttttcctccaaaattttacccctcccccctgagcccgaggtgctgacgtcgcaaaaaaattggatagtaagtgtcgaattttcaaaaaccagccttgaacaagaaatcaacgtttcccgttgtgaaaccaaaaataatgagaggaagaaatgagaccatagaacaaatgtagagtactggagagaaggaccaatcgggtctcttaaatctccattaaaggtcctgtgggtctaaacagtctttgttctctctcccctaccacctgcctcttccctgctgtggagcaggcaagggagagggtgaagggagggccagccagtgaggattttgacggttaacccttgataatccagcagatttccagactgccagagcataagcctttgcgataataaggaggaatggttaccttcctctggttagcagtcttcaaaagggttaatgagctcacatacaaaagatggtggatcttgtggcccagaagtcccacttctttgtgtgtgagacaagcagaacgcctttcaatttgccagattaataagcaatctgtacataaagattgcagggtaaggagatgggcagagaaatattagctggctatgtctttaaagtgactgttaaatcctctctattttaatg

SEQ ID NO: 24807 - DNA, 1160 bp, Mus musculus; identical to SEQ ID NO: 24806

SEQ ID NO: 24808 - DNA, 2337 bp, Mus musculus
cagcttcattcgcaggccctgtaagggaagcttttatcctccgtccctcccacttcagagtcttccgtccctaggcacccgtttctctttcttgcacccatttattcccagcccagttctgatgtttgtttctctctgagaaactctagtatttggttctctttgaaaattttgagataggcctagtagcaaccactcataaactcaggactggggaggctgagacaggaggatggctgtgaattcaaggccagcctgggctgcagagtgagactgtgtccaaacaaagaaaagagaagctgggctttgggcctctacctccatcctgctctcactcttgcttgtccttgcagaccaacggggagatgaggaagaaccatcggctggtaagctggccttgggaaccgaggctggaggtcaggcaggaagcaggactcttgactgaccactcccctctcctcttgggcagaaaatcggcttctttaaccagcagtacgcagagcagctgcacatggaggagacgcccactgagtacctgcagcggagcttcaatctgccctaccaggatgcccggaagtgcttgggccgctttggcctggagagccacgcccacaccatccagatctgcaaactctccggtactgtcattctggggtgcttgaggaggtgacctcatcagctgttcctggaagctgaaggggtttacagcacagatggggagcctccatgtcccaagtacatccatagggttggccttctgcaaggtgggtgacaggagtctcagtacggttccttttgtgacaggtgggcagaaagcccgagttgtgtttgcggagctggcctgtcgggagcctgatgtcctcatcttggtgagtgggcaatcagagaagggttttcgggtcagagctggaaatgcagctgctgcagtgctctgccataggcctcttccttctccacaggatgaaccaaccaataacttggacatagagtccatcgatgccctgggggaggccatcaacgactacaaggggggtaagtgctcagacagaggcagctggagctgctgggcctcttcctcttccactcctgactccctctcttgatttgttcttcctccaaagctgtgatcgttgtcagccacgatgcgcgcctcatcacagaaaccaactgccagttgtgggtggtggaggagcagggtgtcagtcagatcgacggcgactttgatgactacaagcgagaggtgttggaggccctgggtgaggtcatggtcaaccgtcctcgggattgagctccctcctggaagctgctgcaaccagctcctatggctggagtctaggccgtctcccctcatccacctagaagcctgctgcaaccagctcctacggctggagtctaggccgtctcccctcatccacctagaagcctgccatggctgctgccagctgcagcagccacataggccatgaaggtggcgtgttgccttgatgtgtgtgagagcatccatccgtgtggattgtgtccttctcaatgaaggactgtgttccccttgaggtaactgagctggcttgcccacactggctcagtctcttcagaaagaggtgacctttgctgtgctgggttcccctcaggcctagttaaggtggcctcttgtctcaagacctttgccactcagaactgaccctggtccctccttttggaagggtactactgactcactgacacaaacagccagaacctcagggctggaggcaagtgtctgagacctggactgtttcaccaaagatctggtgcctgtggtcccttgtctcgtggggacttgagggcaggaaaggagaactctagaactgaagtctcctttacaggggaggaaataaagtagtggggtgctgacaccatgtgcctgtggggtgcttcctgggctttttgtgtccctccccagccagtgcttgtcctccctgtgccctcatggttgggaaagacaccagaccaaccctgtgaatgaaatggcactccaccctttgctcgggaacccagtctgctgatgtaagatctacagagcatgctgggatagagttacacctataactcacaccctggaggtgtagagagggttttaatggctctagtgagtttgaggcaagcctttagaaaatagagcccttccatagatctggtaccagagatatacatagagtagatcactacacagctggcagagtcaactcatccactcagacactgggtggaaatcatccctcacagagaaaaagcatgaagatgggaccagagagaagtttctactgtagatgtcacctaaagcccctagttacagtgggg

SEQ ID NO: 24809 - DNA, 1211 bp, Mus musculus
gcccctaaatttctttactctgctacaatcaagaactcttccctggactgtgtggaacactgaaaagactgggcgtggggctgacgggactggagcctggttcccgggtgtccctgacttactgttttctctgtttagcttgggcagagaaacgtggttataaaacggccaaggcagctcgaaatgacgtgtacagagcggccaatagcctacttcgcctggcagtggatggccgcctcagcctatgtttctaccctcctggttacagcgaacagagaggtgagagcccacgtgttctccacggtccctactgaggggtcagcctcagggtagacctcaaggccagccagggctactctgggcagttctggtgatagtttactgatgtgcaaatgggtggctgtggggacttgagggcatgcaggaactttgtcagctctgcaggtaggcaatcatgtgaggggtgcgtgccagcatttgaagacttgcctttgccttcacctctgccccagctcgtttgctcagacatctgtttgtgttcctcaggcacctgggagtctcacccagagactgcagagctggtgctgtcgcagggcagggtggggccggcaggtgatgaggaggaggaagaggaggaggaactgagcagctcctgtgaggaggaaggagaggaggaccgggatgcagatgaagagggagaaggagatgaggacaccccaacttcagatcctgggtcctgcctaacagcccgaaacccgtatgccctgctcggggaggatgagtgctgagccccacctggtaccacgtccccctcagcagctttgcttctgggctgagctggaggtgtcttccctttgccaccctgattgtgaataaagattgtctgctttgtagccccttccccaggtggcctgaggtgagagcggtcggtgtgggctgaccgctgtgggaggctttttgcctttcttcttcattctctttgggaagcagagctatctgaggccgctgcccactctctcacatagcactttaggaatccccatggacagaggaggtctatggcaggctcacctggtattagccctcctctccttcacttcaacagagtcctgttaccccctgttgcctggccttggttttacgagcgctttgtgggtgaaggagccgtggaggtgtgtcaccacggaagctttttatagggattttctaga

SEQ ID NO: 24810 - DNA, 1209 bp, Mus musculus
tcctcagaggacacaggtttcagtgaagagcctgggctacgcttgcttatattgtgtaaggcttgctgctcttttttttttttttttaagatttatttatttatctactatatataagtacactgtcgctgtcctcatacactccagaagagggagtcagatctcattacggatggttgtgagccaccatgtggttgctgggatttgaactcaggaccttcggaagaacggtgctcttaagcactgagccatctctccagccccgcttgctgctcttagctgaagagaggcacaactaagcactggcattgctgttgaccctggtcctttctgctgacttgggctgaggcttggctgtgtctgctaggtagtgccactgctgctgatctgtgtttgatatcctgactctaccgagctggactgctggcgtatccgtgaagagtttgtgagtggattgaactgctactgctaacctgtatggggtagtgaaccatgagaggaagcctgataaggtcgagctgggcttggatttgggaagccatggaaggtaggaatttggaaaactctgttgctaaatatgatttgaactgtacgacctgggccaagaagtttcagtggagaagaatttctcggtatgtggcctacagactgtttttgcagtatttcggtgaggtgaagaatctgcctgaggctaaggtgaagagtctcagattaacagcactgacaaagaagtctcgaaaaagcccagcagagactttggttaagattcatgaagagcaacgagcatgttaagctgagaaaggaaaaacacaaaatatacagttcaagtattaaaggggcaccaggaagtgaaatggagataacagattaagggatttggggcaagatcctacccagcttaatttagatccaggcaaggtggtacaaacctttaatcccaggagacaaagacaaacagatctctaaattcaaggccagcctaggacaaagcaggttctaggtgaagaaaagcttaaatccaggcatggtggtacatgcctctaattccagcattacaggagacagagccatgaagatctctgagttcaaagtgaatctacagagcaagttccagggaagccaagcttaggcagaacaggagttggaaaatagaaagctggtaatagaataagggggggagaggatgttccagccccagaaagcagcaga

SEQ ID NO: 24811 - DNA, 1206 bp, Mus musculus
ttttaccattccctcttccattctttgactacctcacttatgctattgaacatcacataaggatgaccatgttgacccactggctcatgtgaattccatcttggcttctgagtctcaaaagaaaatgtgtatttctgtggtgaggggaccagctctacttgcaggtcactagtgcagtgacagttgtagtgtcaaacagacacatagttcggtgtcatcattgatttaactgagtcttgtgtagatttcagtgtgtcttgttaattgtgtgattttttttaaagatttatttatttattatatgtaagtacattgtagctgtcttcagacactccagaagagggagtcagatctcgttacggatggttgtgagccaccatgtcgttgctgagatttgaactctggaccttcggaagagcagtcgggtgctcttacccactgaatcatctcaccagcccaattgtgtgatttcttaaatcttccacacagatcccccaaaggcacatgtgacccatcatcccagacctgcaggtgatgtcaccctgaggtgctgggccctgggcttctaccctgctgacatcaccctgacctggcagttgaatggggaggagctgactcaggacatggagcttgtggagaccaggcctgcaggggatggaaccttctagaagtgggcagctgtggtggtgcctcttgggaaggagcagaattacacatgccatgtgtaccatgaggggctgcctgagcccctcaccctgagatggggtaaggagggtgtgagtgcagagctggggtcagggaaagctggagccttctgcagaccctgagtttgtcatggctcagagctgggatcataacccccacttcatttcctgtacttgtccttcccagagcctcctccatccaccggctccaacatggtaaacatagctgttctggttgtccttggagctgtgatcatcattgaagctatggtggcttttgtgttgaagagcagcagaaaaataggtaggaaagggcagggtctgagttttctctctgtcctctttaaaagtgtagtgggctcattaataggaaacaaatccacaccccacattgctactgtctccacctgggtcctctgtcagttctgggaacttcctagggtcaagattttccttgaactcttacagtttttcttctcacaggtagaaaaggaggggacta

SEQ ID NO: 24812 - DNA, 1158 bp, Mus musculus
gcctctgaaatgttgttataactaccttttaaaaacagaatcagagccaggcggtggtggcacacgcctttaatcccagcactcgggaggcagaggcaggcggagttctgagttcgaggctagcctggtctacaaagtgagttccaggacagccagggctacacagagaagcactgtctcgaaaaaccgaaaaaaaaaaaaagaaggaaaaataaaaacagaatcaggatagattttatctttggcacctacttattactgtgattttttttttgttttattcttgagttcatgtgctctgtgtgtgtgtgtgtgcaacttgcagaaattggttctctccttctaccacaggagttatagtgatctaactcaagttgtcaggcttggcagcagatgccttgaccccaaggccatcacactcaccctaccttggggtttttaaaagaccaattggtctgtgactatgggtgccccatattctgaatctgtctgattatttccccgctctgtggtttaacttggtgctattaacacattctctgtgataatatagtgtgtgtgtggtttttttttaattgcctgttttccataaactgaaagctaaatctaaagtttttgtgaagttcaatcaagtcaaacatttttggaaaataaacttcataggtgatagtgtttgtttttattttattttttttatttctttgtgtgtatgagggggattattttaaatgcctgcacgtttgtctgtgtgtcacgtgtctgaagaggccagaagaactggagttatagccagttgtgggctgctgtgtgggtgctaggaatattgaacctgggttctctggaagagcaggcagtgctcttaacttctgggccatctctctagtctcacgtgatggtgcttagctcacatggttcctcctcgggagacctgtgccagactggctggcttggttacgtggtcaaggtgaacactggctctctccttcctccaggcacattaggaaataatccactgtggcattatagggtctactccaaacctttcacctaatggctctgatgtctgttgatgacaattttattgttacgttggcagttgcagaaggcttatattttctccccactgccttgatccctgaggatcttgatgattctaaa

SEQ ID NO: 24813 - DNA, 1173 bp, Mus musculus
ccacgtgtaagaggcaccctggggcagattagaactcaaagctggtatctaaccccccaggctttggacttttctctcttgtccaatgtccctcaggggctccctccttagctccaggcattgcctcttctctagattttttttttatcagcctctgggtcacttgtctcctctccctcaccccgtttctttcttccccttcaaggggcgcatcagactttcccagcagccagcccttccacatgtgcatgtgagttgtgagtggagcagctgagagtgctagggtttgtcagcagtgtgtctgtcccctgatcaaccctgggagtagctactatacagaggcccctgtctgtgcctgagagctctgcctcggaagctgccatgatgaggagtgctgaggagagagatccacttaaaaccactacccagaatgctggcgtcagcagattttgtctgtattcaggtttccctggagcaaagcgccggaagcttctggaatagtccttaacagccatggtttgacaattgtgcttgttttccaaattgtacctctctgcgaagccagcctgccctctgccccaaccccctccaccctactgactaatgtagtgcccatcacttactaacatgctgtggtgatagtaatcattttcatattgatttttttttactctcttgtctgcttccctctgctaggatgtctgcactacacaggtaggggtttttcttcttttttattgctacctctagcttctagaccagtccctgcctggcacaaggaatcactaagcaaaggtttgtggaatgagtgaaaagaagcagcaaatcggtcaacacagaactgtggaggtttcagtctctccaaagaatcctctcacaagatatgcccgtcctctctgacctgggcacttgtcttcctttcatgtagacagcaccactgtcttccttctgcacaaggggtttttttctccgtgatccttgctgcaaagcagtcatgggatgctcgggttctctcttgtgctccttgttgccatttccataccccaggtcgacgagcgacctccaggatgaccttcctccctgttcctattgcctcctgccaccattccccaaggagcagcccggtgggtgactgggttgcaactagttgcagcttagagcttagtagtccat

SEQ ID NO: 24814 - DNA, 1141 bp, Mus musculus
tcgtcgaaatgtgagtgtgggtggcccagtgtccctggccaccatctcactgttgctttatagctctatcgagttcttggttggaaagaaaaataggtgggaataaaactatgcggtaccaactgcctggagttaggggtgggggcgggggcaagccatggcagaatgggagtcaggtttttccgactctctcttgaattcctgggggaagaggctaaggcagctggattccagaaaagtagggagaggttttcacacagatctggtggaaatgaaactgactgaacactgctcttcatccttcttagctggctttctctctctccattcaggctgctgtatttatgagaagcctcgggcctttggcgagagctccaccgagagtgatgaggatgaagaagaaggctgtagtcataagcactgtgtacggggtcaccgcaaaggacggcgtcctacaaccccagcacccaccccaaccactcctccacagcctcctgatccctctaagccccctccaggacctatgcagcactaaatccctctcaccattcatgtgtctgcctgccccaaatatatccatctgacatggggactccacccattgcctccgttctcctgcccccttcttccgtctcctgagtgatagagaagaggaagaggagggtggatacagatcctggaattctgacttgctgctgttccagaacccaggcttctgggttctcccagcccctgcttccctacagtttgctcccatgcctgggatccaggcatcttggtcccagtctatcccttttgttctcactgccaaactacctgtcctgggatccagtatcttggccacctgcaccctcagcttgagtcccaagcacttcaactgggttttcaacggtcccagctttcactgccagggctccaatcagatgccaggcaatcttgcaccccagttctgcgtattaatcctggcttatggttcttctactgatgcagttttcctaaatcttagttcttgcctgtgggatgtaaggttgtgtggagactatagggttccctggcccttctgctcctcttaccccttatggctctccaaaggagttaggagaggtctttgtcattcacacctaatggaaagtggaaccaa

SEQ ID NO: 24815 - DNA, 1199 bp, Mus musculus
caggactggagttaaagatggttgtgaaccaccgtgtggttgctagggatcaaacctagattctctgcaacagcaacaagtactcttaaccagtgagccaaatctccagctcccattaatcatttaaaattgctccttttattctttaaatgtatgttaagtatattgaaaatgtttgtgtgtgtgatgattctgatatccgatgtttctgaggatctgatactgccagtttctgctgaccttttcatggtactgttttgctttgtaatttttgagtgtgaactccaggtttctcacagtgtggatgaatgcagcactcccagcatggatagggttctttgaggaagatctgtgccaccatgtccagctacagttttttttcttttcttatgaattacagtttagccttttctttctcttggctagtgattttctgtcctagggaatctgcgtacttcatagtaataattagatatcagttattagatattctttttggttaaatataacgagtcttcttcctccataggtttcaggaaaaggaagattcttgacccttttttctggcaacccagcaacaatcctttccttctctcggaagtgaagatactcgtctttgatgcctccttggtcccctccggctaccatgctttgttctcagaataagatcgtcgacccagaatactcctttcccttttgaatttactaaagttatttttctatgaagccttgatgttatgtgtgttactcttaatcatttattctggtcaggctggtgatatatgccctgtaatcccagcacttcacagatacagtgtgagctatatcacgacatgactaaaaactaaaaaataacaataatcggtcttattccaaaggaaatttaggtgaagtagagatatagatataaaaaaagaaaaaactataataaaatgatggagtctggaatgaggtttttatgggtctaagagattccccatgaccataaacaaattaataagagtctttattaaatactcatggcaccaagattgcaattgagagcattcccaagaagcagcatcaaagcttataaagttagaaaccaccagattacatatattctgtctacacataggcagagtctaattttagcatatgtcttgcagttagttgtcttagccattgagcagaataggtaaatttgattacaaaagcag

SEQ ID NO: 24816 - DNA, 1196 bp, Mus musculus
gggcacaaatactgcttaaatccccaaaacaatgcacaatgcttaaatttaccaaactttttttcagacccccccccccacaaaggtacatgtgagccatcaccccagacctgaaggtgaagtcaccctgaggtgctgggccctggactgcttccctgctgacgtcatgctgacctggcagagggatgaggaggacctgacccaggtcatggaccttgtggagaccaggcctgctggggatggaaccttccagaagtgggcagctctggtggtaccttctgggaggagcagaaatatacgtgctgtgtggagcatgagggactgcctgagcatctcaccctgagatggggtaaggagaagtttgagcacagagcctgttattaaggagagactcctgagtagagtctgtgctaggagctggggattagatcccttgaactcttccctctctttccctttctctcttcctagaacccccacctccttggcctgtggttggaataactgttggtgtagttctccttggggttatcatcattggagcactgattgccattgtgaagacgaggaagaagagagcaggtagggaagggattgtatctgagggtttacatagatttgaagccctacatggaaatgtgttcattgctcattttattacattgagactcatctatgtataagtgcttacccaacccaggactctgtatagcaccttttgttgttgttgttgttgttgttgctgttgttgctgttgttatttttgagacagaatctctctacataacccttggctgtcctggagctgactctgtagtttaggctgctttcaaactcttgagatccacctgcctttgcctcctgaatactgggattaaaggtgtatgccaccatgcctggctgcactagcccttttgtacagtccagggatctggggaggggtgttcctctaggacatcatcatcctgcatccttcccagtcattctcttgccctatgtggcaagataactgtcccaggaatctgctttcatcttgtatttctaccttgtaccatcctgtcccggctcttgagtctctttacacactaggaaatcacctagagtatagaaaggaaccagagagctttgtcgctttcccaaacatttctacagctggataccacatgagttctcagctccacctgctgaatgaccac

SEQ ID NO: 24817 - DNA, 1216 bp, Mus musculus
tgagattcagacctggtgacaaatgtctgtaagactagcacccaggaggctgaggcatgaagattgaaagttctttctttgggacaaatatcccacagcccccatcctacccagtttggatcccacctacctggtgtacagtatctacctggatctccttcatcttaccctcaccatccctcagctccactgccatactagctgtcctgttggtaggacatcttgggttccccctttgtgctttgttttgtattgtattgttttatccccgtgggcaccaaactctcactatgtatgtagttgcggatgatcatgaattccttatgtttttgcctccccctctcatgggtatttgcgggtgggggttgggctcactaataaagtaatttaaggatagactcaaaaagaatctcaagatcgttttcaggacaagcaggctgtaaagtctcagcagcttcagggaagagaagaatggaggagagagggccgttataaactggcatgggggtaagacatgtagcagacaagcagccacgtgacaaggaagaaggctttaaagaaagagtagtggagctgaaaatgttggagagaagaccctgagtgttgaggaaattatgcttagaaaagagacagaagaaaagggaaaggactaattcaggaaagtgggcagatttacaaacctccctgactgtggccagcagctactgcactagggccaggaattctgggagaacaacgatggtatctcattagagcattaattattctgcctctttcttttgtgtggattaaggtgagcatgccttcctaggtgtgtccctaggtcaagtaaataaatgatcttgccctactggaactgtaggtctctatccagcccagagattctgttctcttgccagctatttgtgccctaatacttagtaatatcatccttgtataaagatggattgaaggagaacttttgataaaggacaaagacatgccatttccagctcctgtgagggtagagctgcaaacctgccaaccactttgataagaaaaagacctcctggaagagctgctttctttagagactgtagaagtatataaagtctaaaatataaagtagcacaatggtccctttgtagggactctgtgtagtccagctggcccggaactcgcagagatcagcctgcctctgcctctacctcccttaacttacattttaatattttta

SEQ ID NO: 24818 - DNA, 1853 bp, Mus musculus
ttttttttttttttttaaaccaactgtgtaaggaacacctggaaatagaggagggggtggtgcttcacacagaggactctactaatgtggacacaaatctgaggcagggtctccaggaagagggaacgggcctctgggagggcactccatctttttcctatacaaatcctttcttcatgttttttgaccctgttccaggtctgtctgcaaccatacccctggaatattgcctgaggtctaggactaagagtttcctctggaaccaaatcgttctgcattctgttctctgcctttatcctcccagagatggagaaggatgttaactttattatttttatcattttatctccaccccttaacctcaagtcccagcactgaaagtctcgaaaggaaacagagacctagtccctccctcattctgttaaacaacccagcagctgggcacagcctgagtccttggctccactgtggcgggagtcctgtatcttgcatcggatctggtggtgtttggcttttgtattctgtccctggatatgaaggctcaagtttggagttttggatttttctaagattaaaaaaaaaatctgtgaggctctaatgtcccatataaaattttgtgtgtttaaaaggtaataatgtctatacgttggaaatcagtctagggaattttcagatagcaagagacttttatcctgtaaattgctaacttcgtcttgtacttgaggtgatgatactcagtgggagagaaaataactcagggctgatgacaggtccaggtccgtatgtccttacatcctcagggcaaaatactttattcccacttgggactgttccttgttgtgagtactgctctgacaactggcatcagtggcctcaaaccttgttccaggattctcatacctcttcccaagacccttgctgtcttagactgtgaagcagggaggccatgtactaccttctcaccgattttggtaggttctcacactgtacttcaggatgggctggcactcactatgtagctgtgatggctaatcttcattgtcagtttgtcagtttgcaattctggagatgtctctgatgtttccagagattaactgaggaaaggagagcctgcttgaatgtgatgacaccaacctatcactcgggggggcccaggctgaacacaagggaggaagagagggaagccagatgaggggcagcatccccacactctgctcctgatgcatggagatgtgagtccagtcacatgctccagctgccatgaactccaccgtgctttccttccaggatgggatataaaaatcaaaaaccaaaacaaacccttcttgacttaagttgcttctttcagatttttgttttgttttgttttgtttgttttatatattagggagagaaatgagggatacaatgtctactcccataagtctttctgcattggcctgagtgctggtcttgcaggtgtaggggatacagccagcttcacgaatgactaatgttaccactgtgatcctcagctatgttcttgtagatgtgtggttagccccagcttattattcagaatctcagctcagatattgaatcttgttgagatgtccggggggaggggggggggagacaggggggggggggagggacggactcctgtaggcaggaaagttgaggctttctgtgcattttcattacttttgctttattcttttctcatgcaaaacatcccaaccctctctcccctcctccctgtatccctcatcaaactccactgtaaaacatgcctttaatcccagttcttggaggcaggtctctgtaaatatgaggctaacctggtctacaaagcaaggactagggttaggatt

SEQ ID NO: 24819 - DNA, 1801 bp, Mus musculus
ttgaactcagaaatcacctgcctctgcctcccgagtgctgggattaaaggcgtgcgccaccactgctgggctttaagttattatttatgtgtatgtgtgagtatatgtatctgtactgcctgcatgaaggagacttcagaagtcagaaaacgtgtgggtcccctagaactggagctagagataattgtgagccacagtgtaggtgctaggaactgaaccctggtcggctacaatagcagctagtggtctcaaccactaagccatatctctagccagttctttttataaagttttgcttacttatttgaatttgtgcacatgtgatttgtgcatgtatctttgcctgcttgagtgtatgtgcaccatcccatggaggccagaactgaagttacaggcagttgtgagccaccatgttgatgagaggaactgaaccttccttggtccttggaaaaaccaacaaatgttgttaactacttaaccatcctctacccttcccccatctttattttggcagggtctcacactgtaccctagactgggctggaactcactgtgtagctgtgaatgctaatcttcattgtcagattgactggatctcaaatctcacaggaaatgtctgtgaaggtgttttccagagactaaccaaaggaggggagagctgcactgtggggggagctgcactgaatgatttgggggcccagattgaagacatgggagggagaggaggaagccagatgaggggcagcatccccacactctgccccacactttggaactggaattgcttgtgagccacagcctgggtggtgagaatcaaaccaagatgctcttaacctgggccaactttctagcccctgcatttacatttctataagcccgcttcaaaagcatcatgaaatgctactgtaacctcctcaatatctgcatctattctgtgaccctcatctatacatatatttacagtgtgatatgtcatatttgagagaatattagtaattaagattggaataaatggatatgggtttgcttcaattagattaccaaggaaagcaatattacctgccaaattctcaccatggaaactgaattcacttattgaatttattgtaattcaattgtgacattttggaaacatacaagcttgatcatttttctttctgtttgtgctgtttggtttggttttttgaaacactgtttctcggtgtagccctggctgtcgtggaactcactcagtaggtcaggctggcatgtaccactattgcccagcctcatctatgtttctttggttgagaaagagtatcatgtaacccaggctggcctcaaactcatggcaaacctcctttcttagcctaacctcccacatgcttgttcttcagtgatgagctaaattttaagtatatttttaaaatattacattaattctgaaaaaatttttatgtggatgtggggagaagatcaagttgtgtgattctgatcgaaggttccgtcaggaaaacagttttaatgtgcattccatagacccagacaaactctttctcataaagaaatcaaacagtacaacagagtttttaatacggttttttgcttctttgtttcccatttgtggtaacttatacttttattggtttccttaaaactaaaagtaggccatcactggggaagagaggccccttggtattgcaaactttatatgccccagtacagtggaatgccagggccagaagcaggagtgggtaggtaggggggcagggcagggggagggtatagtgaactttcgggatagcatttgaaatgtatataa

SEQ ID NO: 24820 - DNA, 1110 bp, Mus musculus
gtttgtagcttccatttgggctagaacttccctcctcctgggaacaagcccagaactttccacaaataagatgggggaggagccagagccacccagggcaaggtccagggacgacaaggaggtcacagaagtcaaaataggtaaattgagcctgggagggaggacaaaaggaatgctgggtggaaatcgagaagaatgcaccaccggaagtttagcagtggggacattaatgcttctgggatgggtcctattggagacagggttaagttcttctagctcaagctctgcttttcacatggatagtgactcattgaaatattaggttctgaaatgtcaggttatgggaggcggagagaaaagggaagagagggaaagaggtagcgaaacatcttaacataaaatttttcattgtattgtataggtatgagtttatattttgcttgaaagtacacttgcatgtcaggttaaaaactatgtgtgttaggtttctcttaagattgctggagattttttcatttttccttttcttttttttcgagacagggtttctctgtatagccctggctgtcctggaactcactctgtagaccaggctggccacgaactcagaaatccacctacctctgcctccgttttttcgtttttgtttgcttgtttggaggcggtatgttttttggttctttggggttttttttagacaagatgccactatgttaccccgcctcaaacttgagctcttaaatctcataagctaagtaaacaccctgtcagtcactgagctacatcctcaggctttttctttagacgagtgttaactaacgtacccggagtgtctgtgtgcagtgtctgacattcaggctccatttttcctgtaccctctagcttcattttgggacaggatatttaagtggtttgttctgcatccgtgtgacttagtgatgaacaaaggtttgtccagtttctgctcaagcttttgcacctttccatggtcatctagtttctataatttctccaaaacttccaaatctaagaacagctaaaaattctggaggttagtgatttatgccattaagggttttttgtttgttttgtaattttaaacagggtctt

SEQ ID NO: 24821 - DNA, 1543 bp, Mus musculus
ctctgtgctaggtgtcctggaatcctctctaactactgagctatcctgtaactatagtctaagtctcctgtgctttcttggattttactttagctaagatgttgctccacggcccactttacttgtctgcgaagtgttccagtttttctttagtcttaccttattttatttgtgtgtgtgtgtgtgtgtgtgtgtgtgtgtgtgtgtgtgtgtgtgtgtgtgtgtgtgtgtgtgtgtgtgttttactgtgtagcccaggcaggcgtggaactcactttcagctgcctagtacaaggaattacggaaattgagtcacccgtccctcccaccaccccctacccccatcccccactcccattccccaccccaggagtaaatacttatcttaggaaatggaatttcctagcgcagctgagaccagtgaagaccaacagtaggcgggacgagaaggcgtggcattcaggcattgggcttcttcagatctaaatttctgaccttggcagacagccacttgagatgtgttacctgcggacggagcagaacggaagcagagggacaaagtagcggattcctgacttctggcaagggccccttcctgggtttcacgccgctgcgttctggtcgaggctggaacgcgcgcccagccctttgtgtggctgtggtccgaggctacggctcagaagccgagcgctgggaacggcaggactgccgagcctcaagtagggctgtcgagcgcggtgagagcgtgcggggacccgggtggagccgctccctcggtggagccacgagggcccgacacctgggtgggagaagccgcctggctccgcggtggaaaggctcacgtggctgaaacctcgggggattagagtctgggaccggggctgaccgggcaaagccggcgggcatttcttgtcagattgtgcgtgagagcggcggggccacagattttagagagccggacagacggggtgtattgtggcaagtttgcctgatcttcctgtcttagcttcctttgtgctattggggctgactcctcagatttgtgaaacaatgaatgggctttagttggaggagtgcactcagggttgagagacgtctgcacagtccctccagaaatttacccagtggaagggtgaggccaggcctggcccatctcccatgccaggggggtgggagtcgggagggacgggacctgacctccggccaatcaacagccaagtcttatttagtctcttgccttctcagggctcctgcaccaggaaagaacaatcagaggtaaatgagtgaggaggtggatggaggtacccaacacctgtcagtctccttaatcagcctgtatctatattaaagaccactccctgctttgtgtgaatgtgcagcagctcctgctgctgttgttgatgatgttttatgctttctgtagcccaggctgtcctagaactcccggagatcctgtctcagccttcctagtgtttaggtaatcgtctaggtcaccacgcatctttatgctattgttaagacttgttgataaaggggtctttgc

SEQ ID NO: 24822 - DNA, 1139 bp, Mus musculus
aagtcagaggatgaagagacaaaactcagagtggtatgtgacgcattcaggtatgtacttttcagtggtactgaatctagaattaaactttactttcccgtggatcacacatcctagaatggatgacttaacgcttattcttgaggtttgtgaaaatggagccaatttacctctcttggtactgcggagaaggctctaccacagtgcaggaagctagtaactgggtgctacggaggcacttattccttactctctccctttgctgatattatctatttttcttaaaccttagatttctagaagtgggcaccaacaaattgtggctagaagcagtctggaatagaagtcaaacgcctaggaccagcctggcattaccaaacaatggcagctaggaaacaggtaatcagagccctgaattctatggcctgggctttgagggaactaaagctgtcaatcatgaaaggagaatttggacagttgaaccatcaaggaagacaaccttttttagagtagatacttttgttataagaagcagtatcaaattctggggctcatgtaggaaccctccaactgcccagtgcctgggaaatatagagtcccattagccttgggatccagaccagaaggctctaaaagtagaaagagacaccactaaagacatgctgctccatggggtaggtagtatgttagctgctctatagaagccccaaagaaagattatgggtggaaagactggggagatggctcggcatgttgtaaagtacttgttgcacaaagttgaagacccaatgtgggatcttcagtctccacattaaaacaaacggaaggaagacagacagacagacaaggtcagcagaataatcccagaggctttctagccagatattcttgttgagttgaagagcttcaggttcagtgagagatttctcagaacacaggtagagcaaaatagaggacttaacatggagagattactagtgaaatccaacagcagaaaggagatggtccggtaaaggaagtggcaggccctagattctcttgaaccttggttcatgttgaggtcttttacccacctgtggatctggtagaaccccagattgtcccaggccaaacaacagaaaaaaggaattgcaagatct

SEQ ID NO: 24823 - DNA, 2567 bp, Mus musculus
gaagatgcctatgaaacttttactagtcagtagtagtagtagtagtagtagtagtagtagcagcagcagcagcaattattacattttcctatttctagcctatgaagcccaagggtgaatggctgcattttaaaggttgggaaaagggaaagtggcttgtactgagcacaaaccttgtgcaggcattctcataatgaactgtgtattttccctcctctactataggaagcaagaagaaacctcaagaacctagctcagatctgcaagataagaacgaggagcaggagaagtcctccagttgcacaggggtattcaaaggtggaccattctttttctgtctgacctgtggcaaatgtttcaaaaagaacaccttcctctttaatcaccagtttcctgtgaggtcccggaggctggcagtcacaaatccacaaagccgcaaaggcaagggctacaaggctcagcatcgtggagagaggcctttcttttgtaatttctgtggcaagacttaccgtgatgcttctggactgagccgtcaccgacgtgctcatttaggttataggccccgttcatgccctgagtgtggaaagtgtttccgggatcagtctgaggtcaaccgtcacctgaaggtacaccaaaacaagccagcagctagcaaccaggctggcaaccaggctagcaaccagaggctgaagagtagggttccacctacaacacctagatcccaagcgcccgccctcaagtatgtgaaagtgatccagggaccagtggccagggctaaggcacggaacagcggagcctcgaccctgaatgtcagatccaactctattacagtggtccgttcaagagaaaagatctcttgtccctattgtcacataacgtttaccatgagaacctgtctcttaacccacctcaagatccacttcagacgtcaacccaaccagcacttctgctgcaaagagtcggcccactcatccaacacactcagaatgcaaaagatctacacttgccccgtctgtgacagctcctttaggggaaaggagagcctgctggatcacttgtgctgccaaagaccaatcagattcagtaaatgctgggaaatcctgggtcatttgctcggctatcttcatgaacccgtggtgctgggaaatatttttaaagtaagggactcctcgggaaagaggatggaatccaggaggagaagacggaaacgtgcctgcactgagaatcctgaaacagaaggcctgtctgggaaaggtagggtggctccgtgggaaatggagggtgccaccagccctgagagtcctgtgacagaagaagattcggactgatttctgacttcacacctacccatgcacgacaccccccacccccaccccttacccccaccccacaaaataaatacaatttttaaaactaaaagaaggggaggggaggtcaaactgaggtctttgtatttgtttttttcctgaagacttgacctctgccatcaggaggcttgaacaggagagaagtggatgatgaaggaaagagacaaggaaagaaaaagaagtatgcacagagaaacttgtattattaattagcacctagcttgtttgtgtctggtagaccaccaagtagtaatttttgggggaaaaaaaccacattggttctcagagaaataaggtaggagaaaatgagaggcaggggtatgaagggcacgaaggtgtggaacataggggagcagacccagttctcagcccttgcttctcaaggtcctcccaccaggctgccaaagcaagatggtatttctctggtcggtattcttttgaattttagctccaggttttggttcaggtgctcatattcataccctggctcacttagctttccccgatattgtgggctcttctgttcctgacccccccccccccacattgatattcttcccagtcaaggctgtggtcttggaagaaatatccaccatttgcagagttgatgttctatagttcacaatgatgaagtgctgcgtatcctggttggcagaatcactcctgtattactctggtgcataggtgtctcctgatagactgcctggccttcaccacagggtgttttctatagtcagactaacatggtaaaaaagatgtggaagtcaaaaattagaggaaggagctgaggaaagacagttgagggagggaaatcaagttctactcggtatccagaatgtgtctgtagatgtagattggaatctgtccacagcaaagaggccaatgggaaatccccaaggacctgctgggctctccttccgctccaggaagacacaaccatcactcaaaaggggtttcctggaaagacagacaagtgactttaaaaacctctgccagtaggttctttttatgaagtccttgaacctaggagatagaaagttcctaggggtcatgtgatctctcccccaaccgcctggttggtcttggagggaggtgaggttcgggataactattatggagaatgttaaagggggctgcagaagtggaattctggctcaggggcactaaaggctattaagtcaacaggtaagagtggctcag

SEQ ID NO: 24824 - DNA, 3186 bp, Mus musculus
agtagtagtatagaccagccataataagaaaagcaaatctggtcttgcatccaggtttacgtccatccacacatttcaaaggcagaagagtacccactttactgtgctgttgagcagtatctgttttgtgtgcttatagctccatcttgagttcctacaatagaaatgctattttttttttctgataggaatgtgaatactgggggggggggtagggctggggagaacggggaggtagggaggcacagacattgcacacctgatttcctgtggagcaggatgcttgtgaacccagacccaaacctaattctctgtactccctaggggaaggatcctctacaacttgccttttttcttattttcctgtctctccacagtccgaatctgctccaagtcttatttgaccctggaaaatgggaaggttttcctgacgggtggggacctcccagctctggatggagcccgggtggatttccgatgtgaccccgacttccatctggtgggcagctcccggagcatctgtagtcagggccagtggagcacccccaagccccactgccagggtgaggggaacagctgcctgcctgcagctgatgagggtgcctgccctagaatgggagtggggtgggagtgggtagagggaatggatggttgctatgaagaatgtcggggaggagtttgggaggatgcaggtgaaacctatctttacaccacccacctgcctcagacttggttccacggtcctttctgttgggcttccccccaccctcctttcctttagtgtgttcttcctgatttcaaatcttggaccttttttatttttccttcattaatctcaactccgcccccctcagcttcttaaagttaaaaaactgctctccccacctccctggaaaaaactaccctccccccccaccccccgtagacttagaacatcctctgtatcactcttctaggactggtcctttgctattcactctataatggaattgctgtaaatattcagaattaaatcatacattacatttagaaaaagtcggtgagatatgggattggaaacatggaaaaagcaaaaaaattggggcagaatgaccagaacagtgataattcaagggcagatggaagaagactgagtcttgtgtatactttaacaatcttgatcattccttgagggaataattgattgcttttgtgtttgctacccccttgcttgcctctttgctgtcttttctgcaaacgtctcccttttctgggcacccaaactcttgtatatatatactcttctctcctggaatgaattaagcttcagggttcttcattttgactaagtccttattttgagctcttaagactgtgtgcatatgctaaccaacctttggagaacttactaaactaaggtatttaaacagcacttatttaaaaccaattgttttgtaatttgtcttcttaaagagatcataggtttatatatacgtatataatattcaagctctacaaaactcagctgcacccgaccccctttacttgctggaacaaattctgttgtcctttgaataattgaagaaaacacgagtcctgacccctagccccgccttgctcttatcctcaggcacccttccctcatcgcagtctccgctccgcatgaacaggtgtgggagggggctggggatcaggcctgggaagctgggcgcccctggtaactcttctctgatccccgtctttcctgctgccagtgaatcgaacgccacactcaggtgagatcagaaacccttccgcgtgcactgccgcccccatcccctcactcttcaccctccaccagcaggatatctttgcttaggttgtgggtgtcctgttactcatgtcccaccacccattctagtttgaggccgggccctcctctcctacctgtttcttgccgccaaatcgcggttttccgcgggtcgcgctccctcccacttccctgcttggccacgctcctccgggtcgcgctcctctcggactcagctttctagcgcgaagcccggtagggggcagccgcgcgccggaggatcccagatctctccttcgtggggttccttcagacctcggggacctactcttgccaccccctacccaggttttacctgcgaggttccgtcgaccctgttcactggtcccacccatgcgagcctcgcatcctctgtagaccctttctcccatcacctttcttccagccttccctcaactacactatccttctcctaagctgcacttctccataccagttctccccttctgcaaagcctttcccatcgctctcgctcttcctacccttagttcctcgctccatcttcccatatccccctttcagaactgtcaccttcctctcctaacctacccaccctcgcttcccctctttgctctgtgcttatcctctctccttccaaatccttatcctctcctctagtctccttaggcagagacccttcccttccttgcgctctccctcttctcccctccccttcgggcctcggcactggctcctatccccgcctccagcccgtgacgtcaagcccccctcctagctccttttctccctcctcccttctgtcggtcggtcagtcggcgaggagagtccgcggtggcgggagcgagcgtctcttggccctaggaagcccacgtctctgccttccccgggctctggcccctcctccccaatgagaccggggatggaggcgcctccccgacgccctcccagaagccttccccagaagaagtgtcccccctgagctgcccccaccccaaggaggccgcccccgcccctcctcgccatgggcccggggggaccctgtaccccggtggggtggccgctgcctcttctgctggtgatggcggctggggtggctccggtgtgggcctctcactcccctcatctcccgcggcctcacccgagggtccccccgcacccctcctcagaacggcgtgcagtatacatcggggcgctgtttcccatgagcgggggctggccggggggccaggcctgccagcctgcggtggagatggcgctggaggacgttaacagccgcagagacatcctgccggactacgagctcaagcttatccaccacgacagcaaggtagtcggggtgagggacagcgtggccggggtggtgggaggcgagggctatggatcctctttgggactgt

SEQ ID NO: 24825 - DNA, 1253 bp, Mus musculus
ctcccccctcccccctttttttttctaatggactcgtcaaatgtcagggcccagcaggaaaggacagggtgcagagcagacaccctactgatcttgttcttgttctctgaaattgaaggtggaaatttcattgagggagctgcctagggatctgcagagaacgtatttgtatttcctgagcagatgttcagaccctataaacatgggatgaggtggggtacagagatgaccaaagagagtgggcttagggttgtttgagaataagcagaagtgggagacagcagagtatgtgttaatatggaaggaagggcatgcagttttgagtagggccaacgtgccagatgcaagacaagagaaggacgcttaaggcaaaagcaaagtctagaaatttgacaggaagaagaatgcggtgctggcagtgaatagttaaggaaaggcactaggttgcccaagacactaggcaatgtgagatgtgtatgtgtgtgtgtgtgtgtgggtaaggggcttgggagccaaccttcatttcctccttcctccctcagtgcgacccagggcaagccaccaagtacttgtatgaactactctacaacgaccccatcaagatcatcctcatgcccggctgcagctctgtgtccacactggtagccgaggctgcccggatgtggaaccttattgtggtatgcaaggcagggggtcacttccttttgggctgggttgagtagaaagctcatggctatgttctagaggactcgggagagggaccactgccaggactcagcctactttttttttcttttttctttctttcttcttcttttttttcgagacaaggtttctctgtgtagccctggctgtcctgggactcactctgtagaccaggctggcctcgaacttagaaatccgcctgcctctgcctcccaagtgctgggattaaaggcgtgcaccaccactgcccgaccctctggtagaatttcttgaagggctgtgaggatccacagatgtgtgtgtgtgtgtgtgtgtaaatcacttttcccaggacaaagatggggaagtttagagatctgggagaaaagtcagggccaagaaagcagtaaggacactgctagcatgctcagtttgcacggacacttccccttcttctgcctcagctctcatatggctccagctcaccagccttgtcaaaccgacagcggtttccaacgttctttcggacacatccatccgccacactccacaatcccacccgggtgaaa

SEQ ID NO: 24826 - DNA, 1185 bp, Mus musculus
atgagaccgaagcccggaaagttttttgtgaggtggagatggaatctggaccagggaggcagggctggatgggctttctactggtggtttttctcctgggtcctcctcactgcatctctgctcaaattgatagcaaatgaccagaggtgataatgaataccaggcctgtctgtaggcctgacttcgttatttgtctatgttcagacacacacgcacgcacacacacattctcattttattgctttgtgttttaactctgtcttttctgagtggccaaaggaggcattttgttgagactctcctatgatttgaagattatatagtggatttcagtgaagatttttttttaaatcctgatctttgattcttaagggactaaacagtatgtaatgagctaacactacttgccccagaacaaaaacaaacctccaatgcttccctccctactttgaatgcaggtctataaggaacggctctttgggaagaagtatgtctggtttctcatcgggtggtatgctgacaactggttcaaaacctatgacccgtcaatcaattgtacagtagaagagatgactgaggcggtggagggccatatcaccacggagattgtcatgctgaaccctgccaacacccgaagcatttccaacatggtgagggaacatcgaaggagagggaagaggcaggggttgagaatagcaggggagttggggatgggaaggggcctgtacccatcttgagcttgtttgcgtcatgttctacctgtgcttgatttccttgggcgagagagaaaaattgtggagcatacagtaggcttctgatgagcggaagggctgttaccatggaaacaaggagcagttggtgagaagtcaagtgagggagagaggcgttaatggtaatatagtcttgtacatgaagcacacttttcccagagagcttcccttgagcactgatgtgttcttatttattgctattatttattattgttgttgttgttatttttgtgtgtctgacttacattagtacctcagagggttgcttaatattccctttcttgttttcttttcttttctttctttctttcttttttttttttttttggagacagagtctatgtagctctggatgcctagaactggtcatgtacactaggctttcgtcaaactgacagaaatcctcctgcctcta

SEQ ID NO: 24827 - DNA, 1150 bp, Mus musculus
ccctccagacatcacaggaatttgtggagaaactaaccaagcggctgaaaagacaccctgaggagactggaggcttccaggaggcaccactggcctatgatgctatctgggccttggctttggccttgaacaagacctctggaggaggtggccgttcaggagtgcgcctggaggactttaactacaacaaccagaccattacagaccaaatctaccgggccatgaactcctcctcctttgagggtgtttctgtgagttacagcagcttctgttgtgcaccccatgaaaagggagatgcctggaaggtccctagatacattttctcagttatctttctgtcagaatcagtaaagccgtcttagactatggaggtgggacccccccaaaccagaaagccatacaaaatatggcagtgaaaagaattgctctattctagtgcttttcaagctggtcaaggtgtttacagtttaaaaaaagagaacgacttgagaattcatctcctcattccttttaaagtaaggaaattagtgcccagtagggtttggtgattgctcctgatcctctctcggggggactctctaattcagatcttaagatgaaggaagcttcttctccaaagaatactgtttccagaatctagggtatgtgcatctggggtgtgtcctacatgcagcggacggatgccataaatagccttcattcagaagctcaattacatcaaaaacagaaggtttcggagtccctgatgttctcttttcctcctgcttttatcccctctgccttcctccacatgtttctcctcagggccacgtggtctttgatgccagcggctcccggatggcatggacgcttatcgagcagctacagggtgagcccgggtgtgagggggctcagggaggggcaggcagggctgggcagggactgggctgagggctctcttggaagaacattgatcagcctccacagattgccaggtacattttgcctacattgcattgtgttcgtcaggcttttaaatactgataaaaagaacatgggtaggatctttgcagtgattctgttctttcaaaggggcatacaggttaaaaaaaaaaaaaaagcagctgttctttcttcccagtggctttagttttagtcccagaagttgcct

SEQ ID NO: 24828 - DNA, 1120 bp, Mus musculus
tccgtctcagttctctccagcctgggcattgttcttgctgttgtctgtctgtcctttaacatctacaactcccacgttcggtaagtttctcttctgacttgatccctggcctggctgactctccaaatactgactccatactctctgaagattgtgactctcaaggccacatgtcatagagagtggtgtgatgactcaccagaaacgtaaggggcacgaggcaagacccttgcttcaaagcagtcagctagaaaacccaaaaacattccagtagggccttatgctgcagaagccctgggctcccctaggtccagtcctccgttcagcagtgttcttatcctgagtgttctttctgcctgtccccagcctgtctcctttttctgccctggggatagggtcgtgctattgatggcatttctggagagccgagcctccctggaggagatggggtaattctgctctttctcccaccctctccgcctctgccctagttatatccagaactcccagcccaacctgaacaatctgactgctgtgggctgctcactggcactagctgctgtcttcccccttgggctggatggttaccacatagggagaagccagttcccatttgtctgccaggtgagtagatggtgggccaattgcagaacatggctttcctagccctctcaggagcaccttccctatctttcctctttccctgactagtgtctcctttcctgcctcctagtatcaccctctggtctctctctggctctggctctagctctggctcttctttctgggtgccagacctattccattctacagttctctggctgttggcaaggttgctaggcatgccttggagaggagaggggtgacttacagaagacaaaaaaagggatctgcatacagaacctgtgaacaatgatgacttgtctgtggtgtatgggctgagaaacaaaactgtgggctttcccgtgggatccttggttggagtttaaaatgttgaaggcagaatccaagcacatagagtttgggtaagggacatagcatctcagagggaggaggcctctgggactgggcttatggagtttctggtactatgaggaaaagctggcttcaatgatgtttg

SEQ ID NO: 24829 - DNA, 2252 bp, Mus musculus
aggagcaggagagcgaaaggggaagggttgagtttcagtagtggtagcctgaggagagggaggaggctctggagatttcagcctttctgaggcaaaaaagaagtctttggcagtagttagggggaggccattgtgaaccattcattgctcacagtgttactgtgtccatgctgtagttagggaccgcgcagtgctgggtgggggtggggaatgaccttccaactcatctgacataatcttcatttattctttctcttttcttttaaaatcacttattttctccatccattctcttggcgctgttatgttctgtggcttcctttgttcttccctcgattcacattttaatttcctttcttacttgtacatctcgtttcaatgtctctccctcccctttcctcctcccataccacatcaccctcctcccacactcccaattgtgtttcttcctccagaaagaggagcgtgtctctgaactgcgccatcagctccagtctcggcagcagatccgctcccggcgccaccccccaacacccccagacccctctgggggccttcccaggggaccctcagagccccctgaccggcttagctgtgatgggagtcgagtacatttgctttacaagtgagggtgtatcgagaaggatgaggccagcaggggagggaagggtgtggggagtgggtggggaactgggaagagggtggagaacaagctccaatccccctcttagaaatacatgtcattctgtgcatctggggttatctgggtcttcagtactctgggaaacagatggttttctttctttccatataattttatatcaccacttcacagttttgtttgaaccctgcttggagctattcactcatgactccagaggggcatctcgtttgtctcccataggctgtcttgtatagttgttactacagcaactcctgtcatttcagcagcaggggtcttcctacattatcagggctttctctccatttctcagcattagaatctccttccatcatccttctcctccatgtccctgtgtcttcctctccttaaatgttgcttcttccaggggactcaccacacacacacacacacacacacacacacacacacacacacacaccatatcctctcctctcctaggcagctggatgtgtttctgtgcaaatatgttcttttctgaatgctgctatcacttgtgtttgcatatgctgcacctgtgagtgcacagtggttgtgggtgtgtgcagtggtgtgcttgggtaggcgtgcatgatgtgttgagcacaccaagctgtcttcctcatgtgcatatgtcatggttgtctatgttttacttgtgtgcctccttgcattgtgtattttttctttgcattttaatatcactatgtagtgtgtgtgtgtgttgccctgactcgtgtcagggcaggcttcctgtctcagccttctgagtattgggattacagttgtctgcctagctgatgtcctgtcttctttcagcagaggcatgtgcacccaacatgcacatgattaagcaggctcttccccagtacgtgttttctgagccatgcataccctctccttggccttaggtttactctcaagtgttccctctattctcatgcgtcccactttgggtctgtacaatcatctctcagaactactgcatcttggttttcttttctttgttgtcattattattatttttcagaactaaggggaaaagaaatggggacaggttggaggctgtttccagtggatagtgggtgcacatttgatcaaatgaaggcatggacagatggactgaccgggcgggaggcagcatccctttcacactgtggtgtctcttgggggaaggatctccctgaatctcaataaagcagttaacagtgtgactcagcacctcatccactgtcctgtgaactgagtgggctccaggaagcgagaagcccaggctctcaagattggagttaatgaaaaggctttgaagcagagaggtgcaaagagctgtgtgattgttccatgcagggattagtggggcagagcgggatgagatgaagggctcgattagtgagtgatggcattagtggttaaaagtgtgggctctggagtcaggcctgcaccacacgcagaaatgttccctaatccctattctccacttttatgatctgatgatagataacaataatgatgattcatttctctgtggagtgcacacaagaactaggctaattatgcatcccaatgcctg

SEQ ID NO: 24830 - DNA, 1102 bp, Mus musculus
gtacgcataaaatcaatctttaaaaaaaaaaacaaaaataaaataaaaccttaaaaaataaatacgatactttatatttacagggaagggaaaggaattagagataaagtcaatgagatgaagcgtatgaggacgaggatgaattaatgaaaatacaggtagattacatttgattcatgtggtaaggtttttgcatagttatactcctttactgaacctctcttctttgtgtcttacagtctgtcatctactacagaggcaggataggtctgaagatgttagggaggaaaacttaagcctacaaggcatgcagatttcccattcagcttactgagagtgtgtcagccgggcttcacttccttccagagcagcctcctgaatgccctctttacttccttgttccttagggtatatatgagagggttaagagaaggagttcccacagcatagaagagaccaaagaacttgcccctctctcgagcataaggattcttgggctgcagataaacagcgatgactgagctgtagaagagagtgaccacaatgaggtgggaagagcaggtcccaaaagctttcctgcgcccctttgcagagcttatcctcagcactgccctggcaatggcaccataagagacaaggatgaggctcagaggtacaaccaagatgaagacactggcaatagccatttgtatctcattataggtggtgtccccacaggacagtcgaatcaaagcagggacctcacacacaaagtcgtcaacctgatggtggggacagaagggcaggcgcagagtggatggcgtctgaactactgactccactaggccaatcgtccaggccacagctgccagctggcaacacaggcgagggtggatgatggtggcatagtgcaggggctggcacacagccacatagcggtcaaaggccatcactgctagcaggatgcactccgtcgtccccagagataagaagatgaagagctggacaaagcatcccaggaagctgatggtcttttcggggccccagaggttgaacagcatctgggggacacaggttgtggtgaagcagaggtccaagaaggagaggttagagaggaagaagt

SEQ ID NO: 24831 - DNA, 1204 bp, Mus musculus
gtcattttattttagggggttccattctgaagaatttggcttacagagtacctgtgctgaataagacaatcaaaaaggttgcttgattcaaggcctgtgctataatgaggtagaatttctaaaagaaatcttcccaaggtaatggacctgcctttgttgcccaggtaaatcagagactggccaagatattagagattggttaaaagttacattgtgcatgcaggccccaaagctcaggacaggtaaaaaaattaataaaaccattaagggatccttaccaaattgacagcggagactggcgctatgattagatagctctcctaccctttatgctcttcagggataaaaacacccctggacagtttagactgacccccctataaattactctacagggggccccctccactggtaaaaatagcctttgtacatggtgctgacatgctgctttcccagcctttgttctctaggctcaaggtgctccagtgagtgagacaggagcgaaaaagcagctccagaaggcctactcaagagaagaagacctgctacattagacgtctccacacagaaaaccttaagactccggtggaaaggcccttatcttgtactcttgacgaccctactttctacctttatgggacctcttttgattttgcttctgcttttaattataggtccatgtgtgttaaataggcaagtcacctttattaaaacagaaatgagtgcaatgtggcttttagttttaagacaacagtaccatgccctaaagtaaaggatcaagtatgtcaggaaaaaaatagtgtctagttctaagattagaactactaacaagtagaaggggggaatgaaagtataacaacgtaaaaacagaattctaggcctttaggcccaggcttgggaatgtggcctttgtaaaggtatgctaatcaaaaaagagagcaacattcctctacccacccgcttcctgggttcaaagagtgctcattcaaagaaagtcaccctggccattaccagaacctgcaatgcaaatgtgctattgttagaggctcttagaagctgtcttgagagttaacaattaccaggtattccttgtgactcttgtaactttacacttccttgtgactcttaactggtatctttggtatcttccaacaacgccctccccacttccttaagtttcggtttctttaaatacccccttacc

SEQ ID NO: 24832 - DNA, 1194 bp, Mus musculus
ttgttccagccatctatgtttgtcagagtcagtttaaagaaaaacaaaaactgtgagttccttgtatgaaggtatgagtatgaagcctgagttgcattttgagaacacaatatgtagagatacataagctatgggaaatctgccatggagagatggatgtaggaagtggatttatccaaactagaaatatgagaggttgcaggaatagggccatctaaaccctttgaaactgaaactgaagccccatgtctgagacagagctacaggatttggtgtttgccctgctggatttcattgcttggtccaatcttccctcactatgtacacattcctctctattgaaatgggaaagggtattctgtgccattgtatactgaaaagataaagcttgatttctgattttacaagttacggcagtggagagattaatgtgaatgtcaggagagactttggacaattggacagtgtacgggctgttgcagactcttaggatcattgaagttaaactaaatgcattttcactgggatgaccatgagcctatagtgaccagaggtagaatgtagttgattgaatcaagaaccatctacatatgatgatgtctttgaactcttgtctctcctttgtgtctttcattggggacctcatgcaaacttctaggagctttttacatttcttattgggaatggaacttgggtatctatagactcaatccattttctgtttgtctactgtgttgtgattgaaactgatcagtcaacttattctcatgccatcatcccttcatgacatgatagactctatccctaaattacctaagatacaatagaagcaattgctattcagtgctaagctgttttgttatcctgaagtttaaatttttatttatttatttttatttatatgagtacactgtagctgtcttcagacactagaatagggcattggatcccattacagatgattgtgagccaccatgtggttgctgggaattgaactcaggacctctggaagagcgctggtgctcttaaccactgagccattttagttttgttgtttttgaagatgaagtttctctgtgaagctatgcttgtcctctaagtaggtttgtagatgagaaggctagcttagagattctcctcactctgtctccagaatgctggtatcatatgtgagtgtcaagtccagcatggcct

SEQ ID NO: 24833 - DNA, 1529 bp, Mus musculus
ttgttcttttgtattaggaacagttatgttttgaggagcaagagacgaataacataagctgtgattaggaagtgtcatgtttagggaacaaaagataaaaaaaaaatggaagtatttttatctggtctggtatttggaagtccccatctcccctagagcctggagagataaatttagcttgaccctatgatgaaatggaggctgataaaatatctaggacaagtttcttttgattcttcctaatgtttgcatattatagtcatcttcaatgacataaaaggatatatattggaggaaaaccctataaatgtaatcaatatcataaaccttctccagcacatagttacctactaatacataaaagaacacacacttgtgagaaaccctatgaatataaccagtgtggtaaaggcctttcacaacacagtcatctcctaacccagaaaagaatacacacagagctgccacccagcaggagcagcatgtgtgtgcagcatgctttttgccatgattgtgtactgggtccacctggcttaagcagaagggagctaacccagcgtgtggttacagtcaatgcagtctgtcctatccacaaagtccgttttaacctcaactacctgagtcagctactgaacaacaaaaagcagagagtctgcatggtgcatttgaggaactcaaggatgttggacaacagaagcactctagaagagagagctcatcaaagacttgcagaagagatgctgaatacccctgacagttctttgaagacctttcagacaagccctataccctagaggactatgatgtctcttttgagagtggcatgctcatcattaagctgagcggagatctagggaactacacagtcaacaagcagagcccaaagaagcaaatctggctgtctttccccttcagtggccccaagcactatgactgaacttggaagaactgggtgtacacccatgacagcgtgtctctgtgtaagctgctggccagagagctgactgaagcattaagcaccaaattggacttgtcttcattggcctattctggaaaaggcacttgaatgcctgccaagttcaaagacatgaaaaacatatcaggagaagacccagcctccttctgtaattgattgtctggtttgccatgcctgcttctgaggatagtcacactgtatgtgacagctgtgaaaaagtgtgttacctcgccctctccccaaaaatgcacactggaaaggaaccctaagcatgtaaccagtgtgttagactttgcatttcttagtggtctccaaatacataaaagaatgcatattgtggaggagctagagaaattacccaaggagctaaagggaactgcaaccctataggtagaacaacaatatgaactaaccagtaccccggagctcttgactctaactgcatatgtatcaaaagatggcctagtcggccatcactgcaaagagaggcccattggacttgcaaactgtatatgccccagtacaggggaaccccagggccaaaaagggggag

SEQ ID NO: 24834 - DNA, 1138 bp, Mus musculus
tgcaaatgaaaacgactttgagattacaccttacttttcttttggttttggtttttgtttcttatttatttttacctttttatttttattatttttaatttttattagatattttcttcatttacatttcaaatgctatccccaaagtcccctatatcctccctctaccctgctcctctacccactcactcccacttcttggccctggcattcccgtgtactgggacatataaagtttgcaataccaaggggcctctcttcccaatgatggcctactaggccgtcttctgctacatatgcagctagagacatgagctctgggggtactagttagttcatattgttgttccacctatagggttgcagaccccatcagtttttgggtacttcctctagctcctccattgggggcccggtgtttcatcctatagatgactgtgagcgtccacttctgtatttgccaggcactggcaaagcctcacaggagacagctatatcagggtcctttcagcaatatcttgctagcatatgcaatcgtatctgtgtttggtggctgattatgggatggatccctgggtggaacagtctctggatggtccatcctttcatcttagctccaaattttgtctctgcaactccttccatggatagtttagtccctattctagggaggaatgaagtatccatgcgttggtcttccttcttcattttcttgtgttttgcaaattgtatcttgggtattctaggtttctgggctaatatccacttatcagtgagtgcatatcaagtgacgtcttttgtgattgggataacttcttacacgcgttctcgcgaccggccaggaagaacgcaacaagccggaatcttctgcggcaaaagctttattgcttacatcttcaggagccagagagcaagagagcaagagctctattgcttacatctttaggagccagagcgcaggagagcaagagctctattgcttacatctttaggagccagagcgcaagagcgcaagagtgcaagagtgcaagcgctttattgcttacatctttaggagccagagcgcaagagcaagagcaagagcaagaggagctctattgcttacatctttaggagccagagagcaagagcgcaagag

SEQ ID NO: 24835 - DNA, 1354 bp, Mus musculus
gtaacattggtaacaaaaagttgacttaaaactggtaactctgggttagagtaattcagaacatgtggcatgagccaacccatgggaacaggtctctaaagatacgcctgaattgggtaatattctgtgtaattcttatcctagaaatctgatttataaaagataagatttagggtagtgtctttgagatatattggcggctacaccttcttgtgtttgtgtgcaggaacagacagccaaactttgtagcaagtaatgtttttagagttcatttttaaagaaaatagattgttttcactgttaaaattgggttttgcttctcaaaattgtagttgtattctcatgttacaagaaaaattaaaagcttctcccgaaccggagccaccagctaaatcggctcctccaaaatctataaagcctcctgagtggcctagtccacaacctttccccttatccacagcctcaacccccgccgatgggaatcctgaacccctcagggtgacaagaggaggaccgctgcgggtacatgaaactgcaaaacacagagtcctggcggactctggtagacccgcccaaacttttaacccttcagtactggtcattttcctctgctggtatttataactggaaaattaaccaccccctttctcaggatccccaacgcctcacagggttggtggagttccttatgttctctcatcagcctacttgagacgactgtgaacagcggttacagatgctcttaacaaccgaagagcgagagaaaattctgttagaggctagaaaaatagcccggaagccaacggcggtctacacaactacaaaatgagatcgacatgggattccctttgactcgccccagttgaaactgcaacattgctaaaggtagggagagcttaaatctatcgccaggctccgatctccaaggtgtctcaaaacaggcccactactttggctaaggtaagaggtaatgcaggggccaattgaacctccctcaatgttccttgaaaggcttataaaggagttcaggcggttcactccctttgatcttacctcggaagcccagaaggcctcattggccatggcctttcataaggcagtcagctccagatatcagaaagaaacttcagagattagaaggtatattacaagaaagagacagttatgcgatctagtaaaagaggcagaaaaagtgtgtgtgtgtgtgtaaaagagaggcgggaggcaaaagaaagaaaaaacaggagggatcgtagacaagaaagaaatttgccacagtggtaggagaaaaagaaaagacaggatctagacaggaaacctgggcaactgaagaccgagcctcagctaaagaggc

SEQ ID NO: 24836 - DNA, 2016 bp, Mus musculus
tgggacagcaaataactgtagtgacatcccacattcttgaaagcattaccaacgctcctgtgacacatcagagctttttgttgtctaaatgagtgaccttcgcttcattccacctgctgtcccactgtgtgagactgcacctactcatcactgcgctgagattctggcagaagaaatgatctgaattatcagatcagccttggcctgagggtacgagctggtacactgatgacagtagcctcgaggttaaaggtaagcagaaggcggggacagcagtatggtggtgaacagaaagcaagtgatctaggccagcagccttcctgagggacgtcggcccagaaagctgaacttgtgactttaagacaagctctataaatggcaaaagaaaagtctacactgacaacaggtatgcttttgccactgtacgggacaatatacaaagagggctgttgacgtctgcaaaaaaagacctaagatgctgtggctaaaaaaaatcagatgacagatctaaccgccaagcaggtggctcaaggaacaatgatcctggcagtcaagaagtctaaagattattatgacatcagagagaccagctttagatacaccgctgaacactatcaagctatggacagtatttggcttggcctgggggccaagaaattcaaaggtgtggttaggtcctttgactactatgttacaggactctctgacttggcagaagaagtagtcaaaagctgcaaggactgtgctatgacgaggtagaatttctaaaagaaatcttcccaaggtaatggacctgcctttgttgcccaggtaaatcagagactggccaagatattagagatcggttaagagttacattgtacatgcaggccccaaagctcaggacaggtaaaaaaaaattaatagaaccattaagggatccttaccaaattgacagcggagactggcgctatgattagatagctctcctaccctttgtgctcttcagggatagaaacacccctggacagtttagactgacccccctataaattactctacagggggcccccctccactggtaaaaatagcctttgtacatggtgctgacatgctgctttcccagcctttgttctctaggctcaaggtgctccagtgagtgagacaggagcgaaaaagcagctccagaaggcctactcaagagaagaagacctgctacattagacgtctccacgcagaaaaccttaagactccggtggaaaggcccttatcttgtactcttgacagccctactttctacctttatgggaccccttttgattttgcttctgcttttaattataggtccatgtgtgttaaataggcaagtcacctttattaaaacagaaattagggcagtgtggcttttagttttaagacaacagtaccatgccctaaaataaaggatcaagtatgtcaggaaaaaaatagtgtctagttctaagattagaactactaacaagtagaaggggggaatgaaagtataacaatgtaaaaacagaattctaggcctttaggcccaggcttgggaatgtggcctttgtaaaggtatgctaatcacaaaagagatagcgacattcctctacccacccgcttcctgggttcaaagagtgctcattcaaagaaagtcaccctggccattaccagaacctgcaatgcaaatgtgctattgttaggggctcttagaagctgtcttgagagttaacaattaccaggtattccttgtgactcttaactggtatctttggtatcttccaacaacgccctccccacttccttgagtttcggtttcttcctttaaatacccccttacccagctactcggggcgccacagtcctctacccctgcgtggtgtatgaccgtgggcccgagagcgctcttgaataaaaatcctcttgcaatttgcaacaagaccgttttctcgttggtgattttggggtgtcgcctctcctgagtcagaacgtgggggagtcctcacgttgtgggtctttcaatag

SEQ ID NO: 24837 - DNA, 1099 bp, Mus musculus
taaaagtcagcttgaggactcaggctctaaaaaaagctactctctgagccaggtccccacaggaggccagagactagcctcagctttacaatttgcatttgaataaagtacctagacttcccccaaaaaagttctgctttcctactttctcactgtccgagattttgtctttcaagcaggtaaatcaacattctcgaggcggaccagcagatgtacatccccgcgcccctagagcacacaggtggctactgttatctcctttccaaggacatttccagcatgtggctttcagtctgagttaaaaattaggtttaccaagagggctagaaaagtagatatttctatattaataaagattggtttttattttgatagacaggcttagtcccttagctgacctctgacttttcacccttgctgttactgtaaggtgtccttaggctgtaaaaaaaacaaaaatgaggaaaaacgacttccagctcctattttagccacaaatcgtggtgttactaacgacataattcttgcttagactttgctaattctgaggttgataattctcctttaagaactacacagcactcaaaactgtgcatactggtttgtaattgtacaaattcaatatgggcatcgcttggtacagaggtactgcaaaaaaaggtccagcttgaccatttctgagtttcctgtgagataaacccggtttaaaagaggttgatatcatattttggttaaaaatcaaaaatattttccggctctgcctcgcctccccaaaaggtaccgagagccacatgtgtgggtcttattaatacccacgggaaaaatcgggtccatgtccacccaagccaaggttaaaagcccactcatctacggatgagaaaatcatttgatcacctcagttaagcgttgccttatttaacttaatcaataggggggagagagattggagacatactattgaaagggcaagcccttcactgcctcccacccaaataaaaaagccaattggccttgtactacaagagccggtcaaactccttctccctgtttcccacctatcatccaaaaaagcggagaaatatcaacttagtgttattat

SEQ ID NO: 24838 - DNA, 1152 bp, Mus musculus
ctcttggtgtctgagcctatttcatgttgctttcttctgcaatctacacagtcttgagtccaccccatccctgggtgaagcacactgaaaggtttattgctcatcagaaactgtcagtggtcgttctgctctgccgggttgtattgataaatgggctattgttgagctgacttcagatacttatgtactggtaacttttgggtcatttagtctttatgttggttgacagattttataaagggattacaatgcagaattgcaccaagaaccactttcatatacgtattctcaggaaagatgatttcatagtatctcataaacattcttgaggtttatacagcctattttgatttattcacaaaatactctacttgtgttgagtattgagctaaagatgtagctatttattgtaaatatattgtaacacaagtagctaaacatgtagctatttattataaattagtgctcttattagcacctctttttaatattgtagatgtacagttggagaaatcacggatgccttgaaaaaagtatttggtgagcataaagctaatgatcgtatggtgagtggagcatatcggcaggagtttggagaaagtaaagagatcacatctgccatcaagaggtactgtgtgagcgttagtgagcttggggtctcatcttcattttaatacagttcccttgggcctgctgatggctcagtgttcctgttacttgtgaaatacactagctgactttttttttactaatctgttattcttataaaactaataattattaaattaaatatgtatattatatagctgatatataatagatgattaatctatttgtaaaatctgttatataacttattcataactaatgtaaatatacaatcctgtgccagtatgtgaaactttgatattttgacaaactatagattggatacacagtgaaaatctcacaggattataatggtgtttattcctgcctcccgctggtattgcacctagtgatgctggagccatggtcacagtcatgtgtttatggtgatgctgctgtacacctgtgctttgccagttatatacttacacagttatacacttaccagcatgtacactacatagtaatgagtgataacaaacaatgcatttgctgtacttttaa

SEQ ID NO: 24839 - DNA, 1666 bp, Mus musculus
atttcttcgaagctgaaataatgtttatttgagttaagcaaatttgtttaacaggattatgaatttctgtatgaagttggtgtttccaacgtctttggtcctggaacccggattccaagagctgctgtccaagtgcttgatgatattgagaagtgtttggcagagaagcagcagtctgtgtaacatctggatctttagttatgactgaagcagcagtctgtgtaacatctggatctttagttatgaccgaagaaggtagtggtaaatccgtttcgtcaggtaatcccagcagctcttagaatgcttgctttggaaacctcacattaaaagattctaactataaatgtgcagtcatgccaatacacatatttaaagaatctgagttcaaaaaaaaaaaaaaaacctctgaaaatcatttataccaaatatgttttaagtatattattctagaaaattaaaatggtatactatttagaaatagcttacaattcttataaataattgaacttttgttttgttttatcctttgacatggggtcttactatgtagcactggttgtcttgcaactaactctgtagaacagtctggcctcaaactcacagagatccacctgcctctgccttcctagtacagggattaaaggtatgtgcctccatgtcctgcaaattattaaacttaaaaattaaataaaattttaaaatttaaccgattcttccttcaatttagtgttgatttgtgtactagaaactcaagttcctgtgttaatttaataaaataatgacatttatcttacaagaaatagtggagggtatttatggatggatcctcagccagacctactattgcttcaataaaagtagtgtttatcaccccctgtacaatggaataggggacatggtagataggccttccaggattgtgtcagctcctcacatgggaatgatattgttaatgtcaggttcaaaactctggaaaagatgtgtgtgacgctctcttaaatgaatgttgatggacagatgcatttgctataatgacagtctaaatctattacataaagtaaatgaattttcagatctagaaacacgctgatctgtatacactttcttattaatataagttataaaaataaaaaaatagtctgaagaactcttgtagtgtgatgttacttcactcattgaaggaagagactcactctgtgttaacctaatgtattcagcgaaggtgaggtgagcaacaaggattcttttgtaactttctacattatagatcaaataatattggggagggaaaatcatataatgctgtaaaattaataaactatactatagtttaatttttagaccatgactcttaggagggcatcatgattattgttttctattttaaagatgagcagtttgacgtcaaggacaacaatatatttattgtgttatcttatgtactacttataaagaaatatatatttgataaatacgatgttcctgttgtgtgttccattatgtgctagtaacatgtcatgtactgtgttttatatatttacaatttctgacatttttctttgaaaagcacttagaaaagaatgtcatcaaaagctcctagattttatgtttgtcaagtattttttacctgaacctcatagtaatattcaataaccttaccatttgg

SEQ ID NO: 24840 - DNA, 4002 bp, Mus musculus
ttaccaccttgtaaaagcttttcttggtttagtggctctgcattctttctagtttctcttttgagagatttttcttttcattgtgtttgtgtatgaggtgtgtgtgtgtgtggggggggggcatgccttgaatttctttccatatttatttcaaatgcttgtgtgacttagcattatcctagctaaaataaatacatttggtttttttcttactcctttccatttaggaacttacattgttctattttctactgacattcagcagtatgagttttacactctaaggaattagagtttgatattgaaatctgaattccgaggctggaaagtacagtcatgtggtacagataggctaaggtaaaccttgctaaaggtattttgtgttgttcaatttatgttttcaggtggaaatagcaaagctgaagaaagctgttctgttgtcttgaggtggtgtggacccagtgttcctaatgattcatgaacttaactgacttgttaaagacagcagaaatggtggtgtgatgaagaaataagaggacataaactgtgacatctaccgaaaagttgggggtgacaggttttttttatatattttgttttgccaatatgaaaaaaaagaagaggccttatttcttactgtgctgggattgcaaacatttctattgtttgcttaaatactactgaatctgtataaaaaggaaagaaagttcataatagtttttttattgaaacttgtattatttttaaagagttctatactataaatatcgtaatatctttacaaataagctgtaagataaactatttgagaaggacgggttagctttatagtagagtcactgctttcctgtactgcatagggcatgaacttgtatacatacactacaccacacacacacacacacacacacacacacacacacacacacagacactttccttttagcttcttacccaggattacactgctgtgcctgtttgtctgcagtgctgtttgtacattgggtgataaaataggagttcctagttactaggttcctcacccatgcatatttaatcattaatgaaataataacaatccaaattctagagtgttctataatgctcactataggattcattaaaggaagctatttaaattgtactggattaatcttgagaaaataggagctttgttctaaattcatgtggcctaagaaatctaaaactgtcatgctaattcttatttgtgcctagacaccgcagcacatgtggaatatgtaaacaccagccatattgttatattcttatgctcattctacagtcttaaatattactcatttcattatcttgtattcattgtacccttcctttaattttcactaatgataatcttaggaaacaaacctaaacccagatattttcagaattccagaatgaggttctatattggaaagctattgtgtaaacactcaggttttacaggcataatttatcgaatagaacaaactaagtcctagagatattttggactgttacttaggtaaagtgaaaaagagtattagtaattgaccatattgaagatcattccacaatggatgttgagccatttatttagcatcacaatcaacagttgaacatcttagactggctcagccactatcagggcggtatggctacagaccaagtgaacataaaaatgttgtatctgtagggcgacatgtttaaaaacacaaaggttaattttaaaaagtgaaatgtttttatttgttaaaaaaaagttaggttttaagctttactttagaaaatgaatgtcagattgtaaattatcatgcttaaaaaaacaatacattttctttacattttaatcttaaaatagaaaaaaaattaaagtcagatttcttgtgttatttcaagtaaaatagagctgaagtagaaaataatagaatgccagcacaaggttacacttgattagattctggggagagctaattgtacatagagtgtacattgtaggtgttttgacacaggaacttatatatcccaggctggacttaaccttgtgatatagcaaaattgtcttaaacttccggtttccctgcctctgcctcccaagtgctaggatgacaggcatgcccagtgtgcctagcctttttaaccatttcaactctgagctcatctaatgagaggttactgatgaccaaacttctccattttatttttaagtgattagtcaaatgaagtatttgcttcttattaatgtaatgacagtcctcagatgacagtggccttaccctaagtatcatctcctacttcccccacattttagaaatgatctcctgcattcccaaagggaggtttgtctccacccacactgctgggagggaaaggtctaataacagtaaaaagtaacatacacagtcaacagtaggggagtgactatgctttctggacaaataggtaacccatagatactagttaaaatgtaagaaattagaaaagcagataactaacagaaaagtgagtttatgtgttataaacacaaataagaaaaacagaagcacagccccttattgtatactaagttttcctttgcagtttggctccttcctgacccactgtgtcacaacctgacaggcgatctcagccccaggagcacatgtagtttaatgcttgtatgctatttaaaggtccatttgagccacgtgtagtgatgacatgcctgtaacttggagatttggggagagaaaccatgagtttgaggccagcctgtgctgtataggggccctatatccacaagaaaggaaacagcgttcctttggtggcggtgggtatttttagtccacacaatcagagtagccatgagtcatccctacacacttttgccatctcagtcagaatagagaagtcatactgtctgttttctatatgtctattttatgccctttacaaaatagttcagaaaaaaaaccaaacaagcttgaacttaattaaagggaaaaataattcctttaaaagagtaatttgccagtatttgcccttgatatgggaacttttactatttctaaagttaaagtcagaaaatgattaataacaacaacaactttacttagaggtaaatccctcttcccccaatattagtataaaagacagcattgaatctgtcattgccaaattattagtgaatgtatagttcagatttgctagtctttgaaacacagcactcctaagtttctaacaggattccaatgttattttggtgtgtttgtgaccactaagcttgcttcttactataaaggtattacctctatacaactgtacaggacttcacagaaaatcagaagatgcagagagagtgggcccggtcttaacagaggactccttacactcctaactgtgatcacagacaagaaataccttccgaagtgctctgtagatttttttgatgaatgttttatgcttgcatttaaacttgaaatgtatgagcagaatgagacaatctttacaatcagaattgagaagtgttacaattgaatggccttgtgctgtagcaataaaatgaccaagtgcaatgactttaataaaatcatctttcaaacgttgctgctattaatatttttagttaacaaaattctgtcgtttagcctaccttgccttctgtttgttaactgttatgtgatacagttgatgttttgacaatctaacattccaaagtccacatatatatcttaaaagtcttagaatagtatattcatttttttttacaggtgctgttaaaaaaggaaatgaaagcatgcttttccctcaaaaagaaaaattaataataaaagagaactgtgctgccgcctgtgttgttttttcctggttattgcttatcttagtccactttcctgctaaacacttatagatgaaagactctggcttattctttcagagagcagagtccaggatggcaaggcaaaaaggggccacacaggaagaactgagcttacatcctgattcacagcaagaggctgagagagg

SEQ ID NO: 24841 - DNA, 1246 bp, Mus musculus
ttaagcatgtctgcagtttgaaacccattacaaagtctggggtagaatttttaaggttggggctctttagatgaggaatgcttaatatatatatatatatatatatatatatatatatatatatatatatatatatatatatatacacacacacacacacacacacacacacacacacacacacacacacagcattaattgcttgtattcctgctgtaaaaatattatgacccaagaatgtagctcagttagtagagtgattcgctgttatacaaagccctgggtttaatctttggtactgtatgattggcaatctcaatacttgggggtagagggcagtatagaagtttaatatatgaagatttggaattaaaaaccatcctggactacatgtggtcctgtgttaaaaatgaaaaccagaacaaaacaatcttctgattgaaatataatattaaatataaacacaaacataatgagaatttttaaaaatatttttcagtcatctctttcaacaccttcaagtgcttctaaagtaaatacagctgctttcctaactccgttagaactcaaagctaaagcagaagcagatgatgggaaaagaaattccgtggacgaacttagagcccagattattgaattgttgtgtattgtagatgcactgaaaaaggatcatgggtgagtaactcttaattcctttgatgcgttccctaaaatacacttttaggctttgtgaactgaagccctaatctctcctaagtatgcaaatgcatgtttcaaaggcatttgtattatagcactttcagcaaagaccttggtgggaaaacttgctccagtaactccgctctagaagggctgtgtgcacgtgtgcactaaggcaggagctggccaggcataggtgctagttagttttgaaaatactgagaaaattgcattggggttttgggtatgatctagatcctcatgcttaactcttagaggattttgacccctatttctgttaggcttacgttaggtggttacaaaatgaatgggttccaacccacaagaaatctctagcctcccacccccaccctcgcaccccacactttcccgttagctctgaaagctcttgtttgtgtagtgttatggatcaagcccagagtgtgatgttaatgcactcaactaccattgacccatgtccacagctctgaaagttataaagtaggacacccccgcccatacacacacatgaagtattaactctaaa

SEQ ID NO: 24842 - DNA, 1116 bp, Mus musculus
tttcatttattatgtatataaaaatctacctgtgttcttatgacctggcacctcattaaatgcttttactaccgtttcattgtgtgtatcatactcagtaaggaatattttggttggttttaagtttttgcagtgtcagtaaagctgatgttaacatgtatgtagatttttgtgtgaatgtacattttagttcatttaaataaataccaagaaacaataccaaggatgaaataaataccagtgatcgctggatcatttggtaagtgtttcctcttgtaagcaactgccaaactattcccaaagtagctatacaatgttgtatttctaccagtagtgaaagattgttttgtgtccttggcagcatgtaatgttttctttgttttgaatttgtattctgggagttgtgtgatgctgtctcatgtttttcactttcctaatgacatctgatattgaacatcttttcatgtgcttatcaactatatgtttggtgaactgtatgttagatctttgtctgttttttttttccccccgagacagggtttctctgtgtagccctggctgtcctggaactcactctgtagaccaggctggctggcttcaaactcagaaatccgcctgcctctgcctcccaagtgctgggattaaaggcgtgcgccaccaccgcctggctgttttttgtttttttaaatcagtttttttttttaaattgagtttaagagttctttgtttattttgagtagctgcctttcatcacacgtagtttttacaaacaccttttccattgtgtaggtgcttatatttcttgtagaacagaattttattttcttttttctggaatttttttttaaagaaatggattaatatgcgtgtatatgatttgtgtgtcagtgctaggggtatgtatgtgattggaggacaacttgtgtaagttgattctctcctttcaccatgggttcaagttaccatcatactcaaggccatttctgtttctgtctttcctgttttatattatagggattttatattgtaggattgtatgtttttttctttatatttaaaactatgacttgtttagagttttgtttagcttctttagcctgttccaaagacacttta

SEQ ID NO: 24843 - DNA, 1231 bp, Mus musculus
gctctggcctcccacgccggaacccagttagtgtggccccaggtggctacactccccagctcaaaaaaagtaaagtctttaaaaagtgtattatttttattttaacttaagctagttaatagtgtctttttctcttctagcctttaatcctacagcctctgggatctagaactcagaatgtggaggtaacaaaaccagacgttgatggcaagattaaaggtaagctctaaaataaaccactatagtataaatacgcttttatattactaactcaacagacggacgtgtgacactgtactaattcccagaatagtgcatgagggtgagaattttgttgtgctgtgttttagattttagactctctctgaagtttatctattcctgatacatatcagacactgagtaatatttgagtgatagtgaaattttttcttaatgttgactatacgttttaaaattatttaacctttaattgcttattgagtatattacttagcacagaggcttaataagtacctgctacattaatcaacttgtaagtcacagtatttacattcttttgtttcagctaaggaatattgtagaacattatttccctatacaggaaccaatgaagatgaacttacatttagagaaggggagattatccatttgataagtaaggtaagatattttagtgagccatccctcacagcagtaccttcttgcattgcctgtggagcattaacttcagatgggctgggactttatttttgttttggggttctgggaacttggaacataaatacaagcttataaagtgattcttttaaaaggtttttgtcttgcgtattacttaaaattgatatattaaaaaccagtgatccggggctggagagatgtttgagcacctaagagcacttactgctcttacagaggaccagggttcagatcccaacacgcacatggttgcttggatccattgtaactctagttccaggggatcagataccctcttttgacttctgcaggcatcagacatgtgcatgatgcattcacacatgtagacaaaatatccaaatgtttaaaataagaaatctgaaaaagaaaaagaaatgaccagtgatcacattatgtattcctttattaactccaagaattgtacaacctaaatgtttattagtaagtaacaggtgtgggactcatcttcccttgtgaaatgggtgaatctatggcaggggtacacacgcca

SEQ ID NO: 24844 - DNA, 1195 bp, Mus musculus
tcctgtttcagcaaaggcaaggaagggatttctcagaggcaagatttgaatcttttactagcagtaacctcatgacttgtacataatgagcacctgttccatgaattacttatcaaacgttggttttcaggctgtcacatgcctttaatctaggggctgagacaagtggatctctgtgagtttgagaccaacccagtctacttaatgagttccaagacagcaagaaaagttttatgtagagaaaagtttattttcagttataaggttagtaacattgaaaactatttatttaaatgagatatttctagctgtgatgtcacatgtaatgctgataaggaaatggtgacagtgagcagtattcttgacaaaatttactgttactaaaaccctttagcatccatagcagaaactatatatttgaaaggaatttattgaatgttttttaacttatggaaattaagcaatcttgttattagtgagtataaatgatttattaaagaatttgttgcatgaggctatttctgtttagaaggaggtgcttgttagatggacttttgaaagtgaatgttttcagggctgtagaggtgacttggtactggctgctcttcgtgaagatctcagttcagttcacagcattcacaaggcacctcccacagtaactccaatcctagggcatccgacaccttcttacggctgggtgggggtgggggtggggttacgtacatgtggaacgtagacaaacactcaggcaaatgcccatacacgtaaagtgaacacaataaagaaatagacaaagacaaaattattttgtcgttgtttaactgaaggggaaaataaaattttataccacttaggaaattatatctttataaatgtttttacattttattcttttaaaatttatttctaattctgcctgtgtgtgcgagtctgtgtgcatgtgtgtgctggcacttgagctgcttggaggcggctgatttccaggagctgggatgatgggtgctgggaattgaactctgagtttctgtattcttaatttctgagtgtgcgcacactgtgtgtgtgtgtgtgtgtgtgtgtgtgtgtgtgtgttttatgcttatggcacatgtatagaggtcagaggacaacttttgggagtcagttttcttctactgtgtggatttcagggattagttaaggtaggcaagcacct

SEQ ID NO: 24845 - DNA, 1175 bp, Mus musculus
caaggaccaagtgcctggcagagcgtcagggagtgatgccggggtaaattaattggctccacagattgtttgtaatctctctgtgccaggccacttcctggttggttctcacaacaaaggatgaaggaggactccttcagtgtttccactcaccctttcccctctttccccctcttctttcaacaaaggaagatacgggagttcaggaagcaagttgacttagggcaggctagagtatcagctttagaactagccctgtgctctgtaaacaggggttccggcagctcacgtgatcttaggcactttaaatactctctgagttcctggtcatccaagggcttgctgagaggcgtgtctgaggaggtgtctaaagtgaatctgctgctgtctgagacagccaatggtccgaagactgtggctgttctcaaggtcattgttgctcctacggtcaaagtagaaatggcgtttcctccttaaacgattgactttaccggacacgctgggactctgagctgtaaccttgtaaaaagttggttatttgcagtgcttgcagctgagtccatgattattctgtgaaaaaaagacagccgcttggctaagttcaagggtattcaagggctggagagatggctcagtggttaagagctcttccagaggccccgagttcaatttccatgtctgaaaacagggacagtgtactcatataaataaataaatcttaaaaaaaaaaaaggtcttctatgaaaaggtatttgcttgctactgagggtaggttaggaggtcacaaaaggccacctagctagggtttactaaactgggaaaacaggattggcagggctaagaagttaagggtggggatggaagaaaagaaaagggttaaagataaggcctaggaaacagttggctgggaaatgtagcacaagaaaaagataagctcgtggcagcaatgtcgttttggtagggaaagaatgtgtgtggtactggttcatgcagtcaactgggcgggaactggagtcacccgggaaaacttaattaagcaactgtctccatctgattggcctgtgggcatttctgtggagccattttcccccttccttcctactttccattccttgcttccttcctttctatttatcctatatatcctcctcctccctcctttgcttttcttattt

SEQ ID NO: 24846 - DNA, 1141 bp, Mus musculus
gatgtcaagttggtgtggtacccgccagatcttgaacagtggtgatgacctgttattgctgttgctgttgctgttgctctgttcgcctctgctcctctatctgacacctctcttatttctttcagcttggattcctcagcaccatcacagctcaaccagaacaaaagactctgagtctccctggcacctaccgccatgttgaccgtaccactggccaggtgctaacctgcgacaagtgcccagcaggaacgtacgtctccgagcactgtaccaacatgagcctgcgagtctgcagcagctgccccgcggggacctttaccaggcacgagaacggcatagagagatgccatgactgtagtcagccatgtccatggccgatgattgagagattaccttgtgctgccttgactgaccgagagtgcatctgcccacctggaatgtatcagtctaatggtacctgcgctccccatacagtgtgccccgtgggctggggtgtgcggaagaaagggacagagaatgaagatgtgcgctgtaagcagtgcgctcggggtaccttctctgacgtgccttccagtgtgatgaagtgtaaagctcacacggactgtctgggtcagaacctggaggtggtcaagccagggaccaaggagacagacaacgtctgtggcatgcgcctgttcttctccagcacaaacccaccttcctctggcacagttaccttttctcaccctgagcatatggaatcccacgatgtcccttcctccacctatgagccccaaggtaactcaaccccacgaattgcttgcttgaggaaggctttgagcccagtagagtgagctgctaaccaaagatgttctcttcactttgctaaatctaaaaaatcatcccttggaggagggaaccttcattttttgtgtggctaattaaatttggcttctttggacttaatagaaatattgcaactcagagggtttctattaggagacaacagatatctagaaagtaggttacatcaaactggcaaataaagaacttcgagaaataaggacagtgtgtgaccttatgtaaatcacttaaccgactcagtgctgggcctgaatgagtgagttgagtgattttagttgtttaaggttcctttcagatt

SEQ ID NO: 24847 - DNA, 1845 bp, Mus musculus
aggctgaggacaaactggaccgcctcttcgagatcattggggtcaagagccaagaagccagccagaccctcttggactctgtgtacagtcatcttcctgacctattgtagaacacaggggcactgcattctgggaatcaacctactggcggggtgatttcatttcgtttctgacttttgtgttttggtgtgtatgtatgtgtttaacagagtgtatggccggtgagtttgggttctttctttctttctttctttctttctttctttctttctttctttctttctttctttctttctttcttccttcctgaaagtgaatgtataaagcctttacaatgtataactgttggaaaatgcccaccactaaatttttttttaagttccacatattctccatttttgccttcttatatatatcttcaacactattctgtgcactttaaaaacttaacataaacgcagtgtgacttctcccatatgctgggtcccgagactctcaacttcttaaaaacctaatggcatcttgtgactcctagaagtagacataagtctttcaaccttcacacctactctttctgttttaattattattgctatttgtcttattgtttgtgctttacaagcgttcttgaggacggagggaatctacgaccctgttgatgactgtaactctattcgactttgagttgtcttcttcatgtcttgttatatagttcatattcatggctgaaacttgaccatactccctagcgctgattgtatggttttcgtctggacaccgtacactgcctgataacttgtgcacctcttaacgctactatgctctgggctggagaatgaaatctttaagtcaccaggacttgctgtttcagtggcttgacacctgggccaccaaagaactcgatcttcatcttttagggacacctctgctgcaccttggaaagccaaccttaagtgccagtggcactttatgcccagctttgctttgaaagatatctttcttgttttttttatccttctctttctctcttttttttaaaaatacacatagtcaataggtccagtctgccctcaaggccttgctgggttttcttcatcatccaatcactttcattaaaaatggctgcagctgtaagaactcttgtctgataaattttcaactatgctctcatttatctacctgccctctgatgctcagtcgtcagactctaatgcaaaggtggacgtcggctgcctttgcgtgggcgggcttagtggtgaggaactgatatcagaaaaaaaatgccttcaagtatactaatttattaataaatattaggtgtttgttacttgtgtggttttggtatatttactactgaactttcgcctttccctctgctcaggttctagccctgttcatctcttggggaaggatgtgtgttctgaaacccttctcctgtccaatctgtaaatcatgaatattattagcaaaagtcccttttggagaggtacttggaggttcactgcacagggctctgataagcactgccaagcctttcctagtctttcggagttaaaccttaggtaacttgatacctgtaggacgatctgcacacattcacaggcttctagccaaaacctcactgtccctgacgaactccagagggcttggtcagcagtgaggcggatgtggtcctgtgttggtgggatatctcaagctcactgcaggttttcctaagcttggaccccacctctgcggaattccaatgatcaaacgctagcaactttaacatcctctttttgtgagaacctggaagctgatactgtgtatactgtgaccccccacgtcaacaactgggactgtctt

SEQ ID NO: 24848 - DNA, 1373 bp, Mus musculus
gaaaaaaaatatgacgagagtataaagctgcaaggtcagggttttgaacttgacctttgtggctcttgaatgtgccttctgtgcagtcgagtggtcagccatgtaaaatggagttgagtgtcttctgccctggcagcagctgcgtgctaagggcagagcagctccagccctgctactgctcgcttgctcgcctgactcatcataactccgagaaccagagagttgttgggaagcactgtcatcattcactccctccacagctgggtcctcagagccagagctatcaaaacagcctacatgatgtccattggacaacagaccactgcttcctggtactggggtgatctcccgcattctgacaacgtaaagcaaacttgattattgctcttgagacgcaagatgggtctaaagtatgcagtgcaggtagacaccgatgatccgtgatgactctcgacacttgtcagtcatcttagatttattgcgctgaactggctcactgtgaatttccttaaagtttgatgtctggagcctcattgtatttgggttttgagaggcatttctgtactgcgtacataatctatgctcttggtcacagaatggatgttttaagaacaggataggaatgattttgttcataagtgttctgatttattttgttacatgcagtagagatactaaaggttgaagggttgatcaagtaaaacaatagagaaatctctgcttatttcaatttccatttaagaaagtaacaaactgcaatattcgctttgagaagaagtaggtgggcacttaggacttgtctccagcagagttgaagacagtttagctcccacagtgctgcggatcccagcacaatcccagtgcggtctccttcccctggctgcaccttacacttggtgtccatgtgtagaacagacttttataaaggctgggatgggaagggatgctctgccagtgtcttagtccttgcagcacatggatttattttgtattttattctgttctcagaatactaaaactagttaaaatgttataaagtgcttattcaggagacaagaatagtatttgtttaatcaagtatattatcatattgaactttctgctagttcgtttgtatccttgaaaaacaaaaactaaagcccctggctgtagttttgctctgagaaaaccttcttagtaaagataggctttgacatggagatttagtgtttgtgttagctaaacctgctctgctttctgttcaggagaaaatatttggcttccaaaatatttagctcttggtgatagtacccaaagataatgggaacgtgtttgtctgtgtacttgttggtaattgcactagtcagctcagaatttagtaccttgactctcta

SEQ ID NO: 24849 - DNA, 1174 bp, Mus musculus
agccaaagaaatcactgtcacgctgctttagaggctagaagtctgagcccaggcctgtctcttgctgggagagcaaagcagttccatgcctttcctggccttcagtggtgactagcatttcttagtactctctggctcttagatgaaatcactccagcctctgccttgtcctcccatgtccctaagtgtgtctgcttcttcccaaaaggacaccagtggtgttagggactaccttaaccacctcaaactacacctgaaaagaacctatttccaaataaagtcatgttcactagtgctagaaactatctttttttaagaacctgctgaacttatgataccatctaattgccattatatcaagccgcaagaccagttgtgtaacatgcattacctgtgtagcctgggaataaatgcctttgaatgggatagctaaatcatcccatcccaggcttagggaacattgcaaatgaagagtcagaaagaacataggagcccaagaaaagttagagtcgtgtggaactctgacttccagtcatgcatgactgttgcattctgcaactcagaaaactgtgcttgcctgcacacgatctgtgcaagactgaacccagccatggagaggtgagagcttatgtgacccttccctctctgaggatttagagaacactaatggatgggggcaggggagagaaacactatttgtttcatgatgtagcctctgggaaggtgccggtgatcctgtaaataaaccttcacccttggttctgtaaacagccataatgaatactcattggatcacacacactcccgaaaaagacataaaagtagaagaggaacctacctaggataagaatagggattaatgagagaaagcggggcaaaaaaagtaacgggatggattctatgctcaaatacattatggagttatatgaaaatgtcagaacaaaacccctgttatatctaattagaatgtgcttataaaaacattagaaaggcagcagcagtatatgatccatcgtcttgtgagtgagttatcatgttgagctatcatgttgaaacaaactgaaaaaaagaacaaggaaagcagtccggcatgacacctgtcaagtgataggtccacaggcttgccatccttccctctttattttcaatgtctttgaaaaacactactggagaa

SEQ ID NO: 24850 - DNA, 1233 bp, Mus musculus
tagaaagccagggcctagtcagatccaggaaaggccatcccaccaggatggattgccagccccatgctgctactgtatgtttggaggagcaagcagaggacagtgtggcttcggtgtcaggagtggcgttagcacaggcctgaccatatggacccacatgggagggaattgggcttttattttaaattgtggaagtcatgagaatactcttaagaagaggagtgacaggtcagccatgggagtaggttcattgctgtggccatactgtggaatgtcttgcctgggtggaggacaggaagccagttcctctaggagccttgatgcagtagtggaaacttgagggtcctttggaaagtcggttggatagtgttttgctggggcaaacacatgaaggaacgtttcgttaaagtgggcacaggtgtgaaagtctaaggcagactcaggaaggaacgtttcgctgtagcagacacaggggaggatgctttgctaaagcaaggacaggtgatgaaggactctttgctaaggacactgtgtattggctcggcttatattgcgtggttgagctgcatgtctcaggactccatagagagcaacactccaaaaaccttgtggtgtgctgcagttggttgccgcttccaaggactagggctgattgcactcacatgctgaggcaaggcacatgaaggatgtgatgtttggagggtataaataggactccacggagtgatagagacagagcttggcttgctggtacagctagctgtgcaatgattgtgggcctcacgtcttccctgatgagaaatgcacagccaagaactcctggtatttctgttggtccctcctgctgacttgagctgaggctggggcctggctgtctctgccaggttgtgtcacttactgttgctaacccaactctactgaactggactgctggtgtatctgtgaagtgtttgtgagtggaacgagctgccgctgcctgctaacctgtgaactgaactgccaatttccagacaacacaggagttggctccaaagaacctttctaaacaggtcccatttcccttgtatcctttcttttccactacctctggtgggtgatgggttacaaggaaggttaaagtgtttaataaccatcattaaaaataggaatggaaaaaattaaagttacaagctgcctgggtgaggacatggatgcagacccattggggccttaatggttagcgcaggaatggac

SEQ ID NO: 24851 - DNA, 1158 bp, Mus musculus
gtaagagaataagaaagttgaggatcactttacaagagtcactactaagttaattgtttgatttttacatatatctaaacatttaaattatactttatttcttatttagtgtatattcctgtgtcccgtgtgggtgcacatttaccgtggtgtgtgtgtttgggtcagagcacaccttacaggacttggttctctccttctgccctgtgaatgagacctaggtggtcagtcttggaggcaagcgcttgtactggccccaagccaggtgtttcagaaacttttgtttgttttgtttagacggaagctggttttaagtttgtggtaaccctgcatcagccacctaagttttgtaattacaggcatgtgtcactatgctctgctgttttagaagtttttagagactttattagttagtactgacagtgtgaattgacaaggaccaattcttctctacaggaaagagaatctcgtgaacatctccgtttagggttgttaggcctccccgcacctaagaatgattttgaaattgttctgcctgaaaatgccgagaaggaactagaagaacgtgaaatagatgatacctacattgaagatgctgctgatgtggatgctcgaaagcaggtgagaatcattaaaaagcatcatcagtatggtcagtatggtcatgcggctgttgagcagtggttctcaacccacgggttgcaacccctttggggttacatatcagacatcctgtagagcaaatacctgcattgcagtttctaacagtagcaaagctacaggtaggaaatagctgtgaaataaggttatggttgggggtcaccacaacatgaagaactgtattaaagggttgcagcattaggaaggttgagagcctttagagggaggcatggctgtcagtgtttctaggttgctactttgagtttttctaatattttaacaaaattcctcaaattatattattaacaataatatactcacataaatgaatgatcttatgcttagaatatcttaattggtttttttagatgtttgtatacatatgtttgtttaaacactgaaatttactatgctcttctaaacacaagaatgtgttttatttatagaagtgaagaaaggattgctttaatctagtgaagaaaggatgttaaaagcaaa

SEQ ID NO: 24852 - DNA, 1190 bp, Mus musculus
ataaagaattagtgataaagtcagactaaaacctgggtgttgtgacatttggcctcagctcatatcaggaactttgatttcttagtaccttatggtacagagatctggcatggataatgggagtagctcttgggtaatggcagtttcataaggaacccacagcactgttttccccttaacacagtctcaggtggcttcaaactcactgtgtaactgaaggtagccttgaactgctgattgccctgcctctccatcctaggtgccaggattgtaggcatgttgcattcacacccagtgacagtagcatatcttaacacatgaactttattcagaactcctgatgtgatgtgttaggtggacaaaggactgaaagtgccgagatctgttctggggcagttcacaactctcttgttttttttctgaaagattgtgtatacaaatcctgtctgtatcaagatttctgtaacagggccagagggaggattccactagcctttctgactgctatgcactctcttgtatctccaggaagctcagaacctcatggccttgaccaatgtggacactccattgaaaggtgggcttaataccccactgcatgagagtgacttctctggtgtgaccccacagcggcaagttgtgcagactccaaatacagttctgtctacccctttcaggtattgtaaaaatcagcatggtctgtagtttagaaaaacttcacttaagaacctgagcagcatgattttttttgagtaatgttgacagagattagaataactattaacttgggtttgcctttttgatgtcttctaattgggttgcctggtgtctttggaggttagatgagggtattggctcccaaagaactggagttaaggttgtgagccgccatgtgggtgttagaaattgaacctgggtcttctgcaagagcagtctgcactcttaacttgagccatctttctagccctgttatttatttttagttgttagctctgccctctatgggttatttaggctagaaatccccacagtccattatacttgtggatgagagcagaatcaagaatcatcggaagctagtctttgtatagtagttattgcttcctgtgaggctaaagagagcctaatttctattttcctgtgtatatcttgtctcttaaatagattgtaagctccttgggggcagggac

SEQ ID NO: 24853 - DNA, 1346 bp, Mus musculus
cttgaggtcagggatggtgattccaccagaggttcttttattgttgagaatagtttttgctatcctaggttttttattattccagatgaatttgcaaattgccctttctaactcagtgaagaattgagttggaattttgatggggattgcattgaatctgtagattgctttcggaaggatagccattttgactatattaatcctgctaatccatgagcatgggagatctttctatcttctgagatcttcaatttctttcttcagagactttaagttcttatcatacagatctttcacttccttagttagagtcacaccaaggtattttatattatttgtgcctattgtgatgggtgttgtttccctaatttctttctcagcccgtttatcttttgtgtagagaaaggccattgatttgtttgagttaattttatatccagctactgcactgaagctgtttatcaggaaataaatcttttttaaaaatatatttttacttttaaaattatgcatctgtacatgagtacgggcgccttctgtgactagaggctttggaccccccctagggctggagttataggtgagctgcctgatgagggtactgggaattgaactcagattgtctgcaaagaacagtacacgctctttaaccactgagctgcctcccagtcatctccttctgcttcttctatgctagttatcattaactgttaataagtttccatctctctctctttttttaaatgatcgtgtgtgtctcttataggaactctgcaggtactaacttaagatttgcttttcttcatttggaggtgtgtgactgaatgtattctctttggtaactcttctaggatgaaattctgaaagcagcggtaatgaaatatgggaaaaaccagtggtctaggattgcctcattgctgcataggaaatcggcaaagcagtgcaaagccagatggtatgtacctgtcagtaagtggaaaccaacatgatcccgattcccactgtgatgagtgagatggctcatttcatctcccccacccccaagagcatgaactgtgatatggagggaagtatggagagagctgcctttaaataaatgtacttaccacttgcttcctgtgtcttgagcaaaccatttttccttctctttaccctgcctgttttctcacagcttagcactgattgatcagttgtgaatccttgtccaggtgagttagtatttttatttgagagtaccttgtgagacaatgcagaatcttaggtagatggtggaaagggtcagatacagagcagaaggaagtggctcctaggctgcagtagtttgattcccttcctcttagcggcct

SEQ ID NO: 24854 - DNA, 1172 bp, Mus musculus
cttactgcgctgatcatgcctggattcctgtatatctgactgatccgtggcgtggggatctgctttaaaacaagttagttatgctccagaatacacatatacaaaaggattcattggaatgattttggagctgtcatagttgtcacacacagttacactattcaaaataaacacttgaaaatgatgtttgataactcccttctatagttttcaggactgtgatgactattcttcgttgtcaacttgactatatctggaatcacctacaacccagaaatggagaagagcacacctgtgagagattgtctgcttaaagtggatgaatccacttctagtccagacctttgaggtaggaagacacacatttttaatctcaatctcgaggtgggaagacacaagtctttaatccaaatcttaagagatgtcttttgtgaacatatgagccatactttcagctggatgtctgtataaggacgtaaaagaaggaagcttttactctttgtctatctgctcttgccttgctagcacatccattccctcactggtattacaacctacttctggattgcagcatatactgaagaccacctgagacatgcagccttgtgggactgagcaaccactagatttttagactttttattgttggattagctggactacagaggaaggagagagagattgattccataagttctgtgactctaaagaaccctgactaatacagattttggtaccagaagtggttctagagaagcagaagtataaggatgaatcttttaagtatctggaataggcatttcaattcgccggcaccttcagctactgaagtctctccagtcaccccctctcctgggagcttggagagtactgaaggcccatggtatgaactgtattacaaacttaaagagataaatgaatttgattatcctggctcaccaattgtgagcgacaatggattaggtgaccctgtatatgaaacttttgacagtttgggggaaaataaggaaaatgatgctgctggttggttgcttttagcatctctggataaactgataaaggataggaatgagctccgggataaaattaaccaactgcagaatatggtgaaggacaacaaagaacttaatgataaaattgaccatcttcagatgctcataaacaatctaaag

SEQ ID NO: 24855 - DNA, 1945 bp, Mus musculus
tatacctttacagttttacctcaaggatatatagactctcctgttctgtgtcataacttagttagaagggaacttgattgtctgactcttccacaaaatatcacattggtgcactatattgacgatattatgctgactggaccaagtgaactggatgtagctactcattggtaacaacagatatgaatcagaagataggaaaaattcaagaactgtctacaacagtgaaatccttaggagtccagtggtgtggggaatgcagagatattccttgtaaggtgaagaataaataattgcagttgaccccaccccccaccaagaaagaagcataatgtttagtgggcctatttggcttctggaagcattacaactctcacatgggtttgttactccaggccatatactaagtgacttggaaagctgttagttttgtgtggggcctgggacaggagaaggctcaacagatccaggctactgtgcaggctgttctaccacttggatgacatgatccagcagacccaatggtacttgaggtgtcagtgacagaacgggaatgctgtttggagctttggcataccaataggtgaatcacagaaaagacctttgagattttggaacaaggctctaccgtcatctgcagacaactattctccctttaaagacagctcttggcctgctattgggcctcagtggaaactgaacatttgacaatgagccagcaagttaccatgcgaccagagctgcccatcatgagctaagtattattggaccaccaaatcataaagtaggacatgcacagcagcaatccattatcaaatggaagtggtatagagctggagagaaagctcagcagttaagagcactgactgctcttccagaggtcctaagttcaattcccagcaactacatggtggctcacaaccatctgcaatgggatctgatgcccatttctgatgtgtctgaagacagctatagtatactcgtatacacaaaacaaataaatcttttttaaaatggaagtggtatatgcatgattgaacctgaccaggtcctgatggcacaagtgagtcacatgaagaagttgcccaaatgcctatgatttctgctcttgttacagtgcagtcttactgccaagcatacacctatagtttcatggggtgttccctacaatcagcgtactgagaaggagacagctagggcctggtttactgatggttgtgcactttatacagtcaccgcccagaagtagacagctggagcattaaaaaccctttttgggacaactctaaaagatgctgacaaagggaattcttcacagtgggcagaacttggccaaatgaatgattgttcactgattcacgtgctgtaaaatggattggctgaatagtcacggacatggaaagatcatgattggaaaattggtgagaaaaacatctgaggaagacatatgtagatgtacagaggatgtgaagatatttgtgtcccaagtaaatgctcttcaaaaggtgacttcagctaaggagttcattaatcaagtagataggatgacctattctggggacagtcaacctctttccctagccattcctgtcattgcccaatgtccacatgaacaaaatggccatggtggcataggtgggggttatgcatgggctcaatgatacagactttcactcatcaagactgacctggctacagctgttctgagtgccaaatctgccatgccaacatcagagaccaacattgaaacccagatatgatgccattacctggggtgatcatccagcaacctggtgggaggctgaccacattggaccatttcctccacggaaaggacagtgctttatctttactggagtaaatagtctggttacagatttgcatttcctgcaccataatgcttctgccaaaaccacaatttatgaacttacagattgccttatcc

SEQ ID NO: 24856 - DNA, 1123 bp, Mus musculus
tttttatttcatttgtgacccatgggaagagtctgtccatattgagggtgggtctttcctcctccattacatgtctctgaggaaaacaccctcagatacacagagtatgtttcttctaaatctagtcaaggtaacagtaaaggtcaatcaccagagggaccaagccatatccaaactatagcaataggaaacttaacaattccctaagagatgcatcccacagttttattttgagagatttactttggttggactgtttccttttgatcttgagcaattggctcccaaaacttagctcagtggtggcactgactgacaaggcaaagtactatccagttttactctcaaggtcacgcagcaggtctgtgaggcttttcttgcttggtctgacaatcaaagacagtgtatctgcacttccactttgactggggaatgtgccagacaggggtggtgcactttttagtgaccctatgggccaagttcccagtggatttggaacgggacagggaactcagagagatggctggtgtccttccaatgcaggatgatcccacagtaagcatccaggaggctaccactgccttgagaacctcaacactgaggttcctctacttgaactctgtaagaatctgtatgtgaaaggcaaacatttctgcgtgtgtacaaaggaacccagcctatgaatctcttaaactatcagccaaatagcccaatgcctaaaagtgcctatctctaacaaacttaagagtgtgttcagggggcaacagatagttctatcccaatagtaaaggcagtagtgtggcatggttatttggctacaaatatgaatgatagtaattctgctatggatagtcagagcacagctacactaaaatgagttcttcaatgggatttcaaataaactcagaattctacatttgagccagactcagaaacttacagtgaccataagggagagaacataaggagatgcagagactaagtgagccttcaggatgatgtagctcttcgtgaaggaaatacaagtggtcccagagagatgttggtgctgtctataggactccttaaagcccacatggcattatcacataattagaaaacaaaacaaacctccctctaatgg

SEQ ID NO: 24857 - DNA, 1220 bp, Mus musculus
gaggggggatgcgcactatagatcagttctggcagcctatctgggtgcagcatggtcctggccccacatgtgtggtgcaccacagcgacctgtggacacacagccaccaaagaagggaaaccactgtgcttcctcaggctagatactggccctttgggtgcccagttcatttgaaactgtccttataaaactagttaaagtgactaaacaacaaaagaatccagtcgttctagagctgcaggagaagcccctgggtagccagcgaagagcagaggtcagatgggaggcccgggggcttggggtgtgttctgataggaagcccgggggcttggggtgtgttctgatgggaggcccgggggcttggggtgtgttctgatgggaagcccgggggcttggggtgtgttctgatgggaagcccgggggcttggggtgtgttctgatgagaggcctgggggcttggggtgtgttctgatgggaggcccgggggcttggggtgtgttctgatgggaggcctgggggcttggggtgctccctgcactccgcttcctgactgcgagtgcttgtgtggaggacttgagtctctctgtaacttcatttccatctgtaactccagttctgggcaacctgatgcaaacaaacactcatacatgaaataaaaaccatcagtcctttaggacgagaaaaacagcaaatgcgaacagccacacaggcctgaagcactgttacaggggaaggtctgggacccatgcaactagagaggacatgctctgcatactgcaactcggctgttctagcgtgtcactggatgacttgagaaatgcgtcactgggttgcttcactcttctctgaatgctgctgtatgctgacacagacctacacagagaggtcaatgggctcaactgaggggatctcaattcacctaggacacatctctgagcataccagtgagggcttctagattaggtttactgaggtagaaaggctggtatgtagacagaatcctgggttgaataaagagaagcaagctgaacatcagccatcctatctatcaatctatccatccatccatctatctatctgtatatctacctaactacttatctatccatccatccatccatccatctatctatatatctacctatatatctacctacctatctacctaactatctgtagctttctttctgtctcctctatgtgtgtctgtcaatctgtct

SEQ ID NO: 24858 - DNA, 1697 bp, Mus musculus
aggctgggagggctccgcaggccttttctggaaaagactcagtctccggtccatcagctgcttcctcccctaggttctgggtaggtgcttccgtcagggaggccatcctggaggtcctcattaaagcccgccaggggtgagtgagtgagcaagtggacagagcctgagacacaccccgatgtcgagagacctcaggagtagagttagtaatggctggtagactgagactagccctggagggatggcgatgggctggcgtgctgtagcttttcctcagcaggcagtggagcaaacacttaagaaggatgtccctcacacatgcctccatagagccgagtccatcccaaaccctagctagagagatacccatttccagtggcaggagatccgttctcaccagaccctccacttcttcctgtccagcgagttgaagctctaggtcttcagaggggctccatgacacagccccggggcaccagccctttgtcctgtcccttcaaagctctgacaccaactttgctctcccctataccctcttacccctccaccccagtgtgcatgtctgtgtttggccccttgctctcccagctgccctggctgacgttttcccagcagacttagtacccagggattgggctcacatccatccaatcttgctccctctgcttcttgctttgccttcaccagcagaactccatctttttggctttccctcttcctcctggctgtgccaggcctatgccaaccaatgggagtggcccctacctatgcaaaaatctcctctggctccctgtcccctttttccctggggaatgtgggaagccctgttgtggggatgccatggtctagggctcaaatgggggctgagctttctggttatacagagatgcttgggtgaggagggaggggtgtcagagaaggataggtttgggcagaagggagcaagcacaccactgggtttcctgggcaacagtgtcctctggccacttagcacagaaccctccaggaccctgaatttgaggtgtgtgtgtgtgtgtgtgtgtgtgtgtgtgtgtgtgtgtgtgtgtgtggtgttgactattggagcacaggtactgagtgagctgtggcctcaggcctcagttcttggccaactggtacctgaatgtcttgttctcatttaggggcagcttggccatcttacagctccaaggagggaaggacttggctcatcctctttcattctgggtccagaaactgagcttggccttgggagaggagggggtggggaagccccgttattatttttgcctgaccatttctgcctaggtctccttgcacagacagcctcacctcccacacacacacgcacagacttagagagaaagcaattctttggtttcttttcttggtagctttattgattgccagggaaaatgaaaaccagaaaattaattaatctctaaaattaaactttacactgaatgttcttgtttctctaattagaacctctgctagcagctgtggctacacacacacacacacacacacacacacacaaacacagagagagatacagatacacacacacacacacacaccctcacacctacatgtttgcactctggaactgtcagagggtgtcaggcacagaggactctaggctgcccccgacaggcacacacacagtcactcccaagccccctctggtgctctac

SEQ ID NO: 24859 - DNA, 1194 bp, Mus musculus
caaccaaccaaacaaacaaacaaaaaacaaaaaacaaaaaacaaaaaaacaaaaccacccaaaacctgttcaaggtcaaatagtaggtaaggagatgggacttaaactcagctggctggctcctggatggagtctgtttagtgttttgtgtctgcagatgacctcatctgtatatgctcacctgttcagtaaagtaattattaccaagtacttattctcagctaaggagacctcagctcagacttgcctgagggtacttctacttggcagaggtagatgtaaagtcaggtttctgggtctcaggccaagactcttagaggaggtgtttgtgcgtggtacagggttttcagggcaatcaccacttacgggtttaataaacccactggggctgggagagggagggggcggagataatgatgatggtggtggtggaggaaatgatttcagttataaggacttctgtctgtgttgggatgagtagacaaaagctgcagtctgctccccttgcgactccaacttcctcctgcaggtctaccacgagcgggtcaacacacacgtggcggaggccgagttcgactatgcgcgctgtggcgtccgggatgtgtccaagacgctggtggggctggagggcgcgccggccacgcggctgcgcttcaccaagtgcttcagcttcgccagcgtggaggctgagaacgcgtacctgtgccagcgcgcgcgcttcttcgccgagaacgagggcttggatgactacatggaggcgcgagagggcatgcatctcaagaacgtggactttcgcgagttcatggtggctttccccgacccggctcggccgccctggtacgcctgctcgtcggccttctgggcggcagccctgctcacgctgtcctggccgctgcgcgtgctggccgagtaccgcacggcgtatgcgcactatcacgtggaaaagctctttggtctggagggaccgggctcggccagtagcgtgggcggcggcctgagtcccagcgacgagctgctgcccccgctcacacatcgtctgccgcgggtcaacacggtggacagcacggaactcgagtggcacatccgttctaatcagcagctggtacccagctactcggaggtgttgcttatggacctggtcgagctgggctcacgctgcggcgggccagggggtagctacgtgcccaggtgtcg

SEQ ID NO: 24860 - DNA, 1281 bp, Mus musculus
tcggggattgtcgcgcgtagggggatgagggacagtggcgcttcggagagggaagggggtgggggttgcctgtggcctgagctgcccgcgcgctgaagggaacagaggcgacctatgtggctggacaggcggggccgtccccgagaagggaggaggttctgcctggcctgcgccggaccccctgagagagagggagagagaggctctttgtccgtccctctgggctgcagcggagggggcggggaggccactgggcacttccctggtacagtcccctccggagggcagagaggcggaagagctgcaaacctaatcgttgcttcggctgtcccagcagatggtgggcagtagtggtactcgccacactcccttccttgggagcaggtggagagtcacccgaagcccctccgcagtcctggacacagctgtggctcttccgcttcttgttgaatgtagcgggctatgccagctttatggtacctggctacctcctggtgcagtacttaagacggaagaactacctggagacaggtaatgtggccagagggtggggagatgagggaagtctggttgcaggtgttggcagagcgggacttgggccgggagggaggccagtaagtcagacaccggatcgggctggctgctctgcagaggttgtggaccttgactgtgtcttcttcaggcaggggtctctgcttccccctggtgaaagcctgtgtgtttggcaatgagcccaaggctcctgatgaggttctcctggctccgcggacagagacagcggaatccaccccgtcttggcaggtcctgaagctggtcttctgtgcctcgggtctccaggtaagaatacaggctccccttctcttccccagctgggtacagacagcccctgacttaaaccaaattttccctgcccaccccaaaggtttgttagtttgggtctggtttgtgtccctacaggacacagcccagtcctgaaagtgaacttccagcgcttccttcaacacctgtattgaaatgaaagttcactgtacacacgcatgtgttcatgcgcacgtccacgcgcgcgcgcgcgcacccatgcaatggcttctacagtgtggaagaaggcctgcctgagttgtattttttttccctatgcccatattctgctctgtctgtatgttgtatctgagtgtgaatttgaggaattgctggctaaacatatctccagagctgcttcccacattattattttgagacaaggtctcactctgcagccctaattactccagaactcactat

SEQ ID NO: 24861 - DNA, 3629 bp, Mus musculus
tgaggcagcaggctacattgtggggaaaccttagacgttgtattctataaaagtacattttaaggggtggtgagtgccagcacttgggtgagttcttaaggcaagcaaaggggctacacaggaatcttagcttgcttgagaaaccaggaacgaaaaaagcgtagttcgttcttgtattttagtttcagtttttcatgtcttgatttgttctctgtaggtgagcccattggccggggtaccaaagtgatccttcacctcaaagaagaccagacagagtacttggaggagaggagggtcaaggaagtggtgaagaaacattcgcagttcataggctatcccatcaccctctatgtgagtatgggcttggcagtgttggagcaggctaatggcactgggccttgctggtgctacattctccacaattaattacatgtgtcattggtgatttagttggagaaggaacgggagaaggagatcagtgatgatgaggcagaggaagagaaaggtgagaaagaggaggaagataaggaggatgaggagaagcctaagattgaagatgtgggatccgatgaggaagatgacagcggcaaagacaagaaaaagaaaacaaagaagatcaaagagaagtacattgaccaggaggagctgaacaagacaaagcctatctggaccagaaacccggatgacatcacgcaggaggagtatggcgaattctataagagcctcaccaatgactgggaggaccacttggcagtcaaggtgagaagccttcctctgttgtgtaaggcagggtaggtaggcagaagctggaggtggtaaggaataactggctcgactggttggtagctgggacctgaaagccacagaaaagaaccatgtgacaacactggagctactcagagctaacagtggtttcacattctctttctggtgggaatcagggtgtcagccatatctgacactggattactcttctcaatcactcccactgtcatggccaccaccctgattacagccagggttctgcttggcgggataattcttgctaccagcatgctgggtttatttgtgattagggctgctttcctattcatagggttcagcagtacagcattcacagtgctgtcagatgtttgatattggggcttgaagcagtcctgtcctaaaatgtattattgggttcatttcagcacttctctgtagaaggtcagttggaattcagggcattgctcttcattccccggcgggctcccttcgacctttttgagaacaagaagaagaagaacaacatcaaattgtatgtccgccgtgtgttcatcatggacagctgtgacgagctgatacctgagtacctcaactttatccgcggtgtggttgactccgaggacctgcccctgaacatctcccgggagatgctgcagcagagcaagatcctgaaggtcatccgcaagaacatcgtcaagaagtgcctggagctcttctccgagctggctgaggacaaggagaactacaagaagttctatgaggccttctccaaaaatttaaaggtaagacggacaagtgttctccaaataactttgtatttagggtgttttttccagctcatataattggatttttcttttaaagcttggaattcatgaagattccactaaccgacgccgcctctctgagctccttcgctatcacacctctcagtctggagatgagatgacctccttgtcagagtatgtgtctcgcatgaaggagacccagaagtccatctactatatcactggtatgtcggagattgggtctgagtaaagctgtcttgtggacttgggaaagggggaagtggtggtgtggaggccatgtggtggccatgtggccattgttgtattaatcctgtaggtgagagcaaagagcaagtggccaactctgcctttgtggagcgagtgcggaagcggggcttcgaggtggtgtatatgactgagcctattgacgagtactgcgtgcagcagctcaaggagtttgatgggaagagcctggtctcagtgactaaggagggcctggagctaccagaggacgaggaagagaagaagaaaatggaggagagcaaggcaaagtttgagaatctctgcaagctcatgaaggagatcttggacaagaaggttgaaaaggtgagtctcccctagctccaaatattttagtctgctgtacagctagaaatgtcaggcagcacagaccaggcacacacagactaaacagtaattattccatctaatgtatgtatgcaaggaaagggccttcctgtgttgcccaggttatccttgaatccctgtactcaagcaaccttcagtctccagagcatgtaagggggttagtcctctgcctgccatcttagtaaggttcttcatacatagcagttccattatggccaaggtacatcttgtcattgttcttgattgtccacaggtgacaatctccaataggcttgtgtcttcaccctgctgcattgtgacaagcacctatggctggacagccaacatggaacggatcatgaaggcccaggcactgcgagacaactctacaatgggctacatgatggccaaaaaacacctggagatcaaccctgaccaccccatcgtggagaccctgcggcagaaggctgaggcagacaaaaacgacaaagctgtcaaggacctggtggtgctgctgtttgaaactgctctgctctcctctggtttctcacttgaggatccccaaacccactccaaccgcatctaccgcatgattaaactaggcctgggtgagtctggcttgtgagctcctggtagcaagttgttgtactagctggacctttgggcagacttagtgctttgtggcttacttaaatctgtgtctttctcttaggcatcgatgaagatgaggtcactgcagaggagcccagtgctgctgttcctgatgagatcccccctctggaaggcgatgaggatgcctcgcgcatggaagaggtggattaaagcctcctggaagaagccctgccctctgtatagtatccccgtggctcccccagcagccctgacccacctggctctctgctcatgtctacaagaatcttctatcctgtcctgtgccttaaggcaggaagatcccctcccacagaatagcagggttgggtgttatgtattgtggtttttttgtttgttttattttgttctaaaattaaaagtatgcaaaataaagaagatgcagttttatacagtcctgctctccttgtaacactcagggcttcctgagtggtgttggaaggtgatgaaaggcagttacttgtccatcaactattaatgccaaccaaaacacaggtccaaagtcactgctgcagtttaatcaaataagagcaaaaggtgacatttccaagtaccaaaacttgggtaggaacactggggccccaactgggctgggggcctttgtcccttctggcacagcaccattctcactggcccctaggggaactgcatgacctgtaaacaattctcttcccagctggtgcctggtagcctcaagggtgcgtgctatgagcaaagccctggtgctggtttgcttggccaccagcaagatttcagagattgggggaggagctctgggtc

SEQ ID NO: 24862 - DNA, 1228 bp, Mus musculus
cccagcctgaagctgtgctgtacccgggagggtggggatgggggaatcgggggcctccttaaagttggacaaggaatttatcatccttttctcttgatgtgcgatttgtagggaacattctagtaagatcgggtctggaaatggcagccgagttggccacctccattctctttcagtcccctgagttctggactcttggggggtgggggggtggaagcgcctaccttgagttttctgaggcagtccgtagggtattcgcccgcagatacatccctaattgcatatgcatgctccctgctcatcttgaggggggacatgtcctactcctgcagaaatgggggatgtgcaaaacgatattgaattggccttgactcaggaaccaggcccggggtcccgctcctccccgccccctccacgatctgctaccatgacgtcaaggtgggcgggcggcggcaggtgcgtggcccgcagccactcctttaaggcggagggatccaagggcggggcccgggctgtgcttcgccttatatagggcggtcgggggcgttcgggagctctcttgagtcacccccgcgcagcctaggcttgccgtgcgagtcggacttggtccgggcccaccaccctgctctgtactactactcggctttcccgtcaaggtaaggccggggtctctcgtccccggcggctctccgggggcttcttcccggggtcccagcctccatctcatctgtcccaaagcctccttccccggcggggcagcctgtggagataacgtgtctagaggttagaggttcgggctgtaccccggcgggcttgcacgcgaggctccccggggcgggtggattccccggagcgtggggtgggggtgcggcccggccaggtggtgggcggccgcacgtggtagtcgccgacccgggacgctgccatgtttgccctccacttccgggcgcggctgcagggtccgcgcggtggcgggctgctctgcgtgactcagcaaggcctggggaggttggcctggctgcctcccccggacgccgccggtaccaacgtgcttgattttggggaggggtgcacagcagggacgccggaacccaccgcgctttccctttccagatctttctgccctcccagtggagggcgggggaggagagacagagcaggcacgagaagattcctaggtccctccctttctcctcccctccccggagctcagattgttctggaagcc

SEQ ID NO: 24863 - DNA, 1463 bp, Mus musculus
tggctgccggttttggtcgcctcgaggattgtgtttattcccctgctgatgctctgcaacgtgaaggctcgccactgcggcgcgcagcggcaccacttcgtctttaagcatgacgcctggttcatcgccttcatggctgcctttgccttctccaatggctacctcgccagcctctgcatgtgcttcgggcccaagtgagtcgggccatgaggggatttggtgacatcaggcaggacttacagggagatggcagtaggagagtccctccccatctcatagctgcacggagttggagttgctggggggttttaaggggcagtggaggtaagggcttgctaatgtgctcctgctgagctgtgtgggaagggattaagacagggtggaggatggtccctagacacagtctcccaagaagtgggctgggattgggagtgttggaaggtttgggggtggggggacagggctgggctcagcttgcctaagattaccctgcctttccttttaggaaagtcaaaccagctgaggcggagacagcaggaaacatcatgtccttctttctgtgtctgggcctggctctgggagctgtgttgtccttcttgttaagggcacttgtgtgaccctgtggggacagaagaactacactgcctgcttcctgctcacttccttccctgccagggacgagcaggggtcgagaggggctgttcttctagctgacttctgctttcctctggactgtgcttcgcccagctgtccaggagccagcgatggcctgcgggtggacttggaattcagggtcagaatggcaagggctcaatggcctctgactgacagctccgactgatgcccgcttactccaagcacaagagactccagggccaagagagatctgtccgcctgcctatcacaggatagggcggaggcggatggctgattggtgtcgtgtgacctgatgtccctccccttgcccttcttccttctgtgcctgttccatgtccccagcccttgtcattttactgccttttttatactgacagaaaccaggtgccttcagaggccatctgattaaataaacattttttttctccatagctctgtgcatccttccaaggtttaactaactccttggagaggagagaaggctggcagcctgagtctaggtttctgcaatgacccaagcctgggcctgggtataagggggaggatgcagtccttcagtctcagaggggctgcagcgccccctactggggacacagggaagagacaggcctggagccaagacgccacccagactgtggcccagatttagaaagatgtagcccgagtggtcttcacattccataagtacctgaaggtggccttgaaccgcttcctatgtgctggtactgcagctgtgtaccaccatgtcctggatctagggatcaagtccagggctttgtgcatgctaggcaagcgctctgctagcc

SEQ ID NO: 24864 - DNA, 1102 bp, Mus musculus
aggctggccttgaactcagagatcagcctgcctctgcctcctgagttctgggattaaaaaggggtatggtaccagtgtctggctctttggtcttttgtacacagagccatgacaacctagggccctgtatgaatctctcttctcttctctctctccagatctgtgtcccggctctgtctgtctgcttcatcttcacggttaccattgggttgttccctgctgtgactgctgaggtggaatccagcatcgcaggcacaagtccctggagtatgtgtgtcccttgccccctcccagcccccccccccagcccccgcacttccctcctaggacggattcacccagagtctaaagtggaatcatgggtggggtatgggcaacctctggggctccctctgcccagctggatctacacgggcctactagacaccctgccattggatggaaacctctgaggcagaatgaagagtcctaggcccagagagggccagttgctaagtcttaagtctctttcctagaaagctacttcattcccgtggcctgtttcttgaatttcaatgtctttgactggctaggccggagcctcactgctgtctgcatgtgggtgagtacagcatgggcggcagggctgtggggttcaggtgtccagctgaggccaagagggaacccaagaaagtatggtggctgcagtgtggctctgtgactgatagagggcttgctagcatgcatggcccctgggtcccatctgtaaaactgcaagaagggaaaatggagggggtggggcagtggctcaacaggttaagagcactgactgctcttccagagatcctgagttcaattcccagcagccacaacggtggctcacaaccatctgtaatgggatctgatgccctcttctggtgcatctgaagacagctaccagtgtactcatcaaaaacaaaaaacctgcaagaagggaaaaataccgtgtactactcataacttatgtgtaactctgtgtacaagttcattcgtttgtttatctgtctgtagaggcagggtctctgtgtgttgctatctgggaatttactctgtagaccaggctggcctggaactcagatctctt

SEQ ID NO: 24865 - DNA, 1222 bp, Mus musculus
cccaggcttcctttggatgaaggctctctccacccctgcaccttataccccattcgggtcctcttgccaagcctgagccaaccccctcttctccattaaccctccttccgtcctgttcctcttgtcctgcttgtgtgacctttgcatacaataatatatgcgtggtggaatggttgtgagttgtcatgactctgaaactaatgttatgtgaaagaatggcctgaatctcccacttgttttaaccctttaattggagcactgttgccttcctggaagcctacacgaatagctgaggagccttgttaattttgccttccccacttgagaaggaatctagaatgatcggtacattgagtattgatgctgtcacccccattcaccagctctgcgggctttctcaagtgatggagcctctttaaacctcaatcgccctaactgtttagtagaaacggggcagctggaagaggggcatcctcagatttcaagagaagattccgatgtagcagaaactaggctgagaaactgagctatgtgagaggacccttaggacgcaggaaggcctcagatgggcgatagctttcagggcctctccatctcggcaggtcaaggcatggctgaaatgataccagaggccctgaactgctatcagatctctactgggacaaaagtaaagaaagcccctaagcagcaaatggaatgtttggatgtgggtggaacccgagaggtgggaatttctgcaaggggagaagtgatgtgtgtgtgtgtgtgtgtgtgtgtgtgtgtgtgtgtgtgtgtgtatatgtatgtgtatacttgtccaagcctaagccagttttatgatggaagagttagcctccctctggcttgtggctgtattcacttttgctggtgcatgggagaggtgtggggtgctcggtggagaattagctatgttttgatggggtcccttccctactatctaatagaaacctgagtcctcaggctccccgcagccgcagcagaaccctcttgtcctagataaatagcagtgctactgtttgctgctgctctgtccccagtgcctaggaggatgcctggcggacccacagagaccctcagcaaatagtccttaaccaacagcaggagccttctgcctccttctggaggtgtgtggctttgctgtccagtactgagggatttggcccgtctgggtttcacccacagcagaatagaaaagcggcta

SEQ ID NO: 24866 - DNA, 1187 bp, Mus musculus
gaattgaactctgcacctctggaagagcagccagtgctcttaaccactgagccatctctcgggccccttcatttttaataagttcactagctaccctgttcttggcttccccgttgtgcccaccttgtgaggttagaacaaggacagagtgactcatacgcagaaaaagcttcgaggagcatgggctgatcctggctgctgctgtgggtgcctcccggctctgagcagaaccccaccccgccctgccgtctgcaggtggaggccattgagtactacacaaagctggagcagaggctgaaggaagactacaggcgggagaaggagaaagtgaacgagaaacctctgggcatggcctttgtcaccttccacaatgagaccatcacagccatgtgagcaccccgccccacccccatcctgcccgccaccctcggccctctccctctcacagggccctgtactcaccactgtggaccccagtctgggctgaagtaacaagtacctgttccccccagcatcctaaaggacttcaacgtgtgcaaatgccagggctgtacctgccgcggggagccgagagcctcctcctgcagcgaagcactgcatatctccaactggaccgtgacctacgcccctgaccctcagaacatctattggtgagccacagagttggggcggggcttcttacagactgagggtgtggctgtttccaggagcgtggggagagggtggatgctgccagaggccagtcagtccagagtcttcaaagtgacccctcccccactttcccagggaacacctctccatccgaggcttcatctggtggctgcgctgcctggtcatcaatgtggtcctcttcattctgctcttcttcctcaccaccccggccatcatcatcaccaccatggacaagttcaacgtcaccaagcctgtggagtacctcaacgtgaggcccatgcccgcctcccccccccccccccagctctccatgatgtgccatgcgcatccccctcatccctaacatagctctgggtgctccaggtgcttccaggatgctttctaaggtcaagggctgctatcccaacccgccatgtcctgtcctcaggaaaggccgcccttgggtttacatgtcctagacacacacacacacacagacacacacacaccaggagggtgcaaaaccttgggtaagc

SEQ ID NO: 24867 - DNA, 1215 bp, Mus musculus
tcctggacacagacccagtttttacctccctctgagctctcaggaacgcttctggagtgacagacatgattcagaacggtgacaggcaggcaggcaggtatgctcctgctgggaactggggagcaggcttggcttcagactgatttgagaactgaagtcagcagttcggcatctcaaggccttgtggccctggctccgcctctgccttgccctaccaaccacctggccaggcacaggcacgggcagccaaaacagagcttggttgctagggcactggcagggatgccttgcccgataatcccggcctctctgggaacccagtctccccctggccatgtctgtcaaggccatctagcttggcctagatgccagctgcttcctctgtcgtttgtccccttcctgtagcccctctaaagccaggaatgtcggctcctttcccactctgcttctgtggcctccctgagagatcagcaatcgggacagaactgtaagggtcaggctgcccgggtccagctctggacctgctgtgtgactttgggcagttttgcttaacttctatgagctccgattaacttactatggacatcaaaataggctgctgtgagagttagactggagaggagttagaacatgggaagattttttaacagcgatgcatttgagttccatgtgcatttggttaacaacattcagatgtcttctcagccgttcctttaaactgatgagcacagagccgattctctgggggggggggggttggggggagggagggaactagtagggcagttacaaccaccatgatccccagccctgctcctctaaaacccagagcgggctgtcaggtcttgctccaacccttccttcaaaccatccctgggctaagcaggagttggaagaagcccctctcctcattctaggatcccgtagaatgtgtggtctctgagaaagagcctgaagctgccggctccagccttgaagctcactgaaaaagctcgttggtatctgggcgctgaggctcaattctctccctgatacaccgaatgactgtgttgtttctcttagtctttatcattccgttatccttagtagggtccagaaggttccttgcaaacacatcagtgtcgattaagcaattaagcagcagaaacagacttccttatgctgttctgacaaccccccacccacacacacacgatgttcctgcccatagcttac

SEQ ID NO: 24868 - DNA, 1185 bp, Mus musculus
ggacccgtgggctcccaggcctggggaggctgcttgccttcactgccaggctcccgtggccctaaccccctgcctctctttgccatttcccatagatgtgacaagccaaggcggtgagccaggctgcaggaaggagcctccctcagggtttcgggaaccagacctctcaccggaaagaccgattaaccatgtcaccaccacgccatcatcgtcaccgttgacagaacagtccttaatccagaaagcctgacatgaaggaagaggagactcttcgaggagcactttgggtccggagggcgagactccggcagacgcattcccgggcaggtgaccaagcacggtccctcgtgggactggattcgccattttcttatatctgctgctaaatcgccaagcccggaagattagggttgtttctgggattcctgtagacacacccacccacatacacacatatatatatattatatatataaataaatatatatgttttatatataaaatatatatatattcttttttttaaattaactctgctaatgttattggtgtcttcactggatatgtttgactgctgtggacttgtgttgggaggaggatgtcctcactcggatgccgacacgggagacaatgggatgaaaggcttcagtgtggtctgagagaggccgaagtccttttgcctgccggggagcaagcaaggccagggcacgggggcacattggctcacttccagaaacacgacaaacccattcctggccctgagtcaagaggacagagagacagatgatgacagagaaagagataaagatgccggttccaaccagaagtttggggagcctcaggacatggcatgctttgtggatccccatgatagtctacaaaagcaccccgcccctctgggcactgcctggaagaatcgggagcctggccagccttcagctcgctcctccacttctgaggggcctaggaggcctcccacaggtgtcccggcaagagaagacacggtggtggaagaagaggcctggtaatggcccctcctcctgggaccccttcgtcctctccttaccccacctcctgggtacagcccaggaggaccttgtgtgatcagaccattgaaaccactaattctgtccccaggagacttggctgtgtgtgtgagtggcttacccttcctcatcttccctt

SEQ ID NO: 24869 - DNA, 1203 bp, Mus musculus
tttctgtttttatattttccagaaaatcagttcgaggaaagggaaagggtcaaaaacgaaagcgcaagaaatcccggtttaaatcctggagcgtgtacgttggtgccgctgctgtctaattccttggagccttcctggtctccagacaatcgcctgcagctcctctaaccctgcccaccccacccctgccccacccctacctcccctctggctcttgccctgcctcagtctctctctctctcactcaccccactaatggcaccaatgggtagacttggtggtggcattgttggcccagggttgggttggggtgggtggaaggtgagtagatacggaacactcaactcagggaggggactctggcttggctgggcaccgactttctctcacccactgggcattggtggcggggccgttgttggcatgggcactgggcatcagggccctctcatccaactggtttccactgctctagactcttgcacatgtctggagggtaggggtggtgtggagggcaacgtggaatgagttgaggggtctgttggtgggaagtggactgtggtgggctgaagttggagcttgagcgggctgtgcggtagcccgtcctcgtctgttggaaatgctttgacccctgggtttgaggctccaggatgggaaagccctccctatccagcccaacagaaatcacccacagaggtctcctacggtggcctcttcctctgcttataggctgttgtgggctctggaggcctggctggtggacagtgccactggacttggattaccttctgctggccctctcccttggtggagggtctgggcagaggcccttttccagggagaaggtaccctggtggtctcctgggtcacttatcactgtccccagcaggtgaagagtcaaggtgtgttgtgggcacagcagttgtgggggccctgtggccccagataggcccatgtcttcgtggggcacagcactgtccctcatggaagcttaccctccccctgcactctgcctgcctgtgccctcctcttcctgcaggcacatgtcctgccagcgctgcgtctctttgccactctctctgtcttctgctagagtgctcggatctttccagaatgtggaaagggcctaggggccgacgagctgggtggggaagccgtggtggacacattagggggtgttgcatgggactctctctctctctc

SEQ ID NO: 24870 - DNA, 1214 bp, Mus musculus
ggattcttctctgccttcctcctgcagtgtggatgtacactgacaactcttaaaggtcaaggggatgggcctgggctgccagactccacctcagccctgagtacacacacttgtagccgcaagagcccagcccatctgtttacaaaacagcagtcccctcccccaaaaatgctttgccttttgagaaaggaaaactggtgagggaggcagcacagccccagggggcagtgtccggctcttcctgccccagcaggcaacctcttgtgttcccactacagctatctgactcgctgggctcccaagtccgtcaagcccatctataaaaaaggccaccgttggaacaaggtgggtatggccgtggggtcaccactcctgaaagacaatgtctgctactccagaaggcctctgaagatgatgcattagtgggagcaggacttctgaagagctgactagaaccgtctagaagatgcacttgctcctcccaccagaaccattatcctccacaacagcacagagaactaacttctgtgccttggatctgcccagctgcaatgttggaagccaagggcagccaggagctggatctcctggccactgtggtcttctgcctggctggggctgaggttggagcagggacgggagccttacccaaggcaatgtaataaagcaggctcttggcttccccgtgtggtcagtgcttagaaatgtggggcctgtgcatagtagggaactgcctaatgggccctgtcagtggacctggggcaggtccatgtgccacacaggtcccatcgtctgctgacgggcaccacactgcagtgagggcctagtgactgtcagttactagcagctttcagttgaatccaggaatttgagcgggcccctaactgccccttcacaccatctccacccatctacacttgatgcctcctccttcattagctcatcccaggcctctgcttcttggttcagaattgttttctggcctttcatagccaggtgactagattgccagagggacaaaatgacaacaatcaagacagaacaaaaaggcccaacagttgaactttatgaaagagtgtttcgaccccacataaatatccagcctgccttcctacagcatgaagggcaagtccatgttcttctctcctgtgcctacgtagatgtagccatagttcttggtgcgaggagcgtggtagaaggtgaggcctggccag

SEQ ID NO: 24871 - DNA, 1155 bp, Mus musculus
aatttggagggctggagagatgtctctgctgataaaagagcatttactgctcttgtagaggcccaggttcatctagttccaagcacctacattgtagctcactaccatttgtaactccagccccaaggaatccagagccctcttttggtccctgaggaactaagaactgtgcgctgtgtggtgtacagacatacatagatgcaagcacacattccccccattttctttttttttaatcatgacggtaggggcttggagggatggcttagtggttaataaagcttactgctttttcagacaaccagagttagtgcccaacaccaggctgacttgctcacagccgcttgtaacaagctccaggggacccatggtctcttttggcctctgaggtcacctgtactcatatacataccccacacagacatgcacatacacttagctgaaaagaaagtaaatctctgtctaaacaaagatcatgatagaacttttcttcctcccctcccttcagagcgctgtcagatattgactccttcattgcctatgtgggtgctgatctgaaaagctgtgacccagctgtggaggatccatgtggcttgaaccgtgcacgagtaagactctcctgggaatgggaagtttcactggccacgggcaggagttagggtgtttcattgatcaagtttctcagatttgttttgtctgtactgctgagagacccaagagtctctcctgccctaagcttctcctttcttttcttctttagtcttgaattcttgagttagttctcacaacagagcagatggtcttttctatgaagtcattattttggctttaaggatccctaagtagctcggaagactggaggtgtaatgaggaagtaggtcagacttggtggcagggtgagtcccccctgctattgctcgctggcatgtgaagtcctaggtgatggccaaatcttgagaccctgaggccttccagtgcaccggtgctcagataagccactacggtgaaagacacatgaccagcctggcatgaggggttgggggttaggatgcaggctgtggagtcctggatggagggtcaggtaaaaaaaaaaatggcagtttaaatacttggtggtggagctcatccaaaccacccctaccccagggtcattaa

SEQ ID NO: 24872 - DNA, 1234 bp, Mus musculus
tgtgggattaggtcctgactcttttgagagggaggctcatctttctaaggacagttggcctccctgtgtgaggtgtgctctctccataggcataacagtgttgtagtatcctgttttagttttcaagacagggcctctctgtaaccttgactatcgtggaactcactctgtagaccaggctggcctcaaactcaagatcggcctgcctctgcctccccagtgctgggattaaaggtgtgcgcagttttttattgttggtttgctggagactgacatgggccttgtgcatccgaggccacagtgtaccactgaggtacatcccagccctctcttatttccttacagcttatacctacttttaaggttattttgtctaaatttttagtaggaaggaaacggcttgttgggagcgggacagttggtttctgtagtagtgtttctccagatggtgtccatgtgcactagtagaatttctcaccaatgactgaactcatgtaggccaagcatccgatggctcagcaagccagaggagagcaggatgtctgtcacctcagtttgtgcagccttcactgtgagacctgtggcatcagcagctacctgagcccttgctcaaaaagcagaattagggacgcactgcagactgtaaatgttaacaagctacctgggagtttcatgtacacatggaagagtcagcagcgtcaccctaggtcacaggaactgacctgctcacatgagaggtgctcaggctaggcttgttgatacttttaaactatagaagtgaaacatttaaaaaacgtgcagtccttggtctctgacttctattgctcaacatcatggtgtgggagccatgagttatgtgtagctgggtctgtttcttcttcccgtctatgtggtgtcctgctatgtggctgtgctgtttcttattgatcctggtgggcttttggacagaattttgataacacgcatacagtaaatttaataataagctactctcaggatcttgaaagtgtacttgtaagatatttgcatattcttgttggttatacacgggagggtagaaatcctgagttgtaggcatgctcattacagccacatccgaaagttttcctggctagggcagctttcagatgtggctgtaatgagcatgctcccagcaacggcatacaggaatgatggaaagtttttggttctttctttttgttgcttttgaagcagtgtaccgccagcccttggc

SEQ ID NO: 24873 - DNA, 1202 bp, Mus musculus
tccaccgagtcagcctggagcagctcagatctgggtcaagctggagtagagtgggtcctgcgcgaggacccaggtcatcctactagagtgcagggtgttgggacctacgccattccagagaggtggcgggagctggtagccagccggcagtctgggcttttccaggaaaagctagagcacaagggcctctctccagagcagctgcagcagtgcagacagacagacagaaggactggggtgctgtgcccaacccactgaccgtgtgtgcaaggtctcagccgctttcttttggactacaagggtcccacttgagccccttgctgctgggctaacagggatccttttccactcccaggggcatgtctggcctaggtgctacatgctgacccgtatatggccagttttctcagtctaaagcaagaatctggccacttgggaacccatggtacagagctattgctaaagtctgagcgcactgtccagggaacaagagctaaacagaattcagtctaacactctgttccttaaagtggacatcttgcctttctctgattgaccctcgagggtttccccagtgtctgatgacaccaaccatacagaagtaatccagaccaggtaggcttctgacaagttagccaagcagccactgtccctcctgggacagctgagtccaggtgccttggaaatctcagtggtctcttaagcttctgaagactctcttctcaagggtcatttctaaaagtgttccagtcagagccaacacttttaagtccttaaggtccctgggaagggcacaaagcaaacagagcaagatgggcgagacctagtcctgcctatttctctggatgttggcacgcccactgtccacccagccccaactttgacctagtgtgggacacagtcatgcatagtaaagttgcaaagtcagagctgggaaatagcaactagaatcgaggtcactgtccaccctacagctgcacaaggccgtcctcctcctgcctggtgcttggggtctgcaggttgtaaaggtgagctcagtgttgccctccacactcgatagctgcctgctcctgtctgcttagggctgtggaggatgtagttgtatttattatgttgtaatatttttaacatcctatgacttcatgctagaaattttctattgtttatagaaccttttgtagaaatgctaactaaagtacatc

SEQ ID NO: 24874 - DNA, 1427 bp, Mus musculus
gtctacaccaggcatatgacatgggtccccttgggaaatcaggctgatgtcttcccagagggcacaatccgtccagtgcacgacgacatcctcatcgctcagcttcggcctggccaggaaattgacttgatgatgcattgcgtcaagggcattggtgaggacctagtgagcccgccctggggggtgggccagtctgattgcagcaatgcagtcgaaccaggagctcaactgggatgttagcagcaggcagaaagccaacatgcttgtgttgtcccaggcaaagaccatgccaagttctcaccagtggccacagccagctacagactgctaccggccatcactctgcttgagcctgtggaaggagaagcggctgaggagctgagccagtgtttctcccctggcgtgattgaggtggaggaagtacaaggtgtgtttggtgcgcagtgggactaagactaaggtgttttctttgaaggtagaagaaaaggaaagctctcctaacaggcaagctaccatactgtcttccttaggtaaaaaggtggccagggtggccaatgctcggctggataccttcagcagggaaatcttccggcatgagaaactcaagaaggctgtgcggcttgcccgggttcgggaccattatatctgtgagtactccttggataggatttagaactagcctgtattagaggtaaaatcctgctgggactgaatgttttctttggcctctagtttctgtggagtctactggagttttgccaccagatgtgttggtgagtgaagccatcaagatcctgatggggaagtgccggcggttcttggatgaactggatgcagttgagatggactgaagcttacacacatacctgggagggcgtggctgctcttggatcttttgcactgctgtgctgttactagaggtccctttccagtctcatttccagtcaatacattttattaaatgtgccacagacacctttgcctttgtaaggccgttgttgtaaataaattgctcttggcaagttcttttcaggctttttttttttttgtctagtaatgagccttgcctcagcaggttggcattggcaaggaccaaggttcgctgcagctgctgagaaaggccagatacagagagtgcactgccctccctccacctagctctcaggcttccaaccagggctgccattagtcagccatgttgccactgtcagctccagagaagacagctagtgtcttctggacagatgctaagtgtgcagggctttgttggctcatcatcagggctttctgattagtacccctaacagggtgcttggaagagtcactggtttgaaaaaggaaaatagggcccttctgtatgaaacagatttttactgacatgcagatgtactttagttagcatttctacaaaaggttctataaacaat

SEQ ID NO: 24875 - DNA, 1099 bp, Mus musculus
gtgcagggtaggagccaggcaggagtcatgcaggagcttccctccttctagaatttccgtgtggacgtggtgcaaatggatgaagacacgctggagttcgacatggtggggattgatgctgccatcgccaatgctttccggagaatcctgttagctgaggtattagaggacgtgggctggagggtagaaattgtatcaatttgtagacgcttttctcaaagccatccctctggggcaggtagggtggttcacacctatgacagtctgggctacatagtaaacattgtatcaagaatctgagccacacgcctttagtcccagcaccccagcactcgggaggcagaggcaggtggatctctgagttccaggccagccagggctatacagagaaaccctgtctcaaaaaaccaaaaaaaaaaaaaagaatctgaagggcaaaatgaaaaagtgctgcctcttccttttccaggcagggggatgggtggaggtcagttgtctgctttgcctccttgggcaggtgccgacaatggccgtggagaaggtcttggtgtataacaacacgtccatagtccaggatgagatccttgctcaccgcctggggctcatccccatcctcgctgatcctcgtctctttgaatatcggaaccaaggtgaggctgagagcttgggattatgagttaggcagaactgacctggaatgcatgggctcaggtcccaggcctactgctggggctttagttggcatcttgtacatctgccttcgcctgggagaacagctgtccccaccccacctctagtctcactgtgtacaccctcggaacacagcgctagcagcactcaggctctctccacctttacattcttcctggggattgaacttgggtcttcaggttggagcaagcatgcaccctcactctgtgagccttcttgtcagcctggtattagagttgatatggccaggcacggtggtggacagctttactccaagcactggcagaggcaggcagatgtgtcctgagttcaaggccagcctggtctgcagagcaaattgcaggacagccagggctggtaaaacccccgctcaaacccagcccacccc

SEQ ID NO: 24876 - DNA, 1165 bp, Mus musculus
cccttcggcgtcccggcggatccccaccttgcccgggcggtcgcccctctgaacctctccctccctcggacccgggtcgcacgctcttcccacgcgcgcgtgctccagcgacgggaagcctcgagggacatggcgactccggcggcgccggccagcggcgtccgaaatggtgctggcccggaatggggaggcttcgaagaaaacatccaggtatggagcgcgcctgctgccagcagccccgggctggcggcgtccggacggtggctgctgttctctctcgcggggcctagaggtcggctccgctgaaacgcagcctgtcccctttgagtcttcccggggaagggtgtagctcttgtgctggcgtgaaagggacaaactagggctcccgcgggcctcggctctctgtgggggctggaggctaggatccactggcaccccctaaaaataggcttgtttgagaattgggaatggcagatgggctcttttgcaactctttggagctttgaggtggaaagtaggaaaacaacgtggattgaaaataaatagtagggtttccaggaccacaaaagtgacgcgaccaagagttgccaccactgaaagagtggcagttccaagccatgtcctcggcagtggaagatcaaagcctcaagttgtcagctgagcggagaacggggaggatgcaatggaagggcccctcactctccgagccgttgtcttcacagggtgggggttcggctgtgattgatatggagaacatggacgatacctcaggctccagcttcgaggacatgggtgagctgcaccagcgcctgcgggaggaagaagtagatgctgatgcagctgctgcagaagaagaggatggggagtttcttggcatgaaaggctttaaaggacaactgagccggcaggtagcagatcaggtaagccaatggggaaaaaaaaaaggacctatgcatgtcctaaattgatcgaggttttccacttagacccacacgtaaatctcgccgagactgaataacaatctagagccaagagtctcatcatacccatttcccttcagatgtggcaggcagggaagagacaggcttccagggccttcagcttgtatgccaacattgacatcctcagaccctactttgatgtggagcctgcccaggtccgaagc

SEQ ID NO: 24877 - DNA, 1099 bp, Mus musculus
aggtgaggttgcgtaggtgcttataagctgagtgtacagggttgactaggaaatggtgcccagccagcgcttttgctgtgggtcaggctatccttagtgaggccccttcatgtctctctcccttctcttctcttagctaccctgtgagctccaggacatggttcgaaaacatctgcgcagtgggcaggaggttgccagccccagccccagcccttcttccagcctgtccccaggggctgtggtgcctacctcagtcattgcccgggtgttggagaaacctgagtctctcttgctcaattcagctcagtctggcagtgctgggcgccccttggctgaggatgtattcgtgcatgtggacatgagtgggggtgacccagccagcccccctgccccgggcagccccaatggggagtgttgctcagtgagtactgcagggggctccccggaggaggagctgcccctgccagccttcgacaagttgagtccctaccctaccccgtctccaccacacccattataccctggtaggaaggtgatagaattctctgaggacaagatccgaattcctcggaacagccccctccccaactgtacctatgccacccggcaggccatctccttgagcctggtggaggacggcagtgagcgggcccaccgcagctcagtgcctagcagtcctgcctctgcccaagggtcgccccatcaccagcctagtccagctccctcagcactgagtgccccagctagttcggccagctcggaggaggacctgctggccagctggcagcgtgcatttgtggaccgcaccccgccccctgctgccgtggtccagcgcacggcctttggacgagactcactgcccgagctacaattgcatttctccccgggccactccacagccccaccgccttccccgcaccgtgagcggggacttgtgctgccagcagaacctgactctggctttcctcaagacgaggaagaggaaatgctgaacctgcctgtcagccccgaggaagagcgtcagagcctgctgcctgataaagagggcaccgaggaggcctctggcccttctcatgttgatggcagggcctggcctctc

SEQ ID NO: 24878 - DNA, 1158 bp, Mus musculus
catgaactgagggcccacccttacaaagagtccttgcccagctgctggctccagaaaacagtgaccagcctgtgccagcgtctgcatgccctttctgtcaggcatgtgaggcctcctggaggacagcagtgctgtcctggattcccaagagattaataatggagaaggctgattgtgaggggaaacaggagctgtagggcttagtgcctgctggcctgggtggtaaccggagacagtcgggagctatcgcctttgattctgacccagtgcgtttctatactggggaggggccatctggactattgtgcgtcatacactcggtcccgtctccatcttaggctgttctcgaggccagagggcctgtatattgcgtctccttacctagactgagcctaaagggacccacttgcctgtctgctcctttctcactcttgtctgctgccctagggttagctgtttttgatggttccatcccccacctccccaccctccaaccccccagacttttgcagcaggagaatgaagaacttcgcaaacgcctggcctcagctaccagacgcactgaggccttggagcgggagctggaaataggacaagactgcctagaactggagttaggacagagccgtgaggagctggacaagtttaaggacaaattccgcaggtgcggaacaaggggccaatcgtctcccatccgtgggagcaccttcctgtccatacgttagctgaagagcctcaggtccccctgactttatttagtaacccagatcttggaaggagagggaagttcctagactcccatgtggaggagggttggtggggcctgaggaacaggccttaaccagggctctgcctttctctgccttgttggcatgtgtaggctacagaacagctacacggcatcccagcggaccaaccaggaactggaggacaagctgcacgcactggtactgtgctgggagggtggtgtggccacaacatagcgcgggctaggacttccgggggggatgccactcaccctggggcctggggaggagagggaaggcagggcagtggtggggagggcgcggtgtgctgcgccaggcgggacagccctaatgctcacactgtctctcttctctctccgtctccctccctcatgctgccaccgctgctgct

SEQ ID NO: 24879 - DNA, 1205 bp, Mus musculus
gtgcctggtcatcctcactctgtggggtcctcagagggctctgtaggtcatctgtctggcagtgtgtcaccttttccttgagtggccccactttggggcttcgtcacacactgctccattgtacttgtgtattctgatgcagctctcctccaggctctgactccagctcatctcttatagttcttcgcccagagcctgtggggttggggggtggagtgcactctgttggcataggcctggatgagtggcaactgcatctgggggcagggggttgttcttataagccagtgctcagagtcctggtgcagcctggcagtgcagttgggaattagggagacagggagctgctttccacacaatagctgccttctcttgatcaaccagagagccttgtgtgaattagtaagctggactcactgttggcaaggtggggtgttggtcttcctccggagtgctttctggtggcgggaagcccctgagatgctttcgcccacaaaagagtactgtatgtgccagaggcatccttcagtttggtcttctgtgctctctctttgcagctccggagttgagctgctcacacaccaagctgtctgtttttatggagtgcctggagggcgtctgccatgagtctgttgctaacaccactaaccaggaaagctggctggctgaggagaagacactaaccctgtgagtctgaccttggctagctaacctgccctggggggctgcccgcagtgtctctaccagactgactgcctcctttgcttaggcttgccacctctgctttctgggtcttttcctttcatctttccctcatgtggagatatagatacctccatggtctttgttccttttctgttgctgcgtaaatcaccatgaccaaggcaactcggggaagaaagcatttggttgaggctctagtctcagggttggagtctatgactgtggagtgaaagaacagctgagagctcagatcttgatccccaacctcgaggggagggagacggggagtgacaaagaggtaaacagacaaacacacagcaacagcctctaggaatggtgagattcacttgaaaccacaaagcccacccggtagttgtcaaggccacaccacctcatacttcccaaatagtcccaccaactgggaaccaagtattcaaatgcatgccagtctcattcaaacagccacactcttgatgggcaga

SEQ ID NO: 24880 - DNA, 1192 bp, Mus musculus
tcctaccaccaaacgttcactcgaggcggaggccttcagtcagagccgctagtctagctgcagtgtgcccaggggctcaaggactgaggagattcagcttcagattcctttctagaagtttgggaaccctttttcttttccccctgaagagaatttgtgtgtatggttccttgggaattgtaatcagttagaattgtgtgatagccaggcacggtagcacacacctataattctagcatgcaggaggctgaggaaagaggattggtagtttgaggccagccttgtctacatagaccctgtttctgaggaaagaagagaaagagagagaaaaaagggggaaaagagcagtacgttgaatgttgagcagctaagagaattgagctggtatacactagtgactttagtattcgaccatggaggcagaaggatcaggagttcgaaactgtccttaagttacataacgtatttgaggctagcctaggctacttggaacctgtttcaaaaacaaaagaacaaaaactgatacacagagctagcttgctagttggatcccaactgtggctgtttgacttacctatctatctttctttctttttttttggtttttagagacagggtttctctgtatagccttggctgtcctggaactcacgctgtagaccaggctggccttgaactcagaaatccgccagcctctgcctcccgagtgctgggattaaaggcgtgcgccaccactgcccgacttgtttgacctttcttaattgcatagttctatgcacctcagtttctcattgctcagtggaggtagtaagagtacctatctcatatgtgttgtaaaggttcatgaatgtgcttcaactctccctgacgcctgataaaatactgttatgctcgtcggatccctgcgattggccctgtgattgatggaggatttgtaccggtgggctgctagcctgatgctacaaagatgcagtgccaccttttaagctgcgtaaggcgatgtcaggatgctgaggctggaagtttttgtctttgctggggagcaggaatactgaggacgttctcttctggaagcactctgcgtgcaatagctacttttttgagtagcagatatatgaagaagatctgctgtttaccgtcctatttcacagataaagaaatgaagtacagtggttgagtcatttattcaagg

SEQ ID NO: 24881 - DNA, 1180 bp, Mus musculus
ggagctgaaccagaggtgccagtttgcttcctatgccacgatgcagtggttggacattcgactgcagctcatgggggcagcagtggtcagcgccattgcgggcattgccctggtgcagcaccagcagggccttgccaacccaggtgccatccccggacccatcacccttacttcaggagcatgacattttgtatcgttgttccagaccccttgcatgtctcctaaccccctccccacccaccccaccccaccgttacctccaccagtgatccctgagaggatgtgtcatcagcaccatcatcaccctcattttaatgctaaggaagccacaggcagtggaggacctgggatgtgatcctcccctcactcctgcccacagccccgttacacagccactgtcccgccttagtgtctccctgccacccctcacggcctccctctccgggcatcccgggtcccgtcgtaggtctgctcctccgcccttgaacacccacagtccaaagccgggatcctccccaacacacttctcagtacccagggtctcctagcagccggtgctcctctccacagggctggtgggcctcgtgctttcttatgccctgtctctgacgggcctgctctcgggtctggtgagcagtttcacacagacggaagccatgatggtgagcgtcgagcgactggaggagtattcctgtgacgttccccaggagccccacagccagccactgcaggtgtgtctgttctcccccctgggccagggctgccagccatggggtgtgctccagtcctcccaggcctttccctttggctcctgaccttctttttcacatccctgagcctcttcatttgactgctgctattcttaactgtgcctctcgccaccaccatgtcctttcccatcatcccaccgccatggctcccccacttcctctgctgttgccctcacgctggccactcctcactcgtctccttctgtcagtccagccctgttgttctcgccatcgtttctccttcctttcccacagtcaccccaccagcagcgcatcagctggctgacccagggaagtgtggaattccaggacgtggtgctggtgtaccggccagggctgccaaatgccctagatggggtgaccttccgtgtggagcctggagagaagctgggcatcgtgggccgcacagg

SEQ ID NO: 24882 - DNA, 1149 bp, Mus musculus
cacacatgtgaacatatgcacacaaacatacacacatgtaaaaagtttggtgggtttttttgttgttgttgtttttttggggttttgtttttgttttttggtttgttgagacaggatttctttgtgtaacagccctggctatcttagaactctcttgtagagcaggctgacctcaaactcagagactacttgcttctgtttctcaaatgctgggattcaatgtgtgtgctacaacacccagctgcaaaaacagatttttttaaattaggaaaataggatatgagggtgatctggctgtggcatttgtcaccccattaatcaccaaagttgattggctgatctggctggctaggtgggtgtccccttcctccctcaccgttccatgtgcatccctcccaaagctgtgcactctgtcaaagaggactgccttccccgaaaggaccagtcttcggtcaagggttataccagtagctgcgctcccctgctataacctccaaccaagctctcaaggtccactctaggaggacgtagggtagtcaagcttccagactccagacacatccacatgaggcgctgcatgtggcagtctgcctttctttaaaaaaaaaaaataggaaagtaattttactatttagtctgccaaccttatttatattttactaattgttttataattgtcttttatagaaaaagcaattgaaaggttttttgtcacattcagtcatcagccttttaccttttaccttttgatagtaatagtttctgagcttctctagtcataatttgatattttagaaaaggtcatgcattttatagaatatctcttcattttagtttatctgatgttcgtgattgactttagcttagtcatttttggtaagactatgacaaaaggaatgccaagtttatgacaggagtgtctctcaggaaatctgtgcggctgcggtaaaagtcacttgagaggcttctccaccactttcattaacggctctagcctgagaaactcgcttcgatggttgttgagtgatttattttttccatttttgttattccttctatgtagtggggtttctgtttcaacgaggaacttctaactcctgcccttgtttagttatttgtatgagtgtatattcattcagtgatagtagg

SEQ ID NO: 24883 - DNA, 1279 bp, Mus musculus
gtgctttgaatttggtaaaaactccaccctcaggctccccctcaagggatcaggtagttggaggcaatgtgagccctcgggaaatgcctgaacaagaagctgcagttgatgtcatcccagaccacacaaggtccaatgtttataacagtcaggactacttaaatggatgaatcattagattttggaaaatggatcccaagactagttggcaatctcatctggaaccggcacagtaaatgttctttggagttttaaaaaaaaaaaaaaaagccttctcttccctctttcccttaaaaatactagacaaaataagttttaacaacttctctacatatctgtaaagaaaagtattttctgttaatttttttaatttttggccaaattattttctctttgtcattaaagtcaaatgtctatctggctcaccacaaagtgttctttgattttggctttgaggctgccatttctggaataaggggggatgggaaacagctgacttcaattaccgtgctgtatattaccgtgctgtatacctatctacttttctgggcagctgatggagctctggaagaaacaccaaagcctgctggaaaggaaagcgtttgaagaaagaattgtcctcctgtaggttccattccttcggatgggcctaccttaccattgttaggacagcgtgagtagacctgcttgctcttctcactttcctcattggcttattaattagctccttactttgttgcctttgcttcaaatggtttgagtcaccaacagacttgtttgggagtggcctcagtaaatgacagaaaaactgacaggctcagttttggaagacagcaaactggtaaggttcattcctggctcggtgccaggaacatttgtgttttggagctcacttttagttttgaaacggcctttgctcgttatattgtgatccagtacattttatgttaaattgtttatcagccatttctgttgtgaactgtagaagatcttaaattgggattggactcactctctgttccacaaacatagatgtaaccctctacctctccttacccaacttattaccaccatactgtgatgttttgggttgtacattttgtttaataaaagattaaagaatttatgaagttggcttggacaagtttaaatccatttttaatgtgttaaattttttttggaataaatgtattcatcttctacttcttcctgtatgtttgtcttgacaccacacaaattggaacttcaaaagaaactagaatagtgaatggctgccctg

SEQ ID NO: 24884 - DNA, 1460 bp, Mus musculus
ttggctacgaattgggccgggcagtagctcttggtaagccgatcctgtgcctgttccgaccacagtctggccgaggtgagtattccagcgtggagtggcttactccttcctggctttcttcctttcccagtgggctggggcagggagcagagtggggagtatggaaggaagtcagtttcacatttcccccctccccagtgctttccgccatgatccggggagcagccgatggctcgaggttccaggtgtgggactacgcagaggaagaagtggagaccatgctccatcggtactttgaggcttatcttcctcaggggacggcttcctccagtaacccaagtgcctgtcttaaccctactgtattagaaaaaatttaagatttatttttttaacacatgtttaactacatgtatgtatgtaaccacattcataccttgtgcccagaggtcagaagagggtaccacattctctggaactggtggtagagatgactgtgggcctccatgtgggtgctgggaactaaacccacaacaagtgctcttagctgctgaaccttctctttggccctggtccaactttatccaatgctgacccctgatgtttctctggactccttcctgcttctgcctcagtagtaagaaaaggttcgtttagttgggtatggtggcgtctcaggaggcacagtgtggtggtttgaatatgcttgacctggggagtggcactattaggtgtgaccccgttggaagtgtgtcactgtgggggtgggctttgagaccctccacctagctgcctgaaaacagactgctggtttccttttgaagatgtagaactctcagctcctcttgcaccatgcctgcttggacgctgccatgctccttccttgatgataatagactgaacctctgaacctgtaagccagccctaattaaatgttgtccttagaagagttgccttggtcacggtgtctgttcccagcagtaaaaccctaagacagaagttggtaccagggactggggcatcactgtgatagatctgtccatgcttctgtttcgaaggatgtagatgttgggactttggaaagcaaagtttgatgggctatcctagtaggaatatggaagactttgttgctgagagttctacatcttcatggaaaggaagccaggagcagactgttttcaggcagctaggaggagggtctcaaagcccaccccacggtgacacacctactccaacaaggcctcctaatagtgcgattccctgggcccagcatattcaaaccaccacacataggcagggggatttctgagttcagggtcactgtggtctacatatagtgagttccaggacagtcagacctatgtagagaagaccccccccccatctcaaaaataaagtcaaaaaaacttgtttatattggcagtgctagaaccagccctggcttttccaccctgtttcattgt

SEQ ID NO: 24885 - DNA, 2598 bp, Mus musculus
atgatccgcccgtcaccctggacagacggcccaagggacggcaccacttatttattgttgccttttcacggtttctttacacacacactgactggccgaaggagggaggcggggagaaggagcgggcagccacaggactatgccctctcactccagccaaagaaacgggcctgcctgccctccccagctgccctccttcctgctctgcctgtcatgctgttgatggtgcagctctcctccctcctcagaccccctgccagcctggctcaatttgctatgagtattagctgacccgatgggactgtgccaccttcccactcacaggccttctgtgggactgggcacagtgttcccgtccgaggaaacatttggggccctctctccagcctctttggcgacctctggttagctttgtgtctgccatggtctgggtcaaaagagcccggcccctgcccctcagggagccagctgggagagatatgggggcttgtgccctcagccgatgccctctgcccctttcagctcctgaagcagctgggcctgtgcaccgggcaggttactggggccgcctgccctgccttgcctctgttcccgcggacctgcaggggctcctgggttggagggaaccactgttagcggtctcttcctccccttggtcttcccccttctcccagctgctttacttaagagttgattttgaactttttatttgaggagatgacgtgaaaacaaatctataaatatatatttttaaaatatttaacttttttttaatggcgtttttctcatccccctccctgcccaaactcctcttggggaagctcttgggctccctagaactgtctgggcccctggggacagccaccccatgagcttggggtccaccagtgtgtgtgtgtgggagattctgggattgctccacatcctgggttctttccaggagaaaggtgggggaggggccctcaggccaagccacagaagggggatgggaggtcccgcagttctaggcctcttttgccctctagggttgttgctaggaaaagggaagatggagaccaaatgtgggggtggggtgggaggggtcagggagaggagattgatgtcctttgtgccacagtatggtcgttgcagcctgtgctcccccaggcttgcagatacctggggcccaaggtgcagtgggcaggatggagttcgggaggtagggagatacaggaatgggggtcagaggtaaaagctcttgggctgagtgcagcaatggggggccagaggtgggcagctctcccagggagtgagcagctactgtaacttttttaaattaagacaaaaagccttgaagaaaatgactttatttttctaagtgtaacctcagtatttatgtaatttgtacagggccatgccccatcccttaaaatccctttggggaccttgagggtgggctagcataggggagggtgttttaccctgtgtcagagccagcctaaaccacctgtatccattaaaggagctttttccgggagggcagttggggtagggtgtcactaaacccttgttgctgccttcagtaggaacaagcctacttctgcggttaggtggaggggttgggaaggttttatgcacagcctacgtttcatggggatgatctgctgacgtttaagagccccctgaacctctaatccccattactgtcttccccagctgggatgccacctttctggcctttctcctggaaatagctggggcgtttgggtggctttcaagactggggcatggtaaaccaggggtcagagttggggagcttgggactcaggtctgtaactgcccagcccccttctctgctcctgtttcactcctctgccgcccactcatggcccctcccccaacaccggaggtgttgattcctcctcacaaaagatagagcctgggcaagtgattcaggccaagtgcttaccaacgtgtgctgtgtgattgtggccttgggagaacctgtttgtcaggcaggactgaggtggcatttctatgtgcagcaacccttggtgtatccctaattaagtggctctaggggtgtgtgcgcgcgcctgtgtccgagtgaatacgtgtgtgaatgtggagtgcgtgtggtatatccgtggtttctacttctcctgggatgttgacccaggaatagtggacatggtcacatcttctgtacagagctttcttttgtattaaaaaaatactctttcaataaatgtatcatttttgtgcacagactggggtctttggctgtgtctttgggatctttttagcatcgggagggaggagggagcacaatcccttaaagtctgtcccaagctgcggtgtgctttggactgttcaatcctacatgattgaagagatctgggcgaggacttaatgcatggttttgccagcagctcagggaaggtcaggggttttacttaaaagtcaaagtgacccaatgatctaaaataccgcagggtttgggcagcgctgggaaacaacaacaacacacacacacaagtccggtgatgggagtatgggttaactaatgcggagatgattgctgtggtgggtgggagaggaagatggacccggtggagc

SEQ ID NO: 24886 - DNA, 1579 bp, Mus musculus
ggacccccatagtggaaggagagaaccagctctccagattgtagtttaaacacacacacacacacacacacacacacacacacacacacacacaccaataaataagtcatttttctaaaatattagaagcaggctcaggttgtgtaggaaatgatagagcctttggctgccgtatgagaactttcatactggataatactgcttatgcccagggtctctttgagctgtcagttgcttgagctcccgcagggaccctgtctaccagccagagagaactgagggtcagttatctctccttgtcacactcttaaaatgtggcggtgcccacccatcactcaccagtaccccccagagcagaccagtccctgagagaataccatggaaacctcaatccccagcaggtattgacaagccattaaacattcgggctaatgctacccactgtgtattctacagacttgcaggctggcaaggctcgactcccgcagcccgaaggctgcccgtctaagctctaccggctgatgcagcgctgctgggccccgaaccccaaggaccggccctccttcagtgagatcgccagcaccctgggagacagccctgcagacagcaagcagtgagggagccttgcaggctgtcctcaggatggcgtgggcaggggagaacccctcttgaggggagcctgcagcatgatgggcaggataaccctgtccttggccctggggtccctgcccaagcacagcaggcattgctgaagactggcagtgcctaggcgtttctcttcgccacaaccactggggaggctgattcgaacccaggctgggtgactaagactttggaccaggcatctttctttgccaccccttcccttatcagggacagtatgggtacctcaggtaaccccaatttctggcctgagacttcttttggccaagttcagctctgccactaatctgccaatgttgcctggggagggctggactggggctgagctaggtttgggggacttctttaatacacagatatactcaaagttccaagataactctgggcacacaggaccaacgggcctcttggcccacaggtcccacctagtggggggtctaggaggtcacagcagtggagtcctccccaccgtgggcttgtgcacactaagccagactcctggcctcagtctcctctcctcaccctaagtgcctggcagatgaacaagagcgtttgggagcttttgacacttatatgacccgccccttttgtacgcaccatgggcggcctttgtattattgcagcgtggggtgggtgggcttggggaggtctgggtggaccctggaggaagtagggagggagggccaccctggcctcatactttattgttgttgttattgtttgtttgttttatggttttgtttttgttttctttgtttttttgtgttttttttttttttttacactcgctgctctcaataaaaaagcctttttttacagcctgtttgttagacccttcaccgcctttgtccatgaatggtattctttgtttccttctctttgctgattagaagggacaatgagacttcttgacatc

SEQ ID NO: 24887 - DNA, 1194 bp, Mus musculus
gaaccagcgttctaacccccaagtattgtttacttggtactcctgaaaatgattctttttaaaaacaaacaaacaaacaaacaaacctaaattcgctttttttcctaggggaaaaaaattgagaaattatagatttgttctgagggtgtttttgtttttaagtatagcaaaacttgggggtgggtgggtatgggggacttttggtatagcattggaaatgtaaatgagctaaatacctaataaaaaatggaaaaaaaaaagtatagcaaaacttttggggtggagcaatgagtcacctgcctaatggcttgggcacagtgagggcttgtgctctaagaaaggccacggtggctgcatctctctcactcagtggcttcttttgccaacgcggttctatacccaccagggaaaagcgagttcggggaggtgttcctggcaaaggcgcagggcgtagaggaaggcgcgacggagaccctggtcctcgtgaagagcctgcagagcagggacgagcaacaacagctggacttccggagagaggtggagatgttcgggaagttgaaccatgccaacgtggtgcggcttctggggctgtgccgggaggctgagccccactacatggtgctggagtatgtggacctggtatgtcttggggtgcccgcccgtgggaagggggccagaactggggcaccacaggggtcttggcttctgctggtcgcagacagagcttgcctcctcctacttgcataatctgcctcccggccctccctaacagccctgcctttacctgtattccactcctcccgtctttctggaggtcaatcttaagttctggggcttctttgtaccctgcctggatgccctttgggtcctgccaactggttttctttgctttgttccttctttctgcctcaagacttgccactacttgagaacaagcttgtctgaacctggctggccttctctcttcccttccaatctcctctcccttcctttttctttccttcctacctcctcccctcctcccaatcctctctctctccctcccttcttttatctcctttcgcttccccctctcctctccttacccggtttctctcctggctcaggtgtcagcctgatcaccagcctgtccaccaagttatcattcctgtggtcagccgtgtttctgccttccccatttttgctaggttttgg

SEQ ID NO: 24888 - DNA, 1177 bp, Mus musculus
aagtggagaggagaccgggtcagaatgcaggaggcccagagatgatgacaggtttaacagccataggccacacctgccctagtgatctctgtccctttgagaagttgtcactgtggctacagaagagagaggttaaaggggaagaaagttcacaaactttcccacaaacatctccattctgcagaattggtttcctagtaacatatctcatagaaaatggagtgtgggacctcttgcttgaagccattgacgctcaccgagtgactcatgggacctctgtcttctgagtcattggaagcccgtagactagcaatgcaggaactcactctgagctgagtcttagctgggatgttaagccagaagcttccccgtatcctctccagggttagttcacaggaccgagtcagccagagaaggaagggatacgccctgggtcttcatgccacgtgggggccttcaagggtctagaagttgtcatatatctgggctagagacttgagggctagtttgcttgagtcgcccctgtcctgacctctccgtgtgtctcttagacaagccagtgatggaagactcggagggcccaggcagccctcccccatacaagatgatccagaccatcgggctgtcggtgggcgcagcggtagcctacatcatcgcggtcctgggcctcatgttctactgcaagaagcggtgtaaagccaagcggctgcagaaacagcctgagggggaggagccagagatggagtgcctcaatggtgggtccccctgtagcgggaggtggaccggtctgggtacagagcaccctcccgtgccagctgtggatttgagggctggagctgaggctacctctcctctggctgcaaacctagagttgctccattctcagggccttggcttctcaacggcttggctcgggactccctcatcagtcaagcctcttgggtcagccttccctcccaccgggaaagcacagataaatttggcatgcgtctacatgtgtctattacacgtcttttcagttgtcagcctccagggacaatatctgtccatcttttccctcatccctctcatcactaggtgctctctgagggcattgctgggtctccactcagtttaggcggtcgggaacagtgtgtggtgatttcccctttgtatgcaaggggtccagcgatttgat

SEQ ID NO: 24889 - DNA, 1147 bp, Mus musculus
gaatgtgtatatgtgtatacttctgtattatgtatgtatgcatgcatgcatgcatgcatgtatttatgtgtataaagttattggactctgccttttgctttatccactctgtctctgtctctgtctgtgtgtgtttgtgtgtgtgtgtgtgtgtgaattttctttcttccctttcctttctcatcagccccatggagtgaagggttctttctactggccacagggagcgccagccccagtaagttaagctttgttccctcagaggaaagtctgctgagtggcttctctaatctctggctgccactggccatccccattggtggctccacggcaccggggagcacacgagtgctttgggtgtggcagacaagaactcagtctacaagctgtgagctacatccctggcccaatctcattatccttatgggaaggatgccatcaaaatgtcactttttaaaagttttaagatgtatttttattttacatatataagagtgttttgggtctgtacgcatttccataaacaacagcaacaacaaactcctgccttgctctgactgaaggatttccaggactgctgtctgctcctgaactgtgttttaagtatgtgtgtcctttgcttgcagtttgtattaacaagtaaggaaaggagccacttagtgctgagcttgttggtattgtcccctttatattttttctcctgggaacatatgaagcaagttattctttttctgtatctttttcttttcttctgtaaaccttttggtttggtttgtttaaaaatggctttgtaaaagctgggcgtggtggcgcacgcctttgatcccagcctgggggtgtgtggggggggcgtgagggggttcagtgggtgctgtacctgctggggaagcataaggatctagcttggagttccaggacccacatgagattcaggtccagtggcaacatcggtgacccagcaccgagcagcagagacaagggcccctgcaacctgatggccagtcagtcggttcggtggaaccagaaagctctgggctcagggagaccatgtctaacggtggacagttagaggagagcacccaacattgacctctggcttccacacgcacaaataaatacacttcttacacgagagagagagagagag

SEQ ID NO: 24890 - DNA, 1128 bp, Mus musculus
cctacatatagtgaaccccacacaggctagcctgttatccttgtgcctatgtgagggcatgacgcaatgggagaggcactgaagcccctttgtcaggagccctgtgtgtccctggggtggaagatggagggatttgcaagagagctagagctgatgtggctgatattagtagctctgtctacacataaggtggtgatagccatctctgcccctcaccaggtaaacgtgatgccctctgccagccgggtgaccctcctggagaacctgacccgcttctggcccatcatccaaatcagaataaagcgctgccagcaggtggggtgtgaggactgctgcaggtctctgagccccagccagacgtctgtcaccaaactaccccatggcagccctgagcctgatgatgcctttagattttgagccggggcctgggggggggggctggtttaaagggcaaagcctatgccaaggaggatgtggggtcagctacaggtcttgtgtgtaacagggtggcattaacacgcgcatccggggcctagaggtgctgggccccaagcccaccttctggccagtgttccgagagcaactgtgccggcacacgcgcctcttctacatggttcgggcccaggcatggagtcaggacatagcagaggaccgccggagccttctgcacctgagttctaggtatgtgagagcttgcatgtgtgtttgtgtggcaggtcaggttcatggactctgtctgggtgggtcctgaggaggcctggagacgggtctgttctagggcttggggaaggtcaaagccttctgaggggaggggatgacggaaagagaagatagatctctccgagtgcagagggaagcatcctgctagtccagggctcctctaaaagattgccctgggtgctggctgcgtgctgagtcacctaagccttagggcccgaactcttccttctcctccccaggctaaatggggctctgcgccatgaacagaattttgcagagcgcttccttcctgatatggaggccgcccaagcactgagcaagacctgctgggaggcgctggtcagccccctggtgcagaacattacatctcccggtaaccacccacacccggccccgctcctcagtgtg

SEQ ID NO: 24891 - DNA, 1390 bp, Mus musculus
ctttaggtcccaaagtttagggagaacaggaggtctgaatcagggccttaaaataagggaaattggcaacaagggattgacgctctggtaaggatgagggggaagtgctgcctggctggctgcagactgcagagcaggagaggtacctggggtgtttactaaaatgggtacacctgagccagatgcttaggctcagaagtctgtataaacataaacaggaaatcccagagaacctggaggtggttgagtaggaggaggtgggagttgtagtggtaggtggggtctggtgattaacccctctgtgggagtttggagggtgctgtgtcatagctttgttgtcatagagaccacctcttccggtcttctctgcccattgttcacctttccaggtgggagctcaacgccatgaccaccaacagcaatatcagccgccccattgtctcctcccatggctaggaagtttatgctgcctcccctactgagccctctcttgtcttcattgcccctgcccttctcacccgcctgcccctttggaccctggactcggtatacctccacgtggagttgatggactagaggtgttttctgtgctgtgaattcagtggggagttttttgggggagggcatttccctccctccttgggccgagggccccttcccttggtgctctgtccccatccacctccctccaccgctcctgggcctttgctctgccccagtctggctgggtagccaggctgtgtgtgctggaaagggacaggagtgggagaagccagcagtgttggagcctcaggagcctccctctccccatgaccaccctctccctgcttgagcatcgcccgggagctgagaggagcctcggctgttggcatgaaaccccctccccaacccgcggtggtggggaccaacagacagcttcacccttccttgagctgttgctgtacccctgaagctcaggcagctctgactttataaaacctaaaacctccaaacgtgtcctatttctggcgactacgatagaggggtggaggcaaaggggccacccttgcggttctggcttcagggccaagcatctgaagaaatccgatgccactgagcctggcagcctctccgcagacgtgaagttctacggctgcggggcggtgcttctggcagaaccctcagcacattggctcaggcttccggaaagggtgggacgtgggacctcgtcgtgagcggaagtcgtgcaagttttcagcccggactacggaagacatgcggaaggctggttctagggctagggctgaggccgaaggtcctcaccgtgctatggagggcggggaggtgactggcgaccggctgaagggtgaggacctaaggctggggtgagcgggaggcgtttggctgcggg

SEQ ID NO: 24892 - DNA, 1390 bp, Mus musculus; identical to SEQ ID NO: 24891

SEQ ID NO: 24893 - DNA, 1194 bp, Mus musculus
cttcctccgtctgccactgggattgtagtcttatctttgtgcattttcgttttatctggacttactttcaaaggagagtaaaagatatgaaggaggttgataggctctccaccaccacgttctttcctttctttctctattttttgtttgttttttttttttgagacaggttcttgtagctctggctaatttgggacttactgtgtagacccaggtggctgaccttaattacacagacatccccctgcctccatgccccagcacgagtgccttggacttggattcttaagctttcagtcctctttctctgataagcaaaaattgaagagcctgagtaatgaaggaacagtttaacttttggctgctgctgtttcacattgagagagatggctacttaaagtatacagtgaaaggttgtgggggcagttgattcatgaaagctgcgtctgtccccttgaagggaacctcctttgcttgaggtgcacccaccccacccccgaggtttttcctccctgccaaggatttttgaacaggaagtgaatgatcacccaaacccagcagatgtctcctggcaaaggcatcgctagttgcaaaaagatttgcctgaaagagctctcagatatacctgttatcactaggctggccggctgtctttacaaagccgtggcccctctcatctttggggctttctcttgtcctgcccaaaggtatttttgctttctttcctctttccaatctacactcctaccccatctctcctctagagacccagacaggggcagggctgctggaagtggcgtgttcgctaacaatagtccggctgagaaagttgagggcgctcctccctgcccccgactctcagtatacacatacctttctggtttaagtttctagtcctggcagcatacgagccacagctgtcaaaggaactcctcgtgcctgtagacaccctgggtgaccccagggacaacggatcagcttgacaagaacgctctgtgaggggctaatcaaccatggttacatggagttccctgtcctaggtagggacactgttctcctctgaaagcctaaagctcctttttactttaaagcacccatgccagctctcagtggactgtctggggctggctgggctattaatagctgtgagtattttgagatccctacctttaagagatggagggaaattcttag

SEQ ID NO: 24894 - DNA, 1448 bp, Mus musculus
agtcagagctgccacaggacgtgtacaccatcaaggcactagaggcgcacaagcgggcagaagagttcctgactgccagccaggaggccctctgaccccctcaccttcccttcccacaggattccagcccactcagccctgggatgcagcccagccctccaccctctgctcctcatcggctgacctggggcagaacggcacctctctggctactctagaggatgcaggcactggaagcgggatgcccagagcgctccctcttctcccctaaacgtgttcatgcctccctgtggctagtacagacaggctgagcactgagtgctcagtgcttagacaacctgggggtgcctgtccccctgctcctaaccccacagctgcctgaaactgttctgagaaatacacacaggaatcacatgtccctctctacccccttaatcctcatctgaagttgaggtgtctctcctctccctgcagagtacaacaggagactgtcaccaaagtcacgttaagctccgttggccccttgagcgaagagctggagggaaccaatccccagcagcacaaataggcccctagacccagctttatgcaggcgggggtggtagtgtgtttctttgtatcctatacctaaccaagacaacacagaggacaaacaagttacggacactagatgactagtgggcccggtggggagaaagaaccatctgccttgccctctctggcaagcagcagtcctgggatcacacatttgcaagggaccaccctgtggctgactgctttcccttgtgctcttggttcccagagctataaagaaggaggcaggagcagtgctccaagcatggctccctgctgtgcctgtttatttcctggtttctgctgacgctgggctgggcgggtcctcacctgtaccctctaggcgctcagaaacaaaagcctggggagggctggaccaggattcaggagcacaggcggtgtggcttctggctgtgtacacagggtgctttattctccacagagtgatacatgctaaggtgggctgggcttgggccgatgtccccatatgtacagaactgaataaagtgggtctctgagaggtctgagtcgccttggtgtgaaagggacatgggaaggaggaggctgttaagaccagagttgttagtcctgtgctggtcctgacttggaatgtagggaggtaaggcagctcgctctctggtcacttccaggcaggggatgcctgccgggcttggagggctttctgtaccacatcttcccactgagcgtccgagatctcccgagcccaggcaggaacccctggtgcaggcaggcttactccagccatcgtccttttcaccagctctacatgttctgaaagcacagccagactggttagggaataaagaacgggaccagcagccgggcgtggtggcgcacgcctttaatcccagcac

SEQ ID NO: 24895 - DNA, 1237 bp, Mus musculus
tctctacctgttggtttcgtttctgttgtttgtggcactggccacgtacaaacccaggcccttggaccttcaggcaagggttttatcactgagcgtgaacacctctcgctccactcgctgacttctgagtgattgtaagtgcatgctcaggaggcctgagcaatgtggctttctctgaagggaagcaagacctgtaccctcaggaaacaggtccaagccagagaagccatgcagtggctgagggtaggccaggggaaaggcaacagagggcttcccagagaaccgagcagcttaggaactttgtcctcgcgtcgtcttcacaggtgattgtgggacttctcaagttttggcctaagacccacagccccaaggaggtgatgtttctgaacgagctggaggagattctagatgtcattgaaccctcggagttcagtaaagtcatggagccgctcttccgccagcttgccaaatgtgtttccagcccccatttccaggtaagagcagactcactggttcctaggtttggtagagcaggtgttgagaattgcagtgagtgcccactcaactccactctcctcgccaggtggcggagcgcgccctctactactggaacaatgagtacatcatgagcctcatcagcgacaatgctgcccgcatcctccccatcatgtttcctgcactctataggaactccaaaagccactggaacaagtagggccctcgggctgcgctgatggtgggacctgggtattccacactgtgagggcatagaagaacacgaggcgtggacccccagcaaggagaactggtgcccaccaaattctactaagtgtagggcctcaaggggttgactggccagaaaaggtgctaatgagacatcctcgaagtaccaaacgtctgacctgtatcataccacacagctctggagacatcccgggctgtcaggaactatgtcatatacttaacaagcagagtccaacttataaaaaagctttcgtgctgaaagcagacttggtgtgctgctgacagtctctccatgtgaggccacggaatgtgagccaaggaagggttagacatgtggggcccgtatatgtaaagaccatcagatagatgccctcaatgcaggaaagctagtcaagagttagctgcttctgcagtgtagaggttagtgattgggaaaagacagtggactgggagccggcaggctggctctggccccgtgaccaccgcctctgtc

SEQ ID NO: 24896 - DNA, 1156 bp, Mus musculus
ctacacagtccccctcacgagctccggggtccacccagcatccccaggctgagatccaggctcctgacatggaagctgaagagcatgaggcacataagatgctcaccagcgcccccttcagccaggaaggactccgtgcagcctcagcagccaggcctgcctcttccttccaccaagcattctcttctgctggtccttgtcggatggtaaattcgagaacttccaggacaaactcgggtgtggcacaaaggggctggacgccagagccagagccacgccagagactgcagagagggcacctgacctaacccccctggaaagccaatctgcagttcccgtgtccacccactcctcctgaggacgcctcatgctctgcccagcccttctcccagggctaccagagtaaacaccttttggcctttcggtttggttcctgggtcctcatcagcctccagagtgtcccctcatcgatcttttttgcctttgtcccccaatcccaggggctggaaggccatcaccatcattggaggcttaacctgtcagttactaggaggtgctgggagcgcccggggttggtttggggtaatcactcactggctctcagccttctaacactgcagccccttaatacagttccttctgttgtggtgactcccacgcccccacacacacaccataaaattatttcgatgctgtttcataactgtaattttgctactgctatgaattgtaatgtaaatatttttggagatagaagtttgccaaaggggttttgacccataggttgagaattgctgggttcaaggtaggtggcatggggtgaggctgagcacggtgactgaccctgccccccagctgaccttcacagcagcagttcatgtttcccaaggtccttcccactctcgactcgcacactgagtcctgggcatctggctgccctccttccctccctctctaccccaaggccttgtgtgcgcagtgtttacaggtcagcagcagcccctgcccctctggccatattctgcctttgcctgatcttggaccttgctcccgaattgatccctttgctcttcctagtgattgtgcctggacactccgtctcccaggcaagggctagcaggaggccagccctctagactcacccctcgctctgtcc

SEQ ID NO: 24897 - DNA, 2661 bp, Mus musculus
ttatttgttttccgagacaggatttctctgtatagccctggctgtcctggaactcactctgtagaccaggctggccttgaactcagaaatccgcctgcctctgcctcccaagtgctgggattaaaggcgtgtgccaccacgcccggtggtttttttttttttttaaatttatttatttattttatttatttacttattttggttttttgagacagtttctctgtatagccctggctgtcctagaactcactttgtagaccagactgggctcgaactcagaagttcacctgcccctgccttccgagtgctgggattaaaggcatgagccaccaagcccagcagtttttttatttttatttatatgagtacactgtcgctgtcttcagacacaccagaagagggcatcagaccccattacagatggttatgagccactgtgtggttgccgggaattgaactcgggacctctggaagaacagtcaatgctcttaaccactgagccatctcttacttaagtacactatagctgtcttcagatgtgccagaagaggatgtcaaatctcattatgggattacgggtggttatgacccaccatgtggttgctggatttgaactcaggaccttcggaaaagcagtcagtgctcttatccactgagccatctcgccagccctgaacccatgtttttaagagtcctttttcacaaacttaagtgctgtcatgaatgtcccagcatttccctttttgttgagacctcagccatccataccttcacccctgatgcatgctgactggttatcactagcattaacgctaactgggataacattcctgaggaatgtaagtcattatacaaacattattatacaaagaggccttatgcccatagcagccgtcaacactcatggaggctcacacctgctggccctatacaggtgccgagagccatgtcattctgtcccctgctgaggccatgccaaacccagcactggggtaggtcagaggacacttctctcctctattggttctgagaatctttactgggtagtctttgtggccagcagtcttactcactgagccatcttgttggcaccttgtctgacttttggtgggccatgcttgtcaactagaagtccctctgtacgctggagagctagttagcagttgaccctggcacttgaagaatgagagttgttctgtgtgaaaacaggaacaagcctgtgtgttgacctgttggaaagggacaatgcctgatacagctctgttaggtcacgggctagaaaatgtctatgttgctgtggacttttagcctgcagtggaggaggaatcacatcagaaactgatttcagaaggactatgcaggccggttggttacctgttctgctgaaggatcgcgactggaacactctgtcgctgttctctcagacccaagttgagattggtttgttgacacagctgtgttttccctccttaggttttccaaaagcacccctcggaagtgtttttgtcgtcgtttaaaattatcaagtatcttcagagaagattattttctgccttcagaaactgaaggaaggcttgggcctagagaacgacagtaaggtgcgagcaccggagacacttaacacagctcagtccatggaaggacgagttccctcattggctgcctgtctcgaaatccacgcaagctgtggaggaaagaattaccctgctcatcctgccttctatcttggtgtttaatgttgggtgggcaacaagcacaaacctccctcccaccccctccaagactgttagagcagtgggccagaccaagcggcgcacttgaacatggatcaagagggtcccggttttactttttatttttgtcagggtaggcagtcttgtgtttgctttgttcaaagcagggtctccctgttggccctggctggccttatactccacagcagtcctgcctcctcctcctaggtgctgggattaaaggcgtgcgccaccacgcccggctacagcctgcatttttatgcacattggtctgttaagctagttgcattctgtgctaccggaggggactgaagtttaatcacttgtcttctattaaaaactagtgtttgcctgggcctggtgtgtatacctttagttgcagcgcttgggaggcagaggcaggcagacttcatgagttcagggacaggcaagcctgctctacagatttccaggatacccagggctacacatagagaaaatgttaaagataaacaaaaagctggacagtgggggagcacacctttaatcccagcactcgggaggcagaggcaggcggatttctgagttcgaggccagcctggtctacagagtgagttccaggacagccaggactacacagagaaaccctgtctcagaaaaaaaacaaaacaaaaaccaatgcagtgatagattgttgtttcctaaaccacatgtacccaggaaatgcccactaaatttcacctggatcagtgttaactgatcattgggaaatgaggtgaccaaaaatgcatcgcaaccttggacaaacagcatggctatttaacattctgggatcctgcagaatcctgcatcttcctaagtagggaagcactgtagcattggagagaggcctgggcgagcagagctaaggcttccatttctggcttgc

SEQ ID NO: 24898 - DNA, 2062 bp, Mus musculus
gaaaaatcaaacaggactgatttaaagactttctcactgcagctccaaagtagtggtttggttttgttctgttccagggggagagggtatctgcgtagggaagactctccctgaccagcccgctgagtggtgggtagccggtgctctgcctggaagcccaccgccctggctaagacgccaggagcacagccacagagcatcctcctgacatccagtgctgtgcgatgctgcaaaagcaaagccttgtgtttgtcttcaacacattcgtgctgaattctgtctgagaatggtctgttcttagccccaggtgtacgccctgaaattctcacaggctcactagggaacagtggaagtcagttgtaaggcagcgagttggggaggcaccggggtctccgtgtattccatcaacttaaaagaggtttgcattttataattgggtgaagtcaacataacctatgttctttattatcgctgaattctgttccattcaacctcgttgtcccctttccctcagcccttagccaagcatcaaaaggctttcacttaaaaactgtgttgtactctttcagttgaggcttttgaacgggactctggccttgttcgtgagaatagtagtcaacagtatcagtcattcattcccaaacacagtaaaccaaaggtcacaaccagcaggccactgaaggaaggaaccgaggcaggagacagggggccatgtcctggccccgcccccgctgtgtgtggtccagttcaccatagcgatcgagccttcctctttattatttttgttcctttccgggagtggccctcatccttccctctgtgcgggcctgcaccagggcgtgttctgttgctacttgcttcttcctgtgtggtaatggcccacagtgctgtgtctgcaaccctcctcccacgtctccatcaacctctgggatccagaggtagctttgatgcctgtgagggcttcctccctctgttcatccccaggctgtgtaaatgcatccgttgatctcctctgcttcgttatacccccaaaatggagttgtccctatggtcatcatgtagagtgtttcttttccagattggcctgcaatggaaaggaaggcttttgattttgatttttatctttttttcacataacacagcaacaatctaggcatggtggcatacacctgtaatcccaacagtcaggtgactaaagcaggagagtcactggttcaaggccagcttgggctatataacacacccctgcctcaaacacagaaggagagaaatttgagcaatagcagactgtgtgggccttttttacccctctgtccactacacaaaaaaactctgtgagacagccagtctttgagagcgatggaccttctcccgcccacagcccagccaaccaaactagaagagtctgggctgtcttcgagttgtccttttcttccttctctgtgccaatgtccaagttgctgacttccttcctgtattataacacattagaaagatgagttgtttaccagttagacctctgtctgggctgccctgatctctctgtcacaggctcttctcatagccacatggttaccattcaagatggcccctggatgcctgcagcacatggctactaatgaattactttaattattgcaaatcagtggaattctcaagagacaagaaagtctcgtgtatatttgttatctcttccctccctccccagccccggccctggccctagttttctctcctgtgtgtcaggttacagggcttctcaccatgacattagtcccacacaaggagagcctactgtaccaaaatgaaacttgtaaatttttgtgtccttgtatgtaagtttactttttatggaggaaagactctagataatgacaaatgaagattacaaagtgtattttactcctgtgattaggttacaccacatgggtcataactcactcccgagcccccactgctgaagggaagcgctctgcctcagtggccaacgttggtggttcagggtcattagtcagttgagttctagaacgcgtgctcagtaacaaaaaaaaaaaatcacctt

SEQ ID NO: 24899 - DNA, 1185 bp, Mus musculus
gacacttgcttcctccatgaccctgccatgctcctcctctctgggctgtgttctgtattctctgtcgctggtgtgtgtgagtagtgaggccactgtctgcttctcttttccccctatgtatatatgtgtgtggtgtgcaagcttgagtatatgcatgttcaaattggtgtggttgcgtgtgtgtctctgcatttggaagctggcatcgagagtcttcttggatagctctcattattctttggtgcagggtctctcagttgaacccagaacttgcagaagggactgggctggttagacagcttgtcctggggaattcctggcaccagttttgagctctggaatccacccagcattttgtgtacgttctgggggcctgagaagcaggtgtcttaagcactgagccatctccccagcctgcttatagagatctctaatgtagcttcactccgcttccgtattcttttgcagtacccctgttgtgttaatggctgaagcgctagacccaaagcaggaccttcccttaggagtgtgactaggcggagttcggctcctgttctcacttctagctaaggatagaagggatccagggctagagaggatatactgagctgctgaggagcagggtcaagtttaatagtcgtcagctattcgtgttaagatggcatgatcactctaagtcgtccattctttgggtcggagaggtgctggggacttatttagggactctcctatgtcatgttccatgagtgagctcagtagccagccagcccaacatgttccatacttcaggcagtccttaaacttgtcacctccctgtagctgggtcacattaccttttacaggtagtttcagcttcttttcttgttaagtaagtgtttcaaaacctttgtaatgatttcttttaaattataagtatgtgtgcgtgggtagatgaggaggctggccaggaaggccagagaagatcattagatctctggcacttgggttacaggcagttataagctgcgtttgtaagtgctgggaattgaacctgggtcttctggaagagctgcaagtgctcttaaacactgagctgtctctaggccctttttcttctttcttcctctttctccctcctcttcctcttcctcctcctcctcctcctcctccttcttcctcctcctcctctttccttcttcttctcct

SEQ ID NO: 24900 - DNA, 1179 bp, Mus musculus
gtgctgtccaaagtctcccacagggaagtcgaggctgggctttcagtagctagagagtggataccacagctgtgagctgtggctcacactgagaaagaagccctgtagtactgactggatttgaacgtctttttctgagtttcttgagtcacagaaccagtgtagctgatagagagggaatggttgtattcttatggtgccttcagagcacgcatagtaagtacgcactttttgatgtcagtcctgaagttgtagggtgggttctccgatactgtgccggccgtagaagtcaagagtgggcattctcacctgctgctccttcctgcagccaccaaacgtttgcttaaatgggcagagcctaaaggcatctctgtctacctcgtcactcattctgagcacatcaggtgaggaatgggaactccgagacactaccatcatagccccatccccagcaccccgcccacgggctccattgaaagaatccagacaagacgcatacagtggagtgtaggagacagaattggtttggtttgggcaattctgtttgttttttgttttgtattctaacattgttgtttgtgtatggatattggtgaggacgtgccacgcctgtgtggaggtcagaggacagcttgtaggtgtcagttctctctccactctgggttccaggagttgagttcaagggagagtcactctaggtgggctttattccatccctaaagtctctgcagcagaaaacttcccctgggcgctactttcctgcccagaagcttgacagagccatttggattaacttggggagatggcggtgggtcctgttcttttctagggagcttccagcgagaacataatcttaggcagtttagatagttaactgttaatggcctttcaggtttgtctccaccacagtcagaaatcaactctgcccgcactgcgggtccctagttctccaagctgtcacgggttacaagcgggggattcatccccctgaccctcaggcttgccgatggtgaagagcagctgggttgccttctctggcttccaccacgccaggccatcggctgctcagtacaccttcctttgctctactttgactaagccaagagttaaccttgtgtgcttataacatgaccacatatttaccaagttcttctcctttctcacttcttagctacccca

SEQ ID NO: 24901 - DNA, 1165 bp, Mus musculus
cttttttgacactagtgcttcagctgggaaagtgcctcagctttctctggtggtattagggatgcttcctggaccaagggtgtgggttagagagacccttgctctctgtgttcagtcctggccttcagctagctgtgtaatctccagtctttaagcacagtggcgagcagtgttctgttccaggggcagtgagggtcatggaacaagcatactgctcagactttgcagttgctgttcataccctgagtactttgttctctgtcccttcaggagaacaaggagaccggcatggagagcgtcatcgagtccgttgcacatttcaagtgagttcatgacatgcgttatgaagttttattttaaacatgtatttactttctatgcacctgtgctcactgcggcgtatgtatacaagtcaaaggacaacttgaaaagtcagttctcttctacagtgtgttccagtgatggaactcgggccaaactggacggcaagtgtcttttcccactgggccatctttccagcttccgaaatcacttcttaatgtgtttcttttgatacaactaagggcgagctgatgctctgagggtggcaggacttttcaagttttaattctggactagacttctcattggtgtttaagatcaggccgtgtgtgtgtgtgtatgtgtctgtctgtctgtctgtgtctgtgtgtctgtgtgtacatatccgtggagctagagttagcagtcatgaaccacatgatgtgggcgttgaagctgtcctctggaaaagcagcaagtgctcttaactgctaagccacctccagccccggggtaatttttcctcctgcttttccttgctctacactgtagctgcagtgtctttatggattctaaagataagatcgtgtattctacatgctagtacagaaaggttaacactacttacacaccatgttacagcagaaccggtaacaccatgtgtactccatgttaaaacagagaagttaacactgtgtgtactggtgtcccctggcttagaaatgcagcagtttggaaacctgttcggttgggcttctgggctgtgtctccattgcattcacttgcatagtttggactagttcacagtggaggtgctgacatatatgatggctcctgcaggggctttttttggatgtatagtgtc

SEQ ID NO: 24902 - DNA, 1193 bp, Mus musculus
acttacttaaagccagacgaggtggtacacacctgtcatcgatcccagcacgcccttagtgggacgagaggcagggacagacaaatcctcagacgatcccagcccagctcaactgccgttctatcaacagcatagaaagtgaaggctgacacctgaggttgtcttctgaacggcacacgagtgtcctggcaccagcactcactcacacacacacacacacacacacacacacacacacacacacacacacacacacagatccaaaggcaggtcgctctctccccagccccaatcatgttgattttttttttttttttttttggtttttcgagacagggtttctctgtgtagccctggctgtccttgaactcactcagtagaccaggctggcctcgaactcagaaatccgcctgcctctgctcccgagtgctgggattaaaaggcatgtgccaccatgcccggctacattgaattttaagaatgaaaatgctgagggcttaaaccaggaaggtttaaatccagtgggggttcatcaactgcctaaaagactctaagcaagttactttaaaactcatttttgccctctgtgaaaaatgcttcataggacacttgtgtgaagacttcaacttctgacagacccagctcttaggtagatattttaaaaacaaacaaacaaaaaatacgtgtgttatctcttataatagcgtcatggcttttgtaagcagctggaaccagggactgggacgtgagactttcctgtcagaatcttggagaagtgcagtttcctggcctgacagatgctgtctgcagcccctcccattttatttgtggagcactgacggtcgacccgacctgctcagaaccccatagcagtacaagtcacatccctatcaaaccaaaaccatcgtttctggctgaaaccgggccggagagttgcagggccagagtctctctccagttagggacagggctatgacagaagaaggcccgcttttaagggtaggcctgagcttgaggaataccaggctgagaggtaggccacgtcacctccaccttcagtgaacttgccctgtctgctaacttcacttcagacagcctggctccattggctcataggaagcctgccagccaggagccccttgtacctgtcttatcgcctccttctgcactctggtctcctactctggggagaa

SEQ ID NO: 24903 - DNA, 1192 bp, Mus musculus
taagagctgaacctagtgccccaggcatgttagacgagggctctaccaccgagccatattctcgcccatgttgagtattgtgttgaacactgtttttggtgtcacagtacgagcattctgcaggatgggtgccctctcctgggtatgtgcacgctgacatctcatggatgtcagtcagtgttctagctccctccccgttatcataaccttcttgccagcactacagtagaacacaaaactcacttccatttgataggctatttccatcttcaccttatcgatctctccccagttgacgacttcctgtgtgttgggaccatttgtatttcacattttgtgaatagcctatagctaatttttcaccatgcatgcttatcattctcttattgatttttttaaaccttctttatgtatgaaggacctgagcatgcacctagaaaataaatttcatttccctggcatttaatttcacttaggcctcgctgtttgtttacacataggattaatacgtttttaacagttgaacttaccagcttttctgcctttatgctgtactccctggtgtacctgaacttctgacttcacccacaccccttcttcacgtgccgggatgagggatatgctggctgcagacatgcctagggctgagctctgggttgtggtcctcagttcggcagggtctgggaagcagcagtccctacctggcagtccgtctgtttctacctggatcctcacagtttaaccaggatgccactagacagatcgttgctgacctgctgcacactgtggtgatatagaggtggaggctgaaggtcattgggtatgtacatgaggcaggtgacagtgcccttctccatgaccccctactgccactaatagggggctcttctggaagtggtagcctctagggccgtagaaactgaggcagttgtcaagaggaagggccagccagtctggccacatctgtctactctgactgattaagcccaagagggagcaaagatgggacaagtgggaccacggcttctaaaggccatgtgacctggtttggctctgactctgtggtaacagcctcatgatgtgggccagtggtactctatcgactggatcttttcctctctacttaacagatggcccttcccagtgagctgccccggtgaggctggctgcagggtggatgctggtaaatcgc

SEQ ID NO: 24904 - DNA, 1557 bp, Mus musculus
gcagaaggctcagaaggcagccttcgcagcagaaatggcagccaccatcgagaggactacggggccggtgggggcgcccgagctgctgcccctggaccaactgagtctgatgaagccagtcaaggacgtggacatcctggatgacgatgtggtccagcagttaggcgtcatggacgaggccgaggtggtaggcacggatcttctcttggacgaccaagattcggttttgcttcagggtgatacagaactctaaaccctcccgttcatcacctagagacacagaagccacggcctccacctctgtcacccgtagaacctggacttcctgctcctttggaaacccttttaaactacctgtttaaaaagcggtccttttcttcaggttaagggaggggaaaaatccagttctttctcttttaccttcttttacattgtttttgttgggggttggggggaataaaaaaaattggcacaactatctttaagaggtgtctcatctgggctatgttctcacgaggctgcatcctttggggtaagccttctccttcgtgttgctttcagatgtcagccaccctggttgcctttatgtccaaacttcttgctctgtgtgtgtgtgtgtgtgtgtgtgtgtgtgtgtgtgtgtgtgtgtataggtaggtagcaggttatcccattcattctgggactttaggccatgttttctcacgaagaattattttattctgttctgacctgcaagagttctttctctcaaatcagaagaatttctctctctctctctctctctctctctctctctctctccctctccctctccctctccctctccctctccctctccctctccccctccccctccccccttctgttttaaacatggtccgtggccagtggagttctgaacttattttgcaccacttgaacgtactgtgaaacctctttcactctgacttgctctaacgtgtgtgctggtctgagctttgcctagatgttagctacagagagatagggtttttcttaacacatacagatggaaagtgctttgaaagccaacacaaatgtgtccagactcaagtttgctacagtgctcgcattcaaacaatgaatgtatttgttccaagtcacttaccaaagcgattccagacttctctaagctacatggctttgctctgtccccgacagcagggggcgccatttgtacttgaaggcaataaacctgcaatcccacaaaacggtcattgcctaggctttccctgtcagttaggctgaccccctcccactgctagtgcacagtcagactggaccactgcccctggcacagtggggcgcctgtcagcctcccttctgtgatcatggcctgtggcctccaggtgtcttcaggtcttaaccctccttgagtagactagctccccagctctgtgtaagcgtagctatcatactgggctctgtgctggcccgtgatcagcgtggcattagcgagcatcctagtggaggagtagggttggacacccttcacattggattctacaaaaccatttggcacatactcggggccag

SEQ ID NO: 24905 - DNA, 1733 bp, Mus musculus
ggccggcgcgcaaccggggcaagctgtgggagatggacaatatgctgatccagatcaagacgcaggtcgaggcctccgaggagagcgccctcaaccacctgcagggcgcgggcggcgccgagccccgcggcccccgggcggagaaggccgacgagaaggcgcaggagatggcgaagatggccgagatgctggtgcagctcgtgcggcggatagagaagagcgagtcttcgtgaggagccggccgcggtttccagccaatggattctggttgagtaatggcgattggctgacatgacaccctggagaagctgaaaccagagagccttttgttttccttttttttttctccttcttttttttttttcttttcttttcccctctgtcttccctctgtttctcactgacactacgtttctgctatggtctgcggttggcgacctcgatatgagtttttgattattcagtggttccttttttttgtttgtttgggggaaataactttgatttggaaaatgcgctcacatacgggaattagggcctagattgtaagccctgtggcagttgaataacgttcattcctggcctttggttgttgttcctaaattttgaggtgctttgctctttcttgggtgacctgatagctccctgaactttggatctctgtgacacttgagactcggagttgaagctcaccgcctctgaaagttctgaaggagctgtgttaattctcgaagactccatgcagcaatggcagaagagaccagacttcatctgggacagtggatgggccttacatggctaggactgatgacctgggagaagggtcggaggatagtattgtttctattgggggactttaatttctgtgtgagaccaaaggaggagagatgtattttgtgcaaaatttaaattttatgtgctacactatctattgtaacctgcctggtgagtttgttgggacagcctaactcatttctaaaagaaatggaacctcggatgggagaagaggtcttgttagtctgtacaagttggtatccccatatattcgaggagatcctggccataaaatgaaagatccttgcaataccctgtgtggcctaggaaggaaaacctgcaatggacccaaaacttaaaagaagaggcgtcttaaaggttcatatgtagtcgagctataaatgtatgagtggcagacctgataagtgtttgaggtcaaaacccttaccatgttgtaaacaaaatcttacatgttaataaaagtattcgtttgcttgaaaaaaaaaaaaaaaagaacaacccagttagctgtggatggccagtatggacacctctcaggccactgctgcaaacctaatggtctctgtcatcacccacctcttccatgaccacagagcccttaaaacttgcaagtcttagccaggtggcagtggcacactcctttaatcctagcactcaggagacagagacaggcagatctctgagttcatggccagcttggtctaaagagttccagaacagttggggttacatagagaaaccctgcttttaaaaaaacctaagacagcctggcagtggtggcgcacgtctttaatcccagcacttgggaggcagaggcaggcagatttctgagttcgaggccagcctggtctacaaagtgagttccaggacagccagggctacacagagaaaccctgtctcgaaaaacaaacaaaaaaaaccaaaaaaacacaaaaaac

SEQ ID NO: 24906 - DNA, 1153 bp, Mus musculus
ctcacggccttgcttccttctgagctggagatacagcagatggaagagaccgactcctcggagcaggaggagcaaacagatacagagaacaacgctcttcatatcagcacggtgggtcctccccttctgcctgcctcacagcaatcccaaaacagcctgtcccacatcctgcccctgcccctaggaactgaacagggccttccccaggtctctggctggctgttacaagcttgcatgatgggctgtgtgtccagtctccatcatgagacacacctcctggggagtcacacattcagcagatggtgaacgagcactgtaaggtccagaccctggtcctggtctgaggaactagtgtggagcaagacagataaagccccgccttcaggaactaaagagactagagatggagctgtggaggtggtgggggattacaggtgacatttgggtaaagacctgaagagactaacgcctgccctgctcatctctggagtttccaggcaggggacagagcacatgcagggccagcctgaggtagagggagctaactcctggtacctccttctgtgttagactgcagactcacacttccatactacaaagtacaataaaagactgttactggcacttgttactattctggtagcctgcaaaatgtaatcgtgttagaatcctggtcctgcctctgcctgctctgtgctgggattataacccagtcacatctcactctgaccagtttaaactgcccccttgtgtcctgatgtgaggtgtctctcacgcccttgagcgtaaggagcgaggtgtttagagccagtgctgttctgttctgttctcttctgtcgtgtgaactggctctcgtgcaggcagcctagaagtttaaccttttcctctcttatgagaaatcttagcaatcatgtactcagtaaacatgggttggcagtgagcatgtgtctgcccgggatacagcagtgaccccagtatataaaacctctgcccccccttgaaaaaccttaaaaaaaaaacaaacaaaacaagcaaaaacaaaaaacccctctgctcccgagagcctgtgaaatcatcccttacacgtaactcaagacgaaacggttcgcggtgaggatggagcctttgcttccgataacagcacacccaggga

SEQ ID NO: 24907 - DNA, 1164 bp, Mus musculus
tctccagatctctttcccaccaccacgtgcagccccagcctccaaggctggagagcgagctcttctgggggcagctgcttcccttctgccctcgcaggcaggaaggagagtgcggcaagaaacagcagctgacaatgtggcaacaagggtcgtggcgatgagggtggccaacgccaccggggcagaggctccagggcgggggcaaacgcaagatgggcacaaggattgtctgagctgcaggcagctgatagactcctcagctgcttccccgccttctctcatgcttggtgtggccatcattcccggggctgtcttctcattccctcccctgatgtcacccctagctctgactctctcttcctctttatggccagtttcctttcctcggcctctcctctgctctcttcctggaccctggggaagtcattcatatctcttttccagctgtacctgtgacattcctatctccataataatagcatctattattagcaagcacctactgtgtgacggatttttgtctctgactactttgcagtttgaactctgtttgttgacttaccctcgagattgggtctcacagcccagactggcctcaagttccctgtatagccttgaaacttctttacagtctttttgctgtcccctcccaagtgctcagaccaccacatttatgactggcattacaacttcgtttgtgcggtgctggggattgaacccagggctttgtgcatgctggatatgcactctaccaactaagctataccgccagccagcaatgtgtgctctatattctccttgcaaacccatgcacagtcactaccagatctgttttacaagggagaggacttggtttggagatgctaagacatctatctgctcagtgtgactggccagcagtctgaagctcacctcttctcaccagcgtttcctccccccccccccccggggggggggggggacccagttccaggtagttttctgagcacgtcagagccttttctcaaacagaagagaaaccatttgagaaatggtcggtttgaggggtgtgttgtgattttgtattagattcacgtttagtcgccctttgacataaaccagggactggggttgagatgccgtattctgtacttggaaggttgttctctaaccttcagagagcag

SEQ ID NO: 24908 - DNA, 1476 bp, Mus musculus
ctcagggaagctgctcagacagcccccagcccagtgcccaaagccccccggggctctagcagccaggggcccagtcagaccagcactcccacagatgtcacagccattcacctgtagcttgagacaggccctctcaggccaccaagcagaggaggggcccctgccaccccctccctgcctctagaacaatccatgctatatctgaagcccgaggggggctctccttccccctcacaaagcccaaggggccaggtcctgcctatccccacagtgtgcactaaggggttgcatggtcatgaggggcgtcttcatggccagtcagctcctcttccttcccactcaaccagcttggctgtcctgggccatgatggtcagagaaatacaaacaggtaaaatccacacaccagcatttcttttgagtccctcttctgtccggggctccaaccttctcagttgccaaaacgccccagtaccttccaaaggtgttggcccttgcaggctccttcgggcatcccgatagaagcttatgaggagctgccctagatggcctctgtgtaatccgtactccagctgctcttagagggaacagcctaggctttggccagagcaagaacccatacactgttgctttgcttgctgcttagcttctgtgattgtggggtcttaagggtgccgtggtcattttaatttattgctttgaatacaactgtaagagggtacagtgaggcctgtaccccacaagtggtggtaaccctggcggttgctctttccctcccttcttcccctctgctactgctttgtggcccaggagctgctacagcctgggatgggggtcacgccttcctctcctcacccctccacctcatcttcatcagagcagggttaggttgggatggatcgatgccgtggaggtgacagagctatctggagagagggcaagccctagggtcacaggtctttcctcgggccacaaggtttgggctggtggcccatttctatcatgctgccttaataaagatttcggaataaaggtggctcttgtgatccctggggttgtgggagctggggggcaccaggcagctgtcttaggcagagcacttttcctgggaagggttagaaaggtgccgcctaggcagcatggcctgctttccttgtggacgaattacagcgctaaggagcagccagcattacccagagggctcatcgggagacagggctggacccttacacagaaccctaagattcatacgacatcaggcatggtgcttccttagcacactcagggcagacagaggaagagggctagcctgtgctacatagtgcagaactttggctcagcgacagcactggctactcctgagagcctggactcaattcccagcagttaaccattttaaactccagtctcagggatctgatgctgaggcacaaagctcagaatgtattaaaaaaacaaaaccggatgaatggggttag

SEQ ID NO: 24909 - DNA, 2655 bp, Mus musculus
tgatctgtagttaaacacagggattgcttgctctccgagccagaggcagaggtgtgggtggggcagatggatggagatggtagaaactctcaggagcatagtaatcaacaggtgagcagcctgtggtggcccccttgggaacactgaagtaaggctcagtgtaagaagaggactcccataggtgtggcctaattcctgtgactccaccttcccttccagtgcggccatgctgaagatcgcagaaatggaatacagcggtgccaacagcatcttcctgcgcctgctgctggataagaagtacgcattgccctaccgcgtgctcgacgctctggtcttccactttctggccttccggacggaaaagcgccagctgcctgtcctctggcaccagtgcctgctgacactagcgcagcgctataaggctgacctggccacagagcagaaggaggccctcctggagctgcttcggctgcagccccacccgcagctgtcccctgagatcaggcgtgagcttcagagcgctgtccccagagacgtggaggatggtggtgtcaccatggaatgagaacagtcacctgtgttggcccagggggcgcaggaccaccccaggaccccagctggtatagttaaagacctaggtcaagacactgaagggctactatggctgccgtggcctaatcctgggcagggaggactgcatctggttggctttctctgccattttaggctttggtccctgctcacttctggaagctaaccggagttacctcagttcggttcagcgaccccacaacccacctggcagttggtataaggtctgctctctccagatactgtgtaagctcgctggggtgcggagaaaacaggcatttatttatcgcagctcttgtgttttggtccctggaggtccctgcctctctcccctgtcacccacgggagaggtgggagtcactgctggctcctccctgtccccagctcagaagagcgggttcttacttcccacagaaacctcaccccaccttattcttcaaagttgtgtctctagactcttgcttcctttgttcttcacaggaaatgtatgcacacgcgcccctgactcctaccatgacgtacagtcagggccgactctagggatgccagattctgctgccatgttggaaaggtgtctgttggaaaagtggcagtggttcactgtcagggaagactatattgcaggcccttgctaggggacagtgacacaacagaatcaggaaaaaatgggatttcttcctagctatcaagcaaccagagctttaggctggctgagacgccaggtcaggttcctgtgtctgcataactaatgagcaaagaatactgtctggtttggttttggttttggttttggttttttaagacagggtttccctgtgtatccctgcctgtcctggaactcactctgtagaccaggctgaccttgaacttggccacccacctgcctgatggttcaactttttgagggctaggcttacaatctttgtattattttaatggcctgagaaaatctgtatgaaattttagtagcagccaaccatggatctgtaagtttgaggccagccactgctgtgaaacactacctcaccaaaaacaacaacaaaaacccttagaccattgcatcacagctgactgacttgaagtcaccttgctgtatcacgttcacttttgaaaacgtgtgtctataacaatccagtttgtatatctgagaaggtttggtctgttgagttcatatttgcttacacagtagatcatcttgtaaacattagggaaaagcaaagagaacaaacctagcccaacccaaccaaattactccctgagctcactcaagctctccctcccttcctccctccctcttcctctcctctcctctcccatgcagggctgctcctttgcagcaccactgaggaagggcctgcctccctgctaggggaagtgcttccagccacaccctaaccccattcatccggttttgtttttttaatacattctgagctttgtgcctcagcatcagatccctgagactggagtttaaaatggttaactgctgggaattgagtccaggctctcaggagtagccagtgctgtcgctgagccaaagttctgcactatgtagcacaggctagccctcttcctctgtctgccctgagtgtgctaaggaagcaccatgcctgatgtcgtatgaatcttagggttctgtgtaagggtccagccctgtctcccgatgagccctctgggtaatgctggctgctccttagcgctgtaattcgtccacaaggaaagcaggccatgctgcctaggcggcacctttctaacccttcccaggaaaagtgctctgcctaagacagctgcctggtgccccccagctcccacaaccccagggatcacaagagccacctttattccgaaatctttattaaggcagcatgatagaaatgggccaccagcccaaaccttgtggcccgaggaaagacctgtgaccctagggcttgccctctctccagatagctctgtcacctccacggcatcgatccatcccaacctaaccctgctctgatgaagatgaggtggaggggtgaggagaggaaggcgtgacccccatcccaggctgtagcagctcctggg

SEQ ID NO: 24910 - DNA, 1199 bp, Mus musculus
tttgtggtttttcgagacagggtttctctgtatagccctggctgtcctggaattcactctgtagatcaggctggcctcgaactcagaaattcacctgcctctgcctcccaagtgctgggattaaaggcgtgcgccaccacgcccggcataggatggaactcactttgtagatcaggctggcctcgaactcagaaatctgcctgtctctgcctcccaagtgctgggattaaaggcgtgcgccaccacgccctgtgctagagttcatgttatgaataccatcttttctcctaccctgttgttcagaaatacttctccatcctctttcaagtcgtgtttttcctttcattttatgctgaagtcttagatttctggtttttcaggtaatcactctttaaagttttattttgtattagttagatttttatgagataaggttctgggtagctcaggctagctttgaacttgccttgtagctgaagatgaccttgagtttctgatgctcctgctccactccacctctgtagtgctaagatagcagtaccatattcagtttacctgatgctgggggtagaacccaggtccttatgcgtgctaggcagagactgtcattaccagactctattttgtgtgtgtttgtgtgttatgcatgtgcatggctgtttttgccacaacatgggtatgaagtttatagactccagctctctggagtctcagctctcttttccccatgggcctcccagagatcagattcaggcttagcagcaggcacctttacctgctaaacttgcccatattagctgtgcatgggtggtttgtggtttgttttgatcgagggtggaagagcctgtgcatgcccacaccggtgaaggctagcaaaggacactggatgctttccatcgcttgtttcttctatggctctctgcttgattgccttgagacagtgcctctcactgagctggaaacgtgctattttggatatctgactgccagtgaactcttagggtccacctgcctctgctccccaatgctggaatcacaaacgtgtgtgtgtgtgtgtgtgtgtgtgtgtgtgtgtgtgtggccttccagactttacctgggttgtggggattaggatttaggtccttgctgagttatcgtctcaggccccgcttccatttttaaaagtagacttgtatatttattttcctatactttta

SEQ ID NO: 24911 - DNA, 1241 bp, Mus musculus
aggcccacgtgctggactcggtcctgggcccctggcccagctggttcccagctgtagcttgtgttccggggctttggacttccctcctgagcccatcacagctggtttttacttcatgctttaactggatttggctggtcctcaagaatggtaactgtggagaatggaaaagctgtagggcaaaaggtaggacagggttgtcgctgttggcactggagctgtgtgtgtcccaggtgctgagggtttgttatcggctggacgcctgtgctgtatggggctccccttcgcttgaggatgcggctggcctctcctggagatggttaggtggcaggactggattgttggctgctagagtgtcgctttcattctttggacactgatgtcttctcatactgttttaaattctgtgaccctgtaggccaggccgctgtagcagaaccaaaagcagaggactcttactgcacagtttatttttcattaatagttcacaggcattcagttcccagggcaacatgaactccacagcgttaccaggaacttggcttcctatgtcttactgttccttatatcatactgtcccaaaatgctttccttcctacaggatgctcagtagctctgcacccacagtccactgaggagagcgagattgagagggatggttttcagagttgctcaaagcactgtggacacatgttcctgacactcaacactcaggtttttcagggtgcctcctaggttgtcttatcttgcttgagccttgaattcactgacactattacttacctgcctcacctactacagagacatttaacacaaagacaggctcgggaaagctgttaatctacaaagtgtaggctgtcagttaggatcctgtcctcagagcacagctaggcagacttgccagcgcatctgggtagtggctctgaggtactggtcattcttgtctcctagctttagctggcaggacagctcatcacgccttcctgctgtggctcagttatccggttgctcctgttgcttcctcttgctttggttgttagtcatttactgttgttccgtaaacctgaggtgttttacatatcgtaataaagttttaccagcattagcgttttggccttctggtctgtatttggtcttgttgcagtctgtctactctgctttgtactggctgcctgaaaacgcagacgttaatttaattaagtggtaaatgtggactctcagctcctctcagcttctaaaga

SEQ ID NO: 24912 - DNA, 3663 bp, Mus musculus
taaggctgcccctaaggtcccgcccacctgtgtggcatgaagcttcgttcttgcccctagaacatcagtgcccacaggcttcaggagcttttactgccctagtgtgtgagcagtgcttagggactgactggatcgtttgcttgtggcccttgcctgctgtatcccagcgctgtttatccacctctgctgctttgtccgtgaggaatagagcaagactcgtctgttactctggtattagtgaaaacacatctctaaaattgactccatctctatgggattcaggtgctcagagccttcctccctatcaggcacagtaagcttctttctctttgcagtggctactgcagtgccccacagcctcccgtgaatgctctcttttggttaagtagctcgggttaacgtttgagctcaggcagagcagttatcactcaatggggggaggcaacggaggcatggccacacttcaggcacatctgtggtatttactgctgttctcctttgaggtgagctctcagtgggcctgccagacatcagacatggaagaaatcagagtggctcatcctgatagggacgacgtgctggattcaaacaacactgtgaggtttctgtagtatttagcttttctttggaagcgataccgtaaggcatttttgtgctgtttggtttttactgtctgtggcaggcttttctgtgagctttgctcaggctcctcctctcctggacactgttgtcaggtgtcccagttgcccacactgcctgaggctctgacgtaaagctgtaccccttcagggaggccgacattactagcacagcatgacggtgatgatttgttaccactgtaggaaagcccattcaaaaagaaagccatgtgtgctggaacactcctgtaaggccagcacttgtcaggctgaggcaggaggatcatgagtttgaagctacactgtgaggccctgtttgaaaaacaaaactagcaaactagtgaaaaggactggattgcacctcacctgaaaccctgtgttgtttattccagaaagagaatttgcaggcagagaatacagatctgcctgtctagaggggaaacacattaatcactataaacacctacaggaacattaaaggattcttacccaacttttaagaagagttttatagcagctatcagcaggactggtaagcagattagggacctaataaaaaaaatgcttaactgacctgaacacctacatatgagattagtaaaattacttagtcagaagtgaaaccaactgtccccactgagccacccacatgaaggtgccactgcaaccacagatgacacctcagctccaggagcagcagctcgagttaggggtgtggtgcttaaggagagctctgctgcagaagggcagggcagggcagggcagggcagggctgctgcggtactacatagccaaagcagagcgctgtgtcagatgcatcacagtgaaacatcctaaaaacaaaggacagacagacagaccctgactagctgactccaggacatacccccagtgctgctctcccggctgcagtctcctgaacgctgtgattggctggtgtgtttacttactgctgtaaccagccaagatgaattcaccccagccctcaaaaatgacttcttacctcagtctagcctggccctcatgcttgtggtcgcctctaagagcagcacccattactagtgcaaaaccagcagggctagccttggcaccaggaactgtagctctcatcccatggcaggcagagctcttgccagctttaacccagcccctctggctgagatgggagggcaatgccacatagtgaagaacttttagatgtctcttaaaacgtcaagaataagactggaaactgtagaagagttaatgtgtcctatggactcaatagcagagtttatttttgttcacagtggcaaggcctctcgagtccatgattgtatgaggtccctgctctggctatgccttcagctccatccacattcaggggacgaaccaatgaggtggactggccggcagtgcccgagtaagccgagaggtccatggtgaagaatgaaaactttgggggcggggggtgggaggatatctgatatttgttttactgataaagctttgtgaactaattttctacaattcataaaatttggtgccttgtacttgattgtggtttgcatgagagttaaggggagggctccttttcgttatgggtctgtagtgtttaaaggatacgtgctatcagatttttagagcattcctttctttgtcttattacgaatgtaaattgttcttaccagcaagttctagagttttactgtccaaactgtatttgtaatcaatcattcatcaaatgtctgactactaccactgttgttcactgccttttgttcatgcctaacatttatgctggccttttctggagggtgaccctttcttgaatgtctatcacatcctatatggcgttgcagcttatgtgagcaagggtttccggttagttgggagagcacaaatgatgagaaaaggctttctctaaatcacgatgaagctaggtgaccaatggcagtagagtctgcgttaacactggggtccttctgcatgaaccatcaggaagcagtgtcaaaacaatgcgcacatgtgaaccttcagactgtaagacaagccactgtgtactatgcagtgaatcatggagaaatgacccgtctccaccatcctcaacacttctcgggcagatgacaacctggacagtgctgactggctgaggaaggtagtgagactcaagtgtgttcgtcagggccagtcccagccagttctttcactccaagcttgaagtttctgttgaacttgtgagacttcaccaagtgttcatgaatttaccatgcaaagcatacgcggtaactgggtccctcgcttcgttcctagagtaattaggtgaagagttttatctttggggtgaaattttctagggtcacttgattttttgtcagctaagtgtgggtctcacaggtgggtcatttttgtcaatactaaagctgaaaagcaccttctcagaactgtgagcttcgcctctcttctacattcctctgctctccatccagtctgtcactgtaactatgatgtaccgtcaacccatgctccactctacaccaaggctcagtagctatgagtcaggggggtcactttgtgagacctgcccatgcttaagttggcatctttcacttaaaaatacaactagcagctggggaaatgctcattgctagagcacttagcactcgaggccctgggtttcacccagctccactaagccagcttaaatgaaactgcccaaccagcatcatggcgtcaaagaacaacagtaaagttacttggaattaaatcttaggttctgaatgaagcttcagttaagctctgaaagctgtcatgtcttaagtttttgtctcatctggcttttaacttaaatcttgtcattaactgctcaattatgggatcatggcacactttaaggttttattcctccagaaatcagttgctctttcctagtgtagccaaaatcatgtgggttctaagtctcacacactgtttacaaggctgcttcctggtcaccttttggggctctgcaagtaatggcttcaaacccaagctttgtcctcgagtt

SEQ ID NO: 24913 - DNA, 1134 bp, Mus musculus
gccaccctgaggctggctcaacctcctactttctcatagaccttattaaacactgatggcacacctgtcacccctgaactgtcctatgaccaggcaggctttgccagggagcaccaggaaacctcaccgacacaggggccattttagcctttctgtctctcacagggaatacaatgagcagggctgtgtggtctgacttagcagccatcaagaacagatcatgggaacctccacaccaatgtgagcagcgatggcgcgccagccagccaggagaagtgtattttgtatgtgatccaggccagtacacggaaggaagcaaaaagctccagactgctgtttctatggcaacccaacgtcttcctgtctgcttcccaaccatcagttgacccaaggcgcaggcctctgcagctccagcttgagtcacccaactggccctgcccaggactgatccatcctcaggaatggttctgacgacagaagactgtccaggaaggctggctcaccccagctctcccgtacctgctccttagctcgtgtgtgtatatgacagggtgactggggtggggtctctcaccagcgggctgtgggggccctcgaggcaggtccagctctggtgggtggctgctccgcgtgatgatgaccggctcctccgtcacgttgatgctgttacactgcatgaggtcctgcagcaggttgaagatgtcctctgccctcgaacacttgaatgcaaagatgcctggggaaggtgaggaagcagtgagggcctccaagacccggttttcctaaggataggtgccttctggggtggggagaaaaccatgggtaggtgccccatcttcctgtacccatcactctgcctcccagctgcccccacccccaacccttcatccaggtatagccatctctactatctctgaagacaattgggtctgacctacttccagctcattcacagactattcagaccagaggcaaaggcccactgtttccacacaggttcctctcagcttgggagaggcagagcaaggcagtccagtactccttcctgcagcaggtctctaagcacttccaagtgtctgtccacaaagtggcaacacttgactgagcacctgcaactcaatggctctgaagatg

SEQ ID NO: 24914 - DNA, 1198 bp, Mus musculus
cttagttttgtgtgtgtgtctccaaggtcaaatgaaatacatctttctctgagtcatggctaaaaactttggggccatcttttagagactctctctcctgtgcaggatttatgcagtacctactgagtataagacccagcaccctagcggggctgaggtgtccatcctggaacccagagacatggcttggtgggggggtggcctcagggcccagttctccacaagctcaggcagaggacagtcgatctggaatgctggctgcgggtggggaggggagaaggaggtgcttcccggcacggtctgttggctggtcatctcggggctaaagagcctcttagagaggcagtaccttactggtggaggctacaaggctgggcctgacaggagatgtcagagcagagggttgggtgggcatcatcgggggatgctggggaaagctgtttcagtgctccaaggtagtggggtggtgctgaggattctgggttgtgatgctctcctctccctgcctgcagtatctgaggtgaaatgaggcgttcatctttccttctcttgctgtgcccctggtacctcctgaactttctcctgcctgccttctgcagctacagctggctctggtaggcctggtctacgatctgagtcctgctccaggagcccaaagcccttttatgccttaaggcctagccccagcaggtacttggaccattctgggcctcagtgtctcacttgtacagtgggcaccctaacacgtaatagccgatagcctgctagtggcaatgccggtgcctgcctcgtgattcagcacgggtgaccagaccgcaggaagtgtgggagctctgggtgggttaatgtctctcaggctgggagggctgaggaaggtcatgaggacatcaggtgcctgtctggagaatcccccttccttcccaccctgtgaccgagggcagtgggaggagcctgtgatctcagagggctggggacatccctgactttgagtagagatggtccactaaggccccagggagtgagaccaggtctggcaacccccagcctctggagcacccctgcattgagtctcctggaagccccagattgaggttcatgttgtcagggggaagggcagtgcccaaggtagttgccaatttccaggaagctgtgggtagcttccagcctgctcagcagggatcccagaagctcctgttgt

SEQ ID NO: 24915 - DNA, 1150 bp, Mus musculus
ttataggtgtgcatccccacccctggtttgtgtagtgctaggagttaagcccagagctctgtgggcatttggataagtgctgccactaagctacattccaccctccctcccatcccagtaccatgccccgctaccttcacttttaaaaacaggctcttgtatgtagcctaggctggcctgaaactcagcgacatagatcaggctggcctcaaatttttactagtcttcctgtttgacttctgcaatgctgggagcaaaagaaggtccccacactcatcttgatactgttttgggtttgttgttgtttaagacttatttattttatgtatatgagtacacgtagctgtcttcagacacactagaagagagcatcagatctcattacgggtggttgtgagccaccatgtggttgctgggaattgaactcaggacctctggaagagcagccagtgttcctgactgctgagccatctctccactccttgtgttttgtttttgtttttgtttttttcaagacaggatttctctgtgtttccctggctgtcctggaactcactctgtagaccaggttggcctcaaactctgagatccacttgcctctgcttcctgagtgctgggattaaagacgtgtgcgaccaccacgctcttttgatttttggttttgattttttttctatataattactttctccagctagtgaacatgtgtaataataataaaatctttgtagtgtgtgtatgtgtgtgcgccagtgtctaaatggaggttcagaggacaacttgtgaaagtcagttctcttcattcttgtgagttctggggatcaaactcgggtcttcaggtttggtgacaggtgcctatatccattgagccatctcgctgactccccaagtgaactggcagttgtgctgagggagcctgtcttggacatcctggtgttggggaccttggtgaaggcaaactgcttgctaatttcttttaaactgtgtaaggccgactccccctttcagtgagcttcaaaaacaaaacaaaaaacaaacaaaaaaaatgagaacaatttggatggagcatctgggctagtgctcataaacaagtcagcctcgctcacccacacctgcaggagtcacagaccattcctggtcccctcctgcc

SEQ ID NO: 24916 - DNA, 1355 bp, Mus musculus
caggctccgctgccctcggccgcccagccacagtctccgttccatcacctggacttcagccatggcctgagctttgggggtgggggcgacgaggggcccacaggttaccccgataccctggggacagagcacggctccccattccccaacctgtccaagaaggatctggacttaatgctcctagatgactccctgctccccctggcctctgaccccctcttttctaccatgtctcctgaggcctccaaggccagcagccgccggagcagcttcagcatggaggagggtgatgttctgtgacgctggctgcccctgtgccaaggagcaggggatgcctggaggctgggaggaccgagcagagccctcccatccttcaggctgcacttggtgtgaagtagccgcctaccctgcctctctccttccccttggctgctacccccaccctgtttggacttagtgcctgcctggcagctgatggggctggaggagccctccccctcggcttcgggccccctcctctggcggcagtactatgactatgatggggaagaacaggggtgaggcagaagagaaataagaagaaatcctgctaggggagcccctctcctgagcctgggctctcctgtggaggacattttggagaaggaggtacaagtacctctgaggcagcagctggtctgggggtgcccgggcctgccttcctgggactagatggcacccagcctgtcgccctcagcctgaactcccccacaagtggggcatccacccccatttggtgctaacagctctcccctggtggtatgagggtggggtggccagaagaggagtctgggttcagggtggcgagcacccccacccccagacctcccactttgtgcctttagtaaacactgtgctttgtagtatgttgtcctggctctgcggtgcgtcctcagcccatgactatgaggggcggggcgggggccgagcggggagggcagcccagtggactccttcttggattaagaattcaattgctccatgaaggatctgaaggaggttctcttggattcagaggccaaagaaacaaccttgacagcgtggggctgagagcattgtctcactgaggccacatggtggcgctgcagccatgctggtctggacccacacctccagctgtggtctgaacagcagtggaggtgggtgtgtggctggccggcgttctagcatggccctcaacattcttcccggtgttggtagctacagaccagctggagaccaggctgtatccttatggcgataggaaatggacccatttggaacagatgagagcacaggaccctggctgggagtcaaagcttagggttcactcccct

SEQ ID NO: 24917 - DNA, 1223 bp, Mus musculus
acctgtgctcccagaaagctatctgtctggagctcacagcctcagcccccacccccacccccagactcctaggggttcagtaaaggtagtgaggaccgtaagctagttgccaaagttatctgcagtgctcagtgtgtgcctgaggtacagtgtctcagcctttctaagccaccagggtccctgtgcaatcttaaaatcagaagtcaggagtgatttctgccagtgtgtttggccagtgaagatgtagaaaggaattatttaatttcattggcaacaacattttcttgagaccgggcctctatgtagtccaggctggcctgaacccccctgtatagaccaggttggcctctgcctcccaagtcctcggattgaaggcatgtaccagcacaccctatccgagacaaccctttctgagatgagacagacattgaggactttccctctcagtgtccctgtgccgggactgaggttattgttccctgggatatgagatgtgggaccatgggaagattttctacgtacgttcactggaatggaggtgaacccattcactgcatccccagaatgccgtgcgccacaacctcagcctgcacaagtgtttcgtccgtgtggagaacgtcaagggggccgtgtggactgtggatgagcgggaatatcagaaacggagaccgccaaagatgacagggtatgtgggccctagctgagtaagctgtcccagcccggcctgagccagcccagcttctgcttctcagggacaccccggatgccctcctgagaaaggaatgtgggtgtcaaggatgaaggagaccagtgtgcatggccggctacctggacataactggcaaccccaagatgggcactgccatcctccattctcacttctgactaagagaaggaatctcagggagcagggtaccagagaggtgaagcccacagtaatcatggctagagctggcatgtgagctgaggtgacagctgccatcctaaactcttcctgctataggataagaatcctggacccaccgtctttatttcacagtggaattgttgagtggagagggccagggtctgacgggaagccagcaggaaagcaggttgggtccaggaccaggcctcacatccagtttatgctctgtttcagcacacagtaggtcagaacctttccctatctcaccagcacctattttcttgcctacatacattggcgccgggctcctggctca

SEQ ID NO: 24918 - DNA, 1300 bp, Mus musculus
taaagccatccagtcagccattgcagtaggggagagcagccttctcaacctggtcctcagtcgaggcagccacagcccctgcctccctgtgggttctcaacagcatccatgccctggtggggtgccgggctgcctgatgcatagacacttggcactcaggtggctcccaagcaaagaagcttcctgttaggacttggagcaacagaccaagctgctgtcttctgacctgtgctgataagaatctgtctgcccacatgctaggttggtgtttacttcagccaagaaagtacaaaaaggatatttggactcaggataaaaggatagatggacctaaaaggtacatttctagctttgactgtggtctgctcatttctattaacagccatctgggtcatagttcatactgtggccactttagagacagtttagagagtaaagaacaaaacttcaaaacatctgtgctgaagtgttgaggacattcacagtcgttctccaacagaggcgaacctagggtattcaatcatgggctttatgacagcaagtagcaaatggaaggatctgtgcatttcaatctagagagcaagggccctgctggccctagtgctgctgtagagcgtggttctccagtggatggatagataccaggcatgactcttaggctgaagaaaccaagtcacatttacattgacaccttctggcgtgcactaaaagagaatccttatattgcctgaagaagcactgttgagctagctgtcttggctgcaggctggagcactgctggagcacagagtggaggagagagatgtgcttcatccctgcctgggtgctgacccagagggtgaatgctcttcccatggcagctgattctctggtgccagtttccacttgttttctcctttctctgtaggccttgcagcaaggtttgctcactgcatcagtgctgtagggaccaactacagcctgcaaggattcctgcagggtcaggaattgggcctcagaaatgtgttttctggacaagcactctaccactgagccacacacacatacatacacacacacacacacacacacacccttcccctgccccagccccagccccaaccccagccccagccaatgctgaggtctggaagaaaagaccaatgttgatacatcaaaagagttggctgccttctctgcaatcaaagtcaaacgcagtcaatccaaagactaaaatacccgtcaagtctagagactggccctttgactttgttctgtgttaaagataggaaagactttaaccttataaagaaatatcgca

SEQ ID NO: 24919 - DNA, 1125 bp, Mus musculus
atgttagtgcaggagggggggtggggtgggcagagatgatggataaccagaaaagtaagtggttttaaatttgtgtcgactttggggactgaggcaatggctcggtgttccctatttgctatgcaagtgtgaagacctaagtttgggtccatagaagtcatttaaaaatatgtaggtttatcctataatcccagcactagggggcagaaacaggaagaacctgtggctagctggctgtccctgtggctagctggctgtccctgtggctagctggctgtccctgtggctagctggctgtccctgtggccgggagctctaggagactgtctcaaaacaaggtagcaagcagtagaagatggcatccagtgtcagcttctggcttccactttgacaccaagaactgcacagccttccagggcactgcaacaacacagttgttgttgatcttacttagatctagattgcactgaagagaaatagaagtgaaggggacttctcatgagccgcctcatgttaggagaactcaaacagttctttctcttactctgcagtaaggctcctgttaacatttcctaacaccgcacaaaaaaccattggtgcagcaaagggaatttatggagacttgagagagtgtgaatataggccataaagttttgggacagccctgaggttgggctgatggttctgatggagaatggtggagagctcgccaccatacacatctaggacacagtaactgcacaggtagttgatgctgttggaattgacttctgctgggactaaggagagtgtcagtctgttctgttacaaatcgttccttcaagcagagacacgctctacaagggagtttgggatttgtcctgttacgcctcggtccaaagcagcttctgtctgggcctctgaaggctttcttgagttttcacactggggttcaaagtgtggctgagcattcgtatcggcttcctttctagagtgtctgttgatgcggaagactgaaaattggacattctatttacatacagtagctgtctgatttcagggtttcactgctcctgataattaaaacaactatgcaaatatttatggtgcagttcgaagaactctaccttgatcacaaactagcta

SEQ ID NO: 24920 - DNA, 1300 bp, Mus musculus
cctaactctctattattttaagtatgttttaaacatatggacattttcctgcccactcaagtcagttttcattgaaagagtaactaggctagtgacctcgtatcaaagagtgaaataattagaaagtacttaaaaataattggaaagcaaagagatacgatggtcgcccaagaactgtcttgagtgacttcacaacaagaatcgacctggagatttttcatcgtggcttcctgtgggtgagaacctgggaaactgctttggttagagcccaaagggagcggggagggggcaggctcctaagcacgtccatcatagccagtggagggtgtgtgttcacgcgtcctcttaaccaaagaccaagaaaagggcgtgttttcctttgttctcaggattggatgtggtctggatcggctgcagtgggaaaatgtatctgcgattctcgaagaggtgtttgagtcaacagacatcaaaattactgtgtacacactctgaacagatgaagatcttggatgagcccgtggtcttttgtgtcatctacgaagctgtgggactaagcagctgtaggacctcagaatgggcaaggacagtctgtgagagggagtctctcctaggccagatgtgggtttctgtactccaagaggatagggagggcactgcacccaagcaggaggtgaggtctgtcactaggcaggaaaccatgtaggtaagtgtaggacctgctttgcttagccactactggatttgtttggctggccactgggtggcagcataggttctaattttcttttgaagagaaattgtgggaagggtaaacttttgagatttttttttttaaaacaattttatgtttgtgcactttgtgttaatctcaccaaaaatcatcataggaaaggattatggtttttagttatgacatcacaatgtgtcaagagtggaacaataaacgtttcccttgtgttcactgaggtttgcacacatgaacgtctgtgttctggatcttggggacaggctaaacttgagactcaattttgaagagccagagttccctggggagaacaagaaggtaagaggaggtatggacaaggactgtccgcctggttacaaggtgcggttagagtgcttgtggggctctttactgtctgctgtggagttgatgtgattggacatgcctggacttaatcaggaggccagcaaaggaacactgaagactcagaggcaagagcgggttccaggtcctagaagattgtgacatgcaactaactgggctctcacgagcactacagtaattattggtccctct

SEQ ID NO: 24921 - DNA, 1118 bp, Mus musculus
tagggtgactaatagtgctcctctttgaagggtgcgtgtgaggccaaacaatgactccctggaataaactatgagctcagcaaccaacatttgggaagagaatttagcccgtaagaggagaaaggtttttagacttgatgcaggtagagcgggcttgggacagtaggggtacacctttgagcaacgatttctgcatggtgtggagaacccagtgatctaagccctaggtaaggaataatggaggctctgtgtaaggcttccagtgtaaccaagatggctcctgcatgcttttgttcttggaaaggtgacttgagtgtgtagaggtacaatggagtgctttcaaagtgagggttcttaaaaaatagttgtcctgggctgaagaagtggcactgttaagagcacatgctatttacacacacacacacacacacacacacacacacacacacacacacacacacacactgaaaaagctatctttccttttttcaattgttgatccctgtaggaatatgtaagagaagagacccttgccctttggtccccacccagggacctggtctctactgccagaaacctgcagatagacctcatatagtagagtgcttacaaagattataggaaggcccaggctcaatgtccagtaccatatgaactggatgtggtatatctctcctggagtcccagcactcctgagctggaagcagaccggtcaaaggttaaaaccatctttgcctccataacaaatctgcagcagcctgagctgtataaagccatgttttcaaaacaaaacaaaacaacaacaacaacaacaacaacaacaacaacaaaacccacaaaacccaggagctattgaactagctcagtgggtcaagcacttgccaccaagcctggtggtttatgatccccttaacgttcatggtagaaggaccttcacatgttttgtgaccttgaacaaaagttcccttctggcaaagtctgatcaactgctgctctgaggctcccaaaatcgtaacatacagcactgaccccacagaagtcaccaacagacacggtgagttcagctctgcatgtggatcaggcatgagagtcaccagcaccaggaacagggaggacta

SEQ ID NO: 24922 - DNA, 1164 bp, Mus musculus
tccggggtgactgtttcctcaactgcggatgggaaatagaggtttcagcttccagcttctgtaatccaggaagactggctagaaaagtgagggtgtgggttctaaccagagccatccactctctctgccacagtgagcggaaacaaagggtatcactgctaatcttatgagactattgaattgcttaatcacccccaccaagtagttctgtctgactgagggcaggtgtcctgatggaggggcaactgtgaggccttagcagccagtatctggggaatagctgccgggattcgtaaaggccttaacaagagtgatttcttcagtgatgtgggccagcccaggagctaatgataacggtgtgcatttttgcttctttatcatttcttaggggccggagtcacacacccattgcatgtgtaactcacaccacaggcttggagagcagggctaatctggtctccagactcaatcataggtttcagctggcttctaaattgctaggcctcctcatttctagtcagagaagtcaagacttgtgacatttaaacttactgacaaaatgcacatgccctgcctggggttagctttgtagaagactggacgttaaacaacaaatgactaaagagttggcgggttgggtatcacagtctccccaccccatgacaccctagcacaccgcctggagaactgcccttcctgggtaccaacatgtgatgactccggcaccaggaatggatgtggccctcacatctgccggctttttcctcccttcctctccccctccctctccttccctgtcccttctcctcctgtcttcccttgtctgtccagcatcctcatccctcctgcctcctgcccatttccctcccttgccaacccatcgtttctgttcctctattcttccctaaaggatgcgttaagtttttgcccttgctcaaataaacaccctcccccaggcaacagccggtctcctcggcttttgagtttctcgtgtcttgctgtcttcgctctgtctgctctccagcaggaaaataaaattgcattcgattgacaggccatcctgctgggagccgagccatattacacggcttctgtgtgttcctggttgtgatgaaatggtggaaaatctccagcaagcctggaacaagataggtgctggtaatt

SEQ ID NO: 24923 - DNA, 1099 bp, Mus musculus
acagtatgtttaatagttacagatctacctagacataaaccaccgtacgttttacttcctttaagtggcttattatctattttagaggacataaggcaagccaatacaattattctcctaaaaatgtttttattatctttattactgagtgtatgcgtatgggcacacacatatcatgctgtgtgttggggagcaaaggacaacttgtgggagtcagttcttttcctcccaccacatgggtcccggggattgaacttgtgtctttgggcttggcaggaagcacctttatctgctgagtcattgaccacagttaattgatttctgtattcttgagaccaggccacatggtgtagccttgcttggtctgtaactcattatgtagactaggctggcttccagagatatacgtgcctttgcctctttagtgctggggttaaaggcaggcaacaccatgcccaacccaatacaattattttaaaactttgtttataaacttgtcataggccagctgtggtggcgcacgccggtaggatttgctggaggaggcagaggcagaggcagaggcagaggcagaggcagaggcagaggcagaggcagaggcgcagggggatcacaaacttgtcacaagcccctgctgtgtgccagttcatcctggaaagggcccaggcctgggtagtattgaagctgtaagggatgcagctggggctgggagttgagcaggtaggcctgtgtcaccatatgagtggacagcctaacagatgatgctccaatggttgtgtgggtcacagtgtgcagaattctctccacaacccccagggctgcttgagcctcctgcagttgtctctgttcccactctttcccccagaccactgtatgcgcggtaggctggggatttctagtgcagagcgagtgctgtgaaagtggaagttcaccctcccttgcaaggagcaccgcccagaggtaggctttcaggaagccccccagaaaggaggcagcttctgctgaattggagggagggtggttccagatctgccttgtgctggacagagccgggatgggagcattggggcacagggtcgggggaaagctgtgcgctctg

SEQ ID NO: 24924 - DNA, 1125 bp, Mus musculus
ctggaccttggtagcctcaggaggaggaagtggccaaataagggaatagaccttggtgactagctttctaaatgtaatcttaacagtattttttagcaaggtcgaaaaataggggagaggggaaaggtctggcagaaccatgtttgtcagcccaggactgactggctggagtctctttacatgggaactgctatgctcagcttacttccttctgtcctataacattcattcgtctcagctcttttgagcatatttaaaagagttgaaggatctgtttaccaagtcctaaagtgggctttctcaaatacacacacacacacacacacacacacacacacacacacacacacacactttttttttaatcagctgcctcttttactggatatggcatgcaatttaaagctttaaatttaagtattttgatgtcgaaattctgtacatcagatttcttccacgcctcaggtatgtggctgcttttgtttggtgatttttgttgtgctagttcttgtactgttttctgcctatggctgtggaatctgtggtctgcaatttccttcaaacacacagctctcagtctttgcatttggactctgtgttggatgctatttacttcctgtttgtaaagtgcctcaaggcgcattagaggtaagttgaaggttttctggaatctctactgggcccatagtcagccccagggtgataacttccttacaacctaaagccaagttatttgtctgtcaggcaggggcatggaaaataggtttcccccagctgtttacagtggtggcacagtgggtactttgccagcattgattaattggaggtagtttttagaagtaactttataatcatgaaagcaagggtttttattgactagtagaatacacctctaaggaagaaattcagattttattcaattatattttatttgcatgggatttacatttatagaatatgagttttaaattattaaatatgaaacctaggtcaaggttaacagatggccatgttagtttctctaatcatttttgtacacattcttaactggtttcagttgtaaatgggagctttattgttcgatttctttatcactcctattcagtgtgtttttaaaattgagat

SEQ ID NO: 24925 - DNA, 1117 bp, Mus musculus
agagctacagtggcctgttaaatgaggagcacagaggaaaaccacattcgcacaacccggagtcagacctcctgggaattagacctggagttccttctgtgggagcaggtttcctgtagagcgttccaggtaccacaagatacagggctcctattcaacccccaacaccctattcttggagctcagctgtaaactctgcatccagacactccaaggatgggcctgcctgcctcggggcccctgcctgggctgggtatacatgagacatctccccgtctattggccgagtacagagctgtattgggcacaaagctagggacagtggaaatggtggatagatgtagcatctgttagatgtcacctctgccttctgtcctcctcagagagcagctgggcctctgggcagtgccccacccactaatagcattgtaattctctacagacaggaatgctaatgtcaggatgctctgcaggcttcttagctgtactgcatagcagggctggtggctcactcacatggtggcggggctcagtcatggcctcatgaattctaccccctgcctctgaccagtcttctcagcattctgaggagcctgcttgcatacatgtcccatgaagctgctctgtaagaatcagggccaccatccatccctgctagaaggcttccagcaagcattccacttaaagccttgacataaccgtgtcagtaccttagatctagtgtgggaagtattgactgatccatccaggtctgggacagtgccggccatgtctgtcactgctgagccctgtccccagcatctcctttgcgttgagaataaggtcaatagataactatcactggctacccaccaggccaagaagatgataggctgacccattactgtttgaatggacatttcataacccctcgacctacctgccctgcccatgcccgtgatgtgccccgctcctgtgcttgtgtgggtgccacatgagaaccccaggttcacactgagatgtttctatggtccctaggcaggccactctctccttggaagaaccaaggatggaaagctcttctctaagtgactctattcttcgttggtgaccattgcttcccttggttacctacact

SEQ ID NO: 24926 - DNA, 1177 bp, Mus musculus
atctgtagtcctagttaaatttaagtttaaatggtatatctacaattggcctctacctactacttcgaaaatactaagagattaaacgcttttaatacagcaaagagtggggattattgtttggggaagagtatttttatttttgtgggttgtttggtgctttgttttgctttttggcatttagtaagtaataaacctttgaaaagagccaacagtcacataaaactttggaaataacccaacagggagagtattataaagaagcaggtctaagtgattttaatatgaataatacaattttattttgtttatttctcagctaaaaagctgccaaagaatgaaccacagaatcctggtgcaaactcagccagaggacgaggagtagaccttactgagcctgcacagccagccagaagccagtgttgtagtaactgagctccagtgtgaacttcctgaatggcaaaaaccatggagttgggagcatttagccggcccagtgtgacttccaaaaagagactatggtagaatcaagtttctaattctgaattattttgagtgttttgaacttaatttttaataacatgcatgtgctcctccagcagtagaaaggaaaatgaggactgtgtgtacacttgttccatgtgaaagtgcaggggaacagctcatctccagtgggtatggacccactcttaacccacccagtctccaaactgggataatagtcaggaatgacatgttcaaaattactaatgtatgctttagaaaacatttttagaagacttacgcttaacaataaaacccaagcaaatggtgtaatttgattttcttaaaaagtctacatttcacatattaataaagcaatcccaacaaaacagtcttgcatctccagaaagaaggaatgaatattgatgacatcttaattttattcagtcccattacttcttaaaatttgattgaaaaaattaagtcacatgtaaccccatgctgttttaggaatatgaaaccgataaatgcattttaatgatagtggtcccttcatatgagcttcttttaaaaagtggaaacaaaccaggtatctgctttctagttaatcactgttggctattccatagaggtgtgtctggaacagggagggggctctgcttccctttgggcataattagtcagtgcactaaca

SEQ ID NO: 24927 - DNA, 1236 bp, Mus musculus
cagcatacttcgaaataacaaatgagtcatgcaacccaggattgcgcgtccctgtaggaatgactacttgactcttcttccgtcggaacagttccccgggccagcatgtgtaaagggaggtgaaagccgcagcagcctcttgctagagagacaataatggaggaggagaaaaattaaagtggaaagtcacatttaaagtcacttcagagaaaaccatcgtgagttgtagaagacagctttctgaactgccagaaaacaagccaagaaatcgaggagacccaaacctcagggcggttagaccacagacctgagctcaaattctcacatggcactttccatctgtgccctccgaggcttctcacccttcccagactcgagcttcatggctgtgcactgtagatagtgacagtttttccgttcagtcaacattgttactcaggctgccaggcattgatgtagacgatgtgggggtgtagtgacagatgggtccttattcttgtagagcttgctttctggtagcagaagcagatggtgaaaaagaaaataacagaacatggtaagtgccacactgaaggaaaacagagaagttgctggtagtgcctggggaatcccttcctgtcctaccccgcagggactgtgcagagaaaaaaaaatttatttttttgttcagtgaggagtgagtatgctgggggttgaacctagtgctttaaacattttaagcaagtttcatttcaagcctgagacaggatgctacttgtgtagctcatgcttgaactcatggcaatccttctgcctcagccttgcaagtgcctggattacatacaggtgtgcctcaccatgcccaagcaagaacattctggagtcttctctcctgctcttttcctttcagccctaccccacccctagaagctgcttccgaactgactctgagttttgttctttggtggtgtaggcctcataactctagttgctccattaagaggctaagaggaatttaaggccacagaaggaatttaaggccagcctgggcatgatttagatttggtttcaaagaaaaccagtaaacagagaggcggagatgtagcttaagaggtaagatgatcctgggttccacatttagtactgccaccatcaccagaaaacggtattacacaatacactttagtgcagcagtgtttttgagattcaaacgtgtggctgcattcaccagtagccactttctgtttttcgtggagg

SEQ ID NO: 24928 - DNA, 1148 bp, Mus musculus
tctggttgcccatatatatacctcatgcctttcctttttagtttcttctctctcttccttccttccttccttccttccttccttcctttctttttctttggggccagggaattcttaacctcccaagcctaacaatgtcagaacgtatagagaaaataaaggtgttcacagagattggctggatgcttccctgtgtatgattgcaaatattacctgtttttctgaactgtgattaaaggttgcattgcttgcagtttacactatattcagttccttgggtagacttgggtttattcctttactggtaaataattttaagttaaataatatttgaggaggggagaggggatctggtggggggagggagaaagaggagggttagctgcattgagttgcattaatttacagatgtggtttcatatcttcggctctgtgagtacagtgcttaaaactgaactgggccccgtgagactaacaacactttaaatggggcttactgatagagtctcaggtataaaatgaatacttattttgaagatggacttcctcaagtgaatgtaaactagatgtaattgtcttctttatctttctattgctctgataaaacaccatgactaagccaacttaaaagaacagttttagggggctggagagatggcttagtggttaagagcaccaactgctcttccagaagtcctgagttcaattcccagcaaccacatggtggctcacaaccatctgtaaagggatctgatgccctcttctggtgtgtctgaagagatcaatggtgtcttcatgttatatttcaggttatacttcctgttctgtttagagggttagactccatgataaaggagcaaaggcagggtacaggaacagctgagagctcacaactggctttgcaaggagaaggtggagagtcttttgagacttcaagcccaccacccagtgacattcttcctctaacagcgtggcactacctaattcttcccaagccattctaccaactattcaagcgtatgaacctacgggttccgttctttttctagcatggagtatgtgacaatgtttttggagtttgagctattttaagccaaatgtatggttaaagtagcctttgtctatttcttttaccttttcatatgctt

SEQ ID NO: 24929 - DNA, 1202 bp, Mus musculus
tgtttagtgtgtgtgagtgtgtgtgtgtgagtgtgtgtgtgtgtgctacagtattttatggagtcagactgtttggagctggttcacttctaccgtgtcagacaaggagattgacctgagggtgtcagtcttggatataaatatcctcacccgctgagccagctcactgtcagcccccgtacacacgcataggtgtgaacatgctatgacacgtgggaggaggtccgaggacagcgtttacgagtctgttccttgcactgtgggttctgggtattgaacctgggtcatcaggcttgtgtggccagggtgttaacttgccgacccatcttactggctccactgttttgtttttgtatttgggaccttgctttgtagttcctgtttgcctgggatttgcatcccctcggtctcagcctgccaagggttgggatttcaggttagtgccatgatgctaggtgataacctggtttactgtgcatgatctttacggttgtctcttacacctctcgcttcctttggtcttaccctaagctgctcacgtttctcacttggagaatgtgtcagaggaagagatggacagactcctgggaattgtgttggatgtggagtacctcttcacctgcgtccacaaagaagaagatgcagataccaaacaagtgtacttctacctattcaaggtgagagcttacccttttatttatttaattaattacatttagttgcatactcgtgtgtgtgcaggcatgcacatatcgtggctcagatatggagattagagaacagcttatggaagtcatttttctctttcccacattgggttctcagggattaaatcaggttatcagctttggtagcaagcatctttccctgctaaaccatcatgttgggttcttattactgttaaaatgacttattttaattaattaattaattaattaattaatttttgtttttcaagacagggtttctctgtgtagccctggctatcctggaactcacgctgtagaccaggctggctttgaactcagaaatgcacctgcctctacttcccaagtgctgggattcaaggcgtgtgccaccagtgcctgacttacttaatttttaattatgtgtacatgtgtttgtctgtgtaggaatatgtgcacatgagtatgggtgcccacaaaggctagagaggctgttggatcccttcaagctggagt

SEQ ID NO: 24930 - DNA, 2403 bp, Mus musculus
taagagcaaatcaagagtgtagctttcttcccacatcccccttgtcagctgctgagagggaggagtcaacagtcgctaatgttgttgtttcctgtgcagatctgaaaaccatgagtgaacgcctcaggaacaggtactatgtgtctaagaagttattcatggcggacttgcaacgagtgttcaccaactgcaaggagtacaaccctcccgagagcgagtactacaaatgcgccagcatcctggagaagttcttcttcagtaaaattaaggaagcagggttgattgacaagtgatttctttcccttagacacacatcagcagtgtgcctaaaacaggtcatttaggtttttggttgcttttgtttttttgtttttgtttttaaattgtacatcatgtgttgaagagacttgtaataattagcacttttgaaaaacaaacaaaacctccttttagcttttcagagacgtatttaaatggaaatcatagattttttttttattttgagcaatagattttaatctatttactactatcatgtaatttttctctggcatgtccagtagctgactattgcatggtagatgatcaggggcttcctcaaaacctgtatgtgaggaaattgcacacagtaccaagatttggggtaatctagagaaaagtttgaccatgaatgtctccattttttttctaatggaacatgagagtttattttattctgaaggactttaaagggtccgtgacacacctgtgctgtgaatgaactgtgtgatgtttgaagtctccttgtagactttttataagtatatatttttaaaacactcatctagatgaggtgctttgagcagttctgaaaaaaaaaaatgcagcttccacaatagcggctgctatgactcctaaggaagggactttttataagctcctggggctttgatcattctgtctacctattacagacttgagagtgcacaaccactatttaataatatcttggcagatatgtgtccatctcatatttgactttgcttgtgcagggcccaacttctaaaagatccgttcccaggccacaaaggtgttagcttgaaaatatttgaggttgagttaatgttaagacatgtggcctaaacatgaacccaggggagccttgcttcactatgtaaggattctttgtattttctggtacatttaaccccatcaccagtgtctatgtgaacatttcccatttgcacttccagagttttgtttgtctgaggtgaactgaattctcaccaaagtttaggccagtattttaacacctccattgttttattggtccagggttatatcccactaacattcgctgtacaatcttattaaccatttttgtcttgggactccagcttagtgcttggatttatttcctaattacactacatagaaaagtgggacacctgccagcccaactctgggaaaaaccaactaatatacaaccatattaaatgaaggccaccttaatggtctcgacactaatttttatgatgcaaatttataaactgatttttttgtaaaggctgaggttttaaaaatgtatttaatgtatgttttctatccgcataaattatattgggtcactaatagtcattaaaaatagcttgcagaggtagtgtgcttgaaggaaaatatcctggcattgctcccgagtgctgcttctgacatggaaggcatgctgtatgttcatagtgttcactgaagatcacactgaagatgcctcaacattgggaaatgtaaggaacactttgagtggtatctagactattaatgaagagtgataatagaggctgcattaagtgtctcagactggttttaaaacagctttgtaccgatttcgctgaagcgtctgtccagtttggtatcctgtgaaagtttgttatttcctgggtagacatccttaaagagtattgtctttaaaatcagatggtctcttctatattgaaagcatttttatgttttctaatttaaaattaatattttcttatagatattgtgcaataaagcagaagtagaatgtggtttttgcaaatgctttaacggccgacaaaaactttacatttgtaaaattaatatattgtactggtacaaaatagttttaaattatattttgaaaagctctgtctggtgttatgttttatttctctaacagtctgaagttacaaagaacaatgtgtcacctggtatgagcatccattgctcttagtctttacttcttaagcttttgtgaacatgtctagacttgccacagttgtaggaaattttataaacaaaagaaaacaatgtaaagcaaaccctctttgtgttgctagagagtcgttagtccagaaggcatatggtcggttccccagcacccacatctgatgcctgtcattccag

SEQ ID NO: 24931 - DNA, 1157 bp, Mus musculus
gctgacttcaaactcgtatatttgtagtcatgtaatctcaatgtctccctccctccctcactctcttttctctctctttacttacagaaagctaagaagaggggaccctttcacggacttgtgtttcttgaattctcctattttcaagcagaaaaggggtatgagatgtcctaaaagaagaaccaagcaaacacagtaactcatttgattagctactgtttaaggtgatccttcttttttacctaataaaatattattagacagtgcacaatgggcagaacctctaccaggctctgatcaggagggtctcttggacatatactttgtatggactattatattaccaacatctaaaacttctccagcatccttattttttccttaagcaggagaattgcagagtacaaaacttgcatcgtagaaaacttacataggatgtagatctttcataaatccttaccatcacagtaagacataagtgggtgaggatcccttctgtcattgattctttctgtaaactgtgtatcgaatggtgattaagagaattaatgaattgggttctggaacaaggtaactgttgtgaactgtgagtactatgctattgctcagcagaataatagcactgtcgtggacctcaggctagccctttgtgtggtcagtctacagtgtaaataaaggtgtgaataaaggggcttctggctttgatatgtgaacaaaataaaagtatccagttcagaacattgaatctttatgtgtgtatgtatgtcttcaaacttaaatcgttgtaactggtccattgttaaaggtgaagcctatggtgaccgcattgtgttttccttttgctcttaatggtcagttactcttgattatcttcctttctggcctttaccactcccaacttagctggaacctcttctgtcttccctggttccccttttcttcccattagatttgtcctgtcaagttttcccaactgaagcctccagggccaacatcaaggcatttcaattttcattaaatcggaagaacgtttgtctcctatgggcaaggcccagggatagataaataccactcaaacaggagattttaagctatcagaagggccttctggtggtcatctcagattttacccacaactgcatggcttcctacattta

SEQ ID NO: 24932 - DNA, 1196 bp, Mus musculus
gattcacaacttctgcgtttgctgttttccctgctttctcttcctcctgctcgtccaacagctgactagttcttctactttaggtcagcatccctgtgtcatagagcgctcgactttagttgctctcaattcgttcttgtgttgccttcatagcacttttcactgtgtaaaactcagacgtgtctttttttttcattgggaggagaggcacaagtgcctcagtgtgcatgtgaacgtcagaagacacttctgggtgttgtttccttccacgctgggttccacagatccaactcgtcacgaggcttgcatgtcagctgactttacctgtgacctaccctgcaaaatcgttttttaaattttctctttatacactaaaatgtaagctttaagaggcagagtgtgtgtggtgtttcagctgttggaatcctagttcctgaaactacatggcagtgctgtagactgtcagcaaatgtatttgttcattcaacaatacattaataatgcagagtgcatatgcatacctcatagcagtacatacttgtgtttttgttttaatatattaacagaactggaaaggacgtccctcagacgtggtctccagcattgacaatacgaccagggacttgtcagggaagtccttacagtgagtgccaagttcattattgtttctataacactgatccatttgttaaaggaaattgacattatttgtgtccacagtttgaggcttttcctactgggagtataagtaagagaatttgatactcaaatactattgtatatagaaaattagagctgtctttttcttttgtttagttgctttaatgactaagagttagaaactttcttttaactgttttctttcagtctagtttttatgtgtgtcatattttcattttaggaaggagtcattattaaaaaggatatttttccagttctaaacactgtccaatttagcaggaagaaaataaagcaaaacacctctcattaattagttctgtttttccagattcacatgctgatctcttctctttgattgtatagattttatgttctttcttttggtttgtttttgcttttttggtttttcgagacagggtttctctgtgtagccctggctgtcctggaactcactttgttaaccaggctggcatcgaactcagaaatccacctgcctctgcctcctgagtgctggg

SEQ ID NO: 24933 - DNA, 1189 bp, Mus musculus
ctcagccctggggcccccctatcctaagactcggaaaggcccaccctgaggttctattgccttcctggtggtatcagcttccagctgtttcaacccttcccagcccgttgctggcgatgggcccatgccccctctccaggctctctagaggcaggcaggtccttggaatccccagcctgcaagcagaggctggccagctccccagctcagcacacagagacacctggcacctgctgctcatgaagaagtgcacaaggcacaaatgtgtacacttcccatgggaccacagacccagctcagctctgttgaagaccaagcacaaaggccttgaagagtggacattcccaggtccctggcaccttcccttgagccagctccattgctacttattcatgtgactgaagctgaccacaggcagctggcaggtccttttttcaaccagcaggctaggctggccatagacccagctctgcctcaccctgccatgttccagtaatggaggcctccagcctgggctctattacattcttctctacagctgccccataacccgtggcttatccctggcacgtggggccacaccccacgccccctggataggcaacactgtcctgctccagcctgtgctgaaatgaactgtactcctaatttttttttaaaaaaaagtattaaatatctctttctatatagccactgtcccatcttcattcagggaagccctgttcccccgaaaaaaccccaacaactgccatcccaccccagccacaggcttgtgctgtgggcactcagagactttattacccagcctgtcccaggacagcaaagcctatgcagcctcagctcccctgcttgagcacactgcagacctgctccagcacgtggcacatgccctggtccttcggggtcctgctggccaaggacatctgcaacagtagggctgaggtcaggctctgctccggacacgtagccctggcctcccggggctgcagcctaaggacgcacttttggtgcagcctttggtaggcaggggccactttgaagatttggggatcggggtcttggctgtgtagctcaagctaacctagcctaaaagaagactcacacacagacctcacatgcacaagcctttgggtgccggttgacatgtgtgccacacccagcatcactgtgtgtgttgagtctgagcagt

SEQ ID NO: 24934 - DNA, 1180 bp, Mus musculus
catcttagcactgggtttgcagcaataggtcccagtgtagacagtttcaccaggaattactgtccagtacagtatgttgggggtggtggtacatggtcaacatgctgacaggctgtattttgcacaggttgggtctggggacatggatggcttccaggcagacacagaagaggatgaagaggatgacacagactgtatgatcatagatgtgccagatgttgggagtgacgtgtcagaagctcccatacctgctcccacactttgcaagtgacaggtgtcaagttgaaagacctgggggaaattgacctaggtgacagggagtagtggagtgtaggcacctgaagtgcaaggttggtagtaggcatgttctgggcagtggaggctgtgcttcccctcagccttgtagagctgctgagggagatgggaatggagaccagcaacagcctgctccctgcagcatctgactagcaaccaccagagtgagcctcctgctgactctcatgataaagagcactttgtcctacattcctaggtctggagtctgggggaggcctggacagctacttccaaattgtaaagactctgggtccgtgtgctaatctgcccttcttaattgacagatgcctgcttgggccttaatcacagcacttgctgtgggcaaacatctgctatgaattgtgctagggatgatgtggctgctgtgcaggccctgggcaaatgtggacatgtataaacatactctacttgagccctctgtcttctgtctcaactatcatattacactggtgcatgtccttccacttgtcctgggcacagtccaagcctgctagggtgctggtagaaaagaaacacccagggacctcagaatgatactaaagctacagttggttggttgacttataggacagattcatactgccagcccttcaacggccatggtgctatggctctgatgaaacactgggaggctgagtttaaatagcctgtttatttggggtttataacttaggaattacagctccatgctgccagctgtctccatccacagcctgtgtgcattccacctgtgctgcactccaagatggcaccagagggctaaggctccacacaccgcaagccaggacaagcctgtcccttgcagcccacagaggaggtaggaccttgtctccaactctactgc

SEQ ID NO: 24935 - DNA, 1211 bp, Mus musculus
tgccctttgagctgagggcctccggtggacagaagctggaggagaacgaggccctggccttgaatgagtgtgggctggtgagctggggctgtgctcatgagatcatgcccttggcactgaatgggagggtccagcattttggaccaaattcccactgccagggtgtgtgtggaggtgctgtcacctttggtgggtttattacattgtcttagtgcctttgttttcattctgttagatggggaaggtacctttaaaaagccaactgaagggatctgtatggtggtgaaggtggcatggagacagggtcatcataggggtattgcatcctaggtgacattctatctgccttgcaggtaccctctgccctgttgaccttctcctgggatgcttcagtgttggaagatataagggcagcaggagctgagccagcaaaatctgtcttgaggcctgagctgcttgcagccatcgagcaactctcctgaataaatgcaggcttggcccactgtggctccagtctcatgctgttcccaaacccattcctttccctgagtccccagcaataggaaggacagtagtagcagtagagttggagacaaggtcctacctcctctgtgggctgcaagggacaggcttgtcctggcttgcggtgtgtggagccttagccctctggtgccatcttggagtgcagcacaggtggaatgcacacaggctgtggatggagacagctggcagcatggagctgtaattcctaagttataaaccccaaataaacaggctatttaaactcagcctcccagtgtttcatcagagccatagcaccatggccgttgaagggctggcagtatgaatctgtcctataagtcaaccaaccaactgtagctttagtatcattctgaggtccctgggtgtttcttttctaccagcaccctagcaggcttggactgtgcccaggacaagtggaaggacatgcaccagtgtaatatgatagttgagacagaagacagagggctcaagtagagtatgtttatacatgtccacatttgcccagggcctgcacagcagccacatcatccctagcacaattcatagcagatgtttgcccacagcaagtgctgtgattaaggcccaagcaggcatctgtcaattaagaagggcagattagcacacggacccagagtctttacaatttggaagtagctgtccaggcctcc

SEQ ID NO: 24936 - DNA, 1108 bp, Mus musculus
aagactcggagctgccgatccagagtggcccgcacaggctcggcatccaacagctgctgcttgtgccgcgccaggttctgcggctgcgcccgtgcatcctcacccagaacgtagaactcctcctggccctctgtagaggcatcacagctgtcttcgtgtcccatgtgccaccgctgccccctcccacctgcctggccgccctctcaccctgatccggcacaggtagggtgaccttcttgaagccaatggcttcaaagaactcgtggcttccctcgagacagttgatgcgctcctgaggatgaggcacacacaggtcacccaggttgcagggccaggacccagcactgctgagattgaagccaagcagctcccactggcccaacagctgatgagtggttcttggaatgacgtcccccataatggctttgtggttagagaggctacaccaagcaagcctcatgtctgcatttgtaggataaatttggagggtgtcttcccaaaagtattcaaattaaagagaggcctctcgagggagccaggtctccaaccctgagtttcagtcgtagacccaacattactgcgatcttgaaagtcaagaccctatactcaaaaaatccaaagaacagagctggtgaaatggctaggtaagtttaggtgtgacaccaaggacaccaagtgtgacggctgtgttcccggacccatgtggtggaaggagaactactactccacaggtttcctttcctccacacatgaagcggctcatgcacctacctgtaaattaaatgcatgaacgaaaagaaagatgagtgaggagctccatgcctgtatcctagcactttggaagctggtcagtactcagctgaccccccagtactgggtcagattggactatacagtgagacctggtctcaacaacaacgaaagtaagacagacaaaaatccaggcaagccgggcgtggtggctcacgcctttaatcccagcactcaggaggcagaggcaggcggatttccgagatccgagaccagcctggtctacagagttccaggacagccagagctacacagagaaaccctgtcttgaaaaaacaaaacaaacaaaaaaatccag

SEQ ID NO: 24937 - DNA, 1562 bp, Mus musculus
gctcctgtttgttccctaagtatattcccagctagtgctaattagagctgcccgtggtgggtgtcagcagtgtgtcatggtcgccacacagcagggggtgtgataggtcagccacgtgatcctcatctgcacagaagcagagagggccccaggcccctggccttactgtcctcaccttgggcctcccaagatagcctgtctgatgggagcctctctataggcctgtgaaggtggagcggacgcggaagcggtcagagggtctctcactggaaaggaagggggagaagaagaaaggtgagcactagcaatggtgttgggttgcacggctccggtgtgaacctgtgatggtgagaggggctgggccaccttatacctggggccagagccaccctgctcgagctagtatctctcctgcccagaaccctccgtagaggagagactgcaaaagctgcacagcgagatcaaatttgcactgaaggttgacaacccagtaagacacctgctgcaaccccacactgtcctgaaatgggtgcttttcctcaaccacctccttactgattccttggaagtcttgggaaactgaggcagggtcccctggatggaggagtgggtttcatagtatttcagggattgccttgcagtctcccctgggaacagcaggcagcattctaggagacagcctgggctgcctctccactcttgccttgcaggatgtgaggaagtgtctgagtgcactggaagaactggggactctgcaggtaacctctcagattcttcagaagaacacagatgtggtagcaacgctgaagaaggtatagcatgggcaaagcatctaggagatggtggtggtgtctaaggggaggtctcggggcacagccatttgcccttctaagcctggcctcctggtggccagattcgccggtacaaggccaacaaggatgtgatggcgaaggcagcagaggtctacacccggctcaagtcacgggtcctggggccgaaagttgaggctctccagaaggtgaacaaggctggagccgagaaggaacgggccgataacgagaagctagaggagcagccgggggagcaggctcccagagagctggcagaggatgagcccagcaccggtgagggctgcctgcaccaggccagagggcaggggaacagtgccatgtttgtccccagcaagcttgccagacctaacctcattctggggcagctggcacagtgtgttcaagctctactaggtgctagaaatggggtgctggaagtgttctttgggccatagcacctatatgcacttaaactgcttgtaagtttgaccccagctgagtgaggagggttctttttttttttaaaagatttatttatttattatatgtaaagtacactgtagctatcttcagacactccagaagagggtgtcagatctcgttacagatggttgtgagccaccatgtggttgctgggatttgaactctggaccttcggaagagcagtcgggtactcttaccaactgagccatctcaccagccccggtgaggagggttctaatgaaaggcaag

SEQ ID NO: 24938 - DNA, 1170 bp, Mus musculus
aggacctggtgagggagacactggcagagccagggaagacagtccacatccccccatgaacttactcaaggcttcactggggaattctaggcagacgctccatgcctgcaacgcccccagctccctcacagggggctggggggagggggatcctcaacaaggactccaccctcaccatgcccactagccctctttgtaatttcccagtctcctttgtagttccccatgcagggcaggatctccttgtgtcacactgcccggctctgcagttttctattttcatccacctcgcgccctgtcagacctggcctctgtcggacctctgtcagggtttaattgtgcttgtgtcttgcagtgtctcacaggcctggggccttcaaagctgagctctccaagctggtgatcgtagccaaggcggcacgctcggagctgtgaccctcgcctgtcaagggccttcatgtccacgttcctcaggcacactgaccgggactacttgtctagggcactggttcccataggagctgccctgccctgcacaggtcacactgtgtcactccgcagaactctctgagcccggtcacctgttttgccagggaagatgcagggcatgtgcgggggtgggatggaaggacttcctggctttcctgaagtcaagatgtggtgtggtttcccctctgagccacagatgagtgtccccatcccaggaccactttctaaccccatccagggcagctccactcagaaggatgggaaaggatagaaaaaataaataaataagtagccaccttagtggtggctctgtggggtcaggactcagagatggattctcatcgttttctacaatagcagcaggtgcaggcacatagcctctcctaatagtgactgtcacataggtgccagcacagtgggtcacaacgcaaccaatgactttgcacccacaatgactagtcactctctctcttgagacacaatgatgccttgaatccacactgtgttctctagtactaggaccacagggcaaggccactgtccccacagattttggattcaggattttgaagtcaaatgaaagcaacatgtttttagatttatcttatgctctctctgtgtgtgtgtgtgagagagagagagtgagagagtgctgtgaatctctgctgtttgtgagagagt

SEQ ID NO: 24939 - DNA, 1532 bp, Mus musculus
gaggcccgggcactcagcatgttcagggacatcacccagcagctgcagagcatgtgtgtggccctgggggccagcatccagggcttgcccagccacgtcagggagcaggcacagcaggcccgcagccaggtgaacgaccttcaggccaccttctccggcattcactccttccaggacctctcagccggcgttcttgcccaaactcgggagcgcatagccagagcccgggaggccctagacaacactgtggagtacgtggcccagaacactccagccatgtggctggtgggccccttcgctcctggaatcacagagaaaacccctgaagggaagtagggagaaggttcagggccaacatctatctggcttgactgcttttcccaacagtccaattgcacaacaggtcctcccctactgagtctgaatgagacatgtgtttaacctattcccatcagtcttttaaagcaattttttttctagaatgttccaggggtaaaaagatccagaacattctagaaaaaaaaaatgtttttttcctaaaaaaaaaaaaaaaaaaaaaatgaggaatgagggtaatgaatagtgatagcactagtctgtcatcctgtgtcagcactgtggtatagaggcaagagggtcacaggttcaaagcccggctgccacatcacaaattcagtgatagtctaagctacattagaccttgtcttgaagtaaaaaaaggcataatgatttttcactccgggtttcttttctacatcatggcccacaatagcaagagcttttcttgtttgttttttttttttttttcctgagacagggtttctctgtatagcccctggctgtcctggaactcactttgtagaccaggctggccttgaactcagaaatccacctgcctctgcctcctgagtgctgggattaaaggccggctagcaagagcttttctaacagaccctgatacctggcccaagaacccagcaactgtgacaggatagacagctgggatgttgcaattgtttcagatgagaaagtgagggccgagtacactgttcctcaaatcctggggctcagtattgccttaataaattttatatgcatcagaggccaagtggatggtgtatatgtgtgttgccttcctaggagctgagctgccctgacatccctagagaccttcttccttctgtctctactctatgcacagtgcgagtcttcccactttgaatgttggacgtgatcacttgtgaccctgtggggacagcaggaagggcctgctgcctattttccctccgtctctgtgatgtatggagaagggtcagtgtgacaagctgagcctgccaaatatgcccacagtctgttccccttgatctcagggaaggtggggacaagaagatctggagttcagggtcatccttgactacctagtaagtttgaaactaacctgggctactttgagactatgtttcaaaacagcaaaactcggggcaggagagctgcctgctgtggtaaagtgcttggagttgtttggtttgcgg

SEQ ID NO: 24940 - DNA, 1203 bp, Mus musculus
ctgtcacggactgctgacatctttgtctcccaagctgttcccacatgcagagttcctgaagaaagacccagtctcattcctgaagagtcttgttcccttagacgggttgccattccccccttcccccagtcctatttccaccccaggactcttcttcctgaagtcccagtctcccacattggtcctcaggcttggtcaggtctgttcttggttaccataggttatatgggcctgcaagcctttctttcatatgccctcccaattagtttccaggggtgggggcatcattcactgtaaccctaaaacctctgtgggtactgatagtgctcgacgcatggcttctcaagagcagctgtgagtgcccaggcctggaacagagctttgtctggcctctgtattcccatctaccccttccccatgctaggcctttgaggaagacggtctgttatggattttcccacagatggaggatggccacacactcttcgattatgatgtgcgcctcaatgacacaatccagctgctcgtgcgccagagtctggcactgcctctcagtacaaaagaacgggactcggagctctcagactctgactctggctatggtgtgggtcacagtgaatcagacaagtcgtccacgcatggtgaaggggcagctgaagcggatgacaagactgtgtgggaggacacggacctggggctgtacaaggtgagggtccctgtggctgtgtgcaggtgtgacggtggcattctgggtttgctcccaacccagatttatcctttgccagccttggcagtgcctgcccatctctgtactgacaactgcacagggtctcttgggactgactccttggtgacggcactacctgcaggtgttccctctacagttgaaacttctgtatttttgtcaaactggaggttgagcctccctgagaatcctagcagatgtggttgaagctgaagagtgagtgccccatgagagagagccatgtctgccctctgtgaccacatcacttatttttttttaaagatttatttattgttatacataagtacactgtagctgtcttcaaacactccagaagagggcgtcagatcccattatagttggttgtgagccaccatgtggttgggaattgaactcaggacctctggaagagcagccagtgttcttaacctccaagccatctctctagcccccctttt

SEQ ID NO: 24941 - DNA, 1147 bp, Mus musculus
gaccagagttcaaatccccaatacccacataaaagccacttgcagaagcttgcactgctagggacatgggaggcaggggcagaattcctggatgtccaggggcagctagcttgccagatgtaggcagaaattgaggctagacagctgaagggtgccctaacctgtctgtagcacaggcctgcccagatgatttaatccacacatgtagaaaccaaaggggagaatcaacctgggtgaagaagcccaggctcagccccatagtgtgctaaggttttgggatgttctgtaggaatgactctcagctcaacaactgtcggatcatgtttgtggatgaagtcttgatgattgagctccctaaagagaggaggcctttgatcgctagcccctcgcaacgtgagtcttggtcgggccctgagtgtgcctgggtgggggtggcaatcccaggtggcatggtggcctgttgcagcccctcctgccctccggaacacagggaagagcggcccatcctgccggttctgcaaggatgatgaaaacaaaccatgtcgaaagtgtgcctgccatgtgtgtggtgggcgcgaggctcctgagaaacagctgttgtgtgatgagtgtgacatggccttccacctgtactgcctgaagccaccgctcacctctgtcccccctgagccggagtggtgagtggcatacctctggggttacctagcaggtctagaagggaatggaagacaggctgggaggtagctcagccttgatgcacaattctgctgtcctgagttcaaatcccagagctgggctgttaacatgcccctgtgagcccagtgctgggggagcaatgataggagtttggctaggaccttctgactgccagcttggctgtaggctcagtgagaggaagctgtatcagagttaagggagtttggctcgtgtccctcaggtctgccactgtgtgccccactccactgtgcagctgtgcacttggggagctttgtggttcccttctgcacaagggggctgcttttgagctgtctgaccctatgcagacgggaaacctgagactctgccagagaaggaagggtattgtcacatgacgcatgctctttctttcccttacagaacattgggatttgctctttttttttttttg

SEQ ID NO: 24942 - DNA, 1335 bp, Mus musculus
gggatgttgccaggagctaccaagagggagctctgtgtgtacgtgagaggacggagtcctgtggggctactttgagctgtcccctcaccctgcctatttctcacgcaggactgtctggacaggtccttccgggcccaggtgttcagctgcccagcctgtcgctttgagctggaccacagctccccaacccgggtgaaccagcccttgcagaccattctcaaccagctcttccctggctatggcagcggccggtgatgctgagacccaggcagagggctcatggttccaacttcatagtgtgtttagcttgaaggtgttgtccttcacgtctgcctgtggcaactcttctgatctggtcaccagttaaccaggcatctataggaatcccatgttctggctaccagttggacttctgtttttcatccctccaccccctttctataacaaagcctgcgatttattgtccaagagaaggaaaaaaatgtttttgtttttgtttttttttttttgagatgggtttagaaaccgttgagtttcataccaggcctcatgtcatgctggtaggagttctccccacaccagctgcctagaaaccatctgcacccatctttgaaaagcccagacatgtcttcctggcagctatctgtgtgcttcattccaggggtggcccctgcagctgcccctcagaccttcatagatgccctggcccgcgccattcactgacatgattgcagaggggagttggctgtggcctcaggccaggggaccagctgggctgaagctgcatgtgccttgggctggccacttcttcactcccctcaccactgagcattggatgtctaccttgaaagcctggttttcagagagtgcactgactgggtgtcatggaaggcagagatgtgttatcagttccatctcatttttaactcagcaacagaattctgagggtttctgtattatgggtttttttatttttattttttaaagcgagataaatgggtttcctcgatgaatttcttttgtagttacagcctgtactgaggaagatgttttccttggtaggttttgtttcttttgtaactttaccaaagtgtgcaggtgtgtctcatggaaactaaaccatttactacaggcagactggacagcacagttctaagggttgtgttttgttttgtgtggggtattttttccttgttagattgttaacatattgcaataaaataaaattctggccgggcagtggtggcgcacgtctttaatctcagcacttgggaggcagaggcaggcggatttctgagttcgaggccagcacttaaaaggcagaagcaggtagat

SEQ ID NO: 24943 - DNA, 1103 bp, Mus musculus
ggccagtcggggcttttcacacagtacaacatccagaagaaggccatgactgtgggggagtaccgccgcctagccaatagtgaaaagtatgtgggtgagagcagtctctctgctgctcaggcttctcactttccagaggcccagcttgacccttaccttgtccctgtctctgtccctagggggcttccctcatcccagtatgtggcctgaaggtggcccttcaggggaggtccccccatgcttcctggaaacctcttcctgcttccgtgcatcttgtggcttacagtcacagcatgcacagacacatggtccccatgctctcagctccagctgcccctggtttccaaagctctatgcccctccttgtacatctagccttgtttctggagttgggttctgaggctcctagagggtattatactgcccagaacctaacccgaaccactgcactgtttacaggtactgtaccccacgccatcaggacttcgatgacttggagcgcaagtactggaagaacctgacctttgtctcacccatctatggagctgacatcagtggctccctgtacgacgatgtaagtgcccaaaagtgcctgctatacctggccaccatgtggactcatggggatgggaggaaagtggctatacctttcttctcagggccaccccaactccggtggctcccacttctgtgttccctattcactacttggcagggctgtgctgtcttctggcccagggtggcatgctgcataggaggccacagcctgaaccatctctgtggtggtggtgcccgctgaggtgtggagctgggagcccacggctgggagctgtaacagagctgagtctgctctggcacttcactgtatgctgttgcaaggttctcttggtcgactgtgtgtgtgtgtgtgtgtgtgtgtgtgtgtgtgtgtgtgtgtgcatgcacacacacatgtgcacataggagaccagcagataatctcatctgtgtttctcagatccaagccctgtctactttgggtttcttgcagtggggacagggtctcattgtgtaggcaagcttgcctcaacctcaagaaggtctgcctacctccaggctctacc

SEQ ID NO: 24944 - DNA, 1212 bp, Mus musculus
gccaagttgtagttgtcccttgacatgtgctggcttgtggacagttatgtgtaaccgctgttccaagaagggtggggtggcgaagagtgtggagcctaagcagccctaatgtgaccttaggccccttgacctgtctgaagggcccgtgatgctgacataccccagtcatccttttgtaccttgggtgactatgcagccagggtacaggcaggtacacatgtcctggaaggactctgatgactgcacactcattgtccataggacgtggcgcagtggaacatcggcaatctgaggaccatcctagacatggtggagcgcgaatgcgggaccatcattgagggcgtgaatacaccctacttgtactttggcatgtggaagaccacgtttgcctggcacacagaggacatggacctctacagcatcaactacctgcacttcggcgagcctaagtcctggtgagtgccaggatgtgagccatgggaagacctgatggttgctgaggggccactggggaatttccagttccctctttgacttggggaggtacactgacccaggactgatgttcacaggatgtacccctgtcatcctgggcagtggatgggggctctggtcttgcctgagcctcagccaggccaatggatgtgtgtcacctgccagccacagtacagggactggtttctgtgagacctggaggctgagtgaggtgccagcagaatcgttcccttcaagtgctttgtgtctggggcccttgtgtggctcttggtctccctggagcacaaggtgacagctcaggtcttctttcaaacattggaaactagggagatctgctgccccttagttgtaccctgtaatcacacagtgtggtccttctgcccccattgtccagcacctccttgaggctccaggtgtgacagggccacctgctgggagttcttgttgtacagtggagtccatgctcagccctaggcagctctccttccctggaagacacagctctgttgatatgaatgcctttgatggcctagctggatgggaaaatgtacccccaaacccgtttccctttttgacattctcatgtcttgtcggtcccagaactgtttccttgcagttacagaggtgagaaattccgttagtgttgtgtctgctttctggttcccagagccgtagggagctatgcactgcgctgtcccagggtcagaggtcctgcat

SEQ ID NO: 24945 - DNA, 1186 bp, Mus musculus
aggcgctgccttcctcattcccttctgattccaaaacgaggttccagggtggggggttggggtggagagagaaggagccactgctccccaggctggggtcacacagggaccgacctctgcttccgcactcccctgcctgccttttggcaacattttttttcttatttttttttaatagtgtatattttttttctttttctttttttcttttttttttttaagaaaaaaacaaaatcgtgccggtcaaaactttgaaaaagaaacaagatcactgtttgtgcctctgtgggaggcctattttttcatagttagtgtgccgtgtggcggctatgtgcggccacttcgacggcttctgtgtgtgcatctttcccacatgcccgacactgcccccatccccatgtgaatggtgcgcttagtttttatttttaacctttttactttttttttaatcaatcttcagacatatcagatatggagggtgaggcgctgggggcactcgggccagactacagggacatggccaccaaggacacagtggctggccttgctgctccagtccctggcacaccagggagggtcctcgtctactcatgacctctgtgccccgcatggaggacctgggactacgggacacttgggggatatccaaccccctggagcaactgaggtctctctttgtaggagagtgggtcagtactcgtccccgctgttttttgggcagaagcagcaggtgacgcccctgtatgtagataaaccaactttgtattaaagaaagattcgtccgacctagtgcatggagtgctccttaatgctgccactgttggggaaaaggcaggaccagacactggtgaccagtgggctcagagaagaggtattttggcctctgcggtcacacagtggctctgggcttcaaaaacagcttagtggactcaaatatgaggtcccgagttcaaatcctagcacccaggcaaagaggtgctgcaaagaggcatggtggatatacttgtcattccagccctgacgtttctggggctcaccagccagcaaagcctgatgaggggaccctggcaacaatggcagagttggtgaagagtaggaagcgacagtaaggcaggtaaaagaattggggtgagctctggagtggaggagactccttcatagactgccagagcctcgagtccatccc

SEQ ID NO: 24946 - DNA, 1142 bp, Mus musculus
cccactgaaccttcccagtgccccatgcctggccttgtcatcatgggagttacaggaggaacccagacacctcagtgacactgaactgaaagcaaagtctcagtggggagttggggaactgctcagcggttacagcactggctgcacttgcagaggccccgggtttggtacactgcattcacagggtgccgcaaagtctgtagctagtttctaggagacagtaccttcccgtggcctctgcacatgtgttcataggcacacacgtgacttctaggaagtgtgcgtgggtacatacatacgtatatatgtatgcctgtatgtggagttctggcggggcaggtgtctgtgccagggccctggggtaagaaacctagctgagcgtggtctgatggctttggagagtggatggaagatgtgtgtctcacaatgtccccaagaggtttaaatttggcttggaggctgagggacttgggcagggcactctggggagtgtggctctgaccccatgcttgtgccccctccctaccgcagacagcagaaagcctacattgcaacacaggggccactggcagagaccacagaggacttctggcgagctctgtgggagaacaactctactattgtcgtaatgctcaccaagctccgagaaatgggccgggtgagtgtgtgccaggtgggacgggggtggggggacgcactcagggccacggtgctgactccactctgccctacaggaaaagtgccaccagtactggccagccgagcgctctgcccgctaccagtactttgtggttgacccgatggcagagtataacatgccacagtacattctgcgtgagtttaaggtcacagatgcccgggtgagtgctgactatgggagggtaaagtacctaatgacttgggttggaagtgggtttggctactgtacttgttgccttagccctgtggccctggagacaggaggataggcaaatgtggcttgctggctgccagctcagtaagcgacactatggtgagagcaaaaagcataggggaactagtatggccaccagtcaatgccagagttgccgtgggtgacaggagaccagagcctggacagggtggtgggatgaggggctaagccttgggtggctgaggactga

SEQ ID NO: 24947 - DNA, 1188 bp, Mus musculus
ggttccccagctgaaggccagatgcccgtaactgatggctgagcctgaggcttgctgcgtgcttggagtgggcacctgctattgctgagactccatttcatggcctgcagaatgaggtctgcccctgggcttccggagtgcttgagagtacacggagtggggtctggcacctagcacgtgtacaactaatcccaacagccagaccaatgagctttggaactgagtttcctctctggcttgaggcagggttcaggatcaatgactgagtggctatgcatcacatgtgggagcctcccccatgcccagcaggcagggctacagagagccagtgtcacgactgaaaagggaaatgggtgctgggtacacccacatattatcagtaatttccataggctaacctctggtccatagtagggctataaatgtttcatagtaggcatgccattgtgagcaggatcctgctgtttggcccagcacacagttggtgccccttaaatgttgtttgaagtttaaatacagatcaggacatacatcataaatggaagccattggccattagtgacaagctaaatgatgtcagtgcacagaggtcccgagatcacgtagggctctgacagttctgcaagcctcttcagatacagtaaacatttagtgctacttgctataaggaagttggcttggtgtttgatgcccagcaggtgctcagatctgtaccgtaagcttcctgcagctcagggtttgttcagcacacattcagttcctgtcaagttcctagcaccatgtacagacagtatgggctcagttataataagcactacaaccactctagtgtcaggtcatgacatctgacacatagtaggtgcttcatatatgaaaactagaactcaatttaataaaggtcctacaacctgggctggcataccataagtacttaatctaaaactactaacagtacctggcacccagtagttttctaagagatgagaactcttgtttcccagggtatagtttcccagtacctgacagaagtaggtatttaatataggaagacaattactctccagtgtctggtatactgtgggcatttaatatatggaggctattagtccagtgcctacctaacaccagtaggtatttaatgcgtagagagtatttttagtcagtaaatctcctgatgtagtacctgac

SEQ ID NO: 24948 - DNA, 1167 bp, Mus musculus
gtttctcttcttgctttgagtgttggttcctttcagggtgcttttgtttggcctttaaatttctgtttttgcttttttatttttttttttaacttgtcgcctcccccaacccctcctggttttggtttggacgtcaaatgccgttttctgtccttgattaattagcctccacactcattcccactcattctgtttccatgacaatgcagcctcagcatctcccccccccccaccccgcccagcctcgctgtggatgctggcagcaggtggctggctggaccctggtgccgcctcccctgctcctcaccctccacccagccctgtcggaactgtgctcccatctctgccccacgtcccctccagcctgcaagggctcacgttttccctagccctcccctccatcctgtgccctccatgactctggacgttttgtggggctacgttttccgaagggctccagcctgcagactttcactcccagtggctcctctgtccctgtcttctatgacttccccctggattcaggaaacagcttggggtgtccacctagaaagctagactagtaggaatgggcaagggctggcttctctatatctgaggtcccttcagtagagcagatgagcctttaacaagcagttaatgcctgtgcacctaaaactgtgtgacaggggtggctatggagccataatatggcctctcatcctgattcaacctctcagacagtcttcacctacccaaggccatgctcttgccccttagcttcttaagtccctggttaggtgtcactttgagcctcacccctgggaaggctactctttgaggctcaggttcccatgagtgtcccatgctcaccccagaacccactcagcttctgaaaacggagccctggaaatgtcctgctgccttcctagcccacaaggcccctgcagaaggtggcatccatccccacccactaaggagcacagcaaacatgcccctgcccccaatgctccagctcttcggctccttactgttaataattctcaattatgaattgttattgaatatcctgtttatggttctgccagggctgatgtgacaatgtgtctggtcgcattgcatcacatctgctagagtaccatgcagcactgaagcgggctcttcccttctgctgtctctctctatccc

SEQ ID NO: 24949 - DNA, 1112 bp, Mus musculus
cgcttcgaggtgagctgggcagcaggccggggcagcggggcgggggtgccctcagccacatactccttcctctccaaacgggcagtggccaagcctcaggatgccacaaggcagccacagccctgtttctggcactgcagggtttcccaagtctacgactctgtcttgtgagtcctcaaaccaggccctgccttctcttgagtcttaactcacagttccagcacacatgggaggaaatacccatatcatgccacatgtgttcatgtcctgtgctcagtgctgagtctgggggcttaagggtgtgctccattcagacgctcagagggctcagagtgtgtctcttagcttctcttctttcactgtgactgatccttggtggtctcctgtgtgcacacgtgtgcccccagccacatacgcaggacacccttggctcagggacaccatgtgcctgggacagctactgcctgcaacccagcccacaggtcggctgggtggaacccaccctggtctcacctgcttacctgttccatctcgtcttcccttcctcttcccagaccattgactttgacgagagctctggggcggtcctgaggatccagccacttcggacgcctcgggatgagaacgtgtacgagtgtgtggcccagaactcggtgggcgaaatcacaattcatgcaaagctcaccgtccttcgaggtacacactgcagggcacagaggaagtgccaaactgcagatcttgcccccaagcttagagccctcctgcactggctcttgctttttcctttaggaactaggatttctctgctcccagcccaggccccttggtttgtgtggtttaaatgtctgtgcagttggtagacttcaagctcagcttggtctaggcgctcactcagtgctttctggactctgtccctgggtcttttgtgaccatctgttctcagtcagcttgggtcgcaagtgccctcctcagctaatccctagcactccagagtaggtagccatggtgcctggagccacagctggttcagccccacagaggaacttaatggagggtaggtgcctaaaggcagaatgacctaagcccccgccacccctgtgccctggctttgt

SEQ ID NO: 24950 - DNA, 1191 bp, Mus musculus
gagaggctgtggcaggagatgacagggttagaggccacacagtgactactgcattgttgctggtgacaaatgcccagagtttgtgtgtcagaggccaagtgcagaggacaaactgctctatccagtggggcagtgagagcatcggggagggaaaaggcgtgctttcggaagtgtgctggagaggcggctggctcccagaaatggctgtaaggatcgggaggctggaactcgcttctctcctcatcaagcacttgctgaactgagtgggtggtgaatgtgggcaactgggaatgttgaactcttacccatcccctggagccccacctccagtgcacgtgaacttccaggccaaacctagacgtctgtctcccctacttagaccctgttcctaacttgatggccatagagggcaaaggcccaagattgaggtttctttggagcccacagacacaaaacaagtacagatacagattagggaggaagttctagagtgttccctggaataataaataaatgggtgggtgggttacactgccttccttgccacccttctctcctcctcacttctgcttcaaaagcaggacccaactccactcctccaatacaccaggctctccatcctgccacagtgctttcgtatagctgcgttctttgccccagggcctttgatgtatgctgtgcacaggagaaatgtttgtcatggaggcctgggctgggccagccaatgtcaccacccctgtgggctgctgctgtagcagggcgtgcctaggaggggtggaggcaggtggctcagccggtctagcaggtgctgacctgcgagagagtctcaggctggcaatggccatggaggagctgcggcgagggctgtcccgctggaagcgctaccacatcaaggtacacctagccgacgaggcattgctactgccactgaccgtgcggccccgagacacactgagtgacctgcgcgcacagctagtgggccagggtgtaagctcttggcgcagaaccttctactacaactctaggcctctgcctgaccatcagacagttcgcgaagctcgcctgcaggacggctcagtattacttctgctcagcgacaccaggtgaccagggatctaggctgggacttgggctagaacctggtaggatcttgagctctggcttatggaggttggcccagtgggatggtga

SEQ ID NO: 24951 - DNA, 1200 bp, Mus musculus
tcaggccgcctcccttgtgcttcctgactgaggaggacagccttgttcttcagtggacagatacgtcctgtccagctgcacttgatttttgtcttttcaactacccactgcctttttctccctacattttcagttcattctccctccctgtcttggagtgttttcagaggaatacattgggttttctgggctctgcttttcctgctcctatattagggactcacatcgtgaaccctcttggaactctgcaaatcattgttttcatgggattgaggcaggtgctaagtctgtggccttggactggtgccaagttccctgcccttcctcacctccccagccctggttggtatctcccagttcttttgtttcattctggtagatttcttttgcactttctgccatggtctctactatttagtgccagtcactgtctttcagttcatatggtttggggggggggggggccctacaccttcctgacatactgggctacttcttggctgaacagattctggtgtccaccaggtttatcccatgttacccgtggctgggcacaataaccccctgtccatgtgggcaggtgtaccagctgctggctgtcctgtctgaactgtgagggtccctcctgcatagctccccatgcttgagtcaaggcaccaccattcagttcacagcctctgcattttctcatgtcacctgtaacccacctaagtttcccttccctgtccatgtcctggaaactctgggtctgcaaagtgtcagcccttccctatggtacagtggctgctgccttcagggggcctggcaggggtcaggtgctactgagcaggcacttttggctatgcagggtctgactaggtttcatatctatccgtgtggtgctctactggctctgtgtactgtttgagaatcttaatcttgtaaggcaaactgctctaacagattaagattctctagaatccacagaggttgactaactagagctgagtaccgaggacaacagcagttatgggtgtcttctgttgcttggtctataataagccctgtgatttttgtgacagaggctagatgcatccttatataggtgtgttctttcccttggaggtcatcggagccaaggtggtcaccaatgcccgcagtccaggggctcggtgctatggatttgtgacaatgtccacgtcagatgaggccaccaaatgc

SEQ ID NO: 24952 - DNA, 1210 bp, Mus musculus
acatcactctcaaaaaaacaaaatcaccaaggggctggagaactggctcagtgtttaagaacacatgtgctcttgcagtggacctgactctggtgcccagcactcacaccatgtgccctacagctacttgtgagtccagggcctaggacctgatgcctaatctggctcagtaagcattagtgcacctgtggcagacatgtaagcatcagtagaaatgaaaactttacccaatgctatggatgaattaactgaacctgtctttgagacaaggtttgactatataatcctgactgtcttaaactcactatgtaaaccaggctgacctcgaactcagagatctgcctacctcctcagtactggggttacaggtgtgcaccaccaccgtctggctaagattttggatttttattatgtgtatattggggagtgtgcaaatcaactaagtgcctacagaggccagaggatggcaggtgcttactgtcacagctagcaaatgaatacctattcttttgcagactcacaaaagagagaactttggtacttcaaagtaaatactaacctggttcctgctgtagcccaggctggccttcacctagtagtgtggtccaggttgaccctgaagtcctggtctgctggcctctgactctttggcctatgagctctggccacctgtgtactgcattctttcccacctttgcctacctttggttgtttgtgatgagttgtgagggtgtgggtggtctctggttgacccaagctgttatggctgggtttgtgggctgtgttgtgtgtatgtgctagttgcagtggccatgctgtcaggaattgcactgtgattgataggagttatgttctaaactaggaaggccccagccttgtcagtgggtgaagtagatggtttaatgtatgtggtttaattctgcatattgtgtgagggtgtgagaagggggggaaaacaacaccattttagtaagatctcacctccttgtcaccctcgagaatacagggtgctgactgcctcctggagctgttggctttgctcattctagaatctcaccaatatagcactagagccacaaactcttagggctgatttgcagtttgagagtatgttacatttgtgtggttgtagcccagcagagggcaagggtctgttctttccttcctccctcagttctttgccacacaggttgttgtgtagtgtcactga

SEQ ID NO: 24953 - DNA, 1135 bp, Mus musculus
agcgtgaacgcatggagcgggagcggctggagcgggagcggatgcatgtagaacaggagcggaggcgtgagcaagagcgcattcaccgagagcgagaggagcttcggcgtcagcaggagctgcgctatgaacaggagcgccggcctgctgtgcgcaggccctatgaagtggatggccggtgagtagtcagatacaggctaccagagcctgtgtcaaaatagatttgtgctcaatgtggcaggccccatgtattcagactatgtgtcacactcactgaccttactcaggccctcctgtgactatcagtgtgtgagaaatgctctctctgtgccagctcagggtaggaggagctttgccaaaaaccaaacactcagcactacaatggcactgaggcataggtgggagtgttaagccaggccttggagccatgctggctttgttcaagctctagggtgcctcatgagcacctagatcacacctttgcctcccacccaatcacaggcgagatgatgcctattggccagaagctaaacgggctgctctggatgaccgttaccactcagacttcagccgccaggaccgctttcacgacttcgaccacagagacagaggccgttatcccaaccattctgtggataggtgtgagcccatggccatgttgggagggcagtgtgcatgcaaaccctccccatctgggtctcactgaaaccaccttttttaggagagaaggttcacggtcgatgatgggagacagagaaggacaggtgagcatagggtgctgcttcagctgtggaatgggttccgtgtctattgactgccagtagagcatagtgctactcttgagcattcatacaatggcaagtgttagtgatatcccacataacctatccagtataccctatccagtagggagcttgcagctctgtatgctgcactgctccttagagagggtgaccagaggcgcctagcatgtctgtaggattggggctcacccactgtgtcaagttctcactgcacagtgccatccttactgcctctcagttaccatcctacacccttagcttcccattcccaggttggcacgaggggtatcttatccctgggccttcattggtgtcaggttgtcatcctggtt

SEQ ID NO: 24954 - DNA, 1210 bp, Mus musculus
cagggctcttaacctctgagacatctctacagagcccattcccctcaaaagcacttttattgtcagagattaaattacttcaacagctaacaacagtgtgaggcagcattccaactcctaacctaagggatgattcccaagccgaggtctcacgggtgccgtagaacctccggccaccagaggtcgcccgcagcgcgcctgtctctctagccggaaaggcctgcaagtggcatatatcccaggattctgcgcggtgccgttcttcctgtcccggccgccatcggagagcatcaggtaagtgggcctcgtcggggctcatctgcccccatcgggcatcccggccccatggggagtccctgcgggccggcatgcgggcgggcgcgggccgaggtaccgtgtctcagccgctgtcttgtccccgctgcccacagccatggctctgcgctaccccatggccgtgggcctcaacaagggccacaaggtgacgaaaaacgtcagtaagccgagacacagccggcgacgcggggtgagtgctggggacgcgaccgcctcgtcagagatggggacgggggtgaagaagtgaatatcgacacctgcgtagattctgtgtcgttggaatgggaaggtctgagtggttcgtgggcccggtcgttgattgggcgtctgagactgggagtcggtcggtgggctgttgcgttcggccccctgtaaggcccattttggggttcgtgacctcggggctgtgctcgcagcgcctcaccaaacacaccaagttcgtgcgggacatgatccgggaggtgtgcggcttcgcaccctacgagcggcgagccatggagttgctcaaagtgtccaaggacaagcgcgcactcaagttcatcaagaagagggtaggcagcgtgctgcaccgagcacgggtgggggtgtggctggctgcagtggccctgggtgacatgcgactactcctcgcaggtgggcacgcacatccgcgccaagagaaagcgggaggagctgagcaacgtgctggcagccatgaggaaggcggcggccaagaaggattgatgaaccctcccccaataaaagatggttcctacagttttgtgtatgtgtgagctcacggcgacactgagactcaggcttagggcttttggaaaggttttctttattcatgattctacagctgtgctcgtggctccgccacaccatgatttat

SEQ ID NO: 24955 - DNA, 1153 bp, Mus musculus
tgtactgcagaagagtgggtgacagcagaagccacatgaatcagggtgctctgtttttgctctggacagagaatccttgttaactgtatccagatgcctcttgcctctgtgcagatgctctagctgagagaatagcctggttgagtgcaaggctctgcaggtgttggcttctaagctgagccacacggcaagttcatgctagagctctcatgacagtagctgccctccagagccagtgtcctgtgtggcaaactgggcccataaagcccagtgtcttgattctcatcggctgtaagcctgagcaatatagcccccagatcagccagggcaaggggcctccagataaggggagctggagatcatctctaccccctgcttcacagtggctagagcagcactgtcatgccacttggtgacagcgctgagccaccaggccagcgtagggctctcagtggggaagctgggctgtctgccaaaattagtcttgtggctggcgcgttgcatagatgtactataatttgggtgaattgggctgtaaatcaagttgggtggaatctgatcctggggacaccaggctgagctcaccagtccctgtgctgcagagtgggcttttatcttgctgtgccctaagtcttagtttagagaaccacgtggctgcccagtaagctccttcatcaccccagtctgtctgtactctgtgccactcttccagggtatatagggtgaacatctgtgatgtgcggttgcccaccaagagcctgtgagcagcctgctgtcctggaggttgtggatagaccatgctgtgcagcaccgtgcatgcacctgagcccctgcattgcccacagcctttggggtgatgccagccttgagggtgaatttttgtgttcttgagggtggcatctctttctatatatatttacttaaatgtatgtaattaataaaatgtatatataacttttagttgtgtgtacatgtgtgggagatgtgcatgtcagtctgtggccaggcaggccagaggccagatgttcctggaactgagggtacaggtggttgtgagtagcatcatataggggctctatcctgtagaatgtagaagagcagcgagtgctcttgaccactaaaccagccctcagggtgtcctctttgattgtca

SEQ ID NO: 24956 - DNA, 1119 bp, Mus musculus
gctgtcagagagcctctttccgctttgagactcttccaggcagtgtgacacgtgcttgttttctgggtgggcagtaggagggacttccccagtatgttccctacagctgagtatttcttcaaggcatccagtgctcctttgctgtgagaacttggtggcatctctctgtgcttggatttgcatttccaaagtcacccttgtttacatccttggacagcagggtgcatggctccaggccagagcctcctgtgtaggagccctggcttctgttcccagcaccatagaaactaaagccgtacaacagatgactgaacagagagtgacaaagcggcccactgtcctcagtgtcctggccttagtctgtagactgtcagacaccccagcctcactgctaactctgagcttgaagtgggacccatgctttggggtgcagagggtatgggtacccccaacctggtcactgatcccatgtgttacagatccagtgtaagctgtttgtgttcgataagacctcacagtcatgggtggagcgtggccggggacttctcaggctcaatgacatggcgtcaaccgacgatggcacattacagtcccggctaggtgagctctggggaaggacagaccctctcagaggtgggcttaagttgtaggctccacagctggagcagggaaatgactgtgagcaaaggcagcagtgagccccacacctgcttgcgatagcctgggcctgctgccctcacactgggttcctgctcaagtatctttagtggacttctaaaaagtatagcttggaaggaaggtgggggcaggaagagtgccagcctaggcttcagagctgtccctcctgtttgggggactttatgtgaaaatggtctctctctagcccaggctggcctggtctgctctgagcctgtcatgtcctaattttgtcatgtcctaacatttggttacattccccttaaaagttaaggccagaaattgggaagcttaggcaggaggactgaaaagagtttgaggtcagctcaggctactgagaccctcacatcaggaaagaaaagtaaaaaaaagaaaggttaaagtcaatgtcaacaggacctgctcagcagttactatgtgtga

SEQ ID NO: 24957 - DNA, 1616 bp, Mus musculus
gtggcctagtcacaggctagggcctacatgtgtgaacactgcccagtgtggccgttagccacacactgccacgtaacaccctgcctccccaggccagctccaaagacacaggccaactgtatgctgcactgcaccaccgcatcctggctctgcgtagccgggctgaacaggaacaggaggccaaggcgcccccacctgagccaggagccacccgggccaccgaggaggaagacagtgatgaggatgctgttctggctccctccggtgtcacgggggctggtgagcaccatgggaccagtgggagggaccccagctggtgactgtgtgctgggactgagagacctgctctccccacaggcacaggtgatgaaggagatggccaggctcctgggagcacatagcggcggagccactgcaccaggctgctgctttgttgtctgtctgctgcccgtccctccctgcaggccgcatcatggtggtgtctattgccggggtggccacaggctggatccgagtgtcccctctgcagcagacggggacgccaggatgcggcttgggactcagacctcatcatattgatgagtagaaagaacgttcccccgccctcctccgatcgaaatggcacattgacacttgtcacagcttcgtggtgaccgtccatccctgggcagcaacaaagagaactccaggctcagcattctgttgagtaacttgctacctgctcggctttccactctgccaggtccacatggcaggtgcctctccttcatttctggtggcttggctcttgaggtcacagatgaagctacacgtgggctgagctgacttgatgctcctatgggtggtgcccggcccccacgggggttcactaggtttgggcctgagaacacctgtctggacaaaggtgatgaaaccaagagagctcctgccttcttgcctgcctacgtgaaccacctgggtctcccttagcaggtacccagccctgaggtgactgaccacctagggcccctgagaggcaaagggaacctgcaaagggcctgtccccgggcagaagatgaagcccctacccgtggactgtgtggttccatctctggccaggccacttccagccagcaaggacaccagaggctgccttagcagatgggtcacactgcttccagccttagccagccagtgacaagtgaatccagacgtcacccatgtgttttggaacatttatgtaagattgaaatgtatttgagaactgcattaaaacttttaactaaagccccagactcttttgcacctggcagccagtcaggctggatttggccatgggcccctgatggggtcagtaatcaatccagccattgctaggcttgtgggtggccctgcaggagacctggtccagccagttcttcagcctccattctcacacatccccccctccctgtgtctagctggggccccctgggacagtggtggcagaggatggcaggtggatcaagggactaggctaagtgcagctattaggcaggtgagagtagctatgtcagaggtgccaggcgctgtctgctgtagtagtcttggaactcagctagtgtgacctgtggatgtgctggctgtgaggggaccca

SEQ ID NO: 24958 - DNA, 1885 bp, Mus musculus
agagtcctggacatcacctagaggggtcttgagacattacccggatcccatctaaacatcacaacaagtgaaaactcaagatctcatttaaaccccccccccccccccagtgctggagtatctgctacattccactggttttaaatagtttcaaaaacaaatgaaggtaagggtggtaactctgggaggagcattctccaccaggcatacacaaagcccaagccagacaggcaccccagcatcagtgagatggtggggactgaccctgaaacctcggtgtttcctgtttgggacagggtcccaggtagccaggcttgctgtctcaggagtgtggcatggatccctgctaggctgacaggctcccactacaggccctgcctgtggggagtttgtctttttgcttgagatggggtctctctctataacccaggcttcccttgaatcctccttccaagtacttggaatctagatgtgagccaccgtgccctgctgatgggagcactccctacctttctttctactcactcttgtgcctcctgaaccatccttaatgccaagacaaatcattaatcttggatctctctcccatagctctacccttctaggaagaacaagtgggttgagacaccacaacccagagtgcctcaatgtctttccctgattccacactcagttccttgacactcaggtctctctcaaatgcccccttctggaggggccttccaaccagcatctctgaagtcattcctgccagctggtcactgccctgtactgtgattgtttggtctagtttttctgaagcttagtcttatgtagctcaggctggcctctaaaatttttatgtagctcaagctggatttaaacttttgatcctcctgcttcagcatctccagtgctagtatgacaggctttgtgcaaacacccacagccccatcctgggaccaccttttcagtgggaaggcagtggctatgaagcagggaattttgtcttctgtctccatcagtgcctagcacagcccgggaggccctgccttagccaggagccttctggatacctgataagccctttcctggtttccagggacaatgatgtttttgtagcaagacgcctttttgataccctaagagaatctattttttaaatcctggtttctgtgctgcctagagcctatgatggtgagggtgcattgcccttgttagagcagtgagaggaaggggccccacaagcccttgcacccagaggtggtgtctgttgaattccatgacctgtgcgctcagggaaattgtccttgagcagccaccaagatagaaggtagggggtgttcgaaacagaagggcctccagccatccagtctacccagagtctgacatggaccctcagtgtgggagacagaggcccattttttcttggggatggaggaaagaagggagctatctgtatagaaggcagactagggcctgtctgcaccagaataaattggctatttctcaacctggactctaccttttttcctgttgtggggtagcacgctgctaggccttatacatactttacagcggagggggctggagttagccagctgtcctgcagcttccatgttcaagttattcccagagacaattgaaactcagcccgaagaagtgaaggaaaactacttctctgcacaactgaggccacttgcaattcaggggacaagaggaatatcgaaactcatattacccaggctttctagccctcactaggggattgtaggtggaactccacgccctgaccacacccccagcccctcactggggtatgtatcttgggtggggtctgtaatgctaagctatccctagccttgcatcttactgctaagacttgcaatagcttgggctgtatctt

SEQ ID NO: 24959 - DNA, 1195 bp, Mus musculus
cctttgatgagcctggaggaggcactgtggcagctgcatattgatggctggaggtctgggtcaggggtcgtggaccagcatcaacccactggggcagggctctgccttaggtattgggctctggcctagcagccgtggccctggatttgagttctgctgtatcctggaaaggcatcccaacaacctcaaccctctctccctccctcccacaggcataatcggctccgcttacagcgtctcactcaaccccgcagattccaccctggaagcagtggccagagtcggccggtacacattcactgcaggtgagctagtgtcctgctcacagtgacacaggccattcagaggcgactggaaccactgagtggggtcctaggacactgactacaagactggctagggggctcagaagggcagagggtggcacccagcattatctgcacaggacagtcactgcctcagtttccccacctccaacccccattgccccttacagctgctattggagcgatgtttggccttaccacctgtgtcagtgcccaggtccgagagaagccagatgaccccctgaactacttcattggtggctgcgcgggaggcctgacattgggagctcgcagtgagtggccattccctggggacagtatgtaaccactgatcactccagcccctcccactctgtcccctgcctacggcagtcgctgccttctcaacagcaggcagctccgtgataggggagactgtgccctgcagtgggcatccctgcccatctcttcactattggggtgtgacccacagcctgactctaactcggacagacttagccccaaactgcctctctccctctttgtattcctaggggtctggggacaggaaagccatgccagccacagttcagctgtgggaaaaggctttagcaggggagtatccccactgccaggagtcagggctgaccacatccaccctccccacacgatgtctcttgagttaaagggattgatgcagggcagcctttggcctcagtttctccatccccttaactctgttgctgggctattagagaggcccctgaggaagcctcgctctatcagaccccatcttcctgggaggctcttggatcacacctggagcaccccatacctgatgctgtccttctccacagctcacagctatgggacagcagccatgggctgtg

SEQ ID NO: 24960 - DNA, 2092 bp, Mus musculus
cccttcccttacagttcaacgatctggcctccctgtcactgaccctgctggacaaaggtgggtgtgccctggttcccagcccccttgcacagtatctataagaggtaccattgtgacagcctctgtgttgggttgaggatcccagggactagtgtgcaggtggtgggagtcctggcaactgggcatgggctccagtgacatcctgtggtagcttaacagagtgtgaggagagattatcactggccagtctgggcggctgaggccagtggctagtgaccactagagacccaggttagaagcccagcctgttgatgaacccaagggtgaccaggcaggacatgggggcagattgacctgaagaaaaggcaaggcaactctgttcatagtggcacctctgtccccttatccctgcagaggacattggggatggacacagcagtgaggcagatgtggatggccgcagcctgggtgagcccctcgtgaaacgggaacggagtgaccccagccacccactgcagggcatctagccccttccctgggcgtcttccacgtgcttccggaaggcgtcacctggccctctagggacctggactctcagctgtatcacactagtgcctcttcaatgatgccatgtttactgtgacccaaggtggcatggggtccccacccacagggtgccagagactgtgggcaactaagatggtcactcaagctgccatactctgctaaagtggccctgaccctgggctgtcccccaaaggatacagcagcctgctgtgtgtatgtgagttgtggggcacatccccagaaatgtcccaaccacctcggtggctttcccactcagctaaccaccatgtcaaagaaaaaccactccaacagagcccagaggggtaggagcctactattctctggccattgtgtggaggctctgcaggtcccctgcgctgtagtctccatgcatctaatggcctctcatggacagccaagaactccaggcacacaccctggatacatgctaacggcatctcatctcatcctggacaggtccaagccccaaagagataacaggctccaagcagggccagtcaagcccagatgatcgacccatctgcttgactatagactttctgtccaattcatggttaataccaagataacctggggggcctgtgttagggttccccaagtagccacaggggtcagcaccatatccacgcctcccaacaaaactccaaaacctgtgctcagggcagtgcctgagcccctgcagtcttccagacacctcccccaaactagccatgcttgctgctggccagtggccaaccccttctcaaccctagaccatgagatctctgcagacaaatgaacaccaatgcctattgggccctgagttctagaggccctaacatgttacaccttgctgctgtcgtcatgttgagaattctttcccaacacaagccctgccctcccacacctaggaagcgcctaatgaaatatgatagtttttttttttttgaaaaactgttccccccaatagttctgtgctgtaattgttcttagaaggttcttatgaatgtgtccatcgcaacatacctggtgtccgtgtttgttcattcaggcggcaatggtcaccaacacagagcttttagacagaacagctttaaaggatggtgtccttcgggacattgatgctttccgtggctggactgaccagggtcccccttgtggaaagcaacacacactggatgccagccttgcactgtgttggcctttgttgactaggcaggtccccatccttactccagctccagaggagctaatggatgtcttccaagctcactctgggacaaccagcctcccatttagcccaatggctcctcaaaaactgagcctttggcctcaaggtctctcccttctgggagtgatggacacaaatggacttgtgtccccagcaaggccagcttggagctggtgacaggaggatctgtttgcacagggtagcccttccagacccaacagaaaaaatggcacccaacaggtgcttctctgagtgagggcaaatggcctctcctaggaacttggggtgtgggtc

SEQ ID NO: 24961 - DNA, 1175 bp, Mus musculus
caggagcaggagggtccctgggactcgctggccagcccagcagagttaacaggctgcaggttcatggagagaccttgtctcaaaacagaagataagagagttctagctagcattgacctctggccgccatgtgggggagatgagcctaccacagtgcccccaactctcctttactggggccttgctatttaaaatagtgtgacagagtcattcagcgcaggttcaaacctgctgttcttccctgcccgcctcttttgtggggcttgagactgggtccttcatggaaggttccagaagtgggaagaagcccatacattcagctgacaaccatggagccaccgccgctgcctgtcaggccatctgtgcctccctctgccgctgctgctggcgtgcttctgtcttcttgcctgcctgtgcccagcacggatgggagcagagagtggacctggtgtctgctcacccatgccctgtggtgctctccgtgctgggtaaagacagcctggtatcctggctcatccaggcgcactgagggagatcgcagatgcagcacgactctgagggcctcagaagccatgacccttcctatttccttaccacactgtatttattgtgtgcactcatgtgccacggcaggacaacttgtggaagtggattctctccttacaccacgtgggtcctagggattgaactcaggaggacagcttggtagcaagcacctttacccctgagccctctgttttgactgtagttctggtgtgcctggtgagtgaaacattctacttgcccttgcctaaaaccctgagaagcccccactcccctgagtgttttaggtgctttcctggctgatgttagcgccgactgcactataaggccaggtcacactcaatgcagcaacaggtctttcctcctctgctccacccaggcccatagccaggtcaccacacccctgacagcccattctgtccccactcactttcctcagctccatgtccattgcttcccctgcactgtctcctaactccagctccttgtcaggcagcgtacagtggcccagagtccctgagcatctgtctaggaggccctgatgccactagggaaggtggcccagggatcagtgttacccaccatctgcagcagcaggtgcgatgtggggcatgtgtgggggatgggggctg

SEQ ID NO: 24962 - DNA, 1558 bp, Mus musculus
tgggcatggtgggcacgggaggggctgggcatgagggctggcccgccatggcttccgctcccggtaccacccccaactaaccatggtgccccagtacccctcagtggttggtgatgaaggggtgctgcaggccacacacagggtggggtgacataggacacacgtggcctgcagcccctcacttagtccctgccagttgtccattgtgggtgggactgaatggcagattactgcctgggcctctctgggtggccaggatgaccacagtcttccacacagttcacaggcctctctcagctggcctgcctcctagacttgagggtccgttagcctggccagagccagctatgtgcacctgcttctgccatgcagccttgtgcatgtgtgtgctccaggtgcagccagcagccggggggctcaggccacccctctgctggaggcacagaggatctcccctctagatcctaggatgccactgcctctcgaggccccaggccagagaacactacaatgggcaccaatcttgggaccccaagggccaccactgcagccatgtgccagctaagcacccacagttccaaggctagctggactggcagcactcctgggccaccattccccgtgggcctcctcctctgctctctcactgatcaagtctttgaactttgaaaacatgagcttttgccaaatatgataggatggtgtgtgtgaggccggcccaaccctagactgcctctgttcctggccacatgtgcgcctggagaggctttggacctgtgccctgcaaactgccaggggtcaagccagcccccttcccctgtctgagcctggagtgccaccccttccccaacttcagttgtcggtgtttgtgccccaaccaaggtgtttgaaagaggcctgagctgaagccagctcacagttgcctcgatgtgttgcttcctccccattgtgggttcacccctggaggcctggcctcccagctccctctccctgtctgtcccactcccaaactatctgtcaggaagatcctgaacactcctggggaccccagcctctaaggcttcctttacccccagagaaaggaaaaggcctctgcctgtagcccctgttcacactccctatagctgggaggaaacagggctcgtgccccaacctctttccacacaggccgacaatactctccatcaggtgttctgcagcctctaagccttttcatagaaggccctggcatcgtggcagctgttggcctccacatggagtgcgccagggtcccaaacagcctcagcccagggcaccattcttcctctcatggtcgctagcggcccagcccttctgctgccctgggccttggtgtctagtccttccagatgcttccagggtcgtcctgaaaacacccacccatctcttcagttacctcctctggccagaaggtcacaccactgtcctccagagccactctggggcccatactggctgtctggaagcctaaagcagcagcctgcagccagagccgagggttctagggacttgtccataggaaggggtggcactatgtata

SEQ ID NO: 24963 - DNA, 1836 bp, Mus musculus
cctttctccttccaacccccggccaccgtccatcctgccttagtgggtagcgccggaaaccctttcccctgcggggtgtgcccttgatgccagcctcgggctcgtggccagagtctcccagagcctcgcagccccgccgctgggaagcgctcgatgggtgcagaggcttacggaagaggctcctccagtagccactgtcgtgcgacgttgtcgggtgctgggggcaccggccgcaaaggtggaactctgaactgctggggtgtcccgggtgggggcaggatgtggggactgtgctgggtgccacaccggttgctgaacctgctcgctcaaaatctggccacttgggaagaaaatgtctatttttttcccccttctcagcatcactattttgggttttgttctttttttattcttttttcatgtccaagtaactgtgtgttgcaggcggccctggctctgctgggatgaaggggagcccactgaggggactgggccctccctgcctggcaaggccatctcttgtgtgcttgcctctgtgtcccggtcttgtctgtgaagtgggcatgacgatcgttgccaccttccaacctacctcacaggggtgttgtggggacaccatgatctgaatgttgtgacgccgagctgccgcctccctcctctgtccccctcccccctggcaacttctcccctgtgtgccctcttccacacctctggcttctgctgcagacttctcctcctcttcctcttcctcctgcttctcctccaccaaggagcagtctggccagtggagtccccaagacagacagtcacggccccctgcttagcctgtgggggcttgggcccggcctcttggcccactgcctggagttgtagcctcctgtagccaggccgccctcctgccatgaccattcctgtctctccctctctgcaggcaaatgaagcaaatggatatgaacttcatctgtgaaaatatttttttttctccatttttgttccatttgggggcttcttttattggtttctatatttgattggtttggcgagagagcagcggctgcctaggggctggggatccccttcatgccgaggcgctccctctctcactctgtgtgtctcatctttttcctttccaaaattgggatccttcatgttgagccagccttagaaaatagcaagaatttaacctctgccccgccccccaaaaaagtttaaaaattaaatcacaaagagcagaacaaaacctataaaatgatatatgtatagaaatatataaatctctattccccagcctccgagcccaccctctgagggaagcggttcactatctccctactgtctggggccctattcttgtttttaataaactttttaaaaggaaagaaacagtcactattgctatctctttttttcttttttttttctttttcttttttctttttcttttttttttttttttttagttagagttggaacattccttggaccaggtgtgggtttcacaggcccctcctgccctgcccatctctctctgtctctctttctccctgcccccgctcttccctggctcctccttatacccaccccaaccccaggactggcctggtacgttgtcatctgttgaagatgagataaactgagaaaaaaatgagaacaaaacaaaaaaattgtatggcagtttttactttttatcgctcgtttttaacttcacaaataaatggtatcaaaaacctccctgtgtcctgctggctgtgatctgttggtctgtgtcccctgccttcgagtaggcttctgaagcagatgtatgctgctttccctagttataagcataaccctggg

SEQ ID NO: 24964 - DNA, 1115 bp, Mus musculus
cgccgcctcccgctggcggcggagggggagccgcgggtgcgggaggaggccctccgccgggcccgccgggcgcgggagaccggggcggcggaggccctggcggcggcggcccgggtggaggaggcgcgtccgggggcccctcacagcctcccggtggcggcggccctgggatccgcaaggacgccttcgccgacgccgtgcagcgggcccgccaggtgagggggccgcgagggcgcgtgcgcgcgcgcgggggagggggcagcggcgcgcgcggggtcgcgggagggtcacgtgggcggcgggctcggggcggggagtctggggccgtcacggtgtgagggtgaccctctgcgtgcgtgtagttaagggtgcgttgaaggggggatctccgaaaactagactttgcactggacggtttctcttgggtaccagggcttgcagcctttggggtccctgagacccacccctgtacttgcaccaggtcttctctattaggagggttgcagctttggagttcccacgatttttttcctgggtgtactagaggattcctctaggacccataaaggttgcagtctgggacagtgtccccaagagccaccccccgagcttgcacccgttatttccattcaagatatagggtttgcattctgaggaccactctaaagtccaagactgtttgtgatttggagaggtctcctagttttccaaaggcctgagcttgaatgttatgaggatgtccccaagaatcactcctgggttttcacttaggcacccccttaggacccatggggttctagaaactgaggcagatctgtaagagcaattcctgagttcatgaaggatggggtcagagatgctgtgagacccctctttgaacccttggagtcttagggtccccaagggcttctcagggtttgtaaagttgcatcgcaggatggtaggagaccgctattcagagacctgagggttcagaatatattagttcccaagacggagtcctaggtttgcacagggactgagcttggccgtatacttagaaagtgggggggacccatcttagcacacatttgcacccgcccagaaattcaactcccttttagaggatcttgctt

SEQ ID NO: 24965 - DNA, 1592 bp, Mus musculus
gatcctgggctctgccactgggtccctggatccctggattacaggtcccttaacccaaccaatgcattttcctctgtttgaggttccatattcccccatttttactgctaggtctacattccaagcaccaccctcaatctctcaccactggaccccaagtcccaatccactggattctgtctcctggaagcatgggtgcgagagctccagggtccctcatgtggatcccacatgccccagctgctaaattccagatcccagattccttcaaccccttctctggaccacattcatagaaggccaaacttccaaacaccttcatactccaaggtctttgctcctataccccaaatgtcactccccaagtctagatcccaatagcccagtgacagcatctcatatcccagacacaccctggagctgattcccaatgcatggaagcatgccatccaaagagtcttctagaagctcaagacgccagaccagtggctccctaccaggcagtaaggaatgggacatatgaatgctgcattgcacctcagctaggacacacctcccttcccacccccacccccaaatcactttgttccccgtccccctctctctgcaatgtcttccacattcccctgccttccttccaggctagtaactcccagatcccaggtccctctgggagggctgaatctgcttgttcatgggttgggagctaccaggggaagtcagggacaccaccaaggggaccacctgcctctcacactgccagtcctgctcaggcctcagaaagttgcaatcaaggaccaacacacaacatccttcatgaaacccagcatccagtatgcaaattaagtatccccaagctgactcggagtctatttttctaccagagaacaaagtcccctggctcccaccacattcccataccctccacacttcaagattggattctgagcttagacctggggtaccccgctccacctctcagtctttagggggacctcatcaagggactgagaggaaaactgggatgttgggggggcatggtttccacctctccctccaacctacaccaagtcctacctccctgcccatgtgtgtcatttcaaggaaaaaaagaataaattttctaagctattactgttgatttttaattgtttaaattacattcgcttgtttgagggaggggcatatggcagggaagcttgtggggatctgtcctctctttccctgtgtgggtcctgcggatcagactcaggcttggtgtggagtgcctttgcctcactgaccttcatggtagttttgttactttttaaaaagtacgaacaggtgtacgtgtgtgtgtgtgtgtgtgtgtgtgtgtgtgtgtgtgtgtgtgtgtgtgtgacaacactgaggtactaccggaggagaagagagagacatgggtctctctccctccccctccccccctcccctccctccctctctctccctccccccctctctctcacacacacacacacacacacacacacacacatacacacacgtcctttatctcttctccatacctccaccctcactcaccttgtatcacccttcccctccctccctcc

SEQ ID NO: 24966 - DNA, 1197 bp, Mus musculus
gtgcagtttagcagtaaagtgctttcctggcatgtgcaaaggtcctaggttctagctccagtatgggaggtggcagtggggagcagcaaaaactggccctttctccgtgtgacaggggacatggagcccctagccttccctaaaacagacctattgcatttttgttgaccttgagtctaaggtccaacttttggataggaatataaagaggccccatggctgttgggccttatatgaaccacgactgtttctaacaggacaaacacacacacacacacacacacactcctcaacaagactgccaaggagacaggattttataaggaaaatctgggtgggcaaatttgggaaacaaggtaatgaatgagagagaatcagagttcaaggtctcgtcctacagtacagagaatgtgaggctagcctgggctatatgagacaggtgtctcaaaattgaccaaaaagtgcccccaggttgccacttcccagtactatgaccttgaactgcctctgtgactctgtagagtcctcagtctgcctagggactgagacaagaggcagattcttcttatggcctggggctgctcccttccatgaggaactggggctctgagctcctgaggcatgaggcatattctagctgtcttccccacacacgccctgtgggggtgcagtctgctggagtccctgtgtccccttttttcctctgctagggtgtctcctctgactgggatgctgatcctgatggtggcctcagcctggaggagtttactcgctacctgcaggaacgggagcagcgccttctgctcatgtttcacagccttgaccggaaccaagatggtgagatgggctctaggctggggaatggacaagtgggttagaacccgaagcgccgggggaatggggagggctgcttctgactcatggactattttgggagttctcagctgcaactaggtgatttgagcctgaactggcccatcccacctcctatcccttttgcagtaggacccctctctctgcccatacacgtttctcttcagacagtatacttggttcggagaccctcaaatacaaggatagacccttaaccaagcatcttctgggttccttaagtattaccttaaagttggagagctagatcaggggtaacgtggttgccacaaagccacaagtccctaagctcaatcccttgtcccc

SEQ ID NO: 24967 - DNA, 1194 bp, Mus musculus
cactgcaaacacaagatgtttcttgctaaaccgggcagtggtggcacacgcctttaatcccagcactcgggaggcagaggcaggtggatttctgagttcgaggccagtctggtctacagagtgagttccaggacagccagggctacagagaaaccctgactcaaaagaagattcttgctgtcaaacttgacaagattttgatccctagaatctgcatgagaattgactccccacgttgtactctgccccccacaccagtgccatgacgaatgttccctctcccccaaacaaatacataaataaaattaaacacacacacaaactctgacagccaagatccatcaattaccttttgttacttagcttccattcttgatttgggagtggggggagaaggaggtctggagctcaaatattctttcagaccagcctttacatttcagatctgtccatttgattttaatcctatatacagtggtcaaacctttggtttatggcagggtgactccctccaggaatattgtgcatcaaaggtataaacatagcttggaagatacaaaggtggaatggggttagaaaacacttgtgtctgatactgtgtcgggtcatcacctaggcaaagagtggcttgaagggtatgcagaacctgctcacgattaaggtaagaccgcccaaggtgaattcctcatccacagatatttcaggggagtggaggtgggaccccagcccacacatgcatcccttcacaggatggagactctggcctgcagagggggggctccctgagaaccccaagcctcaccagccgctctgatcgtctgcaacagcgcctgcctattagccagcactttggacaggtgaggatgcccaccgtccaccacacatcagatccttcccgaatcctgcacctgtccccagtgttcaccaaactatctccctttgtggaagttcacatgtagttcactcactatacagccaaagatgggtttgaactcctgatccaccatacccagcttaaatggtgctggggattaaacccagggccctgtgcacgagaggcaagacctgtactaacccagttacactctcccaacccccttggggcttttttgtattttagaccaaactggtctacaactcagagatccaccccagcctttgttttgtttttagaggaatcatccaggacttgaa

SEQ ID NO: 24968 - DNA, 1371 bp, Mus musculus
tcaactactacttcatcaacagccagggccaccccatcgaaggcctcgcggtcatgcactatatcacacacctgtgagtcgcccagctgtgcgcacaggtgggggaggcaggcagggagggctgggtccccacctcattatcagacacacacccccaccccctggtctcccaggctgaagggcgcccttctcttcatcaccatcgccttgatcggctcaggctgggcctttgtgaagtatatgctgtcggacaaggagaagaagatttttggcattgtgattcccctgcaggtattgtgggggaggggggctgggggggggtcccaagaaaggtgcagggagagaggctcaggagacgatggagacatgtaaggagaaattcagagaggaatgctggggattgatacaggctgggttgctccggtgacatacaggaagggaattccgtctgtggtgttggggacaacaccacctggcaccctgccatccccacaggtcctggctaatgtagcatacattgttattgagtcccgtgaggagggtgccagcgactatggactctggaaggagatcttgttcctggtggatctcatctgctgtggtgccatccttttcccggtggtctggtgaggacctggacctgcctgcctgcctgccttccagccccaccgaggcccctgccctacccaacagaagactcctgtacactggacggggtcaatactgagcacttcccatatccctccacctgtccaggtccattcggcatctgcaggatgcatccggcactgatgggaagggtgagaccccctcctggactttgtcccagccctgctttctctctgacaccaggtgctgggggccactgtctccacggctgtgcgtcttactcctctgtctgtacccagtcgtccagtcacccgcacacacttctcaattacttttgctactgttcatcctattgccccgggaccactccccacaccttgcccccttctccactgccctcccctcctgccagttttcgttatcctccccccaccccccttaccctactctgtgcccacccacagtggcagtgaacctggccaggctgaagctgttccgacattactacgtcatggtaggagtcctgccttcccacaggcctgagtccctccctgctgccctgtgcccctgagccccagccttgacctgacctctgtcctgtgtccatacctccctgtcccctgccccccgccaaccccgtgcccccaggtcatctgctatatctactttacacgtatcatcgccattctgctgcaagtagcagtgcccttccagtggcagtggctgtaccaggtgagcaaggtggagtccccaggaggggag

SEQ ID NO: 24969 - DNA, 1171 bp, Mus musculus
agagactacatctaatagccagagaagaccccacgtgggtgaagagggacaccaaaccacctataaaacttttattcgagaataggtcctgtctaaaagaaatgcagggacgaagatggagcagaatggaggaatggctgaccagtgacctgtccaactttagactcatcaatgggcagacaccaacccctcacactattactaatgctatgttgtgtttgcagacaggagaccagcatggctgttctttgagaggctttacccagcagctgactgtgacagatgtagatacccacagccaaacattggtttgaggccaagtacctttatggaagagttaagggaagaattaaaggctctcaagaagacaccaatccaacatgaacagtgtcagctaacctggatccctggaagctcccagagtctgacccaccaaccaaagagcatacatgggctagattcagtggatgtgcctaaccctgcaaaggcttgatgtaccaggatgggggaagaccagatggggtggctgccctctcagagatgaaggagaaggaacttgggagaaggaactctgcgaatggggtccaagaaggggtcagcatttgtgatgtaaataaataaataaagatatgatttttaaaaagaaaatcaagttaaggtaaatgtgatactagcataaagcttgaagcataaatagggaccaaggaattgaaattttttaatcttatttttatattctaaacctattcaataaattgtctttctcctgtattaaaaaaaaaaaaaaactccccttatttggtcttagagaatacgatccacagttgaattgaagtatgatatctaacaaaataaaatatctatctatatatcattacaactgtacgaactccatttcaatagtggtattgccataaggcaaataagttttaaataattcccaaaggatcacaaaggatcagtatttaaaattgattactttgattttatgataaatttgacttggagaaaaataaaaaagaaatcggctgaataatttaacgaaagtaaaatttccttatactgttgcatcccaactcagtccacagctgtataaataatgccattcacaaccagaactggaaaaattcaattcagtctctattaatgcagattgtgctaaaaattttcc

SEQ ID NO: 24970 - DNA, 1199 bp, Mus musculus
gggggaaacgcgtgtttatctgtgggagataaacaagatggagtcccaaagactttgacaaaatatttttttaaaaatccactagaatagaaaatacattatttagatatactttatgctgagagtgagtatatatgcttgtcctatttaaacttgtgagaaaaagtggtatcccttggtacatttagaaacacagggggttatcttgtttcatagtggggtttggggcagaagaatgaacatgggatgaccctgttgaaagaaacttagcatggccgaggggttggttccagctgattgccaggaaacacaagcagtgggggtctccttgtggggtgtcgggagctttaaaccccaaagccaagcgagacagggaatagtgtcagaccaatggaaaagtgatctagcctatttttgctattgcacgacatcaatagaaaccatgcctttgtaaacaagcaagtcagtaaatgcaatgatcatgtaatgtggaaaattgaaagcattccagtttaaaaaatatggaattttttatatattcgtttttaagatgtatatgtaaaaaaaagagttcacattatagatggacttcatggatcggaaattgcttagaatttcgagtggtttcaaattagaaaaatatgtgagtggaaggcagctgtgaacgaactgcaccctagagagttgtacgcacgttggaatgtaagctgggcttacttacctggtccctttggagtggaggcaactggagtctgctctcacctgaaccatgtgaccggagtcgccagcctcaaagatatagttagtcctctcccctcttctcccaacatctgagacttctctggagtagcagagtctcatcacagaaggcacccaacatttccactgaaacagaacttcaaagcattggatttctttgcctttatttatgcgctcgacactctcagtgatatccagatgtattctttttattaatagttacaggtttgtgggttagtgggatttcagtaaagggacaaaaaaaaaaatcccttctaagatggatcgatagaaccaagataatactgcatgtactacagtcaaggacaccaagtgatcctatggtgattccagttagtcctaacgacattagtggttctaatgtcattgtagaaatggtgagtcctgtgattctagcatttgtctctaaccaatgatga

SEQ ID NO: 24971 - DNA, 1122 bp, Mus musculus
ggtattaagagttgggctttgcatccttaatctacagcttccctgagcaccagacacaaacttggcttcagttcccagattggagtttcttccccccccgggggggaggggggcttttcacaatcttcgggtgatctggaccttaaagccactgcctctaccatctatctctacatcatcttaccttagcctatggttcttcttccccaagctgacactcccaaattggtaactcttggcacatgatcttcatcttcttgtgcccattcattttaggctgtatgatgtactcggtgactgtcacctttttgacacctgaagctgtgatttgagacttcttgtacaactgtcagagtgtttgggccttctgtcctgactactgggtcaggaggaaagggtgtcccacccctgtgatgtattccagaatagatcccaagttctcccagtctgcatttcagatcatgccctcttattccccagtcacaacaaattgcctctggttaatttgagaaatgtctgtatttggtgtttctgtaattttattttgtgtttcagttgagtaagtgttgctgaatatctgtagaatgtgtgataatttttgtaaaaaaaaaaaaaactcaataaaagaaacattaccatagaaaaatatttcatgttgtgtaaaacacttggctgagaaaatgttttaatgtattatatcaaaattcctcagagtcttaacagtttcgaatacaggaaagagctccatttggcactgaaggagccccaactaaacattgccaggatgggagaagggcatggggtgggtgtagggagcctggatcagaaaaatagttgactttcaggaatctttgcttcattgatcagaagccgctcttcagtggaaccagcactcgtccatctgtctccgtactccgtaacactcattcttcccggttccttaggaaacacattgatgagtaatacatctaacctgccttcctgtggcttccaagctagcgaaggactgcatacagggacatcaatttatctggtcatctaaatgagggctggtgggaggcaggcgctgtgcaggatggcaggaataaagtgaaaacagacgtgaactctgccctcgaactt

SEQ ID NO: 24972 - DNA, 1235 bp, Mus musculus
accttaaacaacagcttctgttcccctgggtttcatagatcttagtccatccacaaggaggaatggaaatgcgaagaataaatttttagggttctgctctcaaatattcccctaatttttaagaggctggagccagtcacggatacaagtaaaacacatttcccccaatgctgagtctgagactgtgaattgagacagggaaatggttttcttttctagatgactatttttcaaactagaaatatgttttgcatcaatgatgtgttaaggtcaagtcaaggaaagagacaatatgtcccatgtcacggagaccgggataatgagagtgttctctgggagctggcgtgaggctgttcatttcaccggcgaaaggttacaccagacagattgtttctcatttgatgtcttaaattaaaccgctgacatggcctgcctcaaagttagaagcttctgttttcaccaaacagaccctaaaggaaaattcctatttgagagagttggtctccaagctgcagcctttgaggattttctgttttcgagtcttgcttaggaattcaaacaggttttcaactgctgggcagctcctaatgtgatcgtgaaggggggcccggtggatctgaggcttggcagtttgttaaagtgctgtgtaggatagaagcaagataaatgttgtctaagtaagattcagaaacagtcatatacaagatgcacacgtgttcagacaggaaattgctgctgctacaaagaatccatctacctatttgagatgtactttggtcatcccctttgttctaatcctggcttgccctcctcaatgaccattttgcctgcctctaaaattcagaaatcaaacgttacggtgagagctcagctgaccagcaacactaatatttcagcatggcaggggctggcccaggcaccgatgtgcagctgaaccaggtccccagatggttgaggaatcctggcccacagatcttaaagaaacgtagtggtgctatgccagacacaagatggaggctggggaactgggcagtaaatatcttaggcaaggcctgcttacagggcactttcgttgagatagggtagggagagcatataataaataaggggacagctgggaacatttctggtggtgttaaggattaggacagggaatcagagaataatggggtggggtgaggaacactactataaatagtgagcaaggaaaaccagctagagaggaaaaattgata

SEQ ID NO: 24973 - DNA, 1143 bp, Mus musculus
tatgtcttatgtaaatgttcatgatgtgtgcttgtgcgtgtgtgcttgtgcgtgtgtgtgtgtgtgtgtgtgtgtgtgtgtgtgtgtgtgtgtataccaccccagaaaattccctaatttcctactagcaaagccaagggctgtttttaaatgccatcacatatttcttgtgcccgttacctaacactttatgaatgaaatcaaacaatatgtgttattggtgtaattttctcccagatgatttttctttgtggtttatctattgtatgtcaacttgatgcaagctatactctaagaggaggggaaccttagctgagaaactgcctccataagattaagttgtaggcaagcttataaggcattttcttaattagtgattgatgagtgagggcccagcccgtgtggatggtgctacccctgcacttgtggtcctggattcaacaaaaaaatcaggctcttcaaaagccattgaagagcaagcagtatccctcatggtctctacatcagctcctgcttccaggtttctgccctgtttgagttcctgtcctgacttccttcagtgatggattacaatgtagaaatgtaagccaaataaacccttcactctccaacttgcttttggtcatggtgtttcatgatagcaatagtaaccctaagacatccatgctgtgctaccaaccgtagctgagtagcaagtgtataatgggagcactacttactccattctactaatggatacctgagttattaccttgttttactaagttaattttaaaaataagcaaacacacacacacactcagagcactaaagcttaagaaacaaaaaagaaaaagaaagaaagaaattgctcatttgacaccagaggacagaaagcagctaaatgtttttccataaaccctttggcaagtgatactagccgccccctcccatctctctctctctctctctttcttgcaaacacacataacagtaaaattcccgagtcataggatctgttatgtatggacctcgggggggaaacttccaagctctcctaagtcagtggcaacttttaaggttgtagcacccaagaataagagatcaaatcagcccacattccaactggcacttgatatcagtcctttaaacttagcttgtcgc

SEQ ID NO: 24974 - DNA, 1176 bp, Mus musculus
tgtttcctaaaagcggtagataaggtaattctgtgttctatgctttttaatctgaagttatttccattaatttgggggtttttgttactgtctccccagctactcaatagctgtactagcttttgagaattttaagactttatgctgtatatttttttctgcccaaaattcatatggagacaacttgcaaaagtagccattgacaggatcagactgtgcctcagaaaattgttgtgccttccagcctacctgcctaccctccttcccacctgcccacttaccctcctgccctccttctcacctgcccctctgcccacctcctctcctgtcctcctgccccatatagaaagcaagttcacacacagaaggaagtgccttcactcacttccaggagagatcccagactttgactgctagagctatctgggcttcaaaatatacttaagtatttatcttgataagacaaggatgggaattttggtgcaggtagtaaaaatatgtagaagagatgagcgtgccatcagaagataggtttgattcattccgtctgagtgattactttaaggagcctggccttgaggaggcatttgggttacatgtcttattctcaataaagcacccgtgccagtgaaccaatgtatcaactgtgcgttctttgtatgtgtatgtgaatgctgtcatgatgacacagtcacaggagagtgtgtttagaatcggaatgagtctgtgcatatctccagtgtcatatttgttcattgagcactagaattcgttttactaggggtctcacagtttcaaagaaatcctctctactccctagtcagcattttcccctgtgatgttccttgtttccaattatttttaaatgctgtgattattagtattacttattactgctacttacaaaaacttgaggaggaataaagtcagactgatctttactgagaaacacatagcatctttgtaccaaagaaagagtgcttgtgatccaagtggagctgcttaagaggatgaaggcagggagcacctgcagacttgggtgcagcgatctgccctgtgccttatcactgaggccacatagctaagatttaagtcgttagccagcttttaagaagcttctttgttggaagtgggaaaatttccctagacagcctttgaaaagttactgtgtgcaac

SEQ ID NO: 24975 - DNA, 1101 bp, Mus musculus
tttaaaagtcccacagtctttacttattaaaagttcaatccttttaaaatatccaatatcttttaaaatccaaagtctttttacaattaaaagtctctcaactgtgggctccactcaaatacttccttcaagagggaaaaacatcagggcacacagtcaaaatcaaaagcgaaatcaaactccaaccatccaatgtctggaatccaactcacgattttctgggctcctccaagggcttgggtcacttctccagccaggccctttgtagcacatgcgtcatcctctaggctctagctgcctgtactccactgctgctgctgttcttggtggtcattcatggtactggcatctccaaaccactgcatgaccccttcagtcctggtccatcaattgcaactgaagctgcaccttcaccaatggccttccatggcctctcacagtgccgagccttagctgctctgcgtgaccccttcatgccttcaaacccagtaccacctgggtgactcttacacattaccaactcctgctgcagcacgagatacaatttggctgtctctggatcacagcctctttgtgctttcagaaaacacttcccagaagatgtcacctcaatgatgctggtctcttcttaatcacagctaattttttagctccagctaaccagcatcaatagttccagtaatgcaaaggcttcgctttactagttctggtatcttgttaatcacagctgattcttcagccctagctaaaccagaaccacagaatcttcacaatcaaaatagcagtggccctgaaaagagtcttaattttccctcttaaatttcacaagccaggcctccatcttctgcactgttctcaatgttatcttccaagcttctacacaacatctgacagagttcttaacaccgaatggatcttctagcccaaagttccaaagtccttccacagtcctccccaaaacatggtcaggttgtcacaggaataccccactatgctggtaccaatttgtcttagtcagggtttctattcctgcacaaacatcatgaccaagaagcaagctggggagaaaagggtttattccacttacatttccatactgct

SEQ ID NO: 24976 - DNA, 1190 bp, Mus musculus
gagtgcgtataacctgatctccttggagcattgtcttcccctcttcagaagtcggaggtgtggtagctctactctctgatgacctattgactggttggtgtgtgtgtgtgtgtttcttactgaagtttgaactagcacctcttgcatgccaggtgagtgtgcttgccctgagggcgagctctagccttacgtgttgagtctctgtagtaacccgacttacctgattactctattcaggaagggtcaaagggacctgtcacggatgaccaatgactctgacactcggaaggttccaagggttttagaaagtttatacagcagaactttgaacaaagaacaagtgtgcatatatttattgtactgcagttattacttattggtagaaattaagtaatacaaaatagttttccacttccagcaaagtttaatttattatatctttttctctcataggttactgatgaattattggaaaaaattgcctccagaagtcagaatataattgagattaacatttctgattgtcgaagtctgtctgacagtggcgtgtgtgtcctagcatttaagtgtcctggacttcttaggtatacagcctacaggtgtaagcagctttctgacacctcaatcattgcggtcgcgtctcactgccctttactgcagaaagtccacgtaggcaaccaggacaagctcaccgatgaaggacttaagcaggtaaatccacggccttttctgagagatttcacacactgattaaagaactgtcaccgcaacatttagaaaggttgttgcattaaaatgaattattagagactaaactaagctgtattttctatgtaaaaatgaatatttgattaggctagtgagctccagggctgtggtgatgagcagatagatcagttttgctgtgttttacagtgagtgcctaatctcttggccagccattttattagctcccagttttattagctcctgtttttttctttttattgattcatttttaaagtaggtctgtaccatactgtgctttaagttacagtattcagtttaggtcagaataagtatttaaagttattttaaaatcttcttttttttttttttttttttttcttttttggtttttcgagacaaggtttctctgtgtagccctggctgtcctggaactctctctgtagaccaggctggccttgaac

SEQ ID NO: 24977 - DNA, 1809 bp, Mus musculus
cattttcatggattaaacactaatatgtgcattgatgtatgtgttaacttatttgtttaggtgtgtatgtgtatttactttgtatattcttccccataatacctatttatgcccagatttgagaagacagacactgtcattttatttactgccatttgctctgccgtgtataggatttactatgtagactcagtaattaaataggtttttaaaattttggacgggctattagaattcttggtaagaaagaatcattggatatttatataaaatatttttctaagggaaagggggcattttcaagcaacagaatcatgcctatttccagagtctctgcaaagactacagtatccagagagcagtctacttgggttttagaaaagaggttgacaggaatatttattgaaggctatagtgtgttaacttaccattggattgggaaatacacttctagcatggcccccaaacttgtttaggtttagaaggaaacaatgcttaaccttcagagatgtgaaatcatagatgtctaactcattaactctatggcctttgttttagcaactgggaaccagtgtatcattcatatgattactgtctatacatgatctgaaagacggacggtctgcttagcaatgtaggtgatttctatacttatgcttatagaaaacaaaactgaaggcagacatgatgcaaaaggaaatgccagatctagcttacttctgggagtaaactaagcatcaaatatagctgctctagatttatacttctggatgcaaatattaattttcatttatttttatctccaagattgcttccagatttaaaattttgtgatttttgtgagccttggtgagtggctggcacctagtaaatccttactgaatactgaaagaataaatgaataaatagaaccaagctgtaagtaagcaacaaagataggaaaatgtcagtaaatttattcagatctagaagtcacatttacttgtttaaaatgagctagaaaaatgtgagaccaacaaaggaaatcaagaaccatcagtgctgttcctgagttcatcgtcacttagcagcagagaatcagtcaactgagagtatctgcaggcttccttctaggagcagtgctttgggtaagggacctgacctgagaaggacagttacagaaatgtcctagagtgctttggatttcagtcctgacccagcatttgtaaactcagataggaagtagaagcagtgtcccagggacaatgagagggactcaatatgaggatgtggccatgggaatttactaacctctgtgtgccacagcttgagcatctgtaaactcagataggaagtagaagcagtgtcccaggaccaatgggaggattcaatggaaggacgctcatagccaggacagtgctaggtcataagaagctttctatcccgcttcctactgttatttattaatggaaaactttatgaaactttatgtacgccaatcaccactggagtacaaactgagaagtttgtgataggcctgatgtaaacatgagtggtttttatgtccagtaaagtgaaaaactgggcacacagtcaagtagtggaattgcacagaatggaaactctactttgattgatgtaggatgtcacaaggtgacacatgctggtcttggactcacatttcctccactccaaccaaatggcaggattgccagcaggtgccaccaggcctggccttagttctttcaagtatgttaaattgtaaagaggaggaaaatttaaaggagaaatgtttatgtcagaattgtagtctcactaagttttcaaacc

SEQ ID NO: 24978 - DNA, 1156 bp, Mus musculus
taagactagaattcccacttttattgtgttcttgttcttgttcttgttcttgttcttgttcttgttcttgttcttgcttgtctgaggcagggcctctgtaaccctggctgtcctggaacttactatgtaaaccaggttagcctcaaactcacagagacttgcctgcttctgcatcaccagggctggattaaagaggcatggctccatgctcagctctaacaatacttcttagctgtgaagatgatcaagggtaaagctttataatgctcttctcaaagagaactttagaaaactttccctgattttgcacagtgggctggtcttcctgcttcacagcttatggttttgtttttatcttgttaagatttatttattttattgtatatatatgaagagagcatccagtcccctggggctgagttacaattggtcatgagcagctgtgtgtctggacagtccaagagcagaaagagcccttaacccctgagccgcctctctagcccctagattatggtttgaatctgagagtgacctttaataaggaatgcaaggcacctcgagacctgttgaagcatatgtgccacattttagatgtggataagtgggcatgaggaaaattatgcaaagagctggggcagattttatatgctggatcagaaccttatcacaccgccccagtgccacagcccttacctgccggtttcattacggcactgtgcttttgattgaggtttctcatcacacagccttgacttgatactgtgctgagagtattgattcagcattgtgagaaggcagcaaaatgcagaattacagcaaaacagtgttatactcactgctctagacagattcagaagattgttcaataattgcttttactttttaaaaacgtcactgttcccagaaattaaaatgactatgactaagccataccactatacctctgccttactttgtaccaagtcactctgtagagatttttaagctataacaaacaatcaagccagaccagattaaaagtattaaaacataagaggtcttgctcctatattttgtaaattttttctgagattttaaattatcttatgtcaggtgtggtggtgtacacctttaatcccagtactcgggaggcagaggcaggcagatttctgagttc

SEQ ID NO: 24979 - DNA, 1185 bp, Mus musculus
tgggagggatagagagtcaagccaccatgttcatttccacctgttcatttcctcaccaccccagccttcccctttcttagggagactctagaaatggtctcttactgtagcagccacatgcctctacgtacatataataagctagaaggatacaaaatgaaaagtccatttctcagcctcactgaccacgctgcaggtactcagcagcaactgtgactgagtcaccttgtgcacagtagctgacagtcctttatgccagcagcccttgggcagtgctgccctaggaaagctagtcaacagagagacaatgtcaaatgctcttagcctctcctctgtaactttctctaatggagaatctgagcttttcctatgtaaatggaaatctatctggtgcctgctccatatgcaaatgttctcctgggcgattcttacctgtgacagaattgatggggagtctggtaaatcacaagcactcttcacctcatcacaaatacactgcagatgtgaagttgcaaagtgtggaagccagaaatgcgaatgccgctttcaatgtgttttaatgggtgttttctgcatcttgttataacccagggacctggctgcacggaactgcctggtgggtgaaaataatactctgaaaatcagtgactttggaatgtctcggcaagaagacggtggagtgtattcatcttctggcttaaagcagattcctattaaatggacagcaccggaagctcttaattatggtatgaatactcggggtttccttttgatagtaagcatggcctggatcagcacgaagcactcacaagtgtggctggggtaaggcagcgtccgggctggaactacttgaggagcaacactggatgagaagtgttcttgtgtgtgagattgctagtcaatgaacatgactagacgtctgagaattctgtgcagaatgtgattacatgcgatgttgctgtggctctggcccattggtttgaatgtcttgtaactggtctagtaatctcatctaaggttaaactgtcagtcaagactccaggatcttgggctcagcctctggaacttatataaatcttgaccaaagagagagttgggtattgctttttataagagcaggaatttcttttttccactgaaattttttaaaatatctctatcctaagaaactcagaagacaatgca

SEQ ID NO: 24980 - DNA, 1146 bp, Mus musculus
ttagcagtccgagcccagcaagggacaggaggctggcttggctctgcctctgtgaacaagacatgaagcttaatcccagcattctggtgtacagagaacatggcactgagactcgctcatccaggctcttagaatttgcaattcacatcataactctttgcttaaattaaagaggcttttcaaaacatcatgacatctgcaacatttaaattctattttattctttgtcccagagcaggcagaggtatagtttaagattaactcatcgggagcctttcagaatcatgtcagtcatctagaatattaaatttaacagaggcacatgcattaaggaaagcttatgcaaaacattcttactgttaattttgttatgcttgaagcataatttattcatcccttctgtcgatgataattattggaattatgtactttaggaggctaatccatacccaaaaagtgcacatataaatacagttctgatttgcaagttgatttagggaaaagagcctgcagaaatgcacagaaatgcacaaaactctacgacatccttgcttaaaaaaataataattgtccacagtggtttcccggtaacactggtgtggatacacttgaacctggtcacggttccttatttctctgtctgagagctttgtgggcctgttcatgactgcgctcatcggcatccctttaggtcagcaagctgggcatgaaggagaaggctggcgaacatgagcagcctgacttccctctgctgtatctaccttgagtcaccaggaaaccttcctgagaaatgggaggtcattgcttgtcaaagacagaaaacttttctgtcatggccacatttggtgcggacttcgtgtgatctaagctttctccttaatgccgttttcttaggaagacgataaagaattacttggcctttttcagcccatcattctgctaccaggaccacagggggaaaatcccatgtgattctttctcctttttccaaggcttaccagggacagtagagttggttcctgagtcatagctggccaccttctcacaaacatccatccacacagcctgcagtcattcagtgtgagtctcacagagaaaacagaattcctatgactgagagtgtgctaatttcctaaaacaaccaag

SEQ ID NO: 24981 - DNA, 2869 bp, Mus musculus
gccttttacagagatgctgagtgtggttcataacagccaggtcaaatgaattacagttgctgtatctagctcttggtaaatcttaacacactgtggctccatgggtacctgacctgatgtacacacacacacacacacacacacacacacacacacacacacaagttaaaacaaatcttttcttaagagacacttgacttgcttcgaggataatgatactatgatttctgactgactggttggttggttggtttgttccctctctccagtccggaacatgccctgtgtgccgccgtcacttcccacctgcagttattgacgcatctgcagctgcttcctctgaccctgaccctgatgcctcgcctgcaaatgacaatgctgaagaagccccataaaccatcacgtggaaatgagatcaaaatcctacacagtaaatctgcaaattccttctaaatctgatgtgcaaataattatatataaatatatttaaaatgctctatatagtatatgccatagtttaggaagagaatattaccctttctaaactgaacttaggtttgcagaacacactaaacatttccagctgagtgttgaagccgtgcatcccttttcttcggttgaccatggtgttgattgtgacgtcagcagtcatctctgtggcacacctttcccttttgtctaaagtgctgccactaagagatcatccttacgctcccttcccacatgagatgtgaagactgtggtcacaacagtagtagtacaacttggtttcattgaaaataaactgaattctaaagcatgctttctcactggtccctttgcttttgctacatcgaaacctcttggtttataacaatactgagaaggttaagattggagcttttcagaatgccaaacaaagactaaagttttgaccagaacaccaaaaaataaaaaaataataataaaaatacatcttggatgtaaacctcctgaaatggtcacgtaataaactcttcagtgagcactggatgtgtttaacggcgagtaaaacatgtgaataatcggatgtgctccatgcatggcacagttcatggtttggccttatgaagcactgtctaagccccgatccagtctgcttctacttgttaaatacttgaaggtccaggacactcttgacatgtttgtttaagaagttggatatagttagcttaaagtagtttgggttctactttagaaggtctgaaggtttgcacatggtcatgttcataactatatcacccccataagaggtgcacagcttttaggtgatcacaggagtgggcaagtgtgtatagacatcggtgtaacgggtcgctcacgagtgaaaccagacatcagcactggggaacaatggcttagacggcatagagcgagtgtgcacccacctgctcctctgctcatagtgtcgggaatgtttatgtagcttccgaaatgcagtttcatttaatagctctgtgtaatatctctgagcattttatattctttctttttttccagtcttaaaaataaatgaattttcacttttggcacatttgaggcttaaatataagaaacataacacttgctttctgatttttgcatatattgtaaatgtggctggtatttacagcaaatactgtgtatccttttatgggtaaaacacaagtgaacattgcatgcaagtaatgtggtgaatttgtaatttagaggttttctggggcttctgtgactttggatgcttaaattgaggccttaatgttgctctagctagcatgtttcctcctgatgtatatagtcagcgttgtataaactaatctctgcttgttttctactctgtgatctttccataccgtatttcattgatcagttagtgtcagaagtcataccagagtaacattagttcctatgtgtatactgtggatatttgtgaattgtgtggtttgtttgtttgttttcttttatgtactgttgactagttatggcacttactgattaaacttacactgctgcagattgctgtgtaacaagccacatgttatgtttagtcactattatgggaccttggtttttcttctagatagcagctgtcccaaagaaaatatttcttctttgcctattaagatgtagctattatctgccagttgttaaaggggtttggttccaaactcaaccagagagttgaacgtaagaaagctgttgtactttttgcttcccatctgttaccgtccctcactgttggctccttactacgcatacacagctgctgtggggagaaagctgaatgagacttgtttcaatttttttagaaaagaaaatgaagttttaggactttcatggtaacaaacctgacaagttcagaccccagtatattatttgatcttatcttggatccttttgaaaagttaagaatatatgaaggtaaattagaaatagtgaaaatattgataaaatgtcatttatcttatttctctattttatgttgttacttggcctattaattttaattttttgaacattttcttatttctcgtatgtgaatgctgatatttaaagttcaactcatgtggatttcttttgtgtttcttagttgttatctctaagctaactaacttttaagattatttgtgatatggatttatatataagctgttaaatatatatgaactgttaaaacggaatgcaaggttttcaaaagcccaggtctaactgtgatgattggtttattggtctacaatcccagcctggcattttccgtgtaaatcataaacaataaacaggatatactcggtgttcatttctaatatttaattgtgtgaccctatcacttctataacataaccctgaaggatttagagtcagtaacaaagga

SEQ ID NO: 24982 - DNA, 1195 bp, Mus musculus
tagctaggaggatgcctatatatttaatttatcaaatacattaaatatttgatcagatgacattgttataagtagctattaaatagattgacatgagctacaaaataagttggataagtccctgatctctgtgagttaggaattgctagaagacatccaacataaagaactctaatagttaaattcaacactgctctgagcaagctgtaggataaacattttttaggggagcagaaaatgatagaattttaggaggtaagtcacaaggttcaaattgatttgtaagaccaactgtcagttaaatagaattaagatatttgccatggaggccatgatctttatgtaaaatcttcaaagttctaaaatcataaattggccacaaaacttgatctgaaattaacttttttgatagatattatggatccaaactaaaataagacatattttccaagtaatcatattttgctccagcgacatttacatgtttgaaaagtatttgctgacctggattctattgggtgttgtcagccattgcttctgaacttgggagaaaagatttaagtcctaaacattcagctctaagatcgttgggtttgactgtgagtctctgtctacttctagatcactattgaaaagaaaaaaagagtctttagcagtttttctttggcaagtggagggttgttactggtttttcctgttacacatttcttgaaaaaaaaaattacttcactagtgtcttcaccattgtggacccctagagcaaaacaaaaataaagacctttaatattgctgacttttttgttgttgttgttttgttttgttttttgtttgtttgtttgttttatgttttttgttttgtttttcgagacaggatttctctgtgtagccttggctgtcctggaactcactttgtagaccaggctggcctcgaactcagaaatctccctgcctctgcctccccagtgctagtattaaaggtgtgcgccaccatgcccggctattgctggcttttcaaatgaaaatgttaaaaattgttttgtttttgtttttaaatcagccctaaaacaaaagtatagttctcatggctcctgcttttcaataattggggttcccccaagtgtgttcttagtatgtttagaagtgatgtcaatattatgaacaatggtagttttgtaaatacagtggacatgaggag

SEQ ID NO: 24983 - DNA, 1148 bp, Mus musculus
tgaccacgtagcaattgagagtggcctttacggcttttctctgttgacacacatacattttagtagaagcagatgtgtggagaaatccgaagaatccaagtgttgacaagctaacaactagttgaccagagcaatctacaacctacccgaataaggctgatgttttgcctttttttttcttttaatatgacagtttaaatgactggaaatagcccttgccatttcttctgatatgccagggtcaatggcttggtgggaatttaatgaaatcggaacgaggacttgcggattctgtcattagtacacagcactagaagtatttttttcttttagaagtgtggaaataaaaagctggccacagacagatgtttccaaatgtttacagcttctgcttcccctatagagcacagagagaaaatatataacacatgctctctgctgcctttaaattttgaacttgggagtttgcaccggccttgtgcaaaggctggagtaaactggcagccagggcccgggagatctgagctttgtcccacatgctctctaattttggagttaaatgtacctttctccccccaaccccattttcagagttttctctttgcacgaaatatataaatggaactcctcttgcccagtgacgtcttaatagtgtcctctagctttggctgggtgatcgcttgaacatgatttatgcgaacatctgcatggggttctctggcaaccttgacatttccctctgtttctaaagcagcgagtgactcattctgttactgagacatctcaggcagttggttctcccattttcgtatgaacccccagctcactgagaagttgagggtttgcctagagtgtacagcatttggcagagcggtggtggtgaccttaggaagtggtgcgttgtctgttccgagagagagagagagagagagagagagagagagagagagagagagagaggtggggggggcttgggagtggcatcctctgtgctttatctggacttcattgtagagagaaggtttagaataggtgggccactgaatctcccagtagctaaactccataagccctcttcgtaagtctcacgtgtttgaccattaacttcatgtgatgaacctatctccccagctactgctcagttggtg

SEQ ID NO: 24984 - DNA, 1169 bp, Mus musculus
tgttgagctatcttcccagtcctgacatttctactctttcttactttataatttattttttgatacaacaaagattaatttttttcataagagatcatgagtgttttgtatcatgggttgtggattatgtgcccaatactttcatgtcctagagcatggtgggcaacagcctttcatgtgttccttggttttctcttgtaatgcataattgagatgctcctgagagtcgggtgttgtgccagccatcaggcatggggagcaaaacagctgcccacttagtggggaaagagggatgtcacgcatgagtcatccactgggtgattgtgataatgctgtggagaaaatgaagtgacgtggagaaagagtactataccgaaggctattttagatagaatagctgagagggcatttaaggtatcttttagggagacagttgaagcattgtacaaagggaaaaaaatatgcattaagtcaagagagtcggcaagaaggagctgacttggagctgggatacaattagggcaaggctaagttgggaaagattgttgcgtgcatcccggtgttaacggagggggtcactctgtgctttgactgtgatgaagaatgctccaaatgcagtaagaagctacagtggatattacagcaggctgttatctgggcaaggcatggatggctaaacatgcacatagggagacagagttgattcggaaaattactagtgccttgtagtcagggtgttgggagggtggagggagagaggtttattgattcaacaagtatgttggagatagataggaattaggtatggaggcatcctgaggacagaggaagaatcaggacaccaacattttgaaggagctgcctggggagaccagagctgctttccggagataggagaatgttgtagctctgggagaagggtgtgttcagcaggtagggttgatgtcaaatagagcaatcagtaggtgcttgcagctctggacttgcctttcagaggtttctgcagaatatgtacatgagcacaacatgacatttaagcctctgagtggatgagcttatccagtatagagacgtcgtagacgttgtagctataggtgctaacccggaggctgacattcagaggtcagagagagaaggagccacaggaagaaagtaagggcacatggaac

SEQ ID NO: 24985 - DNA, 1144 bp, Mus musculus
tttgataggtacaatgttagttttatagaaaattttatcattaatattttctataaaaagaatttgcattgaaattgtatatgtgtgtgtgtgtgtgtgtgtgtgtgtgtgtgtgtgtgtttgtgtgtgtgtgtgtgtgtgtatacacatcagtgagccaggtatggtagtgcttgtgtttaacccagcacaagtgtgaaggaatgggggtgggcagagagagacaggtggatctctatgtttttaaggccagcctggtctacaaagtaagaccttgtctcaaaaaataaaaacaaacaataaaattatcagtgattgtaagttaaacgtttgtttcagaaaatatattaacggctcttttctgcacttagggctgctgaaattctttaccagttggccttgaaacaagctcagaaatacaagataaataaatttctttcatcacctcattacacaacactgacagaagccagaaggaacttaggactatttcagcatcatgatgccatcacaggaaccgcgaaagactgggtggttgtggactatggtaccaggtaatgcagtatggaatggaaacacaggttcaagtacaatatttttaatgtgcgtgtgcgtgtctggagatgaagctgctattgtatagcagagcacataccaaatgttatttgttctaatatatatatatatatccatagctaaacatcaccaactttgaagaactctgtggaagcgtcgtcgtagccccagtgttcaacttcggtccctgtccttgtctccagctgttaagctttgtcttaaagccaggcttgcgctcttcttagcccagtgtggcagctgaggttgtcttctttatccaatacttgacatttaatcagtcatacatatcctgggcaggtaattgagtgccattccctcgtacagcagcttaatcctgtcttctttcatacccagtcgtccttgaatgcttgacatgtcttagagggacaccgattggaaagccagataaggggaaaagcagcaaggactgcagtaagccagatgtgtggggagaaaaatggcggaagtgcgaatggtggctggagttaacaggaagggccttcctcaggaggatctctcaggcagctaaggaagcagggactcagat

SEQ ID NO: 24986 - DNA, 2198 bp, Mus musculus
ttccactttaggtaccacaaggtgtctttctatacagctcatttgaatacaggtgttccaaggtggggttttctatttttaaattaccatatcaaaaataaatgtgccttatttttttataagtcttgttaaatcttattactgtccatattactgtttgggaggtggggtattgggaggttgggatagggggtgggtactttctatgacacataaattatgtaaaattttttgcttgataatgctggccacatcctgatctgtgtcattacatttgtggtgatgttactctaaacattttgactatttgaatgtactgagatgtcagaaaacgaaacaagggagaaaaatattgctaattaaaatatgctgctgccaaggaaactgcaagttgaagcaaggatttcgtaacccacaagatccaagtacttcttgcatttcacagtacttaaccgcgttaaagagagaatgctttaaaaatagactgttttctaaaatcctctgtgtgtagctcatcttatgttccttactaaagaacacgttccaaacatttgtgtgtggtaaactcagcgtgttagtctagcccatgtaccatcatgggacctttgaggtcatttgagatcattgtttctgtaatagaataatagtatttaattttggtatagaaagaatgctttggctatatccacttttgaaaaattctcctcagtgtcttaacctaatttagtattctttgactttaaacctccacttacctcttaccattccagtacattacagagaaaagcatttctgcctcactgtttattctgatcgtcatctggattcttcctcaagatgcagctcctacattcgctgttctgttgagttcctaaaatcctttgcctataatcattaaggaaataccagaatgacaggaccattgcaagggtataatttcatgcagtaagcatgtgacgtacattcccttcctcatttgttggggaataagcaactgaaagtacaacaaaaccacttcctcctataacctctgcagacgctagctaggacgaccaagcgccagtcccacgaatatgatctattttcttgttgtatcttaagtgtatgccttcctgtggatgttcactgtgctctgtggttaagtggctatgcttaatcactacagaagttctgatgaggccaaatgaaaccagtggctgacataaataataaacaaaaacagcagacacaggggacccactctgtgttctggccaccagctccttattcacaggtgaagcagaaactctatgtaaccagcaagcttctgctttttaaagttattttcacattacaacactggggaaatgaagagagggtgtcttttgctttgggttatggtcagaaactggtttctctggcacacgtgggcagtcagccacacttcagacctgacagcgggggagggggggggcggtctgtttagttaggcttggtacatctgttatcacagatgctcagtggaccaagactgtctcgctactctctccccactctctgaaattttaattttgtttagaggtgcatggttcaaatatcagcattctaaaaaaaaaaattgatttaagaaaatgctgtatgatgttagaagacattgtaattatcatcccgtgtctttgctgtactcgtgctgaagtgttttcacagtcctttgtctagaagaaaatgtttactttcattgtgattattttgctcattgaaatcaacaggttttgatatttttctcttggaagatttttataactttttgggaatatgtaatataagatctctaataaaatataatcttatcctgtgcattgtcttctggagtaattcttaatcctactttcaaacagatctattaacacttttataacaaagaagtagagcaaagcagccgaggggccaggtggctgttcttggttctgctgtgacaaaatcagctctcttcagcccagccctagttaaaagggtgggggggggggggacaggatgagggtgtgttctgtgaacaggtggtagatgaatattagtgagttcacatctgtgtgtgatagattaaaggaacactttggtcagattctagatatggaaagaacagggcagaacaggatatgaaggtaaatcagcacacagagctaagaaggcccttgtaaatagatccagaaaataaggcc

SEQ ID NO: 24987 - DNA, 1444 bp, Mus musculus
taattttaattgttttagcagatttatagaattattcggctttatttatcgctttagtacagttttagaatttttcctaattccacaggtttccaaggtagatgggaatttattcttgctcctcttcaaagccatacacatgtactgaattcctttatgaacttttagctctgctactcacctgtgtgtgctgtttaaaaatctttgttttgtgtcttttccctaggatgaaggcctaaggctcagaaaggtagcacattcggataaacctggatccacctcagccgtgtccttcagagataatgtcaccagtcctcttccttctcttctggttgtaattgcagccattttcattggattctttctagggaaattcatcttgtagagtgaagcatgcagagtgctgtttcttttttttttttttttcttctctcgaccagaaaaagatttgtttacctaccatttcattggtagtatggcccgcggtgaccatggcccgcggtgaccaattttttttgtgtgtacagcgtcatataggctttgcctttaatgatctcttacggttagaaaacacaataaaaacaaactgttcggctactggacaaattgtatattatcagatcatcactagcagatgtcagttgcacattcagtcctttatgaaattcataaataaagaattgttctttctttgtggttttaataagagttcaagaattgttcagtcttgtaaatgttattttaataattcctttaaattttatctgttgctgttacctcttgaaatatgatttatttagattgctaatcccactcattcaggaaatgccaagaggttttctgtgggggaaatggtgcctcttactgtgtaaattttctcctttacctttgctaatatcatggcagaatttttcttatcccttgtgaggcagtttgttgactgagtttttcatccttacaatcctgtcccatggtatttaacataaaaaaaataaaactgttaacagattcttgctcgatagcttgtttgtgtctgtcatgtcatttgtgctgggttgggcgtagggtcagagtgggatgagccagcatgttcactctgcagtgaactttattggacttaattgatttgtttgtttgctttggtttggtttttcgagacaggttttctctttgtagccttggcagtcctggaactcactctgtagaccaggctggccctgaactcagaaatccgcctgcctctgccttctgagcaccaggattaaaggcgtgcgccgctgccacccacccagtgggctgtataatgtgtactgttaccttgtatgaaactctttccagtccttgattatttgtaatttaaagtcttgagactgttttaagaaatgacaagatttcaagccaacgtaggtattttggaacatcttaattgagtttatgaaatgta

SEQ ID NO: 24988 - DNA, 1196 bp, Mus musculus
tgagtactgtcaggttttagttttgtagttggcctgtgaacgtaaagattagcactggtgaagaccactgggggacttgtgtcagtcatgtgatgtgttatgaacatgctatatgagtacagtttggctgacaagatggctcattggatggagatccttgttgctaagcctgaggactggagttggatttttggaccccacataacgaaaggagggcaccagttgtaaaaagttgtcttctgatctccacatacgtactgtgacatgtacatgttcatatgtgcaacacaaacatgataaatgtaaccaaaattaaagaacaaaaatcatagttattttatggatgaaatcatcaaaagttgaaaaaaaagagagacaatttttgttttctttagaaaagtgggattgagattatattaacttaatcttgaattatgcttttgttgtgactccagttaatcttttctctgtctgccccttacctttcaggccccttcacagatgtagtcactacaaatcttaaattgcaaaatccatcggatagaaaagtgtgtttcaaagtgaagactacagcacctcgccggtactgtgtgcggcccaacagtgggattattgacccggggtcaattgtgactgtttcaggtagtactccatgtcctagacctttgtaggtttgaatattgacatttcatgactgttgcatttgatgtttagtgtttttatctgtttattatttggcttcagtgtttgtgtaaagatgttccttgggtatcttaccgtacagacattttattgaacctttcctcctcgagacttacgtgggagtgtatgattgcctagggtcaatttgaaatgttatctattctgtatttccacagctttccactgtagcttgtgttcttatttatctttgaaatggcactgttttgtgattaaatcatgttctgtgcatctacagaagcgtttgagtcttaaaaaaaaaatgcctgttttgggcctacttttaaaatcagatgagtttttattcctttcagtgtaaatgacaacagtgtcttgttccttgtttattgcttacagtagttccttccatacacatcacgtattcctgctgtgagatctactgtgctatccaaatgttcctttcttagacagcctttccaaggagacagtactttgtaacacgtgccataggtggc

SEQ ID NO: 24989 - DNA, 1213 bp, Mus musculus
ttctcttttccagggcagacaagacgccctcggcgagccaaaagccgcgtcagcggccccacccactcgcctccaacggacccaggtcgccttcccggttcccagcagccaccgcggaggcgccgcccgcacagggcatgctgggagtcgaggtacccggcgcttcatgactctcttccgttcggaattccacttggaacgccgtgaggtagcgtcgtagtcggcgctccagccccgcactcgcagctccagggccccaagaacgacacccccttcccggggcgccgtgcaccgcgtctccccgcaaagagccccgctccgcccccccgaccctgctctacggagattgacagcggcgcggcgcccggagctgcggccaagtcggaggtgcgcaggcgcactagctcagcgttgacccctcccaccccccagttaggcccggagggcggggccagcacgagggctccaggccgcgggggcgcgcacgtaggcacgtagggcccgtcacgtggggcgccgaggatcgcagtgcgcgtggccgcggcggctggtgtggggttgagtcagttgtgacacccggagctgctgagcggacaggctgccctcgggacccccgcggcccggcagcaggcgcggagcttcgggaatcgtgagcctggccccgtcctagagctccgcggagccggcgccgccaccgtcccctcgcccccgccagcgaaccgccgccgcgggcgcgcccccgctctgcgctgcgctgtctcctatggcgtccgcctccggggccatggcgaagcacgagcagatcctggtcctcgaccctccttcagacctcaaattcaaaggtaggctggctgggacgctccggagcggagctgaggctggggctggggctggcgggcggcggcggggtggccgggccgtgctcccctcccccacgccccggccgagcgtcggagccgcggccccgctgcgtccctcggccccgcgcctcgccgtccgccgctgccgggccgggccgggccgggctgggctgcgctgcggaggggaggggagggagccgccgggcgccgcggagggctccgccgccatcttgcggccccgcgggggcgccgtgggagcccgcccgcgccttgcccgccggcccgcatggcgtccttgccccaggggcggccgcggcgcggcgcggtgcggtcgggcggtgcgggagggcgac

SEQ ID NO: 24990 - DNA, 1759 bp, Mus musculus
agcaaaccaggcagagacatgttaccaccctcaaattctggacccctaaaggtgtgaaatcagaagacatccttaaactttgccaactttggagagaaagggtgtcaaacagtcagtgcccagttcattgacggtgcttgtccgctccaggacgtgagcctcaacatagtcttcctgcttctcccaacttgggagctaattgagtcctagaatacaggggatagcaaatacttgtcctgattcaagagaatcaagactcctacatgtcccatagcaggagtctcactgtcagcaaatggcatctgtatgctgtgccagacttctcaagaccatcagtgcctatcccatgtctccaatatcagcagctgacaggattccccatgctggcaaagacattcgtccactcactacaggtcaaacaaacagagaacgattgagctgaagttgaggtgacctctctcgagtaccaagcttagttttgaatctttccccatttttggggggaaccttttgccgggagcttgtatttacctggatgacggtctagatttccaagccaaattggtactgttcccaggagaggatgccccagctttggattgggtttgcagtggttgagttttgcatgaactgtctgggcttcaccttgagagtgagctgccctgggttggatcagagaagcattgtgagggtacgaccccttgcttttccccaggctgcatgctgttgatgtcacagccatgcagggggtaagtgtgcacacgtgccaccagcctgagcagagagagacgtggcttgggcacacaactactcacaccactttgagccttctctgcaggtaggtgctaaggcctttgatgcttctcctcttggcttggcattccttttgggatgtttttaaccactgaccctcgacaaagacctagacacgacaattgctccagacataggatgtagtgtccttatggctactccccaaattctgttcccaacccccattttcttatctctcacaggtgagcgggtttgtatatgtgtaaatatggtttttatgtcaactgcacctacatgtaatccattttagagtggctgtgtttggctcgtgaccttgtgcccataagtgaggcacagaatgtcaaagggattctttctcaggagacgtccccaaaggacagtggcagggctgtgcaaatgttttatacaggtacagaattgactcaccatttttttttcattaaaagtggtatattagggtactggatatgacgtcatcttgcagactaacctgcatcctagccaacagcaagggctgtgccccagtaggaatcccgttctttcctgaggttaggtttggaggatcaacatgtttcctccgccataatggactctggcttgtgtaggcttcttgctgctccgtagcattccgggcgaggcgtaaggaggcagtggtggtcagccagggattctggctgtgctcatgtgatcacggctttcaccattgtcgtgacacccagtgactcagcagtcataccgtcacacagactgtcgccctctccggtgtttttgtaaagggtttccacttgggctggacccaggtttggtacctagaagatccttctgcagacaccgaggaccttcgcatcttgtactctgttctctgataacgagtttcgggttggcgctcctttgtatcaattgcttttgattttaacccattggtatgattcctactaataaatattttaagttttactgagtg

SEQ ID NO: 24991 - DNA, 1184 bp, Mus musculus
gtcaggccccagcttcagcctgattgatctgtattgcatttgtcctccacgaccctggtgggttgctgggttaattgattactatcccgtgggttattggggactgtatcattcttctgccagctggtgtgatgcgcttcctgccagtcattcctctggaatctcaagtctctgttgaatttctttgactgtagataacagagctcatcataggagatacgacttttaacgtaacgaatgtgctttaccactcctgtgatgagacgataattgaagtgaaaattgagtcactaaaatttcctaattatttggataaagcttaaaaaaaattggtaataaccttatcagtaaaatcattaccaaattttgctttttagaaattacagatttagtatgtgacttgcagtaagaaaaactgtctttatgagacataaggattctgtattttgaattctaaataacaggtactagtggcactgaacactatctgactttctcctgtagacaaatggtggcccggagtttgctggatactctgagggaagtctgcgatgatgagagagactgcattgctgtcttggaaagaattagccgattagctgatgactccggtatgtgtctacagagagacagcacattgtttctagaaaggcttttgccactgaacctgtctttctaagctactggagagacgagatagaagatttcccaagaccttggcaagtgaccccacctctaaccccaacactctggaagagcttgtgttccaaagctattccgtactacacagagagatcctttctccccccccccccaaattcttttttgaaaggaaattattaacttactagttctatgtgaaaaaaaaatccagtttacatatgtccatttacttaattttggaaatttctcatcagtataaatgtaagaaattaggttacttctgtgatttatgttaacataaccatttttaaattatttagagtaaattggaagaagtggaaagggctttaaatgtttgtgggaaaataatacttcctgtctgatttacatgaaaaacatggattgatcgctcttggttttgctttggtctctctgtgtagccctagctgttctggaactctctgtatagaccaagttggccttgaactcacaaagatcctcctgcctctacttcctgagta

SEQ ID NO: 24992 - DNA, 1160 bp, Mus musculus
tataatttgaatgttttttgggtctaacctcattgttgtattttccagaagtgacttcttatcttagattaaggtgtgtggagagtctaacaaatttattagaacccttgatcccgttataaagggtgcccgcttaccagtcttcacccagtgccctcagtgacactctgtctgtcaggctgtctctgtaagaactgaagggagtacccataaatacctgctagggtttgcaagttacaggttcctacattagaagttttcccatctgcaaaaacaatgttgtctctacaatttgtttggttttggtttttcgaaacagagctttctctgtgtatccctggctgtcctggaactcattagaccatgctggcctcagattcagagacccacccacctctgcctcccaagcgttaggattaaaggcgtgcactgccatcacctggttgttgtagaatttattatatatttgtcttttttatactgtggtgttttcttggtaggtgaggaaaaccagtcaggcagctttgctggctctgctggagcaggaactgattgagcgatttgacgtggagaccaaggtgtgccctgtcctcatagacctgactgccccagacagcaatgatgatgtgaagacagaagctgtggctgtaagtctgttgcctacctttcagggagctttgagagtgtgctggtgtgtggtgtcactcccatccttggttcctgagctgagacagggggataggaaagtactaaatgaacctgactggacacggagcattagctctttatacctttaacactgatcttttgttggtataaaaaacaataacagaaattgcgagtgattccaggttatctgtgagaacagtgatgatcatatagttttctgtctcttgaaaaattcccttttcattgtttcttacaatagtagataccaattaacaaaaatgtagatttttttttcctcaacagttttcattgttgtgaaattcataaaattagccatttaaagtatagtattcagtggcatttgatacaatcacaactgtcttagttagggttctactgctgtgaacagacaccatgaccaaggcaacaaggacatgaccaagtcttataaggacaacatttaattggggctggcttacaggttcagaggt

SEQ ID NO: 24993 - DNA, 1127 bp, Mus musculus
cacgagctctggggggtactggttagttcatattgttgttcctcctatagggttgcagacccctgaaagtattttgtttacaaatcaagtttctaatttagcttgctgtttaatggttgtaaaactcactgacttttttgtcttttaattaattgactgtgtatttttaccaggtattgaggatgtgaatgtttgaccctagcactcaggaggtagaggcaggtagctggaggccagcctgggctgcacagttaggtcttgtttttgaagcgtacaggaacacagttctttctgtgttggttaggatatgccactcagctcctagtgtctgaatagtcaagtgaagagagagtcaggtttcttttacaaggctttcctgttatcctgaacatactttggcttttgtatatgcataggaagtatgtgtgcattaaaatatatatacctctttatgcttatgtttattattgtcctttttctcttcttaggttcgccaagcagcctttcagtctctggggcctttcatatccacgtttgctaatccatcaagctcgggccagtgctttaaagatgagagcaagaactcagaagactcctcggcagaagacaaagacaggtatgatggtgaagctttgtatacttgtgacagctttcccactgcgttgccggataatgttagttagtgagtgctttatagtttcttggtgatacatacattgtcctttggttagctacccattgactgagaaaatgcttggaacacacagcttgatgcctcacacagagagtggcaaacctgacttactgagtagttagtgaattatttgcctaggaaactattggtgcttacacaatatattgaaagcttttgtcttaaaaagctacttgaatgtttgcttctgtatatagtctactctgactctttattgttccttacagtcaatttaacgtggatcttggattctctgtacaaagagatcattataatccctcactgagggaagcattctttttaaaaagaatgatttatattgtttttatgagtacaccattgctctcttcagagacaccagaggagagcatcagatcccattacagacgcttgtgagccaccatttggttgctag

SEQ ID NO: 24994 - DNA, 1121 bp, Mus musculus
taatttcaatatcaaaaaaggagagtgaactggggtgcgatagagatgcttaaatgttgccgcccagaagactctgcagccgcaattgttgcatgttggctggtttgtgtaagtgcctttctgctagaatagcttagtgagacttagcagcttgacctatggactcctgaacttgaggcctgcaataacggtgcaggtgccttcagcaactagacaccgtaatcagacagcacactgcacacttttttccgtgcagtctcttgaaggaccagtgatttcgccacggtagaaaattgtttccagctctctcacagcagtgtcagaaacacccgtgtactgacaccagcgtggggagagaagtctctgcgggtgttgagcttgttccgttcacagtctcctttgcccacagcacaggtggacgtgctgtcggctgccctgcgagcttccagcctggatgctcacgaagagactggtggtgtagagcagcggagtgagctacaagatgaagtgtgtgtcagtgagcttccagactgtaacataagtcacgacacttgtgtgcctttgatcagcgctgctgaggaggtgagctcagtgcgtcaccaagcgagagctgcatgagcagtctccgtggggaccgtggggaccgtggcggccagcactccagccagcgctctgctgtcattctttctctagctcttcctttgtctaaagtaaaaatagttattctcacctcatccatccttgtgactttagcattgtgactaaaggctcaaaaaaagtcaatcctgtctatatgactgtttagatgggcggatgttgatgtagctcactgcagtgaaatagtcttactggaaacaaagccctttatcaagaataattaactcttcccttttctttttggagaggtgctttgtttctgatcggaccatttcactgcagcaagcaacacagtactctgagcagaagaccaggacttgaggccatgctgcggagggctgtggcattgtctggactcaagtgtgagggtgggtactgcacagcatcgtctttgctgcatccacgtagccattcacatgatcctaccctggtttcctactgcctttccctcaagccagaggcag

SEQ ID NO: 24995 - DNA, 1086 bp, Mus musculus
acagagtatctaaataattagctgatgtctcattttttttttttttaaagatttatttattgattatatgtaagtacactgtagctgtcttcagacactccagaagagggagtcagatctctttatggatggttgtgagccaccatgtggttgctgggatttgaactccggaccttcggaagagcagaagggtgctcttacccactgcgccatctcaccagccccctgatgtctcatttttaaacctcgggttgatcgttttgttgctgtttgtgtctctgcagacagctgattttacttctggagttatacagtcccagagatgtttatgattacctacgacccatcgctctgaatctgtgtgcagacaaagtttcttcagtccgctggatttcctacaagttggtatgtttgtgcttgttggcctttgcatctgtggtgtgtccgttccgaggacaggagacaagccttacattatgtttccttctaggtcagtgaaatggtgaagaaactccacacagcaacaccaccaaccttcggagtagatctcatcaatgagctggtagagaattttggcaggtgtccaaaatggtctggtcggcaagcctttgtctttgtctgccaggtagggaaggcctggggagccctgctcgtgagactcctcccagtcctgcctctctcccctataatcatgagaaactgacgctgctctctggctgtctttcatgaggttgcatgctcctccaagttaggcatttgttggtttcattcagccagcacgtcctcaagctggcataggcacatagccacgtgtgccacaactccctccatacatcacagtgcccaccagaagtcaggttggaaatcaatgtatgcgctggctgccctgggtctgtttaaagccaagcatggtagagtgcacctggattctcagcacttgagaagtggacagagaggatcctgacctaaatgacctaaatggaatgggggaaggcagttgaaatttaccttatgataaccctaagactcaaagataggggctggagagatggctcagtggttggtagcactgactgctcttccaga

SEQ ID NO: 24996 - DNA, 1644 bp, Mus musculus
tattgtgcaggcagcgagccttctgcacctgactgtacttgactaaactcccaaacaccaagactaatgttgtgtcctgcacatcgtttccagagtacttcttagcctctgccagctgtcaccaggaggccgtggagcagacaatcatggccctgcagatggaccgagacagtgatgtcaagtactttgcaagcattcacccctccagtaccaaactctctgaagatgcaatgagcacagcttcctccacctactgacccacggtgtccatcctgcatccgcaagagcctggcctcgactgcctgcaccactcgggacagctgtggtgggggccttcctcctgccaactcattcgcaggtgcaggttgcctactcccaataccagtggttttaagagtcaagagaaagtacagtaaacactattatcttatcttgacttaagggaaagtaaatctcagaggattataattgtcaccaaagccttaactcgttccttcatcttcctgactgatggcttgaattggcagagcattttcccttcgggaaggatgaggttcccagagacctgcgttgctttcttctggttttatttaacggctgataaatgacattcttacggccagaaggtggatgtgcaccggacaggaaaggccttcagtattagcctaagcatttcttctaggtgctgagcctgttcagctccttggctgccctgcccagcccagccctaagtgtgaatagttcttggcgtgtataaatgacaaaggagtttttcctctcctaagggcttgatgttaacactaaatagaatctgattttgactcctaatgcagcacattgctgtacacatttacagaatgtttgcagaatctctcctgatatttttcatgctggtcatgacctgaaggaaatttcttagcacgaatattgtgtcaggtatttttaacttgatcatggtcagctctgaggtgcaactgtgtcttcccgtgctgcacccctgtgaccactctggggtgtgcagcctgaatcatgctgttagaactgttgtggtacaagctccaaataaaatttattaataggatctataaagagagacaccacccactttgtttcctaaatgtctacaaataaatgcagtatgtggcctgtattacttagcataagatgggagaaaggcgtttgtctttagctcagtgttcacctgtcagccctcctcttggcaggcggcagcagcctgaagtccaggctgctatgaacaccacctactcagtgcgccatggaagggcagccagggcgggtgttggcttcacttgaggactgacccagccttaggatgctaagccttagcttccatccacgaccccttcggccttgcagcttccatggtgggagagcgcgcaccttcacgggtggcccctgacctctgcaggagtgcaatccaggtaggtggttccaggccctgctgctccctggaactgactcaccctctctcacctctcaaaaccaggaccacatgaaacagctaccaaacctgagatgcagatttgcccaccctggaccacaccttgtatgtgctgaccctgagtaaacatccttcccagagcttgactcagtgtgttggtctcactacccagtgactagcat

SEQ ID NO: 24997 - DNA, 2055 bp, Mus musculus
cgggaggccatcatcgagctccgagtgcagctccggctgctccagatgcagcgagccaagtctgagcagcagccgcaggaggaggaggagcccgagaggcgagggggcataggcccaccgccctgtgacggtgtcctcgaggtgcgggtagccaaggagcaggcgaaggcctcgcccagcaaagaccggaaggagacgcccatctgagctgcgggccgggccctgtgcatcttactgtgagtgtgagtgagccgcctgcctgctggacactctgtaaaggctcgctctcagagacgtcccctctcacacacgtctgactccgtgtcaggctcagggcctgggaggctgaagcagtggacacacggggggcttgcagggaacacaggcatttccagatagtgtcagcttatttgaaaaataattttctttgttaaaaataactattttaacctttgagtggcttctttttaaaccaaaaattcttttctttggctttttttttttaaatcacagcagaatcaggctctctttcttatcaaagggtaggaaccaaatcaggtcacttctgcgcctgcctcgtggacgctcgtggtctccccagccctgcagggtctctggccactcttgtttgtgccttccacaccttttggtgcagattgttcagtggggagctgcctcatattctctgactggccagaaaggctctcgctggggttccctgcaccacgttgcttttccacttccgagttgggtctgtctgtgtgagtcaggacggcccaggttggtggcagacagaagttacctgtgcagcctgccaccagcctgggcagtgcaagccactcactcactgccagggatcagcaaaggcctcttctctgaggtggtcggaggtgaccaccttgactctgaggcgttgcacaggaagcttctcaaaccagagcccttctccacactgaccttccaagaaaaccacagtgacttcagctgctagcttgggctaggatacacacctctgccaggataagccatgtaaatgctctcacgcagaacgttcacctttccgcgtcatctcaaggggctgctataaggactctgacagaaccgagccgaaccggtagctgtgactgaccccacctggtgtttgcttctaactcagatgactgctccccgagtctgggaggcctgcctcttaggcagccagatctcactgtcagatgagtggcccccagggaggtcccctgtggctctgaagacaaatcccacactctaaagtgagcgacaaacccacaggagggctctggtctcctcctagttagtatttatttcagcgcctgtcttttgtgcggttttttgttcgcctctgcctattgcactgttgtgacttgttggccattatttgatttttgtacggaaaaaaagctttgttatagaaatcagcatactatttttttaaatctggagagaagatattatggtgactggaaatatggtcaggtgtcaaatataaatgtacaaacgccttgctgcatcccgtccggtgtacaacatccactttatatttgctggcaatattgaagaattctttttgtttgtgtaaactctaatttctatcaaggtatcatgggtttttaaaattagtatttcattacaaatgtctcgatgttggttaactaatttttgccaggaccattattgatcaaggaaataaattcaacagccatttgagaaaaaaaaaaaaaaaaggcttctattgtccactcttctctttgaaataattgcatagccagcatctggcacgaagctggtggagatgcccaaggtggagagcgagtgggaagccttattccacctcgctcctcgcccatgctgtgtgtgtgctcctgctgtggtctcttggccctctgcccaccgtgcttgctgctgactgggagggtttgctcagactgtgtgcagttcctgaacctgacagtttcctggtgctgttgggaaagcaagctctgccttctaggtcaagtccagaaggcttggcccagttgttagaggttacagaggttt

SEQ ID NO: 24998 - DNA, 2175 bp, Mus musculus
ttctggtatgctaggagtgtgttaagttatatgattgtaactgtgctttttatatctggtgcctattagtgtaggtcttttccattggattcaatggaactttagtcacatgaggatcgggagttcagaggagtcctgggaaaacctgacatgctgacagaaggtgccgtcttcttccagctttccaaacacttctcgttttgaacgtgatagcacaagcctggtacatgtgtggttctcacctgccagttgtagaacactaggtccctatagtcacacatctcttaattgtgccttggctggcttacctgttttgtatgagtaaatattacagtttataattctaacaactcacattcaagccatgctgaaacttaatttcaaaccactttacattggttttagaaagtaaatatttactatattttacaacagaagagttttgcctagggccagcgagctgactcagtggataaaggcgcttgctaccaagcctgataacctgagttccatccccagagcccgtacagtggaaggacaggaccagctgctgggagttgtcctctgacctccagacaggcacagtatcatgcgtggaggtgtgcttgtgtgtgcacacacataactaactgtttttaaaaatataaacctcttacatggtgaaatctaaatctgtcgtgtagctctcacactgacagtggtttggatgttatgtcccctgtccgcctgtagtgctggtgtggtgagacacagagtcgtcactgctctggtatagaagagttttgtctaccaagagtgtcatggcatacctttggaacttcatcaaatgcacttgaggatgacctgggtcaggaagtagccaggtaaaagcagcgggactgtaggcgatgctccattagactccgtgcagagcagcaggtgcacagcatagctgggtgtgcggctgaccaggagagggtctgactccgcaccagcagaacagcagggtctccagcacgtgtgggaagcacgtgggagagggttgaggaaggatgcacagatgtggacagagaagcataaaaatgtcgggaactcctagtagggtccaccttaaaatcgctttatagtctctggctttgttactctgtaagattacacttgtttctggatatctgaatccaaataagcatcatattttaagaagctctgtttctgaacttccagggggaaatctgtttaatgtgtttactcctagcatactacagaattttctagctctatagcttcttacctagcgtttccatagtgctgagcttcattactacacgcccttcctagtaataaaattctcaccttcaagcatgaatcaaaaacaaatatctataatacacaggttcaattttatagaattgctattttctctagtgcatatctcattaaaagtaactttttaggaataatctttatatgggtacatattttggtacataaaatagaaaatgttcttaaactcattttgtattatttgaatagttacaagatgatttgtggtatcatgggtacccattataaaccatgctcttcccagtagctgacgaactcaaggtatcacagccttctaagaagccgacttagaacatggctgtacatgaatattatacattaaggtgtcctctcacttctacccagagtgcctctgttcaaaggtgccttggaaacatttcagccccttccttcttagctcccacagggctgtgggtgttcttgaaatcaggaggcgttttgaaggaccacagctgctccatttcagccgctgattcttaggaaagttcatgctctgacagaagtgtgctttgatggcttctagcggtgcatctcgtctcgttttctttgtttgtttttgttgttgctatcatggtttggtttggttttgagacaggatctctgtgcagccctggctggcctggaatgtactatgtagaccaggctggctctcctcatgttttcttagtgatggccataaacattgttaaaatacatcaccatcttttaaaaacttttcattattaaaatttaaaatatagcatgtcatttttttaccccatacatttgctatgaaaaattttttaaaccacctgctttaacttttttattgccctgtttttcctattagaattgatccccactgaggtaaat

SEQ ID NO: 24999 - DNA, 1176 bp, Mus musculus
aggaggaagccagggtgccattcggtcctctggtcctctgctccttgcccactgggatgtggaaggtaagctgtagctgcgtgctcctgctgcctcagaactacctgtcaccatgcacccttccatggtgaactgagagccaaaatgaaaccctcttccttacgtagcttttgcttttctcaggtattgggcatagtgtcttagtcagtgtggtactgttgtgaggaggcaccatgaccaggatttcttttttaaaagaaagcatttcattggggctggcttacagtttcagagggtgagtctgtgaccattatggtggggagcacggcaatcaggcgtggcctggagcagtagcttcgagctcacacctgacccccaggaacacacttcctccatcaaggccacacccactccaacaatctttcaaataattctactccagctgagcctctcccagtgagccagtggggaccattttcattcattcagaccatcccagacagcaagtaactgctgccttccttagcacagcgaggtcctataggaatctctccttccttttactctgacctgtggctacgcagttagatttttggtttgcacccgtctcctctctcaaacatcttctgtattggctttctcctgcccaccccttttcctgcattttagtttggctctgcgttctgttttttaaggaagggttaatatggctccagctggtctttagtttgctgtgtcgcaaaggctagtctttaattcttgatcctcctgggtcttccttcctgagtgctgggattaaagatgcctgctctcaagcctggctccatttctgctttacagtttgtacttgccggaatgtcttataactaaagccacgcactgtgagtctgtcgcccatacctgccctctctcacgtagtgtatattaaatgctgagagttgagctggagaatggctaagcaggaaaggtgttagctatgacatgacctgagtttgattacggtgcttgtcccatgacgtgcacacacacaccacttcatgtgtgcccatgcacatgtgtagacacataattaattttaaaaattaaacagttacactcaaatttcaccttactttcctttcatttaaactttttaagaagtgtgcatattctcactaaaccctcctgctagtttct

SEQ ID NO: 25000 - DNA, 1202 bp, Mus musculus
aatgttatggaagtagaaagtagatttatttattattttataagcatgagggatttgttgaaatgtatgtctgtgcacacatacatgccgagtgtctgtgggagttccatcagctgaaactagagttatagacagttgtgagcctccatctgggtgctaggaactaagaactgaactcaggtcctctacaagagcaacagctgctcctaaccaccgagccatctctccagaaccttacagaactttaaagtcttctaacactttaaaaaaaaaaaaacaattttaagaaactgccaattttggagagggaagatttttctagaacactaagaattcttaaacttcttaaagctcctgggagaaaatgccactttatgattaagattaattagtttaatgtagcttaaattattttttctaattccacaaacaactttatgatttctaaaaattattctgtgttcaactaggaaaaacttattgtatccaatgaacaagaagttctgcgagttcattacagagctgcaagaacactggccaatcaaacactgccatttagtgcttgtactgtcttactggatgcagaagtgtacaatgtgcccttggactcacaggtaaagagctagtttatacagtgctttcaagaactgtggtgtaagccgggggtggtggcgcatgcctttaatcccagcactcgggaggcagaggccagcctggtctacaaagtgagttccaggacagctagggctataaagagaaaccctgtctcgaaaaaaaaaacaaaaaaacaaaaaacaaaaaaaaaaactgtggtgtgcctatctttcaatatgctttcgtagaagaaagcagaattaaagtcaaagaataaatgcaactcttaaaagtcctcctggaggagccaggcctctgtagttgtttgttataaagccagataatcttctgggtgtggttgcataagcctctagccccataacttgacagcttgcaaactatctgtttagcaaaaaatcaaggactgagaacataacttggtaggtaaagtgcttaccatgcaaatgtgcggatctgagtttgaatccccaggcacggtagtgcacatctagactcttggtgctcctgcagcaagaagagaggagactgggggactctggcacatacagaagcaagcacagacactttgtcttagacaagtggaacat

SEQ ID NO: 25001 - DNA, 1239 bp, Mus musculus
ccttgaactcagaaatctgcctgcctctgcctcccaagtgctgggattaaaggcgtgcgccaccactacccagtaagaagaaaaatttttatcttttactcttcatgtggaaggccaactaaaagaatgagtatggaattgatcaccttggacagagtattataaatgaactcattggtcaagaactgctgccagcttgtgggtaacatgatgaaggagctgtggaatgaagatcagaagtgatcatggactacgtagtgatgtctaagtgacttgtaaatgtcatcattcgacttctagaagagatgatgcttacaaagggaagtgcaatctaagcatcaaacaaaaccaaagcatttgtgaagaggagacaaaagcagtcagttcaggaaacttgaaaaggcacgttatggggtgggggtggctcatcaggtaagagcacggctgctcttagcgaggccccaggttctgcacccagcacccacatggctattcccaaccaattacaactctggtttgaggataaccagtatcctcttatggcttccatggactccaggagcacacatggtgttaaatacattcaggtggcacacttgttggggttcaggaattgtctcacaaactgacctcagtcagacagggatggtttattgagcataagccccaggactggtcaaccaggtccacggcctgattcgggaactgaaccatgaccctaagatcccacaggatttttaaacctaaaatccacaagcatctgtgccaagttatttcaccaatcaggatttagggctaagggatttccttgggaacatgtctttgcggtacacttatcctgctcccattggttagggtattcaactgtggcagggggcttgccttgtctgatatccatgtcctaacttgtcaaccaggatgtcagttactcatgttcatgtctatttctgctgagtaggaagtcaggtcccagggaggtcttgggaatttacattttactagaccactattcaaaatggaagtcttattccaaatcgtttcttatattggtgcaggcatctctcatatgttgggtctaccccaggggcagcttataccataaaagctaatacataggtgcagggagtgctgttgggtttttgctttgggccccttcccgggaccaagggtctctcctcctattgatgaccgactaggccatcctctgctacatatgcagctggagccatgagtcccacc

SEQ ID NO: 25002 - DNA, 1182 bp, Mus musculus
aaatataaaatataaagggtttttagctgactcctaaccaagtcattcatattttgtcttttttctatattttatatagttgagataattattatgaattaaaccatattaatattatgtaaattggatattttatcaaataatttagttacattgaatttttttaaagatttatttattatatataagtacactatagctgtcttcagacacaccagaagagggcaccagatctcattatggatggttgtgagccaccatgtggttgctgggaatcgaactcaggacctctggaagagcaggcagtgctcttaaccgctgagccagctctccagtcccaaaattgatattcttgtatattttaaatagtttcttcttctttctttccctttcctttctgtttcatgtttggtttagaaatcctattacatgtagataatgactgtggaaagcatctctcttgaactcgtgttcaattcatgttctcactttaggttggacccctttgcatgaagcttgcaatgttggctattacgatgttgctaagatactgatagcagctggcgcagacgttaacacacaaggactggatgatgacaccccgctccatgactctgccagcagtggccatagagacgtgagtatggtgaaggggaagctagcgtctgctcacaggtcagccagcagggacagagcacactgcttgtgtcagggctcacacttcagtcactgcttcttctcatctttatttcgttggccattttattctattttctgacttctaatttgtacttagtttgatttagctttttttttttttttttcataaagtaagccgtgtacagccaggcattacctttaatcctagcatttaccaggcagagacaggcagatctctttgaatttaaagtcatcctggtctacatagtgaattccaggccagccagggattccccagccccacccccaaatcaaataggtgattgaattgcaggcattttattataagactctggcctgttaggtaactcgcttactcactctaaggttagaacacacacttagaggagaagtcatgtgctgggctgcttctccttgtaaaaggagctgtagctgtcaggttgtatttgcagtgaaaagacgggttcacttttgattggccagtttactgtgatcttattt

SEQ ID NO: 25003 - DNA, 1190 bp, Mus musculus
tctccttaagcctgtataggtttcaggttttgaacttgggttgctgtccttatcaacaaccactttttcctacagacccatgtcattgaccccagacaagatgatctttaattattacttttcttgaaatagctatcttgtattctccctatctttttgtcctatttaatatcacagatctttagttttccttatgtgccatagtttggtctccatgggatttctagttggcttgtgaattcacagtgatacttaaaactaactgtagtacagtcagtcatatgtcacataaccagcaatagacaacagacacaatgaagtccataaagttacatcaaagctgaaagtgcctgttaatattatttcgagataaggtcttacgatagccctggctagtgtggaactcactatatagaccaggttagcaacttaaaaacgctctgcctgcctttgcctctggagtgctggctgggattaaaggtggccagttttttacagtaaaaatttacatatgctaatcactaataatcattacttgcttttcttttcaggagtggccgcttctgttgtgagccagctggaggccttacttctttgactgaaccacccaaaggacctggctttggtgtgcaagcaggcctttaacttgtattcaactgtaaaaaatgtcactggacaaataaaatatgaacttccctacataagctttattcggtttgcttattcccacctgtacatcctggcagtaatctagtaacttgcagctgctaaatattatgtcaaaacaacaggaccactatctcggtctacctgtgaagacctatcattataacagaatcaagttaagaattattttagtgttgcccattcatagagccatgtcatttttatcagtgaagtaaaagttttgcaaaacttaaaatacatttttcctttgtatctttagacacagccaaattgttaaattttttataagctttatgtcaatgttccctttaagcgttttaacatttaagagcatatagttgttactgaagtttctgactggtaagacctccctatcagtactaccggtaagagaattttctcaaagtattccatttatgtttgctatctcattctgtagccctgcttgtatgtttaccaggctggccttcaactttgggtagttttgcttctgcctctcaagt

SEQ ID NO: 25004 - DNA, 1149 bp, Mus musculus
atcttcaggggctggtgaagtagtacctcactgtctgtctgcctgtctgtctgcctgcctgcctgtctgtctgtctcattgcctctccctcccaggtatctctggaaagggacctagcactggaaccagtgagggacctggaggagccttctctcgaatgtcagactccatcccaccgctgccacccccacagcagccggcaggagacgaggatgaggaggactgggagtcctaagagtgctttggccattctcccacatggcagagcagctggcaggggctcctcggccagttggggcctttcagggcctgttgcccaaggaggtgcagggggctgggcaggtgtcccaggcctgtgcctaattcctcttcatggagtcgggactgtatgagccatctgctggctttgctgaagagcttcttccttcaaaggatcctgagagaaaacagcaacacggcggaataaagaaagtaactgtagacctgaacccaagccaacagtggcctttaataaatgaagagtagccatgcgggctgcggcttctgagagtgggagctgtcctttttcccaggtgtgctgaggcatggtgcaggatgactgggggaatggacgtctttctctgggatcaaggcaaatggggatgaggtccgcaggggacagagggaggggtagctttccactggaaaaatgccttgctgtttgctgaggtggctgaggacaggagggactgcaagccacagggagggcttggaggcaaaccggggagggggacctgtgaaggactcaggagggacagaactgcagttaggaactgaaactggtgtgaggtccctgtgaacacagccctgaaaatgtgggtctctgcggtttagatgttgcctccacagaggcctcctgtgatggaccaggctctgtcctcagccaagcctggtctccagcctgaagtccagcaggacattgatccaggccttgttgagccgggcgggcggatctcaggctgaactgccctgggtagttgcagtttcctcaagataatcgagatttgctcctggtgtctctttgggatatgggccacttggggaccactcgggggtgccacagggtgtcagaagaccttctctctgggtgaaactgcacattcaggaacg

SEQ ID NO: 25005 - DNA, 1150 bp, Mus musculus
cttccaaaggtcctgagttcaaatcccagcaaccacatggtggctcacaaccacctgtaatgagacctgatgccctcttctggtgtgtctgaagacagctacagtgtatttacatataataaataaatctttaaaaaaaaaaaagaaattcaattctcaacaaccacatgaaggctcacaaccatctgtacagctacagtgtactcatatacataaaataaataaatctaaaaaaaaaaaaaaagaacaggaaacctgctgggcagtatagtggtgcatacctttaatcccagcactcaggaggctgaagcggggggatctctgtgtttctggtcagcctggtctacagccagggctacacagagaaaccctgaaacaaaaaacaaacaaaagaacaggaaaacaggctcagactacctgctctggagagtgactggctcaagctacactcaggtgaaccaagggtggctggatggggccagtgttgaaacccagctagacccatcctagatcctgctctctccctgagtgccttccagttttcaaatcagcgtcccttaaactaaccttcggccatcgtcattactgtgatcctattggtcatctttggtacctttctctgcttttgttaagctctgaacagttgtcattccccgtagttcttggttacttcagctatgacccttgtggtaggcttctttctccagcttgcctcaaacctccccctttcactctgtaaaggctgactgaagctttcttcatccgatgccaggcttggtagcagtctgtctaattccacagactctcatgctacattgtgagctgagctgaggtgaggcaccaagctgactgagcaccgagggagactgcatctggaccttccctggaccggcgcatttcctttctgccttgatggaaaggattgggcttttttgttttctgttattttgggtttttgatgtttcaagataggatgtcactatctagccctggccatcctggaattcaatctgtagaccaggctggcctagaatggttttgatttttggttttttggttgtttgtctttagtttttaaagatttgtctttttaatgtgtatgccagcacacattcttgttttgaattcaggtgtgcctatgccacagtgt

SEQ ID NO: 25006 - DNA, 1164 bp, Mus musculus
gcaagaacccgagggccataaaagtggtaggagggatggggcatggatcagtgagtgaggatgcatgctcagaagacacagcaacaactttgcagcacacacacacacacacacacacacacacacacacacacacaagcctgcatggttgtatttaccagtaagcactgtgtgtcagagatgacaggcccctgggtagttctgctcatggaccctaggattgtgtgaacttcagatttagtgaaaaaccatgtctcagagaaaaaggtgaagagtgtcggagggacaacacctgacatcttcctctggcctccacacgcatgtgtataggcacatacaccctaaaaggccatgaaaccacatgtaacttgttctaaatatcagtgatagctgcatgctgacttgatgctttaggccgtgtgtgtgacccactacaggtgtgtggtgatggtggggatgccatatcccaacattaagtctccagagctgcaagagaagatggcctacttgaatcagacacttgtgagtacctgtcgtgtttcagagggctaaagggaggaagcggtgtgccaccccctaggactggatgacaaggccctgcagtatgacctgttgtacaaatggttgctttcctctctagaggttttggagtatacctctagcccacttgatcttctctactgcatgaactatatagcacaagctgttgaccagacatgcaacctgaccttgctccaaagcctggactacaaggcaggcaaaagtagattctaatctttcctcttctgtttccttctcagcctaggacacaaggtcagcccctgccagggacggtattgatagagaatctgtgtatgaaggctataaaccaatccataggtaagtgtggggctgctgctgggtgcagatggatgttttgaggcgggagggatgttagtactgtattgtccatttgaggggtcagtgaaggaggagtcccctatgcacatgcagtattggtaggtgagttgaactcaagagtctcgacttgtgcatctacccaggcagggccattaggcaccagagggactttgccagcattgtgctcctggatcaccggtatgcgcgtccttctattctggcgaagctgccagcctggatacgagaccgagtggaggtcaaagc

SEQ ID NO: 25007 - DNA, 1105 bp, Mus musculus
cactgtaatttgcataaccagaccatcaccgccatcagccaacctccatcccaaaggaaagatgtagatcctttctcaaggtcgaaggatgcttttaaaaacacacggctactgaatgttcaacctggtaaactgagatgtttcgggaatgaaacagtaaacgtgcctgtaatcattttttcatagctcagaaaactatttttgtctcccatcttttttacacatgatatattaaacaaaaaaggtaaataaggtataaatagatttaaagagttttaaaatgtacatttgaagagattccgagcacccttgttctcagttctgcctgcctgttgaatttgcactgttccgttctggttgggtttctccatgttgagttcggagtgttctaagttaaattttattttgtccagtcttaatttttcaggagtctttcttaacgctttagactgtcttaactcagtgaactttttgtaatgataaggccgtgaggccagaagacgagagtgtctgtcatctgaaaggatgcaggccaaccttgctgaaaaggtacggagcccttcagatagacttaagactctgcgtgacccatctgcccagcctgaccgcacgtcctcgggcacctgtacatacactgctctgtccctgccctcacctgcgtgtgtgtcagtctggtctactgtaacttgttgtgaagttccttgtaccgtgtgtactgttgctgttggtctcttgtaccagtaagacaatggctccattttttttaattattgttaaaacattaactgatggtgtacaaatctcacttgacatttttcttgtttaaggaaaagcaccataaaaaaaaaaataaggaggccaaaccgagacagacaaaggtgcctcaggtctgcctgagaccacggtgacatggaaataaagtccttacaagaaagcaacagggtcttggtgtcaccgtttattgctggctccttcttctcccttgtcttcttcagctctaaatggaaagtgtctctgggttttcctgtagcggacagagtgcaggggacttaaaggaagagctgcacacactaggaaagagggacacagcagcgctaggcatcac

SEQ ID NO: 25008 - DNA, 1709 bp, Mus musculus
gcatggcaccagccctggcttcctggtgacatgaggagacaggtttatgtcctttgtctccctcaaattacacgtggggggagaaatgattaccttccaagtctagccttccaaggagtacttaacgcaaaatagagttcaaaccagaagcaggtcaagccggtattgattttgacagttgcagtcctctgacccgctcttcccaaggtctgagttgtcagggcagattggttacacgctctgagaagaatgaacattgtagggtatgagttctcaggtagcaaacggtgtcttctctcatcttgtggcttgggagggtctgtatatgtctactctgccttcagttaatatagagcttgctttaaggcgtcatcagttggctaccttgagtttctactcgtattagagatttattgggggcacaaaagaacctttgtattcttgacagtgaatgtttagggcagtctacgaacatagataacccagaggacatggtttctcccccttctctcagatgttcacgtgttctagatgccaggagaatcagtcattgctgtttggactgaccccctcacagtagtcacatcggaaatcgcctttcctctcttggtgaatgtgtgccaggtctggttttcacgcccagataagcagagttgttggtgtttttcctcgcctgtgccaagcaccctgtgtggtatcaccactggaatctcaacatctgagagacaggaagtgtttcttcccctgatttcctcacctctcaagtgaccttgccctctctctcaaagcttggcagcgaggcagagaggtgccgagagaatgatgcaacgtaggtggcacccttccctccaagagcctaatgtaccctggagggaacggttgagcgtgggcagcggtagcttgtggtgatcagaacaaagcaggccgtgtggccagccctcctattgtcctccctccctttgccacggaagttctgtcagagacctgggaagaccctgcccctcggttctgcttcctccagtgtcttgactcacagcagaagacagtcctgtgagctgagccacggcttccttctgcccggtctccctctgagtgaacacagaggccaccgctccctcctggaggccatcttggagcaggggctctctacttgtactgttttgtttgagacactttccaaccgacttgttgtttttttttctcttctttctctgtctgtctgtccagaaccaaactgtcttactaactgccccctggggactctagccctgcctgcctcacactgtaagtgcttcttccccacctccacccgtccacagagctgtgtgtgtagctgatgtactcgtggttggcattcggcatccatcctcatctgtggacgtccactctcacccccaagggacagacgctgagctcagacatcccattttgcccacctccagggtggactacttaggatctagattctgctaaagtttctcctcccctgcagttcaacagagaagcactggccaggagggaccatcttgggtcttgcctatgggagtctttggctttacccaccactgctcactcgcattttggtgatgccgtgggctggggtatggcctgcataatgtgctgagccttctctttctcttgttttttcaaacaaacatgaatcaagagtaaacccccaagtctcttgtccttccaagtcagtccattga

SEQ ID NO: 25009 - DNA, 1294 bp, Mus musculus
cttgggtctaagagtgtccccatctttaatcccactctggaacagttctgttcacacatccccgttgttgcagagagatgtcagtctctgaggtcatcacccaggagtcttcgcttctcagccaagctcggtggtttataaaagcctggtgcacaaatgtttcttggccttgcacatcccacatactgagtccatccctcagctttgtaaggattccttctaagccttacaatggtcattctgtcacctctgacatctatacccatttaaccggtgctttgcaattcctagattgagagagcagggtttgttgctttctgcttagtttcatttccatagagagagcaaggttggttggtcaatgagtgtctcgcatgtatgtgtgtgtctgtgtaccatgtgtgtgccagcagcacccagcagtgggtgtgggatcccctggaactggagttatggatggctgtgagctgccatgtgggtactgggaactaaaaccaggttcctccttgcaagggcagcaagtgttcttagcctctgagccattcctcttgccccttaggattttgtttttgaaacaggatttttggctgttttggactcaaaacagccaaaaacagccagcctaggctggctttgaactcaagattcttagtcctcagttgctaagattacaggtttgggccatcttacttggtactgaccaactctttactgcccaactgagtgccctgtggctttgcatgtcctgtcccccagtctcacttgctgggcggcctgggcagccacacaggcctctaactcagctatttctgtgttgtgagaacttggagccctttgagatgccagagccttttgtctgcctttgagtaaacaatgcatgccattgaagttaccctgagaatgccaattctctctcctcagattgaggaacatccttaaaaattaattcaaccaggttcccaggatccatgccatggaaaaacatggtcaagcaaatcctagacgtggctgtgaagtttcttgctaaggaatacactggaattcctcctctgtcattcacgtcgtaatttacaaaaaaaaataaataaaagttttcatgagttcttttctaataaattgagcacccttcctagactgcttaaatgaaagaaatgcagggagtggaatgggcctcttagtggaaaagacagagaaggacttcatcacttccaaagtgagcagttaccccagcaggccacgcgtagttctagtgtgaggcttgtgtgagaccaggtgtttaagactaactagtctt

SEQ ID NO: 25010 - DNA, 1205 bp, Mus musculus
tgcaaagactccaagactcactgctgctctggcatggcgcctctctttccacaagccaacagcaccaacaggaagaatgtgtgtgtgtgtgtgtgtgtgtgtgtgtgtgtgtgtgtgtgcaggtgcatgtgtgtgtgtatatgtgtgtgtacatgtgcatgcatgtgtgtgtgttaagggtaaggtgtgaggggcccataaaaagcacacatttggtattttcagataaccctccctcgggctattcttgcctggcaggatgacagtgcggatttgaagtgtcagcttcagtttgtcaaagaggaagcttccctgatgcgcaaaaagatggccaagttggggcgggagaaggacgagttggagcaggaactgcagaagtataagtccctctatggtgatgtggacagtcccctcccaacaggggaggctggtggtccccccagcaccagggaggcagagctgaaactgcggctgaagttggtggaggaggaagccagcatcttgggcaggaagatcgtggagctggaggtggaaaaccgtggcctcaaagcagagatggaagacatacgggttcagcatgaacgcgagggaacaggcagggaccacgtgccaagcactcctacctcacccttcggagactcaatggagtcctccacggagctccgccggcacctgcagtttgtggaagaagaggctgagctgctgaggagatccatctctgagattgaagatcacaaccggcagttgacccacgagctgagcaagttcaagtttgagcctcaccaggagtcagggtggcttggggacggtgtgtctaagggccccgcggccagcgttcccctgcaggaggagctgaagtcagccaggctacagatcgatgagctgagcgggaaggtactgaagctgcagtgtgagaaccggctgcttctgtccaatgcccaacggggtgacctcgccgcacatctggggctgcgcgctcctagcccccgggacagtgatgccgagagtgacgcgggcaagaaagagagcgatggggaggagggccgccttccccagccaaagcgagaaggccctgttggtggggagagcgactcggaggacatgtttgagaagacctcgggcttcggaagcggaaagccgtcggaggctagtgagccatgcccggcagagctgctaagggtccgggaggataccgagtgcctggt

SEQ ID NO: 25011 - DNA, 1101 bp, Mus musculus
ggctctgtgtctgtctgaattttgtggagaataaagtttatgtagaaataaaggtttagactgctgccggctatgctctgccttaaatgtttaaataaatgtttgacgtgtttggacatagctcgtgtgggttctgtcataaaaggccccagaagggaactgtgccaagtttgggttctatctttcaaattttataggcatatatattaaacgtgcctcttccagcgaccacccaggagcataacatgatgttttatccatgtgtctaaggatgtaactaacgttactactgttatggggccgtgctcaagagtggctatataattttttctcgaatagaatcctggatgctctcctacagttgttgttgttgtttttttttttttttttcctattgggatgctgtgttcatatcctatatgccagtgctctgaaaataattgctgtattcttggcctctagccttatgtagcctttctagcatggaggaagcctgaagtgaattctgacgaagttagaatctcaatgacccagtgcacaactaggttcatgggcagattgcgtgatgtggctgaactaagattggcactgtgcacagtgccgtgggcttaagtgtgcttgcggtagaagttacctgtcactcgtcatgaaagaccaggttaaagtagaaataccaacagctggacagacagagcccacgtagctcccttttgaatgtatctcactttcttgggcatcgtgtttaagatccacttaaatcaggaactggaggcaaaaccagcctggtggcgctttgattgggctgttgatgtgtgtgtgagctgatgggcagaggagtgagtgggtggtagagcagacctgctgctctgtggcatcctgagggcatccatctggggagaagagatctggggcaggtgccatactgaatatgaggctagattaaatgtcgtcacatgtgttaaaggagagccttaaacagttaatgtgtacgttaaacagtaaacatcatgactattcataaataaaaatcccttgtatattagagcagtaattttgaaaagtcttgtgcatttgtactgactgatttttgtgtgtcaactt

SEQ ID NO: 25012 - DNA, 1178 bp, Mus musculus
cttggtttgcccttctcttcctgaccgcttcggcagtcttgcacattaagactttcctggtagcaccagctcctcacagaagctttctgtaacgttctagactctgaacagatgtttttaatacgatgaaactgctagatgattattgtggaaaacccgagggatgaaactatgagagacagctgactctgctgaaactggaaatacgcagtgtggttcattagggtaggggcgaggtgcaatatcatgtcacaaatcacacggttcgttgtcattcaggaagtgttccttttcctttggatcacactgaagaggagtggcataggagaacaaagcccctgggctgggtatactaacaacactgccagttccaaaaacatcaaggtctcattgcccagttaggcagggctttggaaactacagttgctagttctaccttatttgtggctgcgcttcccagtgtttccatcatcgtaggccgactgtgacaaaacatataaagtgaaaactccagaaatagccgatgcaggtgcttttattccagttatgtcatctcttgttattctgttaagctcttgctatggctaattgtaaatcaagcggccataggtatgatgtggtcacatagaatcagaagggaggttctgaacgattcatccttcgcctatgcacatatgtagatatactggttgtcttttcacaagctgagctgatgataatatcactagggaccaccttcatgtgtgtcgcatacgcagtcagctatggaccacgtgtgtacacctgtgcttattttctccatatagttctttcctagcacatcctatatctcctaagagctttggcatctctaaagggataagggcatgtacttagtagaagagtgatgattgggaccctttgcaagctctcaggagagttggccgaggagaccgtaggctttatactctgtctttggggatgggaggaaggagagacccattatgtttatctggctacagatgtggccatatggaaagtgtccctgctatgctggctagtcttacatcagcttgatacaagccagagttatcttgaaaggaggaacactcaattgggaagtgcctccatcagatctggatgtagggcattttcttaattactgattgatgggggagccagcccatggtgagtggtac

SEQ ID NO: 25013 - DNA, 1175 bp, Mus musculus
tcacttagtgctgacgtttgaatcgtggaatagggttttagagatgtttgcaggcttgcagtaattccagggcaatcagcagttattaccctactaaagtttatgtcctttggagggggaaggtctgcctggttcatcctggtacccaaattgtgcctttggcttgaatctgaaggcttaattatttgcagagcagatatcctctctctctgtctctctgtctctgtctgtctgtctgtctgtctgtctgtctctgcatgtatgtatgtatgtacatatcaagatagaaacttcggggaatcatggtgactgagttttagagcgtctgttcagaagatttgaatagttgatgacattatcatctcctacgaggagcagcggtccctcgctgcttcaccctgaatggccacgagctgctgggtgtgcatagacatctgacatcttagtgtgttgggtggagtggcgtgggctgtcttttggagaggagtgcatccttctagctctctcctgccagggtctggctcaccttccatgtctggattccctaggacgagctggatgagctccgtgcagagatggaggagatgagggatagctatctggaggaggacgggtaccagctgcaggagctccggagagagctggaccgtgctaacaagaactgcagaatcctgcagtaccgactcaggaaagccgagcagaagagcctgaaagtggcggaaacagggcaggtggacggggagctcatcagaagcctggagcaggacttgaaggtgagtgaggtccatcccgttcctagggaacttcagacaccacccaacacatttcactactgcgcttgcagaggacctggatccgattcctacatccacacagtggtttacagcccatctctaacgccatctctgaaatctaccatgccctcttcaggtctcagtgggtccccagaaatgaacacgatgtgttgacatatatgtaggccaaatacccctacccatgaaataaaataaatctgaaggagagtaaggaagagggagactcactggttgaagtgactgagaagaaatcccagactctctaccctttttgctcccagtgtggactgcagagacaccttggtccaatgatacacgtcgatgtgggctatgcaggatggatgtcctctaggttgtgag

SEQ ID NO: 25014 - DNA, 1180 bp, Mus musculus
agggagccccagcatgctctggggttgttttcctgtggacttcaagagccttaccaagtctactagacacaaatccttgtgtctacccaggctcactgactaggggggtcttgtaggtgagttattgtagcattctgggcaccaggtgatgctggaaggctcagtttaagaacctccttttgaagagacaggaagccgcaaaggatcgatcacaaagactaataaggaagggaaggggacagctctggtctgtgcttttcatggttcaaagtggcatccttttaataaataggttgtcatcacggtggaagtttagacagcgaccccaagataagctccttggtttgttgttcccacaccagactggagttttgttctgtgagtgtaaacagctgatgctgaccctgtatccatgataaccacaagctgcggaccagcttgggctgccccattcaggaggaagctaaggaggagtctaatgagagtttacttcaggggcaacatgtccaaacaagtcagaaagattttgatttgcttggctcccaccgacacagtaagtctgggacacttgataggttatttcactgctgccaccggtaaagtgagccaatttaaaccaaattagattagattaaaggcagatttattgggaagctgttcttaggtgggcaagttcactgggcgcaaggaccaaggccagggagtcaccatggggaaagggcagagggtgtaggggacagagagagaagagaagaggagaagagagaccgaaatgtctggatagtatagggggaagcctctaggaaacgacagcccagcctctgggctggaaagttcagggttgggggcagggtatgccaggtagggactgagggatgctgggagaacctggaggtcaggtctgctttggtatgtgaaatatgcacctcagttccttgttcccagtccaaacaacagtgtcccattcccaaccgaagacattaaaatttttgacaggtgctaagagctactaacacctttcttagagtgaggagcagaaagaagtagtggctgcagaaacactccttggaagaagccacaggcagtcagtctcctgacttacagactggtcctcaccaaactctcctcccgttgttgacttctctttcctgtgcatcaacaacagcaaccgtctttcctg

SEQ ID NO: 25015 - DNA, 1177 bp, Mus musculus
ccaggaggagttgacttcctgttgtaacagaacccaactgaaacaaagggatgggtctttggggtttgcctatataaactcggagctgaaaatgaaactttgagccatgattggaactctttggcttggcttcattcttctctcgcccgcctatccgatctcattctcagcctccctttcaggtgtacctacccagttctctgtgactcctggacagctacactgaatgctgggagttctctagagaatgacctcacagccctgagggcacttcaccagtcttacagctctgagatcctgacagggccagtaagtggccccctgagagccctgactggaggtgtttctggccctgtttccacagagaaaacaacttgagttatccgtagactctgccccacagttatccggcaatagccaggtatgcctgactctgtaaaaggggctgtttggcccctccgctctcttactctcttgctctctttccctcttacacttttccctctctgccccttctctcccattcccctcccccctctctcctctcttcacgtgttgttgatagactacctctgtgtgtgtgtgtgtgtgtgtgtgtgtgtactcccttcccaactcccctccccatgccctaaataaactctattctatactatcccgccctatggctggtacctcaagggaaagggatgcctcagcatgggcccccagaggcacccccttccacctcaccatactgcacctataccaaacatatccctggcttccctttctggaccaaggccacttggtgagctctctgcttcagttgctaacagttggctcattagtgctaattcaggcgatctacaatcctttcctcggctattcatatcttcattcattcattcattcattcgttcattcattcattcactttcctcattgacctgtttgcagtgctgggggctgagcctagagtttgacacatctggggttttccttattttaaatcttgggttagctcaatgggaaaaggcacttgctacccaccctgaccaccggagttcagtcttggaacccacttggtggaggaagagaattaagtcccacagtttgccctctggcctctgtgtgaaaactgtgttaggagtggggtcacacacacacacaaagaaataaataacggcaagtctca

SEQ ID NO: 25016 - DNA, 1892 bp, Mus musculus
acccacccagcatttcacaaccgtctgtaacttcagctcccagagatccaacaccctatcctggcttccttgggtaacgggcctgtggcacaaaggcaacacacccgtgcacacggaatgaaaggtttacagtttaatacaatcctgccgtttgcaggactgaagtgtgtctgtgctctcttcttgtcctccagatgcctcttgatgttttgagaaacgagttatccaatagcatcctttctctacaaccagagcctgagatcccaccagagctgcctcctcccagaccacacgtccgatgctgttgatttgatactttggagatggtgcaagcgattcctagaagggggaaacgttctgttctgcactacaatcacgtgacaatttcctttcgcactttgtaacccaagtcagctatacactaacttgtaaatatgcaaatatgcaatcctgggtaaggtcgggttatataagttacacacttcccttcaaattatatttcctcattaccccagtgtctagtgtacgcacactgggaggcgtagtacttctaatacgaagactgggagagaagaaagatgtaatatttcctgagtactataaatgtccttgttaattacactacaaggcagacgctccgatgagaagagaggacctggtgcttcgcttgctgtttcaacgaaaatctacaaaactgaagttttttgaaaaggaagacatgacagccaccttttctttatttatgggctttccccacacggcacctcaaggtttggagtgtctctgcaccaaagcagagctccctcacggccacagtgagagcacacatgggccatgtagtgagagggttcctggataggggactggacttagtcccgaggctgcagaaccctgggtgtttcccgttggctgtgacctgcttttaagaatgaaaaggttcaatagagaaagaacggaagggctgggattgcagctcagcatttgagcatctgtccagcgtacgtgaggctctggcttcaatccccgtcatcgcaaggaaagaaagaaaaagaagcgtttttgaaactatagaaaagattttaaaatcacactgctgtcctacacaaatcctgtttaaagggattttaagagttaccttttagtatatcaaagaatacacatgcatttgcctaaacatcctgtatctttgtaatgacaaacttctccccttgatggtgaggcttattcctattaagcctagactgtgttctttaagttttcttggtccccacccccccttgagggtttttttttttcctggtctgataaggaatttgtgaactctatctttggtatatcttttattaagctgcactgttttgtttagtcaaggtaaataagtatgtatttgaataacttggcgtgtcctgagtgttgtgctatgagaagcatcatggtctttctacactaatgaagtgcaaataaaattttgtatttatgaatgacagttgaatttgccgtgtgtttgtgcagttatagattacatgtgccagtctttttcacgagctccgcatcttaatcttttgagtgtttttttcggtaagaaaagcatgctgtgttctgtgggaaacactctggcagctttagaaggttccgcatggatctctcatacaatccagcaacttggtttctaagtctatgtgcactcaggaagcagatcgggtactggacaaactcttccagcagtgcccacagcatcagttttcacagtagtcaagagttaataaacccaggtggcattcagtggaacagtggggaagcacactgattcaaaaacagtgggtactgttcaggaggcagcggcagaaagaccacaagatctcagccagcatggtctacctagcgcatcccac

SEQ ID NO: 25017 - DNA, 1928 bp, Mus musculus
tcagcttggaggtttgaaaagctaaacactggtgcacatattttccgttgtaaccattgatggttcccgttttgagatgagaattctgtagagaatttcagggactctctttaggtcgtaattggtaagttgccgggtaacaaaactaccacggttctaagtacttagaccggaaaattaaacctccagttttcacactgacttaaatttcctttttgattatgccccttcatgcctttttttttttttttttaacagaccattttggaaatatttatgctccttctaccctgtttgttttttaaatgtttgtcttggggatgtgttattagaactcagtaacgtaattatacccactgcaaatatccaatcttggatcctaagagtatacagggagttattaaccaggaaatgaggcttatattgttttgtttgtttctgacataagtgcagtaggcttgaatgcagttgagaattaccagtcgtttatggccccacacttacatatgcagaaatgaaagctaatggttatatttaatatagaagggaaataggactgcagcactcggaaggctcgaggtgacggactggggtggggagagctggcctttatgacagcacacccacattctaggaagttttcctagggctcatagaagtggatccgtggagagctggcctgtcctcctgagaaagatgggcctactcagtaagctttccccttgttgacaaaatgaaactagcttgagacatcatggaattacatagactatctggaaatgagcggaaacaggcctccttacatacataattatatgtacaaatatacgggtgtctccccacactgagggtggttgaatttttcccttggatgtttttgtttacttcatatccagcctaaagtaattaatttcagtaagtgtttcttgtgggaagttcggaaaaagatggtaaccataacttaaggaaagcctgaagacactacatgctaacaggtgcctctgcctcttcaactcctgcctctgggttgagttattttctagccagcctgcggtttgttgagcacctgctgtgtgttgggtgttgtgccgcctgtggggtaatgtggaagcccagcgtgggctcagtgtgcaagtggtgccagcaggcgccagattacagtgctcaaggggagcatggacagagaagggtacttaacacacaagcctcctggctggggccaagggcttgttagaagattccttcccactgagccctgaggagccaagttcattccttaagttcctttagaaaatgctgtttaaatatgaccctgggtgtggtatagccttgtagctactgcttgagcagagcttctaggtcttcctgtggcctgttttctagttccttcccagccttatacaaagagccccacaaagaagaggagtgtcttccctgatgctttttttactgagtcaaggctgcttctggaagagaccacagtccccagcatgagtccaccaagataggtcacatggcacctgtcattcagaggctagaacgggcaggggtgggagggcctgaaagacacctttgacaaggaatcagacacctgtggaccttgtgtaacaggatctgtggaggtaaatgaatgtaaaggttgaatcagtgagacattgatatctttattgttatgattaataatcggtgcatagtgggcataaaacacctagaattcgcaaggatgtgaaacgatacagtgtttagatgatttaatggaaattattgtgatttttttttcgaatagatttgtatttgcagaattgaattagtggaataatcagccagcgctggttattaataattaataaaggggcagctttatgaaggtagaaaggtaggagaagaaagcttgtttgctacagacgttggcacccagctgagctgtg

SEQ ID NO: 25018 - DNA, 1104 bp, Mus musculus
cacctcactccttttggatgtaccatccccagctgttgaaagcagagagcagagcttccatgagaacacgtgggaggaactcctcgagagcaggaggttagcgagggctgagtaagagtgagagagggcacagaatactggccaccggggagatgtggtgatgcactgaatttcactgaaatgatgacctcatttacaaggtgtgcatagataaggagagaaagcaggaggagggcgctgcaagccacacatctgcaaaccgtaagaacaagaacatccaaccccttagtgtttaatgagcaaaagggttaacaaggatcacacgttggaagagaaagcgtggcgtgtagcttcatggtagaacccttgtctagcatacgcaaagtcctgggtttgattcccagcactggagagagagggaaacaaaaacaaaaacatctaaagagaggtaaccaacaccatttggggtttagtggaaaaatcctcattaaaaccactgcttgcccatcagaacggctgaatatttgacaacacaaaacaatgttcccaagggctagagatgctgtagaactgaccagggtacagcagtgtgaggaagggaggaactcgggggctgacggagacactgtgtgtggatccgatagagccagcgaatgcacatttgcaaaacgtaactccaatacctactggagagttatatactcagtgatatccaaccagccatgttaggccaatgagatatctcatcaggtcaaggcgtttgctgcacaagcctgcctagaactcacataaaagcgagaggaaagaggatctactccacaaagctgtcttccagccaccatgtccatactgtgtctcgccactccctcagaatgatagcagtgccaggcttaagaatgtgggaaaggctagttacctctcacaaaagaagccagtgcatggagagtacaagaagatcattctagaaaatacagatgtgatccaaaaaaaaaagaagaaggcggtaagaacatggactcctcatggctagagcaggattgtttggggggcaatgaaaatagtgactggtagatcttagcacacataatacagttcccagctttt

SEQ ID NO: 25019 - DNA, 1192 bp, Mus musculus
caccaagggaatctaaaacattgactgcagctgtggtgtgctcacccacacacatttagtggataagccttccagctgttatgaataacactgctatgagcattcatatacatctaattttgtgagtgtatattgtatttactctgggatcaggagtggagctgcagtaacacatggcggcactgcctgtgggctttaatctcattgtctctcttcatatcagcgctacagcaaactgtggcccatgggccaaataggcacactgctgtttaaactgtgcacatttgcctatgtatagaccatggctatgtgagagcagttaagagtgactgtctacttagctttacctgaaatcttgctcaaagaggttgcagttgtcccgcgttggccctctacagaaagtttacaggacccctgctttaaaccctagaacttcacatgttaatcagtactgatgtttctcccccaggaaagtggccaggtcagtgtccatgtaggaaaggttatgctggagataaatgtgaccgctgccagtttggctaccggggtttcccaaattgcatcccctgtgactgcaggactgtcggcagcctgaatgaggatccatgcatagagccgtgtctttgtaaggtaagtgtggaaattaaggaagcttttttctttttttctttttgttttcgagacagggtttctctgtgtagccctggctgtcctggaactcactctgtagaccaggctggcctcgaactcagaaatccacctgcctctgcctcccaagtggtggctttgagtctcttctggggttctctgctcccctgggacagatgatcgagtactgtgaagagcaggaaggcttaagttagaaacagcatgtcccagcaagatggccctattctgtgcccttggattgagattggacaccaggcttactcttttgcggcacctctggctaatgaccatggattcccgaggtgtttctgtggcttcttagacggaacccaatactgctgtgccattttcttggcattgcctcccagttccgtgtttggaggcgcaccaggtacatactgagtttcccagaactctaatgaaatgcagatctgttatcttgcatttctcttgaaagagaattgtataatcacaggaatgcgcacacacgcagtgcccgagaagggtcttatttggccatatg

SEQ ID NO: 25020 - DNA, 1209 bp, Mus musculus
gcgttgctcattgagaagcactgtggctgggaagaagctgcagttctgaggtgaaacatacaatatttatgctctgacttgctcctgggttggaggaggagggccttcagtctaaagatctctgtggaccacgtcgctctgtgcggcacactttgaggactggctcacaccatggtgtgagggagctttccctgggccctgagtactcagatgctacgttatgactccatgggccgtggacacagatcctcattgccaagccctgtttggcaaagggcatcttgtgcgcatccagagcttccctgtggccatgacacagccatggtgtcttccgtttctcctctcagttttggtgctcagtgaataaattgcctttctggagtcagcatggatttcctttacagatcaaacacatttttttttttaacatttcacaatgatagtcacgtccgcagccccaaaccaaaagatacagaagtggcattcatccgtaagtgctgaaatgtgccactaggccgaggatttgcaagttgtaaaagttcattgtgctctttgatcattaaccagagatgtggccaagcattgcagattggcactgggcttgtggaagctggagactgcttcttgtcttatgtccacatcttgtccaaccattgtctagacgtgcggtgggagacattcagtcctcgtggttctaacgggaacaaatctaaaatgtcccgagggacaggagagctctacctttcatctcagagattgtagttagagccctcattcatccgggactccgtgcctcatcgtggacgccacaggctgcacatctgatggacttaccagcagttgcaacatttaagactcgtgcggctgtgtgtcagttcaaacaaagccggattacagatgcggaagaactgttccttacctgtggagcccgtgtccagatgtaatgcaaggacactgtagctgcatgtgcagaagaggtccccctgtgctgtgttatcctcatactgaaacaaagcatccttcactcccacagtcagatcatcttattgtggaaggagccaggcactcttgacatctgacgggcagatcatcttatttctgaccttcattcaggagtttgttgcacttttctagaaaccctcccccccccaaaaaaaaaaccagtttgtttgacctatttatgaatttctattttctcccgtttaagaa

SEQ ID NO: 25021 - DNA, 1216 bp, Mus musculus
ttccaggaacaactccttaagtgttcctgctgtatattgaactccgtgttaaaatgagaaatagaaatgaattgtagaataactatgccccgggctggatgggagggatttgttctacgtctagttcagagcaagacagaataggtatgtccacaatctaggaaattaaagccattggtagccccagagatatgacctgactgtgaatagtaactgtttgggatgccagtgttagaatcgagcagagtcatgttaagtcgttggttttgcccaaagatttggtccatagcatcccatccatcccccaccttccccagcaatgctacacccttcatccctgccccaccccactcccaccctaccccacaaagctatagcaggaatgtggattggccttaggcacatgctgcggcctgtgcctcctgtgctccatgacctgggtggcatttcccgtcctttggatggctgccattgctgttgcctgctatctggtttctttctgctaacttccatcctttcaaaaagccaaagagacctgtgagagtgtccagagagctctctttacccacttcaaatgcttctcgatgtttatgaaagaacccagcctcggaatgctgggcgtggcctctgctccatcttctctgctgctccctctttcccacaccctcctcctcccagcgactctacacttgttttgagactggaccacagcaagttcatttcccataaggcctgagccccagtgtacattgtcttaaccccacacctatcatcacgtagaggattcttgatatctgaatgttgcctaaatgacccctccccctgtataaagccatctctatccactcaactaaaagtagccagcgtctactttaactggtcgacttgaaaacatccaccccttgcagactaagtgcattttctctttctccttcaaatagaaggccggctctatcagagcagggaactcataaggctttatcccggagtcggaacagctgctctgggaatcctcatggaaggaatgtactcatatcatacactatgtaggggagaagctgataccaaaatctgcttctctgtttcttgactatgtcaataaagacagcagaagccgatcgttcagtgatggtaaagaggtgggatttcagggtcctaggagggagaggagggaaagagatagaggaagggctttttggtcaggctttggagagag

SEQ ID NO: 25022 - DNA, 1174 bp, Mus musculus
catcatgagcaaagtctaccctctgtgtgcacagctttgccctgtgtacccacctgccatgcaaggactcaggtggctgtgagcatccttgggtgggccgtgaatgctgcaagtgccgctgtagcagcttgctccttacttccagagtgatcattgaaaaggatttgtccagagtcatctctcgggtttaacatttcgattattgaatagtatctctttaaaaccaagaaaataaatgctaaacccacacagacttaaattaatacgattcttgaaagggaatgggaggaagattgtttcaccccacacacaccctgcagtgggcgtgggtgatgcaattttcggccgcagtgtgttggtttcctgtcagaatgagcgctcgagcttccgaggtactttttttgtgtgtgaccactcagatgttttccaatgagaaagtaacgaatttttttttcctcttcccacaggaataactcaacctgcacatgaacccagtcatgtgaactgttaggaaaaccggagcctacatggaattccctcttctaacccaactgacttctatccgtccgtggaaaattctgatccgggagagccgaccttgaccattggatgaaagaccctggcagagagatcttccccgaataaagcaatccaaatcagcatcactaaaccgatactgcatgaagcaacgattaaaaaagaaaatcacaaaaacagtaaaacttttaattttcaccaaaatgtctcctttttcaactctccctgcacgttcataaccaacaatgtaaactgtgatctcaagtaacccatcgacagctcatgcctttcatagtttattattaaagtctcaactggactacagtttcataggtgacaaattctctgtttacagtaaacggtaaccaccctataatgctatcagccgtctaggtccggtgtgtcagatttaccccagattagatgtgccaataaccaaccttattcagtaaaccacttgaatcttgtccttgtctaatctggttttgttctcctcaaccacaagcagtaacactctctgaccctctagaactatttaacgcttacaatcttgctttatgtctctcctttgttataacgtagcactggttttagcttacactgaggtaatttcttcctcctcacttgctctggtctc

SEQ ID NO: 25023 - DNA, 1358 bp, Mus musculus
attggctgtagtcagtgaacacctttgaccgctttgtggcaatttacagcgttgtgctggctggacctaagacagtgcgcactccggttaggtgattctcaaatttctcaaggcagttatgttcctacgttctgaccaaacagtttgctttttttatcttttggtttgtgtgtgcgtgtgcgtgtgcgtgtgtgtgttgtctagtattcatattcccagtaagctcccctacccttctttatggttttaatttgaaatctcctttgtctggtttaaaatgagtggcttctgtttcattcttaattcctcaactcttgccaagctggtgagtgcactgcacagagtcatggaataaattgatttcctagtcccagtatatgtgacttatgtcaaaacagcagttttaataactggatacaagacctttatatggatgcagaaaatgttggcacgcgctgacccagaacactgcagaagtacaaaaccaaatttggaaaaatggaatggttttagttttatatttggtttgtgatttttaaatctctctctctatatatatatatcattgtttctcactgttccttggacaaataatggttgctttgctgaagtgttccttcatccattacaatggcccctgtacccaccccaaatgctgcaggtcatgtatacctcaggatgagtgagaccaccaggatgctggtggtgttgggactcagtttccctttcattcagtgtggccatgctgtctgtgtgtgtccgtgcaatggaccagcatcgacaggagaagagtctgacacaaggttttcacagatacaaaaaacccctaggtcttgaaatcgtgactgatttcagaaatggttttgtatttaagatcaaaattaggacaagcagcagcaatgtttcttcaaatgcgtttttgtagtttacagatggtcaggcctcggggtctctgcatctctgcagcactcaatttcccttggagcagatgcttccttaaatacgtctgaaacccttcacgtgtgtaaatagtattgttggtcttatgtatttcgagaaaagggacagctgcattttttttctttcctttttattttttttatacagtggattaaagtacctttcattggcaacacatatcagacccctttaaccaatattaaagactatcagaccaaatgtttatgttttccaaatatgtcttatcactggttgcagttttcaatagaagctgattgccctgtcatagccataaatcggaattatgaactttgtttcagattgggtgtactaaaacgctcctttgactatttccttaaggatatattgaaatgcccacagagtttgaattatgttct

SEQ ID NO: 25024 - DNA, 1189 bp, Mus musculus
tacaaattgaaaaggaagaattcaaaatatcactatttgctgataaaatgatagtatttttaagtgaacccaaaaactccaccagagaactcctaaacctgataaacaacttcagcaaagtggctggatataaaattaactcaaacaaatcagttgccttcctctacacaaaggacaaacaggctgagaaagaaattagggaaaaaaacacccttcactatagtcacaaataatataaaataccttggtgtgactctaagcaagtgaaagatctgtatggcaagaacttcaagtctctgaagaaagaaatcgaagacgatctcagaaaatattttttaatgaataatagaaacagaattgccgaactaatccccaggaaatcaactttagtctttctagtgtcccatacctgagtgtgaaagtataacaaagtaaaaacagaattctaggcctttaggcccaggcttgggaatgtggcctttgtaaaggtatgctaatcataaaacagatagtgacattcctccacccacctggtatctttggtatcttccaacaatgtcctccccacttccttgagttgtggtttcttcctttaaatacccccttacccagctactcggcgcgccacggtcctctacccctgcgtggtgtatgaccgtgggcccgagagcgctcttgaatagaaatcctcttgcagtttgcaacaagaccatttcttgtgggtgattttggggtgtcgcctctcctgagtcagaacgtgggcgagtcctcacgttgtgggtctttcaagtgtatccccctttattttttttaatgtcttgaaagtatgttagcatagatattaatattaaaatacatgactgggtttgatgcatctgagaatcaagatacatcttctaacagatttagatctaaaaaaccctattcataggagagtatagtttaaaaattcacagaactttccacgcatgtcttatctttttatgcaaacattaggaagtgacttgtttctcctgagctacacccaccttcactgataaaagatgttttccttattgcacaacaatgtaaacagtgtgatgtaacagttgaattctcatgggtgctccttgacagtctaattgttggcttatgcaaaagacaacataattttgtcttttgcaacattatgaattatccttttctggat

SEQ ID NO: 25025 - DNA, 1292 bp, Mus musculus
cttcatgccaactctagaagagagcccatttcattcctgcgtagttggacccaacccaaccctagggagaccagtgtctcccaaacctccctccccaggatccattttggctcgcccgtcagtgatctgccataccactgtgactgcattgaaggatgggcctttctctctctgtcagccgattggtgtgggacagagtacagatgtaccgcaaatagcacccagcaactttacagacacctctctcgtgtacccagaggacacttgcaaatctggacccagtccaaaccctcagagtggtcttttcaacactcctccccctactccaccagacctcaaccaggattttagtggattccagcttctagtggatgttgcactcaaacgagcggcagagatggagcttcaggccaaactcacagcttaaccgttttttcaaacaaaacagttctccaaaatacggtcctgattgccgggggtgatggcaagagatgcattattttatatatttttctattaatatttgcacatgggattgctcagacgaagcttcctgttactaagatgtcttaagtggaatagagtcattccaagaactacaaactaaagctactgtagaaacaaagggttttcttttcgaatgtttcttggtagtttctcataatgtgagacggttcccagtatcatgtgatcttctcctccagactcctcttctttatgttccaagactgtgcaatactttagacgccctcgcacctctctcttcccatgtggaatgggacgcccacctacagtctaatgagtaaactttcagttttttgtttgtttgtttttttttagattcaagcaagtatgaatctagttgttggataccttttttcatgatgtaataaagtattttctttaaaagttattgcaatgaagagcattttcttgaaggaagcaatcagaacacagtaggaatataggaaatgggggcagggcagactgatttaggttgtgtgtgtgtgtgtgtgtgtgtgtgtgtcactgctttgaagagctgtggacggcaaaccactgtgaataatccgggtgggtgagatttcctcttgattggagggtgagtttgcccctcagtctttgcttacagatgaatggcagatagtagtgaggtatccgcatcaattcatgatgacatcagtagtgaggtcaccagcagtgagctgctgtgtatttcagaagggcccacgctgagtttatcttaaactctccaaggttgtaagtttgactgttgcggcatgtgcaagtat

SEQ ID NO: 25026 - DNA, 1144 bp, Mus musculus
gccgtccccctagcccagacgtttaaagagcatgtgagcatgacaagtgtctattcgcaacgtgttagatttcgaaactgccttgcaatccaatccggaactcagagctttagcccgggggaatagacatttgcccacggtgactatgtctgcctccccccacccccactgtcgctgttggcagaagagtccacgaggaggagggtgcgctgtgccgcgcccgcgtgtcaatggcagctgcgccttctggaagaagttgattcttgtctggaatacttttccttcggtgccccaccccttgaatcagaagctgctgcctccggcggctggagcagagacagtgaagtttggggcagctgtcaaaaacaaggatgggggtgtcttttcttctctggggtggacagaggagatgtccttaaacctctctccatcctttacaaactaaatgcactcttcgctagcccggggaggaaaggccccaaaagagaaaccagtgtggccgctgagagctgagggatggagatggtgctctcgccacgggcaggcaggcatgaccctgcttctgggttccgccagcgcgtagagggacgggtgatctcggcccccaggcccagggttgtggagctggaaggtgcgggggaggggcagaggagcgcggcggggcgggcgggggacggggcgggcggttgggggcggaggcaggacctcctgtaccttccctctgctctctcactctgacagcgccgaggtgcgccgagtggagcgggaaacaaaggagctgagtagggagggagggaattgggccagggagaacccccggctggctgccagaagatcccgactggaggaagcccaagtgtcacttgaattccaacccagaagccagcgcctgagaccggagcaccttgtttagcaatagtggttggaacactctcttgtaagttaccggagcactagtataggaggaggatcatcgactaccctcccgccactccacggctgctggctcctagaaaccccagcttcacctctcactgggactcgagttccagaatgaaaagcaagaagggtaaggtggcggcgggctgtgagcgcccggggcaccagtgcgggacatgtgcgggccgcgccggatcgggagaac

SEQ ID NO: 25027 - DNA, 1210 bp, Mus musculus
acaaggttaatacatggactgtaatggctataactgggacagagggtagcagctgcccacccagtctccagccactctgtcttaacataaccctatattttccatgtggctataatttttagagtgagcctattacattcttagcaagaaagaatgaacctgctctccagctccagcgccgtagccatcatgaatgacacagtaaccatccggaccaggaagttcatgaccaaccgtctgcttcagaggaaacagatggtcattgatgtccttcatcctgggaaggcaacagtaccaaagacagaaattcgggaaaagctggccaaaatgtacaaaaccacaccagatgtcatctttgtacttggattcagaacccacttcggtggtggcaagaccactggctttggcatgatctatgattctttagattatgcaaagaagaatgaggctaaacacagactcgcaagacatggtctttatgagaagaaaaagacctcctgaaaacagcgaaaggaacgcaagaatagaatgaagaaggtcaggggcaccgcgaaggccaatgttggtgctggcaaaaagccaaaggagtagatctgcggtaacttgatgttttgctgtgatgtgcagatttctgagaggacaaataaactaaaaagcttctaccaaaaaaaaaaaaaaaaaaaaaaaagaacctagcatggaataattgggacgttttgttttgtttttgagacagggtttctctgtgtagccctggctgtcctggaactcactctgtagaccaggctagcctcaaactcagaaatccatctgcctctgcctcccaagtgctgggattaaaggcttgtgcccccatgcccgactaattgctaccttttttgttcagtttatttgagacatggtctttctaagtagatctggctgtcctagaatgtgatacgcggaccaggctagccttgaactcacagaaatctctctgcttctccatcctgagtgctgggattaaagatgtgagcaaccatgctggttaattggtgtgcatgtatagtatatattttaaaataaagaatttcatataatgtatttagaacatattcaccctgtactctctcccttagctccttttagatccacccccaacttcttgccctcatttttgtttgttttgagacagggtttcattgtgtagctgtggctggcctggaactca

SEQ ID NO: 25028 - DNA, 1242 bp, Mus musculus
aaaacagcaatggccctgaaaagagtctttaattttccctccgaaatttcacaaaccagacctccatcttctgcagtgttctcaacattatctcccaagctcctacacaacatccgacagagctcttaacaacgaatggatcttcaagcccaaagttccaaagtccttccacagtcctccccaaaacagggtcaggttgtcacaagaataccccactatgctggtaccaatttctgtattagtcagggttctctagagtcacagaacttatggatagtctctagatagtaaaggaatttattgatgacttacaatcggcagcccaattcccaacaatggttcagtctcagctgtgaatggaagtccaaggatctagcagttactcagtctcacgcagcaagcaggcaaaggagcaagagcaagagctagactcccttcttccaatgtccttatattgtctccagcagaaggtgtagctcttagaccatagtgagacaggttagttttaccctactgatgatgtgttgttgccatggtaatcctgctcagtacgagaggaaccaaaggttcagacatttggtgtatgtgcttggctgaggagccaatggggcgaagctactatctgtgggattatgactgaacgcctctaagtcagaatcctgcccaggcggaacgatacggcagcgccgaaggagcctcggttggccccggatagccatccaaccgaggatgggaatatggaggcttgcgtgcagctggaaagaggaaacaggtcacattccaagcaggaagtttctagtaagtccttaaaggcaatgcaagccttctgaatggtcaaaacctaaacagagatagttatcacaaccaagctgtgatttggagcaagccgatgaaccatgtgaggtcagccaggagatccgaggcccaggcttctgtctcccatggtgtctgtcttagtcatggtttctattcctgcacaaaacatcatgactaagatgccaagagatgaagccaactgaagcactcatcaactgataagtgaattttaaaaaaaatgtagtttaggatgatagttcaggtgataaagtgctcaccccagaacccacataaaaaagttgtgtgtggtgagagcacatgtgatcttggagctggggcagagacgggcgcatctctgggacttctactgaccagtcagcctaagaagtaagctcagacaatggaagaaactgccttaagaatcaa

SEQ ID NO: 25029 - DNA, 1116 bp, Mus musculus
agggggaataaatttttgtaaaaaccgtaaatggagctgatgagatggctcaccaggtgaaggtgaattctgccaagcctcgtgacctcagtgtgagccccaggatggagaggcctggctcctggaaatcgttcttagtcctctctgagttctccatggcactgatgcgggcgagtgcatgcgcacgcacacactgtcaggaattctctagctgatgtcctacgatttgttttcgataggcacttaaatcagggtctctctttactgtgagtgttccagtccaggtatggcctggtggctcatccatcaacacgcaggaggaggaggcaggagagtaacagcacttgggttgacagtgctttctatagaatcattcaaaataagctgcaagccgtaagctgacctaaaaggtttaactcagatgatgagcttataagtcattttgaagcataccagaccacgggcaactgtatcatgattaaaaacgattagacaaatgttgatttgtcttgtaattgctgttgttgagacaacccttgatgaaccaatgtagaatcaatattcagcctgtgatagtatggtgttttgcctgtcaaactctgagagtttggggtgttgttgttgttgttgttgatttttaataaaaagcaatgaagaagatagcaagatggttccgcacagaaagatgtttttgtcttacgcttgtgggttttgatccccagaacccttgaagaagcagagaaccaactcctgaaagttgtcctcagacctccatacatgtgttatcctgaatattacatgtacatgtaataaaaacctttaaaataataagtgtgctagcatagcgatagccaaaccatgccaacctaagtgggttttctcctttgttccaatgtgcgccctcacagggaagaatcccactgatgcctacctggacgccatgatgaacgaggccccgggccccatcaatttcaccatgttcctcaccatgtttggggagaagctaaacggcactgaccccgaggacgtcatcagaaacgccttcgcttgctttgatgaggaagccacaggtaacgcgctgtgtgtgtgtgtcctcacttgagggtacatggagca

SEQ ID NO: 25030 - DNA, 1099 bp, Mus musculus
gaaaagacaaaattgaatttaaaaaaacccttagtttgggtcctggagccagtccgtgcttcctgccttcgatggctcctcctgtgaatctgcgcacacatcaaaactccctcactgcacacacacacacacacacccgtgtctcagctgccactgtagtgtagctgggctaaaaggagaatctttctgtaaagattttctttttaattatctgtgtatggggtggggtgtgtgtgagagagaggtatgaaatcccaaggagtggagttacaggtggttatgatatttccccacctaccctgagcagccatcttggtcctctgcaaaatcagtgaacattcttgactagctgtctctggccactaaactttgattgctttaagactcctttgcccacggaaccagtcccgcccttttctccttatctactaacgatcagcagtgagttttgtttttagatttttatggcttgtgctttttggttcagttttgttttttgtttgtttgtttttttgagacaaaacctcactctgtaaccaggctggcctgggacttaactgtgtacttagcctcgaacttgcggcaatcctcttgcctcgacctggagagacccacaccagatacaggtttttcaaccagcaattaagcaagtccaagggtagaactttgaaggaagcagtcattagaaagcaagaaaaacctgcagagcggtaaaggaatgtgagatggaatggtggtactcctctgagagagcttaccgaacaggggtggagttctattacggtcacttatttttttgttgttttaccagaaatagaaaattccccaggcacctgacttgtggtccctttgaactctgtggcgctaagcctgaaacaaagatgtttcctcctgtcactcagaaagaattcacagaacaagggctcttaactttgctatcaacacctataaggcaatacccgggggtttgtcgttgttggtggtttggtttggagacagggtctttatagccctggctgtccaggaagttaactctgcattccaggctggccttgaacttaaagagctcttcctgcctctgcctccagagtgcaaggat

SEQ ID NO: 25031 - DNA, 1144 bp, Mus musculus
caggtggcaggttgcaaggcacctgttgtattggcttgtgtggtaggtccagccttgtgctgatgagccacggcaaggatgtagggcagacagacagagccaaataaccacactaagtatctggttgtctgcacggggctttccagggctggtggaagtacacaggctgtgaagttgagtgtgggttctctgaccctccattccttatcctccaggcaccatccaggaggattacctgagggagctgctgaccaccatgggcgaccgcttcacagacgaggaggtggatgagctgtacagagaggcccccattgacaaaaaggggaacttcaactacattgagttcacacgcatcctgaagcacggcgcgaaagacaaagatgactgaagagctgcggcggcttccagcccattgctcccgttgccattggggtatttctgagattttctcctggagcccaatgcatgccctagctttactgctttttgcctttcttgttttatatttattctcagccattttgggccacatgtaccttataatactggaaatgggaccttctgtcattgtgatgagaaagtaagttcatttaacttacaggcagtcttgtcccttgtaataactgcagcccagaatcaatatattttttcagagaaagttatccactcaattttttctgatttataattaaactttctgataaaatgcttagttgtttagcgttatttgccacttgacttttagtttcacgtacgcctttctctctaagcaccgtgggccaagtgaatgacagtcctgtcagggtttggtccgactgcttccagttgtgttattaaagcaatcctggttttctctgctcctgttcatttctccctccagggaaatcagataaagcccgagttgggggccctagactttgtctttcttttggaagatagttcctgcagaattgtgaccctgcattagctctgccgccagctggacggacctgctttacctcgtccatgtaaacttcctgccaccgaaactagcagccgctgagcacactaagttttctgtgttctattttaaaggttctttggaatgcttttaacaaaaaggacagatttcgctgtgtttccagctgttggaaatatagtattt

SEQ ID NO: 25032 - DNA, 1217 bp, Mus musculus
tttactttattttcacactaagaaatagagagcaggaccagacacgcatggtggcacacactgttaatccagtgcttgggaagcaaaaactggttgctctccgtgactctgagttagaggccagccgggtctgcacatccagtgtcaggacggccacacgaggctatagaatagagacacctggtctcaaaaagaaaggggtgggctgggagtagtcactgctgcgctgggatgttactgtacgtggtaatattttcactagttaaggttactgctgttcactagccacacttagcttgaagactgactactgggacatgtcataattgtgctttgttgtgcttgtcaccctctgtgttactaaattgtcatagtttatacagccaaactctcacacatgtcccgtcatcctatgggtttggcagcttgctgagtcagatggcatccctgtggtgacatgttgttaccgttggaggactccagctgctgcaactgataaagcttggggagagtgtccagcactggtgttggtggggtccccacactggcatcttctatctcaggagcccaggacagacagtgcaagagctgagagagagtgcacagccatcttctgctgtggcccctctgcccctccgtccccgcacgggcttgctgctctgccctctcactgtccatttgaaggtgtgcattacagttaagagacagtttctccaaacctaacactccttcctagtctgagcacatctgcagatctgcacggctgccacctgcaaccccacttttaggtttatttttggtttttgttttatttttcagaagttcatattgatctcaccaactgtgtcatgctttgtcttgctttgttacaattttaagaatcctgccttcttatgtaagggatgtgacttagtggccaaatgcctgtgtaggatcctaagttcaattcccagtattaaaattttcctccacttctaggaaaattctgaacatatcaagtactatgctaagtatttaccgaagtttcaaatagttaatggctgtaagagatacagtgttccatttccttatttcacatttatgttccattacaacaggtttccaatgcacttgccctctagcaccaacctttctgtgccctgtctagaaaataagaatagtaaggtcagtgctgcaaagacagctgcatttcctgatgcacaccttctgtgcgttct

SEQ ID NO: 25033 - DNA, 1335 bp, Mus musculus
tctctttcagaaggccaaaaggtgacgtaccaaactgagcatttctgaagactatgataatcctggcaagaatttcctgttcctccaaatgggcctggaagccattgaagctattcaactttcagaatctcatggggcagcacaaatttcctggggtcattgcagtcgttgggcccgtcggtggctggcttgcaaatgtacacttttacccagtggtggtcatcccagccctgggacgtttcctgccctgaagacaacttcctgctcctcagcataatcatgaacatattagaactgtttcttaaaaacagccttttttattgcctttttctggacttatttaacaaacatgttttgtcttttgtgtaaggaaaattctagaactagatatttaactgtaaatatatgtggaaagttgaattctgcattaaaacagagaaagcacaggtgtctgggaatttaaatgttcagatacacaaaaacattggtgagaataggatagcctaaagattgtgtcctgtatgagttggtgataggacagcctaaagactgtatcctgtatataagtaagatatgcagcagcacttggctttaattctacatttgcattattttctaattttttacaactatttttaagagattaaagaaaacaagaattcaaagagtttgttagggatatgttatataaacatctaagctgtgcatttattcaaactaacatacgccgtgtgtgtctctgtaagtgcaagacttttgctctgtgaatttattttgtaaggaatacttttggtacaattttctgttccaggaaatgtgtgtttttaatccttcctgattatgcagcaaggttaataaacaacaatcatttctcctccccaaaaaaattagtggtttccttgattgaaatttaaagctctgtaaaagctgccttagtacaaagtactgaagtgactcgtcggtgtgggtggagctcagtgtctgcagtgttgaagacacaaattggcaataatagaattagttgcagctgtggaggagcacccctgtaactctaatatccttggatatatagcaagttcaaggccagcctaattatacgagaccctgtcttaaaaaaatctgaaagccgtgttggcaaaatggctcagtgattataagcactggctgctcttccagaggacctagtttcaattcccagcacccacatggcagccacactaactccagttccaggagatctgacatcttcacacaaacatatatgaaggcaaaacaccaatgcacataaaataaaataatctttaaaaagaaagagaaaaatctgaaaacaagttt

SEQ ID NO: 25034 - DNA, 1226 bp, Mus musculus
tggtgtaaaatatcatattattaaagtataatacctttttgtttgtttgatttaaaggcagggtctcttgcatattccaggctgaccttgaacttactgtgtagctgagaatggcttgaactcctgacctcctgcctacctctcgcaagtggtgggcgtacaggtgggtgccaccacatctggcttataatgtctttctaatgataaaacctccaagtgtaactgtggtaagatgatcttccctaatgttggaactaaactgttaaacagtgccatggcgtcagtatatgttctatgttctctcttctagagctgtaaagatgtgtcacctgttgaaaagacgatcaagttacttcccagtagccacgctgcttgcctgcagatctttagtgtagaggagcaaaaggcgatccagatcaaacatcaggatgaggttacttgggtagcaggtgatgtaatacgcaatctaatttttcaaatgtatgacgaaggagaaagagaaatcaatattacaccatccttggcagaaaaaattaaggtaagtattttaggcaaattgtttacttgtaaacaatttacttgtttaacttgtttatgttttgaaaattgaaattttgtagatagcctataaattgtttatcaaagaaaaatactgttattaggttggtgctaaataaattatggttttggattgtaaaaattaaatcctcataactagactcaaaacacatttttattactcaacatcagagccattacaatcaacacatttttgccaatgagaaatgagcttgtgtgttcttataaaatacaaattgaaaatcagtgaactcatagagagcatgcaaggaggcagcgtcagctgggtagtttcttctgaggacgctcactgggctccctttctgagtttcctttccacttgtgcttcacatgctgagtagccattgagaatggagtaacattagagcatccatccgtccatctgtcggcttctacgcttgctctcaagtggtcagtgccaacttttgatggctccattgtgctccatgtcttccagaccgttttcctagcaaaactttttgagccagagctgcacaaatatgttcattagttccctggccagatggactgatagtttttcaagttttctctgctgcttgatgacttattttgatcttgaataagaaaatcactcgggccaggtgtgatggcctttaataccagca

SEQ ID NO: 25035 - DNA, 1214 bp, Mus musculus
acaccagtgatatgagtgagcctattgaatttcacacttttcatgctttaagtattgattggaattttcttatctttttatttcatagctttttgatgaaacacaaggaaaacctgctgtcgcagtggtagataatggaagaggaatgacctctaagcagcttaacaactgggctgtgtataggctgtcaaaatttacaagacaaggtgactttgaaaggttagaaaatctttcttttcctccttaatggtacttgtatattttaataagggtaagaactctagtgtgctctaggatatagatgatttattagagggcttgattttatcagcatgtttgttttattacagggtgttgtaatacatactccaaaatagaacatgtgcttttccactgaacaatatttttgcatttcctgaggtctgtgcgagttatgttaacattgaatattgagttggacagtacaatggtacttaggataatcttcataaaccatctcatattacttgaaaatgcctagaaccgcataagattcattaggattctgtatttctatttccagcctcagttctttagactatcacagctgttagggggtagaatccagctttgtatcagcacacacgccgtggacagggcttacccactgcccaggggagctgggcgtggggactccttcctgtagtccgtgtcagcacgcccagatgagcatcagatgagcaaaggctttccctgattgtccatgtttttgtggtgttggcagtagaactcaggcaagtgatgctgctgagccgcccctcagtccttgtagtgctgtctgacagacagagtagtgaatgaagaacaaggaccccgctaccattcacctggtttggatttcctgactctgttgcttgtgggacacttgtcacacttctgtacttaggaaatggggagatagtctatcaaggttttgtgaaaactgagctaggaaacatgtaacatcttgagctagtgcctgtcatgcagtaatcttagttatttcttacttctgatgcagcacttctccataaccatccttactcctgttttcatgaatgagtgatacttaaaagagtggttaagaatccagcatgaagctcagcatggtggcatacgccgcctttactcccagcactcaatcagaggcagggggttctcttggggcatagcctgatctacgtgcagagcaagtt

SEQ ID NO: 25036 - DNA, 1215 bp, Mus musculus
ccaccactacccagcatattatttctttttaactaaagaaataaacaggagaaatagttgagtggttgctctgtagggtggagagtggggcatgtggccttggcctcagccttagcctctggggccttgtggggactcagccctttgcggtgctgccacaggcgcagcttctacttcgagctgctccctccagggtccatcttgccagagactatgtggcacaggtgtctgcgggccccgaaggcaggcaccgccactggggaattgtggcagtcatcagcgctgtggtggatgtccagtttgatgaaggattaccacccatcgtaaatgccctggaagttcatggcagggacagcagactggttttggaagtggcccagcatttaggggagagcatggacagaattgttgctatggatggcactgaaggcttggttagaggccagaaattactggattcagaggtaccaatcaaaattcctgttgttcctgagaccttgggcagaatcatgaatgccattggagaacttattgatgagagaggtcctatcaaaaccaaacaattcgctcctattcatgctgaggctcctgagatcatagagatgagtgctgaacaggagattctggtgactgggagaaaggttgtggatctgctggccccatatgccaagggtgggaaaatcagactcttcggaggtgctgcggttggaaagacagatcatggagttaatcaataatatcgctaaagcccatggtggttgctctgtatttgctggtgttggcgagaggacctgtgaggacagtgattttttttttgttttgtttgttttttgtttttcgagacaagatttctctgtgcagccctggctgtcctggaactcactctgtagaccaggctggcccggaactcagaaatccacctgcctctgcctcccaagtgctgggattacaggtgtgagccaccactggagggcaatgatttataccatgaaatgattgaatctggtgttatcaacctaaaagataccacttccaaggtagtgttggtatataggcagatgaacgaaccaccgggtgcttgagcctgggtagctctgactggtctgaccgttgctgaatacttcagagaccaagagggccaagatgtcctgctgtttattgacaacatcatccactttacccaggctggcgcagaggtatctgccttattgggta

SEQ ID NO: 25037 - DNA, 1177 bp, Mus musculus
tgcgtaagtaacctgctcccgcacgttttgaaagttgttagtctcctttggtcacatacgccgctgttctttcacattcctttcgttccactttattataaggcatgggaacctgtttccatttattttcttagtttctttgaatgtattcgactgaaattgggacttttctttgtttaaaaatttctttttaatttattcatgtatgtgtgtttgtacttgagtggatggatggaggccaggtgagtggtttcccagggcggccagaagagagtgtcagtccttttggagctggaataggagttgtcatcccgtggtatggatggtgggagggctggaaaccaaactcaggtccttgtcaagagcagcgattgctcttgactgctgagcagtctctccagccccagtctttttatttgaatagagtgtgatgtgtgtgcagacatctccgccccagagtacatatgtaagtcagaagacaacccctgacttctaccaagtttaaatcgggatgtctttctttgttggctgctgggctaacaatgataagtttccacagactctcttgcctgtgcctgtaagagcacagagaccgcaggtgtgtgcagtcctgcacactggacttcagagaccgcaggtgtgtgcggtcctgcacactggacttcatgttgcttctggggacaggtgtgtgcggtcctgctcactggacttcatgttgcttctggggacaggtgtgtgcggtcctgctcactggacttcagtgaccgcaggtgtgtgcggttctgcacactggacttcatgttgcttctggggacccagagttacgaggattgcatagcacatgttttacccattgagcccagaagccaaatagccacccactagtagaattaggtgtgcttagtacaccgagggatcctatagttagatgtctttctatgtcttcaaaacttgtctctcttgttttattcttcctgttggctataaaatgtcttccagttaagaaaatgccttttactttccacttattttttatttgcatattctggactaagcccagaaccttgcacatatagggttagcattctacttcagagtgataaccagtccatactttgtaaatttatttaaagagctaaattgtgagagtaagtttgtgtacctgttgccatgtctt

SEQ ID NO: 25038 - DNA, 1185 bp, Mus musculus
accattcagagtacacttgttacttttttgtagcaagaacacagcatttactcaacatttttcaaatatgcaagccattattattattattatttttaattttttgtatatgagcatactgtacagatggttgtgagccaccatatggttgctgggaattgaactcaggacctctggaaaagcactcagtgctcttaaccgctgagccatctctccagccccttattttttaacctatgggatttattatgattgtatttattatgagtgtatatatacattacacacatacacgtttatgcacatgctgctgctgtgtatggacatagaggacaactttaaggagttggttctcgtcttgccctatgtgggtcctgggttttgttttgtttaaacacatgctgactaactctggcttctctcgcttctcctgaattactctgcttggccttaaacaaactggcaatctgttctaatcttctggcggcttctcattctctggctcattctgtgtctagcttgttctgtcggtgcaacctgtctctctataactctccctattttaaaaaactgcctcctcctttcttaccccccccccccccatgtagcttccctttcctctcttttcttgagagttgggcatctctctgatttattctgtcacatttttctctgattcagcacttttttgctcacttgtctgccactcaattagatgtcactttcaaacatgggtgcttccttctataaactaattttaccttccttgtttgggattaatgttaagggctgagccacatcataactagaagcataatcttgggattcacattgtgatcaaatatcctgcaataataggcccaagctataatatttgggaggtcaggtctatgaaacacatttttaatttgcaattattttattggaatttaatcccttataaaagaatatttgtatagtcttagttgagtaaaaactaatttagataacaaaggtattagcattcctatctatagatatgtgggtaagtatattgacagttgaaaggcagaagccatctatgaagttagtcataaactggactaagtacgctaatccattattctagaaaaatccttaaaagaaaaccttaaaaacaatagttttatgggtgtattgtatgaaataattagatacatctaatat

SEQ ID NO: 25039 - DNA, 1176 bp, Mus musculus
atcatatcaaatttgaaataaacaagtctgatgtcatttccccattagatggatagcggggtcttcaaagtcagtagacgcagtgaccttgcaggaaaataccagattagtcgtcacgcagccactgaccagcttatgctgctactcaaagctcttggttgactcagatgtatgtgaatataaaactgtctgtgttctctagaaagtgaggctagagcttgagaaaaatggaagagttcgttgcttgggcctggatgtgtgggttcatgtgtggtatggatctcttttcttgaagagagattttcctcagacttactaggaagaattgttggtgtttaagaagtagaaggaccgttggggctgttgtaagtgctgagagcatatgaagtgatccagtttgctgccttacctctttagaggggggaacgtgggccaggaaacttaaaaagtgcacaggcactagcgtttatgcattgttaatgtttggtgtatatttgaaatgctaagttaaaatgttatttttactttttcttccaggaaagtcatcaaaggaaaaaaaggaaatcggaagttacaggaacaaaggaccaggctgacctgttggctcttggcacggcagttggtagcattttattgtatagtacagtaagaggagagttgcacagtaaattaacagtaagtatatttatgtatttatgtaaaagatgcgacagaaactaattattagagactattaaaaatgctccaagatattgacgagctctatgtagaaagctttccattccattccatgaaaactgcatgatatttgtaaaagtaggtaattcctacttgtgagttagagtacagagaactttggctgaagtcaaaaggtatcagaaggacttgcaagtcggcacaggtagcagcttcaggaagaccattgagcttcttagagggaacaggggcggcacttggagttgctgctgagactgagaccaaatgagttgactttgctaacactgaggaccagtggctccatgggattgggtgcacatttctggagagtgccactgcttcctgatgtctccgaagggagagaggacacttcaggaagattgcaagttggcttcagtttgtcttatcaccggtgaagaatccaactgttggaatggtgcacacgaggatggaagaaat

SEQ ID NO: 25040 - DNA, 1101 bp, Mus musculus
acaagagatcttttcagaaataatataataaagttatcagctgctgagtcatttgcttaaataataaaattaggactggagagttgactcagagattgagagtgcgtgctgtccttccagaggacttcggttcagtgccgcaccatgttgtggttctaggggatctgatacctttcctggcctctttgtgcgcccagtatacaaccagacatgttggcaaagcccctatacacccaacatgattttaaaaataaatgatagaattcataacattttcaaatctaatttttttttttgcattaactaattcagtcgtttatatacattttcaaatgagaaaaacaagtggaatttgaatttaaaaaccttcattatacagtaattatagttgtgtattttagtgtgtaacctaccttttgtagagatttgctataaggatttttaaataagttgtgctcaggggtgttgaagctgtggtgctgtgatgatgccttaaaattgtggtttcgactcactgagagtaacgtgaggacctacagttccttggctgtgtctgagcaccagagcacccctttagaaatggtaaaatcaggtcatgaggcagaagcaagtggatttctgagttcacggccagcctggtctacagagtgagttccaggacagccaggactacatggagaaaccctctcttgtaaaacaacaaaaaaaaaaaaaaccaaatcaagtctcaaatggtggttcatgcctctaatcccatgcttaagaggctgaggcaaacctgggctgcatagttctaggacagcagagcaacatagcttacccagcaagatcttgtcctgttttatttatttatttatttatttatttatttatttatttatttatttattttaaagacaggggtggggaggagagaagcagaacaaagatgagaggagagaataaaaccaggcaaggctgattgagaaggagagaagctagtggtgggtagggataggagaggcatctaaattgtgttttaatgctcaagtgtctttcttttgagaagggaaaggcatacagtgcaagtagagttttgttagggtgagttttaactgtttc

SEQ ID NO: 25041 - DNA, 1157 bp, Mus musculus
gtgtaaagtgtataagtgtacagattgagcctggggagatagtgtagattataagtgcttgcagtgcaaacaaggcctgagtttggtcttcagctaccactttagagagttgtggtggctgccacacagtagtggtgcaagcctttaatcctagcactttggaggaacagacaggtatgtatggtctacaaagcaggttccaggacagccaaggctcagtagcgaaaccctgtctaaaaacaaaaacaaaaccccataaacaaataaatacatacatataagtgaattcaaacttacaaaaacgttaggcatgacacaattgtgcttgtgtcgatgtgaacgcacacacatttagacacgctaaaaaaatctttgtgtctggaacaatggtggttcagcagttaggaattcctgctgcttttacagagccaccaggttcatagctccaggtgcagggaatctgctccctctcccttctggcttgtgtgctgtgggcagcaggccacgactgcctagtggctcggcaaatctgttctcttacctaatggctgcttctgttatctaggcaggtccggtcagagaacaaggagaagagtgcagtgatgtcttttacagtcacagacgagcctgtctatgttgacttgactttgtcagaaaacaaagaagaggtaagtggtttggtgtgagaattcattttagaagtgcgcaaattgttagctgtgtaggatctccagaacccatgttggagccgtgcaggtgtgcttgctgctagtaagcctagcaattgggaagtaaagattcatcagagatcatgtcctaataaatgaatcggaaagcaattgaggaagctacctaacagctttggcaccacatctgtgcacatgcatgcacaccacacacagtttttctctttagttactgaactttttggtgtgtatgtatgtctgtgtgtctgtgcaggcacacatgcccatgtacacatgggaaccacccgagaacatcgggtatcctgctctgccattcttgcttaatctttagaagtagagtttgttctcactaagctggagctagggtgatggtgagcaatcactggcatcctcctgcctcctcccttccccttcccagtcccggggtcacaggtgtgcatgccatcctgt

SEQ ID NO: 25042 - DNA, 1101 bp, Mus musculus
actaagatttatttaatcaagctttacagtgaggatcagaagtctagcccagccactggtgggtcagcttttattgaccatgggtgggtggggggtcagcatttgaataatataaggataatatctatgtagtgtatagtaacattatgctcacatggaacttttctgggacgtaagtagtttgcatgtggctcctgttccctcctagagcaccagcctggacatgctgattcctctcagagcaggcctgttagtaagcagagctgtcctcaacttgcttgtagaacaaacttgtttagggtaggactcagttgttttatgtgtggatttttatttataagaatgttggaccttgaccctttttctgtaaatgaacgttcaggtggcccataaacaaggaagagcatgctgcaccagggccttcaacctgtgcctgtgctcagctgcatgggtctcagtggtgactggctgactggtgacatactctatgaaaacagcattattgatgtttgctttgtttgacaatctttttttcttccatctccttttgaaaaaccatgtccaggctttgaactccaaagatactcatatatgtttggaaagagatatttcaaattgctgggctccaacagtagaaactgctataaccaaggtgagcacatgataggttttatgtttaaaatgacagatttggttaaattaataaatgtatggtgaattctatgagcgctgccgtgtgagattgagttgatgaatttgtttctctcctgtcctctgagatagcttgtttatttggtctggattaaaactcgtgattcttcagcctcagtggtggggtttcaggtgtgtgcatgaccacaccatacctggctctcgttttattctctgctgttctctcgcttctcacttagaagtgtggactgcgtgtagacacagcactgtaaagctccacgctgtgctgttgatgtggtgcatgatggtctgggcagggaactccaggattgagtgcgaatagcagattccagcattgcttatcccaacttgatagagcacagctttggttagcaaaatgtttacaggaaaaatcaaccacagtggcac

SEQ ID NO: 25043 - DNA, 2009 bp, Mus musculus
attcctttctttgctatttccaccaggataattgggacgaagatgaagacaaagacagtgaaaaagatgagggcgttgatgaagacaatgaggaggaagatgaggacatggaagacaaagaagagaatgaggaggacagagaagtgtcaagtgaaaaagaattaaatggagattcggatttagatcctgaaaacgagagtgaagaagaatgaagacagatgcagccagccagtcacacgagaggcctggcttgccttgcccagtgctgcctatagcatcctcccagggaggcttgccctgtgccagaaaacaagaggccaccatatgcttccaagttgacaggcaattcccacacttccttcctgtcctgagtgccccagactttaactgtgtaaataagagtgtttcattcaaatgttaataaactttacacagtaaatagacacactttctgcaatgtactgacatgagtgtccaatatatggtatatttttctaatataatactctggtatgattggttctgttggaaactgatttaggtgaatacagacataccataggggtaaggaactgaatgctgtaaaggagtcggttctcatctcaggttggtatctttcatccagtccaaaatgcaagcggcactaatgaattgttcttaatccggcacgtctaatttgacacgttttcatgaaggaataactaagttaaagtgaaaatggttgtgatttacagaaataaaatcccagtgtccactcaatgctggtctgactcagatccagttgggtggttggagtgcttccccaaataaccacttattttttaaagcgtcatgtgagatatttttttaaacaaaacaaaataatggtaattaaagaagcaaagcttcagccatactaaggggtttcttgtctgcagagtgtagagactcatcagtgtacagatgagacctgctcatcgtgcgactgtaacccttcagtcctagctgcttttgaagaggtttccatttttatttaaattgctaatggatcagagaacaattgtttattttttctctttggttttagatattaataataacattactggaatttttttccaaagaaactatttttataattcaataatttaacgttttcgttccttttcattgcccactcttggcagggctagggtatctgtttatctttcaaaatgataaatctgactcaagattttttatgtatgtataaataagtattttggtgtgctacacagctttttcaaattaccagtaatttgtcttgtttctaaggagtgggccagtactaacttaacttggtgttcagcaagggatgcagacggagagctcccttctgcaggactaagcagatgcgtgtctttcccacccgtgactgtaagaatgctctctgggaggacttccaccggggcagagcaggctgcccagccgaagcgggaagggcatgttgggcaagctgctggagcgactgatgtacagttgttatttgtctataaatggagctgtttatggcaatttaataccattctctttgtaaagtgaataaatactcatctttacccagcgcgtgtctcgtggtgtatatagagtgcacaggtgtgtgtttgggcttaggcctatggtgtgaagggttttaaggtggtttcacgcctagaattcacagggaaatactttgaaggcttgctgtgttatcaagttcgcaacagtagagcaataggcatcttgttttaaatctcactccagtgacaggtggttattttattttttttttagtctctgctggttgggttgcaactttatatgtcaaggttctaggcaaacaggaagcatttatgtctaattaggtatgaggagacaacaaaggaagtttttggtttagaaatgtctgataagatccacactgtctgtctgtctgtctgtttctatctatctatctatctatctatctatctatctatctatctatctatctatcttatctaatctatctg

SEQ ID NO: 25044 - DNA, 1099 bp, Mus musculus
agtggcgcagtgtgtgtgctgtgcttgcttcccaccgggcgcctgcgctctgctagtgaagacttccggtgggagcagggagcgccgttttgcacaactctttctttgtacaaagtagttctgccaacttccatacatttcacgaaagttgttttttttcagactactttaatttctttttatttttttgtaattaaggcatcactacatcattttcctcttttcctctcctctctctccaacccctcccatgttccctatccccgttccctttcaaatgcatggcctcactttctttgttattacatatttatattactgaatatataaattcaacctgctaagtctgtatgatgtaccttgtatgtatatgatttcagagtggaccacttggtattagataaccagttgtggggctcttctctggggaagacgtatttctcctgatgttagcatttcttagtagcctgttcaggctggggtcccctcttttgtgttagcctgcctattgctgttgtctttattcaggtcttgttcaggcgtcatgttcatgagacttcatgggtgtagtgtcttgatgtttctaggagacaccgctcccagcaaacttgctgttcctctggctcttagtctttctatcccctcttatgctatgatctctcagtgtaggtcaggaagctgagttggagatatatcagctggggctaggcaaccatgcatctttcccccacatttttatcaactgtgggttttttttttttttttttggtgttgttgttttttttaaataatggtctctgttgcaaagagacatttctttgcagagaggagagacctacttacttgtgggtatacagataacaatttagaatgtagctaagaattattctgcttttagttgagtggtgatagtaggttctccaagatccttggattccttgttcctgggtatctggctaggtttccagtaccaggcacggttttcctcttgttgaaccgctggttactactaaggtgtgcttacaacgatagtactcttaggaatatcatatagttcatttgattcataccacagtggtcattgtagttcgtctttatc

SEQ ID NO: 25045 - DNA, 1109 bp, Mus musculus
tagagttcttgagatcttctggatggtagctgttcattcgatactcagtaccaataggacagggcccaggagccagccttctggatttgaacatatcttgagatagtatttcctagaggctagataccagagagtgggcattttaggggtagtcttgaattaagcaagttggggtagtcaggacctgccgtaagttggacattccttacctgacatgactggggtcagaagcgttttgaattaggccagtttgagattttggaatatttgcacaatctactgtttgaccatctctagccagaagctctgaaacctgaaaacctgaaacccgaaaatctgaagcattgagagattgtatctggacggctacaagggatggcatattctaatctgaatgtgaattcgaacatctgtgctaaggttgttcaggcttcagaacgccgtacatctggattgtcctgttcaggctactcagcctatagcggtctcatctggaattacattcctgcgcgtcctgcgcggaatctgggtgaatacagagctctgtgcttcaggtgactagggactggcccactggccacagctgaccaccccttggtctcacatgctcttcccgagttgtctgtatccactctcgtgctgtagcaccaacatgacgtgacaggaggctgagctcgctcggctctggttcttcacggaccactccatgtcggagtggagtgtgtacctggctgtcttagtggaactgattctttcctaggaacaaggtttgtgctgttcccatggcagtgattttcctcagggaaccttcttgtttgctttgaataccttggcctgagtgaggaccacagccgtgacaaatacacaatgagatatccaaccaaccagacaagttagaacacgtgaagtgagttttaaaaactaatgtgcttttttttgagtttctcttccctttgtgttctctcctctttacctccccttcccatacctcccacccaccacttgaacaggtttgaaatcttcagccacatctgcagcaaataacagtcaccatgaaggagcgctccaccttggagaaagggtgctggtcgtaggccagcgagtaggca

SEQ ID NO: 25046 - DNA, 1168 bp, Mus musculus
cctcccttcaaggaacaataaatatcctgcccgttgtttagcaaacagtttaaaagatagggacagatagatgttggttctgtttattgaacttgatgtacatcaaggagacagtacaacacagtggttaataataaaagccttgaagccagacagccctggggctaaacccaagccctgctaactatgctttctcttgagcaaggtttgtggtttgctcagttttctcaaccttggtttcctctatcaagtttgcctaccttgttgggtggctgtaaggatcagaggggctgattgtgcacattgtactctgaggaccatgcaggaaactcatcgctgtctctgcatcttcatggcagagacacagtacccagtcatggtgtgtttcaaaatggaggtggcaggaactagaaggagcatcccggaaaggctttatgggaactggcctttggaccccttaaagggtaagaggatttaccttagacagggaaaatgaaaagggtcattctagaaggggtatggagtgggtgggggagggagcacagcacaagaggggagacggggaaatgtagtgtgtcaggaatggcaagacagccattttgctgtaaacaaaaagcacacgttatgatctgcttaatgtattcatcttgacttggaaatttccataaagatatcttgccatgcctctctgtatatgaaagtgactcaattatcctaatgccttgctggtctgaattggaaggcagttatgtgaaatcttgatggtggtaaaatttgttttctggaattctcagccacttctaactggttttccatttcactgaggtctctcatcctactccagacctcaggcacccaggacctctatatatgcaaaaaggattattcatttttcttacattatagctcatattttgattaaagataaattagggcacatgagaaaatctagctcccatgaactgcctacccccaccatttgatccagcctcccatactctttcaaaaaatatagccttagaaagtgaatttgcactacattggggtagtttttgatatgacttcattttggggcacagaatttcaggataagtaaaaggagagctgttggtagaatttcaggcatccgctggcatagatgggattcttttggctgacaatggtgctg

SEQ ID NO: 25047 - DNA, 1416 bp, Mus musculus
agaggcttcggtccttctaccaaggagagaaaaacttccactttactgggcagagtacagttccaccttgcaagtctgagctcagagtccttgtggtcaagctactgtccatagtgtactgggccttgttctgctctgcaatgtgcctgctcatatatctgtacagccctgttcggtggtattttataatcagcattgtgttcttcgtgctgcaggagagaatatttggtggactggaaatcattgaacttgcatgttaccgttttttacacaagcacccacatttaaattcaaagaaaaatgagtaagatggcggcgttcatgtgaaaacctagggttgtcacgggaatgtcagtctttgtaaactgagacgagttttgcatgactatgtcaaatgtttcttactatcatcattttttgttaaaggtattttgcacttaattttatgggggaaatattgctatggtttctttaaaatctctgaatgtaattccaatgctgagtatgtagcaggggtcaatcgctgtgaattactagggtcagagtattacaaacaatcactaagctgtcaagacaaaatgcaagcttttctgaaaggaccaacctgtttctgacagacttttggctcagaggtagccttggcaccatgaacaccagccccagtgtatctaagcaggtagtagtctgcctcccccgcaggacacagtccattctttaattcttttacaccaatcaaacgcaaaggtggacttgccttgtcctaagctgagccccattggcagggagccctccatcactgatagtctcttgtgctgagtgaggcaggaaaagaccccctttcctcgcctggaaatcacatctgcactcagctcagggagcaccgtcaggctctccatttggcttttaaaagacagaaactggtgcagcttgcttttcactcacactcagtcctgccttcctgatggtcaccagggagcgtcatctgtagcgtggactggttcatgtaaagatgcattagaaaaacatctgtagttcagacagaaactggaaggcaggtgtctgtcctatgcatgcagggtgtctgccttctgccattagagctacaacaaacatgcctgcagacaggatggtgtagctaaagcccccaaaccttgataactttactcttaaaacaaaaactgctaactcagaatgagctctttcagtgatagcaaggacacactctctctttttagtcatctctcaacagtgacatttaaacacacactgacctactgtctgccaaatattcctatcatttggaagcagtgacaacatagcaaaccaatagcgagcacgcagtgtcctgggtaagagaatccttgtggccactgtttccactccactgagctgcatgctcccatctgtgtcatgtga

SEQ ID NO: 25048 - DNA, 1143 bp, Mus musculus
cttggcaggtttatggagtaagtgccaggtttatagtgtatgtgcactgggtcaaatcaaagcagatgagaagactactgctctgcaaatgtcaggactgggtaggaggttatagcctttgtgagtagttggtgttggtctaatggacttacttttgagcatattttatacctggcagtaccaaagctttgcttacttaaagtagtatacatttcggtgacttaagtagatgcttttagtattctgtacttgtttttaaatcggctgctttcaaacttttttgtagattttttttaagaattcaacaataagatatgtctgttatcataatcactgttaataaatgttcatctttttagtgtcaacgtaatttgaaaatattttaaatcttaaacagcttaaatgacttttttattttattttattttttctgttttctttaagccataaagatgagtttaccattattcctgtactggttggagctctgagtgagtcaaaagaacaggaattcggaaaactcttcagtaaatatctagcggatcctagtaatctctttgtggtttcttctgatttctgccactggggtaagttctagttttaatatatgctagatgttatatatttgtggttaaagatttcttttcattccaagctctgattctcaattctttatcactctttggaaagttgtatttgtagtagccctgtttaaaagtgcataaaggagccctttggtcatttaaaaaggatcagcagaggatataggcacatttccaaaggcgactggtacaattggattcacactgtgagggcatccctgcttttgaacacttttgttagtgggagttaaagcctgttaaccccatatttgtgtgcatatgtatggtaggttctttgaggtcaggtttgatagatagaacaaattcttcacaatgtagaagaatagtgtgtgctataccagtccttttctgattttcatttttgtaattagtgtcttttatttcttttggtgagctttttttttttttttcccacaattgcaatcaatttttttagttattctctagtattagaacatataggctaaaagtaaggacttttaagtgggttgtgattattataaactaagaggaaggatat

SEQ ID NO: 25049 - DNA, 1184 bp, Mus musculus
ggtttttttgaagctcctctttttggctgctaggcctcttactgcatgactggtaggcatgtccttggagtcatgtgttgtggttgtctcccatgtgtcttccacccctcccccatttccaggatcttattacgaaatcctggccagctagaactcactatgtaacccaggttggcttcaaatttggagtagtccttgcctcaagggtccaacattctgggataatattggacaccagtcctggctttgaagtctatttatgtcaagttgataagggcctcattttaactccattagctcttgaaaaaagttatctccaaattggcctgcagtcagatgtgggaagctggaactttagtatatggattttgatgagaatatagttaagctcttacgttcacagaatgtagtaaaagtaggccatcagcgtggaaaaacaagtacaatttaaagttacttttcctttttttatttaataagatttgtgtagaagtacatttgttctgtgtttctgttgtgtatctcccagccggagaattttcatccttgggccttcccatcatgtgcccctgtctcgatgtgcactctccagtgtggatatatataggactcctctgtatgatcttcgtattgaccaaaagagtaagtatatagaaatcatagctcttaaatagctaaagctcacttaataaagattgcaatttaatttaagatattttaaaagatacaaatataataatatctaaactaaaagttttggtaactaatctgtatacgccagacacaaaagtggtattttcctcataattacaaaaaatatgttaaaggcacttagctccataccatagtggttacatttatatttagagaaatactttgcttgtgctataccatgaagcaagaaattagtatacatgccaacctgatgaaagacttggcaagttaactctatttttatgtgtatcacttttttcactttaaatgatggcaataatactttcatttcctctcattgtttttttatggggaagttattctatattttctgaagctctgaaaagtaatatagaagttttaaatacattttgtttttaacacgtgttattttttgtgtatatgtatgtatgtatgcatgtgtgtgggcttacaggtctgtagtcatatacgtgtgtgtaaaggtgcat

SEQ ID NO: 25050 - DNA, 1168 bp, Mus musculus
gttttgttcatttaataatacatgaatttgaccctccctctttatggtactgatgatacatgtgatacaaatgtgggttgcagtgctaacaagatagagaaagaggggctggaaagatgactcagtggttaagagcactggctgttaaccttaagtggtcctgagttcaattcccagcacccacttggtgtctcacaacataacggaatcctgtaccctcttgtggtgtgccagcatacatgtgggcacaacactcaaatacataaagtatgtaggtaaatctttcttaaaaaggtggagaagacagaggacagaagaagagcttatgtctgactcacactggcccaaggataaaatagcttcctgtgtgatttcttccaatttgaggactctgagaataatttaatcaaaaacttccttttatcctgaatcctttctcaactttgaagtgaaactgacatgtctttcaaaaaaaaagattaattttcttagcttagtaatagattttggttgtttgtttcattcattcattcattcattcattcattcattcattcattcattcctgcctgcctgcctgcctgcctgcctgcctgcactatgcagaccagggctgcctttgctttgtctcctgtgagctacaattaaagatgtgtttcattacatctgactttttttttttttttgctttgttttttgttttttgtttttttgtttttgttttttaataaagagatagtgtctgagctttgtagaacaagttggctttgaaatctcaatcatcatagatccttctgggtcaccctgagtgttaggatataggtgaatgctgtcatacttggtatagtaatagaattctgtcagagtatattgccacagcacacactccttgccctgcaagtctccgacagtgaaagaaccaggtcccttttcttggtacacaagcccactgccaattttcttctttctcacagttacccccttggaacatttaacttatttatgtttgtatgtggtatggtaagattattttatttgaattttagaaaacaaaaaaaatgcatggtttcataatttaggttgtagagcaagtttggacgtttgctatgaaataataggaagctaattttgctttggtgttgaaacaaagggattatggaagttgtaa

SEQ ID NO: 25051 - DNA, 1219 bp, Mus musculus
cgtgcacgctgagcctcctcggcgggcccggccgcggcgctgggcatgctcagtgggccggccccggtagagcggcgagtaaggacgcgtgggctccccaggctctgcctttcccgggttcaggccccggccccgggctgtgtgtgtgtgtgttgggggggaggtggcaccgatcgccgccgccctccggctcgcggcctcccgacccgggatggcgcggggccggtcccgcttccgccgttgagcgcgcggcacggcgggcggaggcgcggggcggggcggggccggcgggcgcgcggcgggagggaggcctcggtggtgggggcggggcggggcggggcggtggggaagggcgcggagtcacgggggtggggtcagcgggaggctcggcaggccgcgcgcggcgtggccggggggcggctcgcggaagcagctcgggcaggggtaggggcggcggcggcggcggcgactccgcggccgcgcggctagggtaaagccgccgtgggccccatcttccggcggccggcggagtttgtggtgattgttgccgccctccgccctggctgccatctcctcctcttcctcctcctcctcctcctcctcctgggccgggctggtcccctccccgcggccgcctcctcctgggctgggcccgcggcgtctcgtcccctcgcggagccgccgccgccgccgcctcctcattcatcctcgtgcaccataggcggcacaggcaccaagatgtccaaccgagtggtctgccgggaagccagccacgccgggagctggtacaccgcctcaggtaagggcgccaggccgccggggtggtcgagctgggcagccggggcccggcgggcggggactcgggcggcgggcggagggcgctgaccgcgtgccgagggatcggggccgggccgcgccgcctcccccacccggcgctcgggcaggcggcctggcgcccgcggagttgggcgaggagttgccggccggccccggccagggcgagcgcgggctccgcggctccgcggacggcctctgcggtggggaaggacgagttggcgcggtcctcgttgccagaggctggccgaggggaccgcagtttttgctcccacccttggggcacccagcgcccctggaaggagtgacaggcagtactttttctaccctatctctcgtgttgctactcttggtctctctcgcttggaagatctgtcagacctgg

SEQ ID NO: 25052 - DNA, 1706 bp, Mus musculus
atcctcaattttacccttgctcttgttaaagatttattacttaaatatagaagatggattatttcttttcctaggatcatatgctgtttatagctgtaatttaaatcatatctcttaattatgattttagacatccctggatcataaaaatgaagttttgatcaataggaaaacaaatttaaccaaagctgtgcatagtttttgttgtgggcagtgtctttttaaggtctcaaatgttaatgcatcagttataaaatactgatagtcccacccggtgatggtgcgaggaactgcagcagtcctaagcagacatctacaatcaggctctaaagctgcaccgctttcacttaggaggggcagtaacattccccctgtttatgtattaagacaggcatcagctcaatggttaaacagaagagcctttaagatcagggttcattcttgattctttaaggacaaattttaggtggtaaaaattttaaatgtctaaaagatacaaaatgaagttaacccaaaactcaaagttattgctgtgtgactgtccatcactcactgtagagaagcacctctgttcatcaggtcgtaggttcagctcctgttaatgttttctgtgatgctgtatgacccaggtagattgtaggccattttgttactgtcttttaagatagggtttcatggagcctaagctggcctagaactcaatgggtagcctataaataaataccttaaactgatcttcatgcctgcatctcccaagtgctgggggtgctgctggtgtgcatcccacatcaggatgtttgctctttttcagatagaagttgctgggatttccaaattaacattagatttttgtgttgagctctgtttactgttgaagataatgtttaaataataaggattggtagctcatgttaacatgacagagtccttgtaagctcggtgaacttactgatcacctaactgagccaaaggaaagactcaatacaatctttccaaatctgctagggctacaaaacttttctgagactagatgcccattggatttatttttgtctctttgcgtttaacaggacaaacagaatttgaaattacatgtatgtggcattctttgtttatactgtaaaattgtttatatatcatacaaaagctaattctttgatagactgaactgcttaatggtttgctttttgttttcttaagtcaggttttcctttaaatgtctgtctcagttttagtcttacttttacttctgcgaagcaaatgacttaaagggtgcatacagctacataacgtggggttttgttgtaaataaatgacaaactttgttttgccttaatttttatagtcttcgatatttcaggggtggtaatttcatggagtattttctaactcttgtgtcaataaactttgagcagaatatgcaaagcagtgaatagaaggttctggatagcaatccagaccagtttaaaaggacataaattcccattggtagagctcttgtatagtcccgcttgtgcagttcatcccagcttatgcagttcatttgaaaatgaaattcaagcagaacacaacaggcaattcagatgaagaggttatcaggctgctgaagccgctggaaatgagaaaggaaatcttggagaggtaattgataagttgacctctgtcatctgcagattcctttcaaatccttgcactttccaaaattt

SEQ ID NO: 25053 - DNA, 1378 bp, Mus musculus
agcagtcttttgtggttttcctgttgtaggctgggtcagtgcatgtacggatccgacgagatgcgaacgaacaaatggtccttgctcatgtgagcaacaggctgtgcacgctggtgtccacgctgactgttcagatcttcaaggacgactggattcggcctgccttatcctctgggcctgttgcgcccaacgtcctaaacttctcagaccatcacgtaatcccaatgcctttattaaagaacgtggatgagaggacccccgtcacgtcaaccccagccaagcccagcagcccacctccggagttttcatttaatacgcctgggaaaaacgtgagcccggttattcttctgaacacacagacaaggccatatagtttgggtcttaatcgcggacacacaccatacagcagcgtgttcagccaaggactcgcatttccaggagttggagcaggccagggattgaggcccaccttcccacatataccaagtagatatggaatcaacaggatggggcagccaagaccctgacagactctaacttattgtgatggggaatagcgacttcttgccttccaatgtatttagtaatccaacttgcattgactgttcaaccacttacatgtcagattattccaggcttgttcatatttcataaaacctataaactatatttttgtaaaatgttcttgtggcagtgaggtctttggaaatgtcatgggcattaggtaggcctccttcaaaaagtttggatatgagctgctttgtagcagcctatgatgtgatagtctggcctccagcagtaaagccatgtgctgagtggatctgcatcttaccaaaaattcataattccttcagtagaatttataaacatacttcatgtatggtgcccaactaagtaaatgaaacttaggtgtccatttgaaaagtaaattctcttttatagctttttaaagcttaattgctacattttttgaggccctcccaaatcatttgttaaataaaaagtaacagtttctattggaagttgtgaggtatattctactatgtagcacaatttaattattactgatcttttgaaacaggttttgctgcatagatcaggctggcttcaaacccataatccttctgcctcagtctcccacatgccaggatttaggttttgagccaccatagaagtatgtcctaaaattttaagtaacaggttttgaataaagagtgtttggcttttttttttttcccatttacaatcgtagtatatttgtatactgcagtcaaacactgagaatagaggacgactgtttatgaatgtggtccatggttcccagtgttttattttgattataaatatgagacctttggtgaatggaatgaggtttaaa

SEQ ID NO: 25054 - DNA, 1152 bp, Mus musculus
tgggaattcttgctggagggattggagaaaatattactagtaaaattttatacattccagatagagaggcaggcttaaagtctttttaaaacaatattttttgtatttaagtaattgcagttatctgggatttttttttcttttttttggtcagaattctgaattctgtttggttcttcatattccgcgaataaataaaaagcgttgtgtttttcagattgtgtcaatattcacctgaacacttgtgccaaaagcacctggatggggagttgtgtttcacatgaagtataaatttgacaacatcctgaaaaatctaaaagtgcaatttttttctttaaagaattttctctggcaccacagatcctgtagatacctatttatatttatacatatatatttatgaaataattcttattcacaaaatatatttctgaatagcctaaaaattaagatactaaatctgatgcttaaattttctttaatttggctattactgttttttgtttaaaacttaaaacttgctttttaaattgtgtatagattttaatctaatagttgctggtatagatttggactgtgtgtgtgtgctcttaagaaaacagttttgaatgtctaaacatttgatttaaagttccctgtttatctttttgaccaaaggagcaagagatataatggatatggcattcattaaaatcattaatatataggaaaaataatatttatagcatcagcaaatatttttaagtggtatatgatcttggacaatgttatatgaagtagaaaataaaatgttttccagctgtgtgttttgttttacaataccttgtcctatattacttgagacttttaacaagtattgtttttttctaacatatttacagtttttgctaggggaaatattaagaaaattttatcacagtttttttgtaaatcatggattctgtatatatctctaatattactttgtaaattagacaaactattttatctgtgtctacaaaatagcaaatccctgttagcaaattattgtattattctttctgacattgcccccaaaaggttaacttctgttcctgatatggtatgacatcgtctctgtgttccttaggcaagacagatctacaaaaaaaccaaacaggtaaaagccctaga

SEQ ID NO: 25055 - DNA, 1061 bp, Mus musculus
aaaaacatttttttgttctttttgtttttgaagacagggtttctcagtgtatccctggctgtcctggaactcactctgtagaccaggctggccttgaactccctgcctctgctgagccccgggatttaaagctggcaccaccgcctcccagcttttaaaatcccccttacccagctgctcccacgtgttccccacctcctttcccacccaaattaaaatttctcgatctaaaataatgacagaaaataacaaagcaaaagtacagaaaaaaaaaaaaaaaacccatacaacccattttgtgttggagctattcatgggcatgaaacctgtcctggagtatggttgatagagccagtgacacgtcattgatttttctcttgctcatcacattccaattacaaataacttggcaaagggtaggagtttgtgtctactaccccttaactgtggattttttcttagtgctaaataaagtatattcaggtagtgttgtaagtctagtgaaaccctagatttagactgtgggacacgtaggaagctttaggtttgatcccattactgagaaaaagcaaagcaaaagaaaacatgtacacttagattttatagtttccctccctccctccctcccttcttcctttccttcctctttctctgtttgggttttagagacagagtttctctgtgtggccctggctgtcctagaactttctttattgaccaggctggcctcgaactcagagactcacttggctctgcttcctgagaactgggattaagggtgttcacccctatctggcaagtattttaagaaaaatactttaaaatactgtcctctcctcttaccacgtaggtcacagggctagagctcaggtcaggtttggtggcacctaccttaatctgctgagccatctccttgggctgcagatattttttaggtaatatcattgtaaacatttcttctctctagatggcatttactctgtcatattagttttggaagttaagaatgggattctagatttggtttgatgacttgtgaatgcatggtgtttttttttttt

SEQ ID NO: 25056 - DNA, 1150 bp, Mus musculus
ttgtggctaatgtgcttgaagatactgttaaggatcttgaagaacttggggcaaacccctccctaacgaactctaagagtgaaaagacaaaggaaaagcaccaggaacaacacaacattcccttcccctgtttattggctggaggtttattaacatataagtctcctgctacctcacccattagtagtaattctcacaggtcactggatggtttaagcagaactcagggcgaaagtatatcagaacaagggtcaactgacaatgaatcctgcacaaattcagagctgaattctcctctggtcaggaggactttacctgtgttacttctttatagtatcaaagaatctgatgagaaagcaggaaaaatcttttcacagatgaacaatatcatgagtaaaagtttgcacgatgacggttttacagttcctcagattattgaaatggagctggacaaccaggagcagctgttgttacaggatccgcctgtgacttacatccagcagtttgcagatgcagccgccagcctcacttctccagattccgagaagtggaactctgtgttccccaagcctggggctttggtgcagtgcttgaggctaccaaagtttgcagaggaggagactctttgtatagactctataactccttgtgctgatggaattcatttgttggtaggactgcggacatgctctgtggaatcattgagtgcaataaatcaagtcgaggccttgaataatttaaataaattaaactctgcactatgtaatagacgtaaaggtgatctggaatccaatcttgctgtagtgaatggtgcaaatatcagtgtgatccaacatgagtcaccagcagatgtgccggagcatctgctcatccggccggagcagaggaatgtcgtcagtggtggatatttagttctttacaagatgaactataccactcgaatagtgactttagaagaggagcccgtgaaaatccaacatatcaaagatccccaggacacaattacctcgctcattttgcttccaccagatatactggataatcgagaggatgactgtgaggaacctgctgaggaaatgcagttagcctcaaagaatgggattgaaagagaaaaaaagtctgacatttctacgcttggacacctggtagt

SEQ ID NO: 25057 - DNA, 1233 bp, Mus musculus
catacttcttattctaatgtttcttaaatgaatcttgatttcttaggtttgttgaattactactatgcatctgcatttgagtgagaaaatattaaacattgcataaaagtagaagagttattctgacctaatacagtagtagtgttttgtagtcatgcactactttggattgctcatttatgtttatagtccccctaagatatctgataatttttttccatttatacttattcccttatttacttgtaattgaatttgatacacctgaccacagaaacaagaaacacaatgtatgtgctatctcttattactgctaaatattttacaactaatttctatataaaagcagtaaataagtcacaaaatacatagattataattgtttactgattgctggggggaaatgtgtatgtgggtgtactggtgttgctcttaacaccatacagacacttagataagtcatttgtttctttttctaacagggcattctgttcctgcagttttacagagtacctttcacgctcaggcctgtgaagaactgtttaaacacttgtgcatcagtgggaccccaaagatacggttgcatactggcctgctccttgttcagctatgtggtggtgagagatggtggggccagtttctttctaacgttcttcaggaactgtataattcagagcagcttctcatcttcccacaagataggtaggttggagaggttaatggttttgttgtaaattaccttcacttgtagaatcattgtcagagtgtgaagttttgtttacatggatagtaagtttggagatgatgtaaaataaaataggtctcatggttgacaagtactaaatgaaggacatgagctctaatatgtttaccctcggatattttctgaatcaatctatggaacttaataggccttggtatgtattttctataagatctactaaatgcgattctttaggctcttggggagtttgttctctgcctgatttctaaggggttgcataagaaaaaataaccgggctggtgagatggctcagcaggtaagagcacccgactattcttccgaagttcaaatcccagcaaccacatggtggctcacaaccatccgtagtgagatctgactccctcttctggagtatctgaagacagctacagtgtacttacatataataaataataaaaaaaaaaaaaacttaaaaaaaaaaagaaaaaaataaccaacaactagagtag

SEQ ID NO: 25058 - DNA, 1197 bp, Mus musculus
cgttacccaggtgtgaagacttatgcctataaggtcagcatctgcaagataagacaggaggatcagaggttcaggctggtcaaaagaaacagttggggtttttgtggtttggtttggtttggtttttccagacaggatttctctgtatagccctggctgtcctggaactcactctgtagaccaaactggtctcaaactcagaaatccacctgcctctgtctcccaggggctgggattaaaggcatgcgccaccactgcccatcgagacagttgtgttttaaagaaaacacactcccctatttttttcttggacactttcggtacatatgaaaattttgtccattagaagttgaatgttgaatattttcatcttacaaacgtgtatactgaaaagtttccattaaataaacatttctctaaatcttgtatgtttctgtatgcagcattttaaggatttgattcgcttgcgccggacagcagaatggtctcgttctaatttagacactgaagttacaacaacaaaagagagccctgagattgagcctcttccatttactctggcccatgaccgttgtatctcagtagtgcaaaagctcgtcctgtttcttctttccatggatttcacctgccatgcagacctcttactgtttgtctgcaaggtaagtaggctgcagtacagcgttggactgatatgactaatgaaaggaatcaatttttctcttttgtgttcaattccctggtcttactctgtgccttggaaggttttaaaaagatagttttcccttagttcctggtgaatcagatgcagtttgtttgtttggtaaaacttgagggttgggaatgtagataatgtgagtgtgcctaccttcattcttctctcagctcacacaggaagtgtttcaacatggatgaggttactgaatgactttgaatgccatgattgttttcctgcagcacagtcattgcttatgtgtaaatattcacccaaatttaaaatcagtcacaaaatctggacctggtgtctcacttctttaatctcaacagtcaacatggcaggcagaggcaggctaccttgtctacacagagaattccgggacagctagagttacacagagaaagtcagtcttgaaaataaataaatttaaatacaatatttaaagtgcaagtttgcaatgtttctattttgtttaaagtaat

SEQ ID NO: 25059 - DNA, 1248 bp, Mus musculus
ggattcctaaatgcataaacattgcaataggagccgtctaactttatcttcttcaacacttggaagaatggttttagaaagttgttacgtggtgctggcaaggtggatcagcaggtaagagcactgactgctctttctgagttcaaatcccagcaaccccatggtggctcacaaccacttgtaatgagatctgatgccctcttctggtgaataagaagtcagctaaactgtacttatatataataataaatgagtctttgggcctgagagagcagggttgactttagcgagcagaggtcctaaaaaattcagttcccaacaacaacataaaggctcacaaccatctgtacagctatagtgtactcatatacataaaataaataaatatttaaataaaaagaaagttgctaggtgactcaagtacacggtgcaggtagggaagacttgtttgattagtgagaagcattctgctcactagttcttctgtgacgttagaaaaccactctgttagcctcttcatctgttacatatgggtaataaaaacatataaattattaaaatggttaggaccatctcctccaacacaggagaattgttggctccggtggctgcagaagcgatggaagaatgcactgtgagtgaggatgttggtgcaacagctggcgactctgatgactccctgcagcagtcccccgctcagctgctggaaaccatagatgaaccattgacacatgagatagcaggtgacttagatcagattcaagacagccctcacttctgtcttttgcatgaatgttaatgacatataaattgagttttgtgtttttctgtttggtcttttaaatcaggacctttttccttttatatcttttgctatcatttcctagtatattaagcattttattttagtgtaacttatatattgctttcattttatagcactgtaagtattttcacatattatcttaatttcttatctgttgttgcagaagaaacaatacccagagcttagcaccttaggaagcattaggaacagaagagtcagctcatgtagtggcttccaaccatgagctgcagggatttgcactctcttctcatttatgtaggcaccacacacacacacacacacacacaacatcctacaatcactttcagttgtttgttttagtcataggttcccccataatcccgttctttcaactgattgcttcttcatttgggaagcctttgtttgcagacagcttccaa

SEQ ID NO: 25060 - DNA, 1143 bp, Mus musculus
gtcttaaatacgatcagattcttgcagtcatcatttctgtttctcttcatccattttttaatggagatgcatttgtaatgcttatataattattgctctttggcatatcaatttatttataattctagttacctttcaggttgtaatctttttttgtttgtttttttttttggtttttcgagacaaggtttctctgtatagccctggctgtcctggaaatcacttggtagaccaggctggccttgaactcagaaatctgcctgcctctgcctcccaagtgctgggattaaaggggtgctctcagtttcagattgtaatcttacaagttattctgtgtcaccaaataaacagaatactactgtaacattttataaattaataacattccaacaactttggggaatttagaaggaggaaatgtttattttgtaggcttacttgtcataatattgtaagtttttataactcagtaaagacattaactcctttctttttgtttttaaagcctataagcagtacatggtatgactactggggtgctgattatggtacctataattataatccttacattggaggcctggggatgcctgtagcaaaaccaccatcaaacacagagaagaatggatcccagactgtcagtgtttcggtgtctcagggtaagtgcatcagaacagtttcaggaatatactaataaagttatgtaagctgaattttgtgttcaccatttctgaattgtgctgtctttgccattcatatctgttactgtcagcaggttgaatgttggtccatgttttctctctaagtcactctaagctatttgatgaatgtttgacgtttgaagtgacaatacattactttattgtaatttcttttttctatgagattacactctagttagattatttctctcctctctttcctctctcaaaccttcccccataccactccttgctctttcaaattgatggcctctatttttattccttgtattaattttgagcatagtataactatgttctcttcctgaactcataaatcacacaccccgtctgttgcttgtcacttggatgcgtgcttcaggcagtttgggcagtcacttgctgacactgtatgatcctatgatcctattatttgacacta

SEQ ID NO: 25061 - DNA, 1107 bp, Mus musculus
caccaactcacccactctcgctttctggccctgatatcccagattttttcaggtgcctttttataagatttttgttctgaagaatgttgacaaatcacattggataaaaagtccatcagatttgtaatgataacatttcattgtgtgtcacatgctgagctttaaacttgtcttgttactgagttcctacactatgtctgtgctcctgagtgtctgcgtgtgagtgcattgggacccacagaggtcagaagagccatcagctttcctggagctacagttaatgcactggtgatcttgtgggaatcccactgagcctctctccagtccccttgttgtcagccctttgagttttattttaggtagtgggaatatttgaagatatgagttaattgtgaagaaataatttatattttgtttttagtctttaataagtattcatttatcccaactaaatatatttttcctttctttttctatgtagcatcaatagctagctttctcacagtgctagcttggtatccaaatactttgctccggacgtggtgccttgtgcttcatagcttaacactcatgacgaatatgcagcttaattgtaagttcaaaatgtgtttatatggatctctgtcatatactttaagtcatttcagaaaatgaaatattcacctaaggatttattgcttttttttttatctcattcttttttagtctctattttatcaatatttggatgattttatatttatttaaacataagtttatttaatagaataccttacactaatatttaaagaattgttctactctctgacttgtattgtatttcccatctgactctgtgctgctgaagattaagttagtgggtttcagaggatgcgttacttaccacagttgacagaatggaacctgtgcatgacaaccgcataggtcttgcctcaatttatcttagagagctgagttaaaaagtgagtgtatctttttctgtttctggaaatggatcgttgtgactctgccagaggccatttgagatttaggtccttcccactggtctgtgtaccaaataaagatgtactggtatgctttcacaatctgaagggaggtgagaggagg

SEQ ID NO: 25062 - DNA, 1206 bp, Mus musculus
gttcagtccagcagctgctgcagtaatttaacagtttgatggtaatgcaagcagagaattacatcagacagatgaacagtatccatgttcatgggcaaagtaactcttagattttacttttaatagaaattgaagaataaaatttcatgatatggtcttttgaaaaatgactacagagataaagtcaatatttatattctggaaaggctcactactcctttccctgagatagcatctttaactagcaggttgtttcctgagatatgacacagaactactaaacatggacaacaaaattctaaagggtgtgagggtaaattttcattctaatacaatgttttcattaattccttggtcattcctatagtgtcatttcgatcatattaagaaatcgagttgtccagattcacagggacttagaaaatcatgttgtgtgtttactttttagggctctcttgctacttgccagttatctgagccattgttgtggtttatcttgagagtgttggatactagtgatgcattgaaagctttccatgatatgggtaagaaaaaaaatctcctatgctgtcattctagcatggtcctttcagctaacattgtggcatggtcatttttgtactctgaatcttcacttgtttctaggattcttttcatttagtattctttgtgaatttaggtggagttcagctcatatgcaataatatggttaccagtacaagggctattgtgaacactgcaagaagtatggtatcaactattatgaaatttcttgattctggaccaaataaagctgttgacagcactttgaaaacaaggatcctggcctctgagcctgacaatgcagaaggaatccataactttgcaccacttggtaagatagtggttatgcctcttactatgactcagctctgtgttctgatgaggtgaagcaaaattagttgtggacacaagttgaaactagattagtacaattttaaataaaaaaattccttttataggctgttgggtccaaaacattctactaagtacaacatttttaggtcagttctctcttcaaatgttaatcaccttaaaaggacttaaacattgatatgttttacatttttaatttaggtgtttattccttcatactgcatttctttcatgcttttcttattgttgtttcatgaacatctgagaaataaagaccattattttcatggt

SEQ ID NO: 25063 - DNA, 1191 bp, Mus musculus
gacaaactcaggcggcatcacgttccacagcactgtaataagatgcccatcacagcagacctagtggctcccatccttaggtttttgacagaagttggcaatagtcatatcatgaaagattggcttggtggttctgaagtcaacccactgtggacagcacttctgtttttgttgtgtcactctgggtctaccgctggaggacataatttaggggcacagcagagcagcacaaggtcagcttctcattcttcagctactacaacagtcctgaccacccagcaacggacagccattgagaacgcaactgttgccttctttctgcagtgtatttcatgtcaccccaataaccaaaagctgatggcacaggtaagacagcaaggcccttcttagactttatacaggagaaagtgctgcaattttggattagctaagcaagcgccatgtgacaacaaagcttggggttaggtctggatgagcatcagaatctaggccacaattgaagtattttctctctccttgcaatacatgctgtcaaaatacattattttttaggattcgactaaattcatactaacattcatgactggaaatccatgaacattctagcttcaatctgacacgattccaaactcccctcgctaaagagcaaggctaagagaatgtgtctctgctgctgggcctggactggctgtcacgtgccaccagaacgctgggactgttgctgtgcctgtcacatagacatgaagagtcggcttcaggagagaggctctgaacactataggctgtttattatagtatgtctgcatggccaaaattttgccagctaggattgtttagaggatatttgcaagtgctttattttgttttgttgctaagttttgcagctttgtggcccttgtgagttttgggttacttttttttactatatacatcagggctagtaacacagaacaccttaggatacaggaaaaaaggttctttttctccctgtcaatggggagtgcttattcctgtcattctattaatacaggtgaacaattttaatttttataaatatagtttgttgactggaaaaacaaggtacattagtgctcatagtagtagttattagacaaatgtctctctgcttaatataactagttaaaagcaagtgcttgagttataagcttgaaccagaagcataattacaat

SEQ ID NO: 25064 - DNA, 1148 bp, Mus musculus
gctgagattaaggcatgggccaacacacctggcaaagtgcttttcaaaaagtaaattttattataactggattgatatttactgacgacagttctggctagtccttctctttatgtgaaagatcaatagtaggcattcctttcctctattgaaatgttagtttgttttttttgtgagttagggtcttactctgtaggctccttgaacttgctgtgtagactgggctggccttgagtttaagagacctaccttccttctcctgagtgccgagattaaagttgtgtgacatcacacctggctgtttcttacacttttaattgtttatctgcttctgtattcccatattttgagatttgagttcttatttgcagactggatgcaataaaacacatttattcgttaatccatattcttaatttcttgttttgttttttttttttaaaacctgaatatctccacttaacttttgaaatttcttcccttcccaaggttctctgtgaactgtttcagacagcccctcaaaggggtagccttccaacatctgggaatatttccgggtttgtgcgaagactgtttctacagttgatgctggaggatgagaaggtgacaatgtttcttcagtcaccttgcccagtgagtaatcttggtgatcactttgttgtccttataactcttagaccttacagacaccttgtgtgtgtgtgtgtcttgctcaaatgtctgtctgtgtgcctgacccaaagagatgagaggagggctttgaactctggaactggagttacatgtattgtgagctgccatgttggttctagaaacaaacccaggtcctctgtaagaacaagtgctcttcactgcagagccgtgtctccagccccattttctctttagtaatgtagcagtttatattgacaataagtgtcatttaggataacttgccacagcccctttattagaacaacaactactatattgtgaatagtaggttttgttttgcggacacacagaatatttgataccattggtacttccaatctaaaaagctgatcaacaattcctaggtaaagaaagcatgccagaaatatgtaaaacatacaaattatgctttattgagctttttattcgtctttatctttgaaattgattcctga

SEQ ID NO: 25065 - DNA, 1124 bp, Mus musculus
aagggaaactaccttaggaaagaatggttactgaatgtttatcttttttttttttttttttttttttttactgtagagtgagaggttgttaacaaagaatatatattggtcattcttacaactactatttaaagtcagcaacttttcactgaatttgatagattttgtttggccatatcttcatgctcatatttgatttctgaagacttcctacatacactttaataaaagttaaacagacatagcccctcttttttgatttactggtacatttttaagtaataaatctgccataaaatgcactatagctggagacttgcacttgtatggatgaatttattacattcaacatatttaattttatgccttctaagatgcagaaaaaaataaatgaacatgattttattctatgccaaacatttgggcctctgaatgtatccattatttgaatttactatatgaaaaggtatggtcaattggaaaagtcgctttaaactgttttcctcaagggctcctcttattcctggactgtgtgggtttgttcctgaagtcacatgtatgtatcaacatggaggctctgtagaggagagaggctgggcctctctggtgctgttacagtacgttctgtacctgccatacaggctcgttttcatgcaaattcttcctagagccaataaataaaaatgtaggtaaattagtatgtcttgtttctaaaatagttgccatggtgtgcaatggtatttctacaggaaaactttttgaaacttgagcgtgggggaaaagaggatgtttttgtaagaccagttattgtaaagaaagctgaaagctgcacgcagtggcactcagttataatcccatatgggacagtcttttcttcacatttcacgttccagcacgaccagggctatttagaaagaccctgtctgaagaaagtagaaaaaggaagagctgacgtgactattaatatttatatagaggtggcagcctggcatcgttccttatacatccctgcctgggaagattgaggtatagagtttgctcagaaaatacagtctgagaccctgcctcaaaaattggggtaaggagaaagaatcacaattctaagaattgaggatgtaaagaaa

SEQ ID NO: 25066 - DNA, 1163 bp, Mus musculus
tgttaagcccagtatggtgacacatgcctttagtcctgttactcagaggcagagtcaggtggcaggtagatctatatgacttcaaggccagtctggtctatagagcaagctctagaaaagccagggctacacagagaaaccctgtctccccccccccccccgaaaaaaaaaaagaaagaaagaaagaaaaaaagacattactaataacttgatcgttgtgggaaaaaaagtcacagtaattcacatttgaaagtctgataccaagagtggaggagctgttcatgcctttaatcccagcactcaggaagtagagacagaaggatgtctgaggtccaggacagtcagtgctatacagagaaaccccatcttgaggtcttcctccaacccccaaaagaaagcctgatactagaaaaagcatgtggagtacaaacttaatgaagactgtggtcacggagctgctgtccatgtgtgtctaggatccaaactatgtgtgtattcaaggtgacattttgtgtgtgagctttagatggccaggcacttgattacttactgtatggcgccagcttttgactctgcactcggcctgggttcctgctttcaaagagccatcgtggtcatctcatctgctgcttgatgcagtctgtgggagctgcttttcattaccaggttgggaatttcaggacatctaggaattcctcagttacacagcttgcagctgcccattgcaccgcacagatggtcttgcctgagtggatgcccactcttacatctcttgctgaagaatgagaaaatacttgtttgtaattagacagacctgcctttcctcattacttaattcccgagggggaaaaaaaccccagattgttcatatagtcactctgtcattgatcaggagagtgcattgtcaaaatgtcattatgttggagataaatacagtagaggacagttttcttagagaaaatgaaaattttttagtaataatgctagttctttgaaagagttattataagaaattttagttaaaaattttcctggtactatttaaatgtgcatatttataggtgtattgattaaatttcaagtttttaaaatacttaaaagaaacttcatacatttctaaccttaacaaaatgacttaaattctttgttatttatatgtgcat

SEQ ID NO: 25067 - DNA, 1144 bp, Mus musculus
tcatgatgtttgtgcaagaatagaaaccctgactaagacaccctcttacaaagacaccttccaaaaagcatgtgacacaacagagtacacaacagagttgttaaagaaaccggaaattttcacttcatatcccccattctgtttttttttaataagagttgtctttttctctgtcattaacaacctacatgcaatagaaataattatgagaaccataaaactagaactttataccatattttagataaggtgcttgtatacaacatatcaaacagaagtcaagcaaaacaaccttaaaattttatcattaaatattcagagcaaccttaaatttccatcgaaatacaataatgaaacaaaacgaccttaaatttctattattagacaatagtcgaacaaaacaatcttaaatttctatcattatacacctatgccaaagtaaaatatttaagactagtaggctaattggttatttatttatttatttattgttagtccccatttcccctccttttctccatttttagatagaagagaaagatctctgatttaaacattgttttgtttcctcccggaccataaccagtatcagccaaccactctagatgataaacaaccattacatgtcaaacaaccaaaaacatccatcctatcttttggtaataggggagtcatgttcttaaaattacttgtctggaagtaaggatatctttttggtaccctgtgaaattttggatattggccaaatcctgggaaagctagctgtatttttttattttgtccagtctctgtgttgtctctccagtctctttataagttttgttggtattcatattttttcagtccttgtagatacataaacataactatatcctcaacttaaaactattgcaggcttccattttaatgtcaacttatagtatattgggttggcttacttcctcagttatattgataacccagtgtctctcagctgttccttttccaccaacattaagaaaatttagggttaacaaagcattatctagtctgtccctgcgggtttttactcttcctttttgtttaataagcatctcttttaaattacgattgactctttctacaactgcttttcctataggattgattgtgtagtatacatacc

SEQ ID NO: 25068 - DNA, 1101 bp, Mus musculus
tcagccttgcctgggaaggctctgacagacagctggccagccccacaccggtcaaatgcctgttttccagttcactgtacccagaaggtggggctatccatatggtatttttctacctacatgcattctgtctaactgcaaccagattgtgtccctgactgagacaggcaactgatctgtctaaattgttcccaacagtctttcttctgtcgtacaggcatggtgatctaaggagacacagaaagagacagagacacagagagacaaagacagacagaggcagaggcagagagacacacagagagaacagattccaaggtggtccaggttccaggaaggaggaagggaacatgtgaggtctcttcaagccatcagtcagagccgcgcccacctcactgcccaagcccaaatgaaggagagatgtgcaggaataaataaagcggttgcaagagaggagaggaaagaaagaattatacataactaatgtcatccctcattagtcatgccggggtagataaaatgcagggatgggagtaaaatagatcagagaatcatttttcacagaatatgttccccgcctttcctccctatcaaaacaaagcaaagcccacctcaacagtcctttctcattacaaacctagtgaattaagggggcggaaatcaacatttagaacagtctttttttctctctctctctctctatctgaaccacaaggaatattatttttaattgatgaataaagggaaaaaatgaaaatattttgtttgggaggagggctattctctaaagtaaagcaggcttcgtgtgcaggctgctccttggaatgaaaccttgaagtgtgggagggagcgctctggtttctgctggactcccatcgagctgctgcagtccttggatgcacctgtaacctttagcttagtcattaaagagcatcccagctgttgggttggtgtgtttctagactcattaggggcgtgcactcaatcccacacaagatgcctggaggctagtgcgccacccagcaagactctctcacctgctccatagatcctgctttcgacttaacggagctttccaaatccgttcataggctccgaaaa

SEQ ID NO: 25069 - DNA, 1196 bp, Mus musculus
tctggagacttttaaaaaaacaagttgtctgtcctgtggagcaggcagtaattgttaaacttttggaggggatggagaaacatctttatttcaatgtattaccagattgcctgtcaattggatcccttacctggatggaagtggaagagcttcatagagtttattaatattgtgatgtgtaaagtcaaccgagaaaaaattaaaaacctgaacatccccccccaaacatttaccattgtatgttataagaaaataaactcaccatttttgtagaaaaaaaaaatttgagtgtggaagaagaagttgtccccttcctcataacagctcccccatctctgatcttttaaccactagtcctccatcacgctaggcttctgtaagttaggactggttagctactgttacaggttgctaatttccatcttagttccaggctgaagtgctgcatccccgtgctttagaatgcgtggattctctttggagacaagatctctaaggaggaaatgaaagttacaggagaccagtggagtaaactgtaacccaagactatgggtgtccttagatgacagggaagtaaggacttgtgcagagaaaaggtcatttgaagagggctggaaggcgaccatcttgcaaaagagtgaggcctcagagggaagccaactctgccacagagtttgacagagtccagaattatgagaaaataaacttctgttgtcaaacaacctgtctatgatactttcttatggcctttccagacaaccaatacagacttgtataacaggaataatgggcaaacaaggcctttcaaagtcccggtctctgatctcatatggacgacccctagcaatgatagctgcttcactcactgtgaaacttactgtgcctcagcaaacccccatgggaaatcccccagtgaacacttccttgaggggcctttgccttctaatgcctgtagcaggcaaagtgataacaacttaaagatatagatcttctaacctatggactctgtcataatgaagggaagtactgtctcagagaagtctgccaagtcacttggccccaaagaggacgatgatcttggattgcctggctattattactatgtaatcaccaggggtgtccttggaacattaaaagtggcaagacagaaagaaagaagttctgaaaatgtgacatgcaagaggtcaagtacagca

SEQ ID NO: 25070 - DNA, 1724 bp, Mus musculus
accaagatggtgggcaccatggtgaacgaggcagtggtcgtgggggaagaggtggtcgagggggtcggggaggacgtggaagccagggaggaggctggggaggaagagggagccagacttatcatcaagggggccagtttgaacagcacttccaacatggaggctatcagtatagtcattctggatttggacaaggaagacattatactagttgaggctacagaaactcacattttgctagagctcaagtaatagaaacttagtttcagaatcctgaatccaacatctatttggaatgaatgtaagaccacaggtagcaggcatactcctgcttaggataaccatttgctggtcttcattcaattctttctctctttttattactaaacagttttacataacactgtttatttaagaaacatatctcttctttctatgaaaaacaaattttaaaggcaatttaagttgcctttagttgaccggtaaactaatccagttggaacatacatgcttttttgaagaaattacttgaataaaatagttttcacattttcaatatgcaagttttgaaaatgaggatttgcctggacttttttatatttaatgctgggaaaccttcctcatattaacaacccatgtatgtttttcgtaagctaccttctgatgtctattctccgagcatagctctgccctgattggcattttattcagagagatgtttgtcacctttctttttggtagacctgttgggttggttcctattacatgagctcttttgcagatagcacattcagtagccttatcctgttggtggaatactgtaccatatgctcctccaaaacccatgaacacggccaaaacccataaaaacaacaaaagcaaactaagtcaagaaccgtagtatctgtaggcacttagttaagtatagcaactcaaaccagacctgcatccatccgagacaaacgttcctccttcacccttgtttttacttgaaattcgctagaagaaatggcgagcagacatctgttccatgcactagttaatgctactggctcagcatatacaagttagcttgctttaggcaagggacctttcttgtgatggacgtgcactacgaagtgagatggagtcctgctccgtgcaggaggcccttcattattgctgcagaagacagaagcctggctgagtcactctccacgtctatcctgaaatcactcaatgcttctgccgggtttttgtacatgtaaacactgtcaagctgtgaaagaaagtggctggaggtgtgtttggtgtgagaggtgagcaataaagtacctgcacattctctccttgctctgggagttttcttttagctattttcataccagattgtgcgtttgtgtcaggtttatggagtaaggcttttgttcctgaatggtatttccttaagtagaaggtagccctttttctggaaactgaaacaaactgggagggggaaaagctatttccacatttaccttatttataacagtacggctagaaagccttcctctgactctgtccactgggtgtagctgttgctacacatgttaggcaagatgcagtaatgcccctccctaacctcagagggtttgtttcccgttctccctaaaagcagacgtggttttcttagaagaaagtgacctggaaactacaaagtacttattagagaaatggtatcttctgctaagtggaccatctttaag

SEQ ID NO: 25071 - DNA, 1165 bp, Mus musculus
caggaggaggatggaaaaatgacatcattagatgtgaagagaccttgtttcaatagtatgggttaaccaaagttcattaagaaaaagaagagggagctgtaggccatcgtggagacgcttgatctcgtcttccctgaagtctggttccttggcaggaattatgatgggaacccttgtgacccgtaaagacatctcccccgtaggtgaaagttcctgaagacctgaaagatccagaagtagtccaggtccagtcgctggtgctaaaatctctgtttggtccactgggatctcgaatgtctcgcatcgagcaggtgagccaggccatgtttgagctgaagaacctggaatctcccaaagaacttatcgaggtcttcatttatggctctcaaaacaacaaggttcgggataaatggatgcttcagtccatggctgagaggtaccgcctgcgccagcaaagtggagtgctgaagctggaggaatccatgaagaccctggagctaggccagtatatcgagtgaagccagtttccagtccttgtgtctcccacctggacccaggttaagctgtggccagtgtttggttctggtggaatttttaactttgttacttacatcctagcaagatattcctggatccctgctgtgcattctgatgtgaataccaaggtcactattctaaataaaaaaataaaattgaaatgaaaaaaaaaagaaagaaaaagaaagaaaggaagagagagagagagagagagagagagagagagagagagagagagagagagagagagagagagagagaaagaaagaaagaaagaaagaaagaaagaaagaaagaaagaaagaaagaaagaaagaaagaaagaaagaaacatatgcagctagagacaagagctccggggtactggttagttcatattgttgttccacctatagggttgcacttccctttagctccttgggtactttctctagctcctccattgggggccgtgtgacccattcaatagctgactgtgagcatccacttctgtgtttgctaggccccggcatagtctcagaagagacatctatatctgggtcctttcagcaaaatcttgctagtgtatgcagtggtgtcagcgtttggaagctgattataggatggatccctggatatggcaatcact

SEQ ID NO: 25072 - DNA, 1117 bp, Mus musculus
ctttctttctttctttctttctttctttgtcctagtttgagttgattattcacacgctagccaaattgcaatttttctctttatatctgtaagacgcctgctcacatgttaagaagatttcactcttgcatatctgagaggttgccttgattcaccaggttggtttgaaacagagtccacaggaggtatccaaacccattgaggccacagaatttatgctaactgcccatcagaaataagattgatcaagagggttcctgatcttgttttgtaccaatatcaaacacattgaagaaaacccttagtctttgcaggctcttggtagccttgtacgtgttgaggggctgcttttcacatcacctgccagatcatttgataagccacctcctcgcccagcaccagacctcaaaaagtaccttctggagcctggtctcctctctgtgctcattatgcgtattgatgttttgcctgcatgaatgcgtgtgcaccccgcgcgtgcctgttgggtcccctagaactggggctgtggaaggcggtgagcccaaaaatgggtgctgggagttgaacactgatcttctacaagagcaacacatgttcttagctgctgagccatctctccggccccccagtacctggacccgtaagaaaccatgcccacccctgatgcaactggaatctgtgttgactcgttggttgtatcatccgagcatttgtgtttcagccctctgtgtgcctgaccgtgtgccttgcagcacgacagtagtgggaaggctggagctctttcatcctttttggggacctgttggtttgcataacagctcacatcttaaaaggtttcgagagactctatttgttagtgaagctaaaatatgttcagagataataagctatcagtttgaaatggccctgggctttgattgttcagcgggatcagcaagctcaaatcccctcaaacccgcgaagtcgtcatcatttctgagaaccaggttttaaaaagattccacagagctttatgccagatgactttagtcggggtgggggctccacagccattgaactgggagcaaaagcattattctttgagtgaaatgtcccgatacctagtcaaaaagatagc

SEQ ID NO: 25073 - DNA, 1120 bp, Mus musculus
gttctcggactcagatgaggagggagaaggtggtcgcaagaactcttctaacttcaaaaaagccaaaagagttaaaacagaggatgagaaagagaaagatcctgaagagaaaaaagaagtcacagaagaagagaaaaccaaggaggagaagccagaagccaaaggggtcaaagaagaggtcaagttggcctgagcaaggtctgcagccccatcttctccccaagttcctcactttccctcaacttctcagattttatattttctattcctctgtgtatttatataaaatatattaactataacgtccccagggaccagagcacagggcagtggtgctaggagggctcttcccagagcgaccttgtccatcctgccgcccccctcaccccatttgcgtggaaagaaaacaaccagaagagaaaaatcctgaactgccaagtgcctgcttaggagctctgctaagatgcccctgttaaacatttaggaggggtctgggtctcctaggaccccttttcaggcttgggtaatagcagccatttttagattggttctgtttataccttcccacccatcttgggcaaacaaaaaaacttatattgccctgtcttcccccaattctgtaggtggaggttgatagcctagcttcctttttgagatattttcattttgtgaaactctttgtaataaaacagctcatttctataaaaaaaaaaaagaaaagaaaatatctaataagaataaaaataaataaaataaaactctttttgttgttgtttttaagaacaatgcatgaaatgccacctcagttagaactttcctaagcattaaatctgctggagacacattttctccgttgctcgttggtgtttattttttactttgccttaattttccatgacagtcccattggatttaaactccgggtagcctgtatttttctcattacttgcactgtgtgtcatcctactggctacttgtgtccagtattgctggtgacaagaggaggttaatttttatcttagttttcttgcccacagtgtgccccttttctcctcagaacgaactttcaacagtttggccttcagttcctaaatgtattttttctttatatctcgtctac

SEQ ID NO: 25074 - DNA, 1460 bp, Mus musculus
tattacagtacttaggatgtttgacactgggattctggtggcagaaaagtagtatctgatgaagtgtgtgtgtgtgtgtgagagagagagagagagagagtgacagagagtgagagagagagagagtgtgtgtgtgtgtgtgtgtgagtgaaatgtattatttcttaaatgtattatttcagtggaagctcagaaaatgagtatctctgtttagcaggtaaacaatttgaatcagttttgcatttgcctctgaaagctttgtaattgaccgtatcaggcatgcagttaggtctccatgtccatggaagggactccacattgaccaagtatttaacagaaccttgacatcagttttattgttatgtgtttaattttgaaaaggttatgttagaccaaacgagatctttagatcccattcttcattctaacaatgtttctgaagtggtgctgaggatttttctggatttttctggctcttggctagtcaagctttaggtttcgtttacctgggaccacgtgttcatcatcgctctggtgcaaattagggagttcatgttcacttagagtaacttcagtgtctgcctgggctcttaccaggctgggaaccagtgagtgccttgttagtgtagagtgatctttcccgttgtccgttaggtctttctgagagggtctcagagactgagctttgagttggctgggcgagctgctgagattggtgatacagcattgggaagtctttggtctgccatgtccactctccctgctttctcttcatcctttggctggtgttggccccttgtgagaaaacaaatagagcccccttcacgctatttttatttccgcttaaggcgtgtcccccattcccgccccagctatatgatccaatgcctgttttaggaagaaccacttctttgtaatatgaaaatctaccacttattttatgtcttctcaatatcagtttactggagcggatctcagggtatcatcagttcagattcctaaataacactttctcttcaacccaaaccccaactggtgagccctgggccagattgtttgatatcaggtatcttaaacttcagttataatatcaattaatgtaaatccaaatgcaaatttgtgtggtgcaagaagtttcttttgtaaattcagggtatggataagctaataatgatatccagttctggtggctctaagtgtattatttgtttttaaataaagtgtacaaatatagttcatgtgctcctaggtgtgtcgtgacttggactgtgtgaactttggaatctagccgtaactttgcagtgaatcagttaaaatgtgttaatacccaaggcgtttgttagagggcttatagaaggatgcagagaaactgaagagaatgagacaaagtggattcatgtgcaaagtaacaaaacgttctccgggacacactgtgagaagagtgggaaacctcaccgtta

SEQ ID NO: 25075 - DNA, 2026 bp, Mus musculus
cggtcatgttgtctgatgcttaccatgaacagtttataactggtctgtcatgtagtccaaagcatgtggtcactgcaggcagctgcttttgcagccacgcctagtagagtagtgcaccccagaaagtcctctactagtgtctcgggaaagaactctgtagagatctagatggagatgttagtgcctgtgatgtctacaaagttctttcttctccccactccccattgtttaattggaatgcatgttttaatgaacagttgatcaatactctatctagagaaaaccatgtcttaaaatgccagctctcgcatttatctgtgagccgaatgtggtcagcttttgggagtctcagaatcctactgacacacctagggcagtcttcacaccctctctgcttttgtcctaaatgacagagaccactataaatactaaattcaaattaatctccacctttttaccaaaatgtgttcatcataggctctctgtcttaaaaatattatacccatagatattatgacccattaaactaattccattgccatagccgtggcttttctggtgatctgttctttgaagtagtattcttacggtgatgtggctaataattgacttcttaaaaatttctgctcatctatctttagaattctccagtgcaggcaaacttttcttacattataagattcgtgttgaacgtccctgattactctatagacatgctgtagcacaactacagtttatctttgtgctttggttaacaagcaggctttagagattcactggtatatgcaagtgaattgagttacacataactaccaaggaaagctcacattttcatgtatagagttttatgctgtgacaggtaaactcttccatactttgtaaagtgaacaaaaggatttattaacatttgtagaatattagaagattccagtcgtaagtggcatatttatgatggctgagcacagttactgcttcagtgtacgtcttactcttgtcatcaacactccagatcccaggagagtctgccctgttcattctgtgcctcgtaattgaagttttcttgttaatgggtgggacacaatcctaagataggcaaagtgtagtacaaatgacagaactgttgaaagttgtttaggaagtatgttttgtgccattgaagactgcacggagaaagagagccttctaaactagccctgtttgctgtcaacctagaaatgagccaactgtcttccaactggatggtagcatgtacgtgtgtttgactttccccatcctattgaaaaatcacaagatgaacagtttcaagattcaaaacccttgaaatactttcatggttatttaccagattgtaaatgttttgagtgagctgttttggaataatatgaaaatcagcaggtaggttaggtccctgccttattttcagtgctgtggatgtgtctccgggagcttacagtacttctcaaaatgcagctgtcacttggagctcatttgctactcaaaccatagacaaataggtgatgggatgaccttcagtatttttctattgaacaaagttaccaatttttgccattaaacagataattagttatgcaaagtatttagcttttgtaatcatttagttgtaactaaaagggggaaattgagctgtatcactgataatgaactttgtgagaaattatttgtttatctgacttccattccttcagtattcttgctataaatttcttttggagataatgattctttatttgaaagatgtctaaaatgtatgtatattttataaatatatattatatatattatagggatatatataatatatagacgatatatatctatctaaaccatgggtgcattttactgtttgtgtcttcactttgggaggtagtatactcataagttgatgagtctgacgagtgttgtgctgtttgcttttacagtataatatatagttccaagtgtttaaatactgtatatactatattcattataggctagcatgcttgttttaaagactgtcattcta

SEQ ID NO: 25076 - DNA, 1174 bp, Mus musculus
cggcccccgcgcccgggcggctgctccctgctgactggggtgtgggcggggagcggcggagggaggaggcagagctggccgccgcagtttgccgccgctgctgggcgcctaggcagagagctccccggggttcgtgcggccgccatggacgagcaggcggggcccggcgtcttcttcagcaacaaccacccgggagctggcggtgctaaggggctcgggcctctggcggaggctgcagcggccggagacggagcggctgcggcgggggcggcccgagctcagtacagcctcccggggatcttgcacttcctgcagcacgaatgggcccgcttcgaggtggagagagcccagtgggaggtggagcgggcggagctgcaggtaaagaccctcccggcctggcggtcctcatcccgcctcttctctctcttcagccccgccccagacccttcgccccctcccccagcccgctcgcgccccctcccccttgccttgcgcccatcacttccagaatctcatcccccttcctccagtcacctttgacttttttttgctgatcccacttccttgagcctgttttcccactccttctgatccatttaccctcccggcggctgttttccccactctcaactccggtgcttattcctactggtttgccatgccacattttggggttgtctgtccctttcggtttactgattgggttgacagtagttttgagagactccgagcagatcatcctggctcaacctgacgcaccctaggtctagagacgttcctcgcagaagggtttggcagttgtctatcgctcactctgcaaggaaggtgaccagagaaagcaacacaagttgtatcagtgaggccttggctttcctcgagaaactgatgttactagcagtgtcagctccagttttatgtctgaaaatgtttccctgtctgccctttgaccccatcccgcattcgcgtttgggttagactcataggtttcagtgaaggatttgattgatgggagtcagaaaatgggcagaggtgggacatcttttcacagaatctcaaacttcccaagagttgatttgtatgtccagagcttaaaaggaactaaaggggcttcagggctacgttgcccccttgcataacctgccagataaagcatgcttatctgagaggagctctt

SEQ ID NO: 25077 - DNA, 1308 bp, Mus musculus
tatatttactaattatgtgcttattctgtctcttaaaagtcttgctgtagtgtaaaacatttataatccaagtaaaaccgtgtttattattggcacatcttactaatactgcaaattggtctgatttgaagatggaaattataatgctttagttactgatgtcttaaaccttttttctttgagactcatttagttcagagacatggctgcagccttgtttgctattaaactgtagttgcacaagtaacatacataatagtgtcatgtattatataatatattgttattattacaaatgacaagctgcgggtctgagtgatagctcagcagttaagagcactggatgctcttctagacgacccgggtttaattcccaacacccacatgacagctcacagctgcagtctcaggggatccgacgtcctcacccaggcacacacgcaggcaaaacatcagtgcacgtaaaattaaaataaaaaagccaggcaatctgcattgtctccagtcaggccagtgatttctgtcctctgttacaggagtccagttactcgctcttctagtgcccactttgatctcttacctgctggatgaaaattcttttgcctcagcaagttcgatctccaaagatcttcatgagtttgcactgcagaacttaatgcatattggacctctgtacccacatgctttcaagacggtaatgggggctgctcctgaactgaaagcacgactagaaactgctgtccgagcaagccaggcgagcaaagctaaagccgctgccaggcagcccgcccccaccacacattccacaccgacaattaagctgaaaacaagctttttttagtgtgcttttccgctcatctgtatttatttattttctcaaacatttaccactttttagaataataccaacattcacatactgtattacaatggtaccacaatataaaataaaatatgtataaactgacacacagagcattcatacagtacattcttttttttcaacatgtatttatttaatatacattgttaaaattaaatcaagcagatttaatttcaaaacaaaaataacaacacagcttagaaatcaaggagaaaggacagatcgtctcagaaaaaagacgacacaaaagaggggtggacagcttgcatgagtgatcttggctggagacctgctttgaataggtttcttgcaggtacttaaacgctgtggggtttttccagcgctccacagcgtgtgtgttcaaagggctatcaatgttgggtttctcctagcaggctctggatagagagcaagatggtcctgac

SEQ ID NO: 25078 - DNA, 1100 bp, Mus musculus
tgatctttgtacctagcttatcctaatgtcacccagcatctttcttgtcatatggtgtgccttatggcctcacactctctccagctccatcacagtcacgctcccctttactgtgtggcattgcacagtgcctgtaacttcttgcctgccaattctgttctctctttctttcatatttgaaccagtttctggtcgttgatccttcctttctgctgggagcctgggagctgggttctctacatctttatgaccttggcactttgtcatcagatgctgggcattatacctgctgtgctagcactggattttgctcttccattaaattgtggtgaactctgtcctgagatgcagtaaaattagtgcaaattgcgccatttgaattcttttgagatttgcttttaagcaaagtccagggttacccttgacctggtgctaaaagtacaagactccctccccattctgttctcataaaaagtcttttaaaaaataattttgtaactacatttcctgactacacactgtttttctacaatagggactgtcagacctgtgatcgtaatgcaacccacaagcgtgttttgtaaatagtttactgggattcatcacactcatttctatagcattgtctgttgtgttctctaagtcctttctgcctgcttccatagtgtagcagcagagctgaataactgcctgagagagaatgtggcctgcaaagccaaaaatagtatctgaccctttacaggaaagttctgctagggcctgttctgagagaactacaagcccatttgggaaagccatggtaatcatgtattttgctgtagctgtcagtgtctatcctgtagttgtctgtgtttgagtggtctactgctgcactgagacacttgagttttattttttagatattgtggatcataagtgctttatcgaattgtttcctatttttatgcattgtcctagtctgggtgaactttcccttgtacagtctgttttcctttgcagatgacctcctagtattgcatctctctgacctgattcgaatggcattcatggctgcaactgatcatagcaaccaactgcgaatggctgggctccaggcactt

SEQ ID NO: 25079 - DNA, 2257 bp, Mus musculus
ctcttaagttgcatctgttgggcttttagtgacaagaaaagtagctaacatactgtttacagaagtcatgtcaacaagaagcacccataatgccttcaaagggagaatgaatttgaaatgctatttacttattggagaatgaactgaagctagatgtagtaacagtatattaacagcatgttaagagaaaaatattttttaaatgtttatggaaggaaaccattcacaagttgatagaacattccagagcatacaaaacaaaatcatttttaaagatcccctccccgatttttggaatctcagtaagtaggacaagcttttacgcaaggggtttgccatcagaacgcaggtgttgggaaagccaccgctaatttaaagcaaaaatggggaaggaaaagactcacatcaacatcgtctccggcaagtccaccacaaccggccacctgatctacaaatgtgatggaatcgacaagcgaacaatcgaaaagtttgagaaggaggctgctgagatgggaaagggctccttcaagtacgcctgggtcttagacaaactgaaagctgagcgtgagtgtggtatcactattgacatctatctccctgtggaaattcgagaccagcgaatactacgtgaccatcattgatgccccaggacacagagacttcatcaaaaacatgactacaggcacatcccaggctgactgtgctgtcccgattgttgctgctggtgttggtgaatttgaagctggtatctccaagaatgggcagacccacgagcatgctcttctggcttacaccctgggtgtgaaacagctgattgttggtgtcaacaaaatggattctaccgagccaccatacagtcagaagagatgtgaggagatcgttaaggaagtcagcacctgcattaagaaaattggctacaaccctgacccagtagcatttgtgccaatttctggtttggaatggtgacaacatgctggagccaagtgctaatatgccttggttcaagggatggaaagtcacctgcaaagatggcagtgccagtggcaccactctgctggaagctttggattgtatcctaccaccaacttgtccaactgacaagcctctgcgactgcccctccaggatgtctataaaattggaggcattggcactgtccctgtgggccgagtggagactggtgttctcaaacctggcatggtggttacctttgctccagtcaatgtaacaactgaaatcaagtctgttgaaatgcaccatgaagcattgagtgaagctcttcctggggacaatgtgggcttcaatgtaaagaacgtgtcggtcaaagatgttagagaggcattgttgctggtgacagcaaaaacgacccaccaatggaagcagctggcttcactgctcaggtgattatcctgaaccatccaggccaaatcagtactggctatgctcctgttctggattgtcacacagcccacaaagcatgcaagtttttctgagcttaaagaaaagatcgatcgtcgttctggtaagaagctggaagatggccccaaattcctgaagtccggtgacgctgccattgttgatttggtccctggcaagcccatgtgtgttgagagcttctctgactatcctctacttggttgttttgctgttcgtgacatgaggcaggcagttgctgtgggagtcatcaaagctgtggacaagaaggctgctggagctggcaaagtcaccgagtctgcccagaaagctcagaaggctaaatgaatattacccctaacacctgccaccccagtcttaatcagtggtggaagaacggcctcagaactgtttgtctcaattggccatttaagtttaatagcagaagactggttaatgataacagtgcatcgtaaaaccttcagaaggaaagaatgttttgtgaaccattttgtgtgtgtgtgtggcagttttaagttattggttttcaaaatcagtactttttaatggaaacaacttgaccaaaaatctgtcacagaattttgagaccattaaaacaagtttaatgagaaatctgtgttggtcaatgctgaaagttaactgagtgtatacaacaaaggtactggggtccccatggtatgttcttagggattgagttctggtcgtctgggtctacccagaactgagctatttcaaaggccattttacaaactaaacagggctgatttgagttaacttcaaaatcttactggttaggacaaagtaatttagatgtatcaacccaag

SEQ ID NO: 25080 - DNA, 1197 bp, Mus musculus
cgagagacagagacagagagacagacagagagagagacagagaagttaaagaggaattaaatagaaatgaaagggctttacctgttctggactcatgtattgaagagttcctgttctccttgttcgggattttccatcattttccagggctgttgcaaggccaaagtctccgatcttaatgtgtctttcatctactaaaaatatattacctggctatagaaaaaaattaattaccatatgccagttggaccaactattaccacaggtcccaactacatttggggatgagacagggtttctttgtgtagcctcggctgtcccggaactcactttgtagaccacactggcctagaactcagagacctgcctgcctctgcctccagagtgcagggattaacgttgtgcgcaaccaccaccacccagccccaactatttgttgtgttggtttgtatggattgcatttatccttccacaggctttccaaaccagggaatttaaaaccttgagtctttaaaactaccaagtgaagaatgaaaacgcgcctgatcttgtctgatcttggaagctaagcagggtcaggcctggttagtagttggatgggagaccacctgggaataccaggtgctgtaggctttgaaagaaagacagaaagacagacagacagacagaaagagaaagacagacagacagacagacagacagaaggaaagaaaagacttttaaatgacagcaaaggtggtttgggttatacctgcttccaaacatcagatcagctatcaagagaaagtttcagtttgcagggtcccaggagagggttccagactggagggtgggtgtgagtatggctccttgctctcacacaccctagcccagtaagaggtacaggaaaaggggttagagctccccatcccaaaacagggctgggcctccaccttagggacatctgcagatgtggctcaggatccgatgggaactaaaaccaaaacatcagtttttttctttccacctatatgtgggctccagaagttgaacttaaatcactagtcttgtataacaaacatctttacccactgagcccaaacatggacacacacacacacacataacaaataagggtggctatatgtgctaaataactacacagcactgactgaaaacaggaagattgttggtgacaaaattaatattttgccattc

SEQ ID NO: 25081 - DNA, 1172 bp, Mus musculus
tgacctttgaacatctcactgcagatggctcactatcagagaggcatgagggccagagggaggggggacccaggagacctttgtcctaaggatgttctgagtctgaagaaaaaggaggtgatagcatgccagtggcacgcatgttcaggtaaaagtgagatgcaggagtgagatgcaggaaagaatggaagagaatcaaaaggaagtgtttattctgaagaaggtgaacagtctcttcctatccctctgatgactgatgcaaaatagaaattggccggtgcgtggggcggagcctgctctaaagttctataggttgttgttttgtcttagttttctatttttttttgtctcaattttagaaaagtatcccctgatgatgtgcaaagaaataaatataccttggacgccaggtaagcggagtttgtctaatggtaagctcactctcgaaaccgttgcttagggtcaggttatgagttgtatttccacccaagtaattaatgtgggctgtggcataggcaggcccatggagggttatggtctctcagagaagtgaggtttagggatccaagtggaacgtgtcggatgcagacctcggtgatgttatcaggctttctgatatccatggatgccgttgaaactgaaaagcaagtaggactttcagcgatttggaagaaaaataaatagagaagagaaaggatagggaggaagataggtgtggagggaagagaggaatgcctgtggggatggacacaagtcagcgtgggcctgttctctagcttgttcacacaagacttcactaggaaaaaaaaggaaagggggctcaccttctgtagatgatggttcagttaaaaatgaaacacctaagatgcaagaagccggtgtgcggcagcggaacattgtgaacaaattctgaatgcttattaagcacctagcccttacctgtaactgttgtgggctggtggcttagggtaggaacaaataaaatagaactctttctctgaaaaaatttggaggtggccactggcattaaggaaatacttataattaaacacgtgtatattcagaggctggggagatggctcagctgtgcaaacatgaggggcctacgtttgaattccaagtgcccctataaatagacaggtgcagtagcgcacacacctagaactctcaat

SEQ ID NO: 25082 - DNA, 1144 bp, Mus musculus
ggagctataactcagtagtagtgcaggggcttagaatacacaggtcctgagttcagttccaggtccttaaaacaaacagacaacaaacagtccgtccctgcaagtgtaaagtagaagacacagctcttactatcctagccggcctaggatagtaagacattgtatctaaataagcaaagaaataataaataacaagacgggtaaagaaaaggaaaaaggaaggaaaaaaagtacatactaatcccagctctaagaagatattgttactgagggtaggtgcttaaagtaggtgcaattcagacattggtacttcagctccatagtgaagctgtcagaggcctgtgacagagtccttgagacagaccctggtcaccccagaagcctggagacaaaagatggaggccggagtaatgacttaatgagtaaacacattggaagccaagcctgatgacctgaggttttttcctggaccccacatggtagaaggagaggctagatttccaaaagctgtcctctgacttccaacaaacatgtcctttcatgagtatgcaagcagcccatgcaacatatactctaacccacccccacatcaaataaatgtatacacatacatatgtatatacatacacccatacatacatacacatacataatacatacacatacatacgtatatacatacacacacatacatgtacacacataatacacatacatacacatgcatacatatacatacatatatacatacacccatacatacatatacacacaatacatacacatacatacatacacatacataatacatacacatacatacgtatatacatacacacacatacatatacacacataatacacatacatacacatgcatacatatacatacatatatatatacatacacccatacatacatatacacacacaatacatacacatgcatacatacacatacataatacatatacatacatatacatacatatatatacacacacccatacatacatacacatacataatacatacacatacatacacatacatacatatacatacatacatacatacatacatacatacatacatacatagaaaaagctaagcacggcagttcatacttataatcctagcactg

SEQ ID NO: 25083 - DNA, 1133 bp, Mus musculus
caggcggatttctgagatcagcctggtctagtgagctccaggacagctagggctacacagagaaactgtgaaatggaaaccaaccaaaccaaaatggaattcttacctgggagactgttctctagcctttcctctaggataatggtagtgcagctctggatggagcacataccgtattctcaggctttgtaaactgaactacctaggctttgataaccagaacttgcccacagcattaatgggaacactaactagctctatgttaaaggcaacatcgttaggcaccccaacttcatatattctactgggtttgccatgtgttactttgtttgaagaaagaatgctacggagtagagtttaaaccacagacttaggatataatttttcttaacactgacaatgtaaaaaatggattagtaggctatcctttctttactctcaatactgttaactaaaacagaatttaaaaactgttctttatcctcaaggggttttatggacaccagcttcacgatgtcttaatcgctcctggaacagcagacctgacagctgatgtggacttcagttacctgcgcagaatggcacaaggaaaagtagcctctctgggtccagtggaacagcgaacatttttaaaaaacatgggcattgatgtccggctgaaggtagtggtttatctcagtaacactaaacctcttaatttcggaaattatttaaattgagctacactggcgttaatgctcttatagcgagcaggcttcaggtgtaattttgcacaagtaaggactggggtgtgcacagcttgccaagtttctatgtgaggctgatacgcccaagaaaaccacgttcatgggtatgaaatcatgactcctctgttgttacggagcagatcgcctgggatatctgctaacgatgcagatgtatacatttggatcacagcatcctacagttagaggacactgtgatcccatctggggaattgctgtactgcatcatttacatcattagtcctgtgctggggaatgcttttcttctggtgatgttccttaaaggcctttctttccgctcaggttctcttggataaagcaggtgagccatctgcgaagcagcagctacttggagggtatgatatgtta

SEQ ID NO: 25084 - DNA, 2395 bp, Mus musculus
aggttgattactcaacaggtttgcagttaagcagtaaccatgaggctaacagcatacagcttgctgtaaggacctttagtgtttgtccactgtcggaggcattgcttcctccttcctggacccgataagcagaccattgtactgctggccttccggtggatgcgtctttccatatggcctgtatgacagaagagttgtcacattttccatgttataacagtcactaggataatcgaacaattggtgttacaaatgaatagaaatagctggtcatcactcagctctgcctctgaacacgtatgttctcaattggcaccatcatgttacagtatgccacagtcggtgggcacaacgctgcatttaactaatttatcctcacctggagttgaataatgtatagacaaaatcacatactagagagggaagctaacacaggtcagtagatgtcactgttatctgtttcctcttcccttggcctttggatggggtttccaatacctagtgtttttaaattagcattgtcgtttgagcagtttggaggagtgactgaagtcaaacatgaaaacttagtttattgaggtgggacctaattaccagtagagcggatggagaaggagtaagaacgtcttacacttcagctccaacagccagctgttttgtagtagttattaatacaaggtcagtatccctatctgagctgctctacaccaggaaggtttcactgccagatactgaaatgtttgcacactctactagttgagcatccctgacctacaaatccgaaatcctccaaattcaagaaactttggagtccttcagatttccacattagtgatattcccacctgtgctttacccaaagagaaaaagatccaggaccatcctctcacaagaaatatagtagctgtttgtttcttcattcctcactagtcacaaaaaaaaaaaaacaaaacaaaaacaaaacaggtttttcttgttgtttttccttttctgtgctgagagcaagaatttggaatgagaaagcctgggtttaagcctaagtgtctttactctgtggatctgtggggctgagcagataacattgtctgagcatttgtttgacttagtttctcagtctgtagagtagacaccataaattcttccttctgccttcctccatgtggctgtgaagattgggctatgtgaccacttgtgacaatctggaatgccagggttgtcgcttaccacgggctctgagatagcaaaggaaaaactgtgtgtgtgagcagaccaaaactaagtgccatcccagatgagaatgcagctgcagtgatctgtctaaaattaaaaatgttcttgaggtgacagaaacagcaggggtgcccggttgtaaatgtttatgctttgaactgtcctcacaatagtcacatgactaagcacacttaaagttgaggcacagggttagttgtcaaagtgcattgagtttaaatatggatttaaacccaggcctatatccccaatccctttacccgtcccagccattgacaatgtactgtacatctgtaagaatttccagaagactttccaaactgtctctgtaattgttttcatacagtagttgtgaagagtaattttaagaaacttctaagaatggatttttccatttctgctaagtctgcttgaccagtatgtacaaggtggaactcgtgtgtgtcactaggcagcccacggtggttttaccatgggaggtgagaactaactgaaatgactgctggtttgctgtacttctgtaatcagactttacaagccatgacattaattgcactctgtttttgtcaaagccctgtgctgtttaaagagagactgtaaaggcgctgtcacggtgcggagttgagtaaccactccactgtttaacctgcataactttttgtcattgtcttaaagccaagctgtgtttgcatatatgaaagtaattgtttcttagaaacatgtgacaattttcaaagtagtgtataatgacactgtttagtacattttatattttttgttacatcccactttttgtaaatattctcaaaacttgataataaaatgtatttctctatcaccatactttcctatgtgaaaaccttagaccatctctagtataaggatctcaagagagttgtatttggttataatattttccccgggcctgagtaacaggagtttttttgtaaatatagccaatgctacatgagcacatatatatttatatatcctctgtgaaagacaaccctttaaagtcatttcaggtgtatactgcatttgagataattatctagagggttcatttattggaatacaatacaaagaataatgataattaaatatttgagcgactatcctaggtattactaaaagacttagaaaaatca

SEQ ID NO: 25085 - DNA, 1874 bp, Mus musculus
gattgcacatccgtctcataggatttgtaaatggtttgagtaagaggaaagtaactttcgttgcattataaaatgtcttaactgcattgtttgtagcatcataactttttctttctttttcttttttctttgttcttttgggagaagcatctttttatttctcacattcctgattatttttgtcattaatttaaattgaattttttatatctgtttttatatgtactctttttttacctcatgcttttgtttgttttgcacatttctcataccacaggtattgaagcccctgggtgataatttgatggaggaaaacataaggcagtctgtaacaaactctatcaaagcaggcctgactgaccaggtgtctcatcatgcccgattaaagacagactgacagttcatctgctcatggactccactctcccttgttcatgcttgctgtacaatgagaactcagataaaataaaccaaagtttacaatcaactgtagaagtagtttagtgtaactggcttcacagatggccgccacagagtgtgaacgttgtttgttggtttgcagccttctttgctgtctccttagactcggtgactgcctgaggagcatcaggttatcatgcacacttgtgccatggttaattcttttctttctttttaccgaattcaatgttagtgaaatttgtcttatgtaaaaggatatttcagggaaatattttaagaaatctatttagagtctctttaatatagtgtcccattgaaattttaatttttagagaatttatgaatcactgtatcaagaatcagatgggaatgacaatgaagcctttaccgagccactacattaaaagtgtatattgctttactgccttcaattgccagtattacataaatgcatgtttcagaaacttcacacaaatcacatgagaactcttgtagctgagaaggtaattctgaggtgtacatttgtcttgcctttttaaatttgtaaacctgccctgaaaggagatgcattatctgggaaactgaactgtctttttgcagtttagccttcatgtacataaaatatgccattaattttattgggggaaaaattccatccaaaaatgttgcctacagctatgagttaagagtgtctacagcgtgtagctttcattttctaaagattacaggtagggcatgtatatgaattataaatatataaatacaattttgtattaaaagttttgtagtttatggcaaaacctggttctgtggtaggctactgagtccagtcctgtgacaggagtgtttgtggctcgtgtcactgtgtgaacgcatagacagtgtgaagttttgatatatttgtgatatttatcttccctgagcactgcagtctcacccccaagagaattcaatgggaatgttttattgtgacttgtcctctgttgcattttaaagttatttcctgtaatttattttcagtacataattaaaaatttgttgtatatataaaacgaaagttgtgattcttttttaaggaattctttcaagtgtgtatctcaccatataacattgttcatgctgaaagagggtgggtcagggtgcaccgagttagagctcaaggtattgtactttaaagctgagcgtgtaaaaagttatttttcgtgtctttttatgtaagggatattttttgtgataatctatctggggatttaataattttaatcttttctccatctcttcccccactcccatcgtgtgtgtgtgtgtgtgtgtgtgtgtgtgtgtgagagagagagagagagagagagagagagagagagagaatgaatatgtgtgtgtttgcgtgtgggctatatatgtaaagctaccatttttccagtacttataacctc

SEQ ID NO: 25086 - DNA, 1121 bp, Mus musculus
gtgtgtgtgtgtgtgtgtgtgagaacagtttgagatgtagtgtcaacatacttgatgtatgcaataggaaaagcataagtttgattcagtcatgggtaagagcatgttttatgctattggacactgagaagagatgagagagtgtcttgggactatcgcctttggctactttgtggtttctttcttccacccttctccacccctttctgccacactttccaccccctagataagagagaggaaagagatccctgaataaagtcaggggtgggaaaggggcaactctatcgttagactacttcctgctgattaggggtgtccttggggcaagtttgatcttcgctgtcaggatatgtaattttttcttcttgtttcttctttgtgcccgactacttaacaacaacaaaggaccatcaacccacactgcctcctttggctctagcatttatatactgtcaggaaactccacagaattccaactaacacacaatcacagaaactctgcagctgggaaatcctggtcagtggctgtggacagtctgaagcagcccggtgtcccacacctgtgtggacagtctgaagcagcccggtgtcccacacctgtgtggacagcctgaagcagccccgtgtcccacacctgtgtggacagtctgaagcagccccgtgtcccacacctgggattcaagtgaaaacgtagtcttaaaatacttttgtgtttcttacagaaaccaaaactccaaaattgtcattatagacttgataagtagcgctcgactaccatttgttaactgttctgccgttgctcatagatctcggcctttcatttggtggtcatgtgtggaagactttcacttaacagccattcctatcaaatgacttctaaggcaggcccgacaccgccagtttgcttctgagtcacctgcattacaaactaaattgtgtgcttgtgtgaactcatgtagaaaaagaaaatacccccaagacatttccctccgtgtgtggaagatcaaaccgagggtcttccaaacatcaggctaagtgcgcctgcctccagagtggatttaggatccaacactccatggttgtatgattgaccttctagttgataggattctaggagt

SEQ ID NO: 25087 - DNA, 1279 bp, Mus musculus
ctcctgggtctggttgtagaagatcgactagagatgaccaactgcttcccgttccccccagcacacggaggatgatgctgactttgatgaggtacagtatcagatggagatgatgcgcagccttcgccatgtcaacattgatcacctccacgtgggctggtatcagtccacatattacggctccttcgttacccgggcgcttctggattctcagttcagctaccagcacgccattgaagagtctgtcgtcctcatttatgatcccataaaaactgcccaaggatctctctctcgctgaaggcatacatgactgactcctaaacggatggaagtttgtaaagagaaggacttttcccctgaagcactgaaaaaggcaagcatcacctttgagcacatgtttgaagaagtgccgattgtgattaaaaactcacatctgatcagtgtccttatgtgggagcttgagaagaagtcagctgtggcggataagcacgaattgctcagtcttgctagcagcaatcatctgggggaagaatctccagctgctgatggacccggtggatgaaatgagccaggacataatcaaatacaacacagacgtgcggaacaccagtaaacagcagcagcagaaacatcagaatcagcagcgccgccaacaggagaatatgcagcgtcggagtcgaggcgagcccccactccctgaggaggacctctctaaactcttcaagccccaccaggcccctgccaggatggattcactgctcattgcaggccagatgaacacttactgccagaacatcaaggagttcactgcccaaaacttaggcaaactcttcatggcccaggctcttcaagaatacaataattaagaaaaggagcttcctgagaaggcgttgagtagacagactgttgagagtccacagagtgcacttggaaaaacgtatttctgtgctgcaaagcaatggtggggaggcgcactgtgcgtcactgctgtagtggttttctagccaataataaaactttaattggttgttcaaaaaaaaaaaaaaaaaaaaaaaaaaaaaaaaaaaagagagagagagagagactacggtgtgactacaatgtagcctttacagggtaacagattttcaactttgccttctgcttctatcaacagacaaaaccacaataggaccacccgaaaggtggctgctttcgggtaagtatatttcaagtttcccacttctgctcagcatccaggccactcagtgatgtgttgcgcaccacaagcaacagttct

SEQ ID NO: 25088 - DNA, 1830 bp, Mus musculus
agtaacaggcagactctttatggagcttactgtctactaagtagggacagtgacaatttaccttacatacagatttccttcctgggactggagagatggcttagtgattaagagcactgacgcctccctttggcacccacatagtgcacaccacagctccagtgcaggggatggggcaccaggcatgcgcacgcatggatggtataactgcacatgtatttacagacaaaacactgatacacatagatatttaaaagtttttctttttgtattcttactaccaacagtaaaatggtagaataatttactaattcaatgtggtcttgaaattttggtgggttattaacttcaatttttcaatttttacagatggatccaacccctatacgttgaagctttgcttttctacatcatcccatttataagaagagaagagcatgttagaatttatgttcatctttattgcagttttaaagctatacttcatccataataatctaaaatggttggtctaatgttgccttgcttactataagatcctgttctgtaataaacatattttgcctcaagtaagtttgttgttaacttaaatattgttttcaccttaagatagagtaccataatgtagactgtctacagcttctttgtagattatacaaatgtatggtttctaacattattatgaattttgttccatggtaaaatatatttgcattcttaatagtaattatctgcagatgtttttccattgtgtattagattaatgcaggtgaaagtattgcattttaataccgaattcctacaatagatgattgagtctgttacagttactcatattaaatataatttgtatttattatttaatcaaatttgagaatgacgctgcatatgttgacttcaggaactacagacttagctgacgtcaatctctaaaaggcttaatagacacgaacacacttgtatggtatgcactcaaactcagattgctgtttcttttaaaaagtcatcatttgtattgacatgcttctgttcctagttccagtttggaggttttataaagttataataataagttaatgtgttcatcttcattattttgcatgtgacctaatctgaaaagtacatgtagtatttgacattgatattttaatactgtagaagctaaaattaacaattcttctatataataatctgggttccataaatgagtttcagagaacttgtgagcccttccaaaattgtgtgtagagtttggaatatatgcatttttatttcttaatctttgatccatcataatatatgtatttttctatatggtgtaagatttaagagttaattttatttttgatcaaaacagctatttgtctcaacaccatttattaaacattctccctctgggtttgtttctttctcttttaagtgatcatactaaggctgttgttcagtttacacctttttaacaattagagaatgggtgcagtcattttattttcatcttaaaagaagagaggatatgttttacccgtgtagactctgggtagtccatagttagcaggagcaatgatatgagctttagattattaattagatttttttttaaaggcttttttggttggttggtttgtttttgtttttttggttttgtttttttgggttttttttttttttttttttagataagtctcaatgtaggtctggctgtctggctgtcctgaaatttgtcctggaacttgcagtatagacctggctggcatcccccagagatccacctgattcagcctcctcagagctgggattaaaggcatgtgtcaccacacctggacgttgttt

SEQ ID NO: 25089 - DNA, 1193 bp, Mus musculus
tatacatttagcatttatactatgttatatattagatgtttagagaggtgatttgcattataaagaaggcaataaaatcaggcatcatggcataacctgtaatcccagcacttgggagttggagacaggaggatcagaaagccaaactcttcctcagttacatagtgagttccaggcctgcttctctcaaaaacaaaaacaagcgcccaaaaccaagagagtaaataagaagaaggttgtgcatagtttaaatgtacatgctgtagcatttggtagagacttgagtctcttgtttgtttattttccttggcaggagggtggggttcctggaccaatccccttggataaatggttgcctgcaccaaatttaaatagcaccttcttttgttaattcatagaaatatttgtgactacctgctgctttttgtctaacaagatatattgtgcttttcttttctaatcttcagtgtgtctaaacagcactcagttgttcccagtcaaatatttgagctagaggatggtacgagcagctacaaagattttgcaatgagcaaaaataatcgctttacaagtgctggacaagcatctaagaatataatccagccaccgtcatgtgtgctgcattattacaatgttccgctgtgtgtcacagaagagaccttcacaaaggtgggcactgaagaaagcagtgttagaatgctgcgctttgtgttttacgtttatgtagtatttcatagttcagcctcatttgagaatttttctaaaatcctgctttttgttgttagtttggtttgggtttgtgtacgtagagcctacaggttggtggtgttggatggtttcctctgttgatctccaccttgtgtatattcattaaatttgcttttaaaatatgaacattttgccagtggtgtggtgcacgcctttaatctcagcacttgggaggcagaggcaggtggatctctgcatttgagcatagccaggtctacaaattaaattacaggacagctggggctatacagaaaaaccctggagagagaaagagagggagagggggaggaagagagagaaagggagagagggagagggggagggagagagagaaagcatgaacatttcattttcatgcatttgtgtgtcatccttgggcaagggccatgctaagtctttgtgtccaattttagcctatgcattgc

SEQ ID NO: 25090 - DNA, 1242 bp, Mus musculus
attgcgaggccacgttggtgacgaggcacactaaataaacccctgtactttccaggcagaccatgtgcccatcgatgtccttggctgagaattcgtgcatggagcgagcacagcgccaatcattgcgggatgcacacatggtgcctgccagaccaggcacagcccaagatctttcttttttagaaatgaaaatttcagagacaggcatattccagagtttgagaccaacctggtctatacagagaaaccctgccttgaaaaaccaaagcttgtagggctgggtgtgtgtgtaggggcttactagaaataaaaatttcaaatcaaatttcaatttattttcaggtccttctgctaacttgtaatcttctttctttctttctttctttctttctttctttctttctttctttctttctttcttcctttctttcttcctttcttcctttctttaatgtgtgtgtgcttgctttataatgtagagttgaatttactgacaaatgcagtttagccttttgaagttaattggaaattgttttctcttccctaggagggaggtggaagtcatcataaagtttctgtttcccctgttgtccatgttcgagggctctgtgaatctgttgtggaagctgaccttgtggaggcactggagaaatttgggacaatatggtaaggagagtgggaacctcatagatactgaagataatatgggagggcgagcctcgcttgagcgctctgagttgcttgtatgtgctgtttgcctgtgtgtgctcttctgtggaaagaacctctcacccccccccccttttttttttttttttttttgagaggaggcattcctcccaaaggagggccagcttggaacttgtatttattccatctcagcctgttgagtgctaggactataggtgtctgccatgtttggaacccgccctgctccccacccctccctttttttttaagtttttacatttccttatagtgtgtggaggtgagacgacaacttgagaagactccctcgagtcaagtctctccaccttgtgggacccagggattaaactcagccctaggacttagatgtacccttgaagggagaggtcttgccagccccacctttggagatttctaagcttgttactacgttttgtattctggtgctagagattgaattcaggcctttgtgcactatacacgctaagcagacactgccactgagccctgagcttgttctcagcctccctgagg

SEQ ID NO: 25091 - DNA, 1115 bp, Mus musculus
atctttctggagttctcacagacaattcctccagacttcatctaatcctaaaataatgcctaagggcctaggtgtttatttcagccattcccagaccacttctcctgcctccacgggtcctctccatccttagtcatcaagtcctgctcagttttagcctctgatattcctcaagtctctttagtcttccacattggttataggactctgcccatcaggactctgttggcttaagtgacttctctctctcgctctctctctctctctctctctctctctctctctctctagtcaaggcctaactcacactgtgggaacataaaattttgatcaataaatgaatggaccgtgaaaataaaaccttaaagatttatcctccatcaggttcctaaatgtatctgaaatgcaaatcttatttccatcctttaaaatatttttgtagggtctgggcatgtgggttacttgcctagcatgtgtgaaagctcagagtttgctccccagaactgcactgcactgcactgcactgcactgcactgcactgcactgcactctgctgtactggtacacacttctagtcccagcactcgggagatgcaggcagggtagtcataaatgcttggtcactcttgcctacataggaagtttgagattagccagggctacacacacacacacacacacacacacacacacatgcgcagacacacacacacacacacacacacacacacacacacacactttctcattgttacccagcccagacactacgcgattttccaggctgctctgccatgccttgctcgcacctcaccagtctctgaactcccatccccaccttatggggacagtaactaccggctttgcctcctaaatcctctctcacccttcaaaactcatattttccccttgcccgtccttcccaaccttctccagtgccgctttgtcacctgtgcgtggttttggtaaggtttggtgccatgtagagtttcttaccagtccagctccctctccgtctgtccctctaccaccggagatgttctccggacatctgtcaggatagctatcaccccaagaagggtttaatgtctctggtttaaagctagagaaactaa

SEQ ID NO: 25092 - DNA, 2127 bp, Mus musculus
tgtgttagatctttggtagaaggtatttgatccctttgaatgtactgaaatactgaattgctctgacttgtacacaagaagcttcgttacactaattggttccaaacttaatgtttttctttttagtcgttccccatcaggaagtccacacagaagtgcaagtccagaaagaatggactgaagttctcaagttcacccgttagggaaaagttattttgtttacattattataagggatttgttatgtctgtaaagtgtaacctaggaaggatcatcaaccatctaatcaaaatggatctggattattactctgtaaaattcacagcagtaaatattgttttgttgaatgtattaacatcttatggtctgaaaatgtgggtttttatttgacacgtttaaataaaatgtttctaactagatgttttgatttttgtgttcaatattaatacttttcaattgggtaagcatcaggcaaggtaacaatcaagagaattattggccatatttatatgggcctgtattcaaagtttaatggtgttagttaaacatcattaactgttctatacgtaacactggccaggatctgaaaggactttgaaattttcattttactcttgtacctttgggtaagatgatctttgagtccttaatagcatgagtgcatcatgtcagatctctaaattgagaattggtgttaacaatttggaattgtcaagcttagagggaccactgataagcctacaaattggtgcatgacagaaaataagcagagttactgacatgtcagtagaaactgatttctagcggctgagattttagtagtgtagtttttcaggctattaagttgggttaattctgctcaatgtacttttttcctttcaaacaaccaatttaataccaaaaaatgcatgtttgaggaattgtctgaatttggaacaaaaccttgtaaaccagctttgcaaaattatccagccccagtcctctgttcttttgaatggattgccttatcctgtgcaaaaacctgttaatatctgagctagattttgtatgaagctatgtgtaattggcagacttatctgttgcacttggttagcttggttactgacattgttctattttgccaagctggtataaagagatgtcaagcaaagtgttaataagataaagcagttttgtaaaccttacatattagcatttcatgtagctaaggattgttatgtttttgttttgggtttttcctcctttggtagtgtctggtagaccttagaatggtgtagccagtaggttcttactcagactttaaatatattatgcataatagggcagtaatggtcattttcaaacgttttttggacaagctttttactatatttcttagccttggtgtaaaaacaatagcacaggaatctgtccttgtctattttaggctttttcatcgaagttgtctgccccaaatttatttggctgagtggtcactagtatgttgaaagtcatttgggttctgtttttagaatttgactggttgaataagtggttggtatgaagctatgtgtaattggcagacttatctgttgcacttggttagctttaattgttctgtattcaaaaattaagtttgttcaataaatctgcagagattgaacaaataatcctgatattcagtctttggaagtatgatatctgaatcaaaaaacaacccatgtagcttttaaagattagctagcagtagcattctagatatatataacctaaagggatgagaatggagtaaagcatcttagtaaacagttaagcttttacaagagcttgggctgtgtagtcagtcagacacctgttaggtggtatccagtccatttagtacacttagttttttggtagttgagaccaccactgctagacaagacaggaaaagtgctgatacttttttaacactagttttaaatagcccaggccctgttgtgaatgtatgtatgtatgtattaatcattttagcctttggggaatgaagccattaagatcaggaacctatggtcattctaggctacataagccattggcattctggaggctgaggctggaggaatctagagatagagtgcaatgtgggctacagtctgaggctcctta

SEQ ID NO: 25093 - DNA, 1094 bp, Mus musculus
tcggggggcggggcgggcccgagccgggccccacctccaccccgcacgcctcaagtctaccatgctcccgctgcagtctcccagggtttccttcctataagagcgccagaacttggtcgcaggtctggctttccagtctttcacgctgtaagatttagtacttggtgaagacctctaaataaagggagccagacctggtggtgcactagctgcctcagggaggttgaggcctgagagtcgtttgagcgatgtatagctaacatagttgtagggtggctccgagtagatcacttagctggctcagagtctccaaaacaaaacgtgtacgttgcacagctctttaaggatggtctgttttaaagaaatgaattccctatcacacgttgaataacatttgttctgtttacattttttaaacagaaaccaaggtatatgttggtaacctgggaactggtgctggtaaaggagagttagaaagggcattcagttactatgggcccttaagaactgtgtggattgccagaaatcctccaggattcgcctttgtggaatttgaagaccctagagatgcagaggatgcagttcgaggattggatgggaagtaagtgggttgtttttcaaatttctttaaaatattccctcgggctggataagtaatctcggtgctaatcatagactctctgggggtggaccttatttttgatagtgtctctggcctatgttgacctggaactcaccatatagctccggtggtggttggagccctcattctgtcagcctctcacatgccttacccttcaggcactggataacttaagatttaggactaaaggtggaattggcggggttttgtaaacaaaagactaaccgtgtagagagaatgagcagttgacatttttttaataaattaatttttattagatattttctttatatacatagcagttgatatttttaaatctagaagtcacatgtgtattctaacattagcattttcttatgttttgtagagtgatttgtggttctcgagtgagggttgaactatcaacaggcatgcctcggagatctcgttttgataggccacctgcccgtcg

SEQ ID NO: 25094 - DNA, 1170 bp, Mus musculus
ctgcctgtcataatccgaacccactgttaagagaaaaaggccactttgaaagtttgttaaaagaatttttaatatgggtaggtaaactttaagtgtctctgtagtttattgctaagaaaactagaggacaagattttaaaggcttttcttaaagcaaccctgcagctgggtatggtgatccttgtctgtagtcttggaattgaggaagctccttccacttgtctcaaagccatgctgtgctgtgtggcttagaaaggtactcaggaggagctggagagaggcctaagagcacttgctgctcttgcagaggacctgagttcagttcccagtgcccattgtcagacagttcctcgtaaccatttggaatacagttccaagggagcctacacctctggcctcgacgtgagcacctgcactgtgtgtacacacccacaggcagacacatctcacataattagcaaggattaaaatcatcttttttttttaaggcatttcttaagaaacaaaagatccctctgcttcattctaccagctatcaaatttataaatcatgattttattctttttcagaattaaaattttagaaatgtttagtactcataatctccagtccgtgttctctcggctcattgaacctccacatattgattctcttcgtgcctcaaaagtacggttgcgagacttgggagccttgactccagatgaaaaactgaccccgctgggttatcacttggcctctctgcccgtggacgtgaggataggcaagctgatgctcttaggttctatcttccgctgtttggaccctgctctcaccattgctgccagcttggctttcaagtccccttttgtaagtgacatttgtctaaattggaattttatgtcacagttctcaaagggatctttagacttttgaggtatgtgagtgcatgtgtgtgggtgtgaaagatctcagagcacaatggtatgtgatccttagaaaaatctttatttccccatcccccaaaaaaccttggggattagaggtatagcttattaaaataataatatgctttttgtttactattgcttattttagaacaatcaaaaatagtaagcagcaagacaccactatataatttcaaaaggtagtgaacacatgcatcagctgtgaaaagtaactcaatagaaagg

SEQ ID NO: 25095 - DNA, 1189 bp, Mus musculus
atggacctccattccattgctgggcctcctgttcctccacgacaaagcacttctcaacttatccccaaactccctccaaaaacttacaaaagggagcacacacacccatccatgcatagagatggaccaccactgctggagaatgcccattcttcctgagttcctctaagctgggatagtttcctagcccccagatccattgctggcaatggatgcactgaacatgccagcactggggagttcaaatgagaactccaaacactaacgactctacttcacgatgtagtataagacaatgagttttaacctacatggaattatggaataaaatggtattccagcttagaatgtggaaactgattgcacctggaaatcacgtgaagggacttttctggccattgggcaggagtcctcatattgtgaagtgatctttatcattaaagggatggaaaacagtctaatgtccaacaagcccatatgttgacagtttttgtaattcaaaatattatgcacttttaaaaaatcttaaacagggatctcctcctttgttttcctttgctttactcttctactttagaatattttcgtaaaagttattcagaggactgtgagaaaaggctgtggtacctgaccttgttgaaatcaaggcccagcactgtactacagtcctgtttacagattattacagtgatctgaatgggtaccgaggcttcaccaaagaggtactttttgttattgttattgttttaagaataattatgccaattttaagaacatcccctacccacccccactcacaaacaaaatgtggtggtgttgcctttaaacaaaaaatgtcaatgtcattaacatgatggaagaagaacattttaaaacgtaactgtcaagtatacgatttacgcttaggagactgttcatctatgctagactgtcatcccccagcccctttgtctcacagaagtttactggtaatgtatgtcctggctcgtggctgtccctctaaccgtacacagaaacacaggcacccaatgtgaacgagagcactctctgggcctccctgacacctttcatgttttactaatagttgagtagttagcatacctagaattaccttgcattgcctaaatcatgtgtatatagtgaatgttatataatataccttgcaggtctgttattatttaattgaata

SEQ ID NO: 25096 - DNA, 1130 bp, Mus musculus
aaatgaatttaataagcttactcagaaaatattaaatcacatggaagtataggattaatctaaggggctttgcctaactttgagttagcttcctaacatatgttacctaggtaatgtaggaagataaaggaaataggctctgacttcattagaatataagtgttctgcagttttcctttttttttttttttttttttttttgtaaatttgctttttcaaacccttttcgcttatcagaagaagtgagcatttgccacaagccttgaaatacaacctcggctccatctgcttaggtcttgtttgtggtgactgagactctgactctgtgaattcagaaaatgtggcttggggatggggacctaaaggccactcctagatgaatacatataagattacaacatcacagcccactctaaaggctcagggagattgtagctggggatggaccacttaagcattagctagggtctgtcccacactaaccaagagctctcctgtctgagtgcttgggtgaattccttactggattgggtctttttctcatgacagaaggaataataaattcaagagaatttcagcctagtgtagaacatgcttacagcatccagggcctggaacaaagattcaagactagccttcaaaatggaaaaacaaaacaaaaacaaacccatatacacatacatttatgcatacatacatacataacgtgtgtgtgtgtgtacacatacatatagtgcctatagcaataataataatattgtatagttttgaaaactgctgagcagattctaagaatttacatctgagaaaaatatttgacagtatatatttttaaatattttgtcaagcaccatattgtataccataaacatatataatttttacttgtcaattttttttgagacagggtttcattacttgtcaattaaaaagtaaaatttctcaaataaaaaattttattaagattttatttttaatcatatgtatgcctgtttgtgcgttcatgcgtgtgcaccctttctgtgtgaaggtgcctttagaagctagagttgttagacaccctgggactgcactttcaggcaactgtgagcaactgggtaggtgctgggagacaagttctggaagaacac

SEQ ID NO: 25097 - DNA, 1189 bp, Mus musculus
atccttattcccagaaagccagttattttatgatatgttaattaaaggttgatagaaaaattacatgaatgttagacagaaaacaagaatatcacagttgaatagacaattaaaatattccttcattttcccattacatgtctggtaaacttatgtatctagataaagctgtactttatcctgttctccagccacaacagactgaatgcagagacaaatagaaaagtcctgttctctgttaaactgtattgaagattagtaaagagagtatgaagatgttctaaaacaaaatgattggtagagagacatatttcttaattgtatatctatcactaaagaataaattttgaagtattttcttattgtaagtcattaaaattcctcaatatctacattataccttgattataaaataatttttttactgaaaagatatcttgttatacaatacaatatgattgaattaatttttctttctcctccgcaggatgtagaaaacatattcagtcgtatagtagatatacatgaacttagtgtaaagttactgggccatatagaagatactgtagaaatgacagatgaaggcagtccccacccattagtaggaagctgttttgaagacttagcagaagtaagtatatcaattatattgtcaattatatagcaagagaagtctgtctgtaagtacattggcattaaaatggggttcataattcctatttccagctcaagtcacataccgttgcttcttttccatcataggtcaacatttattactgttaccaggtacagaaatagttatcaagcactacgcccagtctcggtgtcactctgaaactttgatagaaagatcaaggcaaggccacccgtgagtgagaaaagcttgggtgtagggtcctagtcctcacagctcactgctcagatcactgctgtgtattacatgtgtggctccaggcgagttaccgatattttgcttctctatacacatttgtaaagcaagaagaataacaataagaagtctcaaattttttttttgtaagttaagataatctcccttaaatatttggctaattccctttacatagtaaaataaccagtacgtgatagccacatttgtttttagaattgaacaatgaggtgctaggaaactcagcccatggcatagacagttcagatcccatgggagtct

SEQ ID NO: 25098 - DNA, 1929 bp, Mus musculus
tacatcttggcgggtcacgaaaacagctactgagacacggtgttcttgacagtgacctgtggagacagtgaccacagctgctgcaacgttagtggaggagtgaagctatgcagaccctgcaggaacctagattctgtttcttataatttattgtggcatgagacagatgggagaacattttgttttaagtggtatggatatatttagcatattgaaccacacaagtgcttaattcattgttatgtaatctttgtacatataagcagtatttttctgtgaaacttcatattgctgaaggcatacactaagaatttatgtagataatgtacttttatgagatgtaaaagtgtcttatctgtacagatgtaaatgttgatgaaaatgcaactggggttaatattttaagaattctttagtatattcttgggtgtggtcatattacaaaatgggatgctggcaatgaaccaagacattaacactattgtatttttattatatataatttagtaatatggacataaatcctgtaacttttaaaatggtaacgagctgtaatcattttataatcttgtttttaattttaatgcacgtgcactggtgtttctcctgcacagagtattgacatgtgatgtgttgtcacagagagcctgtgacacccaccgtgaatacaacatcttttttacatgtatttggattgttttctatgtgaaacaaaccagttaaccacctgttgtagtaactgatctttttatatttaaggagaattgtgtaagataagcttgtctgtgcttaggatacaccttcgcaaaaacttaaatcatggaatggcggtaccacggtagaacactgcagctgtcgccagggttacagtgcgcataagagcaactcgcattgctgaggagtccgcactagacatttcacagtcacactgaagagctgtcacattccagagtgagctgatcaggtttctcgtgggcttttacttctgttggcattagtttatcacttccatatttctttagattttgagtattaatacatggccaaaataatttagttactacctcatacaaacattataatggttactacagatcacaagaagttagtttggttaaaatcattgttgattggttttttccaatggagtgtatctgtcttatcaagatagataccaagttgtagcaaagtgcacacctctgactctctttggtatatgttcatatgttctttatattttgatgtgagtatatatacactaagaacaagctaaattgtgatttatgcttcatttattttaactgataatggttttaaatacgttcctgattgtacatactgtaaaataaacatgttttttaacatgctgttgcgtagttgctggtcagtcggcttagtagcattagagggaaatgcttcgtgtgcagtcagatcgtaagcatccagttctcccatgatcatcattgtttgatctacattttaaatataataattcccacatttgagaaagagggcatcttttgtaggatcttgaattcttatcaggaaaaacaaacactcatagtgttttggttgaagctggagtaggcagtttatatcttagccaggtatagcccacctcctctttttattaataaagttgtgtgagaacacagcaccacctatgtgacctgtcacctaaggctgtgcctgtacttctgtgtcacacctgagtggtttcagaggaacaccggcctgagagcagacacgtgagctctcaggccctttacagaaagtaggctgtgacagcctgggagagcacagccaaggagcgttggggacgccgttctgagggcaggggcaggaggagacgtgggaagaactgactgagtaaccaaaacacactgtctcttagggtgaccttgggtcatttagtccagaaccattggt

SEQ ID NO: 25099 - DNA, 1147 bp, Mus musculus
tagcaacagccataaataaaacttttagatgtcttttggaaaaattcccagaaaaatattcaaataatcaagatatcatatcttatattgttggaaatgccaccttgtcttccttttaagagtatagagcaatacagatttatttggggcttggggattttctttttaaaaagataatgtatattagcgtatagtgattgcggcctgctgtgctaagtcttctgcttcctgccgctaggatctgcaactagagtacggacaaggacaccaaagccattgcttcttaggtggcaacaagtaagtaaagttcttttgaaacttaaattctaagtaattgtcttcaatattatattttatatttaatatttaaggtagtaaattttattgagccagtatatgtcgtgcagcgtgcccttgaccttcccatagtcttcccctggtcagtagttgtcatctgggaagatcagcctaaacagcccaacagtccatattggcctaacctgcagctcgttcttgttgcagtcaccccagctgtgatgaatctgtatctcagcggctgatttctttctagagtggacctgcttaccctctgcaaaacttgcttgatgcatctctcagataagctggccactaagagcagctaaaattttttaaaatcattcacctgcttagaaatccatgttttaactttagctgtgctggtcttttaaagaacactagtaaaataaaataaaatgctagtaaaataaataaaagtagacatgcattcatgaaagctatttcatgagaaaagtagattaagacaccatgatggtgagagcatgatatagttagtttacagacttgtgtgagttcgtcatatgccagggttaagaatccagaactgcccatccttaattcctgattccatagatgaattttcattctataagccaatctgtaagggagtatttgaattaccaaagtattctggggatatatatatatatatatacacacaaaattagaactcaaaatttcaatctattgattacactagagagctgagacatctattgccatacttcaaattaagaaacaatgattactgacagacaccttagtttaatgtaaaccatgtctttctcttctataatctgaacacttc

SEQ ID NO: 25100 - DNA, 1157 bp, Mus musculus
ttccaacaatgccatatttatgtagatagataggtagatagatagatagagacacagagagagagacagagagagagacagagacagagagacagagacagagagaaaggtagttaccagcctcccttgttaccagagaaaagaaaaaccacttcaacaccaaagaatgaggtcacaagccatgcttcaatgcaggggtaacacgtgctctttatgctcctacacgtaatagttgaactacatgcagtctgatgctggcctcgggtgtctactacccaccagaagattttcagagcatacaagtcagtaatcacaatggtgagatgggattgaaaggcttggcaggtagcatgctcgtatggggtggcaggagtgcattgaaggacttcaaagccaactctaaagagaccacattcatgcgacttcagtcctttcttcagcagctctgaaggggaacagacaggaggcaggtccagttctctgttgtctgaaaatgaacagtcaacacatggttacagtactaactacttcttttacctgcaaacttgcatatgccttttagagaacttgggagaaacagctgtagtaccttttcctgagcacaaagtgacctccttccctttactgcaagcctatgagaactcaaatgtctgcctttacagctttaactagcacttccccaccagcaagtgtattgaagaggccccagaaagactgtagtaaccaaatatgaaaggtaatagaaagacgccaaaccagctagggccagcagtctgtgggcaatcaggactacttactgctgcttacatctaaatccttgatttcatctgctgcctcagccaccccacaccattttttcctagctaaaagcagtaagaaatgacacaggcagaagatagaaagcagtgtctacaaattagtagaaatgatgatattgtaatatctgtatgctagaaaaatagcccttaatagtgagaggaatataggttgtcccagttacaaattgtatacttttttttccatacatggtcttgctatgtagcccaggctggcctagaatgggagatcctcctgcctcatctccctagtgctgaatcacaggtgcccactaccaggatgcctgccctgttcaacatttcataacctggataattgca

SEQ ID NO: 25101 - DNA, 1195 bp, Mus musculus
ctaaagactaaaattccttttgtgcttaaaattcagctgagagcaacagctctcaaagctgttctccagctactctctgagccagctcccgacaggaggccggagactagcctcagctttacaatttgcatttgaataaagtacctagacttccccgaaagaagttctgctttcctactttctcactgtctttcaagattttgtctttcaagcaggtaaatcaacattctcgaggtggaccagcggatgtgcatccccgcccccctagagcacacaggtggcagctgttatccccagtctcaggacatttccagcacgtggttttcagtctgagttaaaaatttaggtttacctagagggctagaagagtagatatttctatattaataaagattggtttttattttgatagacaggcttagccccttagctgacctctggcttttcacccttgctgttactgcaaggtgtccttagctcaataggctgtggaaaaaacagggatgaggaggaacgacttccagctcctattttagccacaaatcatggtgttactaacgacataattcttgcttaggctttgctaattctgaggttggtaattctcctttaggagctgcacagcactcagaactgtgcatactggtttgtgattgtacaaattcagtatgggcaccgcttggtgcagaggtactgcaagggaaggtccggcttgaccatttctgagtttcctgtgagataaacccggtttaaaagaggttggtatcatattttggttaaaaataaaaaatattttccggctctacctcgcctccccaaaaggtaccgagagccacatgtgtgggttttacccacgggaggaatcgggtccatgtccacccaagccaaggttaaaagcccactcatctacggatgagaaaatcatttgatcacctcagttaagcgttgccttatttaacttaattaataggggggagagagattggagacgtactattgaaagggcaagcccttcactgcctcccacccaaataaaagagccggtcgaacgccttctccctgtttcccacctatcatccaaaaatgcggaggaatatcaacttagtgttattttcatattgttcagtcaaacttagccagagttccaacgccctacttaaaattcaactagaaagttacctaccaagtactaatt

SEQ ID NO: 25102 - DNA, 1172 bp, Mus musculus
gctgtgctgaagtttgctgctgccacaggagccactccgattgctggccgcttcacacctgggaccttcactaaccagatccaagcagccttcagggagccacggcttctagtggtgacccatcccagggctgaccatcagccactcacagaggcctcttatgtcaatctgcccaccattgctctgtgtaacacagattctcccctgcgctatgtggacattgccatcctatgcaacaacaagggagctcactcagtgggtctgatgtggtggatgctggccagggaagtactctgcatgcgaggtactatctcccgtgagcacccctgggaggttatgcctgatctttacttctacagagacccagaggagattgagaaggaggagcaggctgctgctgagaaagctgtgaccaaggaggaattccagggtgaatggaccgcaccagctcctgagttcactgctgctcagcctgaggtggccgactggtctgagggtgtgcaggttccctctgtgcccatctagcagttccccacggaagactggagtgcacagccagccactgaggattggtcagcagctcccacagcgcaggccactgagtgggttggagccaccactgagtggtcctgagctgctgtgcagacgcctgagcaaagggaaaaaaatggaaggaaaataaagttgctaaaagctgaaaaaaaaaaaaaaaaaaagaaagaacaattctcaaattcatttggaataactaaaaacctaggatagaaaaaactattctcaacaataaaagaacttctgggggaatcaccatccctgacctcaagatatactataaagcaatagtgataaaaactgcatggtattggtacagaattaaagatccagatatgaacccacacacctatggtcacttgatctttgacaaagaagctaaaaccattcagagggaaaaagacagcatttttaacaaatggtgctggttcaactggtggtctgcatgtagaagaatgaaaattgatccatacctatctccttgcataaaactcaagtcctagtggatcaaggaccttcacataaaatcaaatacactaaatctaatagaagagaaagtggggaagagcctcgaatacttgggcacagggggaaacttcctgaatagaacaccaatggcc

SEQ ID NO: 25103 - DNA, 1158 bp, Mus musculus
ggccaattttcacataagtaatttttataaaaagcaattaatagtatattttattcagtgccccagtcaggcaggttattttgtgtatttctgttcaatcgatctatctatctacttatctatctatctatctatctatctatcttacaccctgattgctccccgatcctgagtaccctcctctagtacatcaagtctgtgtagggctaggtacatcttctcccattgaggccagacaaggcagcccagttagaggagcctattctggataggcaacagctttagggatagcccccactccatttgttcagggggctacattggggggggggtgttgctgctgctgcagcagtggcggtggctaggtccagcctgtgtgtgctcttttcagtccccagtatttctgcatcttaacaacattcttcagcatttgtcttaggacagcacatactgttccaaaagtataaagctgtacctgagggcctggggttcctgttcctgagtttgatccctagaactgacagggtggagacaagccaagccccagggcttatcaaactagttagtgtaatatgggctcagtcagagactctgtctcaaaaaataaagcggaaagcagttgagcaagacacccagtttcaatccttgacttacacatgcacatgtacacacatggctgcacaccacacacatacatatgctcacacacaaacatgcaacatacattgacagaaatgaaaagttgatctggatatttttaaagcagttacttgagtctgccactgtacaaagctggaagttaaggcttaatacttactttctgtgttatacaacctcattgacaaatctgttgaaagaaaacgacacttagaactcaagatttaaagcactcttgttgttaaacctcatatcatttgtggggcaggagtttgagcagggtaagctcactggctgacattcaactagagagtcctggtgagtgcttcgttatttgatgcatcggccggaatacttggcagtctaggcttttggaactgcccagccagcagacacatacacatgccccctgtgccactgcgtggttcaagttggttcaaggtagttgggcttcttcagtgaaaatttactcccggagaaagtatttcaggaaaccagagt

SEQ ID NO: 25104 - DNA, 1202 bp, Mus musculus
ggtctcaggtcaccagcatctttacctgctgtgccatcctgttgtccaccactttggtttgcttggtcttttacagtacagcccagacttgcttggaacttgagccaatcctaccaaagagatggcaggtgtgtgccaccacacccagccattactcttttaaaaagagattagactgttgggaaaaggaagatcagcaaaaagtcctttgttaagttcatgacagttctgtttttttattggtggtgtgtgtctgatgggttgccatcttgttttcctagagatacaagatcatgattcattaaaagggagactttgaatagcatgctcttgaaaactactcatgtctacaaagtgatgtgtgtagggaacacttcataagaaaactaaagtgctgtcaccatacagggggtcaattgtgggaaacatctttctagaagttggctcttataaacaaggcataatgtttgtttatttgcttgcttgcttgttttataaaaatgatttggtgtaattttctcaccagaaggaaattctttcttgaacagtctggttttaaaatagtcaatattttctctttttagatgatagtatttctgctgcaagtacctctgacgttcaagaccgcctctcagctcttgagtcacgagttcaacaacaagaagatgaaatcactgtgctaaaggcagcattggctgatgttttgaggcgtcttgcaatctctgaagatcatgtagcctcagtgaaaaagtccatgccaagtaaaggtaattagtgcattgtaaagaagagtcttgtgttttgaaaagttgggcatacagacatatctgcttatttgagttccttgtgactatagtagtttcgtttagcccctgtgtgacagcactgacatcccttacaggcttaggctcctccaccataggcgcctgtactggctggctttgtgtgtcaacttgacagaattatcacagagaaaggagcttcagttgaggaaatgcctccatgagatccagctgtggggcattttctctattagtgatcaagggggagaggccccttgtgggtgggaccatctctgggctggtagtcttgggttctataagaaagcaagctgagcaagccagtaagtaacatccctctatggcctctgcatcagctcctgcttcatgccctgcatgagttccagtcctgacatcctttag

SEQ ID NO: 25105 - DNA, 1138 bp, Mus musculus
ttcctgattccacctggaaagcctcatgtggggtgcgaaaaactcagacattggacaaaatgaggtgagcttggagaaggtcaccagtcctggaatctggcacaggactttattgctactctatacagcaaacagagggtgactgtccctcatttctcattttaggcccagcatgcttgttatttcctggatgagccttctcgggtcctaccttgtgctttgtaagtcaggtctccttacaggcacgcttcccctgagcacactgcctcacaggccccacttctgatttgttcagagctgtgtgcttagcactgtgcttggtacatgctaggagctcagagtatatttgtccaaggaatatggacattaagacaaatacagtataagacttaggtctgggtatgagaggggaaggtgagtgtcctggctctagtccggttttctctcctttgtgcctccataacttcttacacgccttgagtatttgctttaaaaccttgacttttcattcaagatacggttatcgaggaaaggactgtagagcgaatgtatacctgcttcccacaggggagatagtttattttatcgcctcagtggtagtcctgtttaattatgaggagaggactcagcgacactacctgggtcatacagactgtgtgagatggtgagtatcaacactgttgcatccgtgtgcctgcctagctcctccatagtcggcatcctcagagctgtactgaagttcaccatcggaggctgagactataagtaataatgttacatattatatacataataattatatacatgtatacagtgtattctatgcactatatttttaaagtaagtcattaacattcttaaaaacactgtggtgccgggcgtggtggcacatgcctttaatcccagcacttgggaggcagaggcaggcagatttctgagttccaggacaacctggtctacaaagtgagttccaggacagccagggctatacagagaaaccctgtctcgaaaagccaaaaaaaaaaaaaaaaaaaaaaaaaaacacacacactgtggtatcaatagcaatagaatacactgctctaaatctcagttaatctaccctgctgcttcaggtctgtatcccttcccgcctggt

SEQ ID NO: 25106 - DNA, 1142 bp, Mus musculus
tttaaagggattgtagaatttgtgagtgctgtggaatattgcagaaccctggtgtggctcagcctggcttgtaggaagattgtaagttagcatcgcagctgcatttacatggggcagaaatgttaagactacagaagggcttttataagttcttaaagaagactatgtttccaaggttagagatggttcagcaggtagaactaactggtcctgctcttgcagaggaccagctcccagcacccacacatcatgtaccacccgtgactccagctctctggaagtcaggcctccatgggcacctgcacttaggtgtgagcaagcacacagacatacatgtgcataaacatgattaacaagtaaaggatatactttgcttcagcaccttgtctcttttgttagggttatttttgataaattgcaagttttttactttttcccttaaaaatgggtttttgttattgtaacttctaaagcaagcaaggtacaattgattgtacttgaaattctctgtcagaaaatctcaccttaaaaacataagcgaagacaaataatccgttctgtataatttagagagcactgatgtgtaggggagttgaagcaaatgaactacagaagtgttttctcttttgtagttaggtctaccccgggaagtcctggttcccccgctggccgttctttacccctttccaggatgtgttgcaggccctctactgagagtgttcctgtctgatctctggttcagctttcccaggcattgtatatgaatgcaatctatcacaaatgaagaataacgtgtcacagtctcctgattgtcagtgtagatgctgtagtcattcaagaccacaggcttgtgcttgtctcttcccctcttttctctcatccagattcctcaaactcctagatgtccgttgccagaattggtcattgtaaagcaactaaaacttaactccagagtatttatttgttcctattcagggtagaaaggaaagccttgggggttgggggggggggagcattttgttaagaaggactgggttctagggctagctagatacctgggccttctctccccactttcctcctgcatgttattctagcaggagactgtccttgcctacatcataaagatttgagtgcttggt

SEQ ID NO: 25107 - DNA, 2605 bp, Mus musculus
tctgccacccgtgaccccgtgacgtgatggggccaggtaacgggccgggcagtggtgaggtcactgtgaatggaggtttgtttcccatgagatcggacactgtccgcagtccgatatgccaccagtgagctagagcaatccaggagactgtttggtagatgttcacaacttcaccaaacttaaatagcaggaggagactggcaggtgagtgtgtccaagaaatccacatttgtgctgcagatactggaaaccaaactgcagctgcagccattggaagaaacctgttacctgaatgcgatttcctccattttctcaacagctggaggcctctcaggcaccatcgctcgagtggctgctggctctcaagctgccattttttcctgatgcaaaaaatgaaagcaggcaaaagtgctgtcattgtgataccgtcccactcagatgtctaacgggagcttgcttaaggggaatgttagcattgccaagtgcgatggtgttgcctttccatgggatattgcattttcttacactacccgagatgtccagacgtgcttggtaggaggctactccctaggtgctgcctttctaagttctgacgaggagcagccctcagtggcttgtgtacagattgctctatcccagaagcaagccttggtttgttgaagagcttttcatgtatagtaaaccatgattctgagagaatcgattctccaaggagtccttcactggcctaaacattctgtaatgttgggcattcaagggaatggaagaaaacaaaccacatgcctttaacagatgaactgtaatgacgacctgctaactgctagccttcagcgctatctgttccctcacacagtcgctaagtggtcaaattggtgcttgaaattcattggtctagttgtaatttttatacaaattacaccaagagataagatgtcttttttttacagaagtgtaatagtcacagtgccgcttataggctgcacgcaccccttgcggatgtgctatctgtgggcatttcctcctcctgtgagccttgcagcccttgtatggcggctttggtctgggcagtgcatgtgttagtagtgtacgtgggcaggtcgggctttctaagctttgtcagataactatttttcctaagtatgtgtttcctactccagtgattgacaagtgtgcattgcctatgtttgtttatactttaattacaaaactattttttttaacttcctacattgttttcctacttttttgttgttggattatgtaacttttcctaagttcagaagtcttaagtgtgcaagcgtttatgtgaccgtgccattccagagtgcatcagaactgtcatcccttccaggaccttctcaggagtaacacatcaggtatgtcatcagcgctgggaaccgtgaacgccaaggacactcgccactattcacacgctgtgccgagggtgtgtggagggacaacagagagcagtgtatctgagtaagatgcacacatcgaagtgcgttcaaagtctgtgtctaggtatatatgtccgtgtagctctctccttttgtttacagctttttttaattaagtggaaaaaataaaaataaaaaatcctcacctcaacataggtctctttcaaagggagatttcaagccacctgacttcttcagtttagtcttcacccagggtcagagcgcacagcttcaggcatctctgtccaccagctagcagtggagatgaaatcaagaccttgcaaaatggatactaggagatgaacaacaattcaacgtgcttctctcagtgcctggaggatgcagctctccacacgcagggactttatttggggacatctgtcacctttggggttgccatggccaatgagatttataatcatgatcctcttgggtggtagttccaaagacactactaatgtgcagagagcgctccggcctctggtgctggccactactgtttcctgtcagtcagatctgtgataatggttggaaggatgtgggattatgaaactgcttttgttttgttgggtttttttttttttgttttgttttgtttttagaaaacttgtgaatgaaaatgaacccaagtgtttcacgtgaagatgagccatttctatcatgcattccgatgtcatggcagaaaattttgaagataaaaaaataagataatcaaaatgtttcctttgcctttgtttggtcttggttgtcggagacagtcttgttatgcattctaggctggccttaaacttgtgacaatcctcctgcctcagcctggaatgttactacaggcatgccctacatgcagttctttggtttttccatgtatcctaagtaggtttcttctggtactttctgtgactacccagatatgagaaggtatagtagtggagaaggagacaccagttgactgctgttgtagacaaactcctggtagcaagaaacctcatgccagcaggggacagtgcaacttccgcttgcttcttctctgtgatgttgctaatatctaacactggctggtcctggtaattacccagttacctacctgacctggctgcttcctgttgctggtgtttgaaggcctgtacgaaacaggttggcatgcctgt

SEQ ID NO: 25108 - DNA, 1854 bp, Mus musculus
cctacagagtctttatcttcaaacgtttccaggcctctgcccttgcaaactgagactgtggtacaggccttagaaacatggatgtggctgtagagagtgactgcaggcttatcaggaagtacgcctgtgttctgccacactggtgcatcccagttgcccgctatattgtgtttgtggagtagttttcatgatggagagaattttcttttttttttttttaaagatttatttattgattatatgttaagtacactgtagctgtcttcagacactccagaagagggagtcagatcttgttacggatggttgtgagctaccatgtggttgctgggatttgaactccggaccttcggaagagcagtcgggtgctcttacccactgagccatctcaccagactttttttttttttttttttttttaagatttgagaattttcttctttagtttgtagtaaaatctgatctttccagccaactcacagttctttcttgctttgcagaaggctgatggtttccacctgaaacgaggccttccagaccaaatgctttaccggaccaccatggctctgacactgggagggaccatctactgcctgatcgccctctacatggcctcgcagcccagaaacaaatgagcttgcctgtggaggactggttcactttgtggcacaaaccctttgaatcctcacgtttcatgttttccacttggatagtctacttaacattttgcaaacaaaggaaaagataagaatacattgttttgatttgtttatggtgtgcagatggcctgtcagatgtcagagctggtttgacagttaaaactattgtttaaggaaatgtcactgagccatcactgagctgtgcttctgctcctgatttccctggagttctgcaggaaagttgctctccagctcattcgtggccagccgtgctcagggcctcgggactcaggcggtgtctgagcgggaagcgaagcgcggaagccttttggagtgtaggtgtgattgaggaaggaaaacaaaagccagcggacaggtggtgaagtgagggctgagttagccaccctagggattgctccgccttgcagaaaacattgagaggaatgatagcaacctgcctctatttgtgggcagttggtttcaaagggttgtgtgtctcgcccagaacctagggaaatgggtgtttgttccatcgtgggaggagcacctgtcagtgctgcacattagacagctgtgtcaggagttctcctttaataatgctgtggctttacgttatgattgaccggactgcggaataaacactggaatgaagatgtttttagtttgtttgttttttgttttttttgagccagtgtcttgctctgtttcattgtctcacccgaaactcactctgtagatcaggctggcctcaaactcacaaagatctgcccacctctgccttgggagtgcagggattaaaggtgtgcccctccatgcacagcttgagagttcttttcaaactaatcataggggactgagcttccctaaacctgagcgttgatttctttttaattagccaccaagccttttttttttttaatttatttatttaatatgtgttttttttactcataagaatgtatgtgagcctggtgcccatgaagatcagaagagggtgtctgatgccctgggactagagtttcagtgggttttgaatcttccttctgggaattgaaccttctgcaagatcaagtgctcttagtcactgagccatctcttcagccccagccccatctttacaagacagtttctcagagtccagtaataggattgttgatttccatatagttcctatgaaagacccccgaagggagac

SEQ ID NO: 25109 - DNA, 1112 bp, Mus musculus
tacttagatagaataataaataaatctttaaaaattaataaaaaataacagacggtgaacgggttagttttttggcaacttgacataaactggggtcatctaagaagcaggaacctcaattgagaaaacccccttctcagattggcctgtagctaagtctaaggcgtcttttcttgattagtggttaacaggggaaggtctggtccactaggagtggtgctccactaggcaggcagtcctgggtcactgaggaagccgtgtgcacaccggtgagcagcatccttcatggtctctgcttcagcttctgcttccagtttcctgcctcaccctccctcagtgatgggccgggacttggaacttccctcgctaagttgcttttgttcatagtgtctattccagccttataaagcaagctgggacagagggctggagaggtgataatcttttattaaaggagtagatggcttactgttctctgtttttgctccctagtgccgtgggaacatttgcccgagccctggactgcagcagctccgtgaggcaacccagccttcacatgagtgcagccgcagcctcccgagacatcaccttggtaagaaggcttttgccatttggggttagcttttgctccttgctcaattatgaaccattataacagttccggagactcggagatctctggccgctagcccttgtctaccaagttgactcaggttagcagttggttaaccggagtgacctcttgtttgtgagctgagaccggtgaacagtattagggagcgaatagagagtggcgggacacacctcaccttctggcgtggcagtttctgccagctttgtgcttttccctgtccatctatctacttgactttgggtcacataaagtattttattccttttaatacctaaaggattattgttgctatcacaattgagattattgctatggtaaccgcatttcactttgggggttaatttttaaataatttttggtgttcaaatattgtgttttattatgacattttcatacttattattctttgttcatattcaggaatttcaaacacacactcccaagcacactcaaatgtttattcaaaaagacatttgag

SEQ ID NO: 25110 - DNA, 1190 bp, Mus musculus
ggatgctctgtggttgcatggatttactctgcagcactctgatttccaagaactaaggatggttccaagcgtttgggctgatcattacagcctgcgctcacgcgttgcagtgcctcctccacaccctgcgcacgcactgtctgtctcctctgaccttcctccagttgtattactaagtgttgatgtgaacttgtgatgtgtcgtgtaaccctgaccaagcagaagggccaatccaatgtgctttctcattctcatccgtcttcgatgatatgcagtgttttgcttagaattttattatgtctagaattaattccttttcagactcgttgaaaaattgtgtattcaagttgtacagtgtgatgggggtgatgtacacactctgacaagtgatggcagcacctaacacacatctgctgactgtcgtgtgtgtgtgtgtgtgtgtgtgtgtgtgtgtgtgtgtgtgtgtctgcgtgcgcaagtgtggggcgcattccattgccgaaccataacccaagcccacttacacctttttggttagaattttgctaacttgcacagctgaccttgaacctctgacctagaacttgagatcttcccgcctcagtgtttggagtagctttctttagttaaatttattctttctgaaaaagaggctttgtttgagctcttcataaatgactttctataacaactatccttcattttaattgtaaagctatatttgtttgtttgtggtaggacctcactgtataaccttggctggtattgagtctgggctggtcatcctgagtccgtctcctgagtattgggattacaggtgtataccatgcggtagcctgaacatacactccttgactgtgcagtagattccagctgctaacctgtcttttgatttgttggatatctcttgaatcagctctaaaacaaaaattgttacttatcaatatggactgaagcaataaactccaagcacagcttttaaattttgttaccgactagctatgacactaaattctaaagccagccaagtgtcatgtcttagtaatcctgtagtcaggaggcggaggctggaggatcataagttcaaggccaacctagggatcatgctttaataaaaaaagttatggtcaggccgggcagtggtggcgcatgcctttaatcccagcactcgtgagccagaggcaggccga

SEQ ID NO: 25111 - DNA, 2396 bp, Mus musculus
accgctcgttcagcgagaacggggagcgcagccagcacctcctgcacctgcagcagcagcagaaggggggcagcggctcccagatcaactccacgcgctacaagacggagctgtgccggcccttcgaggagagcggcacgtgcaagtacggcgagaagtgccagttcgcgcacggcttccacgagctgcgcagcctcacccggcaccccaagtacaagacagagctgtgccgcaccttccacaccatcggcttctgcccctacggcccgcgctgccacttcatccacaacgcggacgagcggcggcccgcgccgtcggggggcggcggcgcctccggggacctgcgagcgtttggcgcacgcgacgcgctacacctaggcttcgcccgcgagccgcggcccaagctgcatcacagcctcagtttctccggcttcccgtcgggccaccaccagccgccggggggcctggagtcgccgctgctgctcgacagccccacatcgcgcacgccgccgccgccctcctcctcggcctcgtcctgttcctcctcggcttcttcctgctcttccgcctcggcggcctccacgccctcgggcgccccgacgtgctgcgccacggcggcggcggccgcgctgctctacggccccgggggcgcggaggacctgctgagccccggagcgccgtgcgcctcctgctcgtcctccggcgctaacaacgccttcgctttcggcccggagctgagcagcctcatcacgccgctcgccatccagacccacaacttcgccgccgcggccgccgccgcctactaccgcaaccagcagcagggcctgaccggtcccgcgccacccccggcacagccccccgcggcccccgcgccgccctccccgcccttcggcttccagctgccgcgccgtctgtccgagtcgcccgtgttcgacgcgccccccagccccccggactcgctctcggaccgcgacagctacctgagcggctcgctgagctccggcagcctcagcggctccgagtcccccagcctggaccctggccgtcgcctacccatcttcagccgcctctccatctccgacgactgaggcaagggggcgcccgcgaggggttgggaaaggcacagcgggggccaccggttggggagggcgacactgcggcagacttggaggcccctccgagcacttggactcgaactctgccggaaggggccccgcccctaccctttcggttctctcgttttttttgttttttattattatttttattattattattattgtaaagattcgttcttgttgataaaagccaacgaactttttcgtatggatgaacaaaatattcacaacagggcggttgtgatgcggaaagaacaaaagataccaaacacttaggtctcagatgagtttgaaactctagttttagaagaaaaaaatcagcccagcaccagcagctaccaaccaccattccatctcttctttcactcgaaagccttagaaacagtccagatgtgagaactcttggaaggggttccaagaccagtgtgagccagccggctgccacctccctaaactataagcttctagaactcaaaataatgccaggaacatgccttgattcgagtcgctcgctctcagcctcctttgtggtggttgtttaccttgtttttgttttttagacaaagttctgtatgtctgggggtggggaagcccttgcattccaaagtttgataacgggctcattgccaccacgtagtgtgggtgtttagcttagaaccatttcctctgctctctggaagctatgggcagagctcagttcatagttgttgggaaataagtgcttcatttttagttgttctgagttgatccgcaccactgcaccacaactcaatatgaaaaactatttaacttatttattatcttgtgaaaagtatacattgaggatgttgtccatactgtatttatcgagtatgatgaaagcaatagatatatattcttttattatgttaaattataattgccattattaatcggcaaaatgtggagtgtgttcttttcacagtaatatatgccttttgtaacttcacttggttattttattgtaaatgagtaagaaaaatcttaatttaagagattgtatgtaatatttatttcattaatttctttccttgtttacgtaaatttcgaaagatcgcatgaagaaaccatgcaatcttgatgctgtggaagtggtttgaggaacattttgaggttttcttagaatgtataatggttgtagcccatccaactttaaagagagaaaggtgagactgcagtcaggctcacgtgtggcttgcttctctacatccagctttataaaccaccagctctactgtgacattgattatagagacatgt

SEQ ID NO: 25112 - DNA, 2373 bp, Mus musculus
agaacagaagcagcatgctgaagaaaggtggctgggcctcagctcaggtctgcaagacacatacatggtggacaccaattgaaactcttttcctcaggtgcctccccacttctgggagtctaggcttctgtcccttcctactgaggaccttgtctgcagcacactcattcaaggcaacccaattagttgcagctacctaggaagtgaagctgctgtctgcaggtttactgtctccaggtgcaagccacctgcaggcctgaactagtcagttctatcccaaagccagcgcccatttccccatacactgactgcattgaattcagtcttagcttacatgtctctctctctctccctctctctctctctctctctctctcacacacacacacacacacagtgctctttctctctctctcacacacacacacacacacagtgctcttttgtttggttttgtttagcaaatacctatttggtcatatttataaacttttattccattttagtaaagggtatgtttgattctgggaatattaagaacctacaacatgcaaatacttgcattttactatctacctgcccaagtccttcagtggtccatattaagagtccccactgtcttacccagaaatgcctgcgaaggctaggaacccttgtcacccatcactggcctcagctattggacagagcctggggaaagggaagcctgagcaaatgcttaattcattcggtgccaccactgtacaccgtcctgtgattggtggagacagcagagtgccaagaaacacatttacccactttaggtgattccatatagaaaccggaagggtttgtcacttcaggcccagcccagctggcatcctcgaacaccagcaggtggcgctcttgcacacattatgctgctggtctagcgcttttagcctactcttttaaaactttttaaaactattatcagcacctgtacatgataggagggcacccatgccccagcatggatgtctgaggaagttgagggacaactttatagagccagctctctcctcccgcctctgcatgggcttcagagatcgactcaggctcaggcttgcagagcacgcacgtttatccactgagccgcatcatgtggcccagcttaccatgctacgtgtgcttccagagtacgtgacacccgcagacgcttgccttcaattcacggcgtggatgtgttgctgtagtgtgatccacattcccagttatccacaaagaccatgccagccatagaaggaacttgtagggcctatagctatgttcagatacttctcagtgagtagtcacttagaatcatgaggaaaagggagagaggcattctatatgctagctcctcctgcagagacgctgacatttcacatgtaattggtctcagaagaaaaccatcctgcaccacagaaacacggctgtgctggagtagagacctgtacgcagggagagggaagtcaggagctgtgtccttcctggccatgaagaggaacagaaatcccctgggtggtcttagaaacactcagcaccctggggtctgtgtggccctgtagtaattacctagttaggcagtgcaacccactgctgatgaaaaattgaaaacctaacattgtttagtttgttttgggctttgcttttagttttctgagtcaggcttgctatttacactaggctggcctcaaacttgtgttaatcctcctgcctttgcctcctgagtgccaggattccaggcatacaccactatacccagcattacactactttaagatctagttggtgagaggggctggtggtgacaaccttgggagattaattctgaacaggacccaaccttccctctccccttccatctaaaatgaaataaaagcagttacatgacaataaaaccatctcacattggcaggcatgctgtcccaaagcatgtttcagagcaggcttatgttatctccaagtccatcctaccaagtctgccattagctgggacttaccccagacttggatcttggctggctgtggccaatctgggaggacaggagggatggatggctccacaggtgggcttgtatctgcaatcctgctagcagtagctaggggaacgactgctgcatgctttcctgagagaaaccaggaaaaccttagtcacagcctcatgcttacatttggggtcctttcagccacagaacccagcagtaataggggcaagagcaacgtgggtgggaagagtgaagcagccatcttccctaagtcactacacttgagggtcctaagatctgggtggccccttgctcagaccacagccaaaagccagtttgctttaatatataagatggtgagggctttgttcctttataggggtat

SEQ ID NO: 25113 - DNA, 1195 bp, Mus musculus
gtactggtataaatacatataaactgtctgtaatgggaaaatgtaattatatcaatgaaatgtatttttgtcaagatatcttttctctaattgctagctagtgcagggagggttttctggttctagtgagtaatggcctagtcatgtttcctcaaagccatcagacagggagagcttcccatttcctgaaagctctggacagcacagtacagaaagtgtgactccagagagtcactggctttagaagagggttgcgtgcaggacccttgctttgccagaggcttctccttgtgcacgttaaagtgaaacaggaaaacgtgacaaaatgtggggctggagaaatgactcagcagctaagagcactggctgttcttccagaggtcctgagttcaattcccagcaaccacatggtggctcacgaccatctgtaatgggacagctacagtgtattgatataaataaaataaataaatcttaaaaaaaaagtgacaaaatgtgtttgaaagcagtgcctgccttcttcagtctgaaatcttttatgtgtaatcactttccttcagtgaactgggagagcctgatcgccaccctggcatgttcctcttactcctggtgttggagagactgtacccatcgccgatggacggcacatcatctgcgctcagcttggccccttttgttcctttcattatcaggtagtgtcatattgcagggaacttgagagaatgttctatcttgttcttatttggagaattataatcaatatattgtcttagggagccattttgtgaaagcaagagagtgaagctttctgctattgctcctgactgttctccagtgctttctgagcagttacctgtgcttagcccctgggtgtgggcgcctatggctgtgttgatagtgttttccttggagaccggctagtgggtgtgtgatgttgatcggaagtatcccttttgaaaacactgcctatggtttgtattgaacagtattgggccagccaacacaggtatgctgggcgggcttgatcctagcatgtattccctgccctgtggtttaaaagaatattaaggcacctggctctttactctgtggaagtcagagcaaccaggacctggtgtgcctgtggcaatgccacttagcccattgtcccacttaatcttctgtttcaaacttggggtgcctaaaagagatgcaa

SEQ ID NO: 25114 - DNA, 1187 bp, Mus musculus
ttattttacattaggtgagaaattcatccacacttctctttagttccttgatcacaagagtttttggcgttaagagaggaaaggatgaagtttccaaaacaaataggtaagcccagtgcaacctcaccttcacacagaagctcgggctaatgtagctgctgattcagagtcctcagtgagccaagactgtgcaggtgctccagtgggctcagccatacccaagtctgcgtccttgggcggatcagctgtgtaataagcaggtcttgggaggcagcaggagcagggctgcagggcagggctgcagggcaggagtgcagtttgactacctctgggtacataagcaaggcttctgtctgtacttgttatcttcttcaagtattgatgaaatgcccccaattactctttctagttgcacttaaaaaactcttcagcaggtcatcctgtcatgtccaggtagagacgtagccatctctgtctgtgttcagtgtatgtccctgactcctttttccttgtacgttgtatgtggacacgtggaagaatcactacgtctggctttttggagtttatgctctcagatacttttctcgacgtgatatctttagtgaacctgtgcacacattttgattatagacaatttaaatgcacggtgaagttgtatgcgtttctaaagaagagaagcaattaactagggaattgtttccactgcagaggagttgatgcttgtctaacactaggtgtcactgttgttttgtgttcagttgctcccttaccattacttaggatccagtttggttggctaagtggtctttagttttccctctcacctaaaaaggttgccatgctccaaatttaagttttaggctgattacttaaagagtgaatttttttttctttttggtttttgttttctagacagggtctctctgtgtagccttgcctgttctagacttctctctgtagaccaggcccaccttgagttcataaagacacacctgcctctgcttcctgagtgctgggattaaaggcgtgctccattattgcccagctctcagcacaccatttggatgctttgcacaccactcctaagatgacctgcgcctccagcacccacagtgtttctctgctgctgctgcttcttgttgttgttgttttttttttttttatagatttatttacttatttcatgt

SEQ ID NO: 25115 - DNA, 1134 bp, Mus musculus
tagctcccagcccaagacacacagcaaagagggcgtcttaggagctttcttgctactgtgattgaaatattttataaaaagctgcttaaggagttggggtctgtcgtggttcgtggacagagaggtcgtgacagggaaggccaggcaccaggaactgcaagtggctgcttccaaaggcagacagggaagaacagaggggtgggagtctgtgctgagctcactttctcctctgatagagtgcactcacagctggtgcgtcttctcatcccagaaagggtgcccagaggcgggcgggcgggcggctctcaggtcattcacaataggtgtgtgtgtgatagtatagtaatagggtatagtaggaaactttttagttttagtcttctcaaaataaaatgtttcttctttctaacagtgttactgtatgtcactagtgtacacgtttaccttttagtacctgatgattccaaacatttgctcgcttgtaccttttaggtgctctaatgtgagtctgcaaaagctgccagagcagtggctgcggagcgttctggaggaaattaaaggcagtgatccctcatccaaactttgtgctacaaggcgcagtgctgggattcccttctacatacaggtactcccctaagagcaggcactgctctgtctgggcttggacactgtacttctcttcttactgtgtcagtgaaagtattagatgttcctgtcttttcagtaccatagactttgtgactttgttctttttattttttattacatttagtgatttatatgtgtatacaggcatatacatgctgtggtacacaaagagatcagaggacagctttctggagttggtcgctccttccatcatttagactccagggactgaatttaggttgttaacattggtggcaagcaccattcctagctgtgccatactctgtctcctgcatgactttgttttaatgtgtggacagtatgttctgtgtcaggtctgttcttggagcaggagatcagtcttgtataaacagagagtagcatagatttccatctatgtattcagtagtcaggaatcatggagcaggagatcagtcttgtaatataaacagagggtagtatagatttccatccatgtattcagta

SEQ ID NO: 25116 - DNA, 1138 bp, Mus musculus
tttatagcagatacacactgagtacactcttcataacagataccctctctttagaacagacagctcatattgaactaaattagttatagataattggtctgttctgaacttggtatttaactcatttaaactcaatcaccgatgaggcaagtgcccttagcatctagaggaagaaaatgagactgctcattctggtgtgtcttgatgtatgtagaacactaacccagtcactgctgaggtgagcaagtttctgggtaagcagatctgagacactgtagcgcagcttccctgttttcgtactgtgagctgtggaggcacagtgaacagatacagtttatatagtctggattttctgaagtcaacagccaccaaatctgtcaccaagtaacagaaagcccagttgggctaactagctcagcagttcttttagttcagaacagcagacacaactaattcttagttgttttctttaaaattagtgggtgtgctttgtgtttcatcttacctagagcaagccggcgtgtcagttgagaattgatagtggggcattctggcagagagtccgtggcttgacttagaagggcctcagactttcaggatgcctttcactgagcttcacgtgtagccttagtctatggctagcatgtgaggtgaatggatgtggcttctcaggttaggatgggaagctctttgcacagatagtgttagcagttgctcagcagtgtgactgtgcttcctatcattgaaccatacactgcaaaatggttgaaatagtaagtttcttatgtatattttaccataataattgcaaaatatttgaagagtaaacataattatctcagaatcatgtatgtgagtttgctactttttgtgattttatgttggtgttgaatgacatgagctagaaggccatactatgaaatttgcaagtctggcataggaaaatttaatatattatatattaatataatattataaaattaatatattatattcaataaatatataaatatgctgtatcagtcatataatattaaatgagatggcatttttaaaaggcttaaggcaagtgtggtagatcacatttataatccccactgaaggtatgaaaaacaagaatttaggttattcctgatta

SEQ ID NO: 25117 - DNA, 1099 bp, Mus musculus
gtcctggaactcactctgtagaccaggctggcctcgaacttagaaatctgcctgcctctgcctcccaagtgctggcattaaaggcatgggccaccattgcctggcttagtctttattttaaaggaaataatagtctttgaacaattacagtgtttctactattcttgtgaaattgtttataacttgtctttacctgatttatttttctctaattcacatatggtgattttttttgtaaatgttaagacctcaagtaaaagtattagagaataagttataatttctttaaattagtaagataattgtgcttacttggaattattggcatgagcaattatctccagtcatttttattttagaatagcactttaattcatgttagaatttaaagtttaatgttaattggatcataaaagttgacacgtcatagtcattgcatagcacaggaatagtctctgctcttatgcttttggaacaagaatagtcttttctccttttagggtcttgtaatcacagaggagctctgggagctttgatggcgtgtctccgaacagctagagctcatggacatcttcagtctgcaactcaggcctgggagaaccttgtgtgcagtgcaagggtaaagcaaggcttaattcaccaacactgccaagtaaggaaacttttgttgcatccatagttcctaataatctgattgctttagtagcccagctagaggcccctgagttgaacctagcactgtcaggagcctgttaaggagccagtagaatgtgccatccttgtactcagtctatgcagtgtctggtggcagcatagacagcttacacaaagaacctacagctcggagacacattctacatgtgagtgtgccctggtaagctagtttatctatctgtaaggcttacgagagcctgaccagggtgcatggtgcttggctgctgtgagctgaacgtggtctgtggaggcctgcagcaaggtagcacaagaagacaagaaagccgtggagcagaagctgcgggagtgaggctttgacctgtggacctgcgaggcctcagttttatccgtgtaatgagatagttttacaggatgtgatacaagg

SEQ ID NO: 25118 - DNA, 1193 bp, Mus musculus
agagctgtaagagaagacgccaggtatcttctcctgtcctgtgtgcatgcatatgtgcactcacttgaatgccccccatacccatgaaaccatcattacagtacagataatgaacatctcattttgtaaaggtttccttatattcatttgttttttattttataaagtaaaaatattcatgtgaaatttcactttcagtttggccttatttgtaattttgtttttgttgttgtaaatgtcattaaattttttgttcattctttgtatttaaaagtcatagatggggtgggggaagggtatgggggacttttgggataacattggaaatgtaaatgaagaaaatacctaatttaaaaaaaaaaagccgtgatactactttcttttactaggcagcttctaaccatacacatcatggtccacttttcttcaggattaaggagtccacattagatatgttcctgtctagaatcctggcatcttggaccagttcagccatacagatccttgaatcaggctcctcaggcttaaagggtcatctgaacggggactcatgcgtacctaggagacttctggagtatgtctacacacactgggagcacccgttagacgctctgagacatcaaaccaaagtcatgttcaggaatctcttgcaaatgcaccggctcactatggaaggggcagatttggccactgaccccttctgtctggagttgactaagagtcttctgcagctggaatggcacattaaagggaagtacgcttgccttggctgtttggtggagactcttggaattgaacatattttggcaatagataaaaccattccatctcaaattctagaggtgatgggagaccagtcattggtaccttatgcaagtgacctcttggaaaccatgtttaaaaatcataagagccatttgaagtcccaaactgtcaccaatacctggatggacaagtggcatgagacttgggttttccctgtcctttctgtactgtgtggaggaaacttggatcagagatcttatgtgattgattattacctgccacggatactgaattacagccccgagagcctgcactacatggtgcacattcttcaggcatctactgatactggaactggtgagatagtttttgttttatgaatttctatttaggatacttaaatgtaagcctctgtgcagatgtttgtc

SEQ ID NO: 25119 - DNA, 1187 bp, Mus musculus
agatattgccatggacacagtgtgggtacagatatattttgaagatagaactaagatttccttacagatgggatacagaggctaggcggcaagagagtttacagtattttagagagagagatactaggaggtagtgtgggtttggagccacttataaattcatatatgttgtgatacctattagatacccaaatgtagatagtgagtaggaagttagaaatacaagtttgtaatgggagagacctggttagagccaaaattttggcaatagtaaacgtacagagtataattgaaagtttaagagctatgtgagatcagtatcaagggagagaattagatagagaactgagaactgaaccttggggcgctttgacgtagaggaggcaggctcggactctgtctctttgtcagagggtctgaagcttccggttgacccttcacaccagagagaagggggtgaggtatgagagggaggagagacatagacacgtaggtaaatggtttagggagacaacgatctagtcctatgtctggggacagagtctaggagaacgtgttgaagacaggtgggaaagagtgcgcagaaaatgtgttcacgtctgtactcgtctcattacgtcttcacgtcttttcaaacgtttctttcttttttttttttaatttatttattttatgtaagtacactgtagctgtcttcagacaccccagaagagggcgtcagatttcattacggatgaattgtgagccaccatgtggttgctgggatttgaactcaggacctctggaagttcagtcagtgctcttaactgctgagtcatttctccagcccttttcaaacatttcttttttttttttttttttttttttttttttaaatatttatttatttattatatgtaagtacactgtagctgtcctcagacactccagaagagggagtcagatcttgttatggatggttgtgagccaccatgtggttgctgggatttgaactcctgaccttcggaagagcagtcgggtgctcttacccactgagccatctcaccagccctcaaacatttcttatctttgccctaaaatagggaataaggttagtgtgggtaaggaaaaagggcctatacaggtaagaggattagaagtttacaattagtgtctgtgtaactggagtgcttttacaaatgggagat

SEQ ID NO: 25120 - DNA, 1182 bp, Mus musculus
catttggagtcttttttttttcctcttttatttttctatatcagccctataagtaagtgccttgtgccctccccccttttaaagtttttatttattatctttatatgagtacactgtagctgtttctaggcataccagaagagggcatcagatcctattacagatggttgtgagccatcatgtggttgctgggagttgaactcaggacctttggaagagtagtcagtgctcttaaccgctgagccatctctccagcctatcatctggagtcttaagcccttcctccaggactggtttagtcactgttccattgctgagagacaacacgaccaaggcaactcttggtcaataaaagaaagattcaattagggactggtttacagtttcggaggcttagtccaaagtcattatggcagagagtatggctgcaggtgctgtgctggagaagtagctgaaagctacatttttatccagaagcagcgaggagagagagagagagagagagagagagagagagagagagagagagagagagaacccatgcacctaggcctggcatacacttttgaaatttcaaagctcacccccagtgacacacttcctccaataaggccaacctctgaatccttctaagcctttcaaatagccactccccggtgactaagcattttagatacatgagcctgtgggggccagtcttactcaaaacatcacaatgacttaatcctcgggacatttttagattttaatagaaatagaaatgttcttccacttcaaagcagtctgcctagtgtgttccactactaccagatggtagtgatccatttgtatcatgcagtggaatattaaaacagtctgtggtgtattgtcagtgtcttccatgtggtagtatagctcagtggctgagcacttacctgggttgtccctggttctgtctctgtcatggaaaaaaggggataatgagatagatggcacatacacacgtactcactcacacacacacacatgtgttatatacatacatatacacatacacatacacatacacatacacatacacatacacatacacatacatatatacatacatacatatgtgtgtatatatatgtatatatacatacatacatatgtgtatgtatatatatgtatatgtatatatatatatatatacactcatac

SEQ ID NO: 25121 - DNA, 1185 bp, Mus musculus
gcggtggctatgctctgactgtagtagtttgtgacactgtgtgtgtctgctacctctgcagactgcttttgagtattacctctgtttaccttctaggcaccagttctgaagactttgttagaactgattcctgagttacgtgataacgataaagtatattcttgcagcatgaaaagctatggtaataaatttaatcgtgctacgttattcaagtgatgtaaatatttctaagtatagtcaactgtgagatcagctcaaaggaatattcctcaatttcagataattactcatttacttagctctagaatatgttcttaaactatagaaaagcatgaaattgttcctagagctttaacattgaaaaacgttcctgaacacctccagagtgtgccgggccgggcagactctgtgaggaagccgctcctccctcccaaggcccgccctgcagggcagaagtgcggcctcctcctgcctctgcgttccactgaggccaaggcttatctcctgcctcagctgaagtgcacagccatcgatgtccacagtcagacagtccatgcgaaggaggcagtggaaggtttgtcacagagcagatgaagtgctgatgtgtccatgtcccaccctcagacctgctcgttacactcgggtatagtggagcagcagacttagaactagtaaatcgattcttcgttcccacatggagtcttgcaatatttacaaacagcagaaatcatagatctccttatgtgagtagcaaacagtatcaaatgccttaaaaagtggacgattagggcagaggtagataaagatgcagacccaggcctgcagaatgagggcccttgcagcaggggtggccctttcacagggaagctgcctggctgagctttcgcaggtccccactcctccccttgagagagcatcagggctaagccctgctcctcacagcctcatgctctacagttgagaatgtgatcgttcatttacacggtgctttctccgctagatacaccagtgccatgaatggtgttcttcaggctccctgtgcctgcccgccctttcccttaccctcacagtgagcgcggtggaggcaggctgcgggttctgagtggccccctacgggagcttgcagttccttgtctcagatcctggagcgcctgggcagcaaagggtgcaagggaaagaagaggg

SEQ ID NO: 25122 - DNA, 1115 bp, Mus musculus
tgaacgatgctgccaacagcctcctcatcataaggcaagttaggcgggattatttgaaaggtatgtcagaatgcttgacctttacgtcacgttaatgcctctgcagaggtttcttgtaacgcccttcgaatacttggataaaggagtccatttagcaaattacctgcttatcaagagccttttgtggtagctgagagacgtaaattactgtacatgcatttataatacggcttgaatatgaatgtgctgtcatctgaccacttagtccagtttccatcccatttaacacaagatgggctttcttaagatgaatcacagctcttcagacatgcaaaattcgtgttccagagcgagggaaagtacaggctttcaagtgcgttaaaattcacagcacaagtcattttgctttggaaattaacatactttggaggtctgaaacaattcccagcagttatttcatgcatgttgtgttggttgtatatgagatagcaaatgagttaaattgagtgttaagtgtgtgagattgtgcaccaaatgattgtaatattgatttttttaaaacctaacctgatactttttaaatagttcataactccaagaacagtgaaatgcagcgattgtttagagttgcatgtcgcaagggtaacgctgaggacacaaaggtgactgagaaggactgggacatgggagctgacggtttcgtggagcctgttcgtgggttcacagtggggtagattagctctcaagggggtcagtgatgactttgaggttagggaagcagcttttcaattaactttcagggctgaattttagtcagtgtagcaacaaacgcccttaggagggagactcaggttagaagctctgctcttccgctcttaactgccgggctggtttcttccccaggctctgatgataatgcttctctgtgctttgcaattcatcatagtttgcatctacagagaggaagctggctgtgtgattgttcagccttaacagtaccttagcttgctggtcctcagctgtcttcctccccgatggcgaccgtttctctttgcagtttcagctcttcctcaggcgcgctgcataccagcagtctttctgacagttttgaattg

SEQ ID NO: 25123 - DNA, 1196 bp, Mus musculus
cttgttaggtatctgtatatttgaaaattgtatgtttttgtataagtcctgtcgtagccaaataatttgatcttctaattttagaattataggctatattcactttaatgctattgtgttgaaatgttaaccattgtaaccacccacttatagattaaagatagcttgaaagtgaatcttttgcgcccctcaatctaaattatacctctggtttatttggactttaacgcatattttgcgatttattttgcaatcttttgaatttagaagagctgattttcatttttattaggaggaacataatctgttgactcaaagcaagtataaaaaataatttggaaaagaagcccttttcttttcggtggtttgtcttgggagctgggagcacactggggcgctcactgcctgtctccaaggattggcaaccgtggacaggaatatattttgggactttttgttttgctagttcagaataatattgtctccattttttatctttttctctcttatagatgcatataatatcttccttaaagccgaaaagcaaaacgttgtatttagcagtgaaacttatagcaccttgataggcttgctgctgagtaaggacgacttcacccaagcaatgcacgtgaaggatttgtgagtatctgtttgtctgtagaaaccctcactttaaaggaatacaagctgagacgtctcagatgcccagaaaagtaacgtgaaaagttgcttaattttatgagttatttgtttaaagcaggtctcgctgttttccaggctggcctcaaacttgtagccgtcctcggcctctcgagtgctgggataacaggcatgtttgccaccatgcctggtccatgtgtgtgttttgacaccaacagtcacatttggaccctgaacctatttaatgtactctgacttgcgcattttttcagaccttatttacacttcaattaatgcctgaaaacattttcaatggtgtcttgtcggctctaacctcagtggtgtgggatgcggattaatttactttttcagaaaatcattgtggaactccatcttactgtacatagccaaggtgctctgaaataagtgatttggaaagacagggaggcagaaaacagaagagagttccatgttaaggagtacaagtagggaacttaaattgttagggaggaaaatgtaagacgtcaaaggccatt

SEQ ID NO: 25124 - DNA, 1099 bp, Mus musculus
aagagattgggtggggcgggtggaaagtgagagtgtctttaaaggtctatcccatcgacaagactgtaggacaggtctttgtttttattaattgttttgtggctaatggaggttaagttatggtgagaatttctaacactttgttactaaagctaaagcgacaaaagatataagtaagattgaatttatgaataatataccgttttgtttgtaaagtgtctggtgtgtacacacatgctatgtgctgtgtggtattttaacacagacttgtatttctacacacaggtcaggagggtgaactagagctggttgttaacatagcttagatattttctaagtttttacagtgagtagtttttgaaaattgtttttttcaaagggaaaaggatgagaaagagtggagtaggaagagtcttaggagctgaagtaaggctccttgaacagatctgtgagggagaggagagggagggagggagggagggagggagagagagagagagagagagagagagagagagagagagagagagaggttcctgtctacagaaggaaagtcttcactggcttgagggatggggaggtctgagcgtataggaccgccatccctccccctgcggtgtggagcaaatggtgctgtttaaacgtggatgagcttagggtgtagatagagggtacttaaagaagggagctcccgctttgttctgaaagggactcttgggcggggtaaattgattccagatgttagaaaccctcggggctagaataaggagatggggctaattcaaagagtaatagattctggatgtacacaaaaggattctgggtaggttatgggggcggggcagctgagaccgtgagattaatgaggatctcagggtcctgggcatagggcttttttcttgataatactcaagagtaatgacataaaaggtcatgtgaattaacagaggcttactcagaataaataaatatatataatataaataaatatatatgtgttatatataatatataaatatatatattatatatattacacctgtgattggtagacatgccttggctgtcatctgaaacttcttgctaaggtgactgatag

SEQ ID NO: 25125 - DNA, 1124 bp, Mus musculus
ttagaaaggtagcattaaagtgaggtgggggcttgtaaaatttgcctttaatattcactaacatattttcccctattttttctaattctgtactaatttgattcccaattttaggatattaaggttctggttgacagagagaaggtagattctcaaaaagtaagtagtatctgactttgttggttttttttttttttcactgcttctaatgagaattctaaatagtgtccctgcaagggatcttgtctgtctctgagatggtaaatctattcgccatcccagaagaacatgaacatctaggatgatctaggagagagttgtgaactccccccctctgcagacctgagattaatatttaatatcccttggggcatttatgacagagagagaagcaaggcactcccagggctgagtgataagggctgtatttcctttccgtagtaaacttttgttcttcccatgtagacttctcaagttacctcatctgatttggaatcaacacttgagaaactcaaagctgaaggccaacctgtaggatctgccctgaagcagctcctgctgctgctctgctcagaggaggtaaccctgacagtcctttccttttcacgcgtgcgtgctttcgcgtgctttcggggtgagacactctatagaccacagtaagtcaaaccaagtataatgtttatgaattttacactttattattatgtgtcatgcttgagaacggttcaattaaatgaaaggctaactaatttcagcgacaccttgaatgacatgttttcaggttgctgtagttttgtttatgataatctgcaaagtgaatgatagtaacagcgtgataggtttatcatacatgccaagtgtcctttcaagccatggctccggtctctcatatccagattgtcaagcaactgatccatgctggagtcatttgcaagtcaaatacaacacgcttgttaatgcagggattgaaattccatttcctgctaggaaaaagctttctgagataaagggtcccttgccttctccagcaggcctgcagctgccccttgtgttcgtgttagtgtgtctgcagtttgttctgtatcactacacttgggagtttctgcttgaataggattgttcac

SEQ ID NO: 25126 - DNA, 1099 bp, Mus musculus
ttagcataaaaataagaatatgaaagactgggccagacatgtgatgtacgcctttagccagtactctggaggttgggacaagtggattggagccagcctggtctatagtgagttccaggtgagccagagctatgtagggagaccctatctccacaacaaagaagttttatggtgggggagcccagagagtaaagtgctctcggagtcaaggtgtggtagttgtagtagaggtgctctatttttaaaaaggcttttgtgtccaaataaagtgagcatatttggttgatcataaaagccaggatagacagtcttagagggtgggaacggtccaggtaaatggtgtctcttttttccctaggatgtgggttagataaagaactgaggacacattctcactgatggagagaatcgtcagagtaaaccttgtaacttccctgaattccaagttctttatctctgccatgctgtgttttatctcacaggaataatagatatcctcaaaataatgaacaaagtgggagtggatcctgatcaggaaacatatataaactatgtgtttccgtgctttgatagtgcacagtcagttcgagctgctttgcaggtgggtacaagtacgcttttcatggctaacggaagagcatctcactcttcctggtgtttcattatcaggacagcaacattgagtggagaactgaaaacggtcttgttgtacagttgtaaggctttataaatacaccagtcagtgtgtgtagcagtgtaacgtagcataagaagaccaaagagcactttcctctgtcttgatatgactgtgtgctgtagacagaacattaagaagactcactcttcattcttgccctggaaactgttctcattaatgttcctaaacacattaatagtatatttactaccctgcacttgaaacactgcttttccgccatgcttcttggcccttccaggatagggatggcggatgagtgtcacctgaagagccgcttctggagagagggcttagcactctttataagacccagatttgacccacaggcggtagctcacacctgtctaactccggtacctggagatctgacacttttttctg

SEQ ID NO: 25127 - DNA, 1635 bp, Mus musculus
cttagtaggatgttggtgtgtaacagttgctattggattgggcagttaagtcttgtttatttagcattaatacttctaatttttcattttgattgttataaccatctttagattctggagaaagtggagaagtcagaccattacttcatggaccgcgacttcttgcaggttatttttagcttcagtaaggctggctaccctcagtatgtctcagaaatactggagaagattacctatgagagacggtctattccaggtatttcagaatgtttatctgcatgccttctattaacacgtggcttcctgtttctcccctaacagcgaggactgtgggaggtggacagtgagtacctgggtggtgcaagcaggaatggggttactcttagagatttagatttttgtggggtttgcagttcttaagttttttctttaaaagtataaacatttttgtttgtgtgtttgggtgtgcatataccacaggtcatgtgtagtctttctctgctgaaccgtgctgctggccctattttttctttagtgttgattacaatttaacagattgctcagtttagtaacaacagatatctttgttttcttcgcagatgcaatgaacctcattttgtttttagccactgagaagttagaagacactgcgttccaggttttattggcattacccctgtccaaggacgagagctccgataactttggcagtttctttttgcggcactgtgtgactctggatttggtattctgcctgtttccactttgtagattgtgtttagtgctgaagtgagactcacaggagaaaattcatgagattagaataattgtaaacaacataaaactttgtaatgttgaagatttctggatagaaaggagaaattcagattttattaccaaaaggattgactgttgaagaaagtcatgtggtcggtcaggctctgcctgttcaggctctgcccgtcggttgactcggtgtctttttttccacagccccctgagaagctgatagactactgtcggaggctgagggacgccaagctgcacagctcctcactgcagttcacgctgcactgtgctcttcaagccaataggacaggtgctgtggtcttgtagtgcagagcaacattaataagtgtctctgagctagcctggtgacgtggtctgtgatttctaacattaataagtgtgtctgagctagcctggtgacgtggtctgtgatttctaacattaataagtgtgtctgagctagcctggtgacgtggtctgtgatttctaacattaataagtgcctctgagctagcctggtgacgtggtctgtgatttctaacattaataagtgcctctgagctagcctggtgacgtggtctgtgatttctatttctgtttttttcagctttggcaaaagcagtgatggaggctttgagggaagaagggtttcctatccgaccgcactatttctggccgttgcttgctgggcatcagaaaacaaaaaatgttcaaggtgaggttgccttttatggggtcagaactagtcagagtgtttgtttgtattctttaaaagcacacttctaagaacaagatctctcgagacactggaactgtgttaaatcaggctgaagtggatttttccac

SEQ ID NO: 25128 - DNA, 1578 bp, Mus musculus
gacagaaagacagtcttttaaaaaagcaaagggagaaaacccagcagtagccgcagcccactgatgacgtcatggtctacctgcagaggttctcatttagttagattctgtcttacaagctgtatttaaaggttactgtcttggctgcagagatgctcagtagttaagagcactggctgctcttcacaggacccaggttcagttcccagcacccacatagtggctcacaactgtccatagctccagttctagggaatctacagatgtatattcaggaaaaacaccatcactgcacttaaagattaaaaaaagcagtttataaaaatgtcttaaaaacagcatcaggaaacttgtgttgttaccccagtaagtcgggtactgctgaaaatacctaagaaatgaatcggtccagaataaatggagcattgtagacaaactatggcaaataaatatgaacatttaccacccttatttttttctctttcagattcattactaaacatgggtgcatttttggataaacccaaaactgaaaagcacaatgctcacggtgctgggaatggtctgcgttatggcctgagcagtatgcaaggatggagagtagaaatggaagatgcacacacagctgttgtgggtattcctcacggcttggacaactggtcgttttttgcagtttatgacggtcatgctggatcccgagtggcaaattactgttcaacacatctattagaacacatcaccaccaatgaagacttcagggcagctgacaaatcaggctctgctctcgagccttcagtagaaagtgtgaagactggtatcaggactggctttttgaaaattgatgaatatatgcgtaacttctcagacctgaggaacgggatggacaggagcggctcgactgcagtgggcgtgatggtctcccctacacacatgtacttcatcaactgtggtgactctcgagctgttctgtgtaggaacggacaggtctgcttttctacccaggatcacaaaccttgtaatccagtggagaaggagcgcatccaaaacgcaggaggcagtgtgatgatccagcgtgtgaacggctcactagcagtgtctcgggctctgggggactatgactacaagtgtgtggatggcaagggccctacagagcagcttgtttctccagagcctgaggtttatgagattgtgagagcagaagaggatgagtttgtcgtcttggcctgtgatgggatctgggatgtgatgagcaatgaggagctctgtgagtttgttaagtctaggcttgaggtgtcggacgacctggagaatgtgtgcaattgggtagtggacacttgtttacataaggtatgtacgctcttgttgttgtttgaactaacactattgattttcaaaagacatggtaagtacttttttctaaagcaaacttagaattttataatttttactgttttctggagaaaactctgtattctcagatatcttcttcatggacgttaaccctttttactaacttaatctgccccaaccttctaatttgaaaattaagtgataacaaatatcttaaacgtattgagc

SEQ ID NO: 25129 - DNA, 1147 bp, Mus musculus
gactctgatagggatcattagtcaggggtttgcagatccccagaaagtcttgaaagtgtttgcatatgtatacattctttattaataaatatgtctctggtttttatcagtttctcaaaggagccagagtccccctactccgcaagaataattgcctaaaggattcttccttataacgtgtaaagtaccccttcttaaagtacctggctctacagtgataccctcccttctgctaacatgctggttgcgagattgggcttagtctgatttattttgagtatagcgtcagtacccacagcagtcagtaccaaagctctgcttactggagagatgtatgcagctggctggcagatacaaagccccttgagtaggacaaagtcttcattatttctgatcgtctacatttctttaacctgaaagggtgaatttggatggatggcttaattcatagtgtttaccacacagacctgagcacctaagtttgatctatgggaaatacataaaaatagggtggagatgggacccgaggatccctggaatgtactaactagccagtcagtgggctccacgtttacagaaagattcacagctacagggcagagtgagtgaggaagacactagaattgactctatctacatgcacgaacagagaggggggggagggaggggcgggacgggggggggggagaagactctaaaataatgagataattggtagcaaagtgattgccacacaatccacaatatccttctaaaaacccaggtagagtgatgtgtgcttttaatcttagcactggggagctggagatgagtggggctcactggccagccagcctagtctagccgtcagcctcagatgcaggtgacagtcctttctcaaagtgacatcatgtgagcagtgacacaagaagctgacctctctgacttgcacgcatctacaacaacaaaaaggttgctgggctgaagagagagttcagctgttacaggtgaggcagaagactgctgattgagatacaagtctgtatttgtattttgtgtatattgttatgtgaggttttacttatttgtgtaggtctgtgcaggtctgtgcagttatgtatgcatatgtgtacacactgtaggtccacggatgttggtaactttgatc

SEQ ID NO: 25130 - DNA, 1116 bp, Mus musculus
acatataaaaatttaaatcatgggtgttttgcatatgtgcctttgtatcacatgcatacctggtatccgtggaggcttgggactggagcttcagatagttgtaagccactatgttgatcctaggaattgaaccctggttctttggcttaacagccatttctcttttaactgctgagctctctctccagcctcttaaacatcactgtaaataagtgtctaaatccattagaaatttctcatgcaaaactactcatgtaccataatgcattcaatggcacattcagattgatgttggtgacaggtgggcatatttctgaactctgctcctcattaacacaaaggacagagctcttgttacagtattactcaagagggtgcctgtaaagatgaaatgaccctgtaaagttcctagcacagtccttggtttcccctcctgagagttatgcaggatatggataagtaggtgaaaatgtgtgtcctagttagaaaggctgggaggcctgcaaggtggaggtccttattatatatactaggtacagcgtaggtgatctgacaagaagcacagaaagggcgcccatgtgttaaaatgggctgcatggtgcagggatttgtgtgtaaggctgtgtgatgggtacgtgtgaaggagcacctgtggaagactgtctggagttcagtttgtcagtttaattcatcagtatgcattgtgagagctttctctgctaacaagcttaagtagatgtcattttagaaacccatggactttctagtatttagtatttaaaatattgtatttatctagagatgattttgttaaatattgtatcttaaggcaaaaataattttattttcaaaagtttttaaatctccaaaagaatccagtctaagttttcgtagttttacatttgtatcttttctcctaccagttagagatgaagtaactaacactgtgatcactgctcaacattctaccctttgcctcgctttaaaacactagatcactttagccagcaagttttttgggtttgtttgtttgtttgtttgtttgttttttcgagacagggtttctctgtgtagccctggctgtcctggaactcatttgtagaccaggctggcctc

SEQ ID NO: 25131 - DNA, 1136 bp, Mus musculus
gggaaactaccgacagctgctggaggagatgctgactagttacaggctagctaaagtagagggagaagagagcccggctgacccagcggctgcagctgcttcttcgaacagtgatggtggaaacccagtggcaatgcaggagagagacactgagggtggtcctgctggcctagacagccgtaatgaagatgcagggacaaagaggagtgctgaaaatatatgaccttttttgagtaatatctttgtgatcttgatttgacagtttttacttaggaagtatactgtgtgcttttatataaccattttgttatttgaatcttgaaaaactagttttcttatattcctatagtcttggtttttttaaaggcctttgcatacacctttatgatagtttaagattgactatttatagtactttgaatttaatgaacttatatgtcatttcacattgtatgcagaaaacaggttgtcgttattaaactcagtagtttaattcttagtagttagggttagagattactggttggaaagacaactatacattgtgagaagaaaccttgttgtgtagaattgttgtgtagaattgacactgcttattttccatcctcatacctttgcatagtcagctttgtaatccatttgtgtctacttactgttttagttcttccaaggatggctagagctggcctataactttcttttagagttgataatctgtctgttttaatttgtttatattttacatttctgtagttttatttttagaatttattgagatgtgtggttatctttcctttctctgtattctttatgaaaatttttaaagaactctgtacttttcctacagctttcatttgtatattctgtatagcctatttacacatcacaatgtatgtctcccgcgtgcttagactggaacgatgcgtgtagtaaataaagcctgtgctgtggcctcgcctgcgcatttgtactctctcagtttccacttatttcacagtcagctttggggcactggaaaactcaataaaggtcatttatgtcctggtaaatttggcacactttggctcagctgttttttatcaacaaaagagaaaacattttaattaaaagtatatattaaagtcttgcttactcaa

SEQ ID NO: 25132 - DNA, 1117 bp, Mus musculus
gctgaacatgaagagtaaaatatttatcaaaaagaagttactggagtttggagaagtaatgaatgtatccatttgtacatggttcacatgttgtggatgctctgtaaacattttcccatgttttaattgtttttcagcaggttgtgatgcccttttgtgtagttaaaacaggagtcattatctggtcccatgtgaaatggaatttatggtattttctgtatcattttgctgaggctgtttctggggagccacacatttgaatgcagacagctttcctgatcacttgatttcttgtgcacctgatttttgctctaaaaggaattactgccacaatatattttatttattctctagattttagtcttgtaagttacagtgcttcacatgatggtggtaaagctacttgtcccttcactgggggttgggggttgttaaaagatggggaatgaagaatgccactgggtcactgttaacctgtcccctggtgagactgtactgatagtccctgtccgggatggtcttctgatgtctcctacaatgcggtgagcagaaccgacttgttacctgaataaagaatcgatttgaaaacggtgtgacatattactctttggtgtgattttcaagaataaagacgcaacattggttgtggttgaaacatgtatcattggcatacttgtggaaacattggtacgatcatagatgaattctagctctaaaagaggctgggtcagccggaccacataggacacgactagttaacctctccgccgctctaaaacctcctgttgagaaaaacgcctcttgagtggttagtggacgttgaagtggcaatactgtgtttataacctagaaagagaaacccacggttaatgtttctttgctccggtgacctttgctgtccagtttcttgtaaaatttgaactcaggacccatttttaattttaaattttaaatatcccaaagaactttttgcttttgtggattatattgctatctgtataggaatttaaagcaggtatttttgtctgtaactttaaaacaccacactagcagaaataacacactagtttatgaaaaataatttcttaagtataaacaacaataacaaacacaaaac

SEQ ID NO: 25133 - DNA, 2236 bp, Mus musculus
gcaatttccacaactccactttaaagaaaaggatagcattcttcatatttaaatgctttagtattttggcataatcttttaaacactttaaaaacagtgcattcgtgctacagaaatatctaagaattgatgccattcatgagtctgctcagccctgtgcgtacgtgatgttctgggtggccatctcttagggagcttccttcctaacacgagctatagaggatgtccagtgcactggagtagcacgcccgactggaaacaaagcatctgtctctgaaagcggcctgctgatggaggggagccttcgtgctgtgctccaagaccaggccctctcccttctccagagaaatggcacgggtgtcaacagcactgcctttggaggctgagttggtacttaaccttattctcagctctggaggaagatctgaaatgatcccctgtagatttagcacagttgatgattctccaaaattcagaaccacgaggaagacgttatctatgccgtccagctctcttgtgtacaccacagagtgactgtcgtctctcaagaggcaaaaccagccccggctgaggaccagctctgtggcatggagtagactcagatcctgatacagcctcagtgctgagctcggctgggtcttttggacctgtttttaaaaagaatattgacataaatgtttgattttaagaattatccacaccccccccaaaaaaatcccttgcttctgtttgccctttacactgtccaagtaagtaaataactgcccaattataaagcatttataaatagttggtcctaaagtcaattacaaattccaattttcttcgtgtctgcgaatcacttcagtatgcactgtgcacccacatcttagagctgcagaagcccagcctgactccgctcgggtcatttaacttggaagaaatgaagtcactgctgtgctctaacttccagatgcctggaagcaaaaagccaccatcataggggacttgggcttggtcctcatctgtaggttgacctgaagggcactattgtgcagatgcggattctcagatcgctgaggatagaaagaacactgcacgctgcagagtctgaggtgcaagttagcaaggctacatttgcttgctttctgctggccgtaaaagatagcttttgtccactaaagatgtgggtgtattttacagctacacaagcgtatctgatgtgatgctgcctgcctttcctcataagcatctctgatacctcattcccccaggtgtcattgtctggcacacaactctaaacgggcccaccttccttctgttccctgccaagtgagcactcgcccgcccatctagtatgctcatctcagacattctcattcccctcccttttacagtatttatctaagatagattatcagacagataattcccgtgtcaaaagggtatgcacattcaatacataatgctaaattattcgtagctgttgccaaatcaacagtaatgttcgctcatgacacccttgccagccgtgtctcgggcggggcagttgttgccattgttactgtagttcttttccggtagatgcttaataatgtgtattgaatgactatctcatggatgtttaatgatgtccgttctgttatcaggcacgaagtgttcctggtctgtgtgtgtggctgtccgtgttgtcgctctctcagtagcttagatgacacatgagaagcagcatggtgccgctcgcacgagggcccagggcgctgtccttctcatctctcacgtgaactctctctgtaatcgtgggcttgtctctttctcttcgcatttctcaaagtacttgtttgatatatcttgaagcttcagttaacatgcataaagatttgtggggtttggtggactcttcaatgcttttcactgtttgaaaactgcatttctctcatatactgctttcatattgaattctatttagtctgctattaaatatttccaagcctacttctttctgaaagtcttttttctctaggaaatacatgcacataaacttcagttgcaagaagaatatattcaaggcaatcatgaaatgactaggtatcatgaaatggtaaccccaagctactgcaagcatctgtaggcatgtttacatatggggccatggaccatcaagtgttgtatttatatatgttaaaagtgttctccatggtggcgcatgcctttaatcccagcacttgggaggcagaggcactcaaatctctgagtt

SEQ ID NO: 25134 - DNA, 1177 bp, Mus musculus
ccccgaggaccaccttcatcccctgacacacctgcagcatcatagttccgggccctgtgccatcatcaggctgagttggagctaagggggagggcatcattaagtttggggtgatgcttgcaattcagagtgagcagtgcctttctgctcttttggaaacgtcatttaggggatttcaacaattctcctgaacctcgactccggtactgtgcttgaatttttcttttggatgcacgcccaacgataaatgatccacaatgatctgaggacggctctcccatccaagaacttaatcagattaatgatgtatttgttttataaaaatgaagtacattaagcctgagaatgcctaatttacatacgaaatggttgctagggacccaaaatactagtggtttttacaaaacagaggttacagaattgactattgtcttgaaatctggtagtaaatagcagtgaaatgcaaaataataaacaaatgttaattggaagtatttgtgtatgtaaattcatcagatggcgtactgttgttcaaaagaacctaacgatgcacatggacgcccccgagacaacattactgaagttggagatgacggtaaacttatttgccgtgttttctagctgatttgacctcaaatcaggctttacatcccactgtcctattttctcttgagatcctaggttagtatatgcaaatataaacaggaaattagcagtttaggtatctgccattttcccgggaaagagcttgatataaaaagaggaaggagagctttcatgaaactgctgaagtttcccaactacacaaacgagaaggacgaatagccttcctggatggcctcttgagttttcacacacacacacacacacacacacacacacacacacacacacaaactggctacagtcattcaacaatctggtcagttaggcaaaaatcacaactcaaaggagcagcttctcacttcaggtatcaaaagggagcgctggagacaaagaaaagccagtcaaggccttagctaggagctagcaggcaactcacagagggaggagccacgtgccctcccctaccacctgacaggacacaccgccctctgccaaggccagtgtgagaacagagagacccaaagctgctgagagttccatctgtagtcacacatatagtatcccggtttca

SEQ ID NO: 25135 - DNA, 1146 bp, Mus musculus
agtggtcagcagaaaaaagagatttttgcttcgagtcctaaatagttcacaattctcttagtagaaagccttccctgccaggctcttcagaactatgaagcagacaccttggacacaccattccaaacttttgtgaggttttagttctcaacttctgctcttcctaaccatttgaaaacttttttttttgagtctaaccaacttgacagtgcaggagtcttgttctctttgtttcagtgtgtggatgggtgggaggggagtgctttgattgctaactgtggctgccttctgttgttctccaggtgacccccctccagccccccacacagggggagttgatggggatgtttttttgaccacttgatttacctgctcccattgacttcatgcttttgaagagtgactaagcttttgacaactctttctttgctaattcacagaagaacaaggcttcagggagaaaaaaaatgtacttgatgtttaagaggcaactaaatttctttgctgtttgttttttggacttgtattaaagaaaattgtgaaattgtaatgactaagtgcatatttttgaaggttttcactttgtttactgccttcataaaaacaaaacaaaacaaaacaaaaaaaatcaacaccagccaaaaccaagcaagccagttactgttaaccctgattcgtttttttttactcttcaagtgacattacttttaactggctacatttggataataaaagccatggattttaaaccacttagtaatttggtttcatttttaacacaaataacaccttttcatccattttatataaacttcaaacaacatatgttttaacttactgccaaataagaagaaatgtgttacattaaagtgcatgttgtttgcttgcgcatttggaaataccattcattttatagcaattttgagttatttttctgtcactttgtattcctattcaaagagacacacagaaaccctcactcaaaacaactcccttagggtttcctcctggatgtcaggaggcatgaggagaggcgaggaggtacagtacaccacaggcttaggtcatggaagtgccaagtcctggtgacttgcatttagtattgtcctttgaattgtgtctgcctgaaactctgtgaggagtatt

SEQ ID NO: 25136 - DNA, 1156 bp, Mus musculus
taaatccatttgatccataacttctgatagcttccatgtgtctctgtttagtttgtgtttccatgatctgtccattgctgagagtggggtgttgaagtctcccaagattattgtgtgaggtgcaatgtgtgctttgaactttagtaaagtttcttttatgaatgtgggtgcccttgcatttggagcatagatgttcagaactgagagttcatcttgatagatttttcctttgatgagtatgaagtgtccttccttatcctttttgatagcttttggttaaaagttgattttttttttgatattagaatggctattacagcctttcatacttgggcctggcagaatggctcccgcaaagaagggtggcgagaagaagaagggctgttctgccatcaacgaggtggtgacccgagaatacaccatcaacattcacaagcgcatccatggagtgggcttcaagaagcatgctcctcgggcactcaaagaaattcggaagtttgccatgaaggaaatggggacaccagatgtgcgcattgacaccaggctcaataaagccgtctgggccaagggaataaggaacgttccatatcgcatccaagtacgcttgcagaaaacgtaatgaggatgaggattccccaaacaagctctacacgctggtaacttacgtgcctgttaccacattcaaaaatctacagacggtcaatgtggatgagaactaacctgctcatgtcaaataacgttgcagaactgcaaaaaaaaaaaaaaaaaaaaaaaaaagaaaaaaagaatggctattacagcttgtttcttgagaccatttgcttggaaaattgttttccagacctttactttgaggtagtgtctgtctttgacactgaagtgcatttcctgtatgtagcaaaatgctggattctgtttatgtatccagtctttattttatgtctttttattggggaattgagtccattgatgttaagagatattaaggaatagtgattgttgcttcctgttatttttttatgttatttttatgtttgtatggctatctttttgggggggtgttgaaagaagattaatttcttgttttttctagggtgtagtttccctccttgtgttgacgttttccatctactatcctttgtaggcctggatttgt

SEQ ID NO: 25137 - DNA, 1197 bp, Mus musculus
gtacactcataacagtgtctggataaaacagagacatggttatatgaggcctgattctgtaccaactcttaggaactatggcgttgccaaatgacagggggtaggggatgtggagtggaacgcagacaaagacattgagattactgaactaaataacactggaagaggctgctgtgctgccatgccttgtcattcttgtttgtggtttatatttgtaatcatctgctaggctttaatttgacttgcaaatcttcaaggctctttctcgtgattgtacatatttaacttaaaatttgtatctgatggagcagttgtagaagacaggtatgaagatgtagacagtttgctttggaattgtttgtggtgttatatttctgtggtgagcagaagtagacccagtgtgactcagggtcaggatgtttcatccctgaagattgactacacaaaataccttctgttcttttttctgagaagagaatttggatgaatgaaaatcttaagtactttttgtgttgtcccccttcccctctatttctaaagagccaaactgacatcagatgcagagaagcaatcagtaatgatgtttggacagaacctccgccagctccttttaacaagtcctgtgccaggccgcaccctgatgggagtagatcctggctacaaacatggatgcaaactagccatcatttctcctactagtaagttcttcaacttttcatatgagagctttttggttgatcctaaattccacttcatagatattgttgtttagaaattgttttctcacggggctgtggggatgagagggcttcctgtatgtctggtcagaactctcatcatgtctctgatcccctctctccattagctagtgttagtgtcaggctgaactcctggtctcctctttccttctcttctgtttttctcctctctcctctccctctcccgctccccttcgcttcctttctttcttgacacagtttcttgtagtcaggctacctttggtgctcttggtggctgagaaccctgaactcaggatttcttctgtctctcctgaaatttggctctgtaggcctgtgttagcgcatctgtgtacgtagtgcctagctcttcaagcccaggcaagtattctccagttgcgctctatagaacccctggtgctgagacttgaactcatagctcttatcaacttcaactctt

SEQ ID NO: 25138 - DNA, 1172 bp, Mus musculus
caaccgcccccaaaagtcagctgaggtctgatatgtgatatggtagaaagctcccaaaaggaggccatgcctccatctccctgatgcaggcttctggggtgttctgatgccattaacggacaggggtcagacaccaagtgcctctgtctaggccttcgttttcatgtctggcaggtgactgttctgtgcccttcaattgaacaaggctgcacagatgtaaactgccacagaggaagggcacattgctgctatgattcctgtgtacgaatgtttctggcgtgctcacacctggtagtgacatgaactgattgacacttgcagcctgcaaatacggtcctgcaacctgaggcaccaagggagaagtcagctaggaagcccgtgaggccttaagttgttgaatgaagtcatgctgcacagggtggggggtgggggtgaccgtgctgcaggatagaggtgagtcacagtgcaagactgttggggagtcaccttgaatctgagccaaaaaagcagaaatattgggactcgtttatcagccttctatcaggtacatcaagttctggatggccacccactggccagcgacatgatgtggacggctctgctctaccgccctgggaaggctctctgctggctcttgccccgctgagcaaagtccgcttgttcgctggagttcacacagactccttgccaggcctgcccagaatcctgtctcctctgacttcctgtgttcttgcataatatttccttgcctcttgaatggctggccccagtgcgggggcagctcactggctctgctggattgagagtaggatgtggagggaggatgggtgatatttggatctaatccgtgggtgctccgcgtcctggtggcagagcccctcaaactttttgatggaagctttcagccagaagggagtgagagagcattgcagactgtatacacacactcgctcgtgcacatgctccctggcttcttatattcatgaatcatctccctgggaaaattgttgaagtagttcaattgttttcttctggtcataaaaatatgaattattcccatatagtcactgtataagaagcctaaaagtaaaataaatatatatatatatataaataaaaaacaaaaaaatgtattattgaaagataagttccattaacagtgaatatagttt

SEQ ID NO: 25139 - DNA, 2168 bp, Mus musculus
acacacacccctacacacatatacacacatgcacgtatgcgtgcacacacacacacacacacacacacacacacacacacccctacacacacacacacacacacacatatacacacacacacacacacacacacacacccctacacacatatacacacatgcacgtatgcgtgcacacacacacacacacacacacacacccctacacacatatacacacatgcacgtatgcgtgcacacacacacacacacacacacatctaatcaccatattgtaaaattttgtgtttttaaagccaactctttgctccggttttttcatacgacttagtatggggcaaaaaagcaatgtgaagaatcaactctagggttacctgtgaagccacgcggtggtgttcgaagctgtctggtaatgcccccatctctccccgggtccagtggatttttttaactattattcaaaagcaaaactgagttttgttttgtttggttttttaagaagaatttatatccgggtttagtgtttatcatatatatgggtactctgtaatatctaaaagcttagaaatgggatcttgctcacaagaatcacttttaagatcttttagggctgttaattttatttttctcagtgttctggacactgtagacctgtgcagtactcccacaggcctgactaaccgccacagatctctctttctttctctctggtgactttttgcttttgtgatatggcagcggtgtgacagtcccaggagagaagtcattaagggggaacattgcaagctatcttttcgtgttctcagtgtattatgtacgtgtgtgctgttgccgctatgagggctcggggcttgcaggctctgagggcatgtcgcaggcgagctggaaggaagcgctctcactttttttcaggcaatgttgctagcccttctagcacactgagctacgagactgccaatctctctcctgcggcacgtttgggttggcacagctaccatgaaatgtttttaatgggaattcataaagcaagttaggattcacaaatgtagtgacctagtccttggagctaaactgggagtgggtgccaggtggagggtagcaggtctgaccagccctacaccctgccacagatcacagcttgccgggcaaatgaccctgcgaagccacggtgcagcgccccctgctggcgagcagcgggcagacctccaaggacagcctctagctgaggtctcagtcacatgaagtgtgacactgaacaggtagaaagcactgaaaatcgtgttccaagagcactttgtaactcactgagggggaggggaagcaccttttgggtttgcgataccaatcaacataaggtgttgttgactcgggtacaataaaactctcaacacacacaaagcccatcaggcaagagtacagtaagcctaaggggacttgctgctcaaaccaaaaattaactctgaaggtcagtctacctgacattacctaggcatggtgttgtccaagctgcgcatcggtgcacagtgtggcctggcacacacgcaggcgggcgacggaacttgaagggttattgacatgcaaatgctggtgtttgatttcctgtgttgttgcctcagcgttaagggcatttccgtttgcagttctactaaagacactctgagaaatattccgagtttcgtattaacctttcctgtccatgtaacaacttcatgaccattactgcattgtcaaattcctactgacgacattataactgtacgggagcttaactttataaggaaatgtattttgacactgatatcttattaaagtattctgatcctatcctgctcgtgcctcttgttttctgtgcatttaccgtggactgtgccgttggaaaaatagggttcttactcaagagcacacagaaatggactttggagctaaactagaccagcctgagaccaccccacaggaagtccaatgaaggaaggcgtttgtgcctgacagttgcctgagcccaggagctggtcgctatcttctgcatttctgtagctactatgtgtctagccaaggccctttccttgcatgctgggaaagaagggaagaaaccatgggctctcacttcagagacccacacgaggcactgaggtccaaggagaagggcaccctgggccaagggcatcact

SEQ ID NO: 25140 - DNA, 1287 bp, Mus musculus
acatgtatgtggagctcacctaggcattaggcatgtgtgctcacaaggcacaagagggcaccatgtctttctttcttactataccttttgaggtagggtgtctccctgaacctgagatgcctttttctcagttgggctagaagccagcaaaccaaggttcctcctgtctgcaccccacttggatctgaaattatgggcatttgtgagagtgtggatgctggactccaaactctggtttatatgattacagagcaagtgcacttatccggggagccgcctccctgtcccactgagtgaccttttaggcgttagattgacctaaataaaccaggcagttgcactgcttgctcacacacgttttcttgtgtttcaggcatctgtgcgatgtgtggcaaaaaggttttggataccaaaaactacaagcagacttccgtgtagatatattgatgaagatcctgactctctaggattgtactttgtgcttcaactattcaaggcatagcatgaatggacgtccatcttacaaaataacctgtgtgaagatgaatgattcggcctgaagcagggaagttgatcagtattgatttgtctgctctcacaaagttctgaacagcaatgatacgcccagttttctgccttaagtggttgttttccttgtgagcattgtactgaactagataagagacaaaattaatgaataaggtgttcctgacttctgtacgcactgtctactcaacattatccatatgattcttacctgatccatgcatttatttatagttactgcaaatgtgaaattactgatcctttgctctgaacttgacatccagacctcagatttctcatttattcacaaatgtcacagttcttagaatgagcagcaccttagttaagtgcattttcatgagctataaattattgcagagtggttccttagtgaccagtcctgccgaaagtctaagacaagttgcatattttacttaaatttgctgttaacactaaagtccaacatgtgactgagagccatggggcccaactgtccaggcactgaagttcagagatgtgcattccgtcagcattatcttaaattcaaatgaggataagtttcttctgtttcggaatgctctttgaagcaagaaacaagtctttccttaacatccctccacccccgctgccactccctcagaaataaagcaagcaccctggcctgttgtgtcttcaatgatgtcactgtagactgctaggagattatttttgaggtttcaaatgaaagtttttcttgttgcc

SEQ ID NO: 25141 - DNA, 1906 bp, Mus musculus
gctggcatatgtagtttctcacttggagttttataaattgaccctgcctggcctgagtctggattcctagaagtggcacattctccctcgagggctcctagataagtgacccttgtaggcgtttgctaatgccctccgtaattctgcccctcaccgtcttgtgtacctctcggtaggaggggagtgagcaggcgccagtcatgagcgaggatgagctcgtcagcatcatagatggtgtcctgagggacgatgacaagaacaacgacggctacatcgactacgctgagtttgcaaagtcactgcagtagaccgttggctctttcctttgtgcacatgtgacccttgctaatgtgatggatgtgtctggtaatgcgaaacaacttatttccgtctactgctcagcactttggtaagagcctgtggcagtctgtaagagtggggtgaggaagaagccacatgactgtggagagaagtgggacaggcctcagtccctagaggtgtgtttaagcttgttgggcaagagctggatgcggatcttcggaagggcggtgggtatcccgagttctcaggaatccgactgtagaatgccactctgacttcttgatgttaatccatgctacctaaagtaaagacaggctgcttggccaagtggacacacttgagaaacagtggagggagagtgtgaaagccacacgcttgccctggttggtcctgtctttaggcagatgtggtcagtattctgttccccaggcatacagcatcatatattaaagccacagcagaagaggaatgtcgcccactgaggccacccagatgcagagtctaggattccttgcccactggccttttggaaatgaagcaccactggcctgaataattagccttttccagatcttcagtatcttccacaactactgccataccctgtgttgtatcatttgaccaggagggaaaccttgaattggggtgtgttctctaatcactttccactgtctgagctttcctgacccctgtattgtatccttgctcccagggctcccttcatggcttgtgaactgttaacttggtatctcaggttaaactgtcagctggtctagcctgagcgaggcctgagaccatcagtcactaagagcagtggctaacctcatcgaagttggaaggaatgtttttaaaattacctcttcgagcctgaatacaaagaataaaagaataaaagaattcttttaatttcagggaagatcagaaaagaaagcctaaagccctttagcgttgtgaacctcagtagtagctgaaagagaagctgccacaggttgtacttgctctgtgagatgttgtagacattccgtaagagaatccagaatgatagcaggatcaggaaagaaatggagccaaatctgctctaaggtgaatagagacttatttttctttattaaagtattcttgtaagacagttttctgtgtcaagtatttgtgaaatcagagctgacatgtaagctattcttgtaatatctcattattttgaaagatttatataatgaactctggctatctgacaataaaatggatgaaaaagcaagcagctgttgacgttgactctgtcccccatgaagcctcctgccgcatggaggctggatcagtgccagcattcacacctgccttcctcccagaagctgtgaggtagctcaccaggccctgggccgttctgtcttgcacaggggattctgtgttcagcttctctttcctttttagcgtggtttgtatccttccgaatgaactcgcttttgaatcttccttctccggctggattctggttgtgacagttctctctcgggtgggcaaacacactgtttccccttgagtctgctaacttactgattatagatcacattattggagtgctccgtgg

SEQ ID NO: 25142 - DNA, 1143 bp, Mus musculus
gacacggaccctggctggcctggaagcacgcgggtctcaggcgttactccatctgcctctggctcccccaccttcctcggggcagacccacaggtcctgttgtctcgacagggttggctagtttgagcctaggaggttaggtagacaagggatgctcgtttgtctcgttttccctttctgggacatggcacctccatccacacatatgcccaaaccagaggcctgggcgtcactcttacctacactcatcaaatacattgaacctattcaaaactctcacttttccagacaccttgccttagcaatcagctctcttttctgctcctttaatattgattgaccctcctcaacgtgtccagtacaggggaggtagagacacgctcagccaccctgccccattcccaggtccttctgtggattctcattgcccttccaagctcttctttccttcctgcaatgcctgttgtgactcactcactgtctttgtactttactcaagacctgcccctcctcatctgaatattctggattggacttaagtcatgtttaggtgttcactgccatatggaggggcgtgctttgctttgggttgaaatatttcttctcatgctttctgtggatgggggtgtgtgtgatacccctggagtgcctctttagtgacctgtgttttgctgtcgagaggcgtctgactgttctcacagccttcacagctctgctctccctatgtaactaggctcttagttaaatgttagttataagggtagcatggcattcctttggaatcccccagtgaacaaatggaccagactattaaacaccagcctattcaggacaagttttcaacctcagcccatgtgggggctttctgtaacccagaaacttgctggttacttggacttcaagagcatggagatgactacaactaggaagcactagtcagttggccttggctccgtgtaacaggatgtctggggtgttgtcaaatgtgattgctttgaatgtaaattcccaactaagagcctctgaaggctgccaacagctgctaggaggaaagcccactccctgataggaataatggcccagtgggaaggaagggtgggcaggagtgctgcaaagggagagctcagccttaggccagggcct

SEQ ID NO: 25143 - DNA, 1132 bp, Mus musculus
gatgcttcctctcacactggcttcactctcacggtcctgcttggaaatggattgggcagcccctcactcccttgtggtgtgagccagccccctcactcccttgtggtgtgagccagccccctcactcccttgtggtgtgagtgagccccactgctctgcccagctgcactccccaggacgtgccctgttctccttacaggcagatggagaggtttgggctttgagattgatgcccaccactcccctgcccccacttccccaccccctcccaccccctacctcaggaggagccccatgagtgagaacttttctatgtgcaaggagatagctttcagcaggttcttaaagggacggagaccccagaaccgtggtgatggtggaagtgggtgtttgcctttgtgcatcctgactgtcctcactccctggtgcttttcttcccctccctgccccacccccacgccacccccacccccacagtgttcttgtggagctgcctggaaaatagtgtctctgcttctgcaggaagagccttaagggggcagcctatgccatgagaactgctcactgacagagactgcacccggggagctgcagaagctgctctagggtgtgagaccctgtacagtattgttccctgttactacagtgcgctgttctgcagagcacgagggaatgggggtgatctaccccgtggagacctccctcactcggtttgctcaattagtgggatccaatgacgtggagaagtccgtctttatcagctctgctttgatctgaactggccctaaaaggctacaaaactaacagataggaattccctttgccaataaattaaaactgttccccacagatgaaaccctggggtacagaaacccatggattatcaggaaatgtcattgaatccattacaggtcagggatcactgaaaaatgtcactgcttttcggctgcgtgtcccgcttccccagctggccccgtgctaagagcaggccgtatgggactccagctgttgctagcaactaattaaaccaccagtccagtaaatattgctcagcaaaacaacagaccaacctgccacggcctggcctcatcagccccagcaaagtgtattctcaggcctgtgacatggcttg

SEQ ID NO: 25144 - DNA, 2075 bp, Mus musculus
gaatagatgacaagtgagcacttccactggcttccatgccacttctcctcccacactccacaccctgcaggcccagctgggcctaagctcctgactgaagctggggggacaagatttgcatccaaggcaaacgcctcgcctcccccagagactgccggttgctgggcacctcttagataaaaggtgtgtctgggagccaagccccttccttggcttcccccaccaccccgggtttcctggtttgggatgaaccaatcttgagtttgtgtaccacagagatgagtgccttgggagacaaactggcttgaatctcagcgacttcacagagctgtgagcagacgtgccggagagccccggatacatttccccatccgatctcagggcagtgcaaagcttgaagccttgcccaggacagccacagcttgaggtcccagatacaaagagggacagtgggctcctgggctcttgtcagcctgaattggccctgttgatgcctggtgtttcctttatggggaggttgcctagaggctacatgtgatttctctgtaccaccaagtgccttttggactcatgtcggccaggcctctaaacaccgtcccccgtcttccattttcactcactgtcatctccctggagacacgccccagtcagtagactccgtgggccctgagccggtggcctccaggatacgccttggaatacaaaacagggttctgacgtagccattcctggtaccttgagtacacagtccctcaagtctttggacccgcccacttgggtgaatgacatccaagtgaccatttataggcctcagcccagtacacctcatcacccactgcccagttttcatcttaggctttgctgagtgaccccaaagccccagcttggccttttgtgctcccctgcctagattcccacagcggccatgcttgaggaacctgacagcctgcctcacctttctgtgcccgcgtgctctctgtcaggtcgctgggcagctgtccctccctggctcgtcagccatgcactctggttttgaaactttccctcaggaagccattccccaaggcctagcagagagttccttctgtctcccctactctgggtagagctccctcgggttcaccttgcgcttgtgttagaatgtgtcaggggtcaccgtgctgaccacagtggccttgcggagaaagccgttggagtctggctccgtggtggactgatgtaccctgcttgtcccctcgtgtctccagagagctggtgcctcctggccacagccacaggccaaagggaggctattcagtccttggttgaagggtctctatgtgtatatgtgtatgtgtgtgcatatatatatatatgtatatgtatatatatgctagagatctatatttttatggaattctgttagagtaaaaaagagaaaagcagatactattggctggccttggaggtcaatcttggcagtgggaaagacagcaaatgtgtggactgactaagcgtcctctctttggaggccctaggaggcaggcccagtgcctgacagtgactttggaaattgaataaaagacccttggagggggacaagactgtctgaagagtgtccagttacttgatgctcagcatagagcagtgacccgggccctggagaagagaccctgtcagaggagaaacccaaaaggcagggctgagggaaggagagtgggaagagagaagaggcccagctccgagaaggttgattcctatcgggtaagcagtaagactagaggtcaagccaatgcctgcaagttctcgggggaggtagaggggtctgggcctggcctgtgtcccgtctttcaaataagcctgcccagtaggcaacctcgaggattgggggtgttagcactcaggcatctctactgcccagtgacagcagagcaagtcatcactagctgccacgatgtgacacatttctactgtggccactagttggacatcctcccgtgctcgtgtgctaggccagtccctccaccctcacccagaggcagcctctgtagactgctccctgatacacctcgcatgtgagatctggcttagatcac

SEQ ID NO: 25145 - DNA, 1317 bp, Mus musculus
agtgtaaagtaagccaagtaaggcaagaatgctctccctcccattctgttcctggggattgaactctgggtcttacctctgctaggcaagtgttgtacagtaagctctatccctcagccccaacattaattgcctcatgtttaatgatctatctaagtttctagtgattatgaagataagctttggccattaactggcttccctgctgctgaggtgattgaaggaagggacagaggtgcagtgtgtggtcacgctggcttgtcctatggatgactcacgtttctgtgtttctcatttttttttccagagtttgtacaaatgatgacagcgaagtgaagacattgtacagaatgtgttaaatttcttgtacaaaattgtttatttgccttttctttgtttgtaacttatctgtaaaaggttccccccccctactgtcaaaaaatatgcatgtatagtaattaggacttcattcctccatgttttcttcccttatcttactgtcattgtccttaaaccttattttagaaaattgatgaagtaacatgttgcatgtggcttactctggctatatctaagcccgtctgcacatctaaacttagatggagttggtccaatgagggaacatctgggttatgccttttttaaagtagcttttaggaactgtcagcatgttgttgttgaagtgtggagctgtaactctgcgtggactgtggacagtcaacaatatgtacttaaaagttgcactattgcaaaacgggtgttttatccaggtactcggacactatttttttgtactgctggtattgtaccaggaacattttcttttattgttacttgctttttaaactttgtttagccacttaaagaaaacctgctcatggcacaacttgcctcaaatccattccaagttgtatatttgttttccaataaaaaaaattacaatttacccaattgttgctctgaatctgagtgatttaataactattagtgtctgattttggggatagcgtgtgaagttgctttctccatggtgtgaggtagactcttgtaggaacttcctgcccttacaaaaattaaaagccctttttatggctgagcctttaaaggaagaagcaggcacatctcttaagtttaggggccagcctaatgcctggtctacatagcacataccaggccagactggactccacagtgagaccctgtctccaagaagaagaaaaaaacccttttataaatgaaccttttgtaaggaattgggatgtaatacatatttagcatttaccttttcttatttaaagattttaggttgatgggtat

SEQ ID NO: 25146 - DNA, 1178 bp, Mus musculus
taaagttcttaagaataacgtatattaaaaaaaaaaagaataacgtatattttacttttgtaataaagttttaaagcttaaaaagttttctattcaaaattgtctttttctctataatgttagatctaagtggacattgatagcttggctcaattactaatatcagtatttgatggtttctttcttgatgttagaaaactagtccttttaatatttttctgaagttcttgctttgatttagtattttattaattgtagacataacctttgaaggtccctctaaacatctgtctgtatattggattttcctgagcttttagtccttcctggtagctcagtatgaaccagcatagtggcttggttagccaaagattttgacaaattctcacaaggtattcccacctaatttattaggagtccgagttccacttgaagtgctgtctatctttgccttcttggagagttagtacattttactgcgtagggcggcggtgctaacctgtatgtttggacgtgtgttctctctggcagagttcaaagaagctttctcactatttgacaaggacggggatgggacaataacaacaaaggagctggggacagtgatgaggtccctggggcagaaccccacagaagcagaactgcaggacatgatcaatgaagtagatgcggatggtgagtgtttaatttggggctggagggtttgtcacagaggcgtctgcattttgttgtatgtttacacaaactattttcaggtaatggcacaattgatttccctgaatttctgacaatgatggcaagaaaaatgaaagacacagacagtgaagaagagattagagaagcattccgtgtgtttgataaggtaaggctcgggcgcattcgtgggcagtggaatgagaccgatagagcctccccggggaccccgtgtaaacttactgcagaggatgcatatgtcatgtgcctttggaggcagggagtagtagctggagacagactacttaatgacatttacagatcaggtagtgtggattctcttcactttgtgtgaaaaaaatccacccaagacagggtttctctgtgtagtcctgtctgccctggaactccctgtagaccaggctgctacagactcagagaaccacctgcctctgcctccacttgatagaaatttctagagtcta

SEQ ID NO: 25147 - DNA, 1204 bp, Mus musculus
actaaaggcgtgcgccagcatttctggctcaagaccacttcttaaaggcatgattgacagaatgagttgacagttggagctacattttaaacttaattttttttttttttttttttttttttacaattttctagactgtgtctgtgacaactacaagctggcaacaagttgctctctgaatgaatatggtgaatgccagtgtacttcctatggtacacagaatactgtcatttgctccaaacgtgagtaaatcaatcttcttattgcctggaagtttaatctcgataatacttttcaaatcgaggctcctcgagttgttttattggctctaatctgttattttgtggaaagtatcttcagccagtaattcagtgcgggggggggggggggggaatagaagggcgggtagaatggaagggcgcgtgaataatccttggcctggatggcagcagaataaaaagctgtgctctgggcacgtgaagccgcggctgtctctcattgggcgttactgtcatcgcctttccagtggcgtctaaatgcttggcgatgaaagcagaaatgactcacagcaagtctgggaggaggataaagcccgaaggggcgatccagaacaacgatgggctgtacgaccccgactgcgacgagcaggggctcttcaaagccaagcagtgcaacggcaccgccacgtgctggtgtgtcaacaccgccggagtccgaagaaccgacaaggacacggagatcacgtgctccgagcgcgtgaggacctagtgagtgagctttccagtgcgcttaagtttagctttgaataccaaataagatttttgtgcctcggaattcaaaaaaccgggaaaagccgggcgtagtagttcagggccagccacagtgagtttgagaccagcctgggctacttgagatcccttttggagtgacaagtgtccatcctgtctccgtgcctcatgaaatggcagtcaccagccttgagttgggctttattggccctaatccagttatatttgttttcttggctctaatccagctgtgttgttttgtggaaattgccgaagctttttatcctcggcaagtcattaagtgtgaggaatggaaggaggcctggaatgatctctggcctcaggttgtgacatttccagagctggcttctgagtcctgtgtagacaggctgggtcttaggttttacggaaacggt

SEQ ID NO: 25148 - DNA, 1337 bp, Mus musculus
atttatttagatccagggtccctttacatagccctggctgtcctggaactcactctgtagaccaggctggccgcaaacttagagaaccatcttcctctgcctcctgagtgctggggttacaggtgttagccaccacatccagctgaaaacgtaactttaagacccccaaacattgagggggtggtgttggtgtacgcctttaatccccagcgctcaggatgcagaagcaggggatcgctgagttcaaggccagcttggtctactggctgagttctgggacagccggttctttgttgcttctaagcaaagaaaccctgtttcctcctctgttgcagataaaggagatgggtgagatccacagagagcttaatgcctagccgtgctgagtgctgaactgaggaggggccgcccgaccggaagtggcagaagagctcggactgcagatgtataaacctggggaagatgaagacctgcgaagggttactgctttgatagttactttgttagtttcacatttgtaacagtgaaatttgtactcgtaaatacaagcagctggacaccggcattaccgatcgtaaaattagacgaacgtcttataggtgcaggtccagtgtggtactcagaacttagcctgcaaagttaagagagttgatgcttattatgacagagtgtgcgtcgcaaacattccaacagtagaatgcggtgactagtctcattttttttttttttttgtgattaaggctgcccttctatatacctgagtcttgtacataataaacttttttttaatgaaataaaacattttaaagtgagtttctaagtttgtttgaatcaaattttcctagcatgtgcataattaagataatagatgtctaaatgctctggcactgctaactggtacaaacctgtaattctgtacttgggaggtagaggtaggagggttagcgcttccgaggtagctgctgtgtatctgctctgccactgactggccttgactatccaacaccctatctgaaagaaataaaaatcaaacttaagaaacgtgggtaagtcttgtgttatgggaggctagggaatgagtgtggttttgaaggcagcccaggctatgtagacacagagttccaggctacccagcgagaccctgaccatcagtaacatattgtgagagttggggtagtgtggggtggttgggagggttgttcagtggtactatgtgcttaccatgtgagaggccctgtgtccaatttgcactaccagtgtcttagtcagggtttctattcctgcacaaacatcatgaccaagaagcagttggggaggaaagcgtttattcagcttac

SEQ ID NO: 25149 - DNA, 1085 bp, Mus musculus
gtacctccaaatcaataacagcccgcagcctaggagcgaggagtggagggcgttttgagagcttcctttaagacaccctcatttgccaataggctgtgttttgttttgttttttttaaaccgtctcgcttgagaacctgggatggaccattgctgaagggcagtatcgccaagtggtcaggacctaggatatgccctggagctgaactgcccggatttcagttgtggatcccctactgtttgctgagtgcggttgagctagttggaaagctgtgcttagctagctagctagctagctttctttctttctttctttctttcttttttttttctgccaccttggctctcaccactcagcatcatctctccctaaaaggcttcagaactcatttgtggcctaggaagattaatttgatcaccataataacctctcccccacccacccccgttgctttttctttcaattacattgaatgtccattatatcatactttggagttgtgagttctaattttttttttttttttggtttttcgagacagggcttctctgttatagctctggctatcctagaactcactctgtagaccaggctggcctcgaactcagaaatccacctgccttccaagtgctgggattaaagacgtgcgctaccaccgcccagcatgagttctaattctttatgctgttatatgcaaatggatgttacagacatcgtatttctgcctggtctgtgctaggtaatagtctgctgccttcacaaccagttgaatttgtttttgttagacagctattctttatcttgagttaaagagtgacacacacacacacacaagaaatgttgtgtccattaataatgttctctcacaatcttcccagtcctgacctctagttttccttctctggatattctgggatgtagcatgtaaatgaagagcttcaaggcttatctctgtcatcagcacttcgttccttttggttgctaaataattgtgtggatttcccacatttcatttagctccttgtccctggagtttgttttggcttggtttttggagacacggtctcactctttagccttggttg

SEQ ID NO: 25150 - DNA, 1198 bp, Mus musculus
tgattttttttttttttttctttttctgagacagggtttctctgtgtagccctggctgtcctggaactcacgctatagaccaggctggcctcaaactcagaaatcttcctgcctctgcctcccgagtgctgggattaaaggcttgcgccaccacgccccggcctggtaaattctttttattcatctcttgtgtgttatgtatatggctgaacacaatgcagtagggatgcaggagtcaggcctattcttctacctgagaggtctgagtgtttgaactccattaggaagcttttattcatagcagttaccttgataacgtatcttctctgtagtccaggctgccctcaaactcctcctgatctgaagttatacccctgcctcagacttccaagtggctagactgctgatatgccccgttgtacatacatgccccgttgtacatacgtagtgtttgttcattcagcagtttgttggaaggttggcttgctgaggaaatgcaagtttaggctaatttgtgaagttctcaaacatgtattacctcacagcctcatctttaacatttaaatttgtttatttgttgtttatttcagggagtaagaccctgcagagtgttgtgcttagcaagatgaactttgagtctttcgtgaaagatcttcttctggttcgccagtatcgagttgaagtttataagaataaagctggaaataaggcgtctaaggagaatgagtggtatctggcatttaaggttgttattttccttttggatgtttgtcttagaaaattaaattcagtgcatgttttactatattaactaggttgtgatagcaaaatgccttgagaaattttgatagtgttgggtttctaaaagttacagtttaatcacagtttagaaattcagtagtctatctatataaaatgttttgaacacgccaaaccttgtctcactgttcctgaaatacaacattagatgataacctggacataaatgttataattttaaaaagattagttttatttatttttttaattaaaaaattacttatgtgtactgggtctgcatgtctgtccgtgtaccacttgcatgcctgttgctagagcgaggagaccagaggagagggccttggatcccttggggttggtgttagacttgtgagccagattctagaagagcacccagtgttcttaatctctgcctgtc

SEQ ID NO: 25151 - DNA, 1099 bp, Mus musculus
gaagccctttccgcagctgtgtatctagtgtttgtaactttgtttcattttgtgctacacaggctgttttggcttctaataaaacttattttcagaataatggttttaaacatatgaaataaaacaaggagaaaagaaactaattgtattgaagtgtagttatcaagatacaaaaccttgatacagagccatacacttgagtttttgtttttgtttttggttttggtttttttttttttttggtttttcgagacaaggtttctctgtatagccctggctgtcctggaactcactttgtagacaaggctggcctcgaactcagaaatccacctgcctcacacttgtaattaatgcatttaaattgtgtatgcgtgcgtccatctgtctgtccctctgtccctccttcccttcggaagagacagtaagatatcaggtctcctggagctagagtaaatgtagttgtttgctgcctagtgtgggttcttggaactaaacttgggtcctctgcgggagcagcgtacagtgttaactctccagctccttagttaatgcatttagaaagattgtaaggactggagagagagccggctaagtgtgtaagatggagagagagccggctaagcgtgtaagatggagagaaagccggctaagcgtgtaagatggagagagagccggctaagtgtgtaaggtggagagagagccggctaagtgtgtaagatggagagagagccggctaagcgtgtaaggactggagagagagccggctaagcgtgtaaggtggagagagagccggctaagtgtgtaagatggagagagagctggctaagcgtgtaagatggagagaaagccggctaagcgtgtaaggtggagagagagccggctaagcgtgtaaggtggagagcgagccggccaagcgtgtaaggtggagagcgagccggctaagcgtgtaaggtggagagcgagccggctaagcgtgtaaggtggagagcgagccggctaagcgtgtaagatggagagagagccggctaagcgtgtaagatggagagagagccggctaagcgtgtaagatggagagagagccggctaagcgtgtaaggtg

SEQ ID NO: 25152 - DNA, 1135 bp, Mus musculus
cacatactcatatacacacaaacacacacacttataatcacacactcacacacacatacatataccacactcttacccacaacacacatacatactaacatatacactcacacacatacacacacttttacacatactcatacatacacactaacatacacacgtacacacacatcacacacacacacatgcacacacacacacacacacacacacacacacattcacacacatgcacacttcaaagctgtcctcaatgtgagtctctattgtgcccagtaattatcatgagcaggccttacctctctggtttaatgatctgaaatgcataagcttatggaaaagggatggtggcacagttaaagacccttatgtatgttgtatttctctcaggacagaaggtagcacggtcaccctcttgacttctggagcaggcatggggcaggtgtgtaggagcccggccttcttgacttctctgcctgactgtattatagcagtgcaagggagtcgggcaggcaggagaagtgggtaggctgtgtgtggctgctgtggattttaattcaattcagtctgtatggcttactgaatcaatgttgggaaaacacagctctctcctgggaggagaggtgtttggtataaatagaaggtattatcactgtgaggcaattgggggatgtctgtcactccaacatacagctcaacacagcaacctacgttcactggggcttgccccagataagagaggaggggggttgggagagagagagagagagagagagagagagagagagagagagagagagattactcagcactcctctctggacacttagttgctttgcttggaaaatggaactattttcatttggctctctgtcccagtcatcctgaggtgccattgatggagtacttccatgcaggtgaggtgccatgaatggggataccgcttaacccctcagcaccaggtctgacccagagccgcatctgccctggttaaacactttgaggagctttaaggggatccactgtccaattcacccatttaacagaagtcccagccactcagaagatgaaggcaagatcagaagttcaaggctacggctatgaagtttactaagactgtctcaaaagaaag

SEQ ID NO: 25153 - DNA, 1107 bp, Mus musculus
atctaaagctctagcttttacattttattatgatatcatcctgctttgtgcatttgagtctacgttgggagtctacatggctacagatataaaggctggaaaccatgatggtgtgaattttctcatgagtcttcagtttaggaaagacaaagtggttgagatcatctctgctctatcccatgccagctggagcagcctgaagcccaggctggaatctgccgggggtaggttgctcacagatgtgtaatcctcagacctctcaggcgtatgatatctcagaacagtgctctcaggggcgggctgtccgtggggacagtgacaggaatgcattgcttctttaactggtcagtgaccccaaatgcagggagctggctcgtgcaattagggcagacctcagagaaaaacaaaattgagatgcaaaactagtgttgtgctaggtaatgagatgtgaccagagaaattaaattaagctcaccgctgtttccaccagggtggccaccccttcagctgtccagatctaccacctaccagaaccaactcttagggaagttcttcagctgtggtaggagtggaattctgtctgtctttggctgtcagaccagatggagaaaagcagcagccctggtctcaggttaagcggcgattgttcttcactctttggattcttcctctctctgtctgaagttccagagcatcggagagaaacagagatggtgccggtggggaggggtgggaacctagaaacagatgaccacaagcacacactgagcatctgtgtgcagcaccctggcctccaggacaggctgctccaaatcacccttagttagaggtcctccctcactcacaggatgagagcttgactgctccaaggtatgcttgaggggaaggtttgtttaagaactacaggatttattttttatttattattttctcaatgtattgcttttaattctattttatgtgcattggtgttttgcctgcatgtcatcccatgtaaggttgtcagatccctggaaactggagttaggagcaggtgtgagctgccatgtgggtgctgggaattgaaactaagtcctctggaagagtatccagtgctcttaaccacta

SEQ ID NO: 25154 - DNA, 1131 bp, Mus musculus
tgactaacaaatggaagggtccagatccagttctaatttggggtaaagactcagtttgtgttttttcacgagataaagatagagcgcagtggctgccagataaattaatttgttagatgaacacagattctaaatcttctaaagtatcaccttgaggactaaaattcctcttttgcttaaaagtcggcttgaggactcaggctccgaaaaaagctactctctgagccagctccccgacaggaggccggagactagcctcagctttacaatttgcatttaaataaagtacctagagttccccaaaagaagttctgctttcctactttctcactgtccgagattttgtctttcaagcaggtaaatcaacattctcgaggcagaccagcggatgtgcatccccgcgcccctagagcacacaggtggctgctgttatctcctttccaaggacatttccagcatgtggctttcagtctgagttaaaaattaggtttaccaagagggctaaaaaagtagatatttctatattaataaagattggtttttattttgatagacaggcttagctccttagctgacctctggcttttcacccttgctgttactgcaaggtgtccttagctcaataggctgtagaaaaaacagagatgaggaggaacgacttccagctcctattttagccacaaatcgtggtgttactaacgacataattcttgcttaggctttgctaattctgaggttgataattctcctttaggagctgcacagcactcaaaactgtgcatactggtttgtgattgtacaaattcagtatgggcatcgcttggtgcagaggtactgcaagggaaggtccggcttgaccatttctgagtttcctgtgagataaacctggtttaaaagaggttggtatcatattttggttaaaaataaaaaatattttccggctctacctcgcctccccaaaagatacccagagccacatgtgtgggttttatcaatacccacgggaggaatcgggtccatgtccacccaagtcaaggttaaaagcccactcatctacggatgagaaaatcatttgatcacctcagttaagcgttgccttatttaacttaatcaataagggggagagagatt

SEQ ID NO: 25155 - DNA, 1185 bp, Mus musculus
ggtcttcaaacacatcagaagagggtatcagatccccactacagatggttgtgagccaccatgtggttgctgggaattgaacccaggacctctggaagagcagttagtgctcttaactgctgagccatctttccagccccgccttaactcttcttaaaaaataattacactatttatggggggtataggagatgggtatgggagatgtgtaaatggcacagggtgtgtatggagttcagtacaatttgtgagaggcacttttacccaggtactaaaacttgctgagtcatcactctggcttcttaatcctttctccttccttttttttttctttctttcttttttttttttttttgttgttgttgtttttcaagacggtttctctgtgcagccctggctgtcctggtactcactttgtagaccaggctgacctcgaactcagaaatccgcctgcctctgccttccaagtgctgggattaaagatgtgctcagccatgccttgcttctttcattcttaaaccgagtctatatgtatctcaggctggctatgaactcacagaaatctatccttgtcttttttttttttttttggatttataaatctatttttaacaccattgctctattcagacacactaccagaagagggcatccaggtccattacagatggttgtgagccaccatgtggttactgggaattgaactctagacctctggaagagtagaattaactgctgaaccgtctctccagccctgcccgtgtcttctaagtgctggaatcgaggctgtgcatcatcagtgtttgtagggctggggagattggatggattacaaggatgagagttttagttaaatgcacagaaggaagccacctagaaaataagctggaaatagtggcagatatccttggcactggggaggcagatctctatttggcaagttctaggccagtgagagattatgtctcaagacaaaaaaggtggctagtaaccaaggaatgacacctgaggttgacctctggtccccatatccttgtgtatatataatttgcacacttgcatacacacaaagctaagcttttagtattgtgtgaaaaatctgagactggcaagatggcttattaggtagagtggctgctgccaagcctgctaacgtgagtgtgaagcctctgtctctacatgcac

SEQ ID NO: 25156 - DNA, 1105 bp, Mus musculus
gaagcgacgggtcatctcagactcggagagtgacattggtggctctgatgtagaattcaagccagacactaagcaggaaggaagcagtgatgacgcgagcagtggagttggggacagcgatagtgaggacctaggcacctttggcaaaggcgctccaaagcggaagagagccatggttgctcagggtggacttagaaggaaaagtctgaagaaggaaacaggctcagccaaacgagcaactcccattctctcagaaaccaagagtaccttgagcgctttttctgcccctcagaattctgaatcccagacccacgtcagtggaggaggtaacgacagtagtggacccactgtttggtatcacgaaactttagaatggcttaagccagaaaagagaagagatgagcacaggagacgccccgatcaccctgaatttaaccccaccacactgtatgtgcctgaagagttcctcaattcttgtaccccagggatgaggaagtggtggcagctcaagtctcagaactttgacctcgtcatcttttataaggtggggaagttttatgagttgtatcacatggatgctgttattggagtcagtgagctggggctgatattcatgaagggcaactgggcccattctggttttccagagattgcgtttggccggttctcggattccttggtgcagaagggctataaggtagcacgagtggagcagaccgagactccagaaatgatggaggcgcgatgtcggaaaatggcacacgtgtccaagtttgatagagtggtgagaagggagatttgcaggatcattaccaagggcacacagacctacagtgtgctggatggtgatccctctgagaactacagtaggtatcttcttagcctcaaagagaaggaggaagagacttctggtcacactcgtgtgtatggtgtttgctttgtggacacttcactgggcaagtttttcatcggccagttttcggatgaccgccactgttccagatttaggacgctagtggctcactatcctccagtacaaattttgttcgagaaaggaaatctctcaacagagaccaaaactgtcctaaagggttcactgtcatct

SEQ ID NO: 25157 - DNA, 1168 bp, Mus musculus
ggctactgagtaagattcataatgttgggtctcccctgaagagccagaaccatccagacagcagggctataatgtacgaagaaacgacatacagcaaaaagaagatcattgattttctctctgctctagaaggattcaaagtaatgtgtaaagtctcagggcttctggaggaggtcgcgggtggttttacgtccaaaaccctcaagcaggttgttactctgcagtcaaaaagtcctaaaggccgctttcctgacctgactgcagaactgcagcgatgggacacagcctttgaccatgagaaggctcggaagaccggactcatcactccaaaagcagggtttgactctgattatgaccaagcacttgctgacatcagagagaatgaacagagcctcctggagtacttagacaaacagcgcagtcggcttggctgtaagagcatagtctactggggaatcggtaggaaccgttaccagttagagattccagagaatttcgctacccgtaatctacctgaagaatatgagctgaaatctactaaaaaaggctgtaaacgatactggaccaaaacgattgagaagaaattagctaatcttattaatgctgaagaacgcagggacacatccttaaaggactgcatgcggcgcttgttctgtaacttcgacaagaaccacaaggactggcagtctgctgtagagtgcattgcagtgttgggtaaggctttggttaacccttgtgtcccaactatccatctctaaacctagctatgtttaatatgggtgtgtgcatggatgtttaaataactacaacttaggtttcactataatagccttatgacaatttttcctagtcttggaatagtttcgaattttatcattgagggaagatttattttcaagtctctttttaaaaacacttactggtactaggtaatttcctgatttgtttaaggatctgtagcccaagctgatgttgaactcctggcaatcctcctgcctcacatccccaagtgctaggattagaggtctgggccactatttcccagcttttacaattttattttgtcatgctggcatcagatctagacctttgtgcatgcagggctatttaaacattttggccacggagccaaaatcttgagcccaaaatgcttttataaatgcttatt

SEQ ID NO: 25158 - DNA, 1093 bp, Mus musculus
aggttattgtctgagataaacttgctggatccaggtattcctggtagttaaagcccagaggtctttgttagctaggtatggaataccaggttcctacttaaggattcttgaatccaatggtattgtgtacagatagattttcaaataccaattcctttcttcccatcttcccaggctggtctgttggctgtgatggcccagctgggttgttacgtacctgctgagaagtgcaggctcacaccagttgacagagtgtttactaggcttggtgcctcagatagaataatgtcaggtgagttgcttttcctccacacaattttacaattcagttggcaaggataacctgccttttgttttaaacttgatgtaacaacatatatgcttttagtttaaattcttgctcatcattttcaaacaagatataatctgctcttaactcagttgtttctttttttaggagaaagcacattttttgttgagttgagtgaaactgctagcatactcaggcatgcaacagcacattctttggtacttgtggatgaattaggtaagacagattttgtttgaatgccattagggtggaaaacccatgtccccaatagctactgtttccccctctctggcggtcctgggatttcctgtcttgtctggtaggcaagagctgtactgctgagatgcagtctccataatcatttttatttaagactgctcatcagtcaagagcatgcatgcatctctgtaccatgtacatgcagtgccttgggggggggggcacttggatgtcctgccttttcctttttttttttctcccttttggttgtgagacatggtttctctgcgtagccctggctgctctagagctcactttaatgtagagtgggctggctatgaactccgagatccacctttctctgtgcctcaggcagtgcctggctgggttcattgcttttaactgctgagcatttacacatttctggtgtggaagcatatgggggtcagcagatgctcagcatattgtatgtcgtatccaggccactgggctcctgctcatttctgacaataagtagacaaggttggcctttccccatgtact

SEQ ID NO: 25159 - DNA, 1101 bp, Mus musculus
acagccacaaaaaaattcagacataagaataataaaatgcagtgttgtgaattcctgacaagttcaataatacaagattttgctttttagatgtcatacttgtaacaccacagatcgaaatgccatatgtgtgaactgcattaagaagtgccatcagggacatgatgtagagttcattagacatgataggtatgtagcagtatgcgtgttgctatggtacccaattccttcccgtcactttgctaattcttggattttcattttgctttaggtttttctgtgactgtggtgctggaacgctgtctaatccttgtaccttagctggcgagcctacacacgacacagacacactctatgactctgccccacctatagaatctaatacgttgcagcacaactgaattccttccctaaagaaaaagtcctgccattctaacataacttaaaacatcttttggaagataaaatacttgcccatgctacagaaagagactgtactgaaaaaatggacacacaaggtcagttgacactaggaagctcaagctaccaaaaaggaagtggcaatagattgactcaggatgtcagagctcgggattttagcattactgcgtaaagacttttgaagggacagaagtgaagaaataagctgcaattttgtacagataccaacttctgaaaaagctggtgtttttacaacgagcattgaatgcagtctgatttgcagtagtcatcttccacagacaagcagctttgttgctgcctttatggacatgggtaccaattgctttttgtaatatggtaaaaatgtgagctagcacttctgcattgatttttttttttttgtttaacatgtattcagattgagaatatgattttaatgctttaatctcatgtagttcgtttttaatttcaagcaaatcttattgtacttgaatgtgccctgttttgttagcacacctagacttgctgtaactgtactcatgtcccagtatgtaccttctttctatgaaagagaaaaacactaaccttaagttatatccagcaatgtttctggtatcctttaagaaaagttaagactattatctccttccctttcctgtg

SEQ ID NO: 25160 - DNA, 1179 bp, Mus musculus
tccacgttctcccctccataagacgaaatgctgcctgagattggcttgggcttacctgttccgccatggtagtaggtgtgtgagatcagctgcagtggctgatcagatgtttttatggtctgcaggccactcggtgtgcagctgagtttgagaccataagtctcagccttaaaaatggggtggggaacccctcatttttccagtggagcaaaatgactatgtgattatggtttgtcgtatctttttatctttctctgaagtgtttgtggtgctgtggtaccatggaggccagagaacaactttctgaagctggctctctcctgccacctttattggattccagggagcaagaggtctctaggcttgtgccgtgttttatccactgacattgtcttgctgaccccaaggctaaatttttgattaatgttggtcagattccagggtaaaatttttaattaagatagggattaaaatcttatattcataattgacatttacatttgctagccatcagtgtgaaatagtcaatttttaatatcctggttatgtgacttctggcaagagctaaccaattggaacagtggtagaagtttttaagtgtgtgtcggtatgtgtgtgtggagggggctagtgtgtgggtttgtgtgcacgtgtgcgtaaaatcgggatcaaactgaggagatgtgtgtctgccagccttgcccagcaagtgcctttagcactaagcctcttgcctacccagagaatattgtaaatattgtaattatttggaattaagtgctcagaaatcctataacaccaagagacagaaacaatattgacttttctgtgcaacctaacatagtttaaaaccctatatactttattgttgggggggggggcgacaacacaaagtcttccattaagtgtctgtttactttaaaaatagatatagatgttttgttttgtcgatttattaaaaaaagagattctgtactgttggtggacagacagaaaaattgacaggacagcaagaaaaagagaatcccagcactcgagagtcaggcagactgtctcatgtggcctctcttaaaataacgtgccacataaaagcttaataccttattattctgacttatattcttccattttactatgatgggtcctgggtcccaccttcagtttcaattaattgtattc

SEQ ID NO: 25161 - DNA, 1135 bp, Mus musculus
gaacactgctggtcttgcagagaacccaggttctgtttccataactcacaactgtctctaacttcagttccaaggaatctgatgcccttttctgccccctcaggtgccaggccatgtacatggtacacatatacatgtgcaggcaaaatacttgtataaatatttttaaaagttttctccccagaagtaaagttttgatttgaccgagtttcaaattgaaattgcagatcatgtaataattgcttctctagtagaataaaatccaaattttacttctagaagttcaaataatgaaaatgaaaaatagaaaacaaaatagggcagacaccatccttactttcagaagagagtagggtgctctttgaaatatagtgtagttatttacgtcgacttctgtacctccttaaacttttaacaatcaaaatgaggctcaaaataaggatgcacacaaaactaaaaattacttacttaggaaaacttgatgcaagaagcagatttcttgcagaataataaatggaacgaaaagaaataagccatatagtgacgaaaacaaaattgttaaatacatcaatagatcaagttggtgtctctgtccccccacacacacacacaatcaccccttattttaaaaatagaaccaaagtttcagactgcaacaaatatggaagagagaggagtttattatgtcaaaaatgctattttgttttgctctattgcccaggctagtctcaaacttgtaatacttctgtctctgcattcctgaatgctagagttataggcatgagccaccatgtccagcttaagaacactattttccttgtttacaagtatatcagctacacttgtaactatgacacactaaccatctttaaaccctcttgaagaaatatcctgtagctctacacccaagctgcctgagtgaattgtaccttagagacagagccactaggtcagggccaacataggcaacaaaaaaaaaagggtgtgtgggtgtggagtggggatggagaaggcaccctggcttgtcccttactaatcacctcaccttcctacactttcttctgtataaatggaactataacaccctctgtagtactgggctattgttgctacttttcttaaataatatccacaa

SEQ ID NO: 25162 - DNA, 1175 bp, Mus musculus
aatccatcactcttcatagcttctctattacgatgttgtaataagagaatttgagttaggtaaataaaaacatagaagtttttgaaagtaaggagaatttcttatatgtgaaaaaagaacatgactgttttagatgctgaatattttttgtttgtttgtttctttgtttttctgaggcatgatttctaactgtgtagccctggtctggaactctgcagaccaagctggccttaaactcagcctacctttacctccagagtgctggactcaaaccaccactcctaggtcctgaaattttaactataaagcatttaaatgttctaatgccatatactaattaatagaggttgctatttatgatctggaatgatttcatagtacaaaaatttagtctttattctcatatttgtagaatgaaaagtccatgagactgtaggcttaaggcatttaaaaaatttaacttgttggaataatttagtacatgcagtattacctaacatgtctctgatagtgcgactctgttatgtagtgtaagtgctgctggtagtacttcaagactctctgtgtgtgttcctttcccttcccttcctttcccctccccccccttccctctccttcccttcctctttccctccctctctccttcttttctttcttatgacactccttgaaattttaggaaaggcaagaaccaccatcagatgttctcttaataatgagagtctgccttccatatcttagatttggcagagttcaggtctcatcctggagtgtcctgtggagggggctacctctaagacccctgtaccaaagtctcagtcctgacagtgcagaatctgcatgtaaattgtatatatcctgccgtagacagtggatggtctctggactattcataacaatgcaagtctgtgcagcttgtaaacaccgtcttatgggcatagtaaggaaagggctcacatgcatgaaacagtctgtctgtcctgttttatgagatagggtctctattatgtagctttggctaacatgaaacttactatgtaggctagtcatttggggacttaattttttttttttttttttttaatgctggaaatacttaagaccttgcatggtagtatatgcctttaatgttcaggaagcagaggcagggtgatcttggggttccaggccagcca

SEQ ID NO: 25163 - DNA, 1187 bp, Mus musculus
gtagaactctcagctgtttctccagcaacatgtctacctacatgccaccatgctttccactataacaatggacctctgaactgtaagccccagttaaatactttcctttttaagagttgtcacggtccctcttttcctcctctccagctccggagctgtagccatcatgaatgacacagtaacccttcggaccaggaagttcatgaccaaccgcctgcttcagaggaaacaggtggtcattggtgtccttcatcctgggaaggcaacagtactaaagacagaaattcgggaaaagctgtccagaatgtacaaaaccacaccagatgtcatctttgtatttggatacagaacccacttcggtggtggcaagaccactggctttggcatgagctatgattctttagattatgctaagaagaatgagcctaaacacggactcgcaagacatggcttttatgagaagaaaaagacctcccggaaacagcgaaaggaacgtaagaacagaataaagaaggtcaagggcacaacgaaggccaatgatggtgctggcaaaaagcaaaaggagtagatctgcggtgactcgatgttttgctgtgatgtgcagatttctgagaggacaaataaactaaaaataatttctacaaaaaaaaaaagacttgtcatggtcatgttgtctcttcatagcaaaggaatactaagacagtaataagatatttgttcaaagagattgatttgtagccttgtcttaaactcataagtcctttctttctgaagaggacagggtgggaattcagagcaaagcaggagggtgtctgctctcctgaaggccatggacccagccatttgtctcctgtgtccagcagatgcacaacttccttcaagagatcatagcgtaaaaatactccctggagggggctggagagatgactcagcggttaatagcactgactgcttccccaaaggtcctgaactcaaatctcagcaaccacacgccacctgtaatgagatctgacaccctggtgcatctgaagtcagctacagtgtacttacgaataataataaataaatctttgggctggagtgagcagggactgagcaagcactggagtgaacaggaccaaccagagtgagcagaggtcctaaattcaaattcccagcaaccacatgatggcttacaaccatcagta

SEQ ID NO: 25164 - DNA, 1146 bp, Mus musculus
ttctagagttttagatttgcattcattggtaatttgttttttattgcagaaatatacgagtaaatgggtccagtaattggaatgactccagataagagagctgagaccccgggagctgagaaggttgcaggactgagtcagatttacaaaatgggaagtttgcctgaagctggggatgctgccaggccaaaggccactcttgtgggcagtgagtcagcagatgacgagctaacaaacttgaactggcttcatgagagcagtaaccttctaacaaacctcagacttggaagtgaaggccttcccatggtcagtccgctgtatgacatagagggagatgagatgccatcctttggaccatcgtgctaccagaacccagaaaaaaaatcagcaacttcaaagcccccgtactcctttagtcttctcatttatatggctattgaacactcgccaaataaatgtttgcctgtcaaagaaatttacagctggattctggatcgcttcccatactttgccactgcacctacaggctggaagaattctgttcggcataatctatccctgaataaatgttttcagaaagtggaaagaagtcatggcaaggtgagtgttcataaacatcgttctgtgtggtgagggaattaatagagtcctgtaaaattcaagaccaagagaaataaaggcatgtcaggttagctcgaagttaattatagtcttcatgtgctttaatatatggtgttttaagatttcttagtgttgaaagaaacttactaaaattacattcagtttgcttttggcacctagattattctttgacgtttcttttctaccttgttacccacccttccccttatctgaaattgaacttagggccttgaagatgctttgttaggaaagcatgctaccactattcccagaccaccaagttgcttttcttcctttcctttcccattccctttccgtctcttctgtgtagccctggaaatctactctctgtagatcagccagacttgcctcaaactctcagagatccatctgcctttgcctcccaggtgctaggattaaaggtgtatgccaccactgcccagcagattttatttttagatgtgtgtgtgattctgggtttgtgcttgattatattgtcttcag

SEQ ID NO: 25165 - DNA, 1201 bp, Mus musculus
aatgcatgttttcctccaataactcatagtgcacaggcattttatcctcttcttcattggttttatgtatatttttccttgaatgtggcatttaatttcttagtaatattttcattggagttactttttcctaatattatgtggcccatgataatgcaacatttatgaaaaagttgaagaagaaagagaacaataatattttgagacatagtatctactatagctgcaggagtacttgtgaccttgtgctaaagaattttaccatcccatagattaggatatagttcagaatattttttaaagatttatttatttatttaatgtatatgagtacactgtagctgtacagatggttgtgagccatgtggttgctgggatttaaactcaggaccttaggaaaagcagtcagggctcttaaccactgagccatctcaccaacccgttcagaatattttttacaagtttagactaaagggctttaatttggactagtgaattggcttcttataaaggaattttggggctattacccaccaccaccactttaatttttatggcattttgatatttaatgggttctggctgatcttccctaactcctcctgtccaccattgtcccgcccccacctaactcttccatctccaatgctctaactttcttttttgtctttgttggttgattggttgttttttattgttgtttgtttgtttgtaagacagtctatgtgaccctggctggcctagaactcttaggtagacaggctagccccaaactcacagcgatccatcagatgctgctgcttaagggctgagattacaggctgtgtcaccacaccctgctcatccaccccacacgtgtttattttattaccgtctctatcgctctcccttctcagggggcccttaccagtgtccccacatctacctgtctgagtgctcacctaggtacgcatatgtgacacgcagaggctgagctccacttggagagaacacgctctctctatcctcgtgggccagggttacctcactctgcacctccatctcttctcctcaggttgcacggtttcctgttgactgccgagtaaaagtctgttgtgtgtgtgtacgtttcgttatcctttcatctgcctgtggacatctagctaatgccactgctttgctgtgtgagtcatgaacgtacagatgtacgagcatctcagag

SEQ ID NO: 25166 - DNA, 1387 bp, Mus musculus
tttttatactactatttcaaaagtgcattggctaagatattttaagtatttgaatggaactgcttatataagtcagttttcatatcacttacagtttgattatagtatttagagcagggatactaatactataactcacatatatatttttttacagtggtgagagaaactttgggaaagtttagtcttatttcatgatacgtcctgtattctagacagcaacctttgaatttttctcatttatatggatatatatacacttgctatatgcaacatacataggctcaggttagtttcctgctttcaaatgtttttatgactatggacttttttaaagagacaaatgtttttatttttacttctaatttctttctgggcaatactgtcaaatgagaagaaaaacagaagccctgtttcttaattgacaccacttaagctataacagtattgatatactcccgtttccatgttagttgtaattaaatctggatagccgacttaatggaattggtgctactaaaatatagacatttttcttttattgataatgcaggatgaagaatttggaatttttctaattcataaatgtcatctttctagaaaacagttaaatgaagttagtttttactgcagtgaataaaacaccaagcagaagtgtgaagtgtggtcttatcgtggtacaagtcttaaagagatggtagagttcagtggatagcagggaattgtgaagcaggtcaccacgcccttctgggtggacctgtcacagggtcaccacattccgtgcttcaccagcagtatgtctctcaaggccctgtgcagcgggcatgttgttctgcaaatggaggaaaatggtctgaagtaggaggaaagagttgttctcagctccaagagaaagacctctccagaattcgtgtttaggcagtaacttaaattcctttccctcctccttcaaatggcctcttacttaaagcaacagccattagcaaggatgatgcatgcccgtgcactcaagactaataagcagtgttctctaacaccttgcacttggctctcttacaaggattcgatttctcacttttcatttgctgctgtgtctaagcatcctccttcaaggggagagagagcctttgagatctggtcccttgtgatgttcttagagacagattatgctcctgtttggtgtgctcagattgaagcctggcttggaaccatccaggcgacgaattgtatgggctagaaattcccaatagataacaagctttgtgtatgaagtaaacacggcttagaaatccagggacagcccaggtctcagtgatttaaagctggtgttggctaaggtatactctgccttacaccgaaacaagaatttggttggaacgaattccat

SEQ ID NO: 25167 - DNA, 1196 bp, Mus musculus
agaagtaaaatctctccccagaagccagcagtgatcttcaaaatccctgcttttaaacaagcccaggagggaattcaagaagaaacactccttttaaacattttaacttgggtaacttttttacctgtgtgaccactttggagtctgtagccaactaaggaaatcactaccctggtctggttatttgggcagcaggggaccacattaactgtgccaatgagagcatgggtgatagttccatgatcagttatgtaggactgagcataagaacacttccatgtctgtgggaatggctgtttatcaattacaaaagataagaaaggtggcacacgcctttaatcccagcacttgggaggcagaggcaggcggatttctgagttcgaggccagcctggcctacagggtgagttccaggacaggcaggactacacagagaaaccatgtctcggaaaaaagaaaaaagaaagaaagtcacactctccatcttgtctttaggtctggtctgtgtatcagagaactgcagttgcctttcattcagcagctatgtttattatctaaccaatttcctacaacttcagttagagagttttccttaacaatggctgttacaatgttttactcagaatatgacttcctgacctattgttacaaactcagaacagactgaacttgataatcatgtaacaaagtattttgtagattacatattgattttttacaaaattaaagatgtatttcaaatagttcttgctgtgctgtgaacttacatcttcgtctgcaaggcctggagactttttttttaaaggtgtgaaatcaatttcaataaccacacatgattgactctgtcgggtgtatatacatggcttcactattaaggagtctctggacatgacatctcggcctagcctagagaatgaataccaacaaactatacttgattgtcatgttgaagatgatagatgatgaataaaaaaaagatttattttattatttatttatgtgtgtgaatgtgcacacgagtgcagtgtccattgaggccagaggtgtgttggatttcctggagctgaagtttcaggcagttatgagctgctgggtgtgggtacttgggaactgaactcagtactctgaaatagtagtgtgaactcttaacttctgggtcatctctctaatactaagaatgattttttttaaaggaga

SEQ ID NO: 25168 - DNA, 1209 bp, Mus musculus
gctgagagttcaacatcttgatctgaaggcagtcaggagaagactgtcttctaggtagctaggatgaacttaaagcccatacccacagtgacacacttcttccaacaaggccacaactccaaatagtgccactccctggaccaagcatattcaaacagggggctatccccaaagctattgcttgtccttgggatatgttcttctagatggggtgccttgtctggcctcagtctctatgttaaaatggcaaaaatgtcccagtctgtcgctttcctccgccccagcgcttcacagccgcttctggctttgcaaggtgtctgtctccgccagtgcagtggcctgccgggaagggtcagagtcctcactgtcccccatctgtccagcaatagtctgtccagagacaagcttctgtagcggcagggcttccgcaaaactagcctgctttgtccaggtcacccagacactgcccctcacttcatgtactggacgggagccgtccgtccgtccgtccctgctggtctctgtctagagagtgctgttcgggatctgctcctctgtcccgggaggtctcctggagttagttgtgtggtcaccaagaggactgaggacacagtagccctgagccaagttgggctcatcttcgagggagcaaacctaaagctggcagtcagccgccctggccagaggcctgcagtggatgagcacaaagtgtgcccggccacagccccctccctttaggctaaaattctcacccgagctttcccacgggaagctctaggataggaggaaggcgggaagccctgggtatatctagcccctcagagacttgatgggctagatgtgttgggggataatgagggggtgaaaactctctcagaagaggagagagagggatagagggaaagattgtgggagggggtaaactgggaaatagtgcagtgagcaatatgtaaaatgaataaataaaacataaaatgaaataaaataaagagctggattaatggaccatgaagactcatctgtaagggttaggttggaaactaattttcctttctctttggatggtaaaaggcacagagcttttgtaattttaacaagaagaagagatgaggatccaaacccatcgatggtccagatatagagatgggatgtttaagatgactgacagcattatgaattaggtgatatcactaacactttcatagctga

SEQ ID NO: 25169 - DNA, 1188 bp, Mus musculus
acgtaattgatcattgcctacaagcatttaatgccatgggattgcctaaccttattaagacagacaatgggccatcttattccagtaaaaactttatttcattctgtaaagaattcggtattaaacataaaactggaattccttacaaccccatgggacaaggaatagttgaacgtgctcatcgcaccttaaagaattggctttttaagacaaaagagggtcagctatatcccccaaggtcaccaaaggcccaccttgccttcactttatttgtcctaaatttcttgcacaccgatatcaagggccagtctgcagcggatcgccactggcatccagttacttctaattcttatgcattggtaaaatggaaggaccccctgactaatgaatggaagggtccagatccagttctaatttggggtaggggctcagtttgtgttttttcacgagatgaagatggagcgcggtggctgccagagagattaattcgtcagatgaacacagattctgactcttctggtaagtatcattctaaagactaaaattccttttgtgcttaaaattcagctgagagcaacagctctcaaagctgttctccagctactctctgaaccagctcctgacaggaggccggagactagcctcagctttacaatttgcatttgaataaagtacctagacttcccccaaagaagttctgctttcctactttctcactgtctttcaagattttgtctttcaagcaggtaaatcaacattctcgaggtggaccagtggatgtgcatccccgcccccctagagcacacaggtggcagctgttacccccagtctcaggacatttccagcacgtggttttcagtctgagttaaaaatttaggtttacctagaaggctagaagagtagatatttccatattaataaagattggtttttattttgatagacaggcttagccccttagctgacctctggcttttcacccttgctgttactgcaaggtgtccttagctcaataggctgtggaaaaaacagggatgaggaggaacgacttccagctcctattttagccacaaatcgtggtgttactaacgacataattcttgcttaggctttgctaattctgaggttgataattctcctttaggagctgcacagcactcagaactgtgcatactggtttgtgattgt

SEQ ID NO: 25170 - DNA, 1190 bp, Mus musculus
atccttttcaggtgggtctagctttccatggcttgctgtggtaggagagctgggatctattggtgtcaaagtatattggtttctgttgcttatgatcttgtgcttgcttcttaccctctggctacctttggtgttagctggcctcagtatctctgtctggatcctgactcctgtgtccctgggttgtagcagatctcctggggcttctgtgaccctagctacagctgatctcctgggagacttgtagactattgctctgactgcagctgatctcctgggagacttgtagactattgctctgactgcaacaaatctcctgggagccatgcaaagtgcttccctggctatggcagatctcctgggagccctgcagactgtgcagggtagagagagtgggagataaaggctgatcttcccccaagcaggtgcaaaccagaaggttcatgtgtagggtggaggagtcccttgtctgctggacacctgtagaatccctgtcactgtaattatttgggtggctatcatacctgtcgctctgactccagcagatcttctgggagttatgcagtgttggaggtgggggtaacaggctgatctgcccccaagatttcctggatgtttcatgacagcagtctttttagatttatctttttatttgactgacatattcatttcatctacatctccaatgtctgagattccttcttccatctcttgtattttattggtgagactttcctctgagattcctgttctagttcctaaacttttcatttccagttctctgatagtttgagaacttttattgactccttttctactttcaggtcttgaattgtttttatccattttcttccattctttgtgttttcgcggatttctttaaggaatttatttatttctctttaaaggacttctattatatacataaataccattctatgtttttgtattatgcttcagctatgttgcaatacccaaggcctactgtagtaaggtcgtggagctctagtggagctaaactgccctggctgttattgattgtgtttaaaccctggtgtctaggcatctgagtttggaagactgtaactgtagatgcagatatcttgctcgttccttgcctggtagggaatgttgcggttcagtagtcagtttagggaaggtttccattaaatgtgtttctagatactggg

SEQ ID NO: 25171 - DNA, 1132 bp, Mus musculus
agttcaatggtagaatgcttgcctggatcctcaaaggcttatgattgattctacagcaaagatttaaaaaatcaaaagacaattttggaatcacttttaatagcttaactaatgtcaatataagatgaaaaacttacctgaaattattataaaccaaagagtgattataataaaaaaggaaaatcaaaaaagttattgaattacatttaaaatgtacttaaatttaaacaacattgttaacttactattttataagaggctctatggaacattcagtgttaattttatctatatttataatacattcttttatattgcttaagtttattatctaaaataatattttcatagtataaaattcttactttattttcatttttatttaaacatttgttttatatattagctaataactgagagcgatcaactttattattagggtctttcttaaaaacaaaatattagtctttattctttgattgaaactagatatttttctcacataatatatcttctttatggtctctcctcccgctactcctcccatgtactccccacttccccttccctctgaatggactctcggtctctcattagaaagctaacaggctacaaagagttaattctaaatgttgctttcatttccttagataaagtgatgggatacgagctatccccaagctgtgcaaatagacacactcttcagcccaaagcatttccttctctcttctaactatccctaggcctaggcttaggcctgtaaactagattccgtataatctaatctgctaagatgacttattcaatttgtcttccctcaacttctgactgaattactctgcctgacctgacctcattctaactttggcaatatgtcctaatcttcttgacccttttcattctctggcttgttcttcttcacctgtgtctagctttttctctgtaatatttctctgtaaaaacagtcctagtaagtttgtcatacacaaacatcaccccaccacagccctctcttcttattcttcttctctttctctctccctctctgctcttaagtgtcctctctttcctgtgtagtttgcctgtgagtttactggatcctatttctacacattctgccgggtctgtctct

SEQ ID NO: 25172 - DNA, 1151 bp, Mus musculus
tctctacttcccatgattattttgttcccccttctaaataggactgaaacatccacactttggtcttccttcttcttgaggttgggatcacccacccatttcaaaaagattaacacagaattgttcctatataaaggaaatgcagggacaaagagtggagccgagactgaagaaaaggccatccagagactgcagcaccttgggatccatcctatctgcagacaccaaactcagacactcttgttgatgccaagaagcacttgctgacaggagtctggtatggctgtcctctgagaggctctgccagagcctgacaaatacagatgtggatcctcacagccaaccatcagactgagcactgagaccccaatggagatgttagaggaataactgaaggagctgaagggctttgcaaccccataggaagaacaatatcaaccaatcagacctcccgccagagcttccacggactaaaccaccagatgtttatgtagcagaggactgccttatctgacatcagtgggaggaaaagcccttagttctgtgaagacttgatgtcccaacatagggcaatgctaggatgatgagataggagtgggtcaggtgggagtgggtgagtgggtaggtgggtgggggaactccctcatagaagaaaggagtggggggatgggatagggggtttgcagcgggaaaactaagaagggggataacatttgaaatgtaaataagtaaaataaccaataaaaaagtttgttttcactgacagcttgaaggtatgagggatcatggggaagtcagggtggctggatcttgaggtaggtggtcacattgcatctgcagttgagaaaaagaaagagatgaataagtgtgctcaggtagctttgtcttttattacagtccaaaccccaagccaggagattggaactgctccttctttggctgagtcttcccaccttaattaacctaatcaagataatctctcccaggcatgcctagagatttctcttctggataattatagagcttgtgaaattgatagacagtattaagcctcacagcaatgaattttgcttaagatgaaagctctttgtgttgaaaactataaggcattagtgataactgaaatgatactaataaaaagagatgtccca

SEQ ID NO: 25173 - DNA, 1199 bp, Mus musculus
agagaaagaaagagagaaagagagaaagaaagagagagagaaagaaagagaaagaaagaagggggaggggaggggaggggaggggaggggaggggaggggaggggagggaagggagaaaaagcactcacctactgcccagaatgaagatcagcccccaattcatccaccttcctgggaacaagaattaggaagagtttttcttcctaattatgggccatattttacttcctttaaggttttcattagatgctagaatcacacattttatctcgggtggtatcttttggaaatgtattcctgtaaatattcctattctctgtttttgattccagacattaggcatctcaaggataatagcacagacttattttgcttagtttagattaaactaaagaagcaatcaaacttgatttaatttttatctatttttagagacaaaatccgttggagtgtttttctcaatgtcccacaaatggttttctatttattcctatctctgcatgagcacaggatcctgctttgcctattcttccaggctgttcatgtgtatgatctatcctcagttgaagaccaggagaggaacatctaggaacagacctatggaggtctctatttccatctccatacaatttttctcctcggcaccctgtcttctcacaatctttggtctgtctgtcttctcaagtcctaaagactcttggatactactttgatttctagcaattctttccagtcagtaacctggaaaatcctaatactccacttattgttatatctcttcatagttatggtacttcagaaatcattgatctttaatgatcttttgggaattctgtttcaacgattttacttgtttctttgaagttctaaaacagattcccatgttaatagagacatctgtttgctcattgtagccagagtgaaaaacagtttccactcctattctctttgttacctgtagtggcttcctcaccactgatgtgaataagttttagtctggaaactttttttttttccatcatagtatcaaggctttacaataactcctagttactctataaacatggaaaagacatttaaaagtcactattctttaaagggaatataaaggaatatgtatacaaacctagcaattgctctcatgggactgatataggctgttaatgccacaaattaatagacattttgcttctactgt

SEQ ID NO: 25174 - DNA, 2537 bp, Mus musculus
gcccggaagccaacggcggtctacacaactacaaaatgagatcgacatgggattccctttgactcgccccagttgaaactgcaacattgctaaaggtagggagagcttaaaaatctatcgccaggctccgatctccaaagtgtctcaaaacaggcccactaatttggctaaggtaaaaggtaatgcaggggccaattgaacctccctcaatgttccttgaaaggcttataaaagccttcaggcggttcactccctttgatcttacctcagaagtccagaaggcctcattggccatggcctttcataaggcagtcagctccagatatcagaaagaaacttcagagattagaaggtatattacaagaaagagacagttatgcgatctagtaaaagaggcagagaaagtgtgtgtgtgtgtgtgtgtgtgtgtgtgtgtgtgtgtgtgtgtgtgtgtgtgtgtgtgaaaaagaggcgggaggcaaaagaaagagaaaacaggagggatcgtagacaagaaagaaatttgccacagtggtaggaaaaaaagaaaagacaggatctagacaggaaacctgggcaactgaagaccgaacctcagctaaagaggctcagctgtgtcagactgaagtgacttatttgggatacacccttcgaggtgaaaagcagtggctaaaaaaagccagaaaaagactgtaactcagatccccaccccaactacaccaaggcaagtaagagaattcttgggtactgctggcttctacagactctagatacctgggttggcgaccttagctgcccagttgtaccccctaaccaaagaaggggaggtgtctgtgtggaccccagatcaccagaaagcctttaaagagattaaagaggccctactgatggccagcctatgcctgacctaaccaagcctttcactctttatgtgaaagagagagcaggggtcaccagaggagtccttactcagactttgggactttgaaaaaggccagtgacttacctatccaagaagttacaccctgttgccagtaggtggttttcttgcctgaaagctattgctgccataatctgcttgtcaaggatgctgataagctcactctgggacagcaaataactgtagtgacatcccacattcttgaaagcattaccaacgctcctgtgacacatcagagctttttgttgtctaaatgagtgaccttcgcttcattccacctgctgtcccactgtgtgagactgcacctactcatcactgcactgacattctggcagaagaaatgatctgaattatcagatcagccttggcctgagggtacgagctggtacactgatgacagtagcctcgaggttaaaggtaagcagaaggcggggacagcagtatggtggtgaacagaaagcaagtgatctagtccagcagccttcctgagggacgtctgcccagaaagctgaacttgtgactttaagacaagctctataaatggcaaaagaaaagtctacactgacaacaggtatgcttttgccactgtaccggacaatatacaaagagggctgttgacatctgcagaaaaagacctaagatgctgtggctaaagaaaatcagatggcagatctaaccgccaagcaggtggctcaagaaacaatgatcctggcagtcaaagagtctaaagattattatgacatcagagagaccagctttagatacaccgctgagcactatcaagctatggacagtatttggcttggcctgggggccaagaaattcaaaggtgtggttaggtcctttgactactatgttacaggactctctgacttggcagaagaaatagtcaaaagcttcaaggcctgtgctataatgaggtagaatttctaaaagaaaacttcccaaggtaatggacctgcctttgttgcccaggtaaatcggagactggccaagatattagagatcggttaagagttacattgtgcatacaggtcccaaggctcaggacaggtaaaaaaaattaatagaaccattaagggatccttaccaaattgacagcggagactggcgctatgattagatagctctcctaccctttatgctcttcagggatagaaacacccctggacagttttttagactgaccccccctataaattactctacagggggcccccctccactgataaaaaatagcctttgtacatggtgctgacatgctgctttcccagcctttgttctctaggctcaacgtgttccagtgagtgagacagcgagcgaaaaagcagctccagaaggcctactcaagagaagaagacctgctacattagacgtctccacgcaaaaaaccttaagactccggtggaaaggcccttatcttatactcttgacagccctactttctacctttatgggacccttttgattttgcttctgcttttaattataggtccatgtgtgttaaataggcaagtcacctttattaaaacagaaattagtgcagtgtggcttttagttttaagacaacagtaccatgccctaaagtaaaggatca

SEQ ID NO: 25175 - DNA, 1118 bp, Mus musculus
cagttgtattagctcctactcaaagggctcattgtgtatatgtttagaatatttcttacattatcatggaaacatatacccttttcagtgtacttcagcatcacatagcatttgtttccttaagttcgtgacacagtgtttcctgttaaagattttataggtaaattgatagcctgagagaggtttaagatctaatgggctggtaacaactttgactaagccattgggtttatctactcagtcacattttaaggaagttctacaaaacacttgagtacaggtagttaaaagggggagattccacagtccaactcatgttgtctgttaatctctgtttggctgtatgaccaacccaaaattctacagggagtcttaattaccagttcagttactaatctacttgagtttgatgacaagtcagaactgtatgttgctgaatcacacagccaaccttttctgtgtaaatattcttaaatatctagatctcccagttcctgtgaacttgagttagatctacagattttcctcccaagatcaatccaaattcttggaccaggtaagaacagatgacttgtaggagtggagaacagaggagcaacattgtccacactggtctttcaggtttgacaggcctagtatccagtgttgacagcaggctacctacagtgacagctcaaggaagcaaatggtcggtggcagtatgagaattgctttattccatgttgttaaagacaatatagcatccagatgttttgtcatttaacacaggctggttttgaacttgctatgtaattaaggctcgtacttttacccaataaacctggcctaaaaatcatctttactagagaaacatacaaacttatgcaacacaatatatagataccagcaccatctcagatatataatccaaaaggcagagccccttgggctccatgtgatggttatttttgacagcatacttcattgattgaaagtaccttaagaaagtcacaaacgacatctagtgtgcctgagaatgttctcagggagtattcatcagggaagaaactcctgctgcatttgtgaggctccatatgatttgctaggggtccatgtgaaataacaggagaaagaggaaa

SEQ ID NO: 25176 - DNA, 2199 bp, Mus musculus
caggagatgtgtaagagtattggaaaactggagagtcagtatgtgggcattgcagtcctcgagtctcatctgcaaatgaaaagcattaaaatagagctcactggtgctgctcctgagcctgcagatgcttggtcctctggttcctgacatgaatagcagagcagctatgacatgtttgactctaatttgctgtctgttttaaaaactgaaatagtcacctgctctactcttccctggtttttaaaagaaaaatctgtttctttcttaatattgatttttttttttcccctgacagaagttctgagagactacatcaagccaggtggccagtgcttggaattgtttgctaggaatttacagccaggttggatgagttggggcaacgaagtcctcaagtttcagcacatggattatttcattgctctggagtccggatgctgactgtaaaagttgtgctgtctttacctcagctccttccttcaaacttatttccccttgtaccagtcagtgtgcttagacatatgaacttttacaccattcagtgtacccagaagtataaattttataccaatcaatgtgcatagaaatatacatacatctcctacagccctttatagtgagtctcttccttccttccttgatctctggcgaacagtggtttgttttcttacgttagtgtttcctaacgttgtgtctggcttcttccactgagcattcaggaaaaccactgacactgtatataaaccactcgctgcttactaaggggattgttagactgaaagtacttggacaagcttgcttcacctacccactgatttcatcagacattaattttgaggtttgttcatcttttgagggcctaagactaatatcttttattattcctttaaactgccagttgaatacaaggctcattgaattattaagtatattcctttaagctttttatggagttttcctgtctaaattttttgatttgtttccatgcaccagatatcctgacctgcacctgactttctgccttaaaaataaaaccaagggcacacctagcttgagactagcttagttgttgcccttgctctgccctccatgtgggatttatctactgtgtccatgtcagttctcaaactcatcttccctggggtcccaagtctcccttttcaagctcccaactctagagacagttcatctagttggatggacactcacaatgtagcccaggttagccttcaactttaatcttcttacattgggttccaggcatgcatcattataccaggccctagatgtaaaccctgaaagaatttttagtttcaagaacacatgaggttaaggcttttctactcatatgattcaaaagactgtaactatttcaaagggctagtctatgttttttctttttctttaatttttttaaaaaagtactatttctatgtatttgggtgtttgtatatatgtatgtgcactatgtatgtgcctgatgcctgcataggccaaaagaatcattagatcccctggagggatgattgtgagccattctttagaagagcaacccgtgctctaaaccgctaaaccaccttcagccttgggcctcacattctttgaaggagtttctatgtcccctcacttttcctatcatgtaccaccaacttgttgcgggcttggggtttcccactcgcacccgtttctgaaatgactctgagacttaattgtttatgaataaatgcctaggccataagttttggctcatttcccaactaatttgtaacttatataatctgtttgttctagtttgtgtctgccacatggttggttacctctccttagtttcatatgcccgattgctcttagtccaggtggccgatcttactgctcttgtatctttcccagaattctttctttctctgctggatgtcccaccttctatttcctgcctcagctaataggccattaggtttttattgacaggtgatgcttctacacagtacataagagattttctctacaacttgtcacatcctcggaagtgctaaagcactgtgtgtacagttcccagtttaccaatatcttgctttatcctcaatacatgcttatgaagatacagctaagatgagggagcaggtcctcagaataactggtgtggctggagactaagaattgaattctatttgggttccttactgaaggtactttatgttg

SEQ ID NO: 25177 - DNA, 1194 bp, Mus musculus
cagggtttctctgtgtagccctggctgtcctggaactcattttgtagaccaggctggccttgaactcaaaatccacctgcctctgctgagaaaaatgttttctaatgtctcctgtgatttcatctttgacctgcatgaattatttagaagagaactatttcagttgcatttgtggttgatcttagtatttttttttctttctttcttgattttcaacttaagtcatttggagtataaaaataaattctagttctttaaagaatgttgtttcgttggccagtatatgaattatcttggagattgtactctgtggggttaaaaaggatgtatgttctgtaactgctggatgcagtgctcctatgtatagtattgaggactttggtatctgtgcaatttttgtgttgttaattgtgtttttgtgttaattgttctactcttactgggtagtgttgcaggatgtttgatcacatggtgagtcctgagactgtgctgcttactggaaaacctgtttctaattgtggtgtggcttagccctagcacagacttttaatctaagagctatctgtttattgttatcaggattaaataaagtcaaccatatgtcaggaggtggaacaagcaaacatttgacaaagagtgaacataggaaaataccatagagtgtaagagaaagtcaggaggatggatagagagatacacaggaagtagaaggggggggacattcatgttgatgttaggtcttgcttctacctcccagtcccacgtgcccagaaataagactcagcctcaaagtatatttacatatacctttgccatatagctaggctcttctcagactagagtcataacttatgatatattttaatctacattatgttatgtggctggttccctgtgctcaggtaccaagtgtctgtctgctcacatcttcccaggcagatctcccgcctagctctatcccagaattccttttactccctggatgtcccaacagtaggttttaaaagatgggtatggtcagtatttctcccatactgagatatgtgagatgtggttcccagcactcctgtgaagaataagattttaggaagtgaacgagttagttgaccatggtgtttcacagatggtggcagaagatatggagtgtctgggccaggacagagaactctgtggctctgctttatgttcacaggt

SEQ ID NO: 25178 - DNA, 1157 bp, Mus musculus
ctttaacataagatatggagatgtagaatttggagatttcccagctggcttttggtcttgttttggtccagtatttcctcacaatatcatttaggaatggtgaagtatatcttgtgtagttggaactatatgttttttgattttcttttttttgttgtttttttttgtttgtttgtttttttttttgtttttttgagacagggtttctctgtagccctggctgtcctggaactcactctgtagaccaggctggcctcaaactcagaaatccgcctgcctctgcctcccgagtgctaggattaaaggtgtgcgccaccatgcctagctcttgattttcttttttaggggattagttacatgattggatgaatctcagaagagactttgaactttgaacttttaacatttttgagactggtatagatgatggggacttttaaagttggacctcatgtagttttcattatgctatgtttaagtatggtccccatatattcctgtactccaacaagcttataggggccaggtagtggaatgtgggagtttaaatatgtttgtcacagggagtagctctattcagaagtgtgaccttgttggaggaagtggatcagtctggtggtaggctttgaagctctactcagtgcagaacagaccctcctggtagccccctgaaagacagtctcttcctggatgcctttagatcaaaatgcagaactctcaactccttgtctgcctgcatgttgccatgcttcctgctatgatgaaaatagactaaacctctgaaactgtaagccagccccagttaaaggtttgcttttatgagagttgccttggccatgatgtctattcctagcaatggaaatgctaagacagaaaccctgtgagtatatggtgaagcctttgcacaattctgtaggcttcatcatcatgaaagaatatgtactggagataaaccttttgattgtattcactatggttaagcttcttactatggttaagaaggaatgagtttgacagatagttatcattctgtctgtttagacggtgagcatcacacaggagtttatgacaagctcattcttaggaactgtctacatctgttaaatcagaagttttgctctcagcaatgtaaaatctgtaacattcaggaaacaagc

SEQ ID NO: 25179 - DNA, 1075 bp, Mus musculus
aaaccttatcaatgtaatcaatgtggtaaagcctttgcacatcacactagtctccaatatcataaaagaacacattttagaaagaaacattagaatgcaatcaatgttgtaaagactttggatgtaagactaatctccaaagacataaaagaacatatactggacagaaaccttatgaatgtaatcaatgtggtaaagcatttaaaagtcacagtcatctacagcaacataaaagaacacagaggaaagaaacctggttattgtttacatattgacataaggagatacaagtatgtttaaaattgacaaggaatggattgtgattgctactcttggttttcaatataagatataaaatggaaagcataggtccaggcatggtggtacatgcctttaaaccctaggagatgagcatcaagcatctgagttcaagtccatcctgatacagaacaagttgcagatgaagaaaagcttaggtctaggcctgtggatacagagcctccagatctctgagttcaggacagccaagctgaggcagtaaaggagttggagaagagaaaactggtgataatgtaatagaaggggccatgtcccaggcccagcaagcagcagaacccagcagctttgtccatgtggctctggctttagaagcaaaaatagaaggggctactggaaaaattgatgcttgttagctgtagctaagagattagaagtgatgaagaagagaccagcatcactgagatgaaatcttctaggaagtgttttctgagaggacaaagaagctgtgttccagagatagccacattgtaccttgtgttgcagctgaacttggtcacatgtaagaatcacccaggtggtactggttttgaaggcatgaaggtgtcctgcagaggcttggcaccatgaagggagcataaatgaggctatcagtgaagcctagttgcaacagaagaacccagcattttgaagatgccagtcccatgggatgagcaggacgaacagcagcagaagtagagtggagtcaaccagagcttagagtgatacagagggcagagctggagaagtggcccgatct

SEQ ID NO: 25180 - DNA, 1173 bp, Mus musculus
tattccctgggccaagcatattcaaactaccacaataatcaaaaataaaaccaaccaaacaaggacccccctcacccccatggcattgacttctacaaaatgataaaaggcacagagaataaaaaaagtattgctgattttttgagatttatattaatttggtatagtccaataacataaagacaatataaagtctacttgaaattagcgtattttagatattaccaaatgcagtttatcacagggacatatcttcaaagattgcatgaacgtttaaaacagagaacacacacacacacacacacacacacacacacacacatacggttgtatgttccattgtatgcacatagatcagaggacagctttgtgcctggcatgatagactagggaggtagaggcaggcagatctcaatgggttcaaagccatcttggtctacttaatgagttctaggccaatcaaggttgtatagttagtacctggagagaggggtaggaggttatctttctggaatcagctcttgctgtagactaaaaaaaaaattaaagtttaataccacttattgtagaataatgaataatgaggagtttcctatgtagtacagactggccttgaacttgactgttcctgccttagcctccagagtactaggattaaatatcatcatactcaaagaggcagcaatgtaagttaaggccactttgtagagcaatttatctgtatctactagtgttcaagagccagataaagtccatccatttatgctgaaattcacactcaagagaaattcttacatatgtgtctaatcctttaggttcaggtctgtcaagctccaggtcctgctggaaatgcactcaggtagagactctgtaggatggtcatgtcaggaaccacatatgggatatctaaatgcacaccaatgggaaggaggaaagtctgtgctgcatgagtaaggccagggagcccagtgcacaaacctgggctactgattcaggaactctagagaagatatgctctatagagatatgtggctctatagagaagtctgctacccagccaggctcaagaactgtggccagagagacctgccttcctctgctattagccttggtgtgggcctcactgtgccctgtgacaatgggtactagtgttgctacaggatagagctctcc

SEQ ID NO: 25181 - DNA, 1219 bp, Mus musculus
tcaagcttggcggacagattgcaagtttgttaactagttcaccaccgcttttggctgcggggacgtctttagatcgaataacaagtctgactttagcatttctcttgtggtaagtatctgcttgaagataggcacgtattagggcacctgtaatgcttgcattaccttcggagaggctctcccagcacctgcctagtgacaagtgggctatatttaggccgaggttttggtgcttgctagattcatagacagagtgccctctagtgccttgtaagggacgtgtttgtctttcattgtttcctcagccttttctacttaagctttgtaataagttcattaggttttgcttttcttagttatagataagtgattttgaaatactgagttaccagtgacctttgtgtagtttgcgacattgtttattcagttggatttatttgtaacccagttttgaatttgcagttgaattgagaataaagaggattacaaggcttccccacaatttagctcacattgcattgtttctgagatgttccttaagaagctgttgttttgtcagatggtgctttttgtgaagtctgtagattgcagcagctatggagcaactgaggagccccaaaccagacactgttgtagtgtgatcctgaaatcaatgacttttttttttttggtgcatgcatttactttagaaaaaatattggtctgtttcttttaagcaaactttaaatttctattcaccatttgactgtcagagcaggaaagaaaatagtaatacaataaaatagaataattaaagtatcaagtatgtttaaaggtgaataattaaggtattcatttatattagaattttagccattgcttgtgaattatatattcatatacttatgttgatagaatgaatatgtcatctttgaagcactttcttcttatagtttgtttaccaccactaggctacagtttcaaatttaaaattttcaaaaacactaaaacttataaatgttgaacaatatccaacatttcccataagacccaactgtagtttggaaataactatttttctgaatctgtcacttttctcagtgacatttgaaaagatgttatattgaaaacaataaatgaaatttatatcctttttattaatgtgcaaaactgcacccgattgaagaacattttttgggactgtggcagaaatgctcttagcagtctttggattcttggc

SEQ ID NO: 25182 - DNA, 1223 bp, Mus musculus
tcctctccttctaccactccctaatgcacacacacacacacacacacacacacacacaaacacagttcctgagttccagggataaccagagctctactgtagtgaggccctgtctcaaaagaaaaaaaaaatgtagtggagctaggaatagtggcacagcaagctttgaatcccagcattcaggagacagatgtaggtgagtctctgtgtttgaggccagcctggcctacatagcgaaatctaggagagccagggctgcacagggaaaccctgtgtcaaacaaaaacaaaaaaaatcaacaaacaaaacccccaacaacaacaaaattaatgtgagatttcagttttgaatcttctaattacagtttgaaattaaaatagtttggaattacatctgcttaaatatttacatgcttatgtatttgaatgacttctatgaaaaactttaggattgaaaagaaacatgcattaagtgaagagaactcaggtcttactttaagtttgaatatattgtgctcctttgcttgggaacttttccagttttcaacttttgatttttgagacagggtctcactatggagctctagttggaattcattatagacaggctgatcctgaattcatagtcatctgcttaactctgtctctttttccacagtgctggtataaaaggggtgcaacactgtgcctggctaggttcccactcttaaaatccatgttttctgtcgttatcagttatataagacctaaaatttgccttatgggcctggggatgtataactaaaaattagtggcttaagagatgagtaggtaagggaatgaatgaatgacagaaatatctcttcacagtgcctatgataccagctgagtatggcagtgtgtgcctatgataccagctgagtatggcagtgtgtgcctatgataccagctgagtatggcagtgtgtgcttataatctcagctgagtatggcggtgtgtgcctgtgatcacagctgagtatggtagtgtgtccctgtaatcccagcatgtaagaggtagaggcaatagaattacgaattcaaggtcatcttctagttctaggacaacctggggtgcatgaggacctacatcaaaaactcgaaacaacaaatacatttcttttcactgttatatatgttggaaactttctgtaatagttttgctattttaggacaaggtctcactgtagcctagactagcctagaa

SEQ ID NO: 25183 - DNA, 1099 bp, Mus musculus
gggctctggggtctgtatctgctcactcagtgatcaggtcaagaagcatctcaggctttagtctttgaagtgataatttcagtggccaaactgtagggtatatgtgaacacaaaagaaaagcataggccaaagtggggagaaaaagatgtgcaaacattgggcgaagacaaaggagtttcgactagtggagatggtcttctttgtgctcactaggcctgtcctttcattgagcttcagtaccatagcttctgtaccgtgctccccgccccagagtctacactttgcattgtagctcactatatgtaggcagcaaggttggggaatgagtcagaagttccagggtaaatgaggcaactgcatttagaagtttaacttgtatttgtttgcccacaagaataatttctatatgtcactagggaatatttatatttacattatacctttatacatacaagatccatttaattaatcttacttcttagtattaaaaatttagcatgttttggtgctttgatgttatatataagtatttaagaataaaaaaagctgctagcattctttggattttcgaatagtttcactagaactatgcattgttttgagtcaccctcataatcttgtgacaagagtatcaaacttgatgaaataaaatatctcccacatatagttacattttttttcttcgtatttatatgtatgcagattagtgtatgtggatacacttgcttacatacaaaggctagaggctgacataggtgtcttctatggcttttgtaccttatggtttgagatgaagtctcacctggagctcactatttttggcaagactttctggccagtccaggccctggtattcactcatcttcattaactgctaaggttacagatgtagtacactaaccccagcttttacatgggtggtggggagtgaactcaggtcctcatgtttgcacaactcagccatctccctggcccaaagtcatatttttaatatttgaaagatatttgttgaaaattgatttgattattttgatttcctatttttattttttgttagttccagggatccatcttgaaccttgtacatgttagacaagt

SEQ ID NO: 25184 - DNA, 1761 bp, Mus musculus
ttctgattttcttcctacatgtgaaatatgtttgatgtttacttttttatcttaaatttcaagcctgtgtgtgtgagtgagtgtgtagaaattgctttttttttttcttccacagtgtggttacacagggttgaacttaagccatcagccttagaggatacacatagagttcccaactgtctctctttgtcctttgtttcttccattcagttctggttttgccacctctctctcccaccagttctgctttagctttcctgttgctaattatctaaattcactgcttaaactctgacaaagttgtaatgggtcaactgttactatatactacatactccctacttcagcattgacagcccatgtcctctaggcaagaactttcaaatgcctttgcattaaccttaagatgtctctggttggttggttggttggttggttggtttgtttgtttgtttaaggaaaacaatctagaatatcaaatggaaacactttggatgatcactgtactgtcaatttttgttttaatcgtaggtgaagttaaaatgaactatttgggaaaaccatatgtagctatggttacaacctaccaaatggcagttcttcttgcctttaacaacagtgaaactgtcagctacaaagaacttcaagacagtacccagatgaatgaaaaggagctgaccaaaacaatcaaatcattacttgatgtgaaaatgattaaccatgattcagaaaaggtaaccttcccaagggatttcaacccttagcagatagaggctcttgtatgggatattggcagttttaaggttgtgtgatattcatatgactctgtaagttagcttagcaattttcccagaagaaaaggccattggcttttctaaaaataaacaaaatactattgtgtgttaactggatacataagaaccttggaagcaagagttcctatagaatcaactcacttgttagtattgtggctactgcagcagtttcagacagaagatgtatatatattggctgggccttaaaatagctaattcctaaatagaaactgaataatgttctggtaaatgtgaaatcagaaaaaaaaaaatttgttttaaatataggaagatatcgatgcagaatcttcattttcattaaatatgagcttcagcagtaagagaacaaaatttaagattactacgtcaatgcagaaggatacgccacaagtaagtactggtttgaatgtcatctcttctagaaatatttaggcagtgttttgaaagagtctattttataccaagatcgagcaaacctctgcactctgaaattaataacatgataatacttctctggtttattcttgcagttgttggccttattgactgccagtatgttagtgtttaaaaaataaacagcttaggcaaaacagatccagctcagttatctactcattaattagcacatatcaagtataggtggttgtggctttattgtgatattttcacatgtgtatacaatatatttctctcctccctctcttactctactgctgccaccctctgcccagtctactttgtttttcttttaatgactccatgagttgaatttggattacttaaaggaacttgggcaacttaacagtgtcttcacttctgccttagttagggttttattgctgtgaacagacagcatgactaaggcaactcttataaaaacaacttttaattggggctggctggcttacaggttcagaggttctgtccattatcaaggtgggagcat

SEQ ID NO: 25185 - DNA, 1099 bp, Mus musculus
ggaggaatactggattccaagccagaaaattgtggtctttgtcttgactctgttgcaaggaaacttggatcaaatcacataagcctgtttgtaccttacttcccatttaagacaaaaaaggaaaagtcagttgcccagtgtacctgcagctttgttgtgcctgaaggagcataaggtaaagttgcctctcactctcattattcacagcttgcaggccttcctcacctggatgcattatctgacattccttctcttcctccctgcagagtgggcaataccataaatttaatgaatataaaaacactgtggtgtggcatgactgaacaggaatgggaggttgaactgattgaggagtcttggctttctctgctgagccctgtaattacagtgagctgtaaagcactgcacagcacatttgccatgagcactctagcaaatagcatagaattacagggttgcaagagtcttcagagaatagccctgctttcattttacagatgaggaaaccaaggttcaggccgggtgaggagtttgcctggggctgtacaggcttcctgatgatactgagtgagggactgaaatctgacccctggtaagccttcccattgacctcgaaggtgtcagctggacttgaggcaaatactgccttagaggtcatgactgttggctagcacactgttactccagagtggaggccttccctttcttattggcttccattatcaaaataggaaacagttttctagaaaggtctcccttgtgggttgggttgttgatgtctccacagcattactgtttacttcttgaaaaaacacaggaccacatggaccatggatttgaacttttaaaactctgcatctaaactggggcttcagggtcttttagttgagattcgcatggggctttgtcttcctaagcaattcctcagctaaaaaatggcaaaacaactctaaaacctttgtacattgtaaactatgtgataagaatctgtaattattaccctaaaagtctccaaatacaagcatatgtcaactcatgtaaacaacacttgtgtaatctctggtgcagaataacgcaaaccatggctacagaaacacgg

SEQ ID NO: 25186 - DNA, 1194 bp, Mus musculus
tcccctttgagcagtattgcagtacttggattgcagtagcactgtaatgcttactgtggcataatatggctgctacgggttcattctgctcaagcctgcctatgcctgtctacaaagttatgccaggcactcagaagatttgatgacttactaggtctagtccagttatgtgtgcctctaattaatgtagttgacagtttcatgcatatgtaatatattctgctcacatgtcttcttccctactcctccactactactctccctttttcccaccagatcttcaccctactttcattttagtagtcaaaggtgactgtgcctaacctatcagacagtgtccatgtttgggtgatacttaaagaaggaaaagaacaggaagagaagagaggaaaagagtagaaaaccagtttatcaggcttgaatgctaagatgtggaaaaagcaaagatggtcttacctttgagtttcagtattttctatgaaatctttttagtgaaaaggaacactgtgctggctagttttgtgtcaacttaacacacaaatgagttatcagaaagaaggggggccttaattgagaaaatacctccataagatctatatgtaaggcattttcttaattagtgattaatgagggagagcccagctcattgttggtagttctatttctgggctggtggtcctgtgttctatacataaaagcagactgaacaagccagtaagcagcaccccttcatgacttctgcatcagttcttgtctccaatatcttctgtcctgacttcctttggtaataaacagcagtatggaagtataagctgggttttggtcatggtgtttcatctcagcaatagaaactctaagataaatacgtcagtagagaaagtctctgggtttttaattgaatgtgtttatagaaatatttttaatgtgactcttatttttctttgctagtaattttttaaattagaaacagatttttttcatactatatattttgattatggttttccctccccaactcctcccagatgctcttcgattccacactagcccttgtccacagctttttttttgtctcagaatacaaacaggcagcttaaaaaataagataaagtaaaaacatacatacaaatagaaaaagcagctgaagaaaaagcacaagtaacacacacaaatgccgagacacacatttgcaca

SEQ ID NO: 25187 - DNA, 1135 bp, Mus musculus
ccagcctggtctatagagtgagttccgggacagccagggctttacagagaaaccctgtcttgataaaaaccacacacacacacacacacacacacacacaaattagttattcctttctgagtctcaaaatgaaagacagagccaaccccatggtggttctgtagcaactgtaccaaggaactgcactgcatcctggagaggaaaaatacatgatctcattaaagagataattagcatggcttactgtgaacctgccttcctgaaggcgattccttggctggatgagtaaaatggggttagcccttaggaaggaaacagaggcatgtcttcacctggaggtagatgccattctttaatgaaaagcttcccgacaccgtaagaagaagtatccctaaaatcacttaggaaatggggaagtagatacaacccatttctaccacaaaaacctatggatccatttccaaagctgttcacaagaaaggattaatgtctggactggagtgttagtttctactcttacacatactcccaactccctttgctttaacatgcagtggtcagaagttactctgttcactgccataacttaatgtaaagactgggagcttacacaaagtatgggtgttggaggtcaaagctggattccaagcaatcagacccagtcacatttttctcccaatacttagtatggtggctcagtttgggtttctatttctctgaagagacaccatgaccacagaaattcttataaaggaacacatttaactgggactggcttacagttcaaaggtttagttcattatcatcatggctggaagcagacaagcagacatggtgctggagaaatgtgcattccagacattgaatctgagatatcaggcttggggataagctttatctgttgagccatctcaatagctcccaacctcaaaacaagccttttaaatacttaatgacttcctaaaagtttcagatttagagcactttatatttcaaatttgataattatggatacttaactgataaagtctatgctgttatcacattatacataaatggtatttattctagaaatgtgactttttacattttaaagtcagagtaaaacagaaatgaattatgcatccatccacct

SEQ ID NO: 25188 - DNA, 1768 bp, Mus musculus
ttgcacagacagagctgtgagagtacatttgaagataccgctctcgaaatcaaccaacttcacggtcattttgcatccatgtccactagacttgccaacccccatacttctgcctttgtattcctatggggaatcttccccgagaagagacgtttctcctgcctactgccttgctcctttaaagaaacatatatttttgtctagaatgactagttaatcttgcatattctgaaaagtgcttgggatcagtacctaggtggcattctatgtgcacacataccatgacggaagtataaaggggcccgtgtttccactattgattggcctgcagagttcgtgtattttgtggcatttcacccttctgcctgtgaaaggtttttgttaactaatattttccaaagcctttgtccccttccttcccctcttacctcttcccctgtcctttcctcttttcttcccctcaccctccacctctctttctcgattaattttttgagacatttagacattttctgacatgccaaattcctgcagtatgagcccatggctggtcagtcctctggtcctaagttcaaacaggactttcacagtctcttatctccaccatatcattttatttcctaagaacctcacatgcactgactggactacacaaagcagagtccaagtagtctcgatacaccttcccagatgcacacatctacagtcttgatttgaacctgtttctcatggccgtccttgtccaaagcttggctcacgtagggaggggtttgagctgtaaatctccctggggcagtggacaaacaggtgagtggtttgcaatggtggttgaatcatctgcgaggggccagtgaaggctaaagtatactagtgtctgtgtgcatgtgtatacatgtgaagaccccagtgcacgcctgtgtacctgtgtacatactggtgctgtactgacttcctgtcacataacctgctaccgtctgaagactctaggacagagagaaggatcctgaaggaaagctgttgtgccttatgtatctcagtctggaacaagctgcacttccattttgtcttgtttgagatcgcatcatacttccccacagctggtcagtcacatagtgactattatagattaacttaagttttccatattctagcccataagcaaatcttttggaaggaagtagtaacgttaaacttagaaacttgaaattttgactacaacttttcatattcctaggtaatgtatatctgaccaaaaatgattttgctgaggtcttaaggtcaatacaaaccaccatttcctatgtaaatttcagatgtgcccatgacttttggtggaaaaaaaagtcttccatattctgtgtttgtaattatttttctcattacacatgttggtattcaataatttggagtttgtgaaattaaaaattctaatttcaaccatttgagctaaaaagtataggaggaattgtgcctgtggttgtttcagaacttaaagacatgatagtgaggtggttgtctttggcctcttcgggggaaatttcctgaaggactgaaaatgagatattttacttattctaatgaatatttacacattcagttgtgtttctgtaagccctgggaaacctctaaagatgcaaccagttcctgggagggaccatcaggattatttccataattataaatacatatttcctttattaataaagaccctgattgtgcatcacctctttggtattgtgtcttctttactgggacggtggatttaggg

SEQ ID NO: 25189 - DNA, 1117 bp, Mus musculus
atggagatggggctggggaaggggtgcttttgttcattgccttgtgccacttcaggtcagctcttggcttttctgtttttacagttgaagatggctgactcatatccctctggagccatgagtcaaagtaaactctttcttctgtaagtcttgtttggttatgatattttatcacagcaacagaagagtaactacccccaccccccaccccaacacatacaccttaaaaagttctgcaagctcactgaacttcctgtggaaaacttactttgacttttgagcacagacactagtctcaggccagatagcaacacttccagattttgcttgctccagacctataggctccaacacagtttcttctccactttctacttggctagaccagcggatctcaatcagtgggtctccatccctttgtaggatatcagatatcctacatataacatatttacattatgattcataacagtagcaaaattatagttatgaactaggaacaaaataatattgtggttggggtcagcacctcatgaggcactgtattaaacgtcacagcattaggaaggctgagaaccactgagctagctgaagatttgattaagagtagtgctctatttacaaaatcttgacacaatctctcttcccttcttaaaaatttatttttgcagttcattttgttgttgttgttgttgtgtgaatgggtgaggaggttgcacaggtgtcccagagcccatgtagatgtcagaggacagcttgtgggaattggttcacacctttcaccatgtgagtcccagggattgaactcaacttgtcaggcctgtagacaactgtctacccactgagtcatcctattggctctcctaccaagatttttatcctctttggttgccatattcacacagattgcttatagtttgtccacagtggttgctctgtttcatcttttcagaatggtcttcccattgttctagatactagggaacaaatgagcaaattgatgagatgtggcagcaggcaccatcacctcatttcagttaggtctggtgaggcagctaccatcaccaagtatatgtgtgtgcatgtgtctgcaaactcagtgttttataaaattttg

SEQ ID NO: 25190 - DNA, 1195 bp, Mus musculus
gacacctgggcttctgaacgtggcacatgcacttggcagtaaggacccaaagccactaagcagtagcacagaccaggtccacacttgcagggacatgtgcatttcagcaggatttgtttccatgtccatcaagagaaggaaaacaaagcaaagtcttccagggtcccctgctaggtgtcttcttcctttctagcaaactataattaaacctcggccctacgtgggcctagtcatcattgcagtgtataaggtgacctatgtctgtttgaagacagtcatccagtgtctgggactttttccaggaaatcaaatcccattgtagaattggctgttttcgggtctgtgcctgtgtgtgaatcttaggcaggaatgggttgccctaactgctgctgcactaataaggtcagttaaggctgggatctcagatagcacaaaaaaagacctgaaaactcaaggaagggacctttgccacactcgtgctggaattgtctgtcatggctgaagagtgtcatgccgtggggtgatgtatgctcacgggttgtcattcctcctgtccctgaggaatggttgcttgcccttcatggctctggaatgtgtgcatgtgcatgcttctgcctgactgaacccaggcacagagtgaccggcacagcagactctgctcttcccatcctctacaatgttcctatttattttaacctgtaggaagaaggaggacttacagatgataatgccatttctaatgtgctttgggtaagcttaactctaatgcaggtgtccttctgtaacagaacacagtggaatccgctggtgggtgcaaagcttagacacacagcctggagacggaggtacaaagagagaggtgtctaccttatgaacactacagagaattctcagagccatgcctctgaataaggaagctggggattcttagtggaatcttatatgtatatatgtgtatgtatgtatatgtgtgcatgcatgtgtcagtcctgaggcaggataccaggaaacaggagagtatccatggtttcagctgagtacagtgcattcctgcccaggtcgctattggtgaatattccctcagctctgacccacatcatctgccactacatcagcatacaggatagtgtccctcccctcatatactctgtacttccctgaccattattcttaccttcttgattttgctcagctg

SEQ ID NO: 25191 - DNA, 1196 bp, Mus musculus
gggccacagagaagtcgctgccgctagacccgaaaatgaatggagatacatatttggactagtagttttttctgtcaaagaagaaagtatttttgaatcagagtttttcaaaacctacagcttgttctagagttgagcattctgtaaatgtataagagaactcttctgattgttcttttccacagttcaggtgaactgaaaagaaaagtgtcttttccgttcccctcagccaagtgctgcctcagtggccgctgcagccctacccttctggtctggctcagcactgccttttttaaagcaattctctttataaagtgttattttgatagtttgtgaattctaaatatatatatatatatttatataaacacatataaatcaagtatgtatttaacaaagcaatatgtattcattcacttgcaactgttttctttggtgtcaaaacaatattagaggactgtgttgcttctgttgagttaagcctaccaccagtctgtcccgtgctcaggagtgcctccttcagccttaggtctggcttgtgctaagttctgcttccggtgctaaagcaaacaaagactttgtattcttagtgtgaactctgaagaatctatttgaatcaacctttctaccttaatatctccccccagaaatgtatagtgccttgtttatgtacagtttatatacagaaaagtttgctctgcttttttgatgctggtttggaatattatctacagctttattctcagtagaaataaaaacatctcaatttctcatacccattgtaaacattacacatgtcattttgtggcacaggatcccaaaataaaatatcaaagtaatcccaattcattgatcagttcacattgaattccaagcctgttcatggggtggggcactattcctgtaagggggggggggggggacggacactatgtagctgtccaacaaacactagtgtgctgcattggtgccaactcctgagactctgaacttcaacgcagggcaggacataagattaaatagacctggcagacacttgacccataaatttgctctaaacactgaacatgttcttaacaccacagctgcatcgatactcactttaagatctcagtgccttttctccaagtgtgaattgatgtgtaaggtgttaagatataaactatggagttagggtaaatagctcggtggggagt

SEQ ID NO: 25192 - DNA, 1195 bp, Mus musculus
tctaatgctgcattctcaaacttctgggagagcacagtagtgaagacaggtctacttagaatgcaatcactccctggcttcaggtagcttggctcagcacatcctttgcctgtggagtctttattagatagaaatggtgttgagaccctctctggtgtcttcagatctgatgagaaaaacactggttctgtccttcttgctatagggaggaaagtgaggccaaaatagattgaggattgttgtcctgcctagattcatgctagaagtaaatagaagagccaaagacaggcctcacttctctgtcttgcatacactttgttttcttgtctctgaggaagtccgcagcccctgcaagtgtaattcatgggatcaggccatacattacaggtgctgctcaggtttactgcgtaggaggtaccacatgagaaactggtagcattcctggacctcttgactcacacctagagttctttggtgacctcagtagtattgtagagttagaaaatttatgggtaattcatattgttcttttaaattataaaagactcaaatgccaatttttaaaaagttctttatgattgtgatggttaagcatcactttgaagttggtgagattcagagacgcctgaggggttagtaaagcacgatacttctgggtgtgtctgtgcagagattccctgagatagccaatgaaggctctaaggaatccatgcacttctctcctggtgccttcatctcttggcattattgagcagtgatgaaaaagtaggaaataggtccaagtttgaggaaggaagtcttagtggtcagtccttgaagatatcctttgtcctgagtccgtctagtactcttccttccctctgcattcctgacagcagagggatagaacctcctccaccacatgctgacaccagaggatcctcatccaagcaatggaaccaggaagacgtggactgaacctcagaaactgtgagccagagtaaccctccatcccttatgtttctctgttgggtattctaataacagcaccaaaggatggctagcacagtactttaaaatatcatgaaatttccttgtggaatttcagctttataaagcccagtctagggctggggaagatggtcaccaaacccaacagcctgaattcagtctccagcaagcaggtaaaaagctggatgcaatggcatgcatctgt

SEQ ID NO: 25193 - DNA, 1192 bp, Mus musculus
cagaagtgagacagcgcaaaggaccatgggaaaggtgcccctatgaccccggcggagaacagtgtctcttaccaaacgcgtagcagttttagttaacaggtgaggggaggaaggcagtgtttgaagaactacctaagaaccctttcgcccgccccaagtccgggcgagaacttgatttgttcccgaggtctctccctttctgtctatcgacccccgaccttctcgcttctggggctgtgtgaagatggtgaagagtggccgcctaagcgcgccagcctgcgaagctcacaggcacgcggcagttggccgtatgcgcttgcgcgcaggtctaggcagggcggggcggggcggggcgtctcccgccgcgcgctggaggcggggcctaggccggagcgctgcgcccgcgggctgacctcgttgaagtcgacccatgacgtcaccccgccgtgacgcgtacgcagtaggaaaactgtaagtttgcgaggatcatgcagctctgccttgcagggctcgcggggcctacgttctgctcgctctcgcagtcgctgtgttggccgcgggcaccgggaaacctcgggttacacgggagctgcggagcgtgacgcggggctggtagtcgccccaggtgggagcgcgccctccctgcagagctggcttatggaggcgaggctgttccttagcctggcccacacctttccctctggcctttgacagccaagagtgtgcgactaaggcctgggaatggggaactggcgaggccctccttaaaattgataaagagattagatcttcaagtaggacatgcttggtcagtccgggatggtcagtctgcgccctcaaggactagctgccctggtccgccttcccttgggatcctgcaagtgcccaggttgcttatgacaaattacgtgcagtgttgcctcaagccttcttctttctatagggctgcagcatcttgaaaccctgtgagttaacctaagctatgtaatcctacacaacagttaagacaacatttattattctagggaatgtggtaatctatctgtatgtaaggatctttctcagggcttggcctcccccacacacctaccccaacccatcggatcatgacttttgaacctgaaggtatctcagctatagtatcagttgatcaggaaccaagaaataactagtatcaatatcacagagattt

SEQ ID NO: 25194 - DNA, 1106 bp, Mus musculus
cccttcagagatttccagtgctgttcttggtcactaacaaaagtttgatttctctatttatcaatccttgcattatttgaatgccgtatgggggggggcagttattattgctgttaagtaggcagtagtcagagtaaagcagaagctgctgggttaaaatttaatcactcaatacattttacactttttaaaaaatttctgggattgaacatgggatattggacagcagccacttgactcctgagctacacccaattccaaaattctcacttcaatatgaaggagtgttgtacccagaaaactgatatttgagatccttggatggaaactacagagagcatgtaatttgaagtgtagtgccagacagaatcagtaatgcgtggctagcatgagtacgtgtcagactcagtgcttaagttaaccttgctcactggggaatgctagactggactgtgaaaatcaccatctctttggtgttttctcctttcttccttaaccccaaataagtgcactgttagaaatgtgtcctatgaggttttaactatgggaccatcacacacagccaacactcagttatgtcactgaaaatacagtcttgtggcaccatcactgaagggaaacttgtcgttgaacacatttatgtggcacaggactatattattattctccctccttaccattggttcacaatgcacccccaatgccccaatgttcacaatgctcccccaatgcccagtacttggttagagctgaacactgctgctgggtcacttttctaaattctctctatacccactgaggggtttttattttatgtgaatgaacaagggaggtggataaaaggaaaatcattccatatgagtagcaagttaggaaagttaaagtagtagtatagacttagagatagaaggatttgggaagattatcaaagcatttttcaaagagaaattgacaatagatgtggtggtttatgcctgtagtcctatcatttgggaggctgagacaggaagatagtgaatttgacactgtcagatactgagtgagacctcaagacagaggaaggaaagtgggaggcaagattaggaagggggatggagggagtgaag

SEQ ID NO: 25195 - DNA, 1101 bp, Mus musculus
ctgtctgcagattcctaatggcatggggagcatgaagaggtaataaacaggacagggtcctgaaaccctgcctgagaaagcttgggaagggtcctggttgtctcagtctgcagggaagtgtgtagtgaacctggaggtctgcttgtaaaaacagttaggcttgcttggggtggtatcagaatggggagaaggaagaaggcatgggcatgagtgacagcacctctggctcagtcctcagcctgtctattggtgaagtgctttttgaagaaaatgctgcagtttgtagggagcatgctgaatgttttgttgtaaatctgatgaccttccataacacccagtgaggaagtgtctgtgctcacatgctagagcaccatagattgaaaagattaaggaagtggtgcgtgatggagccagaatctgaccccagtctgtgggaaagaacctggctgtcttccacaggagtcctgtgggagacgccatgccttgtgctaaacagtttaagcattgactgataatcaaatatgcaaatacgctctactgaaggagctctacggagaggcttcttagatcccttgaaactctaatatctggtccttcaaatagccacactgctgagaaagacagggctcacctttcttcagcctcagggacttgaccctgcggcagcaggcagcaggcagcaggcagcaggcagcaggcagcaggcagcagcagtctcctttggtggtgcttttgtttagctcttgaaagaaaggaacacatcctgctgtaatactcactggagagatcagcacaatcacatgtcctaaggagccaccagtcttcaaaggtgtgacccacactgagtagatgtcagagatagtggctcgtcagactcagagaatcctaccttactggagctgataacctgtaaccataactgggttagaatcaaaattttaaaattaaacttgtgcaacaatatttcctttaaattttaaaaatatttcaaaagtttatcccaaagtctatctgatggccaaggaaaacaaacacctggtgtcctggttagtctagattgcatttcaagggaggccttttttgcaggggtgcctctggctt

SEQ ID NO: 25196 - DNA, 1207 bp, Mus musculus
accgctactcctactgcaagagaggagctgaagacagagatgctatggagcaggaagacgctgggcccgaagtcctgccggaagtcctggcgactgagcatgttggtgcccgggcgtctccctcacaggctgactcggacgagagagaaagtctgacaagggaagaagatgaagacagtgaaaaggaggaggaggaggaagataaagagatggaagaattacaggaaggaaaggaatgtgagaacccacagggggaggaggaggaggaggaggaggaggaagaggaggaagaagaggaggaagaggaggaagtggaagcggatgaagccgagcatgaggcagcagccaagactgatggtacagtggaggttggagctgcacagcaggcaggcagcttagagcagaaggccagcgagagcgagatggagagcgaaagcgagagtgagcagctgtctgaagagaagacaaatgaagcttaggagttcttctaaaaggaaattctacttggtaatgaaatttgctctatattacccacgcttttcatggaaacatggctccatggctcctgtgctatggttcctgctcactactgtgtaatgtcagaactgaaaaaaaaaaaattccgggtgtgcctgaacctcaaacctagtaatttttcatgcagttttcaaagttaggaacaaatttataacatgaagcagcttagaaaacattaatgactcagaaaacaaaggtttctcagcaggttacaggaggctggatgggcgtccggcatggctagcagtattatcactcttacgttggctcattcttaagctctacaatgggagaaattttataatttttttattggtaaacatatgctaaatccgcttcagtattttattatgttttttaaaatgtgagaacttctgcactacagaattcccttcacagagcagtagaaagcagttcaaaccgtgctggctacctgctgctacccagtcagtcaggagataggacctctgacgttagatgccgtgttgccatctaacatgtattgctagccttaaggaagcagccagagaagagctggagtttcttactcgtgtgatttttaaatggagttcaaaggttgtcgttgagtcctgactccagggacgaccagtgttgatgtggcaaggccggcagaggcggcagaatcagtgttcgtgattgtttgcgtacg

SEQ ID NO: 25197 - DNA, 1157 bp, Mus musculus
agcactggggcatctcacacttttgttcctcagtagtcatttcatgttgattgactctcagaagtctctacagaaataaaagggaaattctccaaactacttaatccatgtacttgcgtgtcaggcatggatacgctattggtttttggttcacagccgttttccaaatgttagttattacggacccaggtgatgaacaacagcagctgatttttacctaccagtattattttatttcttttagtttatagatctgtgcaacatttttgtactgtatgtctttaagcctggcagtattaatacccttcttactgacacgtacttttagttttagaaaacttttatatttatgtgtcttatttttatatttctttatttattacacagtgtagtgtataatactgtagtttgtattaatacaataatatattttagtatgaaattttggaaagttgctaagatttacagtagagatgcagttggttcccgtgcgttgagatttgatttaacagtgttctgttaacatttatacttgcctccgactgtagaccagcctttaaatgggaaggtattagttttacaactacaatcaagtcattctccctttccccagtttttaataggaaactcttacactttgacactcactgtgtgcgactcatagcatgccgctctgcagtcttctgttaagagttggcccagccataactcattcccttagcaagccaaattagaattgccttctgtaaacagtgttgggaacaatgtttaacatgtgccaatttgttcctgtatccatgtatgtaagctaccaatctgactcttccttttaagttccttgttacaccatggtcattttctagttttttaccagactccccagctcacaataaacgcatcaacaaacctgacctgctgtcgttctttggatcatcaaatttcctttggaaaattgtctatgaagtgggcattacatcctagagcttcattcatcttgagctgagtttgttgacacaaagtatttgagacacttagcacaaagaatgccttttcctgtgggggaaattccctgaggaagccctctgcacaggttgtcccttcttccaaaacccacagagcaagagccttcccctcagggaacatcagggctgtgcaag

SEQ ID NO: 25198 - DNA, 2579 bp, Mus musculus
tttatagtttgccaaaacaagcttcatgtagcagccagacagaagtctacatggctaaacgaggtgtgtgtcatctagcatgttgagcactctctttctaaatgcagactgttagctttgtaatacaattcaaagttttattgttttttaaataagtttgttttttccccctagggttatagaaaatggagaaaaaaaccgaatgacctatcagagcatagcgattgtttttggccccacccttctaaagccagaaagagagactggtaatatagcagttcatactgtgtaccagaaccagattgtagagctgattctcctggaattaagcactgtctttggacgttgactctcacaaaagacagcctgtggaatagatgctggattccaagatttcaaatcttatacgtggtgtgtttcattttggaccaagcagtgactctgattttgcacttttttgagagtgaaggcgacagctgggccctcatttgctgcttgttgtgagcaaacagcaagttatgactgtgtaaatttggattcattttatcctggatgcttgcatttcatcctctgactatcagtaaacatcaaaactcagaattctaaccagtcatatacactggataatttggtaaggacaactctgtgagtcccctgtggtattgtccttgctgactgcaaactggataatgtagattccttctcatggtccgtaagctctttacttggtacaatgatactcactgtcagttatttttaaaatgctcttgggcatttaagacaaatgaagttgatcatttgaaacctgtgtactgcatatttcagggtgtttgcatgagtggcagtcttaagtgccgaagctcataacccagatagaatcccttgggtgaaggcttgctgtctgattttactgtctcatggcattcttgctagataccttagttgtctgttggagcagcacactgacaggacttaaaacactgtgatatactggagttctggttagtataagtcaaatcagggtatttggtacctgtcttgctgtactgaattatagctaataatccttattatatttagtgccatattgagtttttggtatgacactgtggagacagacattgtttgatgtaagtatgggctaaggacctaatataatttaccttatgtatataaccgtgttgtataggctcagagtacatctaacccaatgtttctaatcatgacattggtaactgtttccatgactattaggcttcctgcagatagaggccatgatttgggaaagttaagctgtgcacttttaggtttcaattacacttagaagcagaccactgcaatgagaatggtactgggaaatactgagtagacctactaaatagtgaacacactacaggagcagctccttaggttatttaatgtgtacagcagacattagaatcatcattacagaatcctaacccagctcaaatagtggaaacatgtaaattggatgttggatagaaaatgacactgcgaaatttgagtatttcctttttacattactactgtagattgatttgtacaataagacagggtttggaaggttttgttacagggaggcatggtctgttgaagatttttaaatgtatttttctagattaactgctgtatatgaaatgtctaatctaataaaggaaactacaatatgcttagagtttttttccattggaaatgtgcgttttagttcttaattgtgttgttgttttgtttttatttactggcatacttttatacctcattttagaaaagtcaaccaaatccatatttcctgtggcagattgacttttctcacttcgtatgttttctgttcttcctataccaacatttccctagcaccacacacttccttatcatcagtgtttgaaaggaaatgatttctgaccatgattctttttcctaggattgcatttatagtttccagattgccttcctggggaacaatttgtgtgtgtgtgtgtatgatctgtccaaaacctttctcctaagtcctgtggctaatatcttgtgtgtgtcgttgtaatcttcttaaataggtaacaaactaagctgtttgacagctcacgcagattgctttgggtggggaaaaattctaaaccagaatgtgtaacctgaagatgccattaataacgcagtgtgctttagggctcttgtgtcttgactgtgtaccaggaaatcaattagactcaaatctgtgatatgtgctgttctttctcttggtgatcataaacatgtcaaaggtttaaaattgtcctgtgtttcttgtttcaaagtacatgtgtgtatgcaaagtctttaatgttgtattggtctaccactaataattgtattgtaatagtgtatgtacaatgagataagtgtcttgtgttttcatcctttgtgaattaaaaattattgattgtttttataataacaaaaccagtaatattttccttcctttcttttttttttttttttgtttgcttgtttgtttatttgtttgagacagggtttctctgtgtagcctagctgtcctggaactcactctgtagaccaccgct

SEQ ID NO: 25199 - DNA, 1531 bp, Mus musculus
atcgggaagaagctctatgagggtaaaacaaaagaagtctatgaattgttagataacccaggcagagtcctcctgcagtccaaggaccagatcacagcagggaatgcagctaggaagaaccactggaaggcaaagccaccgtctccaataagatcaccagccacatatctcagttgttgcaggaagctggtttaaaaactgctttcaccaagaaatgtggggagactgctgctttcattgcaccccagtgtgaaatgattcccattgaatgggtgtgccgaagaaagcaactggatctttcctcaaaaggaaccctggtgtacaggaggggtacaagttctatccacccaaagtggagatgttcttcaaggatgatgccaataatgatccacagtgttctgaggagcaactcattgctgcaaaagtttgttttgctggccttgttatagggcagactgaagtggacatcatgagtcatgccacacaagctatttttgaaattctggagaaatcctggctgccacagaactgtacgctggttgatatgaagattgaatttggcgttgatgttaaccaccaaagagattgttcttgctgatgtcattgataatgattcctggagactatggccatcgggagatcagagccagcagaaggacaaacagtcttaccatgatctcaaagaagtaactccggaaggactccagatggtaaagaaaaactttgagtgggttgcagactgagtggagttacttctcaagtcagacagtcagtgcagggtggtagtgccgatgggcttcacctctgaccttggtcactgtgaagaaattaagaaggcttgtggaaattttgggattccatgtgaacttagagtaacatccacgcataaaggaccagatgagactttgagaattaaagcagaatatgaaggggatggcatacctactgtatttgtcgctgtggcgggcagaagcaatggtctaggcccagttctgtctggtaatactgcatatccggctatcagctgtcccccgaccacaccagactggggcgctcaggatgtgtggtcatctcttcgactgcccagtggtcttggctgttcaactatactttctccagaaggatcagctcagtttgctgctcagatatttggattaaacaaccatttggtgtgggccaaacttcgagcgagcatattaaacacgtggatagctttaaagcaggctgatgaaaaaaatcagacaatgcaatttgtaaaaaagcaatttaatttttaggagaaaagttacgtagtcctagtttggatttaaagaaaaaaaatcaaacaaaatgatttcacataagagaaaacaattcagttactaatgaacaaatggtactcggtgtttatgagttggcacattgtcagtggatattactaatattttctagctctacatagtgatatgtccctgtaaccttagcactccagaggctgaggcagcagaacctcttaagttcagggccaccctgagctgtgtattgagagtct

SEQ ID NO: 25200 - DNA, 1177 bp, Mus musculus
ctctgtatgcatggcatctctgtcccctcatgacctgtttctctctggaatttagcccctttctcactttccttggtcaagttcagacctttggcattcttcagcatatcagttagaggtgcagctggttgccagccacgctgttgtctcttagtgcttctcttcttgccacttgtttaccttgcctcataattggtaggccctgtgatgttctttctgcctttctccttctgtctccatctggctactctgaggttagaggtcagctcctctaggaaactgctctgattctgttctctgtctttcaggttgaattcagttctcctgtccaggttgagataggagtccatttctcagagcacttaacatattgtgtaatgattgtttagggtactttctgtacatttgggtatagcaagttttgttcttttatattcagatgagagtgctcagtacttagagggccagtgcttccatcttactccctgtgggaatttggggaaagtactgactccttttgaacagtgcctgaataaatgcagcctcttgcatgtttctcgtttctggttttaaatcagttttatctgttgactctggtaaaaaaaaaaatctctgacttaagttctttctcattcctgtactcacactgtctgtcactactgctgtcccattcgttttcactctttattttgatacctgaatctccttcctgctgctgctgcttttatgctattccagctgtagctttaaaaacgtcccagagtctcacttctgacagttcacattaagtcacccatgcagagaagttaatgttgttattctcattcttgggaaaacttttatctgtatctgatgaaaggacagtaaattcagaaggctctcaggtagtaacttatacatacttaaaattgtgtcattggcacttttgttgaaaggcaatagggttcttatgaaaagtatcaaatgtgtatctgagagatcaaacacctatgctttataaaatgattgtattaaaattgtaactaagttatatccaagttttcagtctgccaacaataaataagagttaacaaattttcagttagagatgcaagcaaagtttcaaacattatcttctaaatattattgagaaggtagtcaatattatatttatatgctatataaaaagatttatatt

SEQ ID NO: 25201 - DNA, 1176 bp, Mus musculus
tggaaagctgtgtaagaaagaaggatgagcaagccatagggagcaagctcatgagcagtactgcctatgtccttttctttacttcagttcctgcccgccctccctccctccctccctccctccctccctccctccctccctccctctttccctccctcccttccttcatgtaccttcttccttcatgttacctggaaatctaagaaacaaaccacgtcctccccaagttgcttttggtcctggtgtttatcacagcaacagggaagttactaagaaactgtacagataccagtatttacccgcattatacagatgggaaaagtagttgagaagagttcagctacttatccaggggcagaaaacaggaaagtgatccatcagactcggaacttaggccacccgacttcagattctgtgcatcccatcttccatatgctatcctgcctgtaacactttactgaaggatgagcagtttactaaagctataaatttaatatgaaaatcaacattcagtgataagaaaaggttaatgggtctacagccataccaccctgaacgcgcctgatcttgtctgatcttggaagctaagcagggtcgggcctggttagtacttggatgggagaaaaggttaatggttataagctgtaagaacacaattaatagccgggcgtggtggcgcacgcctttaatcccagcactcgggaggcagaggtaggcggatttctgacttcgaggccagcctggtctacagagtgagttccaggatagccaggactacacagagaaaccctgtctcgaaaaacaacaacaaaaaagaacaccattaaaaattcttcagaaaatcatacagactagactataaaaagcataaatttttcagctaggaaataaaacaatcctcctgtttaagtatgcattatttgggggaaaaaataagcagttcaggtcttctgattttactagtggcatttttatattcattccctccttccctccttccttcctttactctcttatttgaaaaacatccattacaattctgcttaaatttacgaatgaagtaatagccacaaggtctgcccttgagaaactttgcaagcaaccaaagagctcttcccaaatttcacatggtaagttcccaagaaagaatttatcattctcagaaaatataaagcc

SEQ ID NO: 25202 - DNA, 1536 bp, Mus musculus
tgaagttagagtctttagctgcatatgtatcaaaagatggcctagtcggccatcactgcaaagagaggcccattggacttgcaaactttatatgccccagtacaggggaacgccagggccaaaaagggggagtgggtgggtaggggattgggggggggtatgggggacctttgggatagcattgaaaatgtaaatgaggaaaatacctaattaaaaaaaaaatcttctttaaaaaaaaaaaaaaagatttgaagttagccgggcagtggtggcacacgcctttaatcccagtacttggtaggcagaggcaggcagatttctgagttcaaggccagcagttccaggacagccagggctacacagagaaaccctgtctcaaaaaaacaaaaaacaaaaacaaaaacaaaacaaaacaaaaggtaatgatttttaaatggtatgtataatgtttatgagtatcaaatttagattacattaattttttctttattctttctctgcttaaataatagtgttatattaatgcatcgaggcacaaggcataatgtggcatgctatctgttttgagagtgagtattactgagtagaaatggccgagagaagtggaaagatcactgcaggacaagcgtatattgaggtggagtatgattatgagtatgacgcaaaggacagaaagattgtgatcagacaaggggagcgctacctcctggtgaagaagaccaatgatgactggtggcaagtcagacctgatgagaactcaaaagcattttatgtgccagcacagtatgtcaaggaggtcactcgcaaagctctgatgccacctgtgaagcaggcaacaggactgccaaataactctatgaagacaatacagagtatgcatctccagagatcgacagaaaatgtgaacaaaatgcctgagctttcaagttttggaaagccatcgtcatctgttcaaggaacaggtcttattcgtgatgccaatcagaatttcggatccaattataattcaggccagactctcaacctaagcctggacctgacccataataatggaaagtttaacagtgactcacattctcctaaagtttccagccagaataggacacgcttatttggtcattttcccgggccagagttcttggacatagagaaaactagcttctctcaggaacagtcatgtgactcagctggagaaggctccgaaagaatacagcaggattccgagtctggagatgaacttagcagcagctccactgagcagatgagggtaagagaaaaggccggtgaaatgcgagtttgcctaaataaaaatgatgttttaattaaaaccatagtgttataaatttggttgttttgctttatgtgttcggaacacacagagtcgatcctgatttaaagagcaggaaaaaatatgtaaaatagcttgtgacattcatagagaaaatccctatgtggtattcataattcttacatctatgtggggtgggagttattttgagcctgaaaacttttttttctccctactgatgtgcatta

SEQ ID NO: 25203 - DNA, 1950 bp, Mus musculus
ggactaagacattatagaattaaataattttcaaatgttaaataattgtattgactgataaatttatagcctctgaaaaatgagaaaaaaattgtgaacaggacagatgaagtataaatttaaaactacatggttaattttgctctgaaatcctataggtggttttcacctgttatactaaatcatacactataatttgtttagttagaaatagtaaactgtttgcaagtcactagtaattctcaaaaaaatattgttggccatagtgaataatttttaaattagaactaagtgtgtacctatttttggcacttatttttcaaataattaagctcaatcaagtatattttaaggatctataaaagtgacaggaagaccgggtgtggtggcgcacacctttaatcccagcacttgggaggcagaggcaggcggatttctgagttcgaggccagcctggtctacaaagtgagttccaagacagccagggctacacagagaaaccttgtctcgaaaaaccaaaaaaaaaaaaaaaaagtgacaggaagggtctcagcacctgcatcctcagtgcttggggcagctgtagccggaagcaaagacccacaggaaatgcagtgtctggggatctttgataagtagacaagcttttgaagttctgggttagaatctggctggcagaatctttggaaaagttttatatacagatatttgtattattaaatttggagccatagtcagaagactcagatcataattggcttatttttctatttccttaactattgtaatttccacttttataataattttgatttgaaaaataaatttatttatttttttaacagtcaaaatctttgctgttgtagtctgcagcctttaatgattgtgttgcttttatgattgaaagaagcactccacaaattgaagagagcgtgatgcagcgaggtgtaagtcgtggttagtgacgtgtatggctcctgtgctcatcgctgtctctgcgaggcatctggctgcatctaaaggacattcgttccaaatgaaaatttgcttttctggcagttttcataatggaaaaaaaattctcctttgtctgagtatagaagttttaagatgtatcatgggtatcggtgcttgtataacacacaatgaattgtaactagcatgttgttaagaaaacacattgttagttttttttaatcttaaatgtttcttttctatttataatttcaacctttcataaagtatactaagaatttcacaaatttcttttcagtgaactgaactcttttttgcaatgataggccattaaatatagcattcacacaaaatggacatttttaatcacctagaatattgaaaatattttaatttgcagtgtctttttttgtgactggatatattaatgttcctctgagtagtattgataattggttcagaagagaaactcaatgaaataagaatagtatttattcatggtgatcaattaaattatttgcctaatttaaggaaactaaatactatgcataactgaatttatttgcaattctcagtttgatttgaggtaacagaggagagtctaggtctacctgtggaatatgttgttttattttcagtgtttagggttacatttaaacatagttggtttgggaaaatgacatataattttaagttaacctgcatgctgtaaatgtgtttaaataaaggaaaatcttttttgaaatgtaatgacacatttgaaccttacttcatgacgtattagcttgattttatgtagctgaatggcctgccctgtgtgaattggggggggtggcgccgtgtatccctctgtgtatattttagcaagaagtagctgtcaagtggattggcttttttgtactttggcttgcatcttttagaattgttttagaaagttttaaccatctatcagaatagaataagtaaataacctct

SEQ ID NO: 25204 - DNA, 1221 bp, Mus musculus
agcaaccaggagctggagagatgtacattggaaagcacttgctcttttgcggaggaccggagtttgcttcctattatccacatagtgacttagagtgacccataactccagtttctagttccagggaattcctcttctgtactccatgggcaccaggcaatcatgtggtatgatgtcataccacatgtggtatgatgaacataaaatctaattaaaacattttttaaagaaattaaatcattcctatcttgttctttatttcaaacatgagttttataagaactaaaattttctctgcttttttcctatttcaggtgttgaaaagtaattgaagtttgaagaggacataaaatcagtctttcactaactaacctctattccttgggattgtagaaatttaattttttaatgtgtaaattactcctaccctgtacagctgtttcctacccactcttgtaaactctgctgcttcccaacactagagtgcaatgttgatgtcctagaagggaaacgacagtttacaactgcggccctgtttgttacacggtgtgtccttcgtgtcttcactgtgctgagtaactgtgttgagggactctgctccttgatttgcctttctgtgagtgtgtaatcttggtttacattacatagctgctattgcttttcattttcccttttctactaaaatgtcttttttttttaaaggaaatatggaacatttagattaaatgtcttaaattttactacttataacactacttgccacaaaatatatcaggtcagtcagtactgtattttaaaaatccctcaagcaaggtatggtggcacgcatctctactcccaggcagaggcagatggatggctgtcagcttgagttcagcctgctttccaggacagccagggctatatagggagaccctgtctcaaaaataaatcaaaaaataaaaaattaacttaaaaataaatttaaaaatcccttgatatgttgctggtatagtctctgaagcttgcctctgaaaacgttgagctttgagaccaggagttcgagactgaacaggctctttctattatatcattagctcatgagatgccttttgaatacaaatatcttacatatcaaaaatggatctcatgttaaatggatttggaagtactataccccttctttctacttctgcacttaaacatagcttaatgtgctctgctttgttctgttatatcttc

SEQ ID NO: 25205 - DNA, 1160 bp, Mus musculus
gagaacttgatgcagatctgaagtttttaaagaactattctaattggattttggattttgtacatagtacttacaagtctagaatgcctttggttttttgtttgtttttttttttaacttacatgactaaaattgtccatgaatatcatgcagaaagatctccctttttcgtggtaccaagcactctgctgtctcttttttgctactaaattatgccttgtgttgcccttactttcctgggcttcacgcttagatttgttcctttctatgtcccacacagtgtagccctgtgcctgctcgtaactgtttgatccatctgttacagcgtaaagtagcagcacctttcttagtgaaacttttcatttctgttgcttgcctaaatcatgaagcaaatgaatgtttccttgcaggtttgttaaaattctattttactctttcatctagcttctggcatcaaccagaagggatcaagataatatgcaagctgaactgaatcgcctccaagcagaaaatgatgcttctaaagaagaagtcaaagaagttttacaggccttagaggaactggctgttaattatgatcagaagtctcaggaagttgaagacaaaacaaaggaatatgaattgcttagtgatgaattgaatcaaaaatctgtaagataaattttgttttcttaatactcaagtataaataacgctaaatgatgttagttaattaagtcactactatgtaagcctaagatgtgggtaacataggttcttaagacacccaggtctcactttctcttgtctttatatacaaagcctaggtggtagagcaacagtgttataaatctggtttccaaaagtatattgatttgtaatcatctaaatgatttgcctatttctaatgttaggaaaaataatagcttgaaatagaagctacctcataattcattatgggtcaagaatctcaaaacaagaaataaatgactttgtaaggactgtaatgactaagtagtctatctgttctgttttcattctatcaggcaactttagcaagtattgatgctgagcttcagaagctgaaggaaatgaccaaccaccagaagaaacgagcagctgaaatgatggcatcattattaaaagaccttgcagaaataggaattgctgtggggaataac

SEQ ID NO: 25206 - DNA, 1175 bp, Mus musculus
tcctagtccttagtatctaaggattcttagcccttcccctttgtaattttaaactagtatttatttttggctatttggaaagttgagagaaaattatcttaaacttgtaagtttgttttattatgtaatcttacttataggttagtaagactggggctgaaggtgctgtgctggatgaagctaagaacatcaacaagtcactttctgcacttggaaatgtcatttctgctttggcagagggcagtgtgagtatacaatctgttagttccctgttttatgggtagtaatttatagaggatatacgtgtacacaaatgtaaaactgaatgtgtcttcttagtttagtgtttatataggtatcctagctcccttcttgaaatcaagtagattaaattaatgaaatacgccaggcccaggaaagcatatctgatcacaatgcttgaggcagaaacaggatgaccaagagttatacaacaactattattgtataaaaccccactggttttgttttgtttttgtttgtagacctatgttccttatcgagatagtaaaatgaccagaattcttcaagattcattaggtggcaactgtaggaccactattgtcatatgctgctctccatcatcatacaatgagtctgagacaaagtcaacactcctctttggtcaaaggtttgttgttgaaatacaaagtataaagacatggcattaaagttactaatgtcagctactgctcaaatccagatgtatttgtcagagaactagatctgtacttttgaatcaggacataggtcatataagttagagatgtattttagacttaacgagctttaacttttcatagacattaaaattgagaaatgtaattgtttaatttccttttgatgaaagtaaacatctgagtcagatgatgaagtaaaagcttttcagatatatgagcctatgtgaagctcactgatgcacttgaagtagcatacatgaaagagctacttaggaaaatcaataacagccttaccttagacccatagtgataggtaacggatgctactgcttcaggattgcaagtgagttgggaaaataactgcattttcttagttttgatttttttttttttttttaatgttaccaaagactgagtgctgacagaaatttatttgggttgtggatagatattttt

SEQ ID NO: 25207 - DNA, 1177 bp, Mus musculus
aggtaatagacagaagcctttctaggcgggtcttagagcaacgtgtgctgctcagttcactgtacagacaatcactgttgttttaaaacaaagagaaacattttcacagcaaggtaactgtgagtgtagatcagaaataggcaaagcagaaataaagttgggagagctagtgtttagtggttaacaagtagctgggttgggggaggggggagggccaggcctgtgctagaccaacatttaaacttttcagcagagagtgtcagggaagaacagctatgttgttgcttattggtagcctttactttgcacatctacaggtccctgtctacatttatcaggtcaataccaggaacgtattgttggtctgttcatggctggtcaggggattagttccgcttccccatcaccaatgatgactttaattgctgtagaactggacaaatatgaggacatttacagtagatgggacttctcatatccctgactctatttaaaagtaggaaacaaagccagtggacttttcaaaggatacctctagaacctagtgttctggctactagtcctgtgtctgtgtctcacttagtgacgtccattaggacctagatttaaagtcctgacatgttagattactgaggtagtcaagctttggggttggaaggagaaggtggctccgggtaaaggtgcttgccatcaagcctggcagcctgagattgaccactgtatccatgtggaggaagaagagaaccagaccctgcaagtagccctctgactatacaacgtaattgtgtaaaggctgaaaaagagttcaagcctgagaaaatgactcagtgcttgccagtacagcgtgagcacctgaattcatagcccacggttttaaagacgctccatgtagtgttgggtgcctgcagtgcttacactgttgggttacaggaaacagtggcacaggcagatcctcaactccatgaacttcaggttttctcaaaaacaaaggtgaagatggatagaagaaaggcacttgccgtccacctctggcctccatgtgcacacacacacacactcacatcccaaaacgatgataaaggttggggcctaccacgatggctccgtgagtaaaggcacttgccaccaagcccaacaagccaagtttgatcccagaacctgcgtggtggaagaaaag

SEQ ID NO: 25208 - DNA, 1167 bp, Mus musculus
tgcttaacagctaaagtgtaaaacagtacaaaaatggtggttaggaagagaggagggaatgattggggtggagtttttgtctttaagccatgtgccttacagttttattattgcttgaaatgcctctaatttatccagaatgttatatatcttctcagcccatttttctgttgaggatttaatttttgagactgaagagcttagaaaccactcacttgagtgagtaataggcagaggactttgaaggaccaacatcatttggagtttgaaaagttggaattcacctgcttagacaaaaagtgcttactgcaaagaaagacctgaagtcataactgtagccatgcagccatgtgggctgagactagatagactactggccttagagagactggaccagaaagataaatttaaaagataaataaacctctccattctaggcgttagatttccagagttagaaactaataacccaaaggaaagaagaaattgaagatttttactatcagaatatttcattttctttaatatcctgctccctctgtttttgtaagccactgaatgagttttgatgctgtagaatggtgttcttgcctgtgtgtgtaagtaccaagccacacatgtctgactgacacagtgacacaagtgtctcttgacttgaaccattggaactgtcactgttattggtaacagcttccttaatcttttagaaaaatagctaaatgatttataaaatagaacttcaataatctagacaaaaaacctacataaagagtgagtggggagtcctgtttgttgtttttatagtttttctctacattcaattcggtgtagaagacacagcactaagctttgagtctgtgtgaggcctgctgatcccttcattctttaggaagcccaggcttgctttatgtagccatctgtgtggacccacacggtgattgattgcttatgcttcctccaccagcttttagcttggacgctgaacagcctgattacgatctggattctgaagatgaagtatttgtgaataaactgaagaagaaaatggacatctgcccattgcagtttgaggagatgattgaccggctagaaaaaggcagcggtcagcaggtacaacttcatgtctttatgtctatgtgttacctataaactcctgtattatgtgga

SEQ ID NO: 25209 - DNA, 1157 bp, Mus musculus
actggacaaacaggaaaattgacctgaatgtggttaccccaggagttcaaaaactcccccaccctttttaatgaggctctacatcaaaatttagcctccttctgagctgaaaactcccaggtaactctgcttcaatatgttgctccttgctgcaaccacgaaaaagaatgctggcaggggaccaaaagattgctagcagaactgggtaagttgggttaccgggcctctgctaaaaaagcccagctatgtcaaataaaagtaatctacctaaaatataccctccaaaataaaaaacggtggctgacagaggctaaaaaaaggactgtaactcaaataccaactccggctactccaagacaggtaaaaaaattcttgggcaacgctgggttctgcagactttaaatacctgggtttgcaacactggccgccccctgtaccccctaaccaaaaaaagtaaaaaatttaaatggacatcagaacatcaaaaagcctttaaaaatattaaaaaggccctgctgactgcgccagcctcggcactgccagatctaaccaagcccttcatcctctatgttaatgagagggcaggggtggccagagaagttcttactcaggctctagggccgtgagagaggccggtggcatatttgtctaagaagctggacccagtggccagcggatggcccacacgtttaaaggccgttgctacagtagccctactcgttaaggatgctgacaaattaactctgggacagcaaataactgtggtagccccccactctcttaaaagcattatctgtcagcccccagaccaatggatgacaaatgcctgaatgactcactaccagaggctgctgctgactgaacgggtcgtgtttgctcctcctgctattctcaatactgcctgcaaagtaatctacgtgaccagccgtggccaggtgtaccaaactggtacacagacaaaagcagtttcctagtaaaagtttttgtaaataccttttcaaaatgggtgaaggcgtacccaacaaaaaaaaaactgccaatgttgtagttaaaaaaatcctaaaaaaaatttttcctcagtttaaaatacctaaggtaataaagtctaacaataaacccacctttgttgcccaggtaagtcagggactggccatcca

SEQ ID NO: 25210 - DNA, 1147 bp, Mus musculus
tgcagatctattcagatgtttaaaataatgcttaaattcaaagagttttgcttctggtgagctggtaattactagaaaattctgcctctaggtatggctaatgtaactttacattatgtaagaaaaatttttattgtttctgcttctatacaagaagccaagagttttaatctttcagtgtatattgtctcctaagtggaaagtattttattaactaatgcttttcaagggaagtttaccttaaatccttgctctcacccaaaaaattcagagacaatatacttttattacttagtgttttagtttactacaaaaaaataaagaaagcttttataattgttattaattggtaattaaatattagttgtgcccaagacaattctttggacagaaaaaacattattgtaaagtcatttttctcatcctcccagcctatcattggcccacgtgggcccaattagctgttatggggcggagtcttaagacacacagtttcccctgtttcagcacaaataatctagttgtatgctgtagatgttgttttaaaatgctgagcaatcaaaccttaatttgtatattaatagtcaatgccatatctctgagctcacaattgcttaaaattgttcatccctcagatactattaattctcaaatttgcaattgcttatgcatatttctagttaataaataaattatgcacatgtgactcttaataactttgcaagctttctagttacaaccgctccttaagaaaaatgattgaaagtgcaattagtcactgcccctttacagccaagtatttaaaatattttgtcaacaagttaattcaaaagattagatattgtaaaattttaaaactttaacttcttaaaagacaaaaaagagagaaattatatccccgtacatactatttagtgcattcccatgcacactatttaaatcatacctttattttcaaaatttgaaatttaaatgtcaaagaatttaataaatgctttatagtatcttaaaaggatctacttattggcttatagattgatcctaaaacatctaccttattaggaaaggaaaaaacaggttctctccacagaacgctgcagaagcatattaattcgtgtgatgagctggcaggtaagttgactcagtg

SEQ ID NO: 25211 - DNA, 1108 bp, Mus musculus
tggtactgagagcagcaagaaatatgccgaggctgtgggccgagctaagcggattgtttggaatggtcctgttggggtatttgaatgggaagcctttgccaggggaaccaagtcactcatggatgaggtggtgaaagccacttctaggggttgcatcactatcataggtggtggagacactgccacttgctgggccaaatagaacacagaggataaagtcagccatgtgagcactgggggcggtgccagtctagagctcctggaaggtaaagtccttcctggggtggatgctctcagcaatttttagtattttctttcctgcctttggttcctgtgcacagctcctaagtcaacctagtattttccacatctccatttggtgttagcgcaagattcagctagtggctgagatgtggcaccaggaacccttaaacagttgcacagcatctcagctcgtctttactgcatcaggatttgtctgtgttcttcaagagcccatttaaattccttagtgactaaaaccattgtgcattgtagagggtgtctatttatattctgcctgagaaaggaagtgagctgtaaaggctgagctctctctctgacttatgtagcctctggttagcttcgtcactcactgttcttgactcagcatggcaatctgatgaaatcccagctgtaagtctgcagaaattgatgatctattaaacaataaagatgtccactaaaatggaaaaaaaaaaaaaagaaacttaacccaaagtggtccagggtctgctgttgttccattatcttgtctttctgaggtcagtagttgcctcttgtctttctgttctgctcactacagcccaaaccaaactcctctacttatccttactccatggaagcaactgttattattctagcactgaaaataagcccagttaaaagtttagacaagggggctggtgagatggctcaggggttaagagcgccgactgttcttccaaaggtcctgagttcaaatcccagcaaccacatggtggctcacaaccatccataacgaaatcaaatgcctcttctggagtgtctaagacagctacagtgtactcacatataataaataaataaa

SEQ ID NO: 25212 - DNA, 2392 bp, Mus musculus
tctctgtggggagtggaggaaatttactaatttgtaattactaaatgtagcaaaaattcctggtttgattgtcagtatcttgtaggtttctatttatgccgtaatcagtagaaacacatgagattatgtgcaataaaaaaatatactatgatccttttccttgacttttagaggcaagtgcaaaaacctgtgatggtgtacagtgtgcctttgaggagcttgttgagaagatcattcagacacctggcctgtgggaaagtgagaaccagaacaaaggagtcaagctgtcacacagggaagagagccgcggaggaggcgcctgcggcggttactgctctgtgctataaactctgggaattccatctcttgcatatttgatcagatagtgacatctttctgtatataaactcttaactgctattagggaccttgcagtttgcacataagtgtttttatcatggcagtgagtatttgcaagaaactccctcattggctttcccaggtgaaatggtatggtaagcatgcagttttcagtctgtagagtttttttggggggaggggaggggattgctgttgttttgttttgggcttttttttttaatgtaacgtaaaatcgatgtcgcttcatggcacatgtgattttatggtttgcatttatcatgtcattttaaaacatcatctgtctgtatgtgttgctgcaagtctgcttttgttctcccttctgcttaattactgaattacttgttatgtagaactataaccatgggaaggtttcccttgaggaataacaaagcatgattcacagcttttctaggatgctttagactcttagtactaagtaaaattctcagttcagaatacagcccaggccaattcataattaaacctctatttgttctgatgatgcttccaaaatagaattgctaagttaaggaagtttggtatgttaatttacaccagtgatgaactcagctacgcagggcactaaccctatgttgcacacgctgggttcctgatcttggtgcgatgttttggttacatggcatctggcaggctttctgccatttgggtttcagaagaacatgaacagtatattattatagctcctttaattcttccacttttaaaaccaacatgttttttcacaagtgttggtagtgtttgtccgggtgcctcagttgtaacttgttgtataatgactgtctgtatcttaatggcttccataaatgactagttgctattcaaaacatatttttgtgatttgaagatggggaaggaaaacactaaatgacaatttgagaaaggtgtattgttccaaattctgactggaggggagaggctcttgcagtgagatcgttgataagttactgcaaaagtagccactagtttattaaaaaccaaactgtacagattaataaaccttttccacaatattcagttttctaactccttgttgccgtacagtgtatgttttcttactcatacattatttaatttctttaacctctgctatttatgctccacaagtaaaatgtacttagactggtcactgtattgtcccttattaagatgctgatattaatttttacagtttattatctatgtacaatggtaaatgataaacattttgtgtacctttgcaatatgtgtgttactgggtttacttcggattgatttctttctgaatagggtgtcttcatatggaaacctcacattacatcatttatatttggtggtctacatgtgattagagcttttatacattctgtatatttttattaaatgtaagacttttgcttctataatgttagaggaaggtagctcacacatgtatttataatttagtcacattacattaaattttagatttatgtacattttgtgtcttgtctgtcttaacaagacttctgcttgttcttgctgagtcatgctgtcgttattaccattagatcatcatcttgatttgagcagaacttgagtatatgagtcgcatgaatatagctttgaaaatttgattgttgtgtctagagaggtggttcattgggcaaagtacttgtttcagagtttgaagactggcatttgcatcccagaactcacctaaaatggcaggtgacatggcagtcaactctcactctccaaacagaagatagagatagaggctccagaatcaagcaggcaagctagagtagtcatgttggcaagctttgggctcagctgatactttgcttcaaagctacagtgaaaagcagtataagaagcctcagtgtcaactgtgggtctgtatacacatatggacatacatgtacacccccacatacttgagcacacacacacacacaaattaattttgacagatttattttagaaccttctatttgttatatctaggtgg

SEQ ID NO: 25213 - DNA, 1283 bp, Mus musculus
taaacataagaatcttactaacagaaaccaagaccactcaccatcatcagaacccaacactcccactttgctcagtccagggcaccccgacacacctgaaaagctagacccagaattaaaagcatatctcatgatgatggtagaggacatcaagaaggactttaataactcacttaaagaaatacgggagaacactgctaaacaggtagaagacattaaagaggaaacacaaaaatcccttaaagaattgcaggaaaacacaaccaaacaggtgatggaattgaataaaaccatccaagacctaaaaaggaaagtagacacaataaagaaagcccaaagtgaggcaacgctggagatagaaaccctaagaaggaaatctggaaccatagatgcgagcataagcaacagaatacaagagatggaagagagaatctcaggtgcagaagattccatagagaacatcggcacaaaaatcaaaaaaaaaaaaaaaaatagaaaatgcaaaaagatcctaactcaaaacatccagtacggggtgcggccagaaagggggctgccctctcgcctgtcacattgaacgcacattcctgtggaacctggcgctaaaccattcatagatgacctgcttctgtgtcggggtttcgtacatagtagagcagatccctcgctgcgatctattgaaagacagccctcgaaacaagggtttgaaataaaaaagaagaaactaaaaaaaagaagaagaagaagaagaagaagaagaagaagaagaagaagaagaagaagaagaagaagagaaatacaaacaaacaaacaaacaaaaaaaaaaaaccaggaaatccaggacacaatgagaagaccaaacctacggataataggagtagatgagaatgaagattttcaactcaaaggactggcaaatatcttcaacaaaattatagaagaaaacttcccaaacctaaagaaagatatgcccatgaacatacaagaagcctacagaactccaaatagaatggaccagaaaagaagttcctcccgacacatgataatcagaaaaacaaatgcactaaaaaaagacagaatattaaaaatcagtaagggaaaaaggtcaagtaacatataaaggtagacttattagaattacaccagacttctcaccagagactatgaaagacagaagagcctggacagatgttatagagacactaagagaacacaaatgccagcccaggctactatacccagccaaactctcaattaccatagatgaagaaaccaaaatattc

SEQ ID NO: 25214 - DNA, 1166 bp, Mus musculus
aaagatataatttaaaatagttttatgggccgggcgtggtggcacacgcctttaatcccagcacttgggaggcagagacaggtggatttctgagttcgaggccagcctggtctacagaatgagttccaggacagccagagctacacagagaaaccctgtctcgaaaaaaacaaaaacaaaaacaaataaacaaatatatatatatatatatatatagttttataagcaagatcaacattccatgtaaatattggaccttttggcagataggtccacacacatattacatgttcactgctgtttggtggtgtccgtggctagctttccttaagacaatgtcaaatttctgtgtgaagcagaaacaaaaacttttctagtgacctcattacatgttcaagcccaacagtcagatgattggactaatgaacacagttcatggaagttctgtgcttattaattaaagccatgcagctcaaacacagagagaaaggctactgaatttctactctgatatcactgctttgtgtggactgtctagaagcacaagtcttaaaaagttggtttggatggaatgtcctgtcccttgctcgatgtgtacacttctctaaaggaactttctagaccaagaatggtgagaagtgtgtccagcataggacattctgaaatagtttaggtatcccatgttcatacctcaggtatctttgctgattgtttttcttcatctggtgactgctctcttcagtttttattttgggttagtgcttgggaaatttggggtaggtagtgaaggtgatggaatgtcatgaaaatataaatgtctgcacctgttagaccacagctgagcatctttctttaaaaaataaataaacagaaataaagcagtttaagaaatcaggtggcatgtagccttacctgttctatttcttgatgcttataaagagatttaatttaaacataaaagccaggccaagataccaacagcatttggccttgctgtgctctctgacctcagcactcccaccaccaaggagaaaaatactttgctcctagctttcagcagcttgtttctggggtgcagtgccagccactattagaaaagcagggtttcattgtttatccatttaaagttgaacctggtatgaggtgctttttttctcctctatctc

SEQ ID NO: 25215 - DNA, 1195 bp, Mus musculus
gtattgttttttttgttttgttttgtttttttgttttttttttctgttactatcctttgaagggctggattcgtggagagataatgtgtgaatttggttttgtcgtggaatactttggtttctccatctatggtaattgagagtttggctgggtatagtagcctgggctggaatttgtgttctcttagtttctgtataatatctgtccaggctcttctggctttcatagtctctggtgaaaaatctggtgtaattctgataggcttgcctttttatgttacttgacctttttcccttactgcttttagtattctatctttatttagtgcatttgatgttctgattattatgtgtccggaggaatttcttttctggtccagtctatttggagttctgtaggcttcttgtatgttcatgggcatctctttctttagatttgggaagttttcttcaataattttgttgaagatatttgctggtcctttgagttgaaaatcttcattctcatccactcctattatccgtaggtttggtcttctccttgtgtcctggatttcctggatgttttgagttaggatctttttgcattttccattctctttgattgttgtgccgatggaatcttctgcacctgagattctctcttccatctcttgtattctgttgctgatgcttgcatctatggttccagatttctttcctagtgtttctatctccactgttgcctcactttgggttttctttattgtgtctacttccctttttaggtctagtatggttttgttcatttccatcacctgtttggatgtgttttcctgtttttctataaggacttctacctgtttggttgtgttttcctgtttttctttaaggacttgtaactctttagcagtgttctcctgtatttctttaagtgagttattaaattccttcttgatgtcctctaccatcatcatgagataagcttttaaatccaggtctaccttttcaggtgtgttaggatgccctggactgggcaaagtgggcgttctgggttctgatgatggtgagtggtcctggtttctgttagtaggattcttatgtttacctttcgacatctggcaatctctggatttagttgttatagttgtctttgtttagagattgttcctctggtgatttttttaccctctagcagcagacgtgggagactagc

SEQ ID NO: 25216 - DNA, 1177 bp, Mus musculus
aatttcataaattcattgtttttgatagctgagtagtactccattgtgtaaatgtaccacattttctgtatccattcctctgttgagggacatctgagttctttccaacttctaactcttataaataaggctactctgaacatggtggagcatatgttcttattaccagttgggacatcttctggatatatgcccaggagaggtattgctggatcttccggtagtactatgtccaattttctgaggaaccaccagattgatttccagagtggttgtacaagcttacaatctcaccaacaatggaggcatgttcctctttctccacatcctcgacagcatttgctgtcacatgaatttttgatgttagccattctggttagttcatattgttgttccacctatagggttgttttgatttgcatttccctgatgattaacgatgttgaacattttttcaggtgcttctcagccatttgatatttctcagttgagaattcttttttagctctgtgctccattttttaatgggattattttgttttctggagtccatcttcttgagttctttttatattggatattagtcccctgactgatttaggattggttaaaaaaaaaaaaaatcttcccaatctgttggtgggctttttgtcttattgacagctttgcaattttatgaggtcccatttgtcaattctcaaccttatagcacaagccattgctgttctattcaggaatttttcctctgtgcccttatctttgagccttttccacactttctcctctataagtttcagtgtgtctggttttatgtggagttccttcatccacttagacttgacttagtacaaggagataagaatggatctattcgcattcttctacatgataacccccagttgtgccagcaccattttttgaaaatactatcttttttccactggatgattttagctcccttgtcaaagatcaagtgaccattggtgtgagggttcatttctgggtcttcaattctattccattggtctacttgtctgtcgctataccaatacaatgtagtgtttattacaattgctctgtagtacagctttaggttagacatggtgatttcaccagagattcttttatcattgagaagaatttttgctatcctaggtttttttttttattccagatg

SEQ ID NO: 25217 - DNA, 1154 bp, Mus musculus
atgtaaattgattttgttaagtttttttgtatttggcatttaatataacgattagccagttggattttgatggaattttatagtgactttttcttacataaaaaatggtttgtttctaaaagcaaattattgaacccgagtcacttcaacagcactattacctctgaacaaataatttcccaaaatattcttcattacatatgagtgtaattttatataatttatgactttttcagattgtattaaaatcaagaaatttaatgttttccccccactttctgttttgtttattgagtagcctttaaagttgtttctgttctcctgccttgtgggcctaatagattgaactcagatcgtcaatctgctttccttgcagcagcatcttgtagcctttttatagattatttctctgtgtgtgtatgatgtatgcgtcttctccgtggggttggaacccagaagcgtgggtgtgggggttgaagggtaactgtctggcactgcttcctcccactgtggatcccagggtcagactcaggggttgggggtgcagcagcccgtttacctgttcctggcttttggacccagcctttccccactccctatagaactatttcacacattcttaagatgaggacaaccttaaaaatatttgaaacatttatattgtgaaactgtaatacctgaagttttttttaactgctttccattgtaaataattcaaggtagacatggttgattttctggtgcaaaaaaagtgtttgtggattagaacttcaaagctactggccaagaggagaaacatagaaacctacaattaagtttgttattaataactgtagtaaaagatgacttcccatgggaacttgaggctgttgttaattctctttttcagcccacacccctcttttgcataggatgttattaaatgaggcagtgaccaatcagagcctccccacccccaacctcaacatgactgtctcatgctgggtatgaggtcaagttttacagtttgcaagggaaaaacaagaattcctgtcagagttaagttttaatcaccaaattataaaactagaccatatagtcacttactaagaccaaatacaccataactacctccaagaccatatagtcacttactaagaccaagtacaccatgg

SEQ ID NO: 25218 - DNA, 1100 bp, Mus musculus
aaaatgtcattaatttgactggcttttgtaggtatagggaacttaattgtgctgattaaagttggatagggaatacgattcagaagagccattaaattaaccaagagttaataagaatgattagtagttaggagcagtgtcagtggagtgtcagaaagtgtcttttctttaagtgaatgaaagaacaaaagcattctatttctcttatatgaatataagaacagccccttttttttttagcttattcacatttgtttcatgtgtatgtgtgcgtgcgtgcgtgcgtgcacactattgcactcattgtctgtgaggtccctgagcctgggctggttggtatagatgtcccatttgggactgagcactcaacaatcatttgttagcactttgaccagttttacctttctgcatcaactgatgctcactgcagagagaagcatctttgtacaaggttgagaacagcagtacccccagaagcataaacataaatacttagaaggcagttttgtaacattatttagctaaatgacattagtagttagacttatctcctagaagctatgaggctccaggctgagggctttcaccaggcttatagtaatcaagcatgagttcctcttgtggaagcagtcaaatttagaagtagttgcttacctcatgatcttttcaagtccccgacaggcaacagtaatttttatttttatgttatcttttgttgtgcctagaaaaggaccgtaccctaccactgacctttacttctcaaccctctttgattatttatactgcactatttctttgatcataccattagtttgtgggaaggaaactctttgcttgtaagatttctttgaaatgtgttttcttgactggtttattttgtaaaccctttggtctccccatatgtacttcccatattcttgtacatttaaatgtatttgtatatatagggtttttttaaaaaaaattctttcgctgggcagtggtggcgcacgcctttagtcccagcacttggaaggcagaggcaggcggatttctgagttcgagaccagcctggtctacaaagtgagttccaggacagccagggctacacagagaaaccc

SEQ ID NO: 25219 - DNA, 1292 bp, Mus musculus
aatcttgcattttcaaaaatccagtgcaagcgccaggtgatctgtgtctgaggatacgattttgaaccttatgagcagtgtacaaatatcatgagacaactgatcagcacttgcacctgatcaagagcagtgctgctccatttgttttgcaaagatatgttttcatttcctgtatgttccattccctctgaagtcccttggcctgattttatccattttttttttttttttaaggtgccccctttcctttcttggggcactgttgctgtggcacttttctataaccttgtcattcctatgtacagtagctggaagtcgcagtgagcaagcataacccacgtttgtataaattattgaaatccattttcacctaagaatggacttaagaagtactgctgggcaagtgtgctgaaagtacattaactgctcaaatacaaggaagtggcccaatgaacatggttgtgggaggggaaaggagaaacaaagctagtcagatgtgaattgtatctgttgtaataaacatgtttaaacaaacacattttgttactttttttcccttcggccggtacatattagaatttgaactacatgaggattctttatcaaaactattcttgttgaatatttatatcttattacaagtaataattccttatagggaggttttgtttaaagtacattaacataattgtgtaaaggatatttaatgaaagtgaaattgaacaagaatgaagaagcacttcctcagtggcatcacttgttcagcttggttcagctgtcttgctgctctgacacttcattttgaaggatgtctgtgctgtactcaacttttcaagtctggtgctgactgttgttcctaacatcacaaaacagtttgtgtcattgagttacttgctgtacccagaaacatgggacatctcagctttgtatagtgtttcctaaagtatattaaaataaaaaaagaaacgattgctactataaagctaccttggcttttttttttttaacccgtttgcttaaaaattttagtcaacatgaccttaacatgacacttccagcattgtactaaatcctgtttttgtatgtatcaaaattgtaacatctgacttaagaattgcattgttggggcagatgttttcttctagatctacaatcaccaagagatgatttttattttacatcagaatcaatgttaactttctgaaacactgaaatcaaaactttctttgctttgactttatttaattatacttaagctacagaaggtaacattaagacttctgtaagtttaa

SEQ ID NO: 25220 - DNA, 1269 bp, Mus musculus
ccttcaccccttagctgagggtgtttaccaggcttcctcacggtggactcattagcatgcacattatttatgcatacgctttgatggagtagtctctgaggaccacatgaccacatacattatttggaattcttctgtatgggatatggtaccttctctaaattattattcacaattttttttgtttttgtttttcgagatagggtttctctgtatagtcctggttgtcctggaactctctctgtagacctggctggcatcgaactcagaaattcgcctgcttctgcctcccagctacaaagttttacatcagtgtttgttgcggtaaatctccacccaaatatgccctggcaatgaaaacacaactcagctaatatgaatacatgctgtgctctttctgttcccagcgcagccatggctccaggtcccaagaaacacctgaagcacgtatctgctccaaaacattggatgctggataaattgactggcgtgtttgctcctcgtccatccactggtcctcacaagctgagggaatgcctgcctcccatcattttcctaaggaacagacttaagtatgccctgactggagatgaagtaaaagagatttgcatgcagcgattcattaagattgatgggaaagtcaggaccgatataacctaccctgctgggtttatggatgtcatcagcattgacaagaccggagagaacttccgtctgatctatgacaccaagggtcgatttgctgttcatcgtattacacccgaggaggccaagtacaagttgtgcaaagtgagaaagatctttgtgggcacaaaaggaatcctgcatctggtgacccatatgatgctcgtactattcgataccctgttccctcatcaaggtgaatgacaccattcagattgatttggagacaggcaaaataactgacttcatcaagttcgacactgggaacctgtgtatggtgactggaggtgctaacttgggaagaattggtgtaatcaccaacagagagggacatccctgctcttttgatgtggttcatgtgaaagatgccaatggcaacagctttgccactcggctgtccaacatttttgttattgggaagggcagcaaaccatggatctctcttccccgaggcaaaggaatccgcctcaccattgctgaagagagagacaagaggctagcggccatacagagcagtgggtgaaatggtctctaggagacatgctggaaaagtgtttgtacaagcctttctaggcaacatacatg

SEQ ID NO: 25221 - DNA, 1451 bp, Mus musculus
aaactcttctattgagtgcagtaaaagggttagaggtagctatcaaagagagagtctgacatgaagtctaagagtctgagtcacacacaagtgctttgcttctgcccatcttaggttgcggtgaccgaggtttgtgaggttttccttgtttgagataaattctagcatttgctttatcatatactcctcctgtgtgagcgtggaaaagtttagaattgtatgctagttttgaatgccctaaaatcatatgcctgacccctctcaatagagcacactttgaagatggaaggaacaaaatatcaaaatcccaaaagtatgaagccacaaatgttagtaaagagtcagtgcagttcttgtgcagttttggatgcaatatgagcaaattctagcctaaacttgcaaagcaggaagtaaaaaattaactaccctcctgttgcctctttgatgatttgctctgagtgggaaaggggatcggcttctctccttacaaaccttaaacagaggtcgaaacatgtagaaagtgtcattttgtattccctcatctctataactctagaagggacctattttcttagccaaatatgaatgcctcttagatgaatccttcctctcatgtaaagtaccttatcttaccagcccatttcaggaaagaactgctggcttgatagcagaaatcttatttttattccttttatttgaatgggagatttggaaattgacttatgtaaatagttcaatgcacctgatactattttgtggagtttattaaactactttaaaagattgtacagtgtattcgttgtatgtgtgtacacacagtctggtacctgacattcaacagtgactctttatagcctggcttggttttattcagactgttgactattgttttcaagccttgtacactggactctacctctgaataggaaggttttctctttgcatcagtgagtgttaactgtattaattggttgtatttcttgcactaaggatttcagttgtactgtttagtctgaattactaggcatgtaagtataggctcatttaatttttctatacaataatgaaaacttatttttgttttctgggttgttctcaggttgccaaaataaaaaggagataaaaccaatctaatagtagtgttgataaatcatagtgactgtaacttgtttgcaaagtagttcggtgtccaacaggtaacgctggatgctgtttgggaatgctatctcagtgcagcctctggtaaagagctcgttgtcattgttgaaggatgaagaaagccacagttttttgactatagacttgatttaaacagcaaatataatttgttgaagaataaacacacattccggtaaattttgttttactttttcactgggaaaagaaaggagttaagctaaaatataatgagatcctaagcacctaagaggtgctttcatgccttaatgttc

SEQ ID NO: 25222 - DNA, 1349 bp, Mus musculus
gccatctctcgtctctgtgaggacaagtacaaggacctgaggaaacccatgaggaagcgttcagcaagtgctgacaacctgattctgccaaggtggtctccagccatcatctcctaactggggcactctcctgaggctgtgctgtccctcagtttctccttttgtttaaagaaaagatgaacttgggtggttttgtttggtttggttttcttttttccttctgtttttaacaatagcctcatcgaggctgccttcagcccgcctccacacttggtgggtgcacgcagagcggctttaagggacgtgaaatcagtattcaggaaacttggtgtcaagccttcccggccatcatgaaaagcacttctttcatggaggaaacagactctaatcctggagaaggaaatgaaggaaaaggaagttgtgttaagggatagattacttggtagctttgctgtttctgggtccttgtctggtcatagataccagatggagccagatgataggtagcagagttgaatgcatctccaaatcgggaatgccatgctatgcccttggaatctgtgtgctctgtaagaaagacttcctgcattccttcatgctgctctcgggattggggatggggatgtttgttcatttttattctggttgggttttgattcctcagagcagagagtatagtttgtaaccaccatggcacagacatccaaataaatagtactgattgtttatctctgctccattttctctagccttcttctgagctttcttcctcacaagtaagatgtgcttgttgtgtttctacacacctgttatatatgattctctttcaacaatagcaggattaacttgactgtagtactgaaccaaaactatccctctcctgcctagttccaagaacattctatctagattaatatgggtgcttgtgccttccagttttcttgcaattggttgttcttggttttggttttgtcacctcctctccatcccaggttctctttttctgctaacatgaaggtgtaattacaaaacgcactcagactttgtggctgaaggcaaaggtcctcagcacaagcatcttggatagagaagcatccggggagccaggtttccctgacctcatgaggagccatgtccatgtgctccctgcctggtcattcttctacttccatgtccattgttgtaagcaatattctccttgaattttatatgcttcctttaaatcaaatttagtctatttgtatacaatttttttaaaaatctaaaatttagaaaatggggagtgggtgggtgggtatccagtgggaagatcactaaaaggaaaaatgttactatttcctgaggtattt

SEQ ID NO: 25223 - DNA, 1129 bp, Mus musculus
gttcatccctcagatactattaattctcaaatttacaattgcttatgcatatttctagttaataaataaataaattatgcacatgtgactcttaataactttgcaagccttctagttacaactgctccttaagaaaattgattaaaagtgcaattagtcactgcccctttacagccaagtatttaaaatatttggtcaactagttattaattcaaaagtttaggtattgtaaaattttaaaactttaacttcttaaaagacaaaaaagagagaaattgtatctccgtgcatactatttagtgcattcccatgcacactattaaggtcttacctttattttcaaaatttaatattttaatgtcaaagagtttaataaatgctttatagtatcttaaagggatctacttattggcttatagattgatcctaaaacaactaccttattaaaaaaggaaaaaacaggttttctccacagaacgctgcagaagcatattagtaaattcgtgtgacgagctggtaggtaagttgactcatgtcctgattgaattaactaaaaaactaaattaaatttatgttttagatccatccttacttgtcatttttccagtttagactagcttctagccttttaactttatggcaatagtacatcagagactgtatattcagacttagtaaaattagtcatttaatagagtcataatgatttttctccttcattgtgaccagccattctaacgcaatcttagactagtctaatattcagtccaatgttagagattcctatattctaaattatctagcaaagttaattcagagcacatcccccacttcccctagatccctaacctcaaaaggatttctggccttacagctagtggaaaaagctattaaagagcaattggtcacttaatacattggtaaaatagaaggaccccctgactaacaaatggaagggtccagatccagttctaatttggggtaggggctcagtttgtgttttttcacgagatgaagatagagcgcggtgactgccagatgtcagatgaacacagattctaaatcttctaaagtatcaccttgaggactaaaattcttcttttgcttaaaagtcagcttgaggactcag

SEQ ID NO: 25224 - DNA, 1122 bp, Mus musculus
tggttttggtcgtctaggtagaagtggacgatggtgtttgtagacgatggggtgatggggttttctgaaatgcgcgcgtctgtatttgcagctgtcctcttgggccgtaaggaccggaggattgtggtcggcagacgtgctaagaggaccacaggctgtggccctgggggacgccctgggaggtagggagagtcagggacgcctggctgtctccggagatcggtcagagggaccgagttctgttgaagcggaagcttccccctccaacatcgtctaattcttttgcctgcttgtggaggacaagaaagggtcgagtgtgtctggatctgttggtttctgttttgtgtgtttttgtgtatgtgtttagagctatgtgaaaatctaaaaaaaaacaaaagcaaaggtaattctcataggtgctttatatcctgactagagatagtttacacctgagatgtgagagaatgggttttaagaaaagtagtactctccgactatctgggggtaatttggtaataaaataaaataaacagtattgattggtctttagagccctgcatctgtagttaggaatctagtgtggctggagaagccctgctaggcgctgattataaacgctgctcttatagggacgagcagcttctcaagttctatggtaagggaacagatggctgcttttcctacaaaaatctcagtgcttgtgattattggattcatcaggtgacaaggtgctcctctcttgaaattacagctagaaaaattaagaattttgtttggtttaaatgggcaaatgtatatggccatttcatttttgtttctaaatagtttcaaaagtataaatatgttttatatgtcttggttatagattagtggctcataagttattggttatgattaaaaatttgtaacattggtaacaaaaagttgacttaaaactggtaactctgggttagagtaatttagaactacaacatacagcatgagacaacccatgggaacaggtctctaaagatacgcctaaattgggtaatattctgtgtaattcttatcctagaaatctgatttataaaagataagatttagggtagtgtctttgagatatattggcggctacaccttctt

SEQ ID NO: 25225 - DNA, 1920 bp, Mus musculus
gaaccttcctctgtgttccttgaaaggcttatggaagccttcaggcggttcactccctttgatcttacctcgaaagcccaaaaggcctcagtggccatggcctttcataaggcagtcagctcccgatatcagaaagaaacttcagagattaaaaggtgtattacaagaaagagacagttatgcgatctagtaaaagaggcagagaaagtgtgtgtgtgtgagagagagaggcaggaggcaaaagaaagagaaaacaggagggatagtagacaagaaagaaatttgccacagtggtaagagaaaaagaaaagacaggatctagacaggaaacctgggcaactgaagaccgagcctcagctaaagaggctcagctgtgtcagactgaagtgacttatttgggatacacccttcgaggtggaaagcagtggctaaaagaagccagaaaaagactgtaactcagatccccaccccaactacaccaaggcaagtaagaaaattcttaggtactgctggtttctacagactctagatacctgggttggcgaccttagctgcccagttgtaccccctaaccaaggaaggtaggtgtttgtgtggaccccagatcaccaaaaagcctttaaagagattaaaaaggccctactgatggccagcctatgcctgacctaaccaagcctttcactctttatgtaaaagagagagcaggggtcaccagaagagtccttactcagactttgggactttgaaaaggccagtgacttacctatccaagaagttacaccctgttgccagcgggtggttttcttgcctaaaagctattgctgccataatctgcttgtcaaggatgctaataagctcactctgggacagcaaataactgtagtggcatcccacactcttgaaagcattaccaacgctcctgtgacacatcagagctttttgttgtctaaatgagtgatcttcgcttcattccacctgctgtcccactgcgtgagactgcacctactcatcactgtgctgacattctggcagaagaaatgatctgaaggatcagatcagccttggtctgaggacagtagcctcgaggttaaaggtaagcagaaggcggggacagcagtatggtggtgaacagaaagcaagtgatctaagccagcagccttcctgagggacgtcggcccagaaagctaaacttgtgactttaagacaagctctatgaatggcaaagaaaagtctacactgacaacaggtatgcttttgccactgtacggggcaatatacaaagagggctgttgacatctgcagaaaaagacctaagatgctgtggctaaaaaaaattcaggtggcagatctaaccgccaatcaggtggcccaaggagcagtgatcctgacagtcaaggagcctaaagattattatgcatcagagagaccagctttagatacgtcgctgagcactatcaagttatggacagtatttgacttggcctgggggccaagaaattcaaaggtgtggttaggtcctttgactactatgttacaggactctctgacttggcagaagaaatagtcaaaagcttcaaggcctgtgctataatgaggtagaatttctaaaagaaatcttcccaaggtaatggacctgcctttgttgcccaggtaaatcagagactggccaagatattagagatcggttaaaagttacattgtgcatgcaggccccaaagctcaggacaggtaaaaaaattaatagaaccattaagggatccttaccaaattgacagcggagactggcgctatgattagatagctctcctaccctttatgctcttcagggatagaaacacccctggacagtttagactgacccccctataaattactctacaggggggccccctccactggtaaaaatagcctctgtacatg

SEQ ID NO: 25226 - DNA, 1138 bp, Mus musculus
taaaataactttgtataagatattttcattcctgtttgtatgactgcttaatttcatagaacttgtctttattgttaacaaattagtgcaaattcttgcttctaaataaacttgtttctctgttggtagataaatcattccgcatgtgagaacgttttagctattatttctcttgctattgggggagtgaccgaaagtaagtatctttctgtttctcctaaaagttgttttagatctgacctgttttatttaagactctcgacatacctcttcctctgtctggttttgttcatcttttatgtgtgttgctagagaccaaatatagggcctcatgcatgctgtgctaccactgacccacactcacagcccctgctcattgtttgactccttcctttgccaagaagatgttcctacttactgctcatcacgattatgtcatgtacattacagtttgtttgttttcaagtgttttaatcatatatcagtacttagtgagcatttattgtatgcatgtactaagttaggattgggaggttcagtgtaagagtctactgggtaatgcagggcagacgtgtgtgagtgtgtgagtgctgtaagcgctatggttagagtttgttgatgaattttaaaaagtaagatgagcttggatctgtgacaaatacctattatcccacacttgtaaggctgaatcaggacagtcagaaattggagtcaaaataaaacaaaatgaaaaaaagaagatctggtctacaaatagaaataaagtttgccagaaatagagaagaagatagatataggaaggccacgttcagcatagctagaaaattatatgagatgagaatggcaaaggaactaagatttgtgggttagtttaaaggccagtgtatctcgtactgagaagactaagtacattggggtagactgctagcagaaaaactaggcagaaattaaaaaaaaaaaacagcactggggcactggaagatggctcattggctaagattacttgatgctcttacagaggacctatgttcagttccaacatctatgacaggcagctcataactaactacctttaactccagctccataggatatgaaggcctcttctggcctttgcaggcacctgcacacatggagc

SEQ ID NO: 25227 - DNA, 3040 bp, Mus musculus
taatggtgtgtatcttcttaatttagatgaatggatcaaatttgatgatgataaggtcagcattgtaaccccagaagatattctgcggctgtctggtggtggagactggcacattgcttatgttctactttatgggcctcgaagagttgaaataatggaagaagaaagtgaacagtaatcttcaatttagctatttatgcttaggtgtgaatgtttttgttgttgttgttgaacatttctataatcttgagctctaaagaaaatgagaacagaaccaagccacttgtgcatcttcaatcttaagactacgggaaattacgtttgggtcctaccttgtatagaggtagcttcaagacattctttaaaaatctcattttttgcattaatccttagaaattcttggctgaaatccattttatcccttgccttttcagcccaagctttagcagtgatgtttattgcacacctatctgttgttcttgcatggttactatcaccttcagtagctgcccgtcctctgccttatctaaccaatatttttctaggaaggtggaaaagtgttgctctcttcgtgtaactcagtgctgctgtccacatcccatcaactgggtgcaatcaagtattgtccagactgactgttgctggcctttcatgactttacaataaattgtgatcaataagaacacacttgattatacacttattattgtgtctctaatgtactgtggtttatatgttaaactttgcattggtttttgtagtaatcataatgtgtaaacaagctctggttgcttggaaaccaaggatatttaataataaaaataaggaaaaagagggattaacaacttttgacatttctttttagtattagagcttggcttaagagtcaaatgaattcagtactatacagtttctgcaaatggctaataatgctaagcagtcaaggatctatttaaaatacaagaaactttagcttgtccagtgttattacaaaagaaatacaaagtagtaaaggtgatgagttcctttggacagtgaattctgtgatcagtttcattccctcacacgtttgttgtttctattttctttcccaaagtctttgtgcccatcttgaaagttactgatttttaagattaaggtatacattaccaagagtattgtttattaatctattgactacccagtgagtaagtccttagatgtttcaggaactttagcaatctaaggaaaggatgaagtgttgaatattcgtgatctggtctgatttgagttgactaggaatgtcaggaatatcatgacatcttccacctcatgttttaatgctctgtaaagtacccaagattcctataggataataaatctgtaatagtgtgggtaagtcagcattttaggtttgtaaatagtttgctaacttaaacattattagcagttaagacgccttacaatggggagtgaaacatggaatgaaacagtgctgtgtgtactgtaatagtttgtgtcatgacccctgggattcagtgttatttgctagaacagttgtagaacgaaggaatttggcacctgtgttttcctactaaaccaggtgaggtagatttagaacaaatatgccaaaactatgtttagaatgcattaagaaaactattatacaaaaagtgtggtgatagtttatttgacctaaaaaggcattccaaaaataattctttaaagtagaaattggacttccatcattttgttttaaataaggtgttaagtgttttagaatgaggtaaaaaaacattctcctccctttcaatccctgaacttgccttaatttgcttaatgcagaagacatctggaggccagggttgtgcttagtcactgcttccccagctagtagagtgcagttcaagcaagaacacttaacagtggtctgcccagtcgcccttcactagtatactaaacacccacaggaaatgctgtatgggactagaacacgaacatcttaaccgtcagccagtaccacacatgctctgctacatatagggtattttcacatctcaagtgaactgacaggaatccctgggtgtttaaagacttaaggaggtcaagtaatctttgtaaagctaaaggagtagttgggtcttagactccacttcatataaacttagagctagcaaacaaacattttctgttttggacaaacagctaatgatttggtttttgcaggcccctggctatcagtttgaactctttgctattgtagtgtcagcatgtcagagtgccaggaaaacacttaaaactatccatggtttgctgatcctcttctctccagtcctaaggtttcagaagtgtcatcttgtaatttcagaataaaattttataaccgatagcatgcaggaaactaatttgggacagtactgttagtagtactcatttaacttcactgtagaaatacttaacaaaaattggtgtgatcttgaggtccttttactttgttttcccaccctgttctccactccaatgcctgttctgtatgtggtttttggagcaccagccaactgtacaatagctgttataaaagtgtttattgtttaccaaaaccagtgaaccttttatcaaatgctgcttggtaacaaaatcttatcactgtttaataaaaaagaaaagaaaggaagaaagctaactgtttgtttcagtgtcattagttagactttctgcaaggtcacttaatccagacttgtttagtgcactaatcaggttatcagttgttgcatgaactccttcttgatcttgccaggcaacaaggagctgcttggctctcatcttcatgtcttcactgtcacactcaatctgcctaatatcagagtctttaatttccaggtaaggagccaaaatcttccactgctcaccaagtttgttggcaaatgactctatctgctcccctgttataggtttatctcgccgaacatctggacctagaaaatatagagatgtgcaattaaagtatctgaaataactgcaaagctgaaatgaccactgggttactagtcccctaaaactt

SEQ ID NO: 25228 - DNA, 1197 bp, Mus musculus
tcaggaagaaattactaaacagtctccaacactgcagagaaatgctttgtacatcaaatctgtaagttatatatttccttttgagattgagttccattccattgaaagggttcaaggggaaggaggtggctcattaggaaacctgcttgctgtgcaagcctgagaactggagtttggagcctcagaactcatgaagaaactggggaggcatgacttcctgtctctaatcccagggtgctggaggtggagctggctggttggagcagtgactccacatgcacagtcagtcacacatgtgctcttgcacatatacactgtaaacatgcatgtaagtacacatgcatgtaaatacacatgcatgtaagtacacatgcagatgctcaccctcactacacacagaaaagcaaagagactgtgtgccagttaatcttgtctaatctttatttttatgtgctcctgtcaaaaaccaacaaaccaacaaaacaaaacaaaacaaaaaaccaacaacaacagaaaacccttatatggcatagattaaacgaatttttctcatttctctccttagtctaagatcagccggctacctgcttacttaactattcaaatggttcgatttttttataaagagaaagaatctgtgaacgccaaagttcttaaggttagtaatgaattttagtctgtatattaaatataatcctgaaggcaattcctaacctgtaatagatgtatttatcttattagggatagctttgcgatgcttagaggtgattacattagacagtgattcttagcccacaatttataaggattatgtattatccattttgttttacacatgcctggcttctttctccagtctcaaacagctaagcctttgacccacctttttatatttttcaaaagactcacagataatcattaattcttatactcctcagaaatcctgcctgagattagattggaaatgaggacagctgcagtaagcacattgcaattgcatttaagccccacagagcttcaactgtgtagcttagctgtatgtatacagtcttcctttggaagaggtgtatgaatctagcctctggagctgaaattcataacattttctggtagttacaggtgaaggttaaataaagcttggtctttattttttatttattgtaattattttaatattgctctttaactgtttcagtg

SEQ ID NO: 25229 - DNA, 1208 bp, Mus musculus
aatctagtgttctgttgcagtaggagcaatattttaaaaaattgtttctcaatgtttatggctagtgtataaaatataattgattttcaattttattcttattctgtgatcttaattcacataatattccagtaatgtttttggagattgcattgtctttgcatcttcaaataatgaatttgctcttccccttttagttattgtgacttttattgagatataattgctaaaccaaataacttctgttttgtttttttttccttgaattcttagtagaatttctagtatactactgaatagaaaatagagagtggagattttctcttgaatcactaacatttaaaattatgaacaactgttaaatgtcgttaagtcctttttctgttacttgttaaaatgatcatctgattttattttatttttatactttgttcagtgtcattgttacctgtcaccatcctctgtccttggtactggggatggaactttgggtctagtgcatgctaggcaagctctttaacactgagaaggtacacaccaagtgtgctctcactgattctcaacccatccctaacacctgatactttgctatgttgtttaggctggttctgaactcctgggctcaggcagtcttgcttcagcctcaaaaaatgaaaaatgtgtatctggtgggtatggttggtatacttgccttgaatcccagcactctggaggcagagataagtagatctctgggaggtccaggtcagccagggatacttaataagactccatgtcaaagaaaaaaaatgcaactaaccccaaaggggatcttgtatgtggactttacccattgatatttatcatatggagatattaaaactgagatatttagggggctggagagatggctcagcggttaagagcaccgactgctcttccaaaggtcctgagttcaaatcccagcaaccacatggtggctcacaaccatccataacaagatctgacgccctcttctggagtgtctgaagacagctacagtgtaacttatatataataaatacatctttaaaaaaaactgagatatttaaaaatattattcattgatttaaaataattacaaagaaagttggcaattgactttgtgggtaagggtgcttgcagctaagcctggggtcctgagttcaatccctgaaacccatagggtagaaggagagacctggcctctg

SEQ ID NO: 25230 - DNA, 1175 bp, Mus musculus
cagctttcacagctggctgcaccagaccactgatatctcaaaatgaaagcacttttttctgttaacaagagacgggatgccggggacaggggaatgagaagctgccagggaacctgcggtgcaggctcctgggagcagcaaacactggcagggacgggggaaggcgtcagaggcagcgactcaaccacttgacggacgcctggtgctcgctgcactgtctgcccgcctggcttgcccttggaggcggcggtggtggcagcgagggagggagcagccaggcgggcacaagggacgtgcgggcaagcacccatgtgcagactctgaggggcagcggctgtagtcagcccctcctcagctgtggcaggcattgtggctgctctagggagctaggcgggaccagtgcgggccacggcgggccttgcccctcttcttctctctctctctctctttttttttttttttttttttttttttttttttttttgcccgcctgcgggcagcgaagtatgtggcggtggtgggcatcccggggaaacctctgtgttggtgttccccccgccccgggcctcaatttttttccgcggcgcctcgcctcggccgcccacactcgccattagcgtctcacaactcgctcgcagggcacagatggcctctgttgccgctgagcctgcagaacccagaaccgcagcaccactgctgctgccaaggtcctaactgctccgccaaagccagaagttcttagtccggctctgcggctgcatcccagaactcttctgagcagcccggggctcatgcaggggagcaggtccgtccacgggaaaacagcgctgagttgttttttcttaactatcactgacaaattctgtcccaacgttagtccaagtctacagtcagagacaaagggttgacacacacacagtctgtcccatgacaaaaaccacaacagaaacaagacagcaacagtggaaaaaaaaaagacaccagtatatctaagcacactcgtccgcatctggacatatacaaccagccaaacgctatttcctgacggggtcggattccacatcgactccctttctgacggggtaggattccacatccactcccgctctggcagagagaacactctcttccttcactctgccaggcaacagccaggtcctcttgactgttccata

SEQ ID NO: 25231 - DNA, 2030 bp, Mus musculus
tgtgttggaatcatgtgggatgctacctgataaaccgagctgtttaaccatgtggaacagacaggctgtttcttttgacacaaataccacaggcttttcagggttaagattgctgttattctgtccttgttttggcacaaaaagcacactgaggattgtcttttttttctgttgtttttttttttttttttccttgcgggtttgcctacaggtagattagattaattattactatgtaatgcaagtacagttggggaaagctttgctagatattttttttaaggtgctgccttttaaatttattagaaaatgcctgtcagtcatgatagaaccgttttcctcgtatgaacaagaggaaggaactttcactttcagtggaatggccatcactatcaagatcagatcgtggaaggagtaaagaaaatatctcaaaatgagacaagtttttctgttttgttttgtttttttaataactaagttttttgtgctcttgcaaaactattcagaactgttttaagaacacagtgatgtcactttaagctcagtgtccttactgtagaattaaaagccttactgtcgattgcccacagtgggctctgtggagaaattaaatatcttacattatgctttacaaaatattgtatatgtttcagcaactttgtagattgggaactgggagaagaggaaagaattacatttaatctatgcatttttgccaagccatattgagttattttactactagagacataactaactgtacaagagaaccaagtttaaaagcattttgtgggatacatcatttctgtaattatataatgtatttctttgtggttttaagtgaaaagacattaagttaacaaacatataaaaatgtatgcactgtttgaaatgtaaattattcttagaatattttcagtggaagttgcattaccctattagtgccttaatttgagagaatttttttactgccataaatacagacttttcagaaaacagattttacaaaaaattatgtgtttttttcattggtaattggtttaatttaaaatatagaggtttgtcagatttttataaattgagtacaacctttgtaccaaactacctgctacaataatgaaactatctgcaaaaacatatacagttacaccagtagtaaagaattatgaaatatatccatgatgttttccagttaacataggaattaccatataaatactgttcaactctcctctggtaacaagagttgatgtgtatgggcagtgtgatttattgtttatttttttaaccaaatacctcctcagtaatttataatggctttgcagtaatgtgtatcaaataagcactggaaaaccgatcttctctagggtgatatgcatgtttcaagtggtattgaaagccgcactgatggatatgtagtaataaacatatctgttattaatatgctaatgactctgtgctcatttaatgagaaataaaataatttatggatagatacttttaatattgactactatagtattttctcatggctggaatgaatagatggcatactaaaaattattcagtgattgtatacaaatgtttgctaaattttgtgaatagattaaaattattttttaaagataaaacttgacttgggctctaaaacaagaggtactattgttcaagtaaaagatagctaatctttgttggaaaacaattccccatgggtctgttgcaggtctgtacatcttgtgagcagaggctgtgataatttacatttgggccatcacagatacaacacaaccacccacagccttaaaagataaaatgtgtcccttcagaggtccctttactgccagtgtctctctgcatggttaaagtcaggcagtttgcttaagcttatttaaaaattcagattccagtgctgaagagatgattggttgaaaccacatttgcctttcttccaacaggacccagttcagttctcagcattcaatgtctcaacaactaactccaagggatctaagaccctcttctggtctctt

SEQ ID NO: 25232 - DNA, 1274 bp, Mus musculus
gacttcacatacttaacctagtctcaaatctgatatgagttatagatagatagataactactaattctccttttttcagtcaagagaacacaggatcaaaaaggttatgtcatttgtcttctctattgagaagtacaagtgtataagtgtatttttctttggaatgtaattgtttgatttttttttagcttaaaaaaattgtgacctatttgaaattcatcactttattagtattatccaaagtctttgttccctgtagtactagtcattacatacactacataaacagaaagagcaatactttgtaatgaagacattttaggattacctgactctgttttctgctatatcatatagcaagatacagtctcagtataaactttcccttggttgtatggattactacaccatcacattgcccaacacttgcttacatatctaaatgtctagttttgaaaactaaaaaccttctatttgtctttagctgtttgttgtcctagaaagtgtgttaagaaagtagccctgtatacttacctggcaggggagataccatgatcacgaaggtggttttcccagggcgaggcttatccattgcactccggatgtgctgacccctgcgatttccccaaatgcgggaaactcgactgcataatttgtggtagtgggggactgcgttcccgctctcccctggaaaaaaaaaaaaaaaaaaaaaagaaaaaagaaagtagccctgtgaacacctagtatgtttttataattaactatgtatacagcttgcatatgtgattatgtgtgatttagtttaaactttatgcttcattaaatattatttagcgccaggcggtggtggtgcacgcctttaatcccagcacttgggaggcagaggcaggcagatttctaaattcgaggccagcctggtctataaagtgagttccaggcagggctacacagagaaaccctgtctcgaaaaacaaaacaaaagtattatttagctgttatactgtaaaacacttatagtcacaaatgtaggattttgctgaacacctgaggaatgaagataaatttagaagtaagggtaagtggaatgtaaaatattatatccttgtaaagtgagtatatgaatcataatcacatgaaatcagcctggtaattttcctgctccacaggaagatttagaaagttaaaaaaatgcatatatgaaataaaaatcatagaactttgctcttccctattatttatgtaatcttgtaaagggtattaaatgaacacaagat

SEQ ID NO: 25233 - DNA, 1224 bp, Mus musculus
ctgtttagctttgttgcctgtagttctttaaggactaatacctgtttagcagtgttctcctgtaattccttgagggatttttgtgtttcctctttaaaggcttctacttgtttagcagtattctcctgtaataccttgagggattttcgtgcttcctctttaagggcttctacctctttagcactgttctcctgtatttctttaagtgagttattaatgcccttctttaaatcttctaccaccatcatgagataggattttaaatccgggtcttgcttttcgggtgtgctggggtgtccaggactcgttgtggtgggcgtactgggttatgatgatgcccagtgttcttggtttctgttagtaagattcttaagtttgcctttcgccatcaggaaatcactggtgttaatgatcaagctgtctccggttggagcttgatcctcctgtgattctcttagtttctgtcagcactcctgggagtcaaactctcaccaaagttccagtggtcagaacactctctgcaggcaagctctcctcttgcagggcaagtgtccagcagtctggagctctgatccacgtcctgagttctggggtcagaaccctccctgtaggccgagtctcctctggcaaggaaggtgcccaggggtctgggtctcagctctgcagcctggctgaggatgaagacctgaggggaccctgaccaagaaggtctattacttctatcccctacgtgctctcaggtgatcaggaggtactgggtgtgctaggggtcctgtggtgtggagagtcctttggtgccctagatgcccttggctgggctcacgcagaagatggctgggctggccctgacctgaatggatcccagactctggtcgggcggggttcctttgtccctgctactgtgggcacaagaccctccgccattctttggagctgatgttgtgttccactcacccatgatcccaaggtctcgtgatcccgaggtaatccggaggtcctgcagagtgaagagcactctcatcattctttttatatgttattggtctacatttgtgaatactttatagtcatatccatgaaatatactggtttgtagctttctgcttcatctgactttgatatcaggttattactggttacacaaaatgagttaaacgtactcttcttcctgttttctagaagagattgtgtaaaattggtgttaattcttagaaggttttgtag

SEQ ID NO: 25234 - DNA, 1132 bp, Mus musculus
atttttatgtgcattaatgttttgcctgcgtgtatttcggtgagggtaccagatactctggaagacagttgtgagatgccatgtgtatgctgtaaattgaacctgggttctatggaagagcagccagtgctcttaaccactaagccatctctccagctcaaaatagggtttaaaagaagagactctggagttttgacgagcagcctgtaaaaaatgttgaagcactgaactctaaactcttaacatagggatgaaggtgaaacaatggatgtgcactggaaagacaagtaaagcgttgtttctaactgccgaggtgcatcgtggcaaagagttgggggtaagcaggagtttctctttgcctttcagcagacaagttgaaagctaagagtgaaaatcaggatatggattgggagggtttggtggggaaaggcaggctcagttttggccgaggtttaaggtggttacagacttccaagtgaaattaccaccttcacagttgtgtatgtggagctagagtttgagagaggtttgtgctgttacttgatgggttagatgagatcatccgaggcagtaaagggaaaacgagatctgtgaggaacaccagcgtctgggagtacttgcaatggcataaacaaggaaaagagatttctagaagagtgatggaaaccaaagaaacagcctcagaaacaaagagggatcccatcaccactgtcaaagcacagttgagaagggcgtctccatggtgctagaaaaagcagcacctgttagaggcagtgaccatagtcagacttcagaagagatttgtataatagctgcttagataaatttctgttactggccctcagttgtctgtcctttctgaaagtatcaagcataggaaccatgagttttgatccataccttgcctgtgtggatgatttctcaagcaagaattgaagatcacacttgataatctgtgggtgtgaactcagtgcatttaccaagagcttggacataaattcagacctactgtgaaatttattggttcttgtttgcctggcctggctgcccagttatgtggaaacacagcttcaatttactgagagttaagattgctgagtcaattactgcagtagtgatggacacatatatt

SEQ ID NO: 25235 - DNA, 1142 bp, Mus musculus
tttttacaaatgaactcaggactggcaacaaccatatggttgttccattttcataaaattggaaacaatgcagtaatagcttattattgttttgtttttttaaagaagatattttattatcttttacagaaatttatgattgtattttatctatagttatttagacatgtttacatgcagcagataattgttcatagtggactgaagattaatgcaaggactatggtctcattgataagtatattttgaagttcttaatatggaaatataccagtgtagcttggtactgtatttttttatattgatctgctgataccagttataggtttaaagattgtattttcaaaatgaaaaccagtgcttttgagttactattcaaagagggtacagtattacacacttaagaatttgaagttactaaagtgtactcttaagtataccccacagaaaaggagagctccaagtgaaaggacttgtataatagcaagtgtctccattgcttatgtttctgagactgatggtggaaaggtctctcctgtggggagccataaatgactagagtcacaaagaactacagaatagttgtaaactaaatgtggacggcttggtatctgcgttgttattcctcagaaatactgcactgagtatacgccctcattactggacttcatcttgatacttgtctgtccttcatagtgccctctacttttaaagggttatatgtcgaaaaactgctgtggccttttatgacctgtatataatgtagaataaaataataaaatacttgatagctttttctaagtgataaatgtacttgatacaatgttatattgaatgtttgtaccctttcagggagtttctttggtttgggactgaaataagattaaaacacaggcttcttaaaggtagttctcactagcttgcaatttttttgaatattttaatattaatttaaaagaaccacagtacaagagtgaagcgccactgtggtttcagttagatcatctttatgggctgaaatgatcatatctccactgaaaacctattagaatttatgattagcagtcgggtgtacattttaccccagcccgtagatttgttcttttattatttatggagtggtgtcacactgtactccttcg

SEQ ID NO: 25236 - DNA, 2162 bp, Mus musculus
taatttttcagaaatggcagcacaaaaggaaatctatattaatagagtactttactaagcgaaggagattaaatagaagccacaaaccaacaaacttggcaagcaaggaaagaaacctgttagccataagacatgttacaaattcatcaacatccagtagctgtagacttcagaagaaaaaacttttcagaaattttgtcaaagcagacaggtcagtgataaataactcctctagtaatagggttaggccggaaactaatcataattaaaacaaattggatctgaatgaagtttattttcattaaaaaaataaaaacttctgaaaacattaaattagaattttctgcagattttcatttccctatccagcagaaagcaagtatctttcaacattcatgccagcttttctcatgtcttagaaattgccaagagcaaaattacttgaaacaacctggtatttttgttggaaatgtacatcagtataagttaaagttgatttttaagatctactccttagtgacaatactaagtacttagcatctgtacctacctggacacagtcctcaaaaactcctcagaaagaaagacattactcaggaataatgtccattcaggagaaatcaaaagaaaattcctccatagttactaaagaaagtgaagatgagaatttagaagaagaagttgaaagttctcagaacagtccaacaaagaagtcaggctccaaggaagctgtaaagacaccagttagattttccaacaaaagtaaaacaaatgagtctgaatttggaatgcgaatgagtacaaggtcagcatcatgttcagctgataaaactgctactaactcctttaataaaaatacagtaactttgaagggacaatcacaagaatcttcaaaaacgaagaaattatgtcaggaaaaattatcacttggaatcttgaaagggaatgaacagcttcaccgcagatcacaaagactacagcagttaacagagtgtacaaccaggtctttgcgcagtagagagattcatggtcaaattcaaacagttaaacagaatcagcaatcagcaagaagagaacaatgtaacagtactcaaagtaaatgtaataaggttaaggtaaatcaaaagcatgtgaaaagaaaagtgcttgaaatcaagtctgattgtaaggaggacaggcattcagttacaaatgaagtaataaattctcccaaaggaaagaagcgcaaagtacagcatcagacaacttctacttgtagttctcagtgcaaccaagggtctgaaaaatgtctccagaagactagtagaaaagaagaaataaaacctgtgcctgtaactgctgatattagaaaattaaaagcagctacttcagtggtctctaaaaagaatgaactgaggaaatcagctcatacacaagtgagtactagcacaaaacgcccccaaatcccactgccactagtgcctgaacacagtgatgaccaggaattggagcaagctggaaagagcaaaagaggtagcattctccaactctgtgaagaaattgctggtgaaattgaatcagatactgtagaggtaaaaaaggaatcatcatgtgtggaaagtgtaaaggaggagaagcctgcagaggtaaaactgcaagggaccgatgctgaaagacaaatactccatcataaagaagccaaccaggatgtgcgctctaatcggttctttcccagtaggaaaacaaagcctgtgaaatgcgtactaaatggaataaatagctcaactaagaagaactccaactggactaaaattaagctttcaaaatttaactctgtgcagcaacataaattggactctcaagtgtctcctaagttgaacttattacaaactggtttgtcaacatcagttttagaaatgcctcatccagtgtcccaaagtacatttttagagatgaaagcgcatggtaatgtaacttgccaacgggataaaatgaaaggaattaaatctgaagaagttaaaattaataatattgcaattgaaattaataaagccacaaaaagggatcctggaaattgtaatttggataaccatattaaaccctctcctgactcatcattggataatcagatgaaactttcttgtgagtcagcaccagatcaggtaatcatccttatcacgtgt

SEQ ID NO: 25237 - DNA, 1138 bp, Mus musculus
tttttgagacagggtttctctgtgtagccctggctgtcctggaactcactctgtagaccaggctggccttgaactcagaaatccacctgcctctgcctcctaagtgctgggattaaaggcgtgtgccaccactgcccagctttgctttcttacagaacccaggaccaccagcccagggatgaatcaacccacaatgggccataacccccatccctcattggtcactgattgacaaagtgcctaacttacagctggatctcatggaggcattttcctcaactgagggaccttctctgacacctctagctagtgtcaagttgatatataaaaccatctagtataacctaactagcaaggtagtgattgcacaagcatgaatgcagttgcatactgcagtaactgccttttttcatccattaattgtgtttgaaattacaggtgagcagaatggcaacaggaatcctggtggattgcagattggtgacctggtaaatatagaccttgatctagaaattgtccagtctttacagcacggtcatggaggatggaccgatggcatgtttgagactttaactacaactggaaccgtctgtggcattgatgaagatcatgacattgtagtacagtatccaagtggcaataggttggtactgtttcctgggttttgatgacaaagttaacacacagagataagagccttaaagaaagcaagtactatgctgaaactcagagtttattgaatttagttcttagacgcttgataacaaattcagagcatgtgggtaaagcagtgagggacgtgtatgtgtgtgatcacatatttataataaaacctttttatatttaaaatgtggcacggtagcttacacttataatctcagcactgaggatattgaaataggaggattattgcaatttcaaagccagtgtggtggtttgaatgagaaatgtcctccataggctcagaatttgaacatttggtccccatttggtggtgatgttaggaggtagcaccttgctggcagaagcacttgagtggtggcaggctttgagagttcatagctccctacttccagcttgctctgcttcctttgtgtggttgaagttgagatctctcagcttcctgttgcagctgcct

SEQ ID NO: 25238 - DNA, 1183 bp, Mus musculus
taacgttattttgttactatttcataactgattttgctactattatgaatcataatacaaatatcagatatacaggatatctgatatgcaactctcaaaggggttgtgacccataggttgagaatccctgaattataattgatagggagtttggctaggatagaatgataaatatatacgtgtgatcaggaaactttcttaaactgctctgaagtaaccaactctgtgtgcagtgaggtacatacagtgatgttctttatgtatgctatgtactggtaaacatcaaaagttaataaaaaaaattcagaatgtaatttcatagggttgctttattattttgaagtagtacagagtttttctcccagcagtgtttaaagatatattgagtgaattcacttgttctgagcctgagttctgtttttgtagatggactttcaatcctgctgttctcactaaggcaaacattgtccgaagtggggatgctgcacagggtgcagaaggaggcacctcacagtttcaagtgggtgatcttgtgcaagtttgttatgatctggaaagaattaaacttctccaaagaggacatggtgaatgggctgaagcaatgcttccagtaagtatatgtaaatagtttggaaaaaaatactatactgtgcttgtaaaattaattagctaattaattaaagcaaattaattttagaaacaattggaattgaaagttacataaaaaaaaatcactcagaatgtaattgcaaagaaagactgtgcacagaaaactgacaaaagctaaagtcaagcaattgaaaatcagctaaaataaattaaggatatgccaagacacagaagaataaaagaacaggaatgaggtgttagaacataagaaagaattcaaaagaagaaaaaggtcatttaaaatattatgattggctgaggagatggctcagttgtaaagtacctaccaggcaagcaggaggactgattccttcaccccgaaccatgtaaaagccatgtatctgtaactccagcattggagaggggagctgcaggtcagtggagcttgctggcctgccaggccaacaaatgggtaaatgccagggtccacaagttggtggggggagggagggagggagggagggagggagggagggagggaaggagagaaagagaccttgcccctctctgagat

SEQ ID NO: 25239 - DNA, 1162 bp, Mus musculus
tgcttgtttgtggattaggtgtacccatgaatgtaaaggtcttagaacagtgtttgtcatctggtgagaactcaggttgctactgatatctgtgcacagctcaccttcctactagatttaatatacatgttatttcttaaaaagcagtttctttacacttttattttagagtaactaatactttatgtttatcagtgtttgcctatatacatgtgtgtatcccacatgtgttctggtgcttggagaggtcagatgaaggtgtttgataccttggagctagatttagtgttggttgtgagccacctgtgggtgctaggaacagaacccagatcacctgcaagagcaggtgctcttaatggttaagctatctctccagccccattattcagatatttcaaaaaggatactattaagtttgtgactaataatctatttgagtattgttacctcaaaattttaaaattagtaactaagtaaaatcaacactttaaaatacataaggtgatgattgcatttaatattacatttttcttttttaagactttaggtaaagttggccgagtacaacagatttattcggacagtgacttaaaggtggaagtctgtggaacatcttggacgtataaccctgcagcagtttccaaggtggcccctgcaggatcagccattagcaatgcatctggtggtaggtttgtcttgtttccctaaagatgatacccagatctcagactggacatggtagcacacacttttaatcccagcactcaggtagatctctgagttcaaatctagcttgatttatagtgctagttccaggccagccagggatacacagaaaaacccttatttgaaaaacagacaaacaaacaaaaagaagttctcatgcccagatggtcatgtctgtgcacttccagatagcatggactcacttggacattgagtacttactttgtaaaccttttttttatttgtttctatggctttgtttttctaggcagggtttctctgtgtagccatgtctatcctagaactcagagattcatctgtctctgcttcctgagtgctgggaataaaggcttgtgacaccactgtccagctacttttaaactttttctttttctctttttttacactttaccctttcctctatgctccttcccta

SEQ ID NO: 25240 - DNA, 1199 bp, Mus musculus
ccacacacattcagtgtgggtctgtcttcctctgttaaacctctagaaacttcctcaaagacacacccacccagaggtgtgtgtcctaggtagcttcaaatctagacaacttgactgcaaaaattaaccacaagtttgaaagataagtcttagaattatattttatatagctttttagaacaaaaaaagagacaaaacaagacaaaaagttaagactgtacagagattaggctctgtagatgctgttgtttagagctctttgatatttgtatagaggattaggaagattgttgaaacaccgtaaagatgatctaaagtgaacttaaaatttactgtgcaaggcacacgatgaaataatcagtaactcaattttccaagtgatttggttttagcaaacagtgtttacatttattgttatttaaaatttcaaataggtccagaatgctcactgctgataggctgcagtttcttataggtgtggacactatccaaatgaggcatctttctctcagcttttggtccgtgcaggtgctaagctagacattcaggataaggatggagatactcctctgcatgaagctttgagacatcatactttgtctcaactacgtcagctacaagacatgcaagatgtgggcaaggtagacgctgcctgggaaccttcaaaaaacacagtaagtaaagataatgtcctctcactactagtggaagcaagttttatatttcttctgcatctgatttgcattggacaaaacattttatcggtgatagacttgggtttatcaaactttaatactactactggttcctatgaagtgcatttgttctgcatcttatcaaaagttgtttggttctttaaaaattcagcagtacaaatggggtgcagtgagtatgtattatggttttaatttgaaatccctagtgcctgttcattctgacctgctttttatttgaccaattccacatgtattttaagagctctgctcaaatctttttcattagaatcttagtattccttgttttcttgtggttttatgttttgaggtgttggcagggattgagtcctaggcctcatgcatgctaggcaagcactctcccactttccaggtcgtttgttttcttctaattatcaagaattgtttatatcatacaaaaacaagtccataccaaggatgtgatgcctacttttgctgtgtggc

SEQ ID NO: 25241 - DNA, 1209 bp, Mus musculus
ggataaatatatgtaaagacagatatgctaactcatgattgtaatccctcacttaggctaaggcaggatttgtaaccaaattgtgctaaaatagtgagttcttggcccacctaggctggagtgagaccctgtctcaaacaaaatcacaaaagcatctctgtacacaattacatttcctatggtttccagacactggaagtatactgtatcctccaagtgtagagaagaatcggaagtgtaggtatgccagttgtgtgtataatggctggtgtgatgtctgcacctcctgccttcctgaggagagaaggtccagaatggatagttggtcctttttgccttcccaaaaaactttttattcttataaagctgtaagagatggggctccatttgatctagtgtttaccctcaagatgtttctctaaattcagatgagcctacaagtctaaaatcactctgttgatgttctccttgtcggtagtgccctgggatggcaggaagtgagttgtgctgtacattcatgcttctttcccttatgactgtggtgttttgtgatgaggcctcagtctaccccagttatcctcaaactcttgttccttctgccttgacctttgcatggctgggatcatggtgtaagccaccatgcccgatttttgacaatgttcttagaagagcagaatgtcttaatgttgaaaaaatgtaattagttttctcttctactatgtatgccttatgtcctaagaaatctttggcaagatggtcattcaggctccttctatagatgcttatgaagctgagctgttgcatttaagttccagtgaagttttatatagtggatgttataggttgccgttcatttatcattgattggtggccaactgtcgctataccatttgttgagtagcatctttttctgcttgagtgcctgcttcctttatccaagatcaggaagctgtttatctggaggtttcctcttcatacagggattgcaggagcatcttgttcttttcgtccatgttcttttttggctgtgggattccccctcaagtgtcttagagctttgtgattcaacatttgtttatattgaaatctggaaagggaagtcctccaaatttattttaaataattgactattttaagccttctcactttcaaatgaattttattatcattttaaagagtataattgaatctgaggcccgaatgtttgtg

SEQ ID NO: 25242 - DNA, 4785 bp, Mus musculus
tgaacattctttaaactgccaacatatactaagatacaataaatagcttaatgtcagatacttagaaaaggatgctggggcatttgtggaaaagcatggaaaacacatgttgacttggttagggggctaagcattttgtctccttaaatgagtaatctttgtatctagcctaaatgtatgcacattgtttcaagattcttcactgctagattgttaaaaacaaaaacaaaaacccacctatcagttatttacaatagtgtccactgtgcgctgtgtataagcatgcactcttaaggatagtgttctttgaggatagtttcccctgcatttgaatctggctagcttgtgtctgtttttttgctatagcaacttaaagtgggagagcagtgtccagcctgctgtgctgtgctgtgctgtgctgtgctgtgctgtgctgctgctggttacttgcggcccagtgagctgagctgctcgttgtcagcaggctcagcagtcccatgtctgtgttgagctgagtaactgctttgtttctctttcgtgtttttgagatagagtctcactatgtattctaagctgacatggaacctactgtgtagctcaggctagcctcaaccttatgatcttcctgcctctgccttccaattgtggggttgtaggatggcgatcccacatatttaacaactttaaattattttggagggtacaatccttattagtttcaaattaggaatgttctattgtaaggaagcaatgaggctatttttttctaagtataatttgaagagtttttttgtttttttaaagatacatctgatgatacgatgtttacataaagagacaaactatcttcttgcagacttggaaagagtagaaatgaggatcttttcttccttgccataggctgcccacctctttctacttgtcatcaggcaaggaggggtggctgctatacagtctgccagcccgagaacctgtgtgccacagctgtatcccacttcactcctttctctgtctcccaggctgcagtgccaagtcttatcctgtaaagattctatctgttaagggatagacctcctgacagcttcatcatctccacgcagagcagagcacactagcttaggagagagaagccgtcaagtctctgtagtgctggggacttacagctttctctttgtcactgggccatttatgttatgtatagtatggacagctgcacttctcttcaggtcttcaggcatctaaaattattgtaaatttgttttgggcttacaggagatggtaagaccaggaactgaatcatgccagtgacttcctcctgcactctgaaactacctcttagtctctttacaacacttggccctttggggatctttccttctagttacccaaacctctctttcctgtgcctcagaagaattcttacttttccttagaattattattacaatgacatgcattcgtttgtttttttttaaagtattggacttgggctaagtggggggcaggaaagaaggtcagtgtcttgtgtctgtggacaacaggatagggtcctgaggcatgttagcattcctcactggtgtttcaggagagctgtcgggagcaatattagattccctctctatgcccctcggcccaccacattttctcctttattcacgaagaccgtcggctttctcactgagcacagacataacttatcaggcgctgctgccacagctgctcttgttcacatagtttaacatccttacctgtgctgtacacatgcagaattttattgggagtggggttttcaagagaatataattttatattagtgtaagaatattatactaggcaaatgtttagttatctgaattacgcttaaggtattgtaatttaataatggcaggttaaccagaagtctactgaaacgtaaaattaactggaaataattccttaaattttatatttttgaagactttagcctgaaacaaccttttactttagaatgttgaaaatgcatgctgcttaagatttgtctagttcaaaattcaaaccttgctgggtcatttttacacagggaacatcctggtagccatgtattgcctggtggatgttttttgtttattttgaattctggacacttttgggataaagaatagttaaacttgccacctaggacaaagctggatgtagcagagctggtttgggggtttggggttgcaacaaatagaaaacaaaaacagtgagctcagaggaatggagcatcatgtaggatttgccacggtattggtggggagggcgtatttaactaaaacatagaagggggtctataaggtcacttcttcatatggcttgtcagttgttttgtaaattacagactttaacacgacttgctcttttaagcccaaaaggaaaaacatttatcctttcagagtgtctggaatgtttatagtaataatttctataaaaacactcatggatacatttttggtgtttttttttttttaaattgcagtgagaaccacatatcataaggtttgtcgtcctgactgcttctaaacatgcagttcagaagggtcacttcctctccgtttgttgggaaacacgcatagaactttatcctgcacctatcaaaggcttccttcttccttccatctgggcaacagggttctgactacttagaacaccagcactcagattgctgactagagtcatttgtgtttgcaagacccaaacctgggtcaacatcaggctcctgagatttgaggaagggcacctctcccctgccataactgctattttttttacatgtatgttaattgaaagagtttattatttcgttatgagccagaggggggaagcacattttaaatatgggaaataagttagctttggttttgtactgtattgggaaggtaatagatttttcacaagtgatttgtgccttgttataaatgtcaattgtcattgagtctacttgtcaaagtcacagaatacatttttctttcaaaatggcaacctgatttagcttgtttgaatattacaataggaatgcttactgatactacttgataatcatgtatatccttttgacttacacacacaaacacacatgagacaacaggattgataattgcagttgtatgtctttaaacactaaacgtaggaagctttttaatgttgccttgtgtgtgtgtgttgctttactgcagtgagggagaaatcctttgcaccaagcttcagtggctgataagtggctagcagtgggtaaaattacaatgtaaaaataggggtggatagttaataacgttaagttgctaccttggcattttctacctccttttctacgagaatactgcttttctttcacccatctagcatcttgtcttatttgtgggagaaaaggaaacaacctgaagataaagttagattttctttttttttttttttgagaatttaagcaatagatacaggaaaagtggcctgtcacattaatttggtgcctaaatgtaaaggtttgaactgataaataaaactgtctaagaaggagagtagtgctgagtatttggactgtcctgtatagttctcttgattttatttcataaacatgacttctttcttcaaaagcaaagtggttttctaattttttatgaaataagcaaatatgccattttgtctgagtacagtttcaggaagctattgaaagttctggctcagggctttttaacagttaaagcaattgttaatatattttggaaactccatctgcataactcttcagtgccttgattaacttggcaacacttaaaaaaactttgtactaggtaaccttcagtgcaccagtcatgatatgcacgttctgatcatactgctaagcatgtgcaagaacacctctacgtgtgggtttgcataattctataagggaagtgttctacatttgcacttgatactttttttttattattattactctgtttttttacaaactgattattcaaggccatggcactgttaccagaaaaatggtgtttgctgtctatatgcaagtctatttagctgctggggagaggacagagctcacactttgtatctaatacaaaaagaagatcaatacaaaaaaaaaagatcatcttcctctcaagtggaaaccaaaccaagccaaaccctttgtttaagtggctcagttaaatgattaattgaaaggaaatcatgaattgcatgtcattcttcatgctgatctgtagactaaaagcatgtttttctgtctccttcaggatgtgtctgccattctaagtacagtatattcaaatggtagaaaaaaaagctgactcaaaggttttacgctttgtaatttttccagttctttttagctttcaatgttggaataaatttaagtcttgtttatggctaaagtttctgtatggaaaaatgattcttgcttattagcttttgtttaagaaaaaaagcttagtaaaaactaagcttttaaaaataaatgcaaacatttaccattaataaaatctgtggtgtaatatgtttttctctgactttttggaggctattctttataataacataaatgaatttttatttttaaggcatttgaaaacaaatctcaatacatccaaaaaatcctattattggaaagaaaattaccatatctttgagaaacaaggacatctctccaactcaatgtaagaagtaagcgtccacatctagaaggttcttgttgtgagtgctcacatgtcaggcaggagcctgtctaagggtcagaggagcttgaatgctttagtgcctaatctt

SEQ ID NO: 25243 - DNA, 1113 bp, Mus musculus
ctgcgctctgctccattccgctcgcctcctgctttcccttgcgtctttgggtggatgttgctgttttaaattagcccttcctagctgtttgaccgtgagcgtggagaccccagtgggtactagaaatgggcacttggcctcagtggatggtggaaatggacataagcattttattggtacaccgtagatgtgtggaattctacatttccgtctcatagccaggagaggtgacaggtttctgaaagataaatataaaaggatttcttaactacattttaaaacttaactttcaggttttcttcattaggttaaatggttggttatttacatttataatgagaatacaaagtatctggaagggcagaaggtaagaatgggatctgctacattttaagaaggcagtgaaacatttccgtttacgtttccccaaattgttcacatattgattgctaatcatttggagagaactagaacaaagtaagtggagctgttcagtaagtggaagacacagcctgaacagctcaagtactgaattgaccggctaactcggctgtgggcctctgccagcgtcacactggctggactcggcctgagaaggtgagccttgttctgaagaccagtgcttgcttgctctcacctcattaccccagttccgggagttacattggatccactaaccagcttcactttctgtctggttataaagagtaaatgtaatttatagttgaaaaattttaacattattttaaattgccaaatatgttctttctcgactatttatttttgtttctgttctactgctttaattgcatttcagaggagtgaatttaggtggctcatcccacttatgtttgctgctccacacaaagatttaaatgatgagaaattattggctggacacaaattgcagaaaagtcattagaaacaatcatttaaaactttgtttgctttcttcacatattctttctcaaaccattgcttggagtgtgctatgaacttgcctttcaagaaattaaaaatgaagagatcattttagaattggttcattgtgtggttaattctttgtccttattttaatgtcctggcaccaagacaccctttctatagcaaagt

SEQ ID NO: 25244 - DNA, 1129 bp, Mus musculus
gaggaagaagggggtcttgtaatgtcagttgcaaaaggagctacaggcagcccactgatccccagtaaagtccagtgttctggctactggtgttagacaaatccttatgaactagacgccaaccacacagccccagatcctctcccagggcaataccgctcacttaaccatagtgtggatcctgttgctccccacagtagcccacgcagggaccccacttacataccttgttttccacgaatggtgacagcacctgtgtgtacacatcagactggtctaccactgcttgggttcgcactggccttttgagaggtgggttgctccggctctgccctgcttctactgcctaaagtggaacaacttgtgaccttggtcatcttccacagacatggtactcactacagttaacccaagacttaaatttctagacacaagccagacacgtgacaagcgagacaaaactcttcccatggcagacctgtgctctggcaaacactccagggtttgtgggagacctcaagtaaataaccaagccagtcacgctctttccaacctctgaagacgtataactgacctcagcttttctcactcttgaccagctgcactgtcgttcatgaagctaccagacagtaaaggagcgcagcgtgcactggatccatgttggcattttaaaattcatttttgtagcctttgaaatggatccagggcctcaccaatctctacattccgaccatcaagtcacagcctctggtcagtgtaatgggaattatttgacagtaagccagagttccccaaagatgacagagctgtgagctacaccagctgtgtgatctctaaagagcaggcacagcttcagtgcggacagcctgaccatgacatcagtctgacaaagcccagggtctgccactgggctcaaacccgctgactccacagcccaggacaccaccagaaggaccaagaggaggaaggagacagaacaaggacagaggtgatgtaagcagcctggccttcagtggcccatcagactaacttcaaagagccaagcaaagtgggttctcagcttgtttaaaacgatgtccactgttgctaagcatatccttgaagtaatttctcccactgatcccaagtt

SEQ ID NO: 25245 - DNA, 1234 bp, Mus musculus
cactgacctgacaaatccatttggggttttaggcctgttttgttttgttttgttttgttttgttttgttttaaagatattgatggggggggagggaggaggaggaggaggaggtggtggtatcagataccatgaagctggcctacaggtcggtgctgggaactggggtcctctgagcgaaggaacctctctctcttaaccaccgaaccattgctccagccccatggcctgggtgccacccttcgtttgttttcaagacagggttcactgggtagttcagactggtcttaactgtgtagcccagactggccttgaactcatgctttttctgtctcagcctcacatgtgtgggattgctgacataagacctccccatgtcaggcttgttccatcattattaatatttcttgacatgtttagcaagaacttttgttacttcatttgctaggaagcatgaaaggtctgttgattgagcatttattcatttatttatttatttatttagctaaaatctgttttccatgattccgtaggtgttttcgcaatcctgtgtttggtatggagagtgtggaattgcgactggagataagaggtacaactgtaaatattctggcccaccaaaacccctcccaaaggacggctatgacttagtgcaggtaagcgtgctgttttgagagcacccaggcacatcttatagaatcttatgaatcattatagactctataatgggaccaaggatgctggaggtgagactagagggctgaaatctgtaaagacgtttgtgtgtgtgtgtatgtatgtgagccttcacatgcaggaggtcagttggatctcctgtgaacctccacgtgggccaggaactgccatgatttccccacacgctcagtcatcactgctgagctgttgctccggcttaaatcttaacctagactccagcctgtaccccacaacacagagctgataagaggtttaaccctccaggcgctgactctgcgtctcctggcgtttcctagtgggagttactgtttagagatgaccttggtacccacatgttaagttagctttcttgttgttgctcctagatttcaacacttgctttttcttaggctttgtcactaaaaggctggcttctcaccacctcttagtgatttcgctgttccctgtaagcccgtgagttctggctacctcccagacattgctttttgttagtgtggttcttagggctgtttgggaaa

SEQ ID NO: 25246 - DNA, 1444 bp, Mus musculus
gttccatcaaggtcctaacccctacagtggagcacaggactggatttattctggcagctactgggacagaaactacttcaatttgcctgatatttattaaagtacagagaagtcaaggtgtttgctaatctaaataagtcttaagcttaagatttttaaatgtttttccttggtttctactcctctataatttgcgtttcacccaatagggcaaggcatctggtacagtggggatgacctgaaagagaagaggcagtgctgtgccacagctgcccccttggagccctgctcatggccagtgagaagctgttggctgcagctcctatccccacactgtaatactcagctctatggaattctatagtgatccaaaaatcaagttattttgaatatttttatgctataatgcttaaatattttaggtgtagctttgaaatgtttagaattcttctgtacaatgttacgtgttcaaatgtagagattatcattttacaaaaactaaattggtaagatggccttttagggaaattaatcctctcaacctcactttccttcctcctagagagggggcagaattcctgatctgaaaattctaaactggaacaggtatttattatcttagtgctcggaatttacgttcacatcttgttattagactttacagggttaacttgtaacaaaaatgccctaaaaatagattttaatcaatattatctaatgacacaccttttagcctcaacttccagtggcaaatgccacagagaaattaagctgcactcatgtattgcaaggtactggagacctactgtacagtagctttccccattcattggggcaatctcatagtatttatccaaccaaaccagactgagatacttgccctaaagagccttaggtagcttccagtaagttatgttgtcttgaagttaacaagtgttatgatgctaaataaaggctttagaatatcaaataaaaaagtgtgaatgctttcagaatttcagttgatattgtaacctagtactatccttaattatcaaaggtattcccagggccagagagagagtggcatgaagtggtcagttagcactctaacttgcttatgtatgacagtgttaaggaagtttgtatacctgctaagttactaaaacagcaatgcagttttatgcttgcaggaagtttattgatacagttcacatggtgacaaactccaccttgaatgctgaatcaaacagcatcagcatctgttaatgaagagacatgagatcgtttaaaaatcggtggtactaatcaaaaatatcctagtatttcctgctgaggccacctcttaacaacacaaggttgctgtgattaaaatcatgaccatgcaattgaaatattgcctccctctcagccccccaagatcacagtagctgaaagccacatgcctggctggcaagcgcttcat

SEQ ID NO: 25247 - DNA, 1132 bp, Mus musculus
cttaggatcaggactgtatggagagatacctgccctcttcgggctctttatcttttgctctctctgttaaggcaaatgacagagcagcccagtgcgtatgtggtagcttcagagatgtgtgcaccctgatctttgatatgtgtgaatgtttggattcgaagttgtgcatggaactgagattgctactcggctgcctgaaaggtgggctttgcaatcccaggagtccttagaactctgagagggagggagggagggagggagaagaggagtcgattcagcgttgtccatgctgtgcttctggcttgcaaactgtaggcagcagccatgaacccaggaatgttgatgacatttagaagctagaacagctggggaacaaattcccctacagagcttctggaacattcctgtccttcactgctttgacttcaagtgagctgcatttcagaactaataaagtgtggaactataggattcatttcagtgttttaaaactccaggtttgtgctagctaaagcaataatagaaagctaattatttgttggggaagcagcctcgtgctgtaagttctgtgggtttatttcctacagaggctgctcttttacttacagtgctttctgtatctgtttacgatgctgtgggtctgtgggtccctagtggataccaggaccatgacctggttggttcatgtgggtagtttgtccagtgaggtcggtctcttttcatgataaccattccccgagcttttagtgtcctagcagccaggagtcacctcatcccaagttttcataattctctgtattataaaggaagtgacctggcagtctgtgcttcctgtgggcatataactgtttccgggctttcgtcacttagagaacatgtcacatggctccacagttccatccttgtcatggtgttttgtgtcaatcaccagccaccccctgtatgtggggcattctcaatgaatcccttcttgcctgttccatcagaagttgatacttgtaaaccagatttgaaaccttaactccatgcagctgaggcagatgcctctttttaacacagctcctgtgatccttgctgagacttaggtgtgacttcgtgtgatttctcttcatggctctggacttctcatctt

SEQ ID NO: 25248 - DNA, 1155 bp, Mus musculus
cggctcggctcggctcggctcggctcggctcggctcggctcggctcggctcggctcggctgagttgtcacatgagcaagccctgttcatctactgcatcatatgagcaggctcggctgggctcggctcggctctgctctgctcgcctgagttgtcacatgggcaagccctgctcggctgctgcgtcacacgagcaggctcggctctgctcggctccgctgagttgtcacatgagctagccctgggctcagctcggcattgtgacttgcacaggtccgatgagaccgagatttcgcagacacagcagcatggttatgggcgtggcacagatgggtagggttagcgtacctcgagtgtgtgttcgagctgcttgcactggtgcttctagagtagacactcctaagatgcatttttgtttttttcggattgactgtgttaattgttaattctataaaaggtagcatgaacaggttgaatgtttatttgttgacttttaaaatcaactttcagagtgaagaaatcgaagcaatggcagccatttatggcgaggagtggtgtgtcattgatgaaaatgccaaaatattttgtattagagtcactgacttcatggatgaccccaaatggacactttgtttacaggtaacttatatatatatatagaataaatatattagaatatatatatatatatgcagctattttccagacattagaacttaatatattaaaattgatttcattgtctatttatgattccagtatgaattggtttttggattgcctttgttgattattgtcgtgattatgcaaacgtgggtatttgattagttacagatcaccctcaaatcatgcttttgttgatggttgcaatccttcttgccataattcttctaattattaaacatgtgttttgtttacagtcttgagtcacctctttttgttactctaaacaataaaagaaggtttagacctggaaaggtggggaaattaagatgaggaaattatgactgaaaattcatagagcagatacttgtttctttagagattcagttgtgtttagaataaataagatacatgaaaagattagttatggctttctgtcttattagttgtggcatattccatgactggtatattttcaaataaaggatgctaa

SEQ ID NO: 25249 - DNA, 1150 bp, Mus musculus
gtggtcacttgcagctcatctttttaaaaaaatcttcccatgcttgtttccatcatgctagcacactttgcgcttgcccaaggcagtgccatgactgcagtggctctcacgttcctgtacatgagtccagagccctgtgcaccaagggagcttctcacaggacaaagcttgcctcttctacctcacacggaggttttgttttaaacagattgctctaaagataagagagagtccatcatgcttattgaaaatgcttgaatagaaattacagtctaatgacagtgttttcatattgataaacatcaatgtgaatggattttttttagagttttatgtgacaacttttaatgattttatatcctagtcatgggcattaagtgcaaaatattactaaccttaaaatatcaaatacaaatctgtcaatatagtttttaatatttatattttcataatatagtactgttgtatatatttagtataattttaaatggtaaattgaatatttgtttattatataagaagataaactatggttagtgggcacttaggtaagaaagcatgaatcttttggaaaacattttttatattctatatacttttttttgctaggaatctgagatttaaaaataaagatgaagagctaggtgtgatgttatacacctttgacccaccacttggaaggcagaggtgtataaagctttgtgtgttcaaggttagtccagtctacatatcaaggactgcatagtaagactgcctcaaagcaaatgaagatggagcgttgcaggatctagttcagtgtgagcactcttgcctcaagcgggtgggtactgggtttaatctccagctgtatacacagacatacaaatcaagatgaatgaggtactaagtgtggtcaccagcaacacatacatatgcacacatatagcacgacacacacaggaacacacacatatacacgtgtgcacacacacaaccttaactgtgtacttataaaatattagtagcctgtccgaagcttagttaggctgcattaaggctgttttggtcaggcttctgaaatcagcttttgaatagtatgactttcttgtgtttattttcatcacagtagaataaggatagtatctttgtgaggattaaataacatcatata

SEQ ID NO: 25250 - DNA, 2829 bp, Mus musculus
ggtcttgtacatggctgtggtgcttcattgaatgctttctcttccaggacgagtcaactaagaatttggggaaaaagaaggtgaagaaagacaagaagaagaatgatcattaagacgtgaacctgtgtgagaggttaacttcccagccactgtggacacgttcccagtggtcatgagtacattaagatagcacactgacagctcaagtcagccagttcatcatggttccaccagcattgtgtttcctcctctggttccaccatttgccagaactagagaatctagaacatattcacatgtgtttcacatttatttggaagaacagctgtgagcttacttaccatttcatataatactaggaagtgacacatgcacagtgttttcctgagctaaatgtcaatttcagtattgtcgcgtgcctttgttaggcagggaagacgtgtctccagaggaatagaaaggccacatgtcttgcgatagaaattgccatgctgttaagtgagcattgctttttcagctcccagttgctttcagagtgggggcgcatggaagacggaggtcttggggagtctttctcttgtgatttcacaagtgagtcacgcttccttccatagtattcatcatggagtgatagtttacgtgaaaacccgagtattcatctgtgatcatgtgccaaagtgatagtttacacatttgctagtccaagtgttactcctcagttgtttcaaattggtgattgtggaatttcaaaaagttactatttcttagttgttgccttttgttgtttgattcctgtagtgacacacagtgaccattcagtctcagtagtccttcccagtagtccttccgtcccatcccttacgtgtgttgaggtaacattccggtgtctctgaacgacctggaagcacttccctgtgctcttccctgtgctctggtcaactcacttgcagaacgagatagaggcagcaggacaccagaggagcaggctgcccactgcaccagtttgatatacatttgccatttgaactctggccagattttttttttttttagttctgtgattttttttttttttttttttttgaggagagatagagggacaaatcttttgattagattaaaaaaaaaacctctttccctgcggaagtttttgtctaatctccttttttaaacacgtgtttaatttattttttacatgcatattacttgtaagaaataagacaaaaattccctttgtgtaggtaagctgtacctgttatctttcagaaataatgccaacaatgactaaattgatcaacggatcgcagactagtttgattcccctcccgaggaagaggcagccttgggagagtgctggagcacacatagacagcgtctgaggttgtgcaggttttttctcttagtttgtaagcttgaaagatccacatcctcacttggtattttaaataggaatccagtagccagctttacactagagtgggttctgagacagaagtcttattttcaacattatttaatgttgtaaattatcaagagttataggatgacctatatgtgtgtttggaacacttacctctgtttccatgaaatgctaagtatatcctatgtattaattgttacagagcttagacagtatttgctaaagataatgatataatcttgacatttcagacctgtgaaaagagattaaaacactaagaattttatgctgcagaaaaaaggagcataaaatattttcctagcacactggattagaatttctttcctggagttttgtctaaaatgtattagtgtttacagaagaaaagacaattttttatatctctgatctcattttccttcacttaaaaattacgtttccccattttacaagattgctaacctcattttgtgggttgagctccttaaccttcgctgcaggtgggaggggagaccccagttcctcacttctaactcctgaaattgcgtatttcacatgccattagtgcaaagtaatgatagcatagttttctctattgaagtagagaaaatcatatgtagagaattttctagttctcccaattataactttgtaaagccaggcgtctgctgtggccttctctatattttattagttgacatgttctccacatgccagtatctatgagcaaatggcatccacgtagacgggcagagcagaagctgctagtgaggtgtctgtcagagacaggctgttggaaggaagcactgatacaggacagataaagcagatactgtttacagggcaggtgagtgatactgtaatcacttcagtgaattgtaatcacatccagtccactaaagagatgaccataaatggtgtatacagtttttattttttattatgcatgattttgtatatatggctatttttctttccgtaaaaatggtattaaaccgtatatactgttttgtatcctacatatttcatatagaagtatattgttaacattttcccatatcaataaatattcttctatggcttaacttcttatggctacattgcattctgtcttctgggtacattgtaacaaacccattcctccagtatttttcagcaaggctttttcaggtttttaagtttttgtttgttgtttgttttgtttttttgagacaaggtttctctatgtaccctgggctgtcctggaacttgctctgtaaaccaggtgggccttgaacttagagatcttcctgcctctactaactgagtgctgcgagtaagccagagttttaactcttagaagcaaatgtaaagtgttgtttcattgcataaaggttttcatatgtctctctgactgtaaggaaaacata

SEQ ID NO: 25251 - DNA, 1195 bp, Mus musculus
tgtagttcttcctgtactttcacctcagagttccttaatcccctactggaggacattctcacccactgcctttgggttgtttttttgtttgtttgttttgttttcgggtggggtgatgttgttggttggttggttggttggttggttattgttggttggttagctggttgttggttggttgtttggttttgttggtttgaggcctctgtctcaccaaatggtacaggctgcacttgaacttgcaattcctctgccttgtccaagtgctggaattacaggtacaaactgcgttcccagctcagcaatcatttcttaaagcccagcttggatttcaattatttgaacatagcttgtttgtttcctttactttcttcttgcttacatctatggacttgtgctacttgctaagtctgtgacagttcacccattatcttaagaactcgttcataaacttatccatttgcttaaaagaatgctctgtaaaccaggctggcctgcagctgaaagcagtgcatcaccacgcctggtagggcgattattcttaagccttgctccactgcgacatgagcatacactggtactgccccttgctctactgcgacatgggcatacactggtactgccccccatgcgtccctcaagtgctgttcacttgtttttcccatgtgaattacttaccttgatctgtgtttatgtccattgtccgttgactctgtcatatgtgtcacgctgctaagcccacacagtgcttcattatcatttcttcagcaccctttgtggtgctgctttccctctgttgagatttctgagctcccatttacaagacgtgtcctgcctttcctgtcaatcagcacagtcttgatgcttgctttaaaatcacgggatgcaaatccatttgaattattgccctgaaaatgaatcacattttccattttcctactttgtcccataattttatattgtatcttggacgtaatgaatgagtgttctggattttgttaatttccttcaaagagaactgatatttttaatttaacagcttggctttactcaggctggaaacagtctctaagattgcaatttgaatgttgcgataccatataaaatctttcctgagtgcaatcagttctgcactcaggggtcagacagggttgtgggggaagtttatatgcagtttactgtttaccacaccact

SEQ ID NO: 25252 - DNA, 1198 bp, Mus musculus
tgtgccttctgcctaattgtatttattttgttcctaaaatgcccctgccctggtggatggtgctgcctttcaaatcagtatatttacatgccctcaaagacccaatctctgattgcagagtatttttaagtgaaaatgtatttagggttttttttttgttttgttctgttctgttctgtttaattctgtgaccttctagctgactaggaagcaaacacatcacaggagaacatgagggaaatcgtagagaatgagggcacaaatctctggaaagcagaactgtgtttattagcagccttccaggtggactgtcctgaagtcacattggttgtcatttgatgatcctttgcttcctttggagaaactgaggaccaatttcggtgaaggaggtggccttgtgctgatggagaacaggtgacttgatttctctcacacactaggagcttgcaccaggctcagcttaagttaccagaaaaggggtcatgagggatgcagagcagaccagcttcttatagttaacaaaatagggaaaatgcaatcattagtcgaacaagcccgcctctgttaacccttatgaaacacccatcctattagtcaactaatatcttcaaacaaatactaatatataggttaaatcaataggcctgtattataaagtagaaggtacggttgatttcataaattcatgccgtattcacttgattgttgtagtgctcgtgcttaaaagcagggcctcctgcatgtcaggcacaggcgtggtcactgagtcccagctgcagcttcagtgataatctttgaatatatggggctgtctttgcaacaagaacctaattccactgatcacctggttacattttcctgtcgtagtagctaaaggagatgtggagcatttcaaagctgttatcgagagatcgcaggcagaggaatctttgtgtctatgtggggaaaagattttaactgtattttgtattaaacctataccagaaacaaaaagaagaaaacagatgcacatcacagcagagtgctcttctgagactttggtgggtgatacattcatgtggcactacctctctctttacaaaaataacgattttcagtgtttttatgcatggccatggtgatatagtctaagacactgctgatgttaaatttgtatcaaaaatcttatttggaaaaatccaattaacttcaacatata

SEQ ID NO: 25253 - DNA, 1808 bp, Mus musculus
acacaaatgtcaagtcaacacagggtgaacattgaagacaaccactgagaaacttcaacaatagaaatctcaccctttataaagccaagcaagcacatcttttttccttcatttttgaagggaaaaattaattgttctcaaataagatttattagcatcacaggacaaagaattagctcaacaggtaaagatgcttactggcaaacctattgtcttaggtttctattgctatgataaacaccatgatcaaaaccagtttcgggctctccagctccgcgtcccgaaggtgggtcccacgcggggtcaacatgaggatcgaaaagtgttatttctgctccgggccgatctacccggggcacggaatgatgttcgtccgcaacgattgcaaggtgttccgattctgcaaatccaagtgtcataaaaactttaagaagaagagaaacccacgcaaggtcaggtggactaaagccttccggaaagcagctggcaaggagctcacggtggacaactcatttgaatttgaaaaacgtagaaatgaacctgtgaaataccagcgtgagctgtggaataaaactattgatgccatgaagagagttgaagagatcaaacagaagcgccaggccaaatttataatgaacaggttgaagaagaacaaagagctccagaaggtgcaggacatcaaggaggtcaagcagaacatccatctcatccgggctcctctcgccggcaaaggaaagcagctggaggaaaaaatggtccagcagttacaggaggatgtggacatggaggaagcttcctaacggtgctccccgcaaccagccctgagcacgctggagtggagtggagactttcggcccctaagttattcattggttccataaggtccttcagacaagggtgattcaatgtgcttcccccttcaacgttgcagcctgtaaaagcatccccttgtgggtgttaggtctcagctcagcactctgcttcactgtgttatgcgcacgcaaacagcaaagtttgtgtgtagatgaagacatgaactgtgggcataaaatggttgagccagttgtcttcctgtgtgaaatccgaatgatgtactattttccgtgcgttgggatagtctgtttattagggttattgagatggaggtcacgcaaggaactgactgttctcatgtctacctgactcttttttgttttggtctagtatgtttagtaatttctgacagttgcataatggcagcacacagcacagctgagttttgttgggccgtctgacctgcttcagccattcagcctgcagctgtgatgttggaggtgggctgggttgttaaactttgcctgaatgtccaggttgtgacatctgtccggaaagattctcctttccttcccgcccagcattgatctagaagcagaagaagaatcttggtgcctttcaaagattagggtgtggttttgttttctctccctcttcttctccctctcttcctttttttctttttctttttctttttctttttctttttcttttttccttttccttttcctcttttcttttctttcttttcttttcttttcttttcttttcttttttcttttggagacatgatctctttgtgtagttctggctgtcctgaaactcactctgtaggtcagtctgcttggcactcacaaagatcccttgcctcctgagttacgggattaaaggcgtgcaccatcgtatccagtattttttctaaaaccttaaaaagacaaccaaaaagaaactcttgcttttggaaagtagaatttatggatagaatgctaactgtt

SEQ ID NO: 25254 - DNA, 2398 bp, Mus musculus
gcttttgagatgtacctactctccctgccagcccagcccaatccaagactttcacgtgtgtgctaccgggtccagctttaaagtactaatcgtctggtgatgtgggctgtacaaaccatttgcatttgagtataatgtcaggaaaattagagtgatcgtgcataaacacttgtattttttggatggatagtcacttttctgagatgatgatatgcaaattatatttgtaattttctgtgttaaactaacttaggttaagctgttagctaattctgtttttcgaatttatctttcagggacagtatggaaattaccagcagtgaaaatgtccttacattccaatagccagtacctattagcaggcacgttgtcacagcactgcaccatggacacccccctgggaagactccttccattccagctaggtttttgggaaaacctttggctaagtggctgcttcgtcagcaagtagctgttatggtttagtttgtaaaggcttcgtagctaccgatgcacctgatttcacgtttctactctagatggcaacattggacagaaaatgcattgacgtgaggagtttgcagcggtttcagaactgtgctgcaaatggactgtcacagcctgaaaggtgtgagcagctgggtgtgtgttcgcggagcttcagggggtttcatacttttccaccgattattttgtaaggggaagggggaaatgtacactttttacagcagcaatattttgtctattatgtttatttcatgtgataaatatgcaaagcggtacactacacactgggcagaatcagaacccctgttaatgtggagtgtggtagatgctcggtgctgtggtgctctgaagacaggcgaggggaggcagaagcccaccacaggcccgctgttagttcttagaggaaactcctctctctcttatctaccagattagcaagggcgctgtgatacagttttttgagtacaaagacattttttaaaaagccttccagttttgtgcattaaaacctttttgtaaatatggtttataatactgttttcaaacgcaaggcaataattatgttgcatctgtgaactttggcaggtttgtgtaaaaggagggaagcctctcttaaaacagcaataacagaaaaggaggaagcgggatgtttttaccttgtcttgtaatcagggagctctcaccacgtcagagaggaggcagcattggtctcaccttactgttttttacattaccatgattggttcatggagcagggaggagtccacgagacttcacacgcttgtgctttaactttcttaactgggcacaagcaaagggcgccttcgtgttcctctcttcatcttagttaatgcgcgaggaaaatgctttgatggccatttctcattcgcactgaaagccgagaggtgacattttacggtttcttgtttttaagcacgacatacttaatcattatttgagactgattattttagctaaatttggggatatgccatggggcaagaaaacatgtactgagagatttctaaacacatctatttaagcatactttaaaaatatctagcccaaaggtaagttgctgtatcctcacagttgtctgcatccagggaatatgactgaatataacatatctttgtaattgaattagtttttgccacttctaactgaaaacagaacagaaggagtgccataaatgcaaagaagcaaagtgtactgttgtcaacatactgtaatcagaggaggggtttcaatgtgtctggatgagagtgtgtgtgtttaaggtcagagtatagggtgttcttcaacttggacagtagaaaataggcatcaagtgtgaaccggtgaggcgtggacagccttcttgtgactgagatgcttgtaagttctgtgccaggttctccaccactgtgtactttattgctatttaaaactgtatcaactctaacgaaagaataaattatttgtgattttaattttctcatttgtttctttaaattagatctctttgactcttactgttttgtctggagactgcactctgggtttctagtccggtacgagtagacggtatttgcattctaggacttgatcaatattctcttgccatgcccacgttaattagaattaactgttcagtaatcagcgtgttgtgtaggatgtttgttgcagaattctttctctgaaaatgaagtccgtgaagctataatcaagatgactgaattagataaatgagttgaagagacaaaattgtgctgatcccaacctggtggagatacgttatctcatttgaaatgagctcaactgacattaagaaataatttgtcttgccaacccatcttctgttgtcttattctcctttaatggaaactaaaattgcaattttaataagcag

SEQ ID NO: 25255 - DNA, 1110 bp, Mus musculus
tgatgttttcttttctcagatgtttagtgccaaagaaattgaactggaggtgagtgaaatagaaagggaaaaggacgaagcagagaagacaaagtcaaagaagtcaacctaatgccagcgtcactgggcgctgagagttccctcctgaggttttagaagaaatcaatgggttggaaccaaccattgagcttttctacgttcatcttcaagaatgtccgttgttttcaaacataagttaatgggaagattttctgtaaaattcctcagttccacgtaactctaatcgtatactgtagagcttgaatagaatagtactgttgcttttcttcatacaagcaaattctagggggaaagaagatgatttttaaagttagtaatgttttgaagtttgtctcttctctgttagttaaggagctagtcatctcagagtaaacagaaccctgagcggcatttcttggtgaatggtaaggacatcaatgtgttggtgaggtgtcaacaatttgataaaatctgtatgtgctgactccataggctaaagcagaaggattgtaagttaggcattgtgatagatgctaaaaaaaatatagggacaaaaataagctcagattattggtttttcttttttaacataggatctcatgtagcccgcactggccttgaaaaccctctgtagccagaggatgaccttgaactcctgatttttttatcttcacttttcaatgggtaactcgtctgtccccccatgcccagctagacttagcttttgtccttattactatatagcaggaagatggacattaagttacaatcattttcatttgggattaatgtagtgaaattctttatgtctgccttctattctaatttagaggctccaatagagctttaaggctgggttccagatcatactcatctttgttcttgcagcttgcctatggtgtgacttaataaatgtttataaagttggtaacttatagagtgtctccttcaaagggcagatcattgggtagagtaagggtagagtaattgtctagctacttgtgaagaactcaatttgttcatctctttggcacatgatggaagaccacacagttagtgaaaaaaatatag

SEQ ID NO: 25256 - DNA, 1099 bp, Mus musculus
ctgctaggagtattggggaaattgtagacactctctgaaatggaacctagtgtaggaattctgccactgaggatgggtccttgcacgtaccttgtctctttctttccacttgtcgtttgtgtctgatgacaggggaacaggtctccacacagccttttgccagcatgatgttctgcctcacagcagtcttaggaatgtggagtcaagtcatcatctatagatgaactccctgaagctgtgagtcaaaacaaaccgttttcccttaaattcctcctgctgggctctgtcacagtggcaagtacccaatatgcagcccatgctcacgacttccacgttgctgcacattttcaccttatgcatggggttagcacgtgtaagagagtacttgcattccccccaacctaatactacccaactaatgtgtttgtaaaatatgtttgaataggcttgctgactgactactgcccactagaattgtaacctttgtgtcattgtatttgctggtattaaggccagtgcctggaatagtgccccgtacataggagatatttagtaaacctcagtgaatactataaatccattcatgtaaagcttgaacatccaaaatcagataccagttctttccagtcttattaattaaaaagtaatgtagctgggtgtaggtgagtctctcagagtttaaagtcatcttggtgtacaagatcggtgcctgcacaatcatagctgcattgtgaggcacactgtctcaaaacaaacaacaacaaaaatataagtacttgctaagatttgtttcctcattatacctcaaaactgaatctgttaaaaatgagaagaacagtggaaagaagtttttgttttttaataagttctccaagtgagtgatagatgtgatggttaagcttgattgccatcttaactggatcaggaaataactattaagcagttttctcggagtatctttggaagtgtacagagacagttccataggagctgaaggggcctttgttcctgtgagtggcacatccaccagactgtgaacttgcatagagccacatgtggaagaaggcagggcctgcaaagagccacacatggaagacgg

SEQ ID NO: 25257 - DNA, 1197 bp, Mus musculus
ggcaggagcctattcagaggccatggaggggtgcttcttactcgcttgcttcccatgacttgctcagcctgcttcctcataggacccaggaccaccagcccagggatagaaccacccacaacaggccaggcctcccccattggttattaataacaaaaatgtcttccagctatatcttaagaagtcatttcctcaactaaggctccttcttctctgatgactacctccagtagagaaggatatgcggataatagtgtactccaggagcactgactaggcagaatggctaaaagggaacatcttaggagctcggagtctagcctgcttcaacttgatctaatggcaagtcttctgtccagcctttacctccaccacctcatctttttctttcctctcctcccacctagccctccagaccaaagtagccatttgccatctccccagttctccaggggaacagatgtcatttgcatcctgatttgcaaacactgggttaatacttaaacattcattgggggctctttgtgtactttctcattattctgcattttcttgtctgtactgatagttttacttttcaaggtcatcctgaagtcttgttatctcggccagctctctgcagaatgtaatgtcccatctcatgaaacaaggaaaacatgtataaaaaactctcctagaaatccaaatggtagcagtgtcatcccaagatctggtgctttgctctggataaactgatgattttgcttgtttcattttatcataaatgtagtttggactagaatattggtaaatgtgtgtgtatatatttatataaataaatataaattgtgtatgtgtgatcttttgactgtatcttcattgcagaaaatttgaaatacttatttttagttacatggttgtctgtgcctctgcatgagcatgcacatgggaatgcatgagctcccgaggcaccagaccccctggagtgggtgtcacaaatgactgggcgccatcagagaacgaggctggaggcagaacttggatcctctagaagagcagtaggcaattataaacaccaaaccttctctccagctctagaaattttttatatgaaacaatgttaacagcatatcagaagtaatgtgtcagggtttaagacatattggtatgctatgacatgcaattgataggaaactcagtgctcttttggtaagttta

SEQ ID NO: 25258 - DNA, 1131 bp, Mus musculus
attttagaaatagaatggtagtaaaaatggatattcataattattctttttaagccaaggagatggcttaataggtaactaactatacctgcagtcaaacctgatgcccttagtttaattccctggattcgcatgatgggaggggagaacctactcctgcagtttgtcctctcatttccacaggagcactagagcatacccctcctctaatgaatgaatgagcaaacaaatataatttttaaaatcgcatggcttaatactgacaagttgactcaaaaggaaaaggtctgataggtacagtgagtggtgacaagaacagagcaaggttttccgatttcttgaaaggtgagcatctaaatcttctaacacttagcttttgtttttgaatcagcgctggaattgtgctctggccttttctaacttttaacttaaagaactatgacatggatacagacaaatggtaaaagtattgtgtccctgttagcagtttaccataggtgcttatggttaaactggaaattagtatggtctagaaaaaaatgcagaaacgtctgtatggggtggtctgtgagcttgtcagaatactgtctgctcttgagtgcttcattgttagtgctcttatgctacattaagtgtttagggtaaggttctcctcagggctcatggtgtttatatgtagcatttaagaacttgacattgtagttttttctttaaaaatgtattcattaaagttagcttaatggtaaacttatgctgacagagttgcttgctttaaattacatagttttaaatgattttttgtgaactatttggatcccagaagcatttcttgaaatcctgtgtttatctttctttctttctttcttttttttttttttttttttttttttggttttttttttggttttttgagacagggtttctctgtgtagccctggctgtcctggaactcactctgtagaccaggctggcctcgaactcagaaatccgcctgcccggcttgtctatttttttttttttccagaaagtaaaattcactttatttttaagaggtaatgtaatttaataataatgtcaaaaagtcaactaacattaatgccgtaaggttaaaatggaatgtctaataaaaca

SEQ ID NO: 25259 - DNA, 1245 bp, Mus musculus
gaggaagaaagaaggaggagaaggaagaagaggaagagaggaggagaaagagaaaactgaggaaagaatatgcagcattttacaaatgtttgcagttgctaactaaatgtggaaattattatatattgacaattatcttggtattatccatactttaaaattttacaacaaaagttcagcattgaggctaaaagaggcctttacagcccatatagagagaatatcttctgtgttgcatgggtgcatcacctgtcaattaaaaagcctatggcatacagcttaggtaggaaatagagttggggcatccagaaagcaaaaaaggattctgagagagcgtgaggctggagatttgctaaagagatgtgatgagacagatgcatagcagctgagcacaggtaactatattacctgagcaaaagtaatgggataggtgttgaaaagaaaaatggggatagtttggtttaaatgggcaaatgtattgggccatttcatttttgtttctaaatagtttcaaaaggtatagatatgttttatatgtcttggttatagattagtggctcataagttattggttatgattaaaaatttgtaacattggtaacaaaaagttggcttaaaactggtaactctgggttagagtaatttagaactacaacatgcagcatgagacaatccatggaaacaggtctctaaagatatgcctaaattgggtaattttctatgtaattcttatcctagaaacccgatttataaaagataagatttagggtagtgtctttttgaaatattggcggctataccttcttgagtttgtgtgcaggaacaggcagccaaactttgtagcaagtaatgtttttgaagttcattaaaaaaaaaaaaagattgttttcactgttaaaattgggttttgcttctcaaaattgtggttgtactctcatgttacaagataaattgaaggcttctcccaaatcacagccaccagctaaatcggctcctccaaaatctataaagcctcctgagtggcctagtccactacctcccccttatccacagcctcaaccccagctgccaagggaaccctaaacccctcggggtgtcgagaggtggacagctgtggatacatggagccacagagcacagagtccgggtggagtctggacccgcccaaactttaaacccttcagtactggtcattttcctctgctgatctttataactggaaaactaaccaccccctttctcagg

SEQ ID NO: 25260 - DNA, 1111 bp, Mus musculus
agttggtgtgtatgcatatcattgttggttttcttaagctcaatataatagcaacattattgttttggattttttggtaattattgcttcatttttgtccttagtaaagaacttttaattttcccagtgaaactatgggactctttcataatctttttgaagcaatgttcttcgtgacagaagcaatagtgtatttagaagtaggttgtggcaatctaatatagaatagcatagttacaatttccatctttaattcagggaccctggaagtgggaagtagtgatagagtttagactaagcatctcagcataataatctcaaacaatctctaggataatgccttctccagtgttttagatgatatggctagttataattgcattgttgtaaaattagttttagaagcagtttgtaattatagttattttatgaaatataggaaatgggccaagcaatttaaaattttttagaaatttacacacaagtaaacttcataccacaggacacactcccttcaatcagtgagctcagcacttaacctagatggatggatattctaggttggataattggtgcaatatagatatgtgtgattgttcactgtgtgtctgtcttgaatttatcaagttggcttacaacaattgttttcagaacaaacattgggaaaaaatgtaaacatgaactatgtatgcagtgaggtcattattacttagtgaaaaatatttctcagagttatttttaataaattatatataaaatggtcgtgtgcaggtggtgaagataatatgaactaagctactttacgcaactggtgtgggttggttacttgggtctgatgtgggtaaaagtggttttaatggggagaaccagcttgctcttcccagctactgttcagggattgtggattatctggatccacagacagacatgcagcattattaccggtacactggggattattcctgtgttgtgggcattggcgattttgcattttctctacttttatcatcttaaggtagaatataactttagcattcttatcctatatgtttaaaagacacttgaattaaaaaaaaataatgtgtgtggttgtgtcttagttagggttact

SEQ ID NO: 25261 - DNA, 1211 bp, Mus musculus
aaacagtagtatagaaagagaaggtattgtcacaaaataaaagaccaagataaaaataagacgggcttatcctgaaaagtatcaaaactgagggtgacatcagacagtttctgctatatttaaaaactactttgataacttcttttttaataattggtaacacaaatgtcatggaatgaacatgttatccacagaaatgtcatctcgtgtatcatcgaatgcccactgactggagtgtgcagtggttgttcctagcatttgatagaccacacacattagataatcaaatcaccgtgaaagctgtgtccaaccccgaccatcttctagctaatcttttgaagtctgtggacacatttttggtgagcacagaaaatggatgccaggaggagctggggagaaaaagcgtccacctgaggccacattaagacctgtctctcctctcaacagccacccattttcatcctcttgtgtctcctgtccggcaggtaccagtgtgctgctgcagcagagcgagcggaaacgcgggagaagtgagattcccttcctcatttccgacagccagggcttcagctgccccgaaaggcaggtccttcagctcactgtatgcgagtgtctgaagggcggtggctgtgtggctgcacagtatgacaactacgtcgggttgggccctgccgccatcgctctcatgattctagcactcctgctcctgctccgtaagtcttcagagcctgtgttcctagtgccttgatcggtgtcaataggtcttcagaaaggacttgccacactcatgtgccgtgtagatagaaggttattttttcataaacagtttattccaatccaagtgtgctttgcactcttctccgcccccactcttggctgctcgccttacctctggccagcacttgcggcagtcaaccctttccaaagcaccgcaatgtgccctcacaatgacaagctgtgcccagccagttctgtctgccctcctttatttctaccaaagacctggcatcccctgcagttgcactgggcacttgggcagagtaccacctccaagaccgccttggccgtctccatggaaagaggagaagcctattaaagatatttatagatgtctagttaagtgcacagaacccaacagtttacaatggacctctagcccgtcagctctgtttggttgtgactgacgtgtcttacttatagtggagacgggt

SEQ ID NO: 25262 - DNA, 2570 bp, Mus musculus
atgtgtgtgtccatgcccctaatgttataacagccacacaagacttgcacattggaaaaacttattgacatgccaaacaaagacaccatgtctcaggtagggttgtatttcagcaatgctctgtgattattgggggatggagttaagatgctagttcctcagtgccttttagagtactgtgcaagcaatactcgcaaacaggacatgtaaaattgagttccaagaacttacaaaactaaagcagggtatctaattcatcaggtccaggaggctgggtctctgcacaatgcattgatattcagcagggacagttccaccccttatattacagagccacacaggttataggtaccaaatagctcatccacccagagacacatctccactctttcatctccactggaaccctgagtacaccagagggaagaaagaaagaaagaaagagagagagagagagagagagagagagagagagagagaacactggagccctttttaactgtctaaagttgacagactttagaacactgtcaggataagaatacatagtgtgtatttctctgcacataccatgtcctgtgagctgaaaaaaaaaatgacttcatatttttcctcacttaccaaaggtcctaaaaatattgagcatttcaaattagttttataatctaactaatcatgatagccaggtgtggtggtgcaggcctttagtccagaactcaagaagcaggcaaatctctccgggttcgaggccaatctggtgtatataaagggttccaggacacccagggctacatagaaaaaccctgtctcaaaaaagcaagcaaaacaaacaacaacaaatactagtaatccaggataaaattcctagttaacttttctgcaatgtgatggcagtctatgaaggaaacgtcttcatagatctgtttcctatctacaagttcatgcacttaggggctgcacaaatgaccgagtggctaagagcacattactgactgctcttgcagagaaccctacttcagtttctgacaactacatactatggctcacaaccacctctaattccaactcaagggatctgatgctctctaatggactccaaagacattgcactcacagttgagtggttagtgagcagccgagttccactcttgcatcctcagtgcctctcacagccgccatatccccctcttgccattgaccgacttccatcctcagtgcctctcacagaaccccagccattatctatggcacaagataagttccacaaaccactcttttacaattagtcaaatatcaagaagactcagtagttcagtaattctgaattatgaactttaccatcttgatatctgacataattggctggtcatgagttgatatgcatgaagtaaatactttatcataaaaacccttgagtaactggcccaatttcattcaacttccttgccttgattctttcaagaagttgtttggattctacagaacatcaatggaaaatattacataacaaaaatttgcttctaaaaaataatgtttcaaaacctatgtatatatcagtcataatttatatccatgtatctcacccaaaaaatgttaagagccatcaaatttctggatattttgctaggaaaatgaaattctacacttattttttgtagactttttttaaatgctgtttacatgaattgtattttggaaaaaatattatactgtgcaccctgtgatgcatgaagtgattttatgtatggtctgctatgtgggcagaggtcaccttattcctatgatctggaattgtttactttctacaaagtaagctttgtggggattttgctttcattttctttgtagctgatgttattttaccaggtgtgcagcaggaattacaccactgtgtggaattataaatacatcccatgtgcaaaaaaaaacaaaaaaaacaaaaaaaaaaaaacctacaactcagtcttgcgcgccccctgggtggctttgaggctccactgctcttttgtgcagagtaccatcttccttgtttccccaaagggtgatttgcattcgtttttacatttgttccttgggaggtttgcatttgtgtgtgtatccatgtaaaatattttaataaaaaggccaccttctttcagagtaacctctctccatgtcttcctactgatattttacaaggaatgttactgtgtggtaaaaaagagcctcctggaagcagacgtttcttgggctttgttatttagtatgatctgctttgctggcccagccagcctctttcttttttttttttttcttttttgaagtgacttgaagggcagaggcggggtttctcatgccggatccgcttgcttctttcattcattcatgtattcaattcagcagaacctttttttttaaggatttattatttattatatgtaagtacactgtagctgtcttcagacactccagaagagggagtcggatctccttacggatggttgtgagccaccatgtggttgctgggatttgaacccagaaccttcagaagagcagtttggtactcttaccagctgagccatctcaccagc

SEQ ID NO: 25263 - DNA, 2095 bp, Mus musculus
acagtcattaattgactgtgtggatattgtgacttctgctcaccctccacacacgggtgaggttttcaatgaccagacaacaacaaagcccaaatagtgttcttactttgaaaatgattgattataaaaattcttgaaaaatagcctatattcacatgtaagatcttatctcccatctttaaacaaatttagaacaacatcgtctgtcaagtaaaccctaagagtgagaattctggatgtgagaaagtttgctccccttgtctaatgttgagagcttagctttcagttgtcattgtctgtcatagttttggtaatgctgatgaccacaagtcaaaccctacagtgataactaaaattcttgcaccggagaagacagatgccctgttgtgacagcaatctctccgtgtttattcttagaattgcttctaaaatatttacctcccaacctttttagctactcaaaaaagagtgaaaaaaaaatctcaacttctggagatgaagatttttgtatgttctcagtttatgttctgtctcctgtggctaatgaagtgtttaatttgaccgaatgacagcagaatgtaatgttaatgttaaggcgggtgagacagggctctttggcccctccttacagtgctgtgggaagctgtgccatgtggaattttattggaggacacacacttcataatgtggcgggctgtccacagtggggtgccttttgcattgatacttagttcacagttttaggaaaattcagaactggtcatctgccttactttcttaggttaagtctagtattaatatggcttccggaattggatgtaagtaattttgctatatcttcgtgttgcatctggaatgtcagcttgtgagaaccaccttttctaattcagacctggaattcttttcagtaatgaatagtgacctgggtatgtttccatggatgacagttttgcctagttaccatgaccacgtgacaataaatctctttcttacatattagcacaagcaggcagtctgatagaatcaaatctatttggtggctttgcactgggtgtctgtctcccatccgctgactggctaactgtggtatttaaaggcaggttttgtttttttgttttgttttttcctaaacaacttaaatcaagaaagttgaaacttatctgaaattagaaagaacaccctctgggaacttatctgttagatgtcttagtctcaaatctagtgtggtcccagctgctgggaggtccttgtgacattggggaaatgatatggtgcctttgaactaaagaaatcgtggctgatggggagaaagttcctacattcattgatttcccacattctatctgattttcaataaagttgtcatttaattatttgccaaaactagggttttaatgaggtggcttccacagccccctttttatatttattttcagttgtaggcccttgagatggctcagggtgtaaaggtgcctgcaccaagcctgacaacctgcatttgatccctgggacccacactgtagaagtagagacctccccttacacagtattctcagacttccatatgtgtaagcacacacatgtacacacacacacagcaaattaaaaagtaaaagttaaatttctgtttgtgtcttatagaaaggtgttcactaagaaaatattcatgaaatttaagtacaaaattatctattaaaaattcctatcggttagtcgtggtggcacacacctttaatcccagcactcgggaggcagaggcaggcggatctctgagttcgaggccagcctggtctacagagttagttccaggacagccaaggctacacagagaaaccctgtctcaaaaaccaaaaaaaaaaaaaaaaaaaaaaaaaagaaaaaaaaagaaaactaaaattcctatcccagctctccagatgcagaggcaggttctctgagttcaaggccagcctggtctacagaatgaattccaagacagttggggctacacagagaaaccctgtttaaaaaacacaccaaaaactcctattccaattgatactgataacccttgtaaaaggaaatggaagcattatcaatacaatattgtcccttt

SEQ ID NO: 25264 - DNA, 1097 bp, Mus musculus
ggtggtctgtgtatctttgtgtctgtgtggcatgtgtgtatgtgtgtgtatatagaggaagagacagatgtacacaatcatgcctatgttcataactagttaacttcttatttttagaatgtttcccttcttaaaatataatctaacttgtgacagtataaaattctctctctttaaggtaacctgtttttgactagtctaatttaaaataatggcttagagagtttaaagcatgcctttattataagaatgcctcagaatatattttcctcttttgaacacatttcccactgttttcccttaggtataaattacttcggtattccaaggagcggcagtacatcgatggactgaacaatttattatacacacccaaaatactggttgataggctgtatacaaatatatctgtaaacctcatgccagaattagctccaattgaagactattaaaagaagtcattctcatggtggggtagaccacagtgctggatcatgaacttggcttggagtgccctcaccgtggaagttagagattggggtgtatctcagtgtcccggtctgtaaaaagagccagcaatccttaatgtttacagcgcgggctccatccgtcacactctcccactctccccctgctgggagcgtccccccatggcaagcactgtagagataagaacccattgcttgggactggaagtgaagaaaactccctacacagagaagatttttatactgaaatctataatttaattcaagagaatgcttttatttccgttcaaacatattttgtacatatgtgatgtaaattaaatgtgttcaaattgttggaaaacaagatgtcacaattttgcatgtaattggttatgccttcattggacttttatagacatttttttatttgcatggggaaaaatgtaaatttatgtcgccaaacaaaggttaagccttgtgtcaaatgaagggactgtcagcgacagacaaagataatatagtaaccgttctgtactattggtgttcagctttagaccttcagcctcatggcaggaggcacggtcctctgagggcttcgaaggaaggaaggactcgcataacttttct

SEQ ID NO: 25265 - DNA, 1220 bp, Mus musculus
agggtgttctttggtataatatttttattattttatctttaggtttggtcacacatagtctatgatctggcatattttaagaaaagcagaaatatgagttgacttgttcatataatgtacattgtatcagtattagtaacctctacctacttttcctctttgccaccaaacatgtcatacataaatgtaaacagtatgcagtcatgtgccccatagcaacatcaccggcaagtggcatcattcatataaaatggtggtacccaaagtgtgtcacccaacgatacggcaggcatagtttgtgtatgtaactctggaatgtctgtacgttaatcagtctctgacctctcagaatgtaccctccactgggaagtggtgcctggctgtgttccatatgcttctgacctgtttctttcactaacgggacataattaccccttgaccatgataccacaaattaagaagtgataggaaagcagcacatgaccaagtctgagttcatttctggttttctctgctctgtggagaccggcacacaaccattcaatcgtgcgatgctctttaatgtgggtttcaaagaggccatgaaagacagagcctgggactgtgtgatcttccatgatgtggatcatctgcctgaaaatgatcggaactactacggatgtggagagatgccgcggcactttgcagcgaagctggacaagtacatgtacatgtgagtagctgggcccctcttgatgctgtacagtgtgggcttgcagcagcatgctgggcctccatctcagcctgctcaacagactgaggagcatcgtcccctgctccaacatgtcctagggagccaggacaaggactggtttgtccatttgagattatatgggggttgactcggggaagagactggctcccatagcaagcacatagatttgaatctgggttttcacccttgggccttgcttagtcactcgctcctctcaaggttgctttccttttccttggcagtagagcccatctgtgggatggctttcttggatcctgatcctaccatgtgctagctgtgtgacccatgcaagctcttcctgactccccgccccttagggtccagggtccagactgcccttccgcagatcgcctgctctttaattatgtgaagcaaatgtcccctgccgtgtgtgtgtgtgtgtgtgtgtgtgtgtgtgtgtgtgtgtgtgtgtgtgtgctatcaa

SEQ ID NO: 25266 - DNA, 1201 bp, Mus musculus
attctctttgtgctttgtgaccaattctcttgagtttatgcctgatgttgagggtttctcttacatttgacttgccttcctctcttaagtttgtaggccccattctgttttacatacataaatctgacctttttaagatcagctactttgcatatcttgtctcttgaaaggagggtgggtatttgtttataaatttgtcagtagaacaggcaggcgttagaagatagattttcctcttggttcactctggcaagcataggcatttacatctacaaatatggctctgtagcgtgcgtgcatccgtgtgtgtgggagtgcatgagcactgtgtgcagcctctgccaggcctgcttcatcagatgaggtgggacgtgaggggagaccatgtctagacttgagcatacagactagaggaggaaggggaggggacacctggagaggagggaccaagtgattcccatgtgcagctgtagctgcaagattctctgaagactcagtaacaacacggccagttggtttaaccttatgagatgaggaagttaaaagaaagacttgactggagggcattagactggtttttttttttttttaacctattttggactttagcaggtgtcaggttagtaaaccgctagaagatgacatgtgattctatgttcctggctttcactgaggtcaggaggacagcatgtctttgagggacattagtgagggatgttagcgagctcttggttcaggattcgactagattaagagtgattcattctcgttgcagagctagagttgggagtgttctgttgcagagttggtgcttgttagaccaagaacatcttggaaatccttagcttttcagttttgtataatcaggggcctgatgcatggcaggcactcggaataaatatgccggcttgtatatacgaattctttcctaacaactgttggtggtagggggctaaaagataggttagcagtaatattatcactcttcctttgaacccaagtttggttcccagtaccttcttaaggtaaccacagcaggggaatctgtgaggcgtgtacactcacatgcaattttataaaagacagatgtatcaggggtcggttatgatggtgcatgcctgtaagcctgtacaggaagttgaagcaggagatttgagagttcaaggccagaactgcacctggagatttgggtctgaatccc

SEQ ID NO: 25267 - DNA, 1213 bp, Mus musculus
gtgacttggtccactacctgagttgtatctggtggctggagcctgtctttgatctctgtgatttggtggagggccttgactcctggggtgtcactgccctgtggacacaggggaagggattgcctaaatgtgggggacaagggacttgtaaatctagaccacaacccagaattggctttggagggtggggcttagggtatggacacccaaagttgaaaagtgtcctgtgagaaacccccaagatgggagacgccaacaggaggcccatctgtgttaggggccaaccatttcttctatgctacctaggtgtgtgaaacattgggaaacacatactggagactatttcgggagtagttaaagattcaatatccagcttcctatagagtgagaagtcatctacccctacataagacatgtaagcagagaattcaggttagagtcaccgatgttgtatttggaatgttaatttttttcttttagttgaacatttgaaccatttgtttaaaaaaatactcttaaaagaatatactttcaaggttttacatgtgtcttagggttcctattgctgtaaagagacaccatgaccaaggcaactcttataaaggatagcatttaattagggctagcttattggttctgaagttcagtccattatcaatggccagggtaagagaagggttagccaaacaagagagagagagagaacagagtcagggctagtttgagtcttagtttaactcctcttttttttttttttttttttttgttgttgttttggttttggtttttttgagacagggtttctctgtgtagccctggctgtcttggaacttactttgtagacctggctggtcttgaactcagaaatccacctgcctctgcctcccaagtgctaggattaaaggcatgtgccaccactgcccagctaactcctcctcttgattaaccaccctcatatccatcttgttaggccccctaattgtttttctgctattgtcactgtcactgttagtgataagatcccagtaacaaccagttaacacagacaggcctataaagagtccaagattgacctctagagtcaccaaaagaaagggggaatgttgtaaccctcgaattactgatactagagagatttcagtgttgtgcagtttgcctctgtgtctccgccagaggctctcatactccctccccacaaccccctggcaagcag

SEQ ID NO: 25268 - DNA, 1543 bp, Mus musculus
ctctgtcttgttattgttcttagaaaatagcaataacttctagcacatggttaattgttacagaaataatattattgttactaatttcataaataattcctagaaataaaaggatttgatgaaagaaagatgtaaaatttgagagaaaaaaacataaagggaaaggtttacaacttaccatttccttcctcctgtagtcctgaggcactggaaactcacggatcattcacgtggcttggacagacacagtataagctccagctgaaaagccaagagatgcacagtttgcagctgaaggcatgctttgttcatacaggcgtttataaccttggaactccaagagtattcgccaagttatcggaccacgttacagtatttgaaacaagtcagcagaactccatgcctgctctgattatcatcaataacgcgtgacaactcagagtcacagactcagtttgactttgtggaattggttttacagcagcatttgaaatacccaacttgttaaggaagttctctgatcactgcaaaatacagggacttggcacttagttgacacagtactctgggctgagaatgtgtagactgcatttttttttttccttttaaacctggttataatttatattcttataatacagaattcaacgtatccataaaccttattaagccgtgtcttaaaaaaaagtccaagtctgctgttgcaacttatcggacggttgactcctagaaggtgattttgaggaatgaaaagccttgctggcaatactcctgttaagccattagtctaaagatcctacctttactgtgaaattctatagagtgttaaatacaaattttcctggcttgccccaaacagttctgtaagaccagttttgaacgctggttatagacactcacatttcagtgtggtgtccctatggcttatacataactgtaaaaacaaaaagcttttctgatgctttgaacatagttttggaaggaggtcaactttattcctttgctcatctcttactgtcacactatttcacaataagatttttgtcattaaatcatattctttattataataactttaacaattaagttgatctgtttaaaatataaatctattcaagttaaaaataagcttttcaaaaatgtattatatttataacaaatttactgtaaatagaataaagacatactattcactgtataaatttattagatgccttttttaaaacctggctttgtgaggacttaatatattctttatttaaaataaatgtcaaacatgtacagtaggcactagcctagtttcctgtgaaagcttcattgccattattcaaaaatgaagcatggtctttgttcttgaagagcagatgaagtttttctttgcacacgtcctgtctgatgctgtgtgcaggtctgcatggtctgtctttaccctgctgggaagggcagcagcacttccaaagctgccatcacagctacacgggctctggtgctgggtatacagacttcctgtggcttcccacaggtacagctgagctgaacaggc

SEQ ID NO: 25269 - DNA, 1209 bp, Mus musculus
gcacagttggagctaggagcagtccagatggaacataagttatcgataggaaatggattttaacaacgtggagggtaggcagctgcccagctactatgctgcttaagacttacttaaaatatataggctgtgaatgtgtctttcatccatgaactcaatgatcaaggcaggggtagaagccccgggctgggattttttttttttttttttttctgaggcagggtttctctgtataaccctggctgtcctggaactcactttgtagaccaggctggcctcgaactcagaaatccacctgcctctgcctcctgagtgctgggattaaaggcgtgcgccaccacacccggctctgggaatttttagtaattttttgttactatagattagaaaattagaaatcctgcaagagtgcatcctctatagttatttggctatgtctggatcttctttgaaatgtgttttatgtgaggcagaagttcatgtgtatttaaatgtgaagtttgttttcttttcctttttgttttaaggtgaaaagcaagcggctactcatataagtcttgatcaagaatatgactctgagtcatcccagcagtggcgggaacttgaggaacatgttgtggctgtggctaataaaggagtaattccatccagtttctatcctacacagtattgtctgaacagttactccgataactccaggtttccacttgcagttgtagaaggtgatgtaattgaacttaaaaattatgtatatgaatgttgtgcttgcatgtatgtgcaccatatgcaagccttgttccctggaaggcagaaaaggatggtggatatcctgaaattggatttagagatgggtgggagctgccctgtgggctctctataagaccagccagtgactttaccattgagccatccctccagcccaatacttgaatacttgtggctttttgttttacttaaagcaaattcaagataacttatgaaatgccatattactggaggccctgggcatgaacacaacttactatgtactgagctgcatttagaagcaaatagtggggatctaatatctgtctatgtaacactgtaacatggtgctgaagtaccaagagaatgacattaggacatctaagtgactcccaaaactgagttctgtatgtgacaaaagacagtctaggcaaaccataaaaacccacagaaggtatgttgaga

SEQ ID NO: 25270 - DNA, 1200 bp, Mus musculus
tgagttccaaaagttgccggaaagcagctgtatgtttgaagtcgctctttggaataggcagtctcctatatggcacgtggaaggctcctagatggtctgtgctgtaaagaaactaactttgctttctgtagttcccccaaactaatttggccttcagactgtcttgaaggtagtttaattatcatgagtttttgtttacatgtttatactctctacattttctgttttgccttttttggggggtattcctggattacttgaaatgtctgttgtttgggctggattgatgctcagggttaagactaccaccaaccacccttgcagatgactcagagtcatgtcccaggacctacatggaagcttgtaactgccaataattcagctccaagggatctgataccttcttctagcctccttgggttcttgcatgcaggtagggcatatcaaatctatgcaggctcgcgcatgtgcgcacgcgcacacacacattaaaaaaaaaaaaaactaaatgaaatctaatgtttggcctcactggacattgcagtgggtaaagtttcttgctgttaaggatgatgacctgagctgagtctccacaacccatgaggtagagggaaaaacccagctcctgagtgttgtcctctgatgcgcacacatgcagtgtggtgtatgtccttgccctccccacataaatagaaatgtaaaagtaatgaagacaagtgacacatctaaggtctgctaagttctgtctgaactttgtgtaaggttattacaaagttgtttttttttcccatttctttagggctgaatcaatttatgaagaaatgaaacagaaatatggaactcagggttgctatttacttaaaatcaattctcgagcaccaaatcgagcatcagatgaacagataccagatccgtggagtcagtatctccagaaaaatagtattcaaaaccaggtacatctaaaaaccgaaccaaaccacaaaaattgtatttaaattttcaaaaagatatgactgtagatttttctcttttgaggggtgggtggagacaaggtctttatacctggctgtccttgaactcattatgtagatcaagctgaccttaaactcacaaagatcatctgtctcagcctgttgaatgctaggatcaaaggtgtgtgcccctaggccatgaaattgctaggtaacccagcctgtctat

SEQ ID NO: 25271 - DNA, 1199 bp, Mus musculus
atatgcgcgaccctgttttaacagcacttgaggaaggcttgacaaactcgggcaaccgaaccgggaggccctggtacccacagggagccagggaggagaatgtgcggcccacacagtatttaaatcaagagtgctctgggcgctactttgtggatattctcaggacttgttttcttcagctttgtacttcagggcatatatatatatatatatatatatatatatatatatatatatttttttttttttttaacgccttttccagttagtgatggtgtttcctagctgtctctacatagctctttgacataccatccaaaggccagggtaacagggtgagagccaaagttctgttgtgtaatgttatgaaatatatcaattaggtcagaacaacagcctaaagataattacacttttaaaaaactgttttcttttgggtggtttggggtgagtttgggtctcatgtaaagtaagtagtctagcctcaaattcactacatagctttacagtccaatcaacgatgaacaacagcaagttttgaaaatcccttccactgctctgaaggagcaacttggctaggtagtcctctgattccacattgtttgcaggggctggattttgaacactttaatttatttgtttctactaaaggagaatataaacttgcaaaatgttacatttctttctgtttaatctttttcctttgttaaagtgaataggaaactggccactggaaaaaagagtcataaaatatcctaacagggactggacaaattgccttccctcccttaaccgttctttgttttgacaaatctatgtccattgttcaggctgtgggcagaatttccatgttcttgcatttagccaacttgggcgccttccactttataaatgttaaccagagtccttttgcactggagactgttgttaacagcaattgtacattctaaatgaatgactctttcctgccaagcttaagttggaaaatgagaaaattgccagtgaagccctgtttttatcatcccatagcaaggttagattgcaaactgggctgtttttgttgattttagtttataaacaaataaatgacaacagttctggatgaatgtatagggaaacctttacacacagtgtgacatagtgtgcaaagacgtgactgcaagctgggtttgggattcagccttcttcttttttttttt

SEQ ID NO: 25272 - DNA, 4333 bp, Mus musculus
gatggagaaacatgtactacagtattacctgcttgtctttgttatgttgcattcaaaaaccgtgttcattctggcttagatctgcccttacattcttgagtctattagacatttaaccacgagacacagcctctcagccattaacagatggaagagacacgacacaggctggctatgtgatggagcagcttcctgtgtccattagtgatgtgtgtataacgctacatattcccaactgtcatcatggttaggcgagaaagccaatctctgttccatgctaaaagacggagaaaggaacaaaatatggacattaaaggaaatctgaaatgtattcaaattctcatgctctaatctccaataaggaacgtgaataatcttatgaaaaggaggaaagggaagaatttgaagtcaccaaaatccaatttagccaaattatagtacataatataatactgcaacaacttctgcgtttgaagtgtattcttagccaggcatggaggagcatgcctgtaattcaggaggtgagtatagaaggggcaggagtacgaggccagccgtggctaatgaggtggctaataagaccataaaaaaaaaaaattaagctgggtgtggtggcgcacgcctttaataccagcactcgggaggcagaggcaggtggatttctgagtttgaggccagcctggtctacaaagtgagttccaggacagccagggctatacagagaaaccctgtctcaaaaaaccaaaaaaaaaaaaaaaattttttttttgatagaagatgtttcaaatattcttagcttattgcttggaagtattttataatgtaggtgatttctaggacccctctgtggatatttatggtagttttcacattgggaaatcccgagctttgttttttcattttaacatcttaaaaaagtataaaatgaagtacatgtactaaaagccagatacaaaatgcatagcttaacatgttataagaaacattgttaatggatggttatgcctgtatgcctaggaggctgagcaggattctagttcaaagccagcctggactacatagttagttgcaggcctgcctgggctatagggtaagaccctgtttcaaagctgaacaaaagcattatgaactcatgtattcagtcatgtatgaacagacttccatccattacaagtgtcactttattgaggttcaacttcaattctctttccattccttgaaggttggctgagttcttaacactctgttactctccttgctgtctcttacagcaagcttccatgttgaatttatttcctgctatgaaccagagatcagcaactctctaagagttatgcctgcaaagaggatctgttgttcaaggtctccctcagctacaatgcaaggtcaaagacaacctaggctacacaggactctgtctcaacctgcccccattttcattccagaaaaaaacttctaaggtcagtgtctgctattgaggctgccattgtttgaaggagagagccaggaaacagctctatgcttgttgtaaagataaaaatggccaggcagggtagccatggtagtccaggatgactggtgactagagaccctcttgcttcagcctcctgtgtgtaagggcacaggtatgtgttgccatgcctgcaattccctattttcaaaaacagttggatggtgccaacgtttttatgctctaccctctcccttttatcctccagttcttcaagtaatgtgcatttattattgctgtcacttttcacatgtgattctttaatgttacattcaggtcacttactaggatttccatcttggaattaagaaaaagtaacaaagactagagacatcaactcctgagggtaaagtgttatttgacttaaaaataccttttggaaagggctggcaatatggctcagtaggtaaaggcacttcctgccaagcctgagagtcagagtttgatccctgtgaccacattcgtgaaggagaactaactcccacaagtgcaagcataatgtgtactccctcctcacacacacacataagcacaatacagcttatattgtaattgtttataagcatcatctgttgcacatcaacattgtcataatcatggtgccatgatttcttccctctttttgagacaggttctcatatgtatgcctggctggtctagaactcagtgtgtaaagcagactggcctggaacttcaagtgatctccctgcttctacctcctcgccctgggacttagatgtgggcactggcttctaaagttttcctagtgaattatccgtaactgctttgatattgctactgttttctcctcaggacaaggttactatatataacaccggggagggacagggcttccgggcagcccttgcattccctggattaacttaggtgtttggtcagacccaggaactgtggtcgctaaggccagtgctggaccacatccttgctttcccttctgacttcaaagtcgctcttcatggctgctaacaagtgacagacttttgcaacctctctgcctccagtctgggtggatgatacaatatatgaaataagttgtattaagaagtgatcatcagcccataaaatacagtatagttctgattattggtaactactgccctgtcagtcaatctaggttaacttagggcaatatgaaagtcatgagtaagtttagaaacctactgggggctggagcaatggctcaacacctaagagtactggctgctcttacagaggacccaggttcacacctgccagtagctccagttccagggaatctgacaccccccacacaagacacacgcaggcaaaacaccagtacacagaaaataaacactgacaagaccaaaaaaccaaaaccaaaaaaacaacaaaaaacaaacaaacatattctggataaatggaatggctcagtagataaaaataccctttgagtaaggctggcacctaagtctgtctgaacccccctcccccccccccgaactgaaccataaagtttgtcctttcagatctgcacatgcactgtggcatgctcttgtctgaattcacacaaaaagaattgggggggtggggtggagagacatgataagtcagcagttagggtccttgctactcactaggattgaggtctcagtcccatgtaggacagcttgctgcagcagccctcatctggctcccactggtacttggaacacaggcacatgctcacaaatatttaaaaatcataaaaataattaagaaacccaacaactgcgtaaatggggcaaggtgactaaagcctctaataccagcaattgggaggtagagacacaatgatcaggagcagcttaaggccagcctcagctacatagcaagtttggggctggcctggggttggttacatgtgattctgtgttctgagtagtaggttcaagtgaatgaacagactgggaatccgacccacagcttttttctttgtctgttttaattttgccacctagaggataagttaggtgctggccacctgagttattttgtattctgaattgctttgttttgaaaatgagacgaagatataatttcactgtgcgtttatcttctttttttaaaaaaaaaaaaagaatttaattcattgctttaaaaagtaaaaaccagtactcaaagttgttgatcatcagtaagaaactttcatgtgctttttgtaaatactgcctaatgaaacaactggaccaggggggaagatgatgctgttattttaaaacttaagttctcctatactgttggtagaaaacgggttgattgtggatcagtggtaaagagttggagctcctaagaacccctgactctggtaatgtcagttcctgctgtcactggggactaggcgtgctccatttcgaagtgagcctactctagtttttgaatgtttctcatgataatttgtatgcttacacattgaaggtatttttttgaagtactaacattcattctttggttcaaatgtaaaaagaacttgtgatcagaatttaaagtgtataattcttcttcttttgaaaactgtattatgagaaataaagagtggcaggaccattgctttcattaaaatgttcactgtgtctatttggggttttgttttggtggtactgggtctcgaacctaagacctcacacatgctgatcaagaattctagggccaagctgcatccctagtctgcttcctttttaacagatctaaattagttgcctaggctgcccttgaactcaagtagctgggactgcttacaggcatgagtcaccacacacagtttttgttgtcttgagacaggacagggtttcaccacatagcttt

SEQ ID NO: 25273 - DNA, 1120 bp, Mus musculus
tggcaggggagcagcatggtgaggtttcttttagaaagtttatattagtgtcaaatttcaggttgtcagttgagactagtaatgttgacatgtcaaggaagaaaatgattagaatcttaaactaatagtgatgatgcagagaagagatcactgacattttaagggttttgtataagatatgatgacaaatatccagtagttaagtgtatatactgcatatagatctggaataaatggtggtaaagtagttttgtgtgtgtattcatcaaggtaagtatgtaactgaaagcaagaagaggtcttagacccaagcgctggcaaatacttacataactagaagtagagagagctgtactctgagaaggagtagacagggtaggaagaaaaacaggcaagaaaaaaacaagcaaagcaacaaaaaatacaaaccacagcagtgaccttaagagaagtcagatataatgcttttaaaaataagtaaaaacaaagtgagggatgaggtaagtgctaaagtgcttacgtagcatgcacaggggtctgggttcaatcccgagcactgaaaaacaaagtaggccttgggtggtacaggcctgcatctggaaagacaaaaaggatagttggaattttaaggctaggctattgcaactgagatctgcctcaaaccaccaaaatgaactggggatatatagcccagcattaacatggttatctagcttatgtgagttctgttaaatcctctcctccaagattattgaagttgggtcaggcatagtggcatgtctataaaaacagcacttggaaggttaggtaagagaactgccatgatttgaaatgagcataggccacatagcaatactgtttcttaaaaggtcacaaagtatgtgtatatttgaagcaagtatccaaaaaacattttaggagaaaatagagtgggtattgataaggttatttctctcactttactttgtaatcttaaaatttttagtttttttttatttttgttgttttgattatattttgaaaaaaagcaacagggaaaaaaggggtttatttgatttacaattacagtctcttattttggagacatcaaggcaggaactcaaagcattgcatccacagt

SEQ ID NO: 25274 - DNA, 1146 bp, Mus musculus
ctggctctctgaacgcacagagatccttctgcctcatccttctttctgagtgctgggattaaaggcgtgtactgccctaccaagcctgtctttgtttcatagttttcaaacacaaatgtagctgggtgtggtgacacatacctgtggttcccagtactcaggaagttaaagtaggattgttttgcttgagcctaaacttgagtctcagagtaagatcctttctttaaaaaaaaattgtaaaatggacatgtgtagtttcattttgttactgtctaatccagtcttattgccagagaaaacatacataacttttaaaactgaggtgtacatcttgactaggtatccataatcacttgtttgtggttcactgttttttgttttttgttttttgtttttttttttcttcctgtaattaacctgtcacaaatgtttggcttagtttctgtagaaaatgtttcctgactgcaatgagagaaagtggaatacattgtcccctatgtcgtggaagtgtgactagaagagaaagagcatgtccggaacgggccttagatcttgaaaatatcatgaggaggttttctggtagctgcagatgctgttcaaaaaaggtagggttatattatgtaattgttttaattttcctggtgaacatggctttgagaagaaagacatttcccgggtgttatgttaaacacctataatctctgctcagaagggttgcaagttcacagcttgcttgggctacaaattgagagcctcaaaaacaaaataaacaagatatgttatttcagttgagaattatatagaaaagaccagaaagtttcatatatcaaaaaccttgttgaatttagagttttatctttaagataaaaattttatttttttcaataagctgacagccttttaagatctatatacaaaactttttttttttaaaaaagttctacctaagtttcaaatgttaataatttagtcaaatagatttatgtactgaaatccctggctgcccacttaagtatttaagaaatcatgaaatacttctcagaagactggtttaaattttttaagcacatgggataatcaggtgttgataacattgtctaatttggaatttattctacttgaagaaagctaaatgggtgaggagtg

SEQ ID NO: 25275 - DNA, 2061 bp, Mus musculus
ttactaggctcaaggtatcctcctgcctcaggttcctgagtggctgagagtatgacacataccatggtgttcaatcttgcattttaaggcatactgtccataaactccttgtatgcaaatgtatatgaagatttgtaatgcattagataaaactgaatagttgataactttcttgttgacacattacttttttttttttttaagaatcttcagctagatgaggaaacccaatatcaaactgctgtggaagagtcttttcaagtaaacatgtgacatgtatagacatctctgcctccttgcaacctacaagtgccatctttaaggagaagacatgaagtcaccattttcagtaatttgctgtgcatattaataaaaataataattcagtctactgtattaggtttttaattgaaaataaaggtgggccaccctaataccattctctagacagttactttaacagcatggaaagggttgtatttcacttgtgtggtgaaaagagaatctctgttgtctttttcttccttgtattacatattctcaatgtttcattaagttgtttttggtatttgatatagttccttctgtttagtacagagataacagcaaattctgaacgatgtgattcttaaaaagctaataaacctgagccatttgtcagagctgtagaatggaaacttgaagtgtgaagtgggataatccaaagggatttttttttaaagtatagattctagctgaggaattcaacaataagaaagttgtatttatgtaatgtttagtatttttgaagactagtgagatttctttaataatttttactttgaaagcatattgtacaaatgtttcttcttttgctattagaagaacatcaagagaagtttcctttggtggttagtttgttatttcaatctaggttgaataatttgtaagcctaaatgttatataccacagttctttgtagtcagtatttctcactgggtgatgaaacttttcagccagtgaatgatacattcaattagttttttaaaaatccaaagttgcagatgtatgtggatatgtacatagacttttgcatgtatatatacacatatatatctttgcctagagtttgtcaggttatgtatagaatttctattaaaaagttttaataatggacaagcaatataggattgaagtatttatctcctttgtttaaaattttgtatgttaccaagtttttaaaacagtaagccaaatactatgtggtacagttggctgttattacacctgaaaaatgttaaatggtgctcacttgttacgtttgaaaatgatgcataactgacgtgtggtgagagattttaccagctactgtttcactacattttagtcaaaacaaagtttgttcttaatctttggtataaagtgttgtagagaaggccaagtcacaaagtaaagggtgaagggggaattctgacattccacactaacataacactgttatgctttctttaaaataactaaccgcaaaagaaaatctctgaagtagtttgctgctaatatatacatatattgtaaaaaaaaaaggtatattttgattttcttaatacccttgttgacttttctacaatgaacatttttaaacttgatttaataaaaatgttaattttggatgtgcagttttgtaaaaaacctttttcagttaaacggtaatgactttatttatgttcagtaatatagactcacaagaagccatacatcttaatgcctttttttctgttgtttcttgagcgtgatgtttactgtgttctctagcactttgagttgacatacaagagtaattctaggaacatctatatgatgaaccctttaaaaggagacttctgtccacagtcctctagtttaaagcaataacttggatacttttaaagttttatttagccagtgtgctcctaaatcatcctgggatgtacaaacttaaagggaaacttgtactagagagggttcctgttttgaagtcttgtggatgagttatattaatagattaatagctttttcatgagaattatctttttttttgcatta

SEQ ID NO: 25276 - DNA, 2440 bp, Mus musculus
taacctatcctgagaaaattaacttcccttgagaataaagacagcttgcaatggagacacttcaggtccccactggaaaccctttctttatccatccttcagcacccagcccttggccatgattttcaagctcggaagcaagccctaagtttggtttgtgtttgctgtgaaggttgccccatgtaaacaactgactcctttggtctttgcaagaaccttacacaaaacaagagtttcagtcttcttttagtttatttgctttggtcctggcatacttatgccatatctgttttgattgggatcctggaacctcccttaaatcaaggattggccttggggtcatacattcattgtatattcagtaagcaccctctgtgtgccagacccgaggctgagaaaagtcctaacccctgtcctcttagaacttagatgtttcaaaatcacagttgctggcggtgtatatgtgtgcgagagactatgaacatttcctggaagctggatgcttagagtcccatatttaaggagcccacagatggaagcaatggcaggtgcctctaagacaaacaataaatgccccagacgttggtgaacaccccctgacacttggaatatattaaagaagaaatgcatctgtctccccctgctcctattttctttcactgacctggaatttttaatgataatcagtactggcatttctaaaagccacaaataagtataattgccacttctgagctgagcacctgtctgaggaggatcctgactagacaaggaattcataagccagagagaatcagacaggctacacagcagaaagcagaaacaccccttgccttccacaccctacagtggaacctcttccaaaagcagccaaatcaagacaatacctccattagcggcagattccctacgtccagtgagggacaatggtacttgtggagaagtgctatctttgggggaatccttaaactcatggctaaatcatcttcctgcccctcccctgtcggaagagaccgtgtcagcaagaagccgggccaagcagctaaaatgtaaaatacgaagtcaattcagagagaaaactcaagtgttcacccaccgcttccttcacagaatcttccagacgcctgcaagttctgtctaagttgaactgctcaagtttatggactgtgaaatgtccacatctactctctctcagcccacatagaccattcaaatttatgaagttgtatcaaactgcccattcagctaaattgcagtgtttattcctgtcctgcagaaatgccacaaccttatgggaactgtgacagcccattccagctgatcagattcatacataaacaacctccgttcacactgcagagccacctgcacagcatccgtccacatgctcccttgtgaagttcaggggcttgaaatggatggatggagaacccatcgttttcctagtgctttgtgtaataaatctagtctcgtgcctatcttccgtaagtatataccctgaatgacaagctgggaaacacaaagatttccaaggagcccaggaaatttgagttgcagtctaccaggaaaagttccatctattggtggacacacgaggctttgagaaacatgcccattgtgtgaattcccaatgctcttctcgaaacctgaaagctgctaaggcaaaagaatcaaagtcccagaggacaaatcgtggaaccagaactttccttatcctgtaggtttgtaatgtaggactctgtggctgtaccacgtcgggtcacatttctaggttttcaggaagtcttgttttatattttgactcattgtgatagccagaaacacgtgagtgtgagtgtgcttcaagcagctaggtgcaagtgtcgtctgcggttgtctccctctgcccacctccgaggctgcgcatctctgtactagagcttagcagagggtgagctcctttggtttacaatctcctgtaggatagggcttccataattccctagccataaacctgtcccctgttttcatatgttccatttgaaatagtgtttcagctaaaactagaaaggaaggatggaaggaagggagggagggagggaggaaggaaggaaggaaggaaggaaggaaggaaggaaggaaggaaggaccccaagaacttggggcattttccttcacttaaatggaaattgtattttctaagaatttggaagtctctgtacagtttctgggctgggagaacagtgggttgctagccacacatcagcagttcattgtgttgcattatttaatgggcccaatgtgtacctcaagataaatgcagtatattatgtctaaaaaagaaaaatccgttgtctgttgatttaaatggttctgaaatgtctataaataaagaaaatctcaaggttgctcttgaagtctttcctgagtgagtcagacctactactgacttttcaaaggc

SEQ ID NO: 25277 - DNA, 1182 bp, Mus musculus
aggcatggtatttattacaaaacagccaaagctgaaacacataaacacttgtgagcagttcgcttcctggggagtcaacggtggacagtccattgtattctgcagctcgctttgcttcctgccagctgttttcctcctgtgcctggtgatgtgagtggtgtgaaatgacactttaatgttccatgcttggtggagatctttttatcaaaaggcattttccaaaaaatcatgttttgatagaggatatctggtgtccttaggaatgacacaaatcatgaccattacatttgatctgtaactgctgctagtttcatggagcagaggaaaagaaaaaaaaaaaaaaggcatgtgtgtgtatgcacatagatgtgttttaatgtagttttttaatctgatatttttagataatatctttttactttataatatccactgaggttcccaggctttgaactgaatggattcgctcaaaaacagttggcgtaacgatcccaaagagtctcagaacctgaactttaaagctcagcctcctaggctccagccctgaaaactcagaagcagtcgggaaagattctgttgaagaatttaatgtgctctgtaagcccgtgggaggactgactcttgcatatctgtgctgacatttggggaaatgacagctgctttggaaccttcatcctgtcctcctgtgtgcccccgtgaaaggtctgaaaagcctttctccaaaatgtgaggtctgctcagcacgcctcttgtgttaggaaaccttgtgactcagacagaccacctctctattctagatgccatatctctgcactgattcctaagataccaataagagtacttgctaattccatcgtcgacctctttctcctcttgtaaaacacagtaactatcattcatattctgagaattccagaacatgtccaaggattttcctaaatgtggctaaataccccaactataccatcactttttttctcttgactgtttgaaggcatataacctcaaagagttccattttttttctgagcaacatatcctccacatagtccatgagtctatccccagattctcaccggacagacagacatcctggtagtgagatgcacacctgagctgctcaggtgagattgtttgaccaccaggagtcagtgtatcccgaacagatgaccccattttgtc

SEQ ID NO: 25278 - DNA, 1178 bp, Mus musculus
ggtaccgcagtccccggagccgcctagaagggaggcagagcgcctagctagtgaattgcgggaggcggagcctgaagggggcggagctatgagaggcggtgcatgagggagattgaagtgggggaggcggggctaggtggagaaaggaggagctagaagaaggtatggtcatgtgggggtgggacatgtggaaatcccatcctactgaaagggaggcggagctagtgaaggtggagtcagagttcctgggaagcgaagcctgcgtaccagcggagtggagctagcgtcgtgggggcggagacagagtcaaagaggcaaggcctctctggggaggcggagcctatactccggggaggcggagtctccgacagggaggcgggtgcggaggcggtgccggggcgggctgcgcaggcgtcgcttgcaccttgttgattagtcagtgccgggagcgctgctatggcgttcctcggacccgcggctccacctcacactgggctcgaggcggaggctaggagagggccgaggaggaggaggcgggcggctggccgccgcaattgcagagccggggccaagggaggcggaggcggagcgggagccgccgcaaccagcccggccgcctgcagtgctcccctggcttgagggcgcggggcgccagccatgcctcggtgtggccactgaagccgggcgccggcgtccccgccgctgtgcctcgctgtccggctgcccgcggcgggagtacggagccgccagccagccagcggtggcgcgagcgcgggagcgcggggcaggaggaggcggggaagatggacccggctccctcgttgggttgcagcctcaaggatgtgaagtggagcccagtggccatgccgctcgacctgctggtcagcacctaccggctgccccagatcgcgcggctggacagcggtgagtgcctgcgggacgcacgggtgccaggaagggtgggaccggtggcgggggcgggcgagaacttgggggggggcggtcagagctcacccctagccgtctagttggcccaagaggctgccgcagctctggcgcgttgctctccactccccccagcagcagccctcgccgctggagaggtgcacatcacaacccttgcagtgcagtaaataaagacaccttacatcgtggaaacctatagatagtaatcttgg

SEQ ID NO: 25279 - DNA, 1211 bp, Mus musculus
gaggaatttttcctcaaattccttgctgcaggaacccacttaggtggcaccaactctgactttcagatggagcagtacaaaaggaaaagtgacatcataaatctgaagaggacctgggggaagctgttgctcacagctcaagctattgttgccatcgagaacccttctgacacacatcatcacctccaggaacactgggcagtgagctgagttgaagtttgctgctgccacaggagccactccaattgctggctgcttcgcacctgggaccttcactaaccagatccaggcagctttcagggagccacggcttctagtggtgactgatcccagggctgaccaccagccactcacagaggcctctcatgtcaacctacccaccattgctctgtgtaacacagattctcctctgcgctatatggacattgccatcctatgaaacaagggagctcactcagtgggtctgatgtggtggatgctggccccggaagtactctgcatgcgaagtacgggagactgtgagcaggcatgggaggttgtgcctgatctttacttctacagagacccagaggagattgagaaggaggagcaggctgttgctgagaaggctgtgaccaagaaggaattccaggatgaatggaccgcaccagctcccaagttcattgctgctcagactgaggtggtagcctggtctgaggtcgtgcaggtgccctctgtagccacccagaagtccccgagagaagactggagtgcccagctggccactgaggactggtcagcagctcccacagcgcaggcatccgagtgggttggaggcaccgatgagtggtcctgagctgctctgcaaacacctgagcaaaggtataaaaaaaaaaaaaaaggtggaaggaaaataaagttcctaaaagctgggggcaggggggaaaggctttagataaacaagaatgggtgccatccaacttcagcttggtgaagcattggtttatcaagatttcttgctagagcaaaagtgactgaatgatagctacagcattgggcatgtgctagagaggacacagttaactgaaccaccagagtccccctcacagcatggatgactcttgaaatccataccactgagtccttgagtaacgcctgatcaagtacactagctacactaacttccctaccaattgattgattaccttgtatatagccttgggatttgtgga

SEQ ID NO: 25280 - DNA, 1338 bp, Mus musculus
atggccctgggatgtgaaggtatccctgtatcccgggatgacaccaggaagctgggaagcatttgtgcgttgttgagttatgcctgaggctggcgtactccagaacctggtgtttaggtgattcttgctgattaggcctgacaccccacagggcctgaaagtaaaccggtttagctaaaactcctcccctatcccacaggagggccaaacggaagagccagaagcagaggagcaagcccatgaccagcagccccagcagcaggaggagtactgaaccgtctcatcagctcttgacacttccatcgtgcgtggggactttgcttccagagaattggaacgtgtgtggcctggagcgcagtagaaaccagccgttcccaacctattcccattgacagtgatcttgcatccgccagccattgctcttggctcccacttcctctgccaagatgcgttagcagatggccattctggtcagctccctgccaggtcatagggtcacataccgtcaacttcacctcctggctgcttaagactagttctactcccccctcataactatgtcccaccccaacaccatcaccaccaccaccaccaccaccacccctttttatcctggtgtgaaacaatggtaatttgatatatggtatttatattggcatttttcaatccagtgtcagtagctgtcacgcgcatttgtggtgctttgatgtttgcgagtctaacctcctctcataaatttggtcagataattaattggaacaaagggaaacagatatttgatatgaaagccatatgacagtagcttgtgtcatggggaaacagtttctccctctactcacaacactaaagggaaaaaggtggattcagaactatgacttcagggcccagcagtgttgatagagcagcatattagacaaacacacagttgttagttttcagacattcgctcacggacaataccatctcagctttgcccttgctccgtgtgtccactcctgcccccctcccccaggttttcctgttattttctttctcagggtcctttctttggtgggggtccactccccgaaagatgttgtcattggcaatctgcagttgcaaagggggtagggtggtctcagaaggcacgaggcttcctgcctcttccctcttcctccttgtaagagcttcaacccaagtcctccaattcacattaaggaatccatactaaagggggacttgagggtgtgtaccctacaggccagccttccacatcgtgtcagtgttggctgcccaggttggaagcgaagacttgattgatagcatggtttcaagagagaagtggggccacacacaaaa

SEQ ID NO: 25281 - DNA, 1175 bp, Mus musculus
caggagtgtccattccttatcatgccatgtattgctatgacctctgcatctgttctgccattagccaagctgctgattctacattttaggtcttaatatcacatccaagaaatttctagttaactcatagatcagataaaatctctgatatttcttccaacagactcctgaatttaactggcatagttattgccacagacttaaccataataattaaatatgtatattctattagcccttagtttggagaagacaatgaccaagcctattcacccagtggctaagcccagcagattctaaataaggaagtacactgtaacaggaatctcagggttaaaggcactagcaagatattaatactcctcagatattaattaaactgatccaggacatgacatttcatagcctcaattcaacatttcagggttcagtaactcttaaaacatgcctactcctgtcaggcataaacacttttatagacagaccttataaagagatcttacggatctgtgccccaatcatggacttacatgaaggtgctcaatggcagttctatctgaagtggagagtgggatgaagagcggattggtgagagtcctcatccagaaatgggtcagttccccccccccccaacccccttagaaaataccattctttgtagacaagttttggataaaattcttctttcaatatgcaaacattttgtgtggatctctttttacagaactgggctggaaagacaaaaatcctgctatcaggaaacttctctatcttttgtggagtctcaccttcaaagtgaattccttgcatttcacaattgtacaaccactgacccttagagctgaactctggtatgtgttctctgatgctgcacaaggcctgacctatgcctaaatattttcctgcattcattacattcataaggtttctccccagagtgagttctctggtgcacagtgagtgctgagcttctattaaaggattttccacattcattacatttataaggtttctcaccagtgtggattctttgatgttccctaagaacataacttgtccaaaaagccttaccacattcagtacattcatagcttttgtctccactgtgaatcttcttatgctgaataagggcagagctctggatgaaggctttcccacattcatcacaactataa

SEQ ID NO: 25282 - DNA, 1165 bp, Mus musculus
cgcttttattattgtagtgaatcaatctcattattcccaggcctttgtatctgataagtgccttctacaaatgtgtgatccatatttgttgaatcttcccagttttcctcagcacttatcaatgttgggaagcctcccatttcgtttgagtccaccgccttgcagtctgtcaaccatgtggggccactgtcaccgagtctcccctcttactgtaacgtctgcagggaaatactcatttgttctacctggagctttcttacaacatggagcgcattttccatttagattttgtttattattccagatggtgagactaagatcaagattggagagccagctacagaggaggaaatgacaggaaagattggaacagtgactgaagagtccggcagccttgaggaggatgttccccatgactccagaggcaaagaattccgtgaatttggagaagaattgaacgatcagatgcttttcagaagaagacagtataactgtgatgaatgtgaccaaagctttgcttggagtacaggtctcattaggcaccaaagaactcattggaaaccttacgaatgtgaggaatgtggaaaggcctttcggatgagctcagccctggttctgcatcagagaattcatactggagagaagccctatccttgtagttggtgtattaaaagttttagtcggagctcagaccttattaaacatcaaagagtccacactggtgaaaaaccttacaagtgtgatgagtgtggcaaggccttcagtcagagctcagatcttatgatacatcagagaatccacacaggagaaaaaccctaccaatgtagtcattgtagtaaaagctttagccagcactcaggcatggttaaacatctgagaatccacactggagagaagccttatatgtgtaaccattgttacaaacatttcagtcagagctctgatcttataaaacatcaaaggatccacactggggagaaaccatacaagtgtgatgtgtgtgggaaggcctttagtcagagctctgatcgtattctccatcagagaatccacactggggagaagccatatccgtgtgctcagtgtaacaaaagttttagtcaaaattcagaccttattaaacacagaaggatccacactggagagaaaccgtataaatgtagtg

SEQ ID NO: 25283 - DNA, 2354 bp, Mus musculus
aaattaggaggaaacaatcagcactcaggtctttttcttcagaaatgaagacaaaattaaaaacatgaagagatatggaaacttatttttccctgttgactgggaaaatctactgggaaatagaaaaaaaaaacttcattcaccattattatcttgaaagaaatggtgttatacctgcctagaaactgaaattttaaataattcaggtgttaatacctaaatttttcttgtgaagtttatattctcttttttttctccccaagtaatgagctacctggttctttgtctctttcctttttcagacagctactttatttctgtgttggtcattggagtgttctgtaagggtgcatacgtttttattttaaaaggcaacataggaattgtaaaatctaaaagcccatcctcaagactcagaaacatcctttaaagcttagtttccttttgttcaggatgagtgtatttgagaaaatagaagataaaggccaaagcctcagactcagatgagccttaagatctcagatgagagatggtagcaaaacttcagagagtagaggggacacactgggcacttacccagtgaagcatgtcacttaggtacagtcatcctgtaggaaaactcgaaaagaaaagtgattttacctaacttgtgggaatcttactaattaaaatggttttcctgtgtaaaaacagacagttgtaaaagtgatggtaaggcagacactaaggaagaatgtagtgatgttgaaaggcaaatgtaaagttaggtaattacatgacatggcttttagaaaacctcaaacatctaattcatttgcctcatgctagttaaggacaggacattccttgatggggtgggtaacaatatcaggtttgctatttttattcctttggtacacaagggtttaacaccaggctaaaacagccatacatttattattaaacatttctaccgacaatgcactgtgccaggtactgtactcctatcgtcagtcggtaggaatctgttccactgtaagtcacaagggattgatttcccctcagcattccccgctcacctctgagagccccagagttgtagttctcttgccagtgtgctgtgtttggagggagatgtcggctcagagtcagctagtcagctcttagcattcttcagaggtgagttcaaatcacactcttttagtttgaaagttaatgaatcttaaaaatccaaacatcatttctagtagcattgtggttgtaactacacgttgaatgaactgtactttaaacaactaagctattaataactagtttattagttgtcagaattgatttttttttaaatttacagtcttaacacatttttaaaaaaaatttattaagagtaatacattttagtagtaggattctgtatgcctgtatacttggctaagaatccaagttctgtggttctactatttaatggaaaactctggaagttaaagcattggataagagaagaggctttttatataagacaggcactgttacatggaaaactatccatgcaagtacagatatttcatagttccagtgatttgggtcatatctggtgctttgtcaaattttaacgtgaaaaatgagatttttgcctgagcctgttgaaaagcagtaataaatgccacacagctagtgaagtgaggccgaatgaagcttgttcatgattttctgataacaattataagaaatgtgctttatagatttaagatttattgaagtataaatatgtagtaatgctataatgtatttttaagttatacaagaaaatgtagggacttctgtttgggtttttctctgtggctgagaggaaacaagttcatgtccaataaagctgcaaactcctctgctctagataaagtagcttggaattgccttacttatttattaacaactggcttctctcccagtaggactttgagttggcacatttatataaagcccgcagggatgacagaactcttagggtaggtaacctctgggtggaatgtcaggcttaacagtttaggatagatttgtctccgaggccaaagctgcatgtgacgtgaaagcacagaagtagcattagagttggtgaacgtatgaggtctgtcagccctgacgccgtgttccttttgagaaggaagctcagacaaggctctgtggggaggggactggactaaaaccctggtggtttacaggaaaaggacgccgtgggctttgtatttaaccgactgcttaaccagttaatttacagttagtgattgctgacttcacacgatcaccacacatattttgggaggtacacagtaatgaagtaggctggtaacaagtgccaagcagtggcctagctagca

SEQ ID NO: 25284 - DNA, 1882 bp, Mus musculus
aattttttaaaaattgtatttttttcttaagaccacactgatatcaaggctgctctgaagtgagttattctgatcctgccgcctgtcttccctgtaagagtggagcctcgaggtgtaccttaaagtgaccggaatgttagagatgcaatttgcagagctggggcaaggaagggctccttgtcactgtagttactttccttgcagtggccaaatgcccaataagaaggaatacatgaccactgctgtggggagtcagcaggtgcgtgatgcagctggccacactccatccacggccatgacataaaacagacaagaagtaaggctggactgtaacacctcaaggcctgctccagtgacccactttcttcagagaggctctaccacacacacaaccaccttccaaatttacactcagatcactacaccatgtctcccaagttaaaacatgtatccacctagactttaaatgtgctttgtaactgttgatggcactgtacagagggccaaagtatttcccatcagatagcatttttctgaacccatgcctcttgggacgagatcacaggacttgacccatcatcaaataggaccaggtgacctacagagacatcacaatgatggcttcctacagtcaagtccatttccaataatgctctcatctaagagaacccatgaaccttatttgaatcctggttcaaacaaaaaccttaaattatttatgagacaattataaacttgatagattttgatgtgtgaaggtatttatgaatatttttagtcagtgatggtatactgttaaggaaaaggttcatattttagggacaaaggctgaaacatttatggacagagtgatatgatatctgggatttgttttaggatgaagtgggagggaggaaatgaatggaaatagtgttgaaacagtattggccacgagtcagctattgtgtgctaagacgctcctcacaccagtctactctgtatgtgtttgaatatctctgtaataaacttaacaaggacatgttttgttggggtgtttttttgttttttgagacagctctggctgtcctggaactcactctgtagaccaggctggcctcaaactcagagatcctcctgcctctgcctcccaagacatgcactaccatgcctgtctggtattttattactaacagttgagtagagaaattactcagtgtctgaggtttctcagtaggttaggaagaaagcacaggcagtgaaactcctctgaatgctctgagtgggcgtcaccttgctggagtcagaaaactcggttggtcagctttctgttgctgtgacagaatcacctgcaaaagtcagcacactcacgatctggtcacccctcaagtgagccaccatctagggaccaagcttccagttcggccttttgtggaatggggatattaatcggtcatattcttgacatggggaaagtctggaatctgtcagcacaagtccagctgtctgtctctgaagaacttcccaggcagccgagcaaggaggatgacagaaacaagctggtacgttttgagcatcgctcccagagtctggcgtcgtctcggaaggggctttttctttagaaagaccagaaatgcatctttatctctagctagcagttttcttcccctttgttttcatgagagataagagttaccgaggcctggactggcttgctgcaaatagtccttgtaatattccacactgcaaaactctagccacagtccccagcggtcaccatgcaaacaccaggataaactacatcttcgaagcactgagcacaggcaagctgttggagtgtggggaactgctgtcactgaacgtaagctggccttgtgccttattgaggaggcaggagaggggacat

SEQ ID NO: 25285 - DNA, 1193 bp, Mus musculus
atatattatacatacatacatatacatacatacatatatataatatattattttttaaatataagaaatcaacttcaaagttatagcattatggtaaagctattaaccatacggagaaatatgtatataagtgtataacatgatgctgccattaattatgcaacatcagtgctggacattttccttgagagcagattatatgcttacttccccactaataaaatactgaagaatagaaatgataagacttgtttacaaagaaaaattttgcctaaaaaggattgtgtaccactaaaaattaatttttgaactctttataatattttccaagtttcagatagtaaagagtgtgtgtaaaagaagaaatgcaaaaagacagaaggttctcagccaacaaatgattttgatactgacttggtatagattatggcataaagaaaccttagcattgtttagttgtatagttgctacggtaagtaggtacagttgaagattttaatttgcttttatgacctcaggaggacagtggtgtgtcctatcatcgacgtgatcagtgatgacactttcgagtacatggcgggctctgacatgacctatggtggcttcaactggaagctcaattttcgttggtatcctgttccccagcgagaaatggacagaaggaaaggtgacaggactcttcctgtcaggtaatttgtcagacgttttctttatagtatattgcagagttgtgacactttttcatggggttaaaggtgtcctttgagaaacaaagtaattgtatactttgtacatatttcacatatttttttaaagaggatttttccccctctagctaacaaagttatattttgttttcattctgtaaactcctagtatacatgataagtgatgataacatacatacattctttattttctatatgaaaacatttcagatttctaagtttagtctgtgtttaaatcaagctactcctcaatcagttgtgtccttatgttaaatactagctcagagttgtgtcttgtgctgtaacattttacgagcatgtaccatctgggtggtacttactaacttttaagcttagaaaagcttggtcctcacaatgctaaatagagattgtgagaaatacattcaatttaaggagtctaagatagaaagttcatcagtactaagaatcaagaaagatgctaaa

SEQ ID NO: 25286 - DNA, 1572 bp, Mus musculus
aacagggtttaaaggaaattaaaaagaattatgagaagtacaatttgttatagtatagtatgagatttctatatagattttatacctcagtggggaaaaactgattccagtgatgttgatgttgttttcatctgtgatagtcatggatgcttctattttcctcggggtgctcagagtgagatagtgggtggggtgagctctctgaacatagtttgaatttctttttacaatattcttatttggtttgtgggctgttggaattgtaagtttaattgccattctttaaaaaaaaaaaaatggagatttactctgcctggtctcagttggaaagttttcgatctctctctgttgttcttgggtcaactggcgtacagactctgcctcgccctgcctccctccctccacacagtttcttaacatgctgtccacttaactctgctgagctgattgtgcttcatgcccaagactcacgctactgcactgcaggtttgtctccacagcaataacctctgacccctgcgagtcacttcacagagtgctgtttatctggagattgggagatcagacatttaatgggttttttgaaacccttgccactccacttagccgtgtgcttccctgtcggacgcacactcaggttcctcctcagttgtaatgttgatttgctgctttttcacaaaataaaaatggactgaaagtgtttaattggcattttttaatgagttagccaaagaagtgcaactgtgattccacatcacagtcctgcgtttcctccctaaattctattttgttatttggttttctttactctggtttttagtaacaggatcacgtattaaaatttgctgttaattaaagtttaccttttgattttacagaaatctcattgtgacatttttttccatagcagcccattggccaaaatgcataattctgcttcctgtctgtcaggtgatacttgatggtattcctctttttttgattatcaaagacttgcttcaggaagtgctgtttcttgtgcgtaagaatgttcctgaagtcacactcgtcagtgacaccatctgtcatcattcatccagtcgtcagcatcgaatatatggatgcttagggtaaggctgtcctccaggatgcagagactccccatgcaatctgaatgaaaccggtgttggctggaatactttttctcttctgtgagctatgttaattctgtctccaatgggcccaatgtttgaaaagtcagatgtctaataaattattttcatgctcagaatttcagatttttgtaccctaacaacatggttttattccttattgtaaaagtttaacagcgttgtgatttaaaaatgtgtctcacttttttaagtggggggatgtgagtgacttaattcatgggtacttttagaacctattagataatcttattgcctttatttttctaattaaaatattcctaaatactttgaaaatatatgatactctgagtagttgtgccttacgttggttttactgagggtaaactggatcctttcatcatagcagttagtgggttaagcagatgttgtctctattgga

SEQ ID NO: 25287 - DNA, 1170 bp, Mus musculus
tgccgctgtgggaggagactggtaggtagactggagatgagtgggcagggtcagaaatgtggccctttgtaagtgagcagccgcgtggggacataaaagaccaaggttcggagcggttcccatgctgcaggctgccccagagagtgtcagttctgttcttactggctgagttaaacccaaattagcacacacgctttcttaagttttactttttacagtgcagagtttttagtgagttagcttagatatatgagagtggtgtacctggttttgataaagacataaatgatgccacatccaaagctcgactgatagtgatttaaattaggggaaaatgttaggaggaagttgtctaggcttctgaaaaaagcccatattctttcaaaactaaatgtattttgtttgtgtatgtacgtttttgtgtgccaggttgaacatgtggaggtcagagaacagtgtgtgggactaaggctgtagagtaatttaatggaacacatagaaaagaaacaagttggttatactagtaggtagagttattttcaattttgaataaatttaaaaaaatactcagggttattaaactcctgaatgtcaaatagaaaaatgtcagccttattgcttctgcccagttcacacacacagatcctatttcaagcatatagtctagagtgttatgttactatgtatgtatgtatttatgtacatatgtatgtgaggcagggtccccttttgtagctgtggctggcctagaacctcctgggcacaccagattggtattgaattcgcagagatccacctgctgccacctcctcagtgctaggactgaaggtgccactgctcctggctgtacttcaatatttagaactagccaccagatgcactcttcctgaagagttgagcccagggctttgcacatgctaggcaagcaagcattctatcactgaggtgtatccttcctctttaaaagtgatgtttagaagtgtgtagttaaaccaaagaaacctgctcctctacttttttgtttgtttgtttgtttgtttttgttttgtttttcgagacagggtttctctgtatagccctggctgtcctggaactcactttgtagaccaggctggctcaaactcagaaatctgcctgcctctgcctcccgagtgctgggattaaaggcat

SEQ ID NO: 25288 - DNA, 1239 bp, Mus musculus
tcatcatgtattttgagcagagtggccattatcagtataggagagctgggttttatttaaaagaccattgggtttactagttcttacttgaattgttctaattctagtactgtgtaagactgttctgtttgagtccctttttttatagacagcttgttctaaatttgcaggtatatcatggtattacctcttaggtttgtttgtttgtttgtttgtttgtttgtttattggtttttcgagacagggtttctctgtgtaaacctggctgtcctggaactcactctatagatcaggctggcctcaaactcagaattctacctgcctctgcctcctaagtgctgggattaaaggcgtgcactaccacgccaggctgtttattttttattatttagctcttggctcattagtttttcagtaagccccaggtgctgtttgtactggctctgctgttgcagttctgagagcaccaaatgctcaactcctaattttgcactgtccctttttagtttgctgcctttctgctcacataaacttgctcaattattggtgctatgctctgtcttggaagaggttgcccacttgaaatgggaaagatacaatggaatttcttagaacatgaatttgctagttgacttacctgtttgagatgttatagtggccttcagtcttaataatctgtcattacttctttcactgttcacagcactaagggtgagtatgtcaacagtgtttgtcttcagccttttggtacagtttctttaacttctgttgagcttctattgcagatattggacacggcgtatcttctattgatgccatcatcgttagcatattcttccagctaaaaataaaatcaaactccaaagcctgtattgtctcatgtttttgaaaattgaagagcgaagctttattattctactttaatacctgctttctcacttttgatgttgactatcattggattcaaaaatggaatttatatttgatgtataaaaaaatagatcacccccacccccacccccagaccttttgctggtgcagtctagccaagtttcctagttaatagtcacgcacagagctgatggtggcaatactagcatttaccatgtcttgggagtcctgttctaggcgtttcacataatcaccttactcagccctgcacagcagggtgcattattatccacactttatagtcatagcagtgaggcacagggaaacaaagcagctcccacattttca

SEQ ID NO: 25289 - DNA, 1469 bp, Mus musculus
tgtgcatgtagtcagtcaagtcctgggacaaagaccaatactttacccagccccaagccacactgtccttcagactctctggtttctctgttctgaaagctaaactgttgcttctgcctctttcaggtgcctgagatgttgcacaatgatgctagtgatcacggatgcagccgttggggatatttcttcctgcagaatgctgggatacttctcggttttggaattatgttactcatttccatatttgagcataaaattgtgtttcgtataaatttctaattaggttctaaaccctagagcagcttaaagaagtactgttgtttgtagttccagtagatggtagaaatacgttcatatgctgtgatacacagcatttaaaactagtgagttttgcaatttttctatcaaattttgccatttgttatgcttataaagtcagttccattgggtaacataaaggtacgttttaatatttaagttattctgttttggaaatgtaaattctgtgtgtgatccaccagtattacccagctgtatgtttcggcatgccgtgtcttgtctattctagagaaaatgtctttagtgctcttctgtgtagctttagcattacttccctgctggagttgggcccttgctcgtgctgagaaagaatgggcacaaaacccaagacaccaacagttcacactgagcatagtcaggaaataggaggaaaagagaactcgggaggattgaggaggtatatattgctttgaaaaatcacaaggttggttgtaacgttgagagggggaaattctagatgtgttttaaaggggcatgtttagttccgagtacgtgcgtggacatctgtcaaattgttatgttcctgtgaaacaagtgaacactctgatacacttcatctgcttgtacatctgtatgatagagaaatgtaaatatgttaatccaagcaatgtgtcacttggctgagaaatgaggcatttaaatctgtgtgtggagatgggccaaatgagtaactagtgtgtcaccagaagacttggttttcaccatggtctcttatgcctgaagttatgtgaacattctagttgtctaggcttccaagtggcaagtattaaaactttagcccatgagaggatgttaagacctgttctgaaaatattttgacttcttggattcaaaaagcacttagctctctttctctctcagtgctttaaaatgtcattgtgaacaactgtcctttgatgtatgacactgtagatacattggggctgtctgtagcactgtctggatgtttctttcttaaaaaattaaagtgtcaactcagtggcaggccttgttctctttcttcttacagtcttagccactgtcaagcatgcagctgaggggttctgagtctgtgcacactgtcttcagaaccttttatcttgcaagatgaaaactagacccattaaaaacttccagcctgagatagtgga

SEQ ID NO: 25290 - DNA, 1193 bp, Mus musculus
gctcacggtggggacaggcacatgtgtgaacacaggtgccacctcgatcctgtgattgttcacccttagggatcttgcactcagaaaaatgtcttgtgctatactgggcagggctgggcagggtgacacacgcctgaaaaccccatgcttaggacttggaggaaggagtgccatgagtttaaggccagcttgaactacataatgagtctcatggcagtctgaacaatatagggaggctcttgtttcagaaaaaaaaaaaaagattaaaaaaattacccattacaaatgtgagccctctgtttaatggccctgtgatgagaggaaagtaagtaaaaataacttgctcctgagctgggcatgatgtcacatgcctgtgctcttagcacctggaagatgcaggcgtaaagattaagatcttagggtcatcatctgcatagcaagtttgaagccagcctgggctatgtgggtctcaaggggcaacacaaagaatagcttcttgctttttcctttttttttttaaagcttgggccaccaccacccagctggactctttcattatttattttatgtaagtgcactgtagctgtcttcagacactcgagaagagggcatcagattttgttacggatggttgtgagccaccatgtggttgctgggatttgaacttgggacctttggaagagtagtcggcgctcttaaccactgagccatctcaccagcctgctttttctttaatttttaaaatatttagtttattttattctagtatgtgtatgaatgctttgcctgcatatatgtgtatataccatgtgtgtgcttgatgccagtgaaaatcagaagaaggcatcagattccccccggtctagagttacaggtggctgtgagctaccatatagatgctgggagtggaacccaggttctctacaagggtaaaatgcttttaaccaccgagccaactctccagctcagccactttattttaatgtccaaaatcaggttccatgtggctgttttcattgctatactaagactggtttgaagacatcctttttatacatatatatcctttagaattattcttagctttaaaaataagctcatggggctagagagcatataatgagtatatgctgtcttaaagaagactcaggtttgttttccagcatctatgtggggcagcttccagccccctg

SEQ ID NO: 25291 - DNA, 1145 bp, Mus musculus
attctgcttctccctctgtgtcttgggatccttcctctctctgtgtttcacatggagttgtactcatgtggaaaaagctcaatgttcagtaggtgatgaaaaaccaagatatatatggggctggagagatggctcagtggttaagagcactgactgctcttccagaggtcctgagttcaagtcccagcaaccacatagtggctcacaaaaatctaatgagatctgatgccctctctggtgtgtctgaagacattgatagtgtacatgtacataaaataaataaatcttttttaaaaacccaaaaacaaaaacaaaatatactatttgagaagagattaaatcataggaggcctgctcaaacagtctgggtacacatgtttgttttgctggatatatatatatatatatacatatatatatatatatatatacatacatatatatgaatgaaaatgtcattcctctagatgactggttttattatctctgatcacattcttgggtcaggaatttgggaggtgctcactggtgttctgatctcagggtctctaaggggtttgcatcaaggtggtgcctggccagggttcctctctgtcttagtcagggtttctattcctgcacaaacatcatgaccaaggaacaagttggggaggaaagggtttattcggcttacacttccatactgctgttcatcaccaaaggaagtcaggactggaactcaagcaggtcaggaaacaggagctgatgcagaggccatggagggatgttccttactggcttgcttcccctggcttactcagcctgttctcttataaaacccaagactaccagcccagagatggtcccacccacaaggggcctttctcccttgatcactaattgagaaaatgccttacagttggatctcatggaggcatttcctctactgaagctcctttttctgtgataactccagttgtgtcaagttgacacaaaagtagccggtacactctcaaaagatgttttatctatagtcctggtgctgaggctggggaaacatgaatacccaggctctctggctctgtggtgtgtctactgggtctccctagaataatgacttccaggagctggagttcttgtacatcagtttgaggttcctatgatta

SEQ ID NO: 25292 - DNA, 1104 bp, Mus musculus
actcgggagttcagaaagagggtgggtgttcctccacgccttgcttttcaaaggtggctttctcaggattaggggtacatgcgtgtgttattcacgttgtggtgacagacttgggaaaaggggttgctcttggaagatcatgggagcattttgcccatttttattgtataggaaatacctaacagaaagtatttaaattgttcacctcccaagtcaaaaccagataaaactaggtatgacaggggactgattcaggatttaaaggtgagatgagaaaaccagcaccggaacatgcgttattcattatttcaagttcaagttccagagtgatagagacaggagggcagaggaagacattgggaagggcttatcgatggtcatattattgaagaaaggcctataaagaaattttcatttgtgtttataaatgaagaggcagtgcaatgcttcattaaggctggtgtacagatttctcaattctccctagctgtgtggtagagatattgcaatggaatgctggtctcgggccttgtgggcaaactgcagggtatgggtgtgtgctggaatggatttctttggctccgctcctctcctctcctctcctctcctctcctctcctctcctctcctctcctctcctctcctctcctctcctctcctctcctctcctctcctctcctctcctctcctctcctctcccttccctgtgggttccttgacaagtttccacctgccttaatatgctgcatggtctgagatgtcacatagggacaaatgcaaaatgtgaacttcccctgagtggacacgtatgtcctgtgatatctcgtgggaagggaactgaaataaacttggaggtgtaggtctgaggttcttgtctagaagccaagttagcatcacagtgactccagaaagtgtctctgctgtggaggtcacagccaggacatttctcagtatccaaatcaggcagggcaacttctatgtagatgattaacacatgttattctattcatcctcgagacatgatatccttgctctacagaaggagagagattcaaagagctttggttgctctcttagggatctagagtgagactgaagatgctgt

SEQ ID NO: 25293 - DNA, 1139 bp, Mus musculus
tcctaaaccgccctaatagtgccaccaatagctgaccaagtattcaattgcctgagactatgaggtacacttaatattcaaatcactctagccatgttgcccatacagaggaaggaaggactctggggacttgagcctctttttccttttatgtgggtttcaggactgaacccctgttgtcaggcttgtgtgccaagtgtttttttgttttgttttgttttgttttgtttttccatagccactatcaggaacagtccctacttaccccctactcaagaacaaagcaagatgacacacagatgcctgttggatttggaggcctgaagcagctgatagctctatagacctgtagatcaggctcttgcttcagagtccaagcaggattcagctctgctctttctggatcataaagtccttttattcacctggaggaagtaacagtgtggggatgctctccaagactgggaaggaagagggcacaagttctcttcggagcttccctttctccacccgctaagtgctttgagtccagatgccaaccatgcccatctagcatttatgggtgctagggctctgacctctgacctcatgcttgtatcaagcattaactgctttaccaatcaggccatctcatccattctgtatgtgccctctgtaaattattatcttaaaaatttcattccttagacaggaatatattttaaagatggtatagagatttcttgggtagccatgaagaaggagagaagcccgtagggctggtggtctttgtggcaggctggggagaagtgatgggtttttatctttaacagcagaagggatgctgaagctgcagggtcaagaagccagccatctcctgctttggctttcatcatgccagtcaactggccatcatgatggagccttctaattgcagatgagaagcaccattgactgcctgcaacctcagtgctcactgtggcctgtactgtttatgcatacatacctctctgggcttgtctccatatatgaaaatgtatgagaaacacaagctatataaaaatcattactaacaataaaacatgagaggtatggttataaaaagtttttgcactagtatattagccattttgtgtgtgtgtgtgtatgaacatgaagat

SEQ ID NO: 25294 - DNA, 1146 bp, Mus musculus
ccagagcccaggtcaatgtctgctatatagaagaggctcaaacattatctgatgaatgagaatcatttgatgtttttttcttttcttcaaacagaactctagcaatattctgttataaataagtggatctgtttttacaaacgaatggctacagttaggagacatggttgagtttgccagctgtgtctggccccatggctaacacagctcacaaggggaggcaggaaatgggtgggggttagggttttcatagatttctggaatctgaatgtaaggagaacttcatgttctgatgtagttttaagaacagggcagtagagtgcttgcctagcatgcacaaggccctagtttaaatccccaacattacacaaactgggttgaggtggggcacaaatgtagtctcagcacttggaaggtagaggcacaggaatcagaagttcggggttgtttttgtctctatagagagtttgaggctatcctgacctactctagactatttatagtctacttttttataatttataacaaaatgggtttatttcttacagtgctagagtctgggaagtctgagcctgagaggtttgtatctggtaagggcccacatgccacatcacactataggtgaaaacagaacaggaagagaaggggggcaaacttgcttctatagcaagccttttctctgcataaggaacctactcccaaagtaagaattttaatccattcttgagggcagcacctttatcccccacgaaccttataagccccaattctgttgcatgttgacttttttccaatacatgaatttggggagcatgtccaaagcatacaggcacattcatatagcagatgcgtgctaagcatacatcctttccatacacccatttttatggatgccttctctgcataggagcttctgtttttcctcatctttcaaatgaagaagtggaggcgggaaggggagagacttactgcctcagagtcagtgaagccattggtgggtaggaattctgaaactctgaatgcaatatgtattgataccaatacaaagaccatcatttgccatcaggaaaaagaggtggggaggtaaatgaaaaaccatatgaaagccaccagaacatgagggcttaagagcagtggatacctgac

SEQ ID NO: 25295 - DNA, 1170 bp, Mus musculus
tttatgaaatggtctgaaacacacttctgctattttatactatgtatttgcatgaagcaatgtttcaacactgacagttattaaattaaaccattgatcaattctgaaaagtaatgaaggggctctgtatgctgaagtttttctgaaatattcagccaaggtttaattctttatgtaaaaataaataaacacattcatctcattggtattcagatttgctttagtcatcaataaatgtcaaagtaacatgtataccaaagaattattttaattatttttgacatttattgtctcagaaaatggggttgtatccctgttttacatgactacctgatgacctgacaaaaatgtctgaaggaaggcaggcttacagttctagggaatacagctcagtgagggtgtggtggtaggagcaagaggcagctggccacatttcatccaccatcaaaaaggagaaagtgatggctactggtgttcagtacactttcttcatctgtctgtatgtctatctatctatctatctatctatctatctatctatctatctatctttttgttgattctttgagagtttcccatcatgcaccccagtcccactcatctccctgtccctttgtacccaccctcttcccttgcaacctttcctgcaaaagaaaaacatatcgtgtggtagctgtagtgtgtcagtgtgtcccacagcattcccttttgttcacacttctttacttgcaaatggtcactgcaatgagtcattagtctggttcgaggcctctgacttctactacaccatcaatactggatcctcactgtgatcctctcagacatcctgttgttgccgtgggtcatggagatcctgcagctttggattacaggaccagccccttcatgtgtgccagcagttcatcaatggggtagatgttggagtgggctcactcacagccctggatcttggcctgagctggtcagaccactgactcttcccacacccacaccaccagagcaggctctccaggtctgccctggctagctcattcaatggagtacagtagctaacaaggggcagggtcagctctcctactgtcatgcccttgggactggctcaccctcacccgcagggccagttttactgtgctgcccaggtgaggtgcagggcctactccctagagtgct

SEQ ID NO: 25296 - DNA, 1182 bp, Mus musculus
tataggtgtgagacagcaggtttaaaagggtcacatgagttactaaaacagctgcctggcatgggtcacagtcacataatgataacaactcagagacattactagttttgagctccattagaaatgtttgaatagctcaaagccagttacacaactaagcctaggtggaaggggatgacacagggtggtgtgtaagtcactagagacctaatattatacggttatcagtgtagctcatgggtggagaatgggtttagcatgcccaggcccagtggtctctccctagagccatccacccaaaattaatatttgatcatattaagaagttatattaagtaggacaataatatagtgattatagtggttttagcaatcattttagtgaatatattaaaatatttacagatgataatgatataatcttagatagctctttgaaaaattggttcatggggttgaaggcaaaagtgagagagaaaccctgtctcgaaaaaaaaccaaaaaacaaaaaaagtgagatataaatggtgaatattgtctctgtgttggcagctggtgcactgctgtgggtagtgtgcatgtcccaccgttcccactcatccctgtctcttgtgtctgtctaaaatttccacagtaaaggagatttaaaatactatgccaagacaagcattgaaaccatccacctctgggtatttactaataagaactagaatcaaaggtttcagaggtttctaaagcaattgtgcataattcactatagcccctcttcttgttcctacttacaacaggggcttatatacagtccaggctggccttgtgctcagaatattcctgccttggctcccaagttgctgggattataggctgtaccaccacacctgactatacaactctatcaccactaccacctcctcctcctcctcctttcctctcccttcctcctttgaccagtatcttgtcatggacccgaatttgagcagttcccccagtgacttgtacatcacagcattgcctggattacttcctgagattcttccctttgcatgaactttctgttcatctcccctttccttgacatggggcaatgaaatcgactcctggacgctgtgcctctcagggaggcactgtgagaggaatgtcacttgatctttggacctttgaggttagacaaagaattagaaa

SEQ ID NO: 25297 - DNA, 1148 bp, Mus musculus
cactatagaaaaatactacatgctcgaggctcaagactaagaactgtgtttccgggcctgcctgtcaattacttttgtgctaactctagatttcttctttgtgaatttatttgctaagaaatgcagataaactgccgagtcttagagtaactggaaagccactttcaggagtgacagatgtaagttggggacagttgtttggggtgaggatttagaggtgagatatctggctgtgcccctggctcaggccagctgtttctaattatgcttggtcagattatacagattatactggcttggagagctaatattgtccctagctgctagttgtttgatcttctattgtctctttgctatgacttaacagacaatatgaacctggagaatatcttgggtaagataatttttgaatgtctaagttgtttatacactgaatggtacctcaaccatgacaaatatcaataaatatttagtgatcaagagatttttgactttcatcccagaagaacatctatttatgatgtaactgaattattgagaaatctgaaaacttattgattaaaaaaagctaggctctgtcattttctttgtctggatgcagctgtgtaggactgtcccatcttaatgtctgcatgcttctttgatgcccttggcgcttctgtttgaagcttgactagggccagagaggctgctggaaaactctagcagtttggaatgtcttactctcaaaggcttatccaaggatgagtgaggattaaagtctatcccattcaacttgttggaaccagaacgggaccagtgtgtctaactttcaggatgatatttccacagctcagaggaaggcttcatgacctagtgtttggggtcttatcacatgacttcaaaataacaatatatcaataaacagtgcaaggacctgggtcagcattccagtttctgtttatattatgaaatagaatatttacggtgctttatcaagcacacagtaactgaacctgaaactagctactgctgctatagttggaactcccagttagaagtaacttctgaaaagaaagagaggaataaaaattttagatatgtgtgtgtatgcatgtatataaataatatagagtatagaatgctatattaggtttcataattcataa

SEQ ID NO: 25298 - DNA, 1189 bp, Mus musculus
ccatttaaaatattgggcagtccgaggtctaagggaaagcagtccacatcagcagatgtcttaccacagcaggcatcatatcctgtagtgcaggggaggacaccataaagcacttgcctgcaaagcctcactgagctaaatctctggggcttgcctccctcctgcccccaacagcaaataaagtctttaaaaggttagttttaatcggaaaatccagactctctctaggaaagagtgttttctgctcctttcaagctttctttagaagcaagttgtattgttgatgtaaaaggtgggttgctacagaagaggagaagcagtccctgtcaccaaaacatagtgttattgttttcgtcctgtacatacttcttccttttctgcaaagaattcaacaataaaatcaaaattcaatattcccattcagtactacaggatactctgctgattcacttgtaatgttcactgcctcagccaaggagttcaagtgctccgagactgtttccaatgtgacctcagaagagaagagagttgtttcataacagcttctgtgtggtttttgaagttcaaaattctaagtagtgttaggtgttagccttacacttgtcgacaggagtttaaatgtttagttctctttatcttctttgttgtggcttgggcaacagacttcacacctccttttgaaaggcgatggaaccacttagggacttgatcctgaggcctgagctccccctgttctacaaggccacaaggacccttggaactgttctgtatgtagcagctggtaaggaaactttagttcaggaaattgatattttttcgctgcacatatttaaacaagttccccagtgagctatacagcaaagagctatttgtgagaatttcttgaaatttgaaatatttaaattataagggatataggcagtaggaaaatgtatacttgttcttttgtgttttattttgtttttgtttttgaaactgggtcttgttgtgtaccccaggttggccttaaacttgtgatcattctgccccaacttccctagtgctgggattatacttgcgcatcacctcacccagctcttttgctctctttttctaagctctcacttgcaaaaatatgatgttgtttaactatagggaactgaattctgcatcgttcagttaattattcctcaagtgttaaatgtctggt

SEQ ID NO: 25299 - DNA, 1102 bp, Mus musculus
tgggagtgctgggttctgatgatggtgagtggtcttggttcctgttagtaggattcttacgtttacctttcgccatctggcaatctctggagttagttgttatagttgtctttgtttagagattgttcctctgttgcttttgttaccctctatcagcagacgtgggagactagctctctcctctgagtttcagtggtcagatcagtctctgcaggcaagttctcctctttcagggaaggtgtacagttatctggtgtttggacctcctcctggctgaagatgaaggcccaaaacaggatctttcccagaagctgtgttgctttggtcaggaaggtggccggttgtctggagccgaagatggcgctgcctcagaagctctgtggctctcgccaggaaggtggccggttgtctggagccgaagatggcaccgcctcagaagctctctggctctcgcctttcccagaaatggctggcctctgtattccacaccgtcacctgtgcagcctacccccctcggagtcctggagccaaggagactcccggcgccagggcctgaggcacaaacctctcaggttggcggatccctgtgcactcaccaggaaggtggccagttgtctggagccgaagatggcgccgcctcagaagctctctggctctcgccaggaaggtggtcggttgtctggagccgaaggtggcgccgcctcagaagctctgtggctctcgccaggaaggtggccggttgtctggagccgaagatggcgccgcctcagaagctctctggctctcgccaggaaggtggtcggttgtctggagccgaaggtggcgccgcctcagaagctctgtggctctcgccaggaaggtggccggttgtctggagccgaagatggcgccaactcagaagctctctggctctcgccttcccagaaacggctggcctctgtattccacaccgttacccgtgcagcctgccctccgcggaatcctggagccaaggcctaatttttttttgaagatatttactggccttttaagttgacaatcttcattctcatctatacctattatcttaggtgtcctggatttcctggatgttttgagttag

SEQ ID NO: 25300 - DNA, 1127 bp, Mus musculus
tcatagaacagccatttatgctttacttctttggattagcatcattttaggtggattctcattgtgccacttatcaatagtttgttccctttttgtcaagtaatattctactttatagatgtaccatgcttttttttctcttcaggacttaatagacatttggaatttttgttatttttaacttctatgaatcatgatgttataggcaaattttttatagatgtgttttataaacgacagtctaaaagtcatagtaagtcattaatcaatttaatactgtgtccatttagcagaacaataagatgtttgtcctttaaagactgtgacccatctagccacaggttcttggcccagtaatggtaccagacagggatttcatcacctggagcaggacaaaatcccatcagaaagaagctagtaccctcttgatgtccatccttgtcaggcccatcgttattatgacttaaagagctcccagctgggtaacactgatgatggtttttctcctccacagcatacagaattgctttgagtttgtactggctggttttgtgtgtcaacttgacacaggctggagttatcacagagaaaggagcttcagttggggaaatgcctccacgagatccaactgtaaggcattttctcaattagtgatcaagtggggaggtcccttgtggatggtgccatctctgggctggtagtcttggttctataagagagcaggctgagtaaaccaggggaagcaagccagtaaagaacacccctccatggcctctgcatcagctcctgcttcctgacctgcttgagttccagtcctgacttccttggtgatgagcagcagtatggaagtgtaagccgaataaacccttttctcctcaacttgcttcttggtcatgatgtttgtgcagaaatagagaccctgactaagacagagttctatgaaagctacccaatatgggtgaggtttccaggtcaaccagcaaaccagcttgtcttctccatgttctaagtctcaagaatgtagtaattttagcaaatagggtcttatccttaaattctagcaggtaaacaataccattggcaatagactgtaatgtttaggaggtctatgggtcctcactggccaa

SEQ ID NO: 25301 - DNA, 1239 bp, Mus musculus
agaggcgctttgattaccccgattgaagtctctgaaactttcctatggttttctgtattatatgtctggatggagctgtttagatacattgattggtggatatttggagaaagcaacaaagatattaagtcattaaccatgaagagaacacgaggggaaccaggggacttcgaaggcaaggtaattgttgtgaaaagtctgtaaatgcttctaattcttcccccctcttaaaatcataatagttgtacagaattttaaaaggaaaagtttaaaatacctatatcatagaagaaaaaaaaattagaggaaagcaaaaaaataaaaaaaaaaaggaaaaaaaaaccttatagaagttagcattatgctaaaatcccagatgttgtaggactgtacttctgtagagtttagactgagcatcgatcccgtctccccgcgagtgctgtcggactccgtccccaagggccaggccggactgtccagacctgcaggctccggccagaagcgccgctccggaagcgtcctgccgcctctcgctttgccagcctgggagccgcgcgcatgcgcgctctctctgcccttctcacctctgcttcactcgccttctgtgcttgttccggagactttccaggccagggagaactgggaacttctcatcttcaaacaactagacaacacacacacacacaaaaccttaaacaagagagagaaaacaaacaatctttgaagaatttctgaaactgtttacaaggaattttgaaaaacagggatgtttaaatgatgctggctctgtttttctgtaaataaatttgcatattttgtaggacttttaattgtaatgatagagaaaaaacaaggaaaactatttaatgaaagcacgatatttatctttggtaaatgactttagagcagttaaagacattgcttaaaaactcagaatcagaaaaacactgaattatttaagaacacatatattttaaagtataacatatttattataatttatttgcaccttgggaagacttgctttgcattctgcctcaagagcttctcattgatgtccatctggaggccaggggggtcttggaactaccatttttttttcctttagatcaacaaaattctggttgccctcaggcctccttccttttctttccatctattttgttgttgttttacttcatttagttttctttttctttctcttgactcctccttttaggatgtccagatgttgtaaaa

SEQ ID NO: 25302 - DNA, 1197 bp, Mus musculus
actgatccaaatcctattggtggaaagattcccttaacagacttgtagcccccaaatgtttgcaagcatgtatttcaaactacaccccctctgggtctgactcttgtattggtcatctcctgcttaggtgactccacacacgtcactctactccatcacttacacagtaaagactgtgaggacaattccttagagaaacgcgtgtatcaactcacttagctctgctctcctgtaccccatgcagcaaatgtctacacatagccctcctccacccagttatcatctctaaaacctcgcaggggatgtccccatgcatcagacagctctgagggccgcaccatcacatttccccaaacccaggacccgaggtctgcggcgggcttttccctttccttatccctgtgccctgcagtagctgagaaccaacttccactgttgagctgggcaggagggaacagtctctcaaaggccctgtttctcctgaagagcctgccttcctgcaacccagaccttcctcagttaagtcagagccacaagggatggaccaggtgatccagccacagagcagagagctgtgcccaaaaggccacatggctcctgttacttgctcatctctcactgtactcagatcccttaatgaatgtgtcttaaaagcctatgaatctccaaatcctgctgcacattcacatgtgcatgagcatacacacacacacacacacacacacacacacacacacacacacacaccacatcttagtgccatactaacccgtcacacatgactgcccttgctaccatctttaaactcaagtctcctgcttcctgcacccttgctcccaattcccattctgtctgccctgtgggcctagctgtggctttcttctcacaatttttccagctctgtgcaaccttagccacaccctgctccccatacgaggccctgtgccacagtcctcttggagtccacaagtcccttccttggagctgaaatattccatagacccatcactttcccctgaccatgacctatgggctccctagggaagtataaggcaagaaggagtggggcctgaatgcagaaactgacagacacatggtgcatacaccgttgggttaggacactgggaacaagttttgggcttggaaggaggaagactctagcacacagaagtagggaggtgtgtgctataggtatgg

SEQ ID NO: 25303 - DNA, 1162 bp, Mus musculus
aaatggatggaagtagcaaatattatcctgagtgaggtaatgcaatcacaaaagaacacatatggtattcattcactgataagtggatattagcccagaagctcagaatcccaagatacaattcacagacatgaagctcaagaagaaggatgaccaaaagtatggatactttggtcctccttagaagggggaacaaaatacccatggaaggagttacagagataaagtgtgaaacagagactaaaataaaagccatccaaagactgccccacctggggatccatcccatatacagtcaccaaatccagacactattgtggatgccatgaagtgcttgctgacaggaacaccacataactgtctcctgagtggttctaccagtgcctgacaaattcagaggtggatgctcttagcaaacctttagacacagggtccccaaaggaggaaatagaaaaaggatccaaggagctgaaggggtttgcagcctcataggaggaacaaaaatatgaaccaatcagtgcccccagacctcccagggactaaaccaccaaccaaatagtacacatggagggacctatggctccaggcgtatatatagcagaggatggcttgttggtcatcaatgggaggagagacccttggtcctgtgaaagctctatgccccagtgtaggggaatgtcagggccagtaagcaggagaggatgtgttggtgagcaggggggatgggaagggaataaggggttttctgagaggaaaccaggaaaggggataagatttgaaatgtaaataaagtaattatctaataaaaaaggtaaaaacactaaaaaacattaagtgcttgttgtttaatttcttattttattcctccatatactgtgtgacatttatgattatttgggtggggcggtaagtgaataacttagtcactgacacttatccagaggtcaaagaaattgtagctattacttcaatattttagcttagttatttacttaatctaaatgataattccttatagaatgatgttttattatatccgtatgaagatcacttgtatgtgataagtctctttttgcccttagaatcctctttggagttttgaccaatggctagtgcgtatatcctacactatttgtcttggagtttattaagctgctctagc

SEQ ID NO: 25304 - DNA, 1099 bp, Mus musculus
taggagcacatttcggcttcatttacacattacatcatgagtaatggtgtccctattttgcaatgatgaatttgaagatctcatacttgaccgtaggttcacaaaaattttctacagtacaggttcacattccattttctttggaaactgacacaggaagctgaatggctctgtggtcttttgacatgtgttactgatttttttctgatggtgaatggtcttcctattggcagaacaactagctgcagggtagctcatatgagctggctgttgaattatggtagtgataaccaggtcagaagtaaagggaccactcaattctcatgcacttccccaaagactacatcattttataacttcctgttgagaaataccatgtagactagctaggatggttttcactctggtacttttcactgtccctctcttctgtgagaacttgaaaccttcactaaacaccattcttaacataccatacagtgggatgatagagattaggacaactcagtcaatctggctttgttttctgaaaaaaaaaaaaaaaaaaaaaaaaggtcagagtgggtttctgttagatgtcagagaactcctgaatgtttctcacattcaaataaaaatcaaaccactagaacacaggaaaaggcccatagcaaaagaaaatcaaagcaaacagccaggttaattaaaaggccctttttacatagctcagaatactgaagctatattcacagagcccaagagattactctctgaacagtttgctgctggctggctgctgacttctgaggacctatcatctgttcttaaaggagtaaaggataatgcttattgtcccttgtagctggtttcctcattcatttccctttataaaccttagtccctgacatcagattttctgatgaccgttgaaagatatttccatgtctcccactcaagggaatgcccatctgcctaaactccatcacttccagttggacttgacacaaatttgtcactaacagcaatctctttttctttgctttcttcaacccaagactgaacatctgccttgtaccctggcaagaatattacatcccacattagcaaacacaatatgctc

SEQ ID NO: 25305 - DNA, 1825 bp, Mus musculus
ataaccaaagatatcccaaaagtacccagtaaaaaccagaatgacccatagctaggatgaatcaaagttgactttgtgagtcctaaagaacttccctttggagacaaagacacaaaatccaaagtgaacctgctggaaggtgaccatgttagctttaatatttcaacagaccgacgtgacaaattagatcgagcaaccaacatagaggttctatcaaatccatttcagttcactaatgaagccagagagatgggtgtgattgctgctgtgagagatggttttggtttcatcaagtgtgtggatcgtgatgctcgtatgttcttccacttcagtgacattctagacgggaaccagctccacactgcagatgaagcagagttcactgtggttcctgttatgctctctgcccaaagaaatcatgctgttaggattaagaaacttcccaagggcacggttttagtcccttcccattcagattgtcgttttctgggcaccatagaaaaagaagccacttttttaaatcctaaaactacaagcccaaataaagacaaagacaaggaggcagaagatggcattacagcttatgatgactgtggtgtgaaactgacaattgcttttcaagccaaggatgtggaaggatctatttctcctcagataggagagaaggttgattttaggattagtgacaaacagaggcctggacagattgcaacttttgtgagacttgtaggtcataattctacctccaaaaggctctcgagttatgtggcaactctgaaagataattttggatttatagaaacagctaatcatgataaggaaatatttttcattagagtgagttctctggtgatgttgatagcctggaactgggagacatggttgaatacagcttgtccaaaggcaaaggcaataatgtcagtgctgagaaagtaaacaaacctcactcagtaaatggcattactgaggaagctaatcccaccatctactctggtaaagtcattcgccctctgagaggtgttgatccaacacagattgagtaccaaggactgactgagactgtgaaggagggggatatgaaaggtgaagtgtatccttttggcacagttgggatggccaacaaaggggattgcctacagaaaggggagagtgtcaagttccagttgtgtgtacttggccaaaatgcacaaactatggcctacaacatcacaccccttcgtagggctactgtggagtgtgtgaaagatcagtttggctttattaactatgaaataagagatagcaagaagctctttttccatgtgaaagaagttcaggatggcgttgagctacaggcaggagatgaggtggaattctcagtgatcagcgcactgggaagtgcagtgcttgtaatatttggcgagtttgtgaaggccccaaggctgttgcagctcctcgacctgaccggttggtcaatctcttaaagagcatcaccctggatgattccagtgctccacgtctaattgttctttgtcagccaaggggaccagatagctcaataggatttggtgcagaaagaaagatccatcaagctggtgtcattgactaaccacatccacaaagcacatcattaatccactatagtcaagttgggggtattctggtgaagggttctgaataactcccgcttcattcctcacaaaatctggaatacttattctactgagcttttacaccagttttaacaccttcctcgtgttatgttaaaagaaaaaataaataaataaatttaagaaaccattttaaaattaaaaaagaagaagaaagaaaaaggcaggtaagatta

SEQ ID NO: 25306 - DNA, 1318 bp, Mus musculus
tgcttcatctgcagtgtggagctggttcccgtctagaatgtcactgaagtggaagaacatacgagcatcacgatccacacacttgatgaaaccaaaaccatctctcacagcagcaatcacacccatctctctggcttcattagtgaactgaaatggatttgatagaacctctatgttggttgctcgatctaatttgtcacgtcggtctgttgaaatattaaagctaacatggtcaccttccagcaggttcactttggattttgtgtctttgtctccaaagggaagttctttaggactcacaaagtcaactttgattcatcctagctatgggtcattctggtttttactgggtacttttgggatatctttggttatagttccttcaaaatgttcagtgctgatatcttcaaaaatgactgttccttgaggcaatagtctgacatctgttgcaacttctttagcatttctgtacttgattgtgagttccacgtcatctccaggatgtagggatcatctgactggaggactgggaaacctattgctattaaattggtgaagataaaaccagaaatacatcctgaagaacgaatgaacggacaagaagtattttatctgacttacacccctgaagatgtggaagggaaagttcagctggaaactggagataaaattaactttgcaattgataacaataaacacactggtgctgtaagtgctcgtaacattatgctgttgaaaaagaaacaagctcattgtcaaggagtagtttgtgccatgaaggaggcttttgactttatcaaaagaggagagtgatgttgtaaaagagatattctttcactatagtgaatttaaaggttacctggcttcttacctggcccagaagacatccaaatggctgactgaagctgtgtatctctgaagattttgaagagattcacattttagctagcagctgagtggaacaaatgattctgttcagtgtggccggccattatagagttttccgagaaccttagtccattttttaaaggacctgaataagctctgagtgagtgagctaggcactgttcttctgtgactctcggcaatactggctcagatctccacaaccaagacagaagctataccattggttctcaaacctttacaggatgtccccagccttcctgggtctcttgcttaacagataacattgtggtactgattttctccataactccttaatctatactgaacataaaactgcttcataaatgaacattttctgtttctttggaagagaatatatatatatatgacataagatattctcctctca

SEQ ID NO: 25307 - DNA, 1193 bp, Mus musculus
tgttcttgataaggcaaagaaatctaaaattctatctcactgatttcattttctttcttgcttttttaggtattccaatctgatcttgaacttgttctccttgatggttgatgcaaacattccagatattgctcttgaaccagataaaactgtaaaaaaggtaattttttttaatataacacagttcacatttgacatataaaagtgggtaaagaatttaacagtgcatgccttctttttgtcccagcccttggaccagtggttcccacccttccagatactacagcctttagtacagttcctcatgttgtggtgacctcccaccccaaaattacagttgtttctacttcataatggtagcttggctactgtgatgaattctaatataaatatcagatagttcgcaggcagatcagggtcctgagctacaggttgagatctactgccatagaccattgagtattaacagagtctaaggaagagtcctctctgtacatttagtcacatttcagaccagcaaactctcagctcttctgtggcaatcctggtcagtcctgtctggattcatctctgtacccatgtgggtagctccacctttgccattgccaacaaaatgcctgacttggtggatgcaggtggaacatgctgaggctgccctatcatggagatgaagctgtctctatagccccatatgtcctccctctgttttggactttactggatcactatagagccctgcttttagttttctttgtaaacaacctatagagatgacaggtaggatccgccacctgtgagcagcagcagtcagctcaatgtcttaacgagacttggaccaggccgtggatttgaagcctttcctttaatctgatttctggtagtagcttcagaggagagctgatagaagagtgctttatgtatccaaagggaaaaagatgattgtcagtattcaacttcagagaaagactgcagcatattaactcagaaaagactaaaatctccgaaagacattctctaagatagagctagctgctcaggatttaaaagtggaggctgacatcaacagatcctatgtctaatggaatggactggagaattacgttcagctctaactgagccagagggaggtcagttcttcccttaggtggctggctaagaggagtttgaatggaggtattttatttagtctcttc

SEQ ID NO: 25308 - DNA, 1151 bp, Mus musculus
agaaaaacacaggtacatgaaaactcatgcatgcatacactttattcttctagtactgagtgctattgaaaatgagcaatgctttaaagtatgaatttaaaaacccacaatcccatctttggacattatagacccattgaaataatcccttgccaaggtccaaggggctgctgtgggaaaggcttttttagaagatctttaggttaccaggggttgacgtagttgctgtgcactagcaccaggtgtatgcaggccagggcgataatgtaataaatatgctcccaccttattgtgtctatttctgttacatagtaggtcttgagctagaatgttcaagcagaaagtgcaactctgagctaaagtaatagcatttctggatttaaaaggagtcagtgtctgattgggagagagcattcagagctcctgatgggcataactcttggcatcctaatgatgtctcttcagagcacattcctgactcattcattaaagaacttgatgttgtccctggtcctctccaggttcaggataagttccgcctggacctgtcagatgaggaggctgtgcactacatgcagagtctgatcgacgagagcgtccacgcactgttcgccgccgtggtggagcagatccataagtttgcccaggtacgtcccaaaggcttagggaactttgggtggcatttggtctttaaaaacttctctggtgaggccagcttaggctaaagggccaaacaccagctaatgtctgtccaggagagaaaatcagctcaggtaaggactaacctagacatgtgttaccattcatgccatttctataaataaataagtagaaaacaaaatatacaccaatttttgaacacaccattaaatatccgaagtaataaacatttccacaaaacctctttgtgaatttattatttccttctaaaaatacctactggactttactccagccgaggtcatgagtgggaactgagggagctggtctgttgaatcctggctgttcctcgtgtgctaagtagtagagatttttctaatgtttatatttcgtttttaattgtgtgatttagcatagtattccctttggggggggccatatttttgtttgtgttctgtgcttttggagtttccctgtgtatatattgatga

SEQ ID NO: 25309 - DNA, 2298 bp, Mus musculus
cctgtctttcatttctcaaagaacttatctgagagggaacaaaatgaaagttctggggatttgtgcctcttgctcaccataaataatcactgcaatctttcttttttctttcctttttttgtatgtgtgcgtgtgtgtgtgtgtgtgtgtgtgtgtgtgtgtgtgtgtatgtaaagttttattctccaaataagctaccctgaagataaaaatgagacattcttggtactctttatttaaacttgcttggataagtactgaattaaagtacaaacctcataggaaatttgcccttatgtgttacgaaggaggaggaggagacactatatttcaacaaatgaaacttgttaatcagcttaataaaatgaagttgatgtgttcccatggtggattagactctgtaataaagtgatgtatagttcactggtcactcatgcagcagttagcattttatttcttcatggctatgctcaagtttacaaacactgaagtgcagtgcctgcaggtgttgcccaacctagaatgcatgcaaactaacactgatgttacatgttaaatgttgcagagggtgtttggactgtgactgatcagagtggaagcttaatatggtcgtggaaaagcatgaagtaaggtgtcagtagcagctgtccctaccagtctgtgtctttggagtaatgctgtcaactcttcagttcctcaaaagggaaaataaatgctgttgatcacattctgtattttatggttaatctcttaacgtgtttttctctgtgtaaaaatggggttaacattttttactgacttttagctgctaaatttttaggtgtttatagtcaccttcctcagaatttcattttgtaagtcaaggtagtttcagagaagaaaccagaaaattttggtttcagaaaatgtttagaacagtctaaatggaatcaaatatttactgggtaaattttgtggaattttccatgtgcctgaagattagatattcaaggattatttattgacagataccatgaatttagtaatataaatttattgcatctgaagtcaaaatgctgctgctgaactaaatacatgattagtctcatttcctgtttccttgcagaaatccacgcaaattaccttaaaataaagatggagagagtttttttttctaactgcttttttttttaaatttgttaaaatgtaacctttgaaagtcaaacacattttagttggccagtgtttctcagtgaattgataccttttacactcagtatgacaaatagccccgtagatgtgattctgttaagtagaatgcaacaaagcactcactcgctgattgtgcaaaaaaacgctacagtgcttttattcgagaatctcataatctgagaagcagaagacgctgccttgacagctgtactgttgttggtcgaggtcatggaggatgtgtgctgtctatgtgggtgtggatgctgtagaacagaaaagacatttccagctcctgcaaaaactacctatgtggagagccgtgaacaatcgccattacaagatggcgctggcttctgcagtgcctaactagtaaacaagcaatgtgcacgggtgctggagtaaattcgtgccaagtcactgcccatctcggggtgtagcagtggggtgatgagtgagcagctaatcaggagctgacgcgtcacacggaggggtatttaagcagctccattttccgggttcagggtcttcctgagaagtaagcaataaaaagctttgccgtagaaggacccggttgtccgagtgtgttttgctggcgagatgttacaaggacacacctaggttaagtgacttagaaaacttatttaagggttcacatcacactgaagttagagtactacttactgctggcatttctgcgttctcttcaagtatttggcataatacatatcacttccctgcccctgaataggtaccatcttatttttattaatagagtactagtttgtatagcagagtaacaataatctgtggtttgactcttgtgtcttgttattttatttatttctaaaatttattaaaggtttattttctttattttttaaaattttgtcacagtaccattttaaatgtcttaggtaataagttgtaatgtaaaaggtttgataaaatgttgaattcaagccaatatatatgtttctcttattgatactagaggactactcatggtagggataaaaggtaatttttttttctagatagaaatgaagatcaagagaaacatatatgtaaaattgaacatttgccaccacctatttaaaaaaaattccc

SEQ ID NO: 25310 - DNA, 1158 bp, Mus musculus
caccacatgtatggctaatgctttgtggtggtcagaagagggcattggcttccctgggacccacaacattgtgggtggttgtgagctagctaccacgtgggtcctgagaactgaacctttgcaagagtaggcagtgttggtaactgctgagccatttctccagcccctctgtttttcattggcacacaaagtagtaggattcttaatggctgactccacactcagtgcgtgtgtctctgaatgggtgagctgcaccacagcacatggagatcagagggcaacctcagtgtctgtcctaaccttctactttgttgggcacaagggctcttatttttttctcagcatatagaagctagcagtgatcttccaggcatcctcctgcctctgcctcccatctctgtaggagctctggattccagtcagtcaggcttcatcttctgctttgatgtggattctgaggattcaaatttggcttctcatgcttgcacaggaagtgcttttaccctgatagatctgcctagccttgcctgggctgtgggcccttcctttactcttttcccgtcctccttcctccccgtcctcttccgtcctgactagtttctctccatgataagtcacatgtgttccattgcccctcctcactctagtttcaaggcctatgctcatacacacacatgcatgcatactacatacatactacatacatacatacatacatacatacatacatacatacatacataaaaatgaaaaacaaggttttgcaattgagagtttacctgttggttgagtctagattgcctgcctcacttaataatttccagctccatgaggtgtcttgcaaattcattgttattactaaataaaactccacgtgtgtgtgcaccacatttttgttgcccatttttctgttaatggcatctaagctgactcttgcctccttactgctgcaagtagaacaataataaacgtgggtataccagtatctctgtggtaggatgggggtcttgggaatatgccagtgggggtggagggtgcagtacctgagtatcacggtaattgtacattttatctctcttttttggtttttcgagacagggtttctctgtgtatcactggctgtcctggaactcactttgtagaccaggctggcctcga

SEQ ID NO: 25311 - DNA, 1146 bp, Mus musculus
tccagtgtagggaagccctgtgccatagagtacagtggggtgtgagtgcccctgcttccagagccagggtgacgccatcagcactggaaaagtaagctgcaaggcaggcttgactgacgggagcaagggtcagaggggcgttaatctctggctttgtttattatgaagactttgtaaagttctttttaaaagctcagttcagcccgtggtgacacaaccttaataaaaacaaaagacaggcccagagagatggctcttgctgaacttgctctttacttttttgagaaagtagaaatggttgagagaatgtcctgctgggtgtggtggcacatgcatgctacctatgatagcagggaatcatgagtagggagggcaagcctggacagagcattcgcaagagaccaaggccagagagatgtctgggtgggtaaagaacacttgctgtagccatctgacccccccaagaaccctggaaccgttgtaaattccgaatcctgtggcatgcgtctgtgaattctgaattcctatagtagagggtggaggcaggaggattgcctaaaaactcacaagcctggagtgtgggacaaagtaacacaagcaaaagtccctgccccacccacaagctgggaggtgagaactgacttaaaggttgtcttgggggctggagagatggcttagtggttaagagcagctcttccagaggccacaggtttaattcccagcacccacatggcagctcaaggctgtctgtaactccaatttcaggggatctcacacccgtgcacttgcacatttttttaaaaagttgttttctggtcttcacacgcatgccatggcacgcatatacgcatgctcagacataaatctgtacagaaaagtaaaggagagagttttcacagctgcagctagtaatgttgcctgttgttgggggctgggaattgccacacaaatcatacaccataagagtggctgtccaggaccacaagaaggaactacttaattgtggcaccagtctgtcctcagggcaggctttttatatgaaatccaggttcagagattggaaggcaagtattgaagtggtagaacactcttggctaaggagacacagtgttctcagtcagtctgtaagctgggtcctgagggagg

SEQ ID NO: 25312 - DNA, 1396 bp, Mus musculus
ctaccgcagcaaacagtcctgtaaaagtgttcatctgtgtgacatcaggtaaccgtgtgtctttttctgtctcagggaaacatgcagcggtgtaaactagtgatggaccaaatcagtgaggccagagactctatgcttaaggttctggatcacaaggaccgggtgctgaagctgctcaacaagaacgggacggtcaagaaggtgtcaaagttgaagcggaaggagaaggtgtaggccggaagaatcaggactcggaaacagaatttatgaagaatgatgctgcgggggtcgggggggagggggagagggctttgctactttgacaatggagcattgaattacaggacacttttcttcattcacttgaggaagcagatctggtggcacagaaggatcagaactggactgacgtgccgagtcctccttcctccagacgcacacctattgcacctcagttttcagggactccagacacttggtgacacagatggccggctgaggtttcagcctttcagcccatagactgtatttatctggtggattcctgtagggcctgagctgagcctggactgaaagtatccacttggacaatctatcctctctagactaaacataaaacctcttcttaccccagtcacttctcctgtttgactgtccagtgcccaagttggccttctacagtggtgccacagcacccagagaactgccacatctcacgcaaaaggatccagcgatcagttcttgtcattttcaaaagaaccatttccaagtgacactgttacactgtctgccctgcctgtgtcagagctggattcttgtggaggttgagagcagacaacactaactgctctgggatcctgttctagaggacatttcagttatctgtccttccctaccgtgtgatgctgttagtcatatgtaccacgcatctccaaacatcaataaaggactagaagaggtttttgtagatgagcagtttgcctctttctaaccagcacctctcaagtattcactctgctgcactcccagagttcaggctacttggcagaagtggtggtccacattgagttccactcatcccaggaatctgatgatgtttttagtggtaaagactgttggttcttacttgttttaagtaagcctgatataatgccagacacaccactaatcccagcactggggaggccagggcaggcatatctctatttgagactagcctggtctacagagtaagttccagaacagccaggggcacacagagaaactgtgtctcaaacaacaatgatgacagtgacggtggtggtggtggtggtggtggtggtggtggtggtggtggtggtgggtggtgggtggtggtggtggtggtggtggtggtggtggtggtggtggtggtgat

SEQ ID NO: 25313 - DNA, 1112 bp, Mus musculus
aaatgctcaagttcctcctgccttgtcaaggagacctggaaatcagcaaggaaaattatttgccccaaaagacatgggctctattggtgtcagtcctgacttgagcataggcattcacaagttgaagtacagtcttggtcacctcatgggaacatgtggcagatagctctcaggaaaaagcaattgtggattgtccacttgggggctttgcatagggaggtcaagctctgaattagaactgagctgccttccatacgttgaccaaagcagtgataagggtggccagttagtggtagtggaaagggaccgtttcctgccctgggtttcctttagctataggctgcaaggtccccactgctctcagagagccagctaaactgctggcttggtttggaatttgtttcatccctagctgtgagtgccttttggtctggaaagttggcttgtctcatcatacccacagctaggacatatactctgtaattatgaattgtccttgttttcctgagctaaaagcgaatgtctttgatcattagagtttgttagtgttgggttgtttccactgtgaggttcttaaaatgtttttgcttcctaatgttaaaataactcatgttagaaaccctgtacacatgaaaaagggtttgtagttgagacattacgtatattttactgtttataataaatcatctatacaaaagtcttgggtgttaattttaatattttgagcaaaatctgttttccatgctatgttaacatctacaatttcactaatagtgttactttccattgatttctgaagcctagaaaactgtttttgtgtgttttttttgttttgttttgttttgtttgtttccccgaagagattgtatggccttcactgcaaagacttcagaccaattacttgtattacacttggttgcctcgtggctatataacttctgagtacacgtcatcaagagtcctgaatgaagtattgtagagaataaatcataatggacaaaaactgtcttctgcctctgtgtgaccacctgacttgagttactggaaacagattttccattattttgtttgatgtcctcataagagatttgtctgcctctgcctcacaactg

SEQ ID NO: 25314 - DNA, 1497 bp, Mus musculus
tgtcaagggctgggattacaggtgtaaatggtcatgctggcttaagaatagtttgagttgctgggcagtggtggcgcacgcctttaatcccagcactcgggaggcagaggcaggcggatttctgagtttgaggccagcctggtctacagagtgagttccaggacagccagccaggctacacagagaaaccctgtctcgaaaaaaacaaaacaaaacaaaattaaatttacatcatgtgtgactgttgaagcttttaaaaatcttttttctatttacaactttttagtgcttatataaaggaatgtcaaaaaccattcagtttaaacttcgaggcagtagagctaagcgagctgctcggagatgagcctcctttgacagactggggaaacctccagcggccaagtcacttacatttcttggttttcttacagcctggaagggcgttttgaagatgaggagctgcagcagattctcgatgacatccagacgaagcgcagcttccagtactgatccgcagacgtcactctgctccttgagttacagcaccacggtctgaagcctggggaggcctcatgcaggaacattgcttcagaagacgctggagcttctttcgtagtttttgcttcactgcgagagagtgtctctccagttctcaaagtcataacagtcctcctgcctcagcctcgcaggtgctgggattacaggtgtgagccaacactttcagcttggcttctggagaggaaagaaaggctggctattgatgctgtaggtgctatcttcacagtgactgttagaccataactaccatctgcgctccttgcagccttttaaggctgctgtggtcaggcaggctgccatcctgaactgctgaggtagaatgatgttcaaacattcgttgactacttcgtaccgtggtttttttggaccccatgttactatttttttgttcttgacacttcagattttaatgtcaattattttgtagtttttgaagctaaaatgatatataaaaaacttgcataggagaggagtgttttcacttggttgtaaaggggagaaataaaccagaacactgtttttttttaaaagaattgtatttatttgttaatggggagagggtacatgatccatggcacatgtgtggggggcaggagtcagttctgtccaaagtcttgtacatactagaaaagtgctgtaccattgagcaacactctagcccagaagttgcttttgtttgtttgtgtgttgtacatatgtatgtgcaagtgtgtgcatctatgtaaggagactagcagaggacattgggtgtatacccatatttctgtcctttgaaatgggctctgtctcactgaacctatatctaggctggatgaccaaaagccccaacaatcctgtcttcactttctctttttgcttgtaccttggggttcaaggcatgtacagtgggaacacagcagtcttttcactaacggtagtgctaatggacagactcaggtc

SEQ ID NO: 25315 - DNA, 1144 bp, Mus musculus
tttatatgacttcccaatgtttgggaattagctgtattttatttatccttagtgcaaatattatagtaaaaccatttgtacgtctaagtcctttcggttttttagtcactgagaatgtagtattttcaagtgtttagtttaaatctgtgctactttacaaacagcactttctgccccatgcctttgattcccgaatgcctcagaaataacctcatgtgaaaggaaaattgagggctggagaataggtaccagagagaaaaatagtcagggcgttaagattcagagatttcccttcatgttgaagagtcagcagttagttgtcttggtagaattaaaaaattcttaccactattaagatattgtagcattgcagatacggtagtacacaccctttaatctagaagaggcaggcagatcttctggtctacatagttgcaggccagccagcactgtaatgaaaccctgtcttagaataaagcaaacaaacaaaagtaaacttaaagaaatttacaaacacatttcaaggcagtgtcactgaattgaatgtattttcacattagcttgggccctctgtacagttgttcagcactgtagcactagtatactactgtatgtagctcagcactagtataggggtcttgttggtgcctgtcaaattgagggggcatatgcattgtgcaggtcttgatactatgcaactccagtgagggagggtctttgagaacttagtctgagttattgtatcggtgagtgagtaccatggcccagaagatttaaatgacacattcagaataaaataagtccagcgccgtaactagaatcttaaccacctgacttatagcctggtagtacacttaggttagatttttcttcactattcttagaaatcttttgatgttaaatagacataggttaatgtttcctaacctttgaaaaatccttaaggttaaagaaattttttatttaaaataatcccaaggtattgaaatgattaattttacaatgtcctgaactatgataatagaagtctcatataagaccttctcacagtttgtattaaaagaaaatcttttgtatgttaatatttcatcttatgtaccaatgaagaactattcatctttttttattagatattttctttatt

SEQ ID NO: 25316 - DNA, 1166 bp, Mus musculus
gaactcgcgggggccatcttcctctgccttctgagctctgggattaaatgtgtgccaccgtgctggttttttaaagtgttttggaaattagagtattgatcctgtttgtttgtttgcttgtttgtttgttttttaaaccataggttttttttaaaagctaattttatagttgactgtatattttcttccttttctttggagcagagatggctaccattttaattagtattcccttctacttctgtaggacttcctggttttgtttctgtctttttttatccaaagtgctgagaaccaaacccaatgctttacattgtgcatagtaaacactctcccactgaaactcaccgtaggcattctttatttttttgtttaatatgttgagcatgcattttgaatagattagattcaaagtatctatcttttaggctttatctttttaggtatgggtgtttggcctttatgtatgtttgtctgtgcactgtgtgtgtacctggtgcctgtggaagtaagaagagggtatcgggtcccctgtaactaaagatggtcgtgaactgtcatacaagtgcctggaatcaaacacaggccctctggaagagcagccaacactcttaactggtgagccatctttccagtcctaaatacatatttttgacaggatccatgctgtttatgcagtatgtttcttttttgttacagaagctggttgtttttactatttctttttaatttttagtttttatatttcttcctctgagtgtgattaatagttaacaaaaataacattgatttgcaaagtaggggattttgcacattaaagatgtctttcaggattttactgaatggcaaacacttaattttcttttgtgtggctctacagtcaattcgcagcaatagcagtacccatagcacctttctgtgaaagactacagatgacagttccctggggatgcagcccagttgacaaaatgctagtgtagtgtccaggaagttcatgctgggaaggagaaagatgagaatttcaacatcatccttggttacatagagagtagtagggttagcctttgctttgtaaccctgactgtggagaagaagggagtgagtctttcttcattttcttctgagagctagctaactagccagtttttgagtagttaaggcaaaca

SEQ ID NO: 25317 - DNA, 1101 bp, Mus musculus
gtaggcatggtgctggagcagtagctgaaagctacatcttaatcactgattggatggtgtgtgtgtgtgtgtgtgtgtgtgtgtgtgtgtgtgtgtgtgtgtgtgtgtgtgtgtgtatttgtggtagtgggtttgagagagcttggcctgggctttgaaaacctcaaagccctccaccaatgatctacctcctaatgaggccacatcttctgattcttcccaaaacagttccttcaactggggaccaagttttcacacttatgagcctatggggcccatttccattcaaaccaccacacaggtgattgtgagctgccttgtaggtgtttttcttttctttttctttaattaattaaaaaaatatttattcatttattttttgagacagggtttctctttgtagccatggctgtcctggaactcactctgtagaccaggctgcccttgaattcagaaatccccctgccactgcctcccaagctgctgccccgctctaaattttctttctgtctgtctgtctgtctgtctgtctgtctgtctgtctgtctgtctgtctgtaggtgtttttcaaaagaccacccagtagctgactccagtgtaatcacactagggtctattacaagctcaagcctgtggttagtcatggctgacccagatacagcagtatgatttggtgaagcagccctaaaccctcagcgggacaaggttttataggaaatgggagcaactgagggggtgtctagcccagcaagcatctaatagaatgactattgtaagtctacaggtgggtgctctgaagcaaatccatgaataatcacaaaggtctgaaagtacatctgaaacaatcagacttttcttgattagctgttgctaggaggtagctagggagtaactttggggtatgggccaaggacaagttgtggggtccttcttggtacttgagtgtagcttgggttcagctgcaggtcaaggtcttaggctttttttttttaaagatgtagttggggcctgagatggattaagtttggcctctcaaatgctagaccatgtaagatcgtctggaagagcagcatgtattgcacttttaacatttgagctctc

SEQ ID NO: 25318 - DNA, 1207 bp, Mus musculus
acttgaaaggcagagacaggcagatctcttgagttcaaggacagcctagtctacagagtgagttttaggacagccagtgtcatacaaagaaaccgtgtctcaaaaaactatgactaaaacaaagaataataaatatttatgtgtaggttcctggatgcatgcatgttcatttgtgtggtatgtccctgttgtaagggcacatgcttatggaggcctgaggccacgtcaggagcctttctaggttgctctttctactccatcattgaggtagggtctcagttgaatccagagcttatctgttctgctctgaccaaccagccagtgtttgtaagtccccatctctgccttctgagcaggtgggccactacattgtcttgacattgatgtgggttctggggatgatctacactctgctcatgttttgtagccgttagtttaaccactgagcaatctcctaagctcttatctctttgatctacttcaaacattattcagctgtggccaatacttctggctttgaatcctgcctttgccaggagggcaggcttctccgctgtgtctcctttgccaggagggaaggcttctccgctgtgtctccgctgtgtctccgctgtgtctccgctgtgtctccgctgtgtctaaattatggttaatgtactttgctcactgtgttctgagcatcacaggtatgaacagaaagcactttactcagttagtgcaggatagccccaatacataagggaagatactgaaaggtatagcaggagtgtgggaaagaatgtacattttagctgatttaagaggaggctggaagtgattaggagctagtaaaagatttgtttaaggggaaagattgagttgagagttaggatggggtgtgattatactgttttcagcagggatttttcacatacagatgtatcattacatgtacataagtaactatgtaagccatatgcatataaacatccaacaccacttaaccttttctggggggagacaatatggctggccagagacctgcctgcctttgtctcaagtgctgggactgaagagatcttcgccctcatgtcagaattatgggcttacttaaggaaatttctctcagatttcccatctctggggaaaaaaagagtttatttttactgtttgcttgtacccactagcttgtgtgtgtgtgtgcatgtttgtatgtttgtgtctgtgt

SEQ ID NO: 25319 - DNA, 1189 bp, Mus musculus
gttgttcaaaacagggttactctgtgtaacaaccctggctcttttggaactctagctttgtagaccaggctggctttgaactaacagagatctgcctgcctgtcccaagcttgtagaatcaataaattagagaattaaaagaatccattcttgttgggcagtggtggtgcacgtaagtgttctaccatgtaaaccattttaaatagctgagtgtgagtagcagctactgtattagaccatataggttaagttcttacgtatttgtttttagaggaaattccacagaggcttataaacagtatatatttaaatttttgcagttgcacctctggtctccctgcataccttccatgtccagttataacccgaataaaatggataaataatattacttcctagtcatcctagactcagaaacctcatgcctgacttcttccaaggtctgtcatcctctgaagtgcttactgtgtctgtcacattctacgtgcaaactcttgttggtcccctgtagggtcacagttcaccactgatagccgtataaaaacagttatgtgtgtgcaggccagaggataatttgtgggacttggctcctgtcttccagcatgtgaggtctgaggacagagctctgggtgtgaggcttgtacctgctgcacacctgtgggagcccttgagtgtcttaagggcaggcttattattgtccagtgttttcaccttccccaaaagagttttaatgccacctttacaagtgctttccaatattaagtagttgttattcattaccaactgtttttatactaagtagaatacacctttctttctttcaccctgaccctctctctctcattcctaaactgttttttaatgatcctcctgcctcatcctctcaagtcctgggataacaggtatgagccaccatgcacagtttcttcttatattaacatcataccaagaaacttgcgcacaaaatttaccctgcattatttatttgtagaactccaacatcacactaaaggaaacataaatagaatacctttaacttgtttccactataccaatataagtttcattttttttcttatttgttgtttgtttgtttattttgacctctctacatagctctggctgtcccaaaatgtaggccaagctggtctcgaactcacagagctcctctacctgcctctgcctcctg

SEQ ID NO: 25320 - DNA, 1150 bp, Mus musculus
tagaggacaagttgtgggaattgtttctttccaccatgggggtcccagggatggaacatggttaggcttagtgccaagggtttttacccactgctccattttgctggtcccttctttttcttaagattcaaagtataactgaagagctttctttttcctcaagcctcaattataatgtgtgcttgttgttggaagataagagaaacaatggcatgtacaggaggaagcgtcacctgtcagcacccgcgatgtctgcctgtcttccacctccttgtgcacatgtgacttagggcattcatgtgtgtctttaacagtgcccgtggtacagattggtttatacaagagataaagttatatattgtggacactgtagtcaccttgttgactcctctatgggattatacgactttgaatactgggctgtaaggcagttattttggaatatatttgaaccctatttaggaacatttaaaaacaaaaggagaatctttttgaatattatttatgatacttgattttgagatctcaagatcttggaacatccctcccgcccttcctctggtctgagatgacctaaaacccgtgtgtcatataaggcatacacatcctttgccttctgaatgagtgtagatcacttctggtgtcttgggaccatctcttccttctttctcacttcctttttgcctttgttcattcctccttttcccttctcacatgaaatttctaagagctggttttgcttcaggtgaaggaggacgccgtttgagaagtcctcacttcaccaacctagttcatttaccccataagatactctaccatcatcaatacccggccttcacaaaaccataaacagtgctttgttcattctgatttttcacatttgtgagttttagtaatttgtggatctgtcagacatttttatacttcagtaaacaacaacaacaataaattggactaccattactgtcttcctgtttagaaagctatagtgcctaagcttagatttaggacttttgatctgtgcagactaccctgcagaaggaacacctaagtgaacagtacaggttgggtcttagaactaaaacaatgaggaatggctttaaaagcttaaaaagccttccgcgtgcaccttccaaaaagtctgcctgaa

SEQ ID NO: 25321 - DNA, 1141 bp, Mus musculus
ctgaggcattccttattctgctccacctgccagttaccctatctgaacatgagattatacttgccacgccaggatttctgggcttgaggtttgcagggagcgtggatagcggacccatgcttgtctttacatttgttgtggggtgttttcttccaaatacacgggagctgcatttttgccagtgttcagcagtctgttggctccattgtgccagactagggacaggtctcatgtttccatgtcgtcgcagacagtgacagtcacaggcagtggttggggtgaggccttctgtgagctcggtgcgaatctcaagtaggttcccacagtagacttgagctgcagtctccacagccaccgctgtccttttagagtgtctgtccatagtgtaaccatcccctggtcacagctctgtagtcccctcagtgtctgtcctatgaggccatgcccaggaagggctagtctgttcctggcgctggctgctcacccaggctggccagcagtggcctagaactagttggcagctcttgctggtgttgtctctcgtggaggactttggacatctcgctcgcctgagtttatctatttcctctttacttcctaccccttcctttcagcactttctagcagtttccccattctctctgggtttctgatgttcttgttttcttctctgagtctactcatccttctccactcccttttttaaacaagaggcgtggaacccaggctggactccaccttgatgtagctgaaaatggctttgagctcctgctgccctggtatgtgcctctagagtgccaggattacaaggagtctcattacacagcccaagtctgttatttcttgtcctgattctttcccttcactgagttacaacttctaatctgccattcttgttgtgattaacataaggctatttattataatagagagatggagtattgaacattaatttttgttgcttaaattttgttttaccttttgattttaaatgttctttccacaattaaaaccattaaaagaacgctattgtaagaacttgatctgagctgctgtgcccagggaagacttgaaaccatgctttctttctccttttacttctccttcactagcaaattctggactcgaaaccggccaggtg

SEQ ID NO: 25322 - DNA, 1119 bp, Mus musculus
gggaaagggcaaggcctgccagggccatgtttgctgtgtttgggcttgctagagcccatcagctctgaaagccattatgtatctccttaggacctcctggtagtccactgtcatcagagagagagtgctacaccaggaatgactggggagcaggcactgggatacagaaagccatttcttgaaccatgttttgtttcaggccgagggggcccaggaccttcccagagagtgccaaaatccggccgttccagctctttggatggagaccatcacgacggataccacagagatgaaccttttggtggccctccaggcagcagctcatcctctcgaggcgcccggagtggcagtaactggggtagagggagtaacatgaactctggccctccaaggcgaggcacttcaagaggtagtgggaggggccggtaggagggccaaacagtccatggcctctctggatactatttaagacgttcttgtgggctcaccactgaagcagaaacaagcctttaccactgtagccctgaccgcttcttctggggcagctgaggtctaggagcccaggtggggtactcgagacgaaagactgatgccgactccctccccagggagttggccctgcttggtcttgtatctcctcgttgctctgactcttcccgtttgtttgtgaagataaaagctggaatccttttttaagtgtcctgagaaatggagcacctccacaaagttcagttcatgtccgattggagatttatttctatatgtacagtttgtcagagaaaaaaaaaacccttgttttgtatgaatacagaatgtgatttactgagttaacagcagcacccactgtgcagtgctggccttaaggagcccttgctttcagcgtcgctgacctgctgagggtgaccttgctactggcacttccaacagatgaaggtcatttgccaactctgtgcttttcacatcatttttacctttctgttgttacactgttcttgttatgcgataaggcatactttaaaattgctctaacatgttcaagaaggctcaaaacctcagacatgctctatgaggtcaaaaattactctgaagaaaaatttgaatcttctgggtcttcaacta

SEQ ID NO: 25323 - DNA, 1107 bp, Mus musculus
ttacaaagattaaatgagaggatatgtaggaagaactactatcaagaaagttagccacaagagctggaaagatggctcagtggttaagagtgctggctgctcttccagaggtcctcagttcaatttccaacaaccacgtggtgactcacaactatctgtaatggaatccgatgcccttttctgatgtgtctgaagacagctacagtgtactcatatacatgaaataaacctttaaaaagaaccaaaaacacaaaaagaaagttagccacagttgctcttgtcagcctccaagaccttttcatatgcttccttgtttatgagagatctagaccctaactgaagtacagattgactggaagctctaggttggttttcattcttcccatgtgccacatttaagaaagaaatactctataaatacctacaatactgcccagtattaggttatagttatttaaaggcctgggagaaaatgctattttatgaactaaattcttactattttccctttttgcagatgagtggtctcggcccatatttggtcttacctcaaactataaaggaatgacaagagaagaaagggaacagagagatctagaacaaatgccacagcgacgaagattgagcaggtatgagggaacaggtatgaatgcacaagtgtagcttaatctgatggcatctagggaagacctttctgggacagctgaatacaatatgctatcccagggctgcagtgctagagatggtagtgttctagacatttgcagaaaacaactttctcagcccagttccacaactgtaagaggaaaaaaatgttattggtttaatttctctgtattctggatatattttggaaggcagggctatcatttataagtatagtttgggtaggtcacccagaatgaaacctcctgcacagtacagttacagtgaacaatacgtgagaacagtgacaagttctcaggccagcaagatggttcagagcagaaaggcacttgctgtgcaagtctggcaacctgagtgatccgcatgacccaagtaaaggtggaaggaaaactaactccagttatcctctggccacatgcatactctcacacacatactttt

SEQ ID NO: 25324 - DNA, 1961 bp, Mus musculus
tctgctttgtacagaagagtacttactactcctgcttctatcaactgtacgtaataaaatttcattatggttttggggggttgtctcatcattgtcttagacactattctctgtgagatcaaaagccagtccgtttcagtgtgtaagtatgatatgaggaatttgtctggcctttgttcctggctcctgacaaggaatatctcaaacctttacaattcttgaactatctttgttatactcttgatttggcacatcgtagggccctaagttcgctctaagactggtcagcagaaatatgcttgacctagtcgtattgcctgtttgattaaccagccatacctttgtattgaagctatagtaaagaaaagaactctggacaagtcaggtgccttgcacacctataatcccagcattttggagactgatgttgaaataagagggtcatgagtttgaggctagcctggattacatggcaagactcttaactgctctggatactgcaactatgttgatgtgcaaagagaacaaaggcacagaagctctgcaccaccctccatactactcctgaatcttcattgacctggttggcttaatttgtatcttttctaataagatcagttataagtataaccttttattgaaagacatagtgcttttccaagttctatgagtcattcagcaggtttttaaaccaagaaattcttgggaacttgcctggaagtttatagctaccctggaattttcatggtctaaagatatcacttgcagtctatgtctgaagttgggacagtcttgtggaggaaatctgatccctagaactgtcaattcttacactaacaccgagcatttggtatcagaattgtgttgtataccactgtatatgcctataatctcagcactttggaggcagaggcaggaattttgggagctcttccaacaataactttgagttactcaaagactgttcaaataaagatggtatctcagtagagttggaaatacaacaagcatactttttatttctcttgttagagatgctttgtttgtttaaatctgaagagttaagctgtggggagaaaaagttaagaaaatacagatataattgaaaattagttacatatagcaattggacaaatagaaaaaggagaaactatttatagtttcttacttggttttgagaattcttaatcatgagagatttctatagatcaagaaagttttatcagtaactcattcattacttaagtcctcttctagtacaaactggagccttgatttaaaaaaatagattattattggccacaatggcctttggacaattgaaggaatgtggacttcatggactagaacactccataagaacctctcaagcctggtgtggtgacacacacctttaatctcagcatttgggagggagaagaaggctgacctctgagttcatgaccagcctggcctacagagtgagttccaggacagccagggctacacagagaaaccctgtcttttaaaaagagagagagaaaaaagaaaagagcctcataaagcctcattaaagtacactcagcatgcaagagcaaatggagtgtgaagcagaaacctacagagccaacagttacagactaggtggtggcaaaaactacctctggctttgtttaatttcattaactaaaaacaataaaagcatctaatgaattcaaaacagttctgacatgtaaagcaagtttttaagagttattttggtgtcttgggatgagcttcacgtaacaccatgttaatgggagtaaatataaccagcaggtgataagcccttgattgaaggagatggttctgcactacttgaagggaaagatgctaatttctttataaattacctttgctgtgtggattggggggggggggtccccaagcttgacccattcattgccttcatagtttccatttactatagtttctagaacact

SEQ ID NO: 25325 - DNA, 1203 bp, Mus musculus
cacctgctttcctcctcagtgagagagctcagccttcaaggtgagtttgttgatgaactcaaagtagttgtaagtatgttgaaaaccctagaggtttctaaaaagacccagcctttcacatgtatttggtgaaggcctgctgtgccccagacatgaccatgtagtgtaatcagtgagtgcatacggagattatgattgtcaggcccttcaaggagagacgtgaaattgaatcaggtgttccaagaattccaatttctgaaactcagtggtattaaagctgaaaggtgatcattagctagagcaagacaggaaggaagcagcagttgccacttgggcagtgccagtaccctgcagctaagacctttctcttgtcaggccatctgcatgttagtccaggggtgccaaagtgacctttgagatcaagctgtgacctggcatgagtcaggtgcctgtttctcccacatctgtctggttcaggtgcaagctgctctgggccagtctccttgcttatgtggatgctgttcaaactcaccttgggctttattttgtttggcttgagatgggtattatcatgtaactcacccacttgcctctctgcgcctctgcctctgcctccgcctctcatgggctgggattaaaggtgttcaccttgctcccccagctccacatccatctttggagcatcttggccacgcccagtttacatacactcagcacgtgctcatggctttggtgctgagtcaagccagggtttcctggatctcccattggctcaaagccttgtatcaagtcttaggagattttaagagactccccaccctatcttttttaattatctgtttattttatatgtatgggtgtttgcctgcacgtgtgccactgtgtacacgcaggccagaagagtgcttggggtccttggaactggagttgcaggtggtcctgagccactagaattgaaaccacagttctctggaagggcagccagtgctcttcactgctgagccacctctccagctccagtccaccctaataactttttataaaaaaaaaaaaaaggaaagatgtatttattttatgtatatgagtacagtgttgcaatcttcagacacaccagaaaaggacattggatcccattacagatgtttgtgagccaccatatgatggttgggaattgaactcaggacctctggaagaacagtcagt

SEQ ID NO: 25326 - DNA, 1198 bp, Mus musculus
gtggcaagggactgattagctgcgttggtgtgtctagtgtgtctccgtgggctgcagggtgaacagtagtgcagagctctggggagtgtcgggattggtagaggaggggctagaggctccccacacgcttctatatccatgagtctcaacaaccacaacagttctattttttataacaataaaagtggagaataaaagctgactctccacctcatcctattcctggaggtagtctcatttaatatattgtgcagtgtattccttgatgacctaatggtgcagtctctttgttctaattgaagtttaaattcctgacagtgcaaaactttaagaacttttactggtatcaaaatttttactgcttaatttatcttggcattcattgtgctataatgtgaaaaaataatgcatgtaaagaaagtctaatgccatttacataaatattgcttggttataaagaaatatggcttcttaagtaatagtaagaaataactagattcattttacaataatttagatgaagctgctcttaaccttctgaaagaattgggcccatctgggattgaaacagagctgcgaaacctgtcccctgatgacggtgggtcggtagaagtcatgcggagctttttaagcatgattggaatgatgttggacagaaagcgtgatttcgagttggcccaggcataccttgcattgtttttgaaggtgagtgagatacgatactttcctttatatgtggcagtgttatcaaacaagtctgcaaagatgggcatgttttgcatctacagtattgaataagccaatgaatacttggaatatggctaactatagctgaacaatagctgcctggcctggtgtctaccctgacatggctggggattttggactttctagtctttatttttgttactactcagtggcataattttgactttatcccaatttgtcatttctttgttacctgtgctgaaccttaactttttaaatttacattttcttttttaagttttctgtgatcataagggaaagttgggttctttgtttgttcatttttgtctgctgctgaaatcaaaatattcacccccgccagtttcaagtaacttcaagtacaacttgcgcttttgagtaacaaaaccaagatgttctgtataggtgcactgcatggtgtgatgtgatgaaggcgtggctaacactagct

SEQ ID NO: 25327 - DNA, 3851 bp, Mus musculus
atgtgaggtgactccgtgtccacacacattttgtgtttgtgtgaacacgcagcgctcagtggtgcatgccatttccgtgtgggttgctgtttctgctcctcactggtcttacgtgtttccctttccttcgtttggttggttggtgggaaggtgggtgggtttgtgtttccgtgttggcagatctggagtaacgtgagctctggcaataatggcaggcaggcaggtcacacagaggccttcttcacaagtctgtggtgggtcagctgcatgaaggaagggatcaaaggcaggaaggtctgctcttcagtttacattagtttgtttctgtaaaaatgtaaagtcagttctttacatccattttgacagtcaaaaaagggagactgaattttttctcttctaaaatttttttcttgcaactggtgatgaagatacacacaggacagaggcgcagggtcagtgttctggtgggtgagctcatagctcttggcttgaaatatcacttccaggacctgccagacgcagttccccccagagggttgtgttctcagtttgttcattgctaagttcctgtctgactttattgtaacttctgaaaggctagatttcctctctgctcttctcttcagcaatagggaaagaaaatggacttgagagtgtccggtgaaggctgtgaattgttaactatccagtgtgtcttctgtgactttatctgtttttattagtgagagcagaaggtctcgtgtatcccactagtctgcccatgatcataaagtgacaggagcctgggtaaagacttggtaccaacattggatgctgtcaaggctctccctggcctgctccgaacgggctctctgcggatctcacacttgcccagtgtctcttggctagacctccagtgactgatgaggtcattcactgctgagcagggacgcactgcaagtaaaacaaccctcgtggaaatgttttcattgccattgtgagtttcacagtaggttcagaagtgacatgtgagctgtctgaaacctatgttcattaatgtagagttcacataatctacagtttacctgtggtaaaagtgtgagtgttctttaaaaaaagaaaggaaaataaaaaacaaaacatttgaagagttgtgcagccctcaccacagcacagtttagaccgtttttgtcacccaaaaagatcctttgtttctgtgtacactgtgtattgtcacctaagcagcagttacccaagttgccaggatagggagaggatgaaaagggcgacaccagagcttgctaggttttacttctgagagtagagtggtgtgtgggggtggggcgtgtcggggtggggcgtgcatgcaggtgcatgtgggtgtggacgtgcacgtgtgcacatttaagctcaggaacatttacatgttgtaagtgtgttatctccattattgtaacataaaaacgatgtgaagtgaggatgatacttgcatacttagagcggctgcttctggagcagacctattgcaggaaaaccctacaagccatacgtgtaactcagagtatcccagcagaggctgggaggtgatggtagtgaaagagcgttctctgctcttgcaaaagtacctggggctgggggaagggcttatagcagtccatagctccagttctgaaggatcttgtgccctctggcctctgcagatgcaggcatgtgcacagtgcttatacacacatccaaaaaaacccactcattcatagaaagaaaaaatacacagctgaaactaattgtagcaatgttttctttgactctatatccaaagtatttcagtacacagctgatgtaaaagatattgcgatagctcactgtgtctattaactcttggaaataaggtgggtattctgtgctgggactcgccatatggcaagcactcattgtccacaggaggcctgcagctgttatcatgactcacacaagcctacagtagctttcatttgccttgctgtaagatgaagtggacaattcctgaattgttctcttcaccagaatcttttatagctgagcactttcagtgcttgctgcacacggtgtctgctttagaaatgtgcataaataaattactgatttccagtaaatttaaaaattattgcctcaaaattattttcactaaaagtaacttttgataggaccgtgaaggagaaacagaataaccactcacattgccgtgcagatgaacatttcctgtagcttacagcttgctgaggaaatgtgtgtactctggaaatacgtgccctagtgtcgtgttcaggacacactgctcttttaagatgaaattagttttatataagtgacattttggtaggaaatactgggttttgcttaaaaaaaaattcttgcctactcttgaatgactaaagcaatactcagcaaaaaaataatagtagaagtattcttagatttctgtgctataaaccactggagtattatcttataaataccaggatttctttcttgttccatgaacacaatgggtgtatttgaaactggggggtttcaagtgtaaatctatatcctaggatgtttcccctttatcttcttgtcttttctacttgaggatcatttgactgatacttagtgagctaaactaatgtctcaaggttaagactgtacccgaggttctggagaagcagagacaacaccccagtctttgtcactcatctctctattaggtctgagaaatcccctttgctgtggatggcagttttgtatgtttatgagagcacagtagcccctttaggaccagatgctaaattaaatggctgttgtagctttctagaccaaaaaagagaggctaacagaaccagagaagcagatggaaatctggatttaatgaggactcctttaaaagttacatgaacacttgtccaggcccttccatccttccttcttttcctgtgataccgaggcctggtgcatgctgggactgagctacacttctggccccctcagtgagcacatgggacttgtaagagtatagagtggcaagatctgagcatagaagaagggagtcctcctcctacagtgcagggctggagttacggttttgtcgtcactttatttccagggattgtataagtactgctatgtactaaataaaaattcatctcttgcagtccaacaaatgatgtattatattaagataatttttagaaagtttatcattttatgaatctgtatatggaattagaataaaggactgctgatataaatgagatgtatatttttaaattacagtggaatgtatctgaataaagatttctagacactctttgtcactggtcattgaccttgtttgtgtaagttactttaaccttaagtactgaccaaatgcttatatatttatatttagagaatgtcatttaactacttgaactatttaacaagtataaatctggaaaataaagctaaacctatgctaatctgccaatgtttcctataatattagcaacaatactgctaaatctttatttgcaatttgcagccttacattgcaataataacatactggaggaaattaactgataaagggaagaggtttattttggcaaacatgtctgggggttctggtctggaatccagtagccttgccattggcctctggtaggagcagcatgctagagtagtagcatgtgctgaagaaagcaaacaagcaaacacaaaacaaccatgcttacctctgcatcccgaacatgaagagagggaagaagaccagactctcatgtccctttccaagtgtcccctgctgacttgtgtacctcacattaggtaccacctcatagaactactgggaccaagttttaagtatatggctcttt

SEQ ID NO: 25328 - DNA, 1116 bp, Mus musculus
cagaacaccccctgcttccaaaacacctcgtctgctttaaaggtgaccctaggcttggctgcgcgtctgcaaggcagacagggaacactgttttaggttggtgcgcttgagtctttggttactttgtaacgtctttgtaatgtagcatctcactgcctagggagacaatggcaaatgcagtagaagaattgagtctggtgtggcagtgatgtgattaactgggacactcggtatgaaagcttatcatatataatgtgaagtagaaggtcagaggattgaataacatatcagaaccactgtttataataatggttcacccaaggcaaggggaggaaacactggtaggttctctgagaattttcttatagcccctgaatctctcgtgtgtgtgtgtgtgtgtgtgtgtgtgtgtgtgtgtgtgtgtgtgtgtttggtcctccattttgtctaggctaaatgatagagaggattcacttctttaccccatgtgccttccgtggaacctttctgcctttgggggctgctgtggtttctcctttctcctcttgcagatggagagctgaggcttgcttctgttggcgatttttgtttcacaggaaaaaaggaaagaccttctgcagagccaagaattcttctattctggtcgcaatcctattcattaaagattaatttgaattaataagctaataccttagatgggctaaagccagttccccagagtgagctgcgcaccttaatagcaatcgtgtgttgcatagctgagggttagccgaagaccttatgtgagttactctgtttaccctcccccccccacacacacacacaggaatgctgggggatattcagagcctttcagttctttgtctcctattgcatgagaatggcagggagatccaggaagaaacccctgtgattctgctccagggttcaggtcctccgctgagctgaactcccctcatggatcctgaatgacaatctgagttaaattgattgctttcttcctaatacctagtagcaactgttacagggcatggagcagctaatgaagaggtagccactgccttccaagtgatgcaactcattcctaaatgtctggctgttacccacctgacagtg

SEQ ID NO: 25329 - DNA, 1126 bp, Mus musculus
ttatatgtaagtacactgtagctgtcttcagacaccccagtagagggcgtcaaatctcattacagatggttgtgagccacggtgtggttgctgggatttgaacacagggccttcggaagagcagtcagtgatcttaactgctgagccacctctccagcccccatggtttcttcggaaagtcagttatgtcaaatgatgttttgttggggcacactggtgaaagggtgttttgctaaagcagactcatgaaaagatgttttaagtgaagcagacacaggagaaaggatgttttgctgtagcagacccgtgaaggagtacatgatgtttaaaaggaacatagatatgaccccacagatggacgatgtgagctcgatattggctgtccttgcttggccttcttagtcttcactgatgacatgtattggctcgccctctgttgcattgttgagcttcacttgtggtgacttcatagaggaaaactcctcaaagaagttctctagagatcccttggcttcctgctgcttcctcagactcggcgccataaggtttcttctggatagaactgctcttgctgattcatgtgtggtgtctgccaagtggactggaccgtagctgctgattcgtgtttggtgtttgctagtggactggactgagaacagtggatattggaatctcccaaagaactatttctaaacaggcccaatttccctttgtcctaataacctttcttttctacctcctggtgggtggtggactagaggggaggctgaacccttattaaagtaggttgtgatatgtgcctacacttccctttccttctcacagtggtctgcttttctggaagggaccaaaagcttgatggaccaaactcatccaatttcagcattctggaaatcttgtcaacagtcacttgagcatccccccattaggatataagctggtgttgtgtgtaaatggagacttccaaagatcaactacagttgttttgttctgttctgaaaggcttgattatgaagccagactttaaagtgtatggctcctgtgaaggagaacatagggccagcagctacactcactgcctgagttctaactttgcctttgaccacatgttggctgggcaagttac

SEQ ID NO: 25330 - DNA, 1177 bp, Mus musculus
tccagtcagtcatctgtcaccgtgcccattgtggaccctcttaagatgaaggggaagggagaagtgagtgttacctgcagttgactttgccattcccagcatgctcaagggcttcatgtttttgtcagatccccttgggtgattctcagccctttgctctgtaagtcacccagtggagctaaaggcagcaacaaagcagggtggctgctgtcttcactgcggtccccattcatctgggcagtggagtaagcaatgccactcctgatcagttttcggctgagcttgggaatgctgcatcatggtgggggttcctacattaaactcagtgtctggtgtccattcttggtggtactggggaggggcgaaaggccgcaagataaatttggtccactttcctggagaagcagcttttcctacggtgaaaaacaacatttccaattaatctctgaccctaggcaaaagtcaacccccttcatagagcagagcattaaatcagcatctctccctttctcccctccttccccgtcctctctcttccttcttctccccctcccctctttgcctctttcttacctttcctcccatcccactcccccatcccagttgctgtggagcccaggctggtcttgatctcctgcttcagcctgtaagtgctggggttacatgtgtcccctggccctgtttatgtgaagtttccttgttaactgagacagagtctgactgggcattctgtctggccatgaacttacaggtccccttgagaatgatgagcacagtcacctttagagaagcaaaagctaggtccggattctggagagtcagctgtgtgagctcctctgcatctgattggagagccctgaagtcctgggtgtgtgtgtgtgtgtgggggggggggggggggcggagcggggctgtgggggggggcactgttgcacagtctttattactttgtattatgtaacctaggcgcctggaccactctgatgttttgtactatgaatcattttcatttagaagactttgcctcttttcctcatatcaacatctttaacactgtcaaagcatttctcctgaataaagcagcttaaaaaaaaatacaatgcttcctgctccctgcttttccctccacttgttttttctgtctttagctcggggggggggggggggcaggggggtg

SEQ ID NO: 25331 - DNA, 1109 bp, Mus musculus
aaattgatgagtgaattcaaaggcagaacgacttcagagtacagttattttggcggagtgctgtgcagataaacagtatttaaaaggggctctggttggcagtaatcattttcactgcaagcctggcctcttttggtgtcacagaagcatgccatgaggattttgatgtctgtgtgtgtaacacagatgttgtctgctggagttaaccacattatttgcagttactatacctcctcaaaaaacgtgtgcgttaggacacatctacctgcggtctttactaaactaagcacgtttatatttaccaatggtgtgatcatctcccatgtaaatgatacgtgcacattgattgaacatgtgtgctattcacaattgacttaaagaaacattgtcttacccttcctgttatggcatagagatgcaattactatatatgtatgtatatttgaatgtcgtttatttatgtgtattggtgttttccctttgtgcatatctaagaaggtgcattggatcccctggaactggggatggttgtgagctgccatgctggtgctgagacttgaactcaagtcctttggaagagcaaccagtgtgcttaactgttgagccatctctttggtaccaattaatgtatattaattaggtaaatttagcttctactttagttcacaagtgaacaattaactgtaaaatcattaatcaatagctgctattactgcagtaatttacttggtgattggctattgctaagtacagtcaaggttaatggaaggtccaagtgtctttaagggagaagaggcctggacacctctatctgaaagcagagaagaaatgcctacatattctggttttggaaatacagaaattggatgaaagggattcagggttctgtgaggcgtcaggaagagaaaaagcttaggtcagattttttccagcagcatgcctgagatttaaagtttggaaaattgacaaaaatttaactctagttgaaggcattacattaggaaatgcatctctcgtaagtactgggaggaaagtaaaaatgacggtgaagaggagctgaaaaaccaaaaacgtcacaattgtgggcaaaaatagattcccagctttac

SEQ ID NO: 25332 - DNA, 1167 bp, Mus musculus
aaaatgtcactggaatttagtcctaagagaagtacgttgtcatcatattggcagtgtactgttgtaaaaaattaccacaaacttagtaggtttgttatgtatttgtgaggattagttggttggttgaattttttgtttgtttggtttttagacagggtctttatagctcaggttacccttgaactgtgcatgtagctgaggataaccttgagcagtcactgattttctcactctactgctgagtttctggatgtatatccagttttatttggtggtgggatcaaatccagggctttatgtgtgctaggcaagcaccctcccaactgagccacagccgcagcccactgcatggtttaaaacaaaatttactattgacctttcttgggggtcagaagttgacatggttctccctgtacagtgaagaggcacttcagaggcactgcgtgtcctaaaagctggagagaagcagtcatctttgcccttctttcccctggcttcactccctttcttcatcctcactgttataatctgtctccctctgaacctgatgccttgcttctgttgtcacgccctttcctgactgaccctttgtcttattctgaggacatatgtggtaacattggttctgccagagttcagaagaatttgctgcacaggccttactaatcacctctgcaaagtcctcgtagccaaggacggccatgtggttatgggcttgggagatgacggtgcgcacagcttcctggattgccattgtgttgccacaggtgtcctaacacagctttttttccttgaagcattttaaaaattaattttgaaaatcattcttttgtgaatgagtgtttttctgtatattaactacttaggacttagtctatgatagaaactgaaagactttttgcagcaccttttatggactttccaatcaactccagcctctttatactatctaaccacatgcacagtggtgtttatatctctccctccctggtttccgtgattcctctatatgtgaggtaggtgtgtgtgtgtgtgtgtgtgcgtgtgtgtgtatgtctgtgtctatgtctgtgtgactgatgtgtgtgtgtgtgtgtgtgtgtgtgtgtgtgtgtgtgtgtgtacacacacacatatatagtattcctgttattgaacttgggagtc

SEQ ID NO: 25333 - DNA, 1247 bp, Mus musculus
attataacctgatgaaatgtaatgattgcagagaattagaatttagtagattataattgttgcaaatgttttctattccttagaagtaaaaaaaagttttaaattatttgaagaatttaattaaacaaattgcagagagagagagagagagaatatgaatgtgaatggagtatctgagagaagaaaaattattttcattcataataatcaattacctttagctgatacaggcaaatagcaatttcagtgctgtgagaatcacagtctgcactattactattacttattcacataaaccaactgtggatgtaatttttaaatagctgtcatctcttcatccagaaaagttttcttttgctttattttaatttttattgaatatagtaaataatcccattcatcacttcattagatctagttttgggtattaaagttataattttgtttctaaactcatttggcccacaggtggaaatggtgtattccttgttgtcaatgcttggtactcatgataaggacgatatgtcacgaactttgctagctatgtccagctcccaagacagctgtatatccatgcggcagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgagcttactgtgaaacctgttgggagtggcaggaagcccacgaacaaggcatggaccaggacaaaaacccaagtatgttctttatagtgtgcatctcaatgcatgtttcaaaagctttcggttagagattctttttaagttagtatgctgtctttatgaatagaaggaatttgcattagctaactaatgctgctaaaaaattttaaggcttaaatctgcatttccctgaaaaatttttacaaaggaaactgttatgtatggtactgtgtaagcaggtcagatataaaggtaatctgggtgggcaggcttgccttccttccttcctcagtgcaccattgctcccaccccacccccaaagccaagtactcagttaaagaggacagccttccccagaagacaaggaccatccagtcagggatatatgagaagtcctgctagaacttcaggcaagctttcaagaagaaaaaacaaa

SEQ ID NO: 25334 - DNA, 1087 bp, Mus musculus
gaggacgacctgttacaggagtgtataagttctgccatgccaaaaaagaaaaggccttcaagactcaagagtgagagcgaaaagcagagccctagaaaagtgggtggcatattagctgaagacctgacgcttgatttgaaagatctacagaggccagattcagaacacgctttctcccccgactcagaaaattttgactggaaagctattcaggaaggcgcaaactccatagtaagtagtttgcaccaagctgctgcagccgccgcgtgcttatctagacaagcgtcatccgactcagattccattctgtcactaaagtccggcatttctctgggatcgccttttcatcttacacctgatcaagaggaaaagccattcacaagcaataaaggcccaagaattctcaaacctggagagaaaagcacattagaagcaaaaaaaatagaatctgaaaacaaaggaatcaaaggcgggaaaaaggtttataaaagcttgattacgggaaagattcgctccaattcagaaatttccagccaaatgaaacaacccctcccgacaaacatgccttcaatctcaagaggcaggacgatgattcacatcccagggcttcggaatagctcctctagtacaagccctgtctctaagaaaggcccacccctcaagactccagcctctaaaagccccagtgaagggccgggagctaccacttctcctcgaggaactaagccagcaggaaagtcagagcttagccctatcaccaggcaaacttcccaaatcagtgggtcaaataaggggtcttctagatcaggatctagagactccactccctcaagacctacacagcaaccattaagtaggccaatgcagtctccagggcgaaactcaatttcccctggtagaaatggaataagccctcctaacaaactgtctcagctgcccagaacatcatctcccagtactgcttcaactaagtcctccggttctgggaaaatgtcatatacatccccaggtagacagctgagccaacaaaatcttaccaaacaagcaagtttatccaagaatgccagcagtatccccagaagtgagt

SEQ ID NO: 25335 - DNA, 3410 bp, Mus musculus
gtttgattcttgttagaggggttttgttctggaaaccatatttgatagtacactttgtcctcactggtcattttgggaggcactcttattaggtaggaaaaaatggtaaagccaagtatatttgtacagtgtgttttacatgtatttaagtagcatccatcccattgtcctttaattatcacctgtcttaaaaataacactacagatagaaactatatgatatattgctgtcatcaatcacttttagattataaattaaacttacatcagggagaaattggtatttatgcaaaaaaaattagtccttgtgaatccatctaatgtcataattaatcatgtggctgtgaaattcacagtaatgtggttccccatgaatatgtttacccagcctgctttgctttactgcatgaatgaagctgacggttcaatttcagaagtaacaattaatgattctgtgatcacatggtgtgcagagagatagctacagtgtaacgattcacactattttgtgctcaaatctgtgtaactgtaaagcattgaatgaaactattttaactgaactagattttatcaaaagtaggtagaatttttgctatgctgtaactgttgtatattctggtatttgaggtgagttggctgctcttttattaatgagacacgaattgtgtctcaaactaaatgaacatttcagaataaattattgctgtatgtaaactattactgaaattggtatttgtttgagggtcttatttcacatttgtattaataactgtcaaaagggcctcttttaaaagctaaatgtaattttttttcttcagattctatgcattaagagtaaaatttcctcttgctgtaataaagacaattgaagaagattgttgacacttaaccattcctaaaatttatttttatgtaattagcacctctcaatgcttggtatttttccactttttttcttactccttgggggtttgattaaaacaaatgcctataatagcacaagactaggcactggacataagggcccacatagaatatctccttttccttaatagaatccatacttgaaaaccattgattcttgacagttaccagttttgtctttcaggctttccagtgcaactgtcttaccccgtcatcttctccgtattgatactgggtctgaaataaatgcctactaccactctgtatagtaaggcagatttttttttgcaatcaggcataatcagtattttctcatactcaaaaaatacaagtcagtgaaacatcagagatatgtaatgctgttatgataatatttcaagaaagattcaaaagtgggccaggtcagtaggtaaaggtgatgcctcaaagcctgaaggcccagttcacatcacaggatgcacatggcagaaggaaagaaccagccccctaaagtcatcctctgacctccactcgcctgtcttggcacatttgcatgtgtgcacacacagacttcttacgttgtccatgaggacattcagggctaacgagaaggctcagcaggtaaagcctggtgacatgaagtctgtccccagaatcctccaacctccacacacgctccataattagaaagtcacaagtttttttttaattcctacccgctaaagacaacttcatttttaatgggtccggtggttgggatgttattaagtgcccactgcccatatgaatgagaatacactgacatacttaatagccaagagtttcagttcttgtcaaatgttatgtgaagttgttttatatcagtattccatattgttctccaaggttgccataagcaatgggagatgggaatataggtcacagctggttctctttcattcctagttttccattagaattactgcacgtcagtttttataaggcacttcaagtagttttgtggaaagagatgaggttttagttagaatacaattgccttttaattcatgttttaagaaattaatgttagaagtaaaagaagagtccattccacctattggagacgaaattcccatgggcagccctgctgggaagggtctgtcttgtgttgtcccttgaagatggagttgctggattaaaccctttggctagagataatggctgtgaaagcaaaggggttgaccttagttgtgctttcagaagttcactggatgattccttaactggtagcaggccaagtactcctggattttgcttgtttcagatggcacactaagcccagtcagtgttggggcttggttactgggctggatgcttattaaaagggcaaggacctacttagctttggactgcagcaaagaaagcctaaggtagcaatttcaaacaggtgtggttggatcaccagaagtgtttgttagatcatttctgggcacacacccgcagtttgataagagttgatctggagagggctacaagaatttgcatctgtaatgtatttagggatggtgggtggtatgtgggcttctggtgtggggaccgtacttggaaaagtactgtcctaagtgtgtacagcacagctcttaataagcaaatgagttcctgatctaccaagtaaatgctccttggcatgggagacctgaatattgacttgtccagtctcctagcctatgtcgactcattgtagggaggaaactcaccatacttaggaatacgaaagtcaagatgtccactgcctctgagtgcatcactcttgtccctttgaaataactactgttaaaagagggtgtgtgtggtgggggggggggtacttaaaatacttagtttcgatgggcagtaagaggctatggaaagggaaattcaggatgagggaagattggttgtaagtgaaaggaaactaatcaatttgttagtacacagtagaagtgattaattggtgaaaaaaattatatttgataatgaactttacaaattaccagggtactaactaggtaaataaataaaagataagccctgtaggtatcaaccagcaataagtaatgttagagttttctttatagtgtaaaatgtggatcatgttaccacaaagttaattgaaagatgactttgtcactgaaaatgggagatggttgccagggtttctttgcagctaagaaaatgaaaaaattaaactgtccaaagctaaagggtttacatggtcagataattcagatatacctaacaacttttcaggagtcaaggctaaaatacagtgtatattctttctcattttctagtgagcctatctatttccctgtgtactaaccttagaaaacgactttgtaatgtggaattctatgaaccgtgacttctgtaaacccaggtcattttcctcctgttctaactctgctttttgttaggccattgatgcatctttccgactgtatgttctgtgtataatgctgttcttggtgctaaatagactttctttc

SEQ ID NO: 25336 - DNA, 1139 bp, Mus musculus
tccagagaatggaaccgtgatgttcagtttcgaggcagagtccgggtacagctcaaacaggaagatggcagcctctgtcttgtacagttcccgtcacgtaagctttttaaaatgaattcacagggttcttgggtaaggttatcttgtacaaaaggaataaataccacacagaatgttgaagcagaaggattattagttcaatacctgtgtgggctgtagaatgagttcaagaataacatgagcaactttgtaagtccttgtctcaaaatagaaaacttaagaagtctagagatgtggctcaatgctagactctacctaccatgcacaggttcctaggttcaagccccaatacagcaaaaataaatctaaggagcaatattgaatgacaaaagcagaaatattcatgctgtggttccacgagtgtaaacttaaatactaatactatatattggtaaatatatttattactgatagaaatggatttttaaatggactagaagctaacatacccacttttcagacagtacttgcctaatggcgagtggtaaagtagttagggagtggggatcggagactaatagagaacactggaggggtggatatctgctcggggtggatgtcagctcaggggacaagggtacttgatggcctttgttcaggggaaagaaagaacagactccacagttattttctgacatgtgtgtacatgtcacatatatatacacacacattatgtgcatgaacacatggttttagttcaaaaacagtgtcaaatctttacttttttatttatttttaaccttttaatgcatatattttaatttaaagctgttcactctcttccctccccccccccaacgtcttcaattttattaaaataaaacaattgcactgtcagtctaattgatatgaagttgtttgtttttagtcaaatacagatgaattggtttttatacatcggttattgccagaagcttaagagtctgactcaagaataatagatagggctggaaagtggccaggtgccagacacctgccaggcagcacacatgaagttttctagtttgttttctcttaacattttccttactgccttaaaggacccaaaatagatacacgaaaaagcttatgatttgaaa

SEQ ID NO: 25337 - DNA, 1183 bp, Mus musculus
tgttgtcgtatatgtagaaagcattttcatttaaacctaacagagtgggcagtacctcaagtgtttaaaatattttgctgtgtaggaagacatgtcactatactccaggaaatacaaaagagggttgggaatctctgtctgtaggccccgtgctctgcggggctcactctgcatgcgtctccttgtgcttacagttaggaaacctttgtggttgtgcttcacgcagtgtatgattatatatatatatagttctgtgttttaatgtatctgggcatatacatatatatggaaaatgttattgtttggctagaacatgcacagtgcttgtgaggaagaggccaggagaggcttgtagacgccacctgtgacctgagaagggagaccacctgccgaggctggaggtctgagcttccaataacgtttcagaaatcaatgcaagcgagtaagactcgaacccgtgatcagctccagtttcccaggaaacagtggcaccatctcccctgctcctcctctgagatgctgaaatgccagccatttatggtttacctgaaagctggctaacaaggtccttagtctctcctcccaaactctttaaaaactagttcatggcacctcccaagacagacatcccacctcccattttttaaaaacacgatcccacgtagcccaggataacctccaaatcccagctgctgctcattgtagcttgtgccccacggctggcatacgtgtgtgttcttgttcctgtcagcagcacattgcgctgatgacgtccagctctaagagccattctgggcaagtgaagggcagtggctaacagctgttgtcggtccagcagtggctgggttaaactttctactcttttttggttttatggccaacctcaagaggtctccttactttacaattcataattattagcattcccttaaaaatctcgttcagttttaggttttgttttgacagatagaataaagtttaagtgactgcccatggcctgattggtcagaggtttgggtctaaaaatctgcagtttgcaccatatgccagcgtcccagcctttgagttagtctgaagtggactaaaggagttgtctaccaaagttaacaacaggagttactttcaagacaaatagatagtaattctcctccagatgactaagatcataataatatgatattaa

SEQ ID NO: 25338 - DNA, 1110 bp, Mus musculus
atctcaaggtaacaatagcccaccaggaggctagactaccttgcttgaaaaatagtgtgccctagaggagggcatgtgagctttctccaggggaattttcaaaactaccctgagtcctggcacaggagggaagcaggcctgctcacagacttgctcagggccggtcacacatttccatttttaggttaaatatgtcttcgtaggtttagcacagcagggtgtccatcagactagtcttacgcggttgtaggcatttaaggtcacccgcccctttctgtctaggtgcaccgattggatttaaaaagtcaggcggactccgggcaggtccagctgcttacagcgggggggggggggggggggggggggggcagcgcagtgagccgggtatgggcgtggcagctgaggtgagcgctcggctggggcagggcggggtccgcgccaacagggcgaaggcgagcgcggggcgcgctcccggaaacctcgtgcacgagccgcggcaccgcccgcccccgccccgccccggtcagctgggttccgcgtccagccggctgcggagcatcccgggcggcgcgaacggcccagccatgtccgcagccatgagggagaggttcgaccggttcctgcacgagaagaactgcatgactgatctcctcgccaagctcgaggccaagaccggagtgaaccggagcttcatcgcgctcggtgggcggcgggtccccgggagcggcgccggggcagggacagaggacgggcgggaggctcctcgcgcgtggagcggggcctgggagccgcagactgcgggacgcgcggacgctgacgtgtcgcctctgccggccgcgagtgtcccaggacccacagctttgggcgcagtgtctagcggggtgaagctcgccttcacgtcccagaccccacccccactccggcagccgggcctcgcgtgcacagtcctcgcgtgcgcccgcgcgcgggagccaggtctagccaagcggggcttccgaggaggggggaaccgcgggccagccagcaggaaggagaagcaggggactgctgggtgtgcccaaaccagccgggccctcctccatagggtgttgaggccggggttgctcggta

SEQ ID NO: 25339 - DNA, 1234 bp, Mus musculus
tactgaatgaaattcttcggttgccttttcttataaaatgactgaaaatgtaaaagaatagcctataagtgtgacatatggaacggtattgtttttttctagaaaaccaaactggattttcaaatcctacattggaacacctttctgtgtcgttcccaaagtgacacctgcacagatagcacttagccaggatttgcaattcagtggtcacaactcctgaacggagagaagctcgagtagaccacaaagcaaccttgcttagtcattgcaacattacacacatcactcacagagctgaatcacatcacatgctgcctacaggacttcagttactgtcaccagctggcaatgctgacttgtctggatcaatccctgtgctgtccccaacccacctccagataatgtgagaaaatagccatgccagtgtggagggacttgggtggtgctcagatctgtgtgtcatcagatgggcctcaaaagaatgagcacacctcagtgtgttctccaagggctagaccactgcagctttccaggtttattcagggggcttcatctccagatgaccaccgctcgctcgcccgcccagttgcttgctgttcagagcagccgctcacaggatgtgtagtggtatgcttcttgtcgtagactcttagcatctttttttcgtttggctttgcatggcttttcagataatctgctaatcatttcttacgggatagtaacttgtgttaatatgacagatgtgggtcaggcttcatctaagtgggttgtccctcataccccacccccaccccggtgcttatttgaattgataaatgtctcactttgcccatgctttgcatgtaatgactcatgcatgattttcttcttaatagtttgtttcatacaaataaatggaatttcacaacatctttaataaggtgaggaaagcatgaaccttgaacgctgccactattattacccagtaagagcaggaagtagtttgataaggaatagtgtgtctacgtacttcacatttcacttgtgtgtgcaatgcctttctgggggagagggaaaatccagcagtagtgagtgtgtagttggagggtttttttttgttaagtactgaatcacccagccttgtttgtgtggtttccttttgataatactaggtcattcataatgtatttttagaaaagtaattaagaatgccaaaaaaaccctgtatcatttgatttgaacccatcatgtggtg

SEQ ID NO: 25340 - DNA, 1114 bp, Mus musculus
cccccccgcccggtgtgtgtgtctgtgtttgagagggaggaggggtgtgtgttagaggtcaactttcaggagttggttctctccctttaccaaatgatcaaatttaccaaggatcaaattcaggtcattaggtttggcaacaagtacttgtacccattgagtcatcctaagctgtgggttgtgacccctttgagagacgcatatcagatactctgcatatcaaatgcttacattatgattcataacagcaaaattagttatgaagtaacagtgaaataattttatggctgggggtcaccacagagtgatgaactatatataagaggatcacagtgttaggttgagaaccactgctctaggcttttaagtttcctaatgtactatatctctatacgttgtatattagtgtatcgttctctactctgctttagaaatacaagatacatacaaataggtgctactaatccctccaccccagaaatacagagctttgggtagtggaagacagttgagaaattttgtgcatttcaatgattagatttagctgggaggcagaagcaggatgatctctgtgagcttgaggccacccaggcagggctcataatgagaccctgggttttttgtttttgtttttgttttccgagacagggtttctctgtatatccctggctgtcctggaactcactttgtagaccaggctggcctcgaactcagaaatacgcctgcctctgcctcccaagtgctgggattaaaggcgtgcgccaccacatctggcgaccctgggtttttttgtttgttttgttttgttttgtttttaaagatttttttcagcatctatctgggaatagttgcaagatcctgaaatcccaggtgtttcctgggagttcattggctggttagtctacctgaactggtaagcttcagattcagtgagagattctttaaaaaaataagaatagaagaccacacacaaacacacataaagatatgggaactgaagcagttgttttctctctttttatagattaagttctgaagtactgatcgagttctgcgtttcttcaatgaggaactacaggctgatcttctgccataatctcaaacagccataaat

SEQ ID NO: 25341 - DNA, 1802 bp, Mus musculus
tttttgtttgtttgtttggttggttggttggttttggttttggttttggttttggtttttggaacagggtcttgatgtacacctcgagctgcccaggattttgctctgtagccattgaactctactccttccttagcctcttgcctgtcatagcagtcatttttattgtcaatgactgcttatttttcttcagaggaaatgaccacccagttttaatatatacagtgtataatctggtacttaggttgttcctatctggaagatcttaggtgaggttaaagaaaggaggggtgtaggtggtagcttattcaacacagaactcacttttgttctttgaaactgtaacatagtcttaagtcctagcgtggctgtagcctcttgttcattcgtgtgctgtcttccctcactttgtgtacttctttgtcaggtgctcccactctttcccggcttttagaagctgggcccacacagttcaccactcctcttccttccttcactactgttgccagtgagccgccagttaagcttgtgccaccccctgtagagtctgtgtcccaggctaccattgtcatgatgcccgcgctgccagcaccatcctctgctgcggctgtctccacttctgaaagtggagctccaggtgcgtccctgacccacgccctgagcgccacaggaccaaaccttagatagagaagggtggccaagaccatgatctcccacctagagacttctgttctccatagacttggaccatctttacccttaggactacaaggatggaagtgggtgtgtgtttgtgagttgggtggggcaagttaagtgcaataacataagcaggcttgagactgtattctcactttactttataaataaaacgagggagaagaaagcatggtcagcaataagtttttgaccttaagtgtctacagttctggtgtgatctcagggtggtcacttaatactggataagcttctgagttgctttttctttttgttcatcagtgagccagcctgagccctgtgtacccctggaagctgtgggggatccacatactgtgactgtttccatggatagcaatgaaatctccatgatcattaattccatcaaagaagagtgtttccgctcaggggtagcagaggctcctggtggatcaaaggctccaagcatagatgggaaggaagacttggatctagcggagaagatggatattgctgtgtcttacacaggtgaagagttggactttgaaacagttggagacatcattgccatcattgaggacaaggtaactgtgtagcaaaatcctaaaaagtctcctaggcttacaccctttttcctgtctctgacttagacttatttaattctacttttgcccgttttcagctttgtactctgctaaactgatcttccttttcatctctcttacttgtctgcatagcacaagtgtctgcacttgtggttcccactaaatggtaatagcgagcagctgtagcatctaactctgaactggtaacctgagggacctgggctttccctgtgtgctcaacagtttgtgtgttgtgggacaggtggatgatcaccctgaagtgctggatgtggcagcggtagaagcggcgttatcgttctgtgaagagaatgatgaccctcagtccctgcctggcccctgggagcaccctatccagcaggagcgcgacaagccagtacctctgccagcaccagagatgacagtcaaacaagagaggctagacttcgaggaatcagaaaacaaagggctccatgacctggtggacatcagggattccggtgt

SEQ ID NO: 25342 - DNA, 2380 bp, Mus musculus
aagtgttccaccttactctcttggctccagatctcaattggattcatgttcgtgatgttgaggaagcctggaaactattgaaagtgggtcgcaagaaccagagctttgccagcacccacatgaaccagcaatccagccgcaggtctgctgtgggaattgactcttgactgtatctagatagctttagccttccacctgatcatagaagttatagagtaatttttcccttttccttttcagtcacagcatcttctcaatcagaatcttgcaccttcagggagaaggggatatagtgcccaagatcagtgagtaagtttccccacttagaaatttgatcatcttggccatgtggttatgggggcagaagggaacttctcaaaggaatttgctctttcccttcttttgatataaacagcttggaagggcccttccctagagagaggaattatagaacaaactatgagttccttacatcagctcctatgctttactccagactgtcactctgtgacctggctggctctgagcgctgcaaacatcaaaaaagtggtgagcggctaaaggaggcagggaacattaacacttctctgcacaccctgggccgctgtattgctgccctgcgacagaatcagcagaaccggtaagctgtaggctgcggtggcctgggcctggccctttgctcagttcctggtcagccctgagggtggtgcttggatacacacacaccctgccaaaggctgcacttatactcacaatgctttttatctgattctgtacaaggtcaaagcagaacctgattcctttccgtgacagcaagttgactcgtgtgttccaaggcttcttcacaggtcgaggtcgttcctgtatgattgtcaatgtgaatccctgtgcatctacatatgacgagactcttcatgcagccaaattctcagccctagccagccaggtgagaagctatacacataatgattgtattttccttggatgcaattttttttggtcttttgagtcagggtttcactgtgtagtccagctatcctagaactcactctgtaaaccaggctgagatccatctgcctctgcatctggagtgcttgggattaaaggcatgagccactaccaccccgcaggactggcaatcttaaaatagctcttaggagccgggcagtggtggtgcatgcctttaatcccagcacttgggaggcagaggcaggcagatttctgagttcgaggccagcctggtctacagagtgtgggttccaggacatccagggctacacagagaagccctgcctcgaaaaataaaaacaaatagctctagttaaggagtcaattgagattttttttccccttccagcttgtgcacgccccacctgtgcatctgggaatcccatccctgcattcattcatcaagaagcacagtcctcaggttggccctggcttagagaaagaggacaaggccgactcagaccttgaggacagtcctgaagacgaagctgacgtctccgtgtatggcaaggaggtgaggacacaaggcagttcggttgtggcagcttggtggctggacatgtgctacaaggtgtcctggtcgatatggggctttttaaaaagtgcaggggggctcataggtgtggtcttctaggaactactccaggtggtggaagccatgaaagcgctacttttaaaagaacgacaagaaaagctgcagttggagatacagctccgagaggaaatttgcaacgaaatggtggaacagatgcaacagcgggagcagtggtgcaggtactgctagcccagcccctgtgacagggacagcagtggggtgtaggctctgttctccagcttcactcaggatcctcactaccactttctgacagtgagcgtttggacaaccaaaaggaactgatggaggaactgtacgaggagaaactgaagatcctgaaggaatcactgacaactttctaccaagagcagatccaggtgagtttatcctggccagtctcaacagccactcggcttccatcatttgggtcagagcaaacaaatgtctacttttactctgtcttgaaaaaccaagccaaccaaacaaaaacaaagtcctggaactcactctgtatgtagaccaggctggccgtaactcagatccacctgcctctgcctcccaagtgcttgggacaaaggcacacactacctaccaccaccgccactgccagcatcttatgggtttctgagatagggtctcactattgtcgctctggccagcctcaaactaagttttataaactctagaaagaacagtagtatatactataattaatgtttattaggttcccttagtatcgtgcagctattgagtttaagttgagggatgagctcagta

SEQ ID NO: 25343 - DNA, 1575 bp, Mus musculus
aaatagtaccatttttgaaaagggggcagaactccttttatttgtaaggaatgatctgaacagtattttaataatcattttttgagattagcactgaatatattttgaaacagctgtgactttgtttcagacccgggaagaaggtaaggccttgctccgccagatcctacagctgaggaaccaaggggagacacccacctctgacacgccgggtacctttttcctccctgcctcactgtctgcaaacaacactcctacacgcagagtttctccactcaacctgtcttcagtcacaccatagtcgactaccctcacgtcagcacattgctagaccaatatcaaaccttacctgcagtaaagagcagtcacgtctgttttcccaaggacctagacagaaacagcctgagggacagcctatggaaccaccttcagaggcaggcagaaatatggtgggggaaagatggtcttctgcagccagctagcagtgctcccttctattcagagtggcaggtcttggcctttctagccactcccccaaccccccaaggaatcccttttacaacacttaaccagcagtgatgccacagaagcaaggtttcggcgctgctgagaggggtagacaagaacggagcgaagctcaccatgcttggtgcctgtcctctgcatgcagggagctcagctgtgactttctttttaaagacagggtttctgtgtatcctagcctgtggcctttctgcctcagcctccctaatgatagcattacaggcgaatgctgagtgaggcctaactagaacgacctttatgttactgagtgtactgttcggataagagattaggtttagagtggagctatccatatgatcttgtgtagttttccaaagcagccttctaaaatcttccaagtgagtcagtgagtatggactgtggctcacatgagggccagatggccgctgtggccatgctaactatatatatatgtgatgaagcaacacaagaagagaacttcgtggacattatggaagcttttttacttcggattttaaagtctccaatttggttttcaaccttatctacaaggttgaagaattcactgtgtttttctaggtttcagagccacttgatgtctgctacaatgagcttgtgcagtaggtgctatagatcattctgtggttaggagctagccttccttctcttgtactcagaacattttactccccatttaatggaaggaacactaactgggtgccatgtggtggtgcatgtctttaatcccatttggagacaggcaggtgggtgttttgacatagcaacttcctggccagacaaagctacccaagcctcttgggtatcatttaaaattgtactcatttcctagtgtgcattaggctggttcccactgctgttcctgtccaagggtctaacaggccagatggtatttatatcaattttctgtccccctttttatatttttctaaatttggaatccaaataaaagcataaacaatgtctttattccatataatatttgtgcatgaaaaaaaaaacaagattacataggtgattataatacaataa

SEQ ID NO: 25344 - DNA, 1169 bp, Mus musculus
tctctgtgtggccctggctgtcctggaactcactttgtagaccaggctggccttgaactcagaaatccacctgcctctgcctcccaagtgctgggattaaaggcgtgcgccatcatgcccggctaacatattttaaattttgtatgtgtgtgcatgtgtctggaggtcagttcactcctgccactgtgtgggtcctgggaactgaacagttgataggcttgtcttcaagtgcctttatctgctgataagggctgccttaccagccctttaacaactatttttgtctttggtggtggtggtggtggtggttttttgggtttgtttgttttgtcttgagacaaggtcttactctgtagcactggttaagacacctgtcactttattgtttattttttatttttttggttttaaggtgtttattgtaggaaagcggagagagggagaagagtagaaagtagaagccggccatggccacgtggagagaagggagagataagaaagagaacaagaccctaagagagctgtcactcttttaaaaaatggattatttaggaatctcatatcatgcaacccaatcgcactcacctctcagtcctcccgtgtctgtcctccctccccatgacaccccccaccaaaaaaaatttattttttctgttgtccatatactcattggagcctcatcaacttgtaatggccagtctctggccaatgtaagccaaggtaagttcttcaagaaagggtttctttctatagccctggctgtcctggaactcgctctgtagaccaggttggccttaaactcagcctgcctctgtgttattgaatttagctcctatacttggtgggcactgacagtcctttgggtctcaatgtgttatctatgttaaaatttacttgtttacctgtcatttctgattttaattacatctttactttttagtttctgacttgctttgtggcctgacttatgtaaagctcaatttcttttgtaggcttcatgaacagttgactgagtcagagcaggctgcccagtgttacatcaaatacatccaagatatctattcctgtggggtatgtgtcagagcacaagagccttgtcacagatgggctcctgtcacctcggtcacgcctgctttccttatctaggagaccgtggagcacttggagga

SEQ ID NO: 25345 - DNA, 1245 bp, Mus musculus
tgcttcatcgaaagcagacaacatcttaagtggacctcaccaggtatctggaatacatgtacaggaaataggctttcttgctattgcagccgtgaaggaaatgtgccgcccggtcatactctttaacatcaaagtaggccttggccagggtgtaagcatccacatcctgcgcgtcctcctacaaggaacaggttatggagtggttaggtctcagacagccagagttcacctagggaaagcacagtcgttaactctgagatacaggaaagaacggttatttcccctcctcaaaatgtgtgcatgcacttatacagcttagacagtattttagagaaatatactacatgtaacgccaaacaactgtttttcctaagtttttttttttttttcaaaataaaaaaatggagcctggcacagtgacacctgcctttactccaagcagttgggagtcagaggtaggcagatctctgtgaagtcaaaccaatcccggtccacagagtaagactcaggagagccagggttatataataagacttaagtctacggccataccaccctgaacacacccgatctcatctgatctcagaagctaagcagggtcgggcatggttagtacctggatgggagagcgcctgggaataccaggtgctgtaggctttaacaaaaaaaaaaaaaaaaaaaaaaaggttgaggtctggggagatggttcaatgagtaaagtgcctgctacacacacatgagagactgaacctggcccccagcacgtagaaaccatacagcaccatacaatcgtaaccccagtgcatggctgtaatcccaacatccagcaggaggatgaattcaaggctctcctcagcgtttgtgtgaggccagtttgaggactcagcaagtttgaggtgaggccagcctggtcaacaagagactctgtctcaaaagagaaggaagagtgaggaaggcaaggagaaagggaagaggcagagagagggaaacaaggtcacgctcattactacagtggggagcacccctgcccgggtgtgtgcacacacacacgtttgctggggccagcaagatggctcagaagataagagcacttgtctccaagccaagccggaaatttccaggaccatgaggtagacagggagaattaactcctataggctcttctctgaccttaacatatgtgacatggcatgtgtgcacacacatacagatacaataagtgaataaagaagcttatacatgaat

SEQ ID NO: 25346 - DNA, 1175 bp, Mus musculus
gtatggggattagctgattagtgcttgtttttgtttactcttcagggattttcaccaggaccttatgaaaggtatcccagtaagtagacctccatccctttccctccctccctcctctgctccctccctcctttcctccctccctccatccctctcttcctttctctttgtctttctgttaagagagggcctcttaactgtgtttagctacctgggctggtgcagccgttgaacactgagacggaagccatgtgccaccaagcctagattttccttcctgactttggtttgtctctcaggtggatggcagagggttccacacagccgtgtggctgtagctgttggatgctttctgtagacatgtctgtcttttaggtacagcttctttgtagtactccgaatgctatgaatcatggccacagaaagaagattgcaaagcgtagcacatctgcacataaagaaaatgtgagtgttacttcctaaactgggaactgtcagctctgttcagtttgttggtttagatctcaagttgctgctgctatcctgaaaataactgtttggagagcatcacaaacagtgtgtgagtgtaggttcctgtaatggactgctggaagtcagtttttgccttttcacatgggtccagggctggaattcaggactttaggcttctttcccagcaagcactgtttaccactgaacgctagccctaaataattttactttgtaagaacatacataacataatttgttcataaattctttgtgggttttttttttttttttttttttttttttttgcacttttattgctaaggattgggtgtagtcattgttcaaacagctctttcatgtcattgagctatacccctgccttgtcttggattcctgaggatggagcagtatacagccctagtgcatgccaggcaagcagcagcctacagctcactttttgtgtgctgtttttaagatagagtccatgggactggagagatggcacagcggttaagagcactggctgctcttctagaagacctgggttcaattcccagcaaccacatgggaactcaaaactgtctataattcacaacctcacatagacatacttgcgggcaaaacaccaatttacattaagtaacaataaataaattaaagaaaaaaaatacagggtccagtta

SEQ ID NO: 25347 - DNA, 2439 bp, Mus musculus
ggatcttgtgggtttttttgtttgtttgtttccttaatataacattgggcttgttcaaggtgtcaagaggagagagtttttgtttttgtttttgttttttttttcggtcttaatagctctggagccaggcttttaagttcatcgcatcactgctctgtaaatggttctgttttggggtctagcagaatcttttgagtactatgatttcagctaatgggcttttctgaagtcccgccctctcccactagatgaatctagtattgaggcttgaggcagtccccacacttgttgttttcattgtctaagctgtctgcagcccgcttctctcgcttgctgagaagctgcaagcagatggacaactgaggcagagctaaggagcttgggcgctctcctcttccccaaggggacctttccttttctgatcttacaagtcagagacagggttgctctccaagaatgtgttgaggcagaccaggagcagtgacattattccctggaagtccttgaggccaccctcagcactgccttttggaagctggctgtagggaaacttactcttgcaatatctaggcccggtctctctctgatctgcttgaaaaagaggtagggtgttcagcatttaatagtttgcttgtcttccacacttgccaggaaatgtttatttgcttctaattggccctgagagaccacagagaggctggggctcaccgagggattgacttggggtgtgtaaagcaaaggctatgagaagcagctgggagtttgttgttgttggattgaatttctttttttgtttctcacccacaacttcagccagtgcagcagatccagtggttggagggatggacttgaagattgcagttaccttggtagggttggcacctgtgggcatgcatatagaagctgtcactatgcatcctgtgaggctttgtttagaacaccctgtatagcgaaattggacctgcccttcccagttgttatagtaagggcacttttctgttcaatttccatggtgtcttaaggcccagttcctagtgttacagaagacaactaaggtcatgtactttcttccttgtggaattgagcctgatgtttaatgtctcccacatgctaataggaatactatagaggcgtcagactctttgcctccacttcaggggaggtggccatgtcttcttaaacctgtggccctcagaggttctaccttctcaaggctcctccctgtctcctggctagttaccacatcttaccactgggctaccggtctctaagggcctacgagagactctcctgagaattcagggaaactgagcccaggagttatcgtaggtttcatctttccctggttctccctctttggtccataatttccctggtgccagcttcttttccacctggggcaacctcatccctgggctctctgctgcagatggcagtgtcagcctccagtaggtcactggcagtgccaatggggtctctgcgggccccaagtttaagtgaaggcagtgattctgcctccaacctggctttcccaaagcccttaggtcaccgcccttagggaaggaggcctacaattgtcatattttaattccattactttaagtctggaatgttaaactaggcagaactatcatcttgcttcccagtttaaatgcctctggccctggaacaagccttttcaagacgtgaatcgttggttttacacagtagctctgctccaacggttctgtgtaaaccaaacgctgttttttaatgcatttggactgctgaccatgtaaaggcagcctatgtttgcttcttttgtaaagcaagcaacttccctctactttagccagtttcatcatttgggttctcacacagtgggcttacccagagtggagcacacctccggggcttgtggctgctgctgtgtagacgcctgcatctgtgctgcgtgtgtggtgcgtgtggctggccagcaggtgagtcttactgcgtgcgtgagtgaagccactcccaggctgatgctctcctcctgtgcccggtgactgcccagtggcagctctagctgcccttcattcccacctgctgccaaagtccctgtgctaatgggattacagaaacaaaaagtggaaaaaaatttttcgtaaactttgttttatattaaaaaatccataagtctgtgtgtgttaaaacatgaggttctgcctctgtggctgtgtttgaaaaaataaagttttattagaataatccattttcccaagcaaccttgtgtacgatagtgtctttttcccttatatgtgcacatgtgtgtgcacaaacatgcacacacaaacacaaacacatagagggagaggaagaaacattcctcttaatttaacttcattgcagaagggcagtatctggacactagactctgtgatcagactctgttacctgggattctgtcgatatggcttg

SEQ ID NO: 25348 - DNA, 1582 bp, Mus musculus
tcctagctccacactgccttccgaatacttggataataaccaatgaagtagcggtttggatgacaccctgctatctctggctcatctttctaaaacaaaaatgacttgtggtctgtggctagttttctcgataccagtgctggtgaaatccaggtgtaagagcaggttcatgaaatataggagagaaaagttgattgacttatagaactgtgatggctatgataaaggaaggtcagtgggttggatcatcactaactgaagctaaaatcttccttccagaattcaagaaattctagtctggcctcttctggatttggagtgtctctctcaagtttgtcacaaccattgacttttggaagtggacggagccagtccaatggagttttagccacagataacaagcctttgggcttctctttcagctgcagctctgcatcagagtctcagaaggactccgatctctccaagaacttgttttttcaatgcatgtcccaaaatgtacccagcactaactacctgagcagggtttcagagagcgtggccgatgactcctcgagcagggattccttcacacaaagcctcgagagcctgacttcaggcctgtgtaaaggcagatctgttctcggagcagatactcagccaggtcccaaggccggcagctctgtggaccgaaaagtgcctgcagagtccatgcccacccttactccagccttcccacggagtctcctaaatacccgcaccccagagaatcatgaaaatctatttttacagcccccgaaactgtcccgagaagaaccttctaaccctttcctggcgtttgtggagaaagtggaacacagccctttcagcagctttgtgtctcaggcatcaggtagctcttcctctgctacctctgtcacctcaaaggcaacagccagctggcctgagtctcactcctctgcagagtctgcacctttagcaaagaaaaagcccctctttattacaactgactcctccaagctggtatctggtgttctgggctccgctctcagcactgggagtccgagtctctctgcagtggggaatggccgctccagctcgcccaccaacagcctcacccaacctattgagatgcctactctctcctccagtcccacagaagagaggccaactgtggggcctggccagcaggacaatccgctcctcaaaaccttcagtaccgtctttggcaggcactcaggcagctttctctccgccccagcagagtttgcacaggagaacaaagcaccttttgaagctgtaaaaaggttctcattggatgagcgaagcttggcttgcagacaggattcggactccagcaccaacagtgacctgtcagatctgagcgactcagaggagcagctgcaggccaagagtggcctgaaggggattccagagcacctgatggggaagctaggccccaacggggagcgtagtgctgagctgctactgggcaagggcaaagggaagcaggccccaaagggccggccccggactgctcccctgaaaggtgatccagctgggaccatacatggtctttgctctagcacaaacaccaaatgct

SEQ ID NO: 25349 - DNA, 1254 bp, Mus musculus
tcactataagagttatctggccacaaaaaaacatttttgatcttattaatttttttaaacatcgggaactaagtttttttgtgtatcccatttgtttctacttctcttagaccatctttaaatttacttcagggagttaggaagaaatagtcactgttcccatagcaacctttggtaaatttgatgaagcaaagagatccacaacctctatttgttcttccctcaagacgcaccagagctcagtagctatgataggctattgcttagagtctagtgataaaagcagtgctttccttcaggctctggtaaactttaggataaagtccaagaggctttggggtcctgaagagccacagccaggtggtgactgccttcttcctccctgcgggggtttcatccctatccctagagttctcacttagctgggttactcagagttgagttctccatggctcgtagttcccaaccgaagcctttttctttcatgcgctcttttctgggtacatcctcaaggagcatggagagaaatagctcacgtcagggtgtgtgtcttgtactattgagccctgtttatgcatacctcttgtgaaggccctttgtcctccttccccacgacagttggccagtcggtgctgaaggacgtgagtaaagtaaggaagctgaagcagtctggagagcccttcctgcaggacggctcctgcatcaacgtggcgcctcacttgcacaagtgccgagagtgccgcctggagaggtaccgcaagtttaaggaacaggagcaagatgattctactgtagcctgccgcttctttcacttccggaggtactgggcttttatctaactcacttcccagttttcattggttttaaatgactgcagctctctctgaacccacagatgtgtcttgccatctttcttaccttccctaacctttgctcttagagtctgtgttgaggctctgtcagagtagtcagtctctcagttggattgtgaagtggcatgtggctttgtccttagagagtgtaagttgaagtattttagctatagccttgtgctgtccctgagttattctcaagtctgattccattgggagttgtataagcaagactcagattcttttgtggctccccctgaccacctcccttccctcagtgctagagtaagctgagagatgggcatttgggacgtagtgcaaagctgcttctgtccttcttttgtcgttcagttggtttgctttaggggcagtgtcttatttg

SEQ ID NO: 25350 - DNA, 1176 bp, Mus musculus
tacagagtgaggtccaggacagccagggctgacagagaaggttgggggatggaggcagagaaaaaggttttttaaaaaaaattatggattctgaaaatcacttggcaattattctctgaagatcagttctgggcctcaaggagtctgatctgaaactcctatagatctgttacacaggaaacccgggacctctgcatagtctctgctgctgtgtgtgcgcaggcggccctttcctctacccaggtatttattctccctgattttgctctgtctcagcccagtggggctgccaggctgatttggcctcctctgtgctacagttagaagctgctcctaggcagtgcacaggccactgtagaaactagcttgttcagttacatagcagctgtggcaacagaaagggattaagtggaagagccaaatgtaaccctggacttgtgagtggaagttatgagctgaaggaaggaaatgcaatgggtgacttgatgttgatgccacctgactcttagatgttgagagcagcttgactactggacacacactgagtgcattcaggcaatgcctcttacagcctaaagtggaatctactgtgatcttcagatagcaggaagatagtctagtgatggaatgttaccctttgactagtatcatagcactgctagcctaggttcttttggtaatagacattgtaatttaaacggaaagttccatatatatgtatatattgactagatcttaaaaccttgctaatatggttgcctaccacttcagactccacatctggcaaagtttaacatcggaggggcctttcttcaagtaataggcattccatttgtgatgcagttagctttatggcacatagacattcataatttgagccaaggatgttcatgtgtacttgacaggtcaaactatgaaggacaatgtcaaatccaactttctccatgtatgccttaggttgaatttgtttccaagttaatagcttttactggcttagacattcacactcatctgttttattttatgcttagtcatatttaaatccagaatttaatagtctactagacagataaatgagatgcatgaatataaaaatatataagggaaaggagatggtaaactatttataactttattatattactaacatttcaaagtttattagttgcttataaa

SEQ ID NO: 25351 - DNA, 1228 bp, Mus musculus
ttgaatgtatgtagggcaccagaccctgggagctagatttacaaagggttgtgagccactgtgtaggtctggggattgagccctttcaccgtgtcagcagcagtgccttttacctctgggccatctcttcagcaccattgttgtgccattttttttccttaatcttttaaaagatttatttttatttcatattatttatgtctgtgtggcacatctgtgtgccgatacctttggtgttcagaagggggcttgagataccctggagctggagttacagactgacaagaattctggaaactgaacttggatgggttccctagaagagaaagaagcactttttttttctttttttaagatttatttatgtactttatgtacatgagtgcactgtagctgtctttagacaccaaaaatgggcatcggatcccattacaggtggcgtgagccctggttgtggttgctgggaattgaactcgggacctctggaagagcagtcagctcctgaagcccagaagaagcactcgtcactgctgactcacttctccaggccttgtgttagcctcaaacactcagagtgacctagaactcactatctaactaaggttgaatttaggaccctccaactcccaagtactgggattataggagtatcccaccaccactctgttgtctacatgctagaatgttgtgtacatgctagaatgttgtctacatgctagaatgttgtctacatgctagaatggccccagggcttcatgtaagctaggcaagtactctgcccactgagaatgcatccacagcctacaggaagtgattttacatgttttaagtaggccttgaacttgggacaggtgagtgattagctctgtcagagtgaaagaaagcagtcgggctggcgagatggctcagtggttaagagtgccgactgctcttctgaaggtcccgagttcaaatcccagcaaccacatggtggctcataaccatctgtaacaaaatctgatgccctcttttggagtatctgaggacaactacagtgtacttacatataataaataaataaatcttaaaaaaaaaaaaagaaagaaagaaagcaatcagtagatcaattgctacttcttcattgctgtgacaaaatatccaggaaaagtcacttcaggattgtattcaaagacaggattcagaaatgaaatgttggtgttcttgctcttctgtttttagtcagttttgg

SEQ ID NO: 25352 - DNA, 1146 bp, Mus musculus
gatatgacagtgtggcgctgctccatgatctttatatagcaggtgcctgaggaaggaggagcttagcttagcgagtttcctcatttgcatttgtattgtgaagaaatattctcagcagccagctatgtctcctcacctcaaaatactggtagataccaacttaatttttccatcccagtgcttaggaggcagaggcaggcagatctctgggagttcaaggccagccaggtctacaaagcaagtctaagatagctagggctctattacacagacaaaaaaaaaaaatgtagtggtgtcctccagagtgagaacacagtataagagcagagtagaggccgagtccattctccgtagccagagatgatgacctgggaattctcatggagcacagcatgtgtagatggttctcattgggttgcttttgttttcacagccagtgctagtttcaggggtgcataaaaagctcaagtctgaactctggaagccggaagccttcagccaggagtttggagaccaggacgtggacttggtgaactgcaggaattgtgctatcatttccgatgttaaagttcgagatttctgggatggctttgagatcatatgcagtaagtaacttggttatctggttaaatagagacagtgtagtcctgcacctgaaataacagcccatcccccatggagggaggagccttctgtttcgaccccagctgaacagagctgcatggcagtcctgtcatcccagagcaggcctgctgcgcttcatggaagacttaggttgtatggaactctgttgctctaaggaaaggagcaagaacctgcgaaatggagcagtaacagcgtgggtggagaaagcaaggctcacctcacctggcccattatgaaatgagaggttgcatctctcaacaccggtccctagattagtcaggagaggtttatgagaatgctgtctgtattctagagagactacggtcagaagatgggcagccaatggtgctcaaactcaaagactggccccctggggaagatttccgggacatgatgcctacaaggtgagtggtttcagatagtaccgtcctcacgggcttgtgctgggtggaatccagcagagcccaggcacagagacctgagctctagctcttgttttcc

SEQ ID NO: 25353 - DNA, 1864 bp, Mus musculus
ggtttaggaagcacggtcgctgtaggacttagccgtgcggctgtgagctgctgccgggaactgacagtgctgattgttctccaggtgaagaacatcatataccacgcagtgaaagacgctgtcggcactctcaaggcccacgaatccaagctcgcaaggtcctaaaacctggggtacttcagctctcctgtcaagcaggcctttcacaacacttaccagggaacggcagggttctctgcaggagcagaggcccttccccaagccagtgtggtcagtattacaaactccagccgctctttctgtgctgcctcaacactgaagggtgacacaagcaagtcgcactgttgacacacagtgtcagactcaagccgagggtgccacattcccatccagtggccttttgggaatccaggttgcttgaacattgctgggctctcctgcacattctcctggtttgagaccatggaaaccaggaatgtgggcacaccttcctttcctgttcctcttgtgcctggctaactagggatgtgtttggaggcagaggaagtcataactggcaacataaggtgatgacttactgtgcctggtgagagcctggcagtgtctccacacgtgacctctgacctggcccatcctaggagatgggggtgcagcccttcccgtactctccatgaacaccggagtcttcaggacccagggagagcccactgcttttcccaggaggctccaggattaggaaacgtgtatttagtgaaaaataggtttgtagtgaaatagttactatttcatgaaagtagatatttttagaacttttgaaataacagttgttttcctggactatgaggaaaggcacattacagttagtcttcctttcgataaaactctttgaaaagaaatatgatttttagaaatcagctgccccttatagcacaaaatcagccaaagcgtgatttaaaagaattggctttttattaggagttttttagtttctccgcgtccttctcagtcttatcttgagggagcagtcatctgagaaagaactgcatcatgtctgagcttcggagtgttccctgcacgtgaactgctgaccccaggagctgtgtcaccaattaccagcgttcccttgggactcctcatgtgtgtccaaacggggtggaaagtttgatctccaatataaagaagttttgcttttgttttttggagttttgtctagaatattttcagcaaagctttccaactcagtggagtttttattaaggatttacttggaaatgatagaattcattggcccataggtgcattgggaaatgtgtctctttccaggtgtactaccctgcagccttgtttatatgttcacagttactttcttttttttttttttttaaataaaagtcatttattgtagaatacttttaatttcactttctgtattttaattttattgaagggctgattgggatttccatgttcttattaaaaaatctaacaaatctctttggagtagacaaaattctttctctaccaacctttctaaagtcaagaaagtctctcacattgggtgtgagagatggagttgatttcagggtttcctactgccctgcctgcatctggtcattgcactttgctgtttgaattgtgcttagttgggaggaagacagacagtggggatggagccatgtgagctgggaagtggagagagggttcccagtttgtgctcattgaacagaatggagtacgtgcaatcctgctaggagccgtgcaatcctgctaggagccggatgagagacgcctgccctgacgtgcagcctggacagagctgcaggccaggctgtgaggctgcagtcgcctgcctgccttaacctgt

SEQ ID NO: 25354 - DNA, 1099 bp, Mus musculus
ttctcccaggacaattgaaatttgctaaagggaataaaagaaagcaaagggagaggcaggaaagacataaaagcacaggagggaagagatggccgcaagaggggccacctcttaggtcagatggaagatctcagagccaagtccttctactcacgagtagaaggaccgttggccaacagccctttcacttaccatccctgcctcccccgtcctgttccctttgacttcagctgcctgaaacagccatgtccaagttcttcacctctatccaaaggacttgatttgcatggtattggataaatcatttcagtatcctctccatcacatgcctggcccttgctcccttcagcgctagaccatcaagttggcataaagaaaaaaaaatgggtttgggccctcagaaccctgccctgcatctttgtacagcatctgtgccatggattttgttttccttggggtattcttgatgtgaagataatttgcatactctattgtattatttggagttaaatcctcactttgggggaggggggagcaaagccaagcaaaccaatgatgatcctctattttgtgatgactctgctgtgacattaggtttgaagcattttttttttcaagcagcagtcctaggtattaactggagcatgtgtcagagtgttgttccgttaattttgtaaatactgctcgactgtaactctcacatgtgacaaagtatggtttgtttggttgggttttgtttttgagaatttttttgcccgtccctttggtttcaaaagtttcacgtcttggtgccttttgtgtgacacgccttgccgatggcttgacatgcgcagatgtgagggacacgctcaccttagccttaagggggtaggagtgatgttttgggggaggctttgagagcaaaaacgaggaagagggctgagctgagctttcggtctccagaatgtaagaagaaaaaatttaaacaaaaatctgaactctcaaaagtctatttttctaaactgaaaatgtaaatttatacatctattcaggagttggagtgttgtggttacctactgagtaggctgcagtttttgtatgttatgaacatgaagttcat

SEQ ID NO: 25355 - DNA, 2310 bp, Mus musculus
ccaggtatcttgcggtaccgagtagatttccagggaatggagtaccaaggaggagatgatgaattttttgaccttgatgactactaggtagtcgacatgggtccggcaaccgtgcctcaccctccagcattcaacccaaggagcatacccgtggtggagtccaacagatccctgccttacaattggagcatttccagaacttaatccgtgagcattggatactgaaaagaaaagtgaaacaaaaccagacccaaccctacactttggtttgtcgtggtgtcagcgcagcagccgacaactaagtctctaaaggccactgtggactcatttaaaaagaatcccagtttttacttttacttgatggtaaaattggttgctcttgtattttatgaaaaaatgatttttttaaccttcatacatagaagcaaaatactttaactgctgtaaaccttcaaaagttagtagacgtgaggtcatactggtttgtttcttcctttgatcggagaataactaaattgctgcatttcgcagtgacccatttacatggcattctcggcttagactgcacaagaagaaatatatgtgaaatattggaactgtttctctcttggtctctgtttaatgttgaaagggtgagctgacaggaggcagtttgagcttcactccctcacactccccactcccagactgtccctttcaaaggtgcaggttgcgttgtaaagtcagactgagtgccaacacactggggccagggcactctgggcagtcaccagtgtggaggcacagttgtgcctggcatttgggagccctctgtgccattagcgttactgaggctccctgtcatctcagcctactagaaaccagtctgggatggacatgatgggcttctgtgctattgctgggattgggagaaataaaacatgcaacttaagtggaaccaaaaaaaaattcaaagatgattttgcttggatctattcttggtaaggggaggcggtggtgtttccttgtgttggatggcatgagattatgtgaatgttttgattttatttttttgttttcaaatgaactgcaagatttttttcacgggaacgacagacacgacacgtatgaccgtgcatgtatctcaaacccctggtggggctggagcatctatttcaaaaagtgggatctacaagcacctctcagatgagaaagtatggaggcgggtggggagggtaggggtggggtgggtaggacacggctgctggcaccatggactatataaaccatgttagagccggaagttggcctgaaaacctgaggcttaggcttcatagctgggctgtaaattggatttaaacccagttggagtgcaaagtcatggtgtgctcaaggtggtgacagtgaacagagtatggggtgcccggtggtagcggtgggaaaactataccgagtagactttgaaggaccgaaggttttttaagtcaactggtatcacccacactcaccagggtggtagggtgcattgggtttcaaattgggtacttttaacactttagtgcctgactgctgttcttcactgacttgactcagtcacttgtagctttattggtctgaaccagctccttgttcccaggttacagacctgcctatctatcgttccaataatcctgtttcacttgaatgaagggagtctgtcttcaatgtaaagcttctgcttctcacactgtaccctgaggtccaaatgactgtctgtcctgtaacctgatgtctcaacccagtgagaagagtcagttccttagtgttcaccaacacgggaggcttcaccggaacaggcttttgctttgggctctgctgtttgtttgcagaacacccaagagcgagcgaacacacccttcccagcagtaccttagggttttgccattgtaaatgggtctaatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctccttggtgatatatattgcattatatattgatgtgtgtatcaatatataccgatatgtgttacacttacgcatacaaacacacataagtgaggggtgaaaccgtagcctgcactccctagcctctgcagagagaccctaagagcagaatctcggtgttgtgatgtacagaaatggagaagagtattaaaccatatttaagaatatattttgtgtgcttgagatt

SEQ ID NO: 25356 - DNA, 1614 bp, Mus musculus
caggcaggcagcatcttccctacagcaggcgtcattgaaactcttcgaaatggcgtacaaaaaggtacaagggctggaggggtaactgggacctagttattggggttccctctaccatttatagaattgagaaaactgtaaatagaatgtcacggggaagatgaggtttgtacggtgaatgaagcctgttgaacagagagcgaacttgtggatacctgtgaaatcttagtgatcctcaagtattttctcaacagatggcatctgaacgggaaggttctggaagttctggcactggggaacagaaggaagatcagaaggaagagaaacagtaatcgtggcagtgcattgtggagccagaaggacatactatgaagcttgggactaaagggacttcctgagcagaaaaggggcagacttcagtctttttactgtatttttgcagtattctatatataatttccttaatatataaacttagtgacaattgctaactcatttaatgggtaataaagtcagcaatagcaggttcatactgttctgtcactagcctgttattttcagctgcatgtaaaggggtgggatggggctgtgaaccaatcattaaggtagatttggtttgtgctgaaatggctgtgatttcaaggtgggaagcccatttcacatgcagtggaggtagtctgtcattgaccttgagttgagatcatatgcagatgcttgttggccaagagcactactataaagaatgacctctgtatatttgctcctacaactgatgcctttaagactgagctacctgtaccatggtctgtaggtgcagaagctaggtcagtggatagcagttgtgttagccatagcttaaagtatgatatgagaatgatataagcctctcatgggcctgaggcatacttctctagccaccctcttggttggccaatgtctggcatctgtattcttgatgattgttcctttttcatccactctggattttttaaataaaattctgaaagcctcttgatctcctttgtgaatggtgatagctcaaggattatgactgctatcagttttgtagggagaaaaatcactggctaaaaggttgaacaaatgaaacatggggagtgactaataaaatgctggcatatatgctggatgtgaaagtccactcaggaagcagtttgaagccaggcagggctgtacagttagactctgtcttaataaaagtactggcataaacaaatccagtcgttgtaatcttctatctagaaaaacttcagtgctttttaccttgaacaaatttcaagcagagttggtttaaagaatatagtttcattagtaagttctaatgtctgatttcagtgactcgggacagtttttgggtgttttgttttttggcctatgtctatgtgcttatctcctgaagctgtagttagaggtaactgtgagccctggtggtggccctgcatttgctgagatagggtttcactgtagaatactggaatgtactacaaagccacctgatttctaaacatttttgaaacattaggatagggtttccaagatacaaaaataggatatacagctattatttgctataagtaattatttcatgtggaaaca

SEQ ID NO: 25357 - DNA, 1123 bp, Mus musculus
caaaataagaccctaggattctggtttattctgttattgatattaacaaattctcctaagatgctgtgcacttttgttacctctaatacataggctcagaaactatccctcatttcagatgtaaaattgataatacttcttcctaagattgggcgattgtgtagaatatgagaactgtattttataaccccttgtcatgtgccttctatttcaaatgatatcctctgggaagctagataattaaattcttctctcatttaagtggacagtggatgagatgctctgaagttgtcaaatacaaacaagtctgcagtcttggatatgaatctctctgacttgctgtctggcaggcgtattctgtttggctccatcagtcgccctgggtgttggctaacaggttctttctccctgatgcttaggttcagcagactgtacaagatctttttggcagagccccgagtaaagctgttaatcctgatgaggctgtagccatcggagctgccatccagggaggtgtgttggctggtgacgttacagacgtgctgctcctggatgtcactcccctctctctgggtattgagactctgggaggcgtctttaccaaacttattaataggaacaccactattccaaccaaaaagagccaggtaagagccattcttttttcctgcctattaacagtcccaagttgtacaagtgctgtttacaatcactttatgaactctttaaaactttgtttctaagactatactaactggactgggtgttgagactatgtattttgtttttttcctccccctttttttgcagttcctagaaaagttagacctcaactagcagtggtgaaagatgatgcaatttccttaaaaggctgttgtcatttattaccatatattaccatagtccttgtagtcttctgttatcaaaagcaagaaaagcctggggagggacatgggagtaggtttgatttctgggcgaatgatgggctgtgttgtacaccaccaagtagggacatatgggtctggcatggtctcagatgaagaattacttcttgtggctggtagattattccaacacttggggatgttgagacatgaaaattcagagtttgagaactgccttg

SEQ ID NO: 25358 - DNA, 1163 bp, Mus musculus
aataagaactagcttatgaaggcagggagggagcagcctgggaataaattaaagaaagaaagccgcatccatttctgcctctgaagagcagatgtcagcatgcctgcccctcttgctggattcagcacctttctagagataaatggcagagctcaaagaggcttcgtgcgggacctgtgctgagcctcgatggccctgggatatgtcagccaccaggaaagaggcctggaggttggaggccaggtctaggcttctagtatctgagagttaattttgtttttgtttatagaagctattttattgttagcactggatataactgtaaaactgaaaaagaggccaagatatggtgatatagactgtattccatccacttggaagactgaggctggaagattctgagggcaaggcaaaaataaactacacagtgagacccagactcagaaaagccaaggaagaacaaaacaaaaaagctgaaggaagatcaggtaagagtcatttttttcttgtggttggggatttagctcagtggtagattgcttgcctagcaagcacaaggccctgggttcggtcctcagctctggaaaaaaaaaaaagacaaaagaatcattttttcttttcttttaaatgaagatctcagactctgtgtttcccaggctactcctgaaccctggactccgtgtcgcagcgtccaccgtgtcgcagcgtccaccgtagctgcacttacaagcagatgctatcaggcctggctagatgagtttacaagagagattgtaagatgctaagatgtttaccaaagtgacacaggaatggacttgttggagcttctagaagtgataagtcacagcttgatggttaacctgggtctctctgaagccctgtctctaatggacctgtggctcttctcacccacatggccactacccttcatacacccctgctcttctcggcttccttttctggattttggagtctctggctctcatatggtgttccttaaccttggagtacttgactcttctctcatcatgggacagtaataactgaaatcgcaggatgctcgtgaggctccgaggaaggttaaaattctgtgatcttggaccaaacagggattccagatttcctagaacttagaaacttctcagatgagctacagggaagga

SEQ ID NO: 25359 - DNA, 1209 bp, Mus musculus
tttgagtctgaagtctctctaaaaacttaatgattacttaagaacttaagatatgcattatatttctctctctctttttttaagatttatttatttatttattgtatatgaatacactgtagctgtcttcagacacaccagaagagggcatcagatcccattacagatggttgagagccaccatgtggttgctgggatttgaactcaggacctctggaagagcagtcagtgctcttaaccactgagccatctctccagccggcattatatttcttatcgtatacattaagaaacaaaattattttggaaactaaatatagcataattttaagaattgtgttatttcatgtttagtaagatctctaagtgtgtctgtcacctaacttacttatgaacttggaattgctatctttaaagatactagtctactatttttcattctaaatgattttttttttaaattaaacttctaggttacaaccctggtaaacaccaatagtaaagggccgtctaataaaaagagaggccgttctaagaaggcccatgttttggctgcatctgttgaacaagcaactgagaatttcttggaaaagggggataaaattgcaaaagagagccagtttctcaaggaggagcttgtggttgctgtagaagatgttcgaaaacaaggtaggtcaatatatgaagagagacaggttttcctagaaatacattaaaattttaaatttacatttatttatacgtgtgtctgtgattctatatatgggtgccacagcatggcatatggaagtcagaagacaactgtgggagccccctccctccctccctccctccctccctcctcccccctttcccccctcccttccttccttcctcccgtcatgtgagtctggagattgaactctggttatctggttatcaaatgtggcagcagctctcactgagccatctcactggccctaactgggcttctttctcatgggttattcaccaggggagagttggctgctgtgccatgagaacacttaggaagttctgtagcaaggaggtaacgtctgctgctaatggccagcagcatacttttgccaagcatatgaatggactactttggacagatagccatttacattcaagattcagaagacagcactcccaactaaccccaaaggattataaatgctccttttaagctatcattaatttttgaat

SEQ ID NO: 25360 - DNA, 1155 bp, Mus musculus
tttgttgtctgccagccttgaaccagaaagtcttctttcttctacagtagaggccacaggcttctacacttacatgttcagtgtgatttgcgtatatttttattttattttattactaataagcacctgttaaataggagatgaagaagttgttatggttgaaatctagctagactgcattataattgatgtaaatgtttatctgattccttatagtcactgagttaagggaagaggtattttaagcccttttgttatatagtacccagatctctgttatatgaagatacttaagtaatagtacaaaccgaagagagaaaaacagaaacaaagactctttaaaatacacgtatatatgaaataatggagtgtgggctatcttaccctttaaataaaatgttagtttttaatgaataaattatttgaattaatttctgctggttttgtgttttcattctgtaaaataggagatttgatgaagagcgctgctggggagtttgcagatgatccatgctcttctgtgaagcgaggcaacatggtccgggcagctcgagctttgctctctgccgtcacccggctgctgattctggctgacatggcagatgtctacaaattacttgttcagctgaaagttgtgagtttgtatctatatttataatttgttctttgtgtcctagtgaagctggtgttggccatattttgtttagtattaagaattattttggggctggagagatggctcagaggtgaagagcacttactgctcttccagaggtgctgagttcaattcccagcaaccacaagatggctcacaaccatctgtaaaggaatcggatgccctcttctggtatgtctgaagacagctgcagtgcactcacatacataaaataaataaataattctttaagaatgcttttggttttgactcagtgattgctttgttcaatttcttctctagttcaagtatttatgacacaggctcttctacaggccacctttgtctcagttttgctgaagaaattgtaacaaaggtatttttgactgccttttattttattttttttatagtactcattctatgtttctttgtactaatagtgttccagaattagaaagccaaagtataaactaattaggtgctcctcaatacctcca

SEQ ID NO: 25361 - DNA, 1172 bp, Mus musculus
acttgtatgtacacattcgagtctgtcctagttagattacaagagtcagagctacttagagagagacacagacacacagagagaaacagattgattgtagagattaacaatatataatcatggaagtagttaaattctgaagtagattaaaagtatatgtgaggctgttgctttcatacatcttttataaaagaaaaaggactttaagcttggtgtttctaggaaagaattgtcacattaaatgggtttcatataaattgacatattccaaatatagatttctttgaaaaatgtcatggttgaatacaaggtagtaattaattgcctcactttgagtacttagatttttaaatttttttaaagttcttttacatagaccattttaattggatcaaaattatttgacctggatggctggaagaagcagcccagttatagatgttttaatgatgcttttagactttatttctgtgagataaatcttccttttgtaattctcattggtaccacatttgcaggattctgtttatgtaaatagtgttttcttttgtgtgtgcatgcgtatgtatgtgtgtgtttgtatgtgtgtgtgtgtctgtgtataagaaccctgagacatctcattgtcttggcctgtaaatagttttattatttaatttttttctatttgtattggcagaatttgtctgctcattatttatggttatacaagtactagttggaaatattgagtgtgactacacacatacattcaacttagtggttctctgtctgtctcatcaaatataagcagccagtactagaataaaatggagataatgaaatgggttaaaaaaaaggaaaaaatgactggaagtgagctaagtagtggctttctctttgatatgacctgggtttcatcttgatcattttgtgcccctactctctaccaccttagatttatacatttgggtatgtgcacttgtgttctcttccccttccccaagtataagtagaaagtgtaaattcttgcgttttcaaggaaagactgaatgaaatgctgaatgagtagactgccaggcatcaccgaagaaaaactgctgtaggggaggagaggaaagaacaatttggtaacttctcagactgcagttaactaaaatccggaacttatttatgtgggcattggaagtagg

SEQ ID NO: 25362 - DNA, 1090 bp, Mus musculus
aataggatttttacctaataactgctgcaggggactacagctgccagcccctttggtctttgatatgtactgaagtctcctctgctatattctcttgtcctttgataaaaataaaattagactttagggataacacattgtttttttattcctcaaaatagcctttggcacccaaagagaaagcccagcattaatttatgtcatgttcttgttgtcataaagtaagcatttatggaattgcttgatgttgggtaaaaacatctcttctttaaaaacttttgtccaaggatggtttttaccttcatgtgcatttgtagattcgttggggaattgtattaaaactgaaatcttcgttatgattgattcagaggtcagcctgaaccctaagtcctatgtgaagagctttctttacagagagggtgaggaggctgacacactgctctggtgaccagaggctgcaccctggcctctgtactgcaggctaagggctctccctcagccggaagcgtgggctgactgattcatggtctttgtttggctgcagacccccgaggagttggacgactctgacttcgagactgaagactttgatgtcagaagcaggaccagtgtccagacagaagatgaccagctgatagctggccagagcgcccgggtaaggacatggcccttggtcctctgacttgtttgggaaaggctctgtggcacttaggcctggctcttttctagggtgttcagaatgccattttctgatcctttttttcctgtggagtacagctaaaatcctcagtcatggcagctgctagtaacttgtggcttcctacaaaacagccctcagctaggcctaggtgagagcccaggtccacagctgtacgctgggctgcggtttatggtgccccctgagtcaggaaagagtgagggtctagtcagggttacgtttgctaaaaatgattttgcaatgcttctgcttgttgccctgataactgtaggaatgtgctcttaaattcatgggcctttaaacctacaacaacaacagacccacaagtgcatccaagaagaccattcaccactgtcacattgtggtcattac

SEQ ID NO: 25363 - DNA, 1631 bp, Mus musculus
tggtggggccaggcctgcatgcatgcaggggtctaacccagcttgtcactactcatctgttccttgtaggtggacagcgccatgtccctgatccaggcggccaagaacttgatgaatgctgttgtgcagacagtgaaggcgtcctacgtggcttccaccaaataccagaagtcacaggggatggcttccttgaaccttcctgctgtgtcatggaagatgaaggcccctgagaagaagccgttggtgaagagagagaagcaggatgagacgcagaccaagattaaacgagcttctcagaagaaacacgtgaacccagtgcaggccctgagcgagttcaaagccatggacagcatctgagcctgcacagcccatggggttctgaaaaaaaccagtcacatgcttcactcaaatgtatttgctaagtagagaacactgtcttattccacagggaggtagcagatttcagactcaaccaggtggtgaattttgcaaggacatgtttgtgttaaagctggttagaaaaaaaaagcttttagaattcaaaaatatatttctagctatatttttataagtttaatgaaaataacagttctgtaaccaaagagtaccacattaacttcttggtcacatttctgagtaggctgaagtgcctgctttctaggtaggggtgagcgcctgaggggagaggttgctttttagccctactgttgggcagatggaattaaatgaccaagggtggcccagtgtaaatcacagggcaccttagacggtctggagaaggaaggtaccagaaacctcttctgaggaataaactataggagacaataaaatataacacagtacccaggaagttgattgctttctttatgaagcagaaggggaattatgacgcatggctacagttactaatggactctgctgcagaacattaatggagttgctttattcgggctcgtgtgttgtgatgctgtaatcagaacatgcttccctgttattccagcttgaaatgcaaattcaccatcgggctcatttctaatcgtcgcagtgtttcctgctttgggccagcaaagaagcctgatgactgcatagggtttgcttaggcaatacttagacgcaccgtgtttgtgactactacagcaatcaccatagctacgagatgagattttactgtcttatttaaattttatgaatctgtctgttttttacactaattttcccaataaagtccattaagaaccaagtctaagaagcagaagtcgttctttgccttcaagaaggagcagacttgtgctctatgcccctctgccaggacggttgcctagggagggaaggagggagggacagtgactgtgtctctaaggaggacctttcaggctcttgccacccaggaagggtcaggtcccgttcagtaccccagtcccagcagcgtgagcatggcgggttccattccgtagcctcatctcctgggccttcctactagaaatgccctctcggaactccctagaaagatggctgtggcccttgtcacctccctagattctgttctgccatttcagtcagctcttctcttgccccttgtcaaggcgcctgccttccacaggctttcagtgactgtcgctggtttgttattg

SEQ ID NO: 25364 - DNA, 1174 bp, Mus musculus
gtgttcagaggcactggatgcatggaaggttgtgtggttaggagctccttcctctccttcctgctgctcctcctcctggtccctcactctgctatttgttcattttcctcaagggtttgctcattctgtgtttattccctctaagtgctatgagggtcaatttcaagaaatagggtgaaggaaacatttccagtgggttgaggctgagcgactgattgggtctcccctgtactttgtatttgttttggagaacagttgcagcaagattgccttctccgtctgctttggcagatgtggttggttccacctactgcttctccttctggcagtgcaggatggaggatgacgtgggaatggagactccagctcagtggctagcctaggaacctgtctctctggccagcgaagggcgaatgtgtcaagccaagctttctttgcttaggatttgaattctgtcaccataggcctcatttttaggttttgggctcttaaggcagtgacatttctaaagaatccacgcagggccagatcttccccgaagccactggtatctgttgctgttcaatgggctgtgagtgctttttttttaatctgaagaaaaaagtgagttttattaagagctatttaaagagttcaggagagtagatgttggttattccagtaacccctgggttgagcaagtaaaagctgcgtgattcctgcttcctcactgtggcattctgcctgagtctgacctatcaaagcctctaggagttgccctctcttagaacgtgagaacggcttccagcaattagagatttaaacaggagcatggagaattggaatgcttggtaaataagctgagagtagttgactatcagtaggaaagggaaagttggaacacagggctcttgtgtttctgacttatcggacagctccatggaaggataaggcatgtagagtgaaggataaggcatgtagagtgaagaacgggatcagtttgggacttgagtgtgaaacaaacaagagactatggtaggattatccttcaggttgaggcagcatgaaggttatgttgaaaatctcatgttgctttgatgttcaaattattcactgcgttatgtctctgtggataggtcatgtgattgaagtccaaattctgtttaccgctgagttacaagactaaggaatagtt

SEQ ID NO: 25365 - DNA, 1112 bp, Mus musculus
gcccccaccccccatctttactaaagtgtcatttttaaaagtggttctcttaagtgcaggatggctggttctggaggcagtcttactgttttggcttcctacaagttaagattacaggaatcagccaccagagcagtgcactgtggtccaatctacctgatgtacaggggtaatggctaatgccgttctacaaataagaactccagggagtggacttagctagtggaatggttatttgggggtggagctcccaaagtcacactgtttctctactcttgtttctttgactcagcccaacaaagtgaagggggtttgagggctggagatggttttttaacttaattgcacaggtgtcgacaggctgactctaatctgggatgttttgatttcatagtggccagctgccagtttgaggcgatgtctgccctggtaagtacagttcggctagttccggtttgccccagctgtaggcagctacctaggtttccttgtacctaggcaagtgttacactgctgggagaacagcagccaatagctggttggcattctgggcctggttcatgccacctctgttgttaactataccaggatgtcagcatagttgcttacccaggaagagaagcgcaagctctgcaggaagaaacctgaagtccagatcttccgacatggaggttacttaaatcacaacttggaaatggaactgagtaaaagccactgagggaaataaataggaaaaaaaaaagtcaagatttagtgcctgtaaatggttgggagcggacctgaggcagtggagggagttactagactgcacgttcactaaaaataggatgtttcctcgctccacaataataaaagctaagtcatgatcccctttagtgagctccctgttgggaatattgagtctggtgttgtagtatgcagggccccttcagaccgtccaggcaacctagatgcccaatctctattactattctgctctctagctcgtcaataaatttatgcatattaattgaccatggggttctgggaactagcttaggtcaaacagtacaatgagcagttaggctcccccttttctgttattcatgatgattttctaagaaatgcctcaa

SEQ ID NO: 25366 - DNA, 1112 bp, Mus musculus; identical to SEQ ID NO: 25365

SEQ ID NO: 25367 - DNA, 1157 bp, Mus musculus
ttaccacgcatttcttttctctatcaaaatagtccagactcctctggacaggatcgtgtgttgtgggaccttccggttttcaaacaaagggtttggagggccatggtgtagcccttcaatctttcttttctctgctagtgctgtgccatgcttttgtgtttttcctttaccgtgggtgtttagcccttaaggcgcgtttcctgttctgtgactgtcttgtggaatcgccccttctgtggaatatttctatattggataggttacagttattcatgtagacgtttctagaacgtctagatgtggttctaaaatttctagtctttctatagctctgaaatttcgtgtggctgatttcataggaagtgttcatgggacttttgtgttgatgctgcatgctgcatatttaaatgggctaacttgtcagtcgatccaacgtgtttcgcccaggtaaatttagacttgactatgcgggtggtttttcatgggtgttgaaaagctccttaaaagctccctagttgttgggcgtagtgacgcatacctgtaatgtactcaagagaacagggcaggagaattgctgtgacttcggggccagtcgggtaacatcaagattaccacaaaatattattgtactaacagttaagtctcactacgaattacgtagatttctttttgagacagctggaggctgtttttgagaggcacctcctgtctccacttccctagagctgaattacctacagccttgtgccaccacacccagcccagttatcttcataacttttgaacattagtattttaggaatctagaagggaggagtatattactgcaaaaaaaaccccaacgttgcctttgtacttaaatgtttttacaaactcaaatgtctccgaagtactagagaagattaatctggttggttatataatcttaaaaggatagcttttacccaacaggttttgcattgaagttcttctaaatttttatttctaggcccttcacaagtatttagttcatacttcctacccatagaagtagctttcccttcatcgtttatatacagcttttatatagcattctaaacatgaactgatttgaaacttaactttttacctgatgcttttaaactaagtaatagtacaaggcggtaagtgaaaattta

SEQ ID NO: 25368 - DNA, 1227 bp, Mus musculus
catgctttcacagcaaacagatttactcattaagtcatctctagccctgtgctggtaacttttattaaagccttcaaggtttcatgagtgacagatttttttttaaaaaatattaatttatggttctaaggattgatcataggacctcacaaattaagtgctctaccagtgaactacattccagcttccaaatgaaattatttataaaaaaaagtttgtgtgtatgtctgtgcaccacatgtgtgcctgatgcccacagaggcagacattcattgaaactgaagtcaccaatggttgtgagccaccatgtgggtgctgggaatcgatcctctggctaagcagtatctccagccccaccaaatgaaacttgtaaagaataattgtcaaccctgtcctcaaacatgtatcttaacactggtgtaaaaatcttccccttgggcttggagtgtagatatctgtagtagatatttgcttatcgtgtatgagaccctgagtttgaaactcaggagcctggtgaaaaacatttgaaaagccctaatcttataaataaatatgatggttcatacctgtaatctaaagcttctgcagcctttataaatgatgttgacttgagattgataatgaactatccatgccatctgccagtaacaacatctattattgttatttaaacatatttagtgtttctgactttgataagacatttaggtgtcaatgagatggcacaatgggtagagttactagtgtgatgacctgaatttgatcctggagtccacaatgtggcagaagataatcgactcttctacttttgtgtatatgagtattttgtccccatgtatacaggtgcactgcattcatgtatgatgcctacagaggccagtgttgtggataccctggaattggagatacagatagttcagttagtgagagctgggagccaaattcaggtcttctgctaagctatctctccacctcttagaactgacttttgagagttatgtactgacttttatacatgtaatatggcatacacatgcctgccctcacagcacatacctacccaaaagcagaaaaatctaaaaagttcttgcctttgccatcttttgtgtggctcagaaggagaatattaaaacgatcgaggttttgtaactatttttagcttttttatgagattaaagtttaatgtataatgaatgatattattacctgcatgtttctactttttgg

SEQ ID NO: 25369 - DNA, 1558 bp, Mus musculus
ttttcttggcgttaccatttttgaagcaaagttaacctagctttctagcttgagctttctttttggccatcttttaaaacttttttttttttttttgatctataaaatagacaagagatagttctacaatgtccaagtcattccagcagtcatctctcggtagggattcacagggtcatgggcgtgacctgtctgcagcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttgtcttctcaacaccgtggagatacagaccaggccagtaatattttggccagctttggtctgtctgctagagacttagatgaactgagtcgctatccagaggacaagattactcctgagaacttgccccaaattcttctacagcttaaaaggaggagaactgaagaaggccctacattgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagaggggcgctcctccaagtagcaatattgaagacttccatggactcttaccgaagggttatccccatctgtgctctatatgtgatttgccagttcattctaataaggtgagttaaagcaacagatgcttctaatttcttttacattgtagtgcctattctgtatttatctatatcttttactctaattctgtagtctgatgacattgagttgatcaaaaattgttatacttttgagaacactatttggaaggtaattgtttttgaacaatataaaccagggctttacattaataatacaatctacctacaatgcttcttgccacaaagctgtcatccactggaattatcttgatggtttttttgtttttgttttgtttttgggtttttgttttgttttgttttttggcatcagtatgttcttcttaatcatatttaagcaggcttttttctcccccagtctgctttgttgaattgttttaagcatttttccccctgaagtcaatgtgctttccatttaggatgctagatttcagctttccatctgtcttgattgctgatttatatgtagtcaaatatatattcttagacaattctcttttttccttatctgtggctacagggaa

SEQ ID NO: 25370 - DNA, 1947 bp, Mus musculus
gagcatgacacctcttaagcaggctttgccactgagttgcaccgtccgtggaatataaatactctttttaaatatttaaagtgatgtatttttaatttttgtgcatttatgctttgactgcatgtgtgtctgtgaatgtgtcaggtaccctggagactagagttacagtttagatctgtcatttgggtcctgggaatttaacctatgtcctatggaagagcagtcaccattcaaccactgagccatctccagccccgttataaatattctccaatgtttttttcttagatgagtcaggcttttcatttgatgacgtatgagtgttggtgaccctcctattatgttgctgaagcttggtaaacttgtttctctatagggttctctaaaggctgcacattaaacacttgaccactgagcaacagccataaacgtttatctttaattttataacaagttaaaattggccataattagtacttttaaaaaaatatttgtttattattatatgtaactacactgtagctgtcttgagacataccagaagaaggtgtaagatctcgttacggatggttatagctgctggaatttgaactcaggacctttggaagagcagtctgctctatctatctatctatctatttatctatctatctatctttttaatgtaagtacggtgtagctatcttcagacactccagaagagggtgtctgatctcgtgatggatggttgtgagccgccatgtggttgctgggatttgaactttcagaagagcagtctgtgctcttaaccactgagccatctctccagcccctaagtagtactcttaaaattaaccatcctgccattccatacactatggccagtaaacctgtttgtttgtttgtttgtttgtttgtttgtttttaagacatttagtataacagaaaaactatcttcttaaatcttaaagatttagagtaaaacaaaagccgggcgcaagcctttaatcccagcacttaggaggcagaggcaggcggatttctgagttcaaggccaacctggtctacagagtgagttccaggacagccagggctacacagcgaaaccctgtgtcaaaaaaccaaaaaaataaaaaaaagaaagaaaaggaaagaaagaaaggaagaaagaaaagaaaagaaaagaaaagaaagaaaaggaaagagatttatggtgctgaggttttatacatgttaggaaagtgtactatatttatatctgattacaaaaatgatgatggtttggttgaaattaaggtggacaagattgaggaacttgatcaagaaaatgaagctgcattggaaaatgggattaaaaatgaggaaaatacagaaccgggtgccgaatctgctgagaatgctgatgatccaaacaaagacacaagtgaaaatgcagatggccaaaatgatgagaataaggaggattatacaattcccgatgagtatagaatcggaccatatcagcctaatgttcctgttggtgagctttaaagatttttctcgtccccttttctgtttctcccaacaaacttattaaaataagacttaaaagttgatcttatataagctctgatagtgtataaagttatatcccctggtgaattaattttatttttttctaacactgttctatatttttttttgtgtctcctaattttgtattatgttaccattcccactgtgttctctcctcataatggtttctaaaataacacatttctttttgttttgtgtttgttatatattcttgtctttcattttaagactaaagttaggtgggatcttgaatatcagttaagtaaaacaaaagggtaatgtgatattgttggtatttttagtttaggccatactggaattcacacatgttttctgattcaaattatattgacaggaaaaaaagatttgagactaaaatttaagtttacttaa

SEQ ID NO: 25371 - DNA, 1199 bp, Mus musculus
ttttatacaaatgaagaagttgcaaagaatactcattgcagcagccttcctcattatcagaaattaaaggtaaggctgaatataagaggagacttgtgaaaactaacaaacaatatactttacagaaataagtgagatacaatgtgtgtatgtctctggacccagcattatgctttctcatttttccaaaattgcctgggctttaaggagtttagcggtttttacaaacttgagtctcttttcattcaaatggttaagcaaggtttagtgttgccacatattgaatatgcctaatctgccagttaaaaatacttcaacatggggctggagagaaggctccagtggttaagaacactttctgttcttctagaggttctgagttcagttcccagcaaccacatggtggcttacaaccatttgtagtgggattttatgccctcttctggtgtgtctaaagagagccaaagtgtactcacataaatttttttaaaatattaaaaaagaaaaaacctcccaacaaaataccacatctagcttagtagcaaaaataaattgttatcagaatgttgatatacttaaaaatattgtgcagttatatttggaagattagggaggtggctcagttgttaaactgcttgctgtgaaagctccccagaacttgggcaaatacttgtaattctagctgtcaaagatggaaatggaggaggctggtagtaaaaccagctttaccagcaagatttgggtttgattgagaggccctgcattagtgaatgaggttgtaggcaatcaaaaaagattcctgataaccaatcatgtacttaaaaataaaattacgtataagagatatagagatacagcttagtggcagagttcttggtagcatgcataaagttctgactttgaagcactaaaaagaaagaagtagaaaaaagatacaattaactacctttggactgggtttcatggggcctcatccaaatctgaaagctctaaagcttctactcctaagtgtttcaaacaagagaaactctgcctgtatagcattcagttatctcagcacgttttctttaacaactggtggataattggtagccttgtattttaatgaataatctgtcctttgttttatcattttttgttgtttacaaatgtatctttttgtaatctatgtttcctgacattatggttataagaaaaga

SEQ ID NO: 25372 - DNA, 1756 bp, Mus musculus
ctgagccagtttagttttgtatgttaagattaactcatttgtaaaatattaaagtgttagcattaagtccttaaagttggactggatgttgtattttataattgatacatattctaggtgttttttaaaattacttagtctctgtaattctttttcccccttcagaaatttctgaataaattggcagaagaacggaggcagaagaaggaaacttaagatgtacaagaagcttaattcaaagaaaacgatggttctttgattttaatgttaaccttttttaaaatacaatactgatagttagaaaactactgtacacttttgttttagtggaaaataatagatgtctgttgtgtttaagtgttatagcaaaaagtacacatacggttaagttaatgaaaatgtttttgtttcatccgagtgacaacagacaaaagtacttcctaaagattgactgttgtaagctatggaaaacaacttgcaccactaagagaaagataacatagaaccattcagaaaaatgaaacttagtagtttgaggcttcaaagaaatgtcaacttctgattccattcaataaagaacaaaaccaattgtatttttttttacttttcatctgaaacattccacattttaatctgagccttgcagacttttcatttgactttggaagctgttttggttgcattgcatttttagagaacttcattcatgtgagattggccattcaattgcaggtgcagttttcttttaatgtcatgctgtttagatgataagaaatattaagaattggctttagatttgtaatttttttctcttgagttcctgctaggttttatattctagtagtcaatgttatttcagtgaaatgtaaaaatattcccgttctctttgaccagtattaatttcttgagaacctattgcctgtcacttgaatcctgtagctgtcatacatctctggtataagcaacatttgatttttgaagtgtgtaaaccatctatattttcaagatgtaattttacatttctgcatttcaaaaccagtttggccataattcttgacgcacgcttctaattcatgtacctgcacatgtgacctttgtgagcagaaatttgcatgtataatctgtgtttacttgtaactctctggttatatactgcttatatctgtggattcaagttactgaagtgaataccaataaaaaaaaaaaaaacttaggtcatgttgattggttggttaaacatgtttggatgttaaccaaaatatttgtccgttgtggctttttattcactgttaaatttttatgcatgctttaacaaattattcttaagtctatattggtgttctaaaaactactaaagattttggtttagagctgatggacttcttgttcttgttacataactaaaaatgagactttttctttaaccttacagttttaaatctgaggataaagaaattgcaaaagttcaaattcagagatatctgtgcctttaacaatagaattaaagtagcattggaaagattcgtcttgtcgctgcttcaaaatcaagaaggaatttttgctgtgttgaataatctgaagacccaagaacagctttaatttaaatcggtgacaaatagtaattgtctttcaaacactccgacagttgtatttaaaattataatttaaacatattgttgggtaaaattttagtaacatgcacaaaaaatccttgctaatctttagttttagctgttactaattatatgcttttgta

SEQ ID NO: 25373 - DNA, 1164 bp, Mus musculus
gtattaattgaaaaaaaattaacaaaagtctagtaaaatttataaatctggagctggagagatggctcagctgttaagagcattgtctgctcttcagaggtcctgagtgcagttcccagcaaccatatggtggctcacaaccatctgtaatgggatcggatgccctcttctggtgtgtctcgagagtgacagtgtactcacataatgtgaataaaaatctttagggctgggtgtggtggcgcacacctttaatcacagcactcaggaggcagaggcaggcaaatttctgagttccaggccagcctggtctacaaagtgagttccagtacagccagccagggctatacagagaaaccctatctccaaaacaaacaaacaaaaaattttctaaatctaaattttaaaatacagccatcttctcttcccctacctcatgtaacacgggaataagctctctaaatccctgttggttacttgttttgtggtgctggggatttagagccccgaaatagggaaccctctaacactaggctatattcccaacccaatggacctcctctttccttttttctttatttttattaaataataaaatttcaaaacttatgatagctgtttcatcttatgcagactagccttgaacacatgctatatctgatcttcctgctctgcctcttttttgggggtgggggggtgttgagacagggtttctctgtatagccctggctgtcctggaactcagaaatcctcctgcctctgcctcctgagtgctgggattaaaggcgtgtgccaccacgcccagctaccgctctgcctcttgagtagctaagattacaggcatgaggtacttacaatgcctggctatctgttcagtattcacaagagggaaaaattaatttcctgcaacagtgaagccctatttcaatatagattattgactagaaacacaaaagtctgaaaatttgattcagactaaagttcctactcaaatatgaattcaacagacatttttgaacatgcagttgtttgaaaatatgtaagttcaggcaatctttagaaaaaataatactcttaaatctacgttagaacgaggagctggagagataattctggctatcctataatgagaagaaaataaaaaacaatctaccttctaggagccct

SEQ ID NO: 25374 - DNA, 1207 bp, Mus musculus
cctaccacttgagaggcagagggaggtggatctctgagagtttgaggccagcctggtctatgtatggagttccaagacagctaggaccacataatgagactttatcaccagacagtcaaatcctctatttttctcccttaaattttgtttccagacaggttttctcactgtagctctgactgtcttagaacttgtgtttgttttgttttgggagattcaaggatttttctttgtagtcctcgatgtcctggaactcaaaaccagtctgggctggagctcacagaggcccacttgcctctacctcctgagtgctggtattaaaggtgtgggccacacaaaccctgtctttattttttaaatttatgtcttgtgtgtaggtgggtattctgcctttaagtatgcgtgtgccaccgtatgtgtagtgcctagggagtcagaagagggtatctggtccctgggactggagttgtaattgtgagttgccctgtgagtgctcaaactaaaaagacttccagtgctcgtagccactgaggcacatggccaaccccgccctggttttttggttttgtttttaaaggagatctcaccaggatgtatggctttctgactatcctagactggctgacaaaccccagggatttaccacctcattgctgccatgacagcatatgccaccacgtatgccaccatgttcggctttttatttgggtgctgggagtggaactcaggtcctcatgctctcaatgacaatcacctggctagtttttttgtttgattttgggattttgcttatttgagtgaggctcttgctatataactgtggctgacctggcatttgctatgtagcccaggctggctatgaacttatagtagccccttgactaagcttcccaagtgttgaaattattatcttgttagttttcagtcaacgtctctagaagtggtgggacctaggaaaatggagtcaatagaagaggccaactaaactctcatgcaatagccagctttactcagaacctcagatgggaccaaaatgtatgggggttaagaaagctcacctgagtaaggttctcttgagttgtttatgcgatcacaagaacaagccacgaatgtgtgagtgttcacattgcataaattaatttgttttcccagaagcatataaaggatagttaaacatttaataatagaataacagagccaggcgtgg

SEQ ID NO: 25375 - DNA, 1872 bp, Mus musculus
cccccaagttttcagtgaaaatcttaaataaaattccctaatagccaacaatgccccagttaatcagactgagaacatgtatttaacatgtttggaagtattttcagagcatcaggcacacttggaaaaagaaaataccttatttcatgctatttcttatagcttaagtgaggttagtgcgtttcttgttatacttaataggatgtagaggctaggaggtgcagaccttcagtcccagcacttaggaggcacattggctggtgggtctccgtgagtttgtggccagccagatgacattctttctctgccatgagtttgggggtaggaagaaccttagatagagttcaaccttttgtatttttctgggagataatttttacataaaggtctaggttgaatacttctgagaaatcacagtcatctgtaatgaacttgctttttcttttctttttcttttaatatatgatttttcaggtcaagagcaatctgaatcccaatgcaaaggagtttgttcctggggtgaagtactgacatgtctgagcagccggccgcttttggtggatgtagcacagtttccacactgggaaggcagtgttagaagactccattgtaaaagctctcgtcactgtgttacacttacgcattgccaaagtttttgttagtcttgcatgcttaataaaagtgctgagactgttactaagtaaggagctgtcacacaattactgaaagtagaattggccacgtggcttaatgtaaagacagcaatgggagaagcaccagtcaactgtgacaaagaaccaaattaaatcacctccaaatctcattgaattgtctgtctttgaggctaaactggtcccttaagggttagttgacacgttttaatgtctacactttgtataaatttaaattaggttctgattgttaaacagatttctcagttgcatttgtccatcaaaaataacctcttctggagaaaatctgttaaattttgaagtaagtaatttcacaagaatgtctttgaggttacaaggtgatggtcagataggagctagtctggcttttgcctggtgtattatcatgttaggaatactgagttctcccagtgttaatcttgaggaaatacagtttgaggcttgcatcttctgaagattgattgcatcatcgccatcatgtgtgaagtctaacacaggacccacaccagcccataatccaactgaagcactcaaaagacggtagcatgactctggtgctcttccttgctttgttaaccatcatgactatagtctgcagcacaacttttcttttaacaaagctagaacagttttggcttcttaaacttcatatttgagtaggttaagctgccatacgtgttcagtgtgaatagtgtttaagttgaaaatattgtaaaaaaattatattttttcaaaaatatttaaaaaaaaataaatgatagtagaaccgagctggtgcttgtgttattggtgcagacaacagactccagcgttggtgctcgcctagtgtgggcactgggcagccctgtgtgtgaggtgtgctgacaggaaggtgtactccagtccacagtagccaagcaggtgtctgtcaagtgtttgacttgcccttgcccaagactgcactgtcagcaatcttagccagccatggtagaaagctgtggttggtctggggatatctgttaatggcggagcacttgcttagtatgtgcagcagcataaatgtttcttgatgtgctagagctgcaggccatgtagccatttattgtatttgagaacagtgtattgctaaatagccaaggccagctttgaacttaggatcctcctacctcaagttcctgggtgctgggactgccttgctctt

SEQ ID NO: 25376 - DNA, 1824 bp, Mus musculus
tacacagaaagttcacagcgaaaccttgtctcaaaacatacgttgtaaaatgtacctatgaaccaaacttaaggaaagctcctagacatgaaagcttccctctcccagccccaggctctgctagaaaatgcactgttatgaaactgccctgacagcgtaaggcccctcccactagacgacttttactaattctgtagatttcctggcactgagagttatctgtgaggtgatgataaccagagacaacactaacagctccgtcaactgttgcacctattgtctgttcttacagcctggtggcactgttttatttattactgtagcctacagtactcatatcctgtttccttgcttcagttgaaagataatatggcactatctagaatagtgttaaactcttaattccttgcttacagtttagatatgttgtctgtgtgttggtgaacaaagttttgttctcctgcctacatcttttgggagacttcctggcacagtgagttctctgctggggctgtttttgctctgtgtgtgtgtgtgtgtgtgtgtgtgtgtgtctcacagattgagaccacagaatggagactgacgggagtgaggctcgcacaggagtggaagctgccattcccgagaggtgctttctttagtgagagggagacagaaaatccttttccttctatggaacagtagagcctgaaggggcaagttcatcactcaagccaggaaaacatctccgcttcactgaccggcgccaggcctcacagcttgggagaagcgacctacggtaaggaaatagcattgctctgcatgcttatgggaactgttagaaaggacaagaagtgcagaaccctgctggagcccgatccagccagctgctgaattctccatccgcaagtctccatcctcactcctctgaactggcgctgccagaggcaccttgggaatcccagcaggttcctgttgcaaatggccctcaccaccaactcattgtctctgcatgcacggctcctcccaggggctggcgttaaatctgtactcacttaaggtgttagattggtgtcctaatccctttattttgggaaggggccaagttactaaacaccttgacgtttgggcctgtgctgttgatacctcatgcagtatcaagtaactgttacatcctgagtacatttgcatttggggaggtggagaagggaatgttctggggccagagtcggggttgacatatgtgaaatcagttggcagtgaaaaatgctgagaactctggtcacctgacccatggcgtttggagtgagttttaacaaagtgaacattaaacgattttacatacaaaattcgactttatgactcctctttcctcagccactgctgtcagcttcagatactgaacacacgtggagccattttggacacagttgttactgtgcaatagcttgtgtttagaacagcacataatactgatggcatgaattctaggttcgtttgttttgttttgttttgttttgttttgtttttcaagacagtcttcaagacaagactctgcctctgcctctgcccagcctgtgctggaattaaaggcttgcaccaccaccacctggctaaggaatttttttttttttaaagatttatcccttttaattctttttatgtatatgggtgttttacctgcgtgtgtgtgtgtgtgtgtgtgtgtgtgtgtgtgtgtgtgtgtgtgtgtacactacaccacgtagtgcccttggaggccagaaaagggagcggttgtgagccatcatgagggcaatggaagcagaacctggggtctcatacgagcagcaagtagggctt

SEQ ID NO: 25377 - DNA, 1102 bp, Mus musculus
gttacttgacaatggacttgattataagctgagggactagagaaatgactccgttaaaagtactgactactcttccagaaaaccagggtttgattcccagtagcttatattatctgtaactccagtctcaggcacatacatgatacacagacaaaacacacaacattaaaaaaaaaaaaaagggacataggctgaatggaaaactgagtttcttttctttttctttttgatttttattactttatattagtgtttaccctacacttatgactatatagtctaccacatacatatagtacttgtggaagccagaacagtgtctgataccctgtaactagttagcgagtgggagctaggactcttaatcatagaacaacaaccaatgagtccttttgactccagctccctgaagatactataaaaatttcctttgaagcagagcagtagtggtacatgactttaatcccaggacttgggagacagagttaggctaacctggtctacagagcaaattccaggatagccagggctatatagaaactccatctcaatagtaataataaatttcctttgaattgaattggggggggggttgtttttttgtctgtctgtttgtttttttgagaattgaattttttttttaattttccttttggaatggtaacaatatcagagattgaacctagagcttcaggtgtaggaggcattccctttgccactgacctacccctagcccttttattgaattctatatttgcttttttatttttagacagtatgtcattctgtagctcagtctggcctttaactctcaagcttcgtaagtgctaggatacaggcatgagccgtcatgcttagcttaattgaattttttttttctttttaagtttaatttttgggctgggtgttgtgatgtatgccttaatcccagtattcaggaaagaggcagaggcaggtggatctctgagtttgaggtcagtttagtctacatactaagttccaggataactaggactacaaagagagaccctgtctcaaaagaaatccatccgttcctcccttctgtaactgtagatcagtctgtctgtctttcttttgttct

SEQ ID NO: 25378 - DNA, 1140 bp, Mus musculus
tcagacacaccagaagagggcatcagatcctgttacagatggttgtgagctaccatgtatgtggttgctgggaattgaactcaggacctctgggaagagcagtcagtgcttaaactttgagctatctctccagccccgcccatatttttcttgttttgagtcagtcttgttatgtagccattctagttttgaactcactccttcctccatttgcctgtacaattgtactttataacttaataaattatatatcctttaccactcaattttttaaattgattttgtattttaaaaaaaggactactaaaggtgtgctttgttcctgatgatcaaactgtcttaagatacataatacttgataccaaatttgtcctcagtttaactatggactcaatttttctttctttttttaaaatgaccattttctaacctttactgcagataacctgacaattctttcaggtatggattttatcataagaaaacagacttcccttttttattgttctctctctgtctctctctctctctgtgtctctctctgtctctctctgtctctctctctctctctctctctctctctctctgtacttgttttttagagggtgtgtgtgtatgtatgtaacagccctggatgtcctggaattctatttgtagaccaagctgacctcaaacttaacagagataggcctgcctctgccccccaatgatgggattaaagatgtaaagatatataccgctttgtatttggtgacattgctctttacctctttttaagcttgagatttggtgtaactccttacagtaagtattttaaatttctagtttccagtgtagttgacttagaaagtaagattgagctggtggaagggaccctagtaacttgaatgtaagatgggggaactatcttaatttaggttttattgttaagaacaccatggcaatggcaactctataaaggaagatattttattagggatggcttatagttcagagtccattatcatcatggcgggaagcacaaaatcatgcaggcagacatggtgctgaagaaggacctaaattctatgtcttgatcagtaggcagtagaagacagattcacttcatccaataagttgacacctcttttagtgccactt

SEQ ID NO: 25379 - DNA, 1172 bp, Mus musculus
ttagctttggctacatattaatcccagaatacaggagacagagatagttagatctctgtgagttcaagactagcctagtctacaaattgagttctaggacagccagggttgttatgcagggaaaccctgtctcaaaacaaaaaaaaaaaaacttaagatgatacacataccagcaaatactaaatttgaatcttgagtcctttagatactacatttataggaaattgttttgaattttagaacagtgtctcactgtatcctgagtataggcttatttataattggaggtaaagctaggtggtgctatgtccctgtaatagcaacaacccaggagggttgccacaagttttgaggccatcctagttttaggtagttcatggttagctatagctttgaagtgagaccctaacccaaagggaggggcaggtggttagggagcaaaaggcgggtgtgtgaagaaaattagagggagaaagttgattttgtttgaacattttcagttattgccttaaaattactagttgggataatgaatgaaatgttgcttattgactccttacctatgttaagctgagttctctttgtgtgtgtacaggtacaacagaatagctcgggaatggactcagaagtatgcgatgtaattaaagaaattattggataacctctacaaataaagctaggggaactctgagagagagaaagtccttttgatttccatttgactgctttctatgagcccacgcctcatcttcccctgtgcacatgtttacctgacacagcagtgctgcgtgttgtacatacttggaacaacaaactagaaatactgtacttctgtaccaacattgcctcctagcagagaagtgtgtgtgtgagaagccagttctccgggcataacctaggtgtgagactaaaagctttccttattgacttaactttggataatggcaagatgtgaggggtagtaggtacacagtgtgtgcttggatgggaggaaaagctccagtgacccataggagattgtccttaagtggagtccatccaatctcaaacagtcataaaaagcaaggtgaagaacgtgaagctgtttctatattcatttcatcctgaaggacctacaacttaggtgaaagttatgaccaaacagattaaactacatgctgtgctttaaggtc

SEQ ID NO: 25380 - DNA, 1151 bp, Mus musculus
tagcccctttccataatctttggtttgtatgtggtttctcagttaatacatagctaatagctcttatttttcttatgtttttaactgctttaggcctatttcgatgtaagggtggagatgtatttgatggaaatccgtgtgtatatttaagaccctgttgctcctctggagcttgtacgttcacgaatgattcatctgtgtaataaactgattactacagtcattacagataattttgtgtgaataggctttttgatttaaaaacttggtctagctaagattagtggtggatttttcctcacccctgaaatgttttcatctatatttgttgcatttcaaaatcatgaaacaattccagtttacatactaaaaaagatataaaagtaattttattaaacaaggtagaggcataagcttaaaggcattttcatgaaacttatatgtgcaccattccaggaacatgactgttaaactaaataaatttgctttgttaatgaaactgagcagcatttcaccaaaaccttgtgacagtctcttggtacatagggcatagaatgcaaaggtgttggttgctgtttgttaagttaattgattgtaatcataaagagtagctgaccgaacctgggaaacatgagcacaatcttgtattggagagtctgtgttgttactttgcactaacatttgcaggatgtcccttggttttaaattgtactgtatgtggctttttgaagtcttcccttgactctagtaaaatgtagtttgaaatttgtaaacaactgttaatccagaaacattcatgtgaactaggctagttacctcccctcgtcccctttcctaacctaaatgtaagccaggccagcttgaaggccaatgctctttagtcaccaagatctttgaaatgcatctttacactcttgcacaaaaatcgaggaataaatgaccactgcttttggttttaaacttgttcacctgtctcatctctcagtgtcaatgttcctccatctcaacctgtcagctaaaagtctcttaattagcagctggctgcttacacaaatttcaggaatgctatattagcatctccttggccctgcaggtaattgctttaaccagttgtaaaagaacaattcagaattgaactctaacaagatatt

SEQ ID NO: 25381 - DNA, 1229 bp, Mus musculus
tttatgaataggttggaccgaaagtgagggaccccgtttttaaaataggggacctgtcacaagtgctggggcgcaccggaaaaagcaagcaaaatttccttttttttcctccctggggaatcgtaaggggtgcgcagagttgggttggtgccatgggttgcaaggaggtaccattagattttggggggtttgtagtgactcatctggaaagacttgctcccctagtctccagaaaagtggggggaatgaaggtttggcagccgcaccctactgtgctccccgggaccctgggtggtctgagagttgggtcatccaaatgggagtacccaaaacgagatgcggattaggcccttgatcctctcgccttcccttgtgcccccttgctgtttggagccctcggttttgtagtgcgtccccctcccagcccaccccgccccccgtcgcgcgggtttgcccaggaagcactagggaagggggcgtgtgatcgctggctctcgcccccgcccccgccggagcagccccagggccgccggcaaacagagtccctttcaagttttccgctggggccgcctggcgggggcagtgagcgcggtcgccgcggacttgtttggagcgcggtttgaacgcccagcgccacctcaattgcccccatcggggggttcgggtgtacggtcctagcagtggagactgtttaaatgagatgggtagggggcgcctattggcctaagcttgacctgaccctctcctgaaaggctacagtgccttgagttgttggtggaaacccttcccatctcctttttgagagtagtatgaggagactgtcctcacctacttcgactgtgactgcatggtgttgatttagccgttccttagatgagagtcaagctggagcttgttgttgggggggggggcgggtagcgacgcgctctgcagctgtcgcccccctcagaacggaaattgtcctccttagggaggagggaagggtgacagtttgattttttttttttttttgccccggggaggggtgggaacagctgacggaggttggcctctgggttactctgtagtcctggtaagcactataggtgcctccccttcatcctggcaggagctggattctctaggagaagcacttagctaaaggggctgcagaagctaggcccttggctagctggcttgttagtgccttatttatgtgtgtgtttgggcccggtttcccagctcagcag

SEQ ID NO: 25382 - DNA, 1125 bp, Mus musculus
ggccaggaatggtaactaacatccataatcccgggatttaggagctcgggttgttgcctctcccgctccccaaacacacacacccaagaaaaagcatccagtggccctgtaaatgtcctatccttggcctcaagactgtggctgtgaccctgcagaggtcatccatacctggcacccgctttcagctgtgtgtcttggtcatgtctccctatcctttgccaacctcttcctccaagaaggcctctagcctcactggtgattccaccagcccagctctcacgcactcctgcgggaagggtcagtgtggccatcccacttgcccctccctccacagtaacacagggcattggtaggaaagggagaaccactaaacatttagatctagctgtaggcctcctagggacagagcaccagcccctcccaggacgtaagctccaccccctatgcagtcacgctcttctggggctgagggtagggtgaggccatcaccaccacctccggtgacctcattgccagctggcattatgatgtcactggcctagcattctgagttcctcctgcatgtgtatctctaagcctccaggtggggcactcccctgggggcctgtgacagctgacccctgaccaggaagaagtgacaggcatggtaacaatttggtggcagggtagtaggataactgggtcactttgccttgggctgttctgtcagttgcccaagtagaacaaaggcagccataaagcaggtgaccagcacttagctctgggttcaagttctaccacggctgacagcttgaacttttgtgaacctttgtttctttatctctgaagctggttaaagcttcctgtctctcaggtaccactatctgaacatgtgaagcatacgaatgcaacagcagaatagatgctcaacaaatgcgagcccctaggaaagggttcttagttaaatgttagttgaggtgccggtttgaaaggaccagactctgctttcagggggtagaggctgaagtaccccccactgctatcaggtggtcacatgactttccttcttcccaatagccagacacccaagcttctgaggctagggtctggggcaagaactctgcgttcccatccctccatctgttc

SEQ ID NO: 25383 - DNA, 2404 bp, Mus musculus
ctggaggtaacagcaccgtagagggaggtgtgcgggctctcccatctctctggcggtccatacctacccctgagtcctggagcccacctttcctgtctgcaagtgtgggggatacccaagcccctagggcctggaggtctggctgcaagatacctgttcactgccctaaaagtcagagccacatcctgagatgccagcaagccatggtttgcaggtaggggcctggcgttcccagtgaggccctgggactctgatgcccctcctagggcctgtgtcaagatattcccacataggtaccaagtttctatctcctagacatgtcctaaagcatctagtctgtaacctaagactggttctgtccctagccctatctgaggggttttgtctatggaccctgtggccttgagaagagtcatgtgttgttgaactcccaacccagccccaccccacccccaccccccactccataagatagagtagtcccagtgctgcctgccctgcctgcaggtaggaagaggcagctcattcataactgtgagcttggtgtacctgcagggatctgtctacccgtgtagcagagcctggctctctgtcccagatggggtgaactagccgagttcaggagcagcttcgcagtttcccatccctgcccactcgtctccactccttgcaaagtggcttgactccataatggttggaaaggcatcctagtcgtggccttttggccacctttctgaccgcagcctgcctctctctcatgtgtcttgcttacctaccagcacaccaaggcacacccactccagggtggacacccatgtgtacacctgccctgtaggcctcctcatcatagacttggctgcttccccgccacatgcacacagcagtgctcacactcacttgccagaacgcagctgtggccccaggtaaacgatggccacctggtgctaggtgcctttgggcatctgagtggctcaggaggcctctgggtgctctgggcctttgggtagcccagctgggtcatggctcctcctttggccaacctggcctggccgagatgaccggaactcttcggggtaactgcccgtgcgttctccatgcccgtccctccgtcattgagccggccacggggagcatcttgcaccaggcccaccgggaccctgactgaactctctccttgtttttgtctcccgccccgccagaaggtgatgcttccgtcgggagccgccttccggtggtttcagtgatttcagtgacggccgggaacccaaagctgccctctccgtgcaatgtcactgcccgcgtggtctccggcaagggattcgggcgaagacaaacggatgcacccgtctttagaaccaaaaatattctctcacagatttcattcctgtttttatatatatatattttttgttgtcgttttaacatctccacgtccctagtataaaaagaaaaagaaaagaaaaaaaattttaactgctttttcagaagaacatcaacaacaacaagagaggtaaagacgaatctataaagtaccgagacttcctgggcaaagaatggacaatcagtctccttcctgtgtcaatgtcaatgtcaatgttgtctgtgcgggagatgctgtttttgtgtagagaatgtaaattttctgtaaccttttgcaatctagttactaataagcactactgtaatttagcacagttttaactccactctcattttaaacttcctttgattctttccaaccatgaaatagtgcatagtttgcctggagaatccattcacgtttataaaggaataggtggtggcaccgtgtagaagcccctctgtatccatccatgtgtgcagaggggccagagcccactgggactgggagttcctgacccaggcccgaccatgttgcaccccatcgtcccctgattgggattccccctaccccaacagtgatggattttggagagatgaaaattctattcatttgttgatccactgagatctggagagcccacatctcagtatttctgatcctggctacttcccttagagaaaataagccctcttttctcagccttgctcgcagcagcagaagaaagggcttctctgcgtggtcccctgctggtaggggtgggtgcccagggggccccctgcccgtggccagctccctgctgaggaacatgctgtttgtattgttttaggagaccaggctgttttgtgaataaaactgaatgcatgtttgtgtcatgataacactcctggcttcttgctcttgggttttggggggctggcttggggctggggctggctagagtctcttgggaaggagaagcctttggacccaggaggtagggtgagagctggaacaggcatcctggaaacagcacggaacccgttgtgtatggaagggttggtg

SEQ ID NO: 25384 - DNA, 1178 bp, Mus musculus
acgacgcgttgcgctcggactcgccgccgctgtgccccgcggccgacagcaggacttactactccctggacagccacagcacgcgcgccagcagcagacacagccgggggccgcccacgagggccaagcaggactcggggcccctctaaggccccccgcctcgcccgccccacgtctccaaggagagcggagaccaccgactggagagggaaaaggagcgaacaaagaaataaaaatatttttattttctataaaaggaaaaaagtataacaaaatgttttattttcattttagcaaaaaaaattgtcttataatactagctaacggcaaagacgtttttatagggaaactatttatatgtaacatcctgatttacagcttcggaaaaaaaaaaagaaacaacaaaaaaaaaaataagagagatgggccaattttttgactctttaatagaaacctatattgtggtgccttttgctgtacgctaatctggggctcctggagagccgtctggggtgcagtgtgagggtgggcgcttgtaggatcccaaactggtgggggtgagaaagggcagggaaagaagagactgtgaggttctaatggctctgaggaaagtggacaatgaggaagaaaatgaagataagatgtaattgtattttccccagtcctgagcagagaaggcagggatgttagccttagagctggaattgagattgggttatctccaaggacactggcctccccgctacagcaactagaatggggaagggtcctccccagccctcacagctgctaagggaaagaggacagagaaggctgtctccccaccagccccctgccgagggagggggcagctctaccaggggcccaaccttcagggctcctcctccctggcggcctccaggacatcctctgtcctctgcagcgccttcgtttacaggtcgtcttttctattttacgcctgcatgtcctttgcatttcggattctttagattgaatgcatggtcacgctgggacccagaagagccactccgacagtgtattcgattccccttttagcaataaagtaacaccatgtccttctcacagcccagctcccaacccacctatgacttccatcttccaatcctgccctccccagccagccctcacaactggatccaatgctaatttgtcaaaaa

SEQ ID NO: 25385 - DNA, 1203 bp, Mus musculus
ttttaaagagggaggggtaagtcttagaccaagacataatccactaatcagagtgaacccaaggctcataaatgaagatttttctgtgaaagggtacaagatattgctgtagaaggcagcctgtgtggctgttacatagttggtctcttcgtttctctttctctctgcttacatctttagctactttttagttttgggtatctttttgtctgtctgtctgtctgtctttttgtgaccctgtcttcctaagtagcttaagcaggtctagaattgtcactcctccaacctccacagcccgcctgtttagtttagttgtgtgctggtttcctggtttcctatatccagcctcttctcatggattttattgactgccttacctgatgcttccctcaccctccttcctgctcagtccctctgatctgctgctcactcttaacctaaaggaagcagccattcctcagcctcattaccccaaacatcaggaaaaaaatccagaaagtttgacaatgaaacccccaatccttctttgaactttagatctctcagtctctattggaaggtgggagtaagacctgggataggaggaacatggaactgtaacagataggccagcatctccagtgaggttcatctgactcttagtaacatgcatattaaactgtcctggccagagactgacattgatcccgtccagatggcctctgcaggacctgggtggttcagaccaacactgagaagaccttaagctgtggatctggacacacctcggtccttaaagctttaaatgacctcttcactgagatactctaaagccaatgtctttttcccttgcaagctcagtcagggcttaaggacaaccatttgccaggaactctgcttgccttacttgtcaatctaaagaagctgattcctctgaagtgggacctagaagtatgggggaggcattcttggagaagtctcacatgtcatccacgctagccgcacctgagacgattgcatgcggatccggaagctgtgcttcccgcttctactcagggtagcgcaagacatcacccgttgttgctggttggaggaggcacatgagtgaccccaggaggagatggtgctgcagtctccactctcataaatggcctgagtggttcccatcatgcatgtcgtgtactcactcagcagagagtacggtggatgagaattgtagggaaa

SEQ ID NO: 25386 - DNA, 6283 bp, Mus musculus
ctcagcagggcctggttcatctgcagagctggccgacaacccaggctgggctgagcgctaagcggcgtgccccccttcccaaatctcagaagggggggctgccaggcagtcgtggtcccagagggggctggtcgcaggtttttgggtgaatgtaggtttcttttttattattgtttgagagtaagggcatagcctacgggaataggcactgcgggcaccccggccctggtgcggctactgtcctcagcccagctcccccctctggtgagtgcgcccgcccgactgtgcggggctgcggttggggggagggggagcgggatcatctgaggccagagccgctgccgtgcgcggggagggggagcggcgggagcgaggggagggagaggggagggacgggctaggtgtctgctgctccgcgccactgctgctggcgcttggtcctcatccccagcagccccctctgcagctaagggcttaccaccgcagcacctcttttgcttcgcctgcctcttcggctctgcggtaggagacagccctgctggggggtgggtgacactgtctgggtttgggtgtgggtcaggcccacaggggaaagggaggccgtgactcggtgtcccctctgcatcctactctgctgtgcagcgaaggcccctcccccacatcctctctttggggtcactggaaagcagagccaggcctgatctctgtgctcaatacggcatatcctcccctctcccccccccgccccccggtcccccgacttctcaagtcgaggctgctgagggtctggccaacgggtagttacggcggtggcagcagaggctgcggtggcaccagaactgcgacgcggcgctcccgctccccccctccagagaggggtgtagggcgagggccggcgggtgggcgccgcctggcgggcaggcgggcagggtggctggcctggggaaggggcgcagtcacgtgccggcaggcgggtgggcgcgtacagtagggcgccccgctactgtactggggagtcagtgccctgttaccgggtctcgtctgtctcgtctctcccgcagatctcgcgagagtggctgactggctgtgggggttgcggcggcagcaggcggagccggggagggaaagcagcggcggctgaggcgactgaggcggcgggcggagcggcaggcggcggcggagcgcagcatcatggcggaccgagacagcggcagcgagcagggtggtgcggcgctgggctcgggcggctccctagggcacccgggctcgggctcaggctccggcgggggcggtggtggcggcgggggcggcggcggcagtggcggcggcggcggggccccgggggggctgcagcacgagacgcaggagctggcctccaagcgggtggacatccagaacaagcgtttctacctggacgtgaagcagaacgctaagggccgtttcctgaagatcgcagaggtgggcgctggcggcaacaagagccgcctcaccctctccatgtctgtggccgtggagttccgcgactacctgggcgacttcatcgagcactacgcgcagctgggccccagccagccacccgacctggcccaggcacaggacgagccacgccgggcgctcaagagcgagttcctggtgcgcgaaaaccgcaagtactacatggatctcaaggagaaccagcgcggccgcttcctgcgcatccgccagacagtcaaccgggggcccggcctgggctccacgcagggccagaccattgcgctgcccgcacagggtctcatcgagttccgtgacgctctggccaagctcatcgacgactatggagtggaggaggagccggccgagctgcccgagggcacctccttgactgtggacaacaagcgcttcttcttcgatgtgggttccaacaagtacggcgtgtttatgcgagtgagtgaggtgaagcccacctaccgcaactccatcaccgtgccctacaaggtgtgggccaagttcggacacaccttctgcaagtactccgaggagatgaagaagattcaagagaaacagagggagaagcgggccgcttgtgagcagctccaccagcagcaacagcagcagcaagaggagaccaccgctgccaccctgctactgcagggcgaggaagaaggggaagaagattgatcaaactgaatgaaacacacacacacacacacacacgcatacacatacgtgtacacacacacacacacagccacacacagagaaaatatactgtaaagagagaaaataaaaagttaaaaaaaaaaaaaaaactccaagggagcaccacccacagaacctccaccaactgacagtttctcttcttgacttgccacccatcgctggatgttgtccactttatccaccatataaaacagtaagcagctgctaaaacaaaaaacaaaaaaatatacaaaaagtaataacattatatgaactgtgtttcctacttgattaaaaaatataaagaactgagtgtttatttccctaattaaccaagaacttttgtacacgtttaagctattattattaaaagtgtttgcaaaatggtcaagattataatattgctgaattatataaaaagtccttttcatgttgagctaacatttgactttagcacaaaaaaaagagatattttagaacacgtaaaataatatttttagtttttctcattttgttaccaaatttcaaaccttacatggaggttattatagtatatttgacatcctatatacctgtgattagagatgtgtatatatatgagggctaggcatgctgtgtgtctgagctttgtctaaatgttatgcagaagtttgtagagttcaaggtacgtaggtttaattcatgcaaggtaaacaataagtgctctcttttatacaatatgcattgcatctggaccttaaacatataaaatggtcagtgaaacttctgtgaacatgaagaaattattaaaaaaggcatttaaatgaaatttgctaagttgtgatttttatggttggaaccaaagttattcaaatagtaaaagaaaaaaagagaaagaaaaaggaaatttcccataatatttttctgcatctgtttgctttgactgagtagatgttttgttattattgtgtatatgagatgtacttgtattgttcataatatatattttttattatgtgtagaaagattttaaaaacctaactaacgtgcagcaatttccagtgaacctgtatttggatatcaggtagtgagtctatttgtggtcactagcactgtctcctaaacttgtgagaggtctgaagctatcctttgatttttgccagtgctattaacttatgtagacctgtttaaaagcaaagcaacaccattatagttatcctactgagccatggattctgagtttcatttcaaaagtgaaagccaagttggtgtatgtaaaggatttccatgtagctgtggtgctagttattactggctacattatatgctaagtgtatttgtgttcccaagtgtacacgccttctgtcaaaagtatgttctattatcactcatattcaaagtgtagggtatgaaaacgcaagcttaggagagcactttaccaagctggtgtcctccactgaaattgtttgtaacgatagtcttttacaggttttcatttaaagatgtttatgtgcttttaattgacaactaacttcttgctgctgtatagtaaaatattaatatattttttatcattaaactgctgcatgactatcatctttgagtgaagagaaaatgttataaaaaagatgccttaaatacagtacattttggtttggaattctgtagaaagtattttggtaaaaaaagaaaaaagaaaaaaagaggatcttgtatcttgtctgacagagagagttctggacatgcaattgtttcttggcaaagccagccatctagctctacctgctgtatgtagaagaaaccacctgtaggactgggaaggtgtcagcacctctcccattggacagtatcggcctaggaaggcagaacagttatcttttttgaaggattttttttttttcctgctggctctttaggttttgatttgatagttttaagctttctggttgagtgtgttgtctttgtttttgagatctactgtatgtgttgaatagcaagctattttcattgtactgtgcattttcccattgtttgcttttcatattcatacaatgttaaatatgaggtgaccgtaaaatagttaggagtttctttacttacaaaatcactggaaattattaaattgctttcccctccccccaaggtgcattttttattattttcatatagtaaagttgagcttttacagtgcataatgtgacatttggaatgcttatcaactgcatgtaaacattaataacctgcactttttgtcttaaggtttgttgagctgttttgttcactgtactttaactgtgatatggaaaagattgcattctctgtgctgtttctaattaggaaagagaattgctttgattttgtctcttgtttactatagcttcttaaagttaagccttgtgctacgagttgttggagtactcctagatcagtgttttgtagtagccagcagtcagtagtgcaagtcaacaaaaacacagcaaacttaggcaaagtgtcctttctttgagatgcaagttctttcgtaaggttttctttagggtcagttacctaaagtaaaacctttcttacctgtagacttcagattctgcttggaatcctaccggatcaagaagcacatgtattgtgcagttgtctttacactattaacagttaacacaatcttactaggactttgaatccattgtctgatttatggtcagtgggtttaaaaagaaatccacatgcagatcttttaagacttaaaaagtggtcatagagaagactgagtgactgtaaagatgctctttttgtttaaagcatctcacttttctctcccattgacctcctaacctccccttgcccttctcctgtttcatccttccccctacatttcccctcccaggtgctcggtactttaccaaggttctatatttcagtgtattatgttaagagtctcttcttgtttttattttactagtgggtagccccagtttgtgctgaaaaaaaggggggggtatatttgaccatatgtgttactcattgacaacagtatgatcaaatgtgccaaaaacaagcaaacagaacttaattcatgacaagtatgccttatttttattgatctgctttgtcttacaattaaggtccaagagcttggttaaactatgttatatgcctaagtaaaaaagaaaacttgaaatgcattgaaatattgatgttttttaaaatgagagacactgtcaagtaatttgattcaaagatcagccaccagatttggagagtgagtgagtgagtgagtgagtgagtgagtgagtgagtgagagagtgtgtgtgtatgtgtgtgtattggttgtagtggtggtagtgatgatggtatttgtggcttttccccccttttaaattaccaaatcttattttaaagctaccttttatttgtgcctcgtatttatcatgctgatgttagaagcagcagtcatccagccacagagggagctaaagttaactaaccagaactgtagaaatcattcatgcctttgacaacaaaggaagttcataggaaagccatgttggcttttcctctactagacacatgttggaggtagatgaatatttgccaaatgaggggaaaaaaagacaaagtagtcaggaaagacaaacggttttccagcttctcaaaagccatggaaagtagaaaccaaaaccaatggaaaatttaaaagaccttgaaagtctcactttctagtcccatgcaggggttaaaatttgactcaaaatgaaaagtctatcaatttttggttttagacccttacatctagagatggttaactattccagttttttgttttgttttgttttattttaggtaatggagaaagctgctagtgattttaacccctgctgaaaggagacagataatttcatttgggagcaaatacttattgccttgagaaatagcactgtaatagtttatgttaattagtcatagaataacctttatccctttcaagctatgcaaattattaaataggtataaattagaattgaattaaagagagttgattatattgcaatcagatggcattcacaaacttaactggagcatatacaaataaaatctattagtttaagaggttttttttagtgctgacat

SEQ ID NO: 25387 - DNA, 1153 bp, Mus musculus
atggcctggctttggggtgttagtaagtttccatttagcaatgatatctgagtcttactgggcaagtgcttaagaaactggaagtaaatagggggcagttccctcttgtgtgtagctttctataagggtcatataacttctccttggtttatgtcacatattggtgtttcgtgaagtgagtgttctttttgaaaatttaagatggatgctttctgagggatggtaatagctaaggatccaggactgtgacttaaccattggcagtgttatagctaccttgatacactctactcagagaacaaagagtattcttgtgaatgtgtgttgctgtactcagaattgcaaaaaggaaaaaaaaaaaaaaggaaaggaaacaaactgagttttctcaatggaacagagagatgtatttttggctagaattgttttttataagttaatgatcttattctcttttcttttcttgttgtttttttacacacctcatacttaaaaccagcaagtaagaggtctcttttcagattattttggaaggtctgaatgtgttctggatggggtgttgatcgtgacgtgttcttcccgtcgtgttctgctggtcactgtggctcatagaattttcaaattctgttgaaaattcagtggtgtatttgaaatgagactatcttctacaacatggtatggatgtgtgtggctagattccatgatgtgacatagttgtggagccatagctttgatttaatttaaatagaaagtttaaccatagtccagattttaggtttatgtacaggaattgtgccaggtacttgtctaaatgtggaccatttttggaaatgaaagttaatgaatgtggatttgactctagataattctatactcaaaaatacaagttaaaggctcacatcattagagttacctacatttgatggccttagctctttaaatgtggatggcattcagcattatatctgtgaatttccttaggaaaagaaaggttcagtctttataccttttcttggaggctaaatttaccacatatggaagtaagaaaattgtagcaagtggctttatttttttagtggagtttaaccagcttaattaattccttttcctactttgaatcacttatttcccatgtataaataaagggaaagat

SEQ ID NO: 25388 - DNA, 1128 bp, Mus musculus
attcagtctggtttgccaatccagcctgattgaaataagtaaccaatcacttgcaaactgaaaaactgtccaactcctctaaggttttgacaaaataaccttggctgatgtgggaacattcccactttgatttctgacctgacagcgaagattcatgtttgacatgatttcaaacctgacagtgtctgtttaaggagccatggtacagtttgctaattcaatcccagatacctgttgattacctgtaagatctagagttcaacgtagccagcagccgtatccctgagtgctctgtgcccatcagataacatgaagtaagcagagttgggacaagccacagctttgagtattgacctcagagcagagccccagattcaagatttgtatctgctttcttgggagtcactgaactgatgtcccacactgcgttacttactgtagatgctctccaagaggaggcccagagcacacatccgaattgcttgtggtactcagagagggggtgctaactctgatgccctggccaaattccagtttagggatgtgggtcttcttgtcattctagttggaaatgtgcatcactttccatttttcctgttgctctcagtgcaaactacacaagtctgttcctttgctccaatcccaagtctccaagatactggtatcacacgggccaggttcatgccttatcttgatacacaagagttggagaatgggagcttggcatcaggatgccttacactgggagggtagactcttgtgaggcttggggatggaacctgccctctttccgcatatgttagggagcgtgcactggttgggagcttccaaccataaggtgtgagatgaaaccaatttcccctcttttcttataacatgatgagaaagtcttttgggttttcggtagttggggaaggccggagttctgcagctttaatctgggtaactaaggctggtataatctgggtaactaaggctggtttgagcaagactttggtaaattaactgggttctcagatgccacagactccgagagaagtcaccattatttttagtggccgtgatggagtccccctgtagccattactttaagattacatgcagagttgctttattttgagctttttg

SEQ ID NO: 25389 - DNA, 1162 bp, Mus musculus
caaaactgctcttaaaaaggaatactactgcttctcaagtgcctactacacaccagtatatttcgtggattattgcactaaaccttcaaaactattctgtgggccaggaggaactgaattcaatgtccagcacacacaaaaacagatctaggtatggcagcacatgcctgtcatccaagaaccagggaggcagacacacggggtccctggagcttgctggccaggcaattgagcagaactggtttcaggttgagaaaccctgttttaagaacgaaaagacctttgtcctccatgcacaatcgcatgtgcacgtgcatgtgcacacacacaaattgtgtgaggtggtgctattaactgctcccacctgatcgacagaccacagcttgggttaagtcgcaagctgcagagctgggacgtagatcctgaaccccgaccctgtggttctctgtgttgtctgctactcgtgtgtgctcctgactggtgtggctagatatccacaactgggtggctctctacccctgcagtgacaaccggaagtgctgagctcagccccctgcgcgcctgccctttgaacccgtgacaagcttttcctggccacctccctgaaagtccttactctttccccagggcccagctgtggcctaacatcctgtgggtgtgtgtggctcacgcacggcaagggcagttggttcctggcagcctgtgtgatctgctgtgtctgcctttgcctcctctcatgtgaccactgtctaggcgcaggagagccccgttccactgggtcatcatggtgcttcccaggaaggccttttcctggacggcccttcttactcatctgcggtgctcaggcctttatctcactttctcagagaccagactctgcctcccagacccaaatgcagtcaaaactaccgttccctttggactttattacctcaaccccaagctgtttgattttggggggcagattcacaatggctctgcgcaccggcatctccctgcccagcacggaactcccatatgttaaatgagtgaaggaaatggaagcttgcctaggccccatgacctaagggagcccagaaggcaagacctgtccccccatcctagcttcctgaaccaattcccagcagaaaccaaaccagaagaacagcccgctcagcgcaga

SEQ ID NO: 25390 - DNA, 1144 bp, Mus musculus
ggaaaaagttgtttgttgttgtggtaataatttaatctcaatcctgctccacattagatgttttttgttttgttttgttttgtttttgttttgttcccagatgaaagacacaaaacttgtatttatgataagccttaaaagcactagagctgggcagatattcactctctaagctattatgtctacttccctaccaataaccctgagttagaatttaccatgcgctgggcagtggtggcgtactcctttaatcccagcacttgggtggcggaggcaggtgtgtttctgagttcaaggccagcctggtctacagagtgagctccaggacagccaggactgcacagagaaaccctgtctcgaaaaaccaacccaacaaacagaacttaccatgttacatctgagcagctcttaagtccaattagccagccctcatgcccatgttttcataacacctaccccatggctccctttcctctctccaccttcttctctttctcctggtttggtcttgcctcagaccccaagcccaggaaccgaaactccacctctctctcttcggcccagctataggctgtaggcatctttattcaaccaatagttttaaattaatgagcaaggttacacggcaccattttgcttacgtgaagatttcctcatccctgcaggaaaccgtggccagcattacaataaacagcaacagacccaacctcaacatgttgtaattccagtgataagggaaattgtgagttccaggtgggctatatactgaatttgagccaaacttgggccatgcagtaacactgtctcaaaaataaaataaaatgaaataagtgagaaatcaaaagaattgggctaaggtgagagactcaaactggtatattttgagcccttcaccttagtcactcccttttgttatggtctgtaccctcttcacagagacgtaattaataagaagctatatgagatttgaacagctccaaagcaggacatttcaattcctggatgagtgctgtactttgagatgtagcaaatttttaaaaagaagtgaaagttacaaacttttgctgaaataccatttatacttagagtcctttttgcccctcttcccaccctcagagtctttagaattagttacgaatcaact

SEQ ID NO: 25391 - DNA, 1159 bp, Mus musculus
aagatcaacttccaccagcctgcttttcccatgtgtcactgttctgggttgtggcagcagcagactcattagaaaagcagattgcagcctgactcatctgcctgcctgagtgagacgtgcagtagactgggctcacggatagtgtggtgcatgctgtctgctctgtacaccagaggctatgggtgcctgcctcagaccatagaaagccctcagaggagacagtccattgtagggcaggagctttgtcctggaatttcctggccttcatttgtataatgtcatgtacttactttaggggaaaaggtgctatggcctgccctctacagggcctttgtgctccctatacctggccaggtcctcccaaggtctgagcaggatgctgtagacaggtgagcttacctgtctcttatttggtagcatgtctgctatcactgtccacggaggacaccagaacctgtggctgtaacggctatctaaacctgctcacattggtcctaacccttctctctcatattacagcagaagaaatcctacctggagcggagcgtcaaggaggctgaggacaacatccgggagatgctgatggcgcggagggcacagtaggagctgctgggaagcgccttccgttctgatccctcacatcctgtcacggcaggggctgtgcagggtactgccctccctctgcccagcagccccatctctccatcaccctgagcccctcaggtcccaactgaatgtctgccaacccctgctcaggacactcttctttcctggggcaagccaggagctctcaacagagggaggactggagggcagatggagaaagctgtccaagcctgtcactaggcatgtgggttagaccaggttagaccaataaaaagctatgtctttactttatggcatgtgcttttctccaccggaggagagagaggcaagtgtctccctcagcttgtgtcccttttttcctcccctttctgtcctgggcctctgtgtagagcatggaggaagaagacgacaagttgataggtgtggtggacagaggcacagttggcttcagggttccttccctgttttctccccagaattctaaaacaaagttcagtggcgagcagcatctctaggctctggtcctgtctggccatggtgcgcccgtggccct

SEQ ID NO: 25392 - DNA, 1222 bp, Mus musculus
cagaggtgacgcatgcctttaatcccagcacttgggaggcagaggcaggcggatttctgagttcagggccagcctgttctgtagagtgagttccaggacagccagggctacacagagaagccctgtctcgaaaaacaaacaaacaaacaaacaaaaaaagaacttgagctggggttgactttttacacttgtaatttcagctactcatgaagttgaggcaagagaattttgagttccagactagtgtgggtaatgtggaaatactgctgggttgggatgcaaggagaaagtgttcgtctaccatgtgtgagagaccattggttgactctctagcacacacaaaaacaacaacaaacaaacacgtcacttgagatagaagttgtggtggtttatgccaaggaattagagagagattactagaatagtagtatgccacttattgacttgtagtttctatttttattttttttattctttgttagggaacactgcactgacttatgcttgtgctggaggatttattgacattgtaaaagtgcttcttaatgagggtgcgaatatagaagaccataatgaaaatggacacactcccctaatggaagcagccagtgccggtcatgtagaagttgccagagttcttctagatcacggtgcaggcatcaacactcattctaatgagtttaaagaaagtgctctgacacttgcctgctacaaaggtactttctatgttgaaatacttataattgtttttataacagcctcaaatatttgaatattatttgggttaattttgtattccttcttcacctatttgaatgaactttatattttttttttcttgtcgtataaacttaccttataagatataaaggccattttaacttgtatttctgtacaattcctatatatatatttctttattatttttgtttgtttagttatgatgttaaccaaacaacttgcagattttaggatttctgttatttaatactctttgtcgaatttttcccttaaagagttataaatagatctactgatagacagttgatgtagaaatcctgaaaaagccttgtgtggtggcgcacgcctttaatcccggcacttgggaggcagaggcaggcggatttctgagctcgaggccagcctggtctacagagtgagttccaggacagccagggatacacagagaaaccctgtctcaaaaaaaaaaaagaaaacctga

SEQ ID NO: 25393 - DNA, 1189 bp, Mus musculus
cctcaccgtcttcctctggaatcaacataaagttcagaaaccatgtctcgaagatatgactccaggaccacaatattttctccagaaggtcgcttataccaagtggaatatgccatggaagccattggacatgcaggcacctgtttggggattttagccaatgatggagttttgcttgcagcggagaggcgcaacatccacaagcttcttgatgaagtcttcttttctgagaaaatttataaacttaatgaggacatggcttgcagcgtggcaggcataacatctgatgactaacgagctaaggctcattgctcaatggtacttattacagtatcaggagccaattccctgtgagcagttggttacagcactgtgtgatatcaaacaggcgtatacacagtttggaggcaaatgtccctttggtgtttctttgctgtatattggctgggataagcactatggctttcagctctatcagagtgacccaagtggaaactacgggggatggaaagccacatgcattgggaacaacagtgctgcggctgtgtcaatgttgaaacaagactacaaagaaggagaaatgactctgaagtcagcacttgctctggctgttaaggtgctaaataagacaatggatgttagtaaactgtcagctgaaaaagtggaaatcgccacactaacaagagagagagtgggaagatggtgatcagagtcctcaagcaaaaggaagtggaacagttggtcaaaaaacatgaagaggaagaagctaaggctgagcgggagaagaaagaaaaaaaaaacagagagaaaaggataaatagatagaatcacggattttataaactccttagaggcatcaattcacttaggagctgtcctggccttccaccccggaagtgttttcttgtattatcttccttaccttggccatcggggaaataggacattacatactgaattgggtccatgtctgtccagttggatgctttattgtaatgatggacatctttataaacatcttaatctcaacacataatttttggaataaaacttggaaagattaaaaaaaaacaatttcattacttaggtaaatgtagtaagagtttgtacactaaccatactaagactaccaatcatacaagcgcgttcagttgggtgaagtttgataataagtccttgttagaagctg

SEQ ID NO: 25394 - DNA, 1203 bp, Mus musculus
gttacagagtgactatattttgaatgtgtgctcatagaaaggtatcctgtccgtccctagaagggtaacccttcgcctaatgcccctaatgacagtaacttagaaaaaaaaaagacaagagttatccctgacgtctctgttcaaaactaaaatggttaaggaacaggaatgccacgccgactgaagcaaccctcgctttcaactcaccttgtcatccgccatctttccccgccgaacttgttgcgcacgcgcagccccgcctcctcagggcaaaggctacttccaattttagaggcacttccggggcatttcgaggggtgggggtggggtggggaggaaggcggggcgtttttggtgacggctgtggcatttaaggcagcaaccttgctccccatctgatcttttgccgtgtgcgcgcacgggtaaaggtcggaacgtgatgatctcatgctccacgcgatgatctcattcgccccctggtgcaccgtgtgcaggatctcctcgcccggcttccgccgtccgaggaactcatagttactaacctgtgcggagttcgtagtgtcagtacgcttcgtaggacagcacgtaccgaaacacgcgaggactcgggaaagcagacgcgccagcagctctgccctcccccaaggccgtccctatcccgcccagcgtttgtttgcgcggtgccagttggccgggccggcggtctccggcgcagagaggctgggcttgtggcccctgcagctccggaggtcgcgttgggctgagagcacaggccagcagaggctatgctgggcaaggattatatgctggccatcattctggtcaactgcgatggtgtgcaccgagggtccggttgggaggaccaaaagccgaggggagatgagggatgaaggaaggctacccgaggttcaaacaccgggtggtggtggtggttggcgtctcggggatgagaaccagggaataattgaagcttgatctttgcatgtgctatatttaagatgagagttgatacctaggtttagggctgtctcctatgggatggagcaagggttataacggtagtgttgggagctctcgaaataacatgtgcccttgctttaatcccttgttcctgtagatgacttgtggggggaccaaaatctggagggggaaacaggcctaccccctggctggagaaagatccgtgatgctgcaggaacttat

SEQ ID NO: 25395 - DNA, 1128 bp, Mus musculus
caaacatgaagcaaggagtaaggcggttagtttgtagtcatcagagaccatactaggaaaagaagctggggaaactgaggggctcaggttccctggaagcctctttggcattctggccgaatggggttctggttagagtcctctgaagctattatgtgatcaggactcctacgttctttttcaagctccagaattttgagataatctttagagaagagaacacagctgtcagtagtgaggagcaggtggccgaatgccctcagcccagcttagctcctaggcagagaaaaagagagcacacctgatttccttctttgtttttcctcctccgcaggatggctccctcttgtcctccccattcttcaagggcttcctggcaggatacgtggtggccaaactgagggcatcagcagtattgggctttgcggtgggcacttgcactggcatctatgcagctcaggcatatgccgtacccaacgtggagaaggcactgaagaactactttaggtcactacggaaggggcctgactagaccctttggggaaagcaggacgagcatgttgggcctgcaggtagagccctttctatcacagacactctatctggcttcccctgctattattgttcatgtgctaactccgtctattctgcctctttcatccctgcctttcttcctgcagagagtggacagtgctttgtcagcctgcaccccagactccttccctccctagttccatgggactgaccccaaaactatgggccattaatcccctcttgaagacctaactggaatgtgcggctgtctctgatcctcagtattctctctggtgatgtaccacagttctatactcaatctcctacaaatgtgtcccagcccctctgtcccttgctagctacccaggccacctagggtctggtgtgggccatgagtgtagaagatgggggcgtgccaggcctagcccgcccaagacaggctcgctggaccctgttgctcttcctgtccactgccatgtatggtgcccatgcaccgttcttagcactgtgccatgtggatggccgagtgcccttccggccctcctcagctgtgttactcactgagctgaccaagctcctgttgtgcgccttctc

SEQ ID NO: 25396 - DNA, 1375 bp, Mus musculus
gggcagtgcttgtggtgctgaaccaagcagtcaatgggctgctcatgtcggctgtcatgaagcatggcagcagcatcacacgcctcttcatcgtgtcctgctcgctcgtggtcaacgctgtgctgtcggcggtgctgctccagctgcagctcacggccatcttcttcctggccgcactgctcatcggtctggctgtgtgcttgtactatggtagcccctaagtccttgaccacctccactcacttgtgactgtgtagattaaatgcaaccaccagagttacctcccatccccctgtaatccccagcagccccgtaacaagtgccttgtaagagaagctaaggtgtccaggttagcctttgcgtgttcaggtgggagagttacccctaggaggcataaagagtgggcttggttaaggaaacgcctaactgcactcctgaattctttcatactcaagaggtgggatccccaaacccaggcctgtccttgaagatccctgccttgtcctgcatgtacatggctgcttcaagtgaagcttcagtcttcttacctgctgtggtcactcctgaagactctgtcccgaagtttggtgctggctgctccagcccagcatgacttccatataaagatgcttagtttgccccctccacagagctgttcccctcacccacctgttattctggaggggtcagaggaggccagggcttgactcatctcagggaacattggccctgggccctggcttaagcctacactcctgacccctgtgctaactcgagagccctgttgaagcctttccctctgaagcacttaggagctactgctctttccactctccgtggtgtcctcgcttccaacagctcgggagggctctgcagagtaaccagggaccaggtccagaaaatgtttatagccaatcagtgtctaactacttcagcaataaggtcttaataaagtgttctagggtgtggggtgcttcctacaaccatgtacagttgtcctgtcttctgtgtttcctactcccctcagtcatgattttactgagtttcctaagtggttttggaggaacgtctagagtgggaggaaaggattctcccagctgtcgccagtgtcattgttcattttgggagctcggtggatctgagatgtttctgtccagttatggtgggacatgcccgtgatcccagctctgtgaggcaaagcaggaagaccttaggcttaaggtcaggctgaactgcttgatgagaccctgtctccgtagaaccattgagagggtgtggtgacacaaacttgtgactctgcttgagagatagaggcaggactaagagtacaaatggagctggtttagtggttaagattatatgtttctcttgtaaa

SEQ ID NO: 25397 - DNA, 1234 bp, Mus musculus
tgtgggtggggagagtcacatcctactacaatattgttgtaatcaagactaaactaataaaacaagttttctactaaagcacacagaaggacagacagaagtaactttaaagcacacagagggacagacagaagtaactttagtgtgtagtgctgtatgtgcatagtaccacacagtatgttaagtgggctatagccagccaaaaagtgaacagtcagcgaaagctagacccctggtcagtagttaatgcctacagtgaccttaaagcatcagacacatttcttcccatacaaaattctactagggactgggtttaaagctaagtacagcaaaaccactttttttttaaaggcaggattgtatataaccatagccagcccagaactggctgtgtagccatgagccactatgttcagtgaaccgtacctctttccttccttatcctaacaacttcgaaaaaataccctttataattttgtgtagcctttataatttggatatgcaggatattcatttgaatcccctttcctcagcttttggccaagagaagacggtgtctctgaacaatctgagtgctgatgaggtaaccagagccatgcagaatgtgctaagcggcaaagcctgaaggtctccactgaggactgtgagcgagagcagctgaacctgctggactgaagacagtgtggggaaatgtgtgctttgggtccttataaagcttacgctgtacagtgtcccttcagaatgtcctcttcattaccttctccctcttactgcgcaacactgaggcaaagtagttttatataaaaatactcctttatttctcctcaaaaaaaaaaaaaaaaaaaacccaccaggtgccagctgtgatgtcgtacgtcattagccaagttgctgaagagcatgaactaagacaatctcaagtgcaacaccacactcaggtataacaaaaagctaccagcttctaaagtgaagtaggagaccctagggtaaatacgccgcggggtaaagggtgatattgagcagccaggtcatccatgggtagcagctatctgctggagcgcgtgtatcctctcctgaagctgagtttcctcctggagcttttctagggcctgcagccctgactgctgcaggaaggctcgggcagcctgaggagagagaaggacagacatttaaaccctaaagcccaaatcccggagccccatgggccagcccacttcttagatggtgcattcct

SEQ ID NO: 25398 - DNA, 1122 bp, Mus musculus
tgtgtagtcttggctgtcctggaactcactctgtagatcaagctgtccttgaactcaggaatctgcctgcctctgcctcctgagtatttggattaaaggcgtgcgtcaccaccggcatagtggactctttcttaggtgggagggtttcagttgagaagagacattgacagatccaggaataggtggtggagcagtcatggaaactgagagaggtcatctttgagctttaggtggacttagatcactaacagcatgcgtataaactactgctgtccttttacagatcattgagaagaggaagaggatggaagcagatgggtaagcggcatccctctttgtctttgggcctggtgagaactgttcaggatactgatcctatgctgatctacttctcttttgatttcagggtcgaagtgaaaagaccaaagtactaatctctagttccagctgtcaccacgtggctgttcttagttgcttgcttctacaattcctcagacggttgcaaactgttgttgtttgtgaaagtttataaatgtttattgtataactctttatagatctgtgtcccacatgctaagattaatggcaatgcaacaccatgtccagcatgttccattaaatgtagttaaacctgctgtcttttctgtgttgggcattccttcttaagggtcccatgaagttccggagttccagaagttgtattgaatgttaggtctcatctgaggtgcctatcagcatatcagagctgacgttggctgccagttctcccaacatacctcagtccctacctgttccaggatcctcctggtgtcataccctaccgtttacctttaccctcaactcctgggcttccctttctttcagcttctctgattcttatataacccatccattttggttacaactctttttggccacttggcagctgaaccaggtaactccctccctcctgtcacctccttacatggcctgggttaggatcttgttcatttcacccttccaaatgcctctggcatgctcttccctcatctacactaaacctccaccgtatctaggaacagtcaagtcaagtgttttcatttcttcttttcattgagtctgctgtgtttttcctgtactgat

SEQ ID NO: 25399 - DNA, 1202 bp, Mus musculus
aaggtgcctgctgcatcctcccccctcctccagagtttgtctctgagaacaacagaagcctttgttttcttccttggtcattttgcaggctgagctgctgtacaagaagaacccgaagttactaaaccagttgcagtactgtgaggaggcaggcatcccactggtggccatcattggtgagcaggaactcaaggatggcgtcatcaagctccgctcggtggccagcagagaggaggtgaggagggcgtcagacgctggctggcccaggcctgtttgagacctgagcctcctataggactagcttataaggaacccgagggcttaggctttaactataattgtggcatttaagatctctggggtgcctaactgggcacatgtcccagtgaaccaaacctggtaactagaagtaggcactcagggaacagctaagaggaagatattcaaaccttcttcctctgttgtggccaggtggatgtccgaagagaagaccttgtggaggaaatcagaagaagaacaaatcagcccctctccacctgctgagctgagcaaaccagtagaggaaacaggattgatcttaactgaacgaaaacaaaactgcatatgtacttaaacagtctgcatatttgccatccagcagaagactgaagggtggtcagaacagaggctttttgttttttgtttttttgtttttgtttttattattatgttatcagtaatcactggcaaaaaaaaaaaaaacaatggccaggtactacactgtcggggattataggtggactaaccacgtctctgcctcctaaattcctgtatggacttgagatggcttcattgaaaaaccacacggcagatgaacaacctatggccaaaacgtccaataaatgtctctaccgctaacctgtctgtgtccttgatgcctagcgctaccttcctctggtcctgacactggtataaaaaggaggaagccttctcaaactcactgagtcttgctagaggttcttgtttccagtgtccattcggccccagagctccctccactccgcccagttttggcgatggaactcctcccacccacggtcctaagtggggggttcgagatttccaagggcgtgcgcagcgtgcaaggatgactctttgagaggcggggtcgtgctcagagccaatgagaacttgagggggcgtggagggcagggaatcttcca

SEQ ID NO: 25400 - DNA, 1188 bp, Mus musculus
tttttattttatgtagatgagtgttagtgcctacatgtgcatctgtggctggtccccacagaggccatcagatcccctcagatctcaattacagatggctatgagctgccttgtgtagtcagtgctcttaactgctgagccatctctccagtcccattatgtgttttcttggattttcattcggttttgttgtgtggttgtttgttttgtttcgctttgttttttgagacatactaagctcaaactcatctaattcaaggctagccttagccacctggtccttctgtctccacctcccacgcactgcaattacaactgtatatcatcacactaagcttgtcatccaagtcacacagtcggttcatttcttacaccttctcagaactatcccatgtccagctggtaggtcagaaggctgccctccttccctagttgacctcaatgagttggacttagtctctcaggatcccaactatagcttccatgtttgttcctcgatagcatagtccagctctgactcttgcctgcctctctctaggcttcagaggaaaaggtacggaccacagagacgcaggtgcttgtggcatctgcacagaagaagctgctggaggagagactgaagcttgtctcagagttatgggatgctgggatcaaggtacaggggccatccctaggctggctgcaaacttgggagtactagacacaaactaatacaagtttacatagtgccttcttcccattgtttcttcaaatggagcaaagaacaaggtgcctcttacactacagtgtgtggtcttcatgtgggactccgaacagagggagcagggtctgtctctgactctgttgcctgcatttgggaccctttcctcctagtgggttgcttaatggagccttaataggagaggaggtgcctagtcttactgccactcgatatggcggggctgtttgatatccatgaaggcctgtcctttatgaagagaaacaggagggatggaggggagaagtgaggcatagggaggggatactgtggtcaggatataaataaataaataaataaataaataaataaataaataaataaataaataaataaagcctaaaaaggattgcttgattgagagagctttgtcaagtatattctcccaaatgttcttatatgctgttaacagcctttttattatcaatacc

SEQ ID NO: 25401 - DNA, 1199 bp, Mus musculus
agtttctttcctgaaaacagtaagatccttagaaaccagattgacccatgtgctgtttcttcccatttgtcagctactactgcaatgtctgtgactgtgtggtgaaagactccattaacttcctggaccacattaatggaaagaaacgtaaggcatggaggtagttggtggctggagctgggttgggttttaaaggtgtgctggagggcaggtgtggtagagtggttttctggggcctttcgtttgttcgtttgtttgcttgcttgcttctgagtatccctggctgtgtgctacctgtgcatgaccacagaggccagaggaggacgttggctggccttgatgataatctgcccagtaaataggagcaggtgaggctgagagcttcttttagccatagttatttttgttgtgtactttattatgaaaaggtaaacaagtaaacaaacctaaaaaagccagggcgagactttcccggggggggggggggtggctgaggatgttataatgacttgtctccgttgttaacctcacccagatcagcgaaacctgggtatgtccatgcgcgtggaacgctccactctggatcaggtaaagaagcgttttgaggtgaacaagaagaagatggaagagaagcagaaagattatgattttgaggaaaggatgaaggagctcagagaagaggtgaggctctgctaaccctgctccccagcttggagtgttttccttgtggaccgagggtggccctcttcctccgctcactctcctagctccagttttgttcctgggtttctttgtactagggcatctttgttcgagatccatgagaaacagctcaaagcctatccagttttctttggctttttagattagatctcttggggtggggagggggggcaattattcattcattgattttttttttttttttttttttttgagacagggtttttctgtgtagccctggctgtcctggaactcactttgtagaccaggctggtctcgaactcagaaatctgcctgcctctgcctcccgagtgctgggattaaaggcatgtgccaccacgcctggcgattttgttgttttttttttaaagacaggtttgttttagactaattatgggttcatatccaagagaagaaagttcaaagcctcccattgccatcctgttcccatgcttgcacacatagctttccctaaa

SEQ ID NO: 25402 - DNA, 1100 bp, Mus musculus
ggaattcaagggcgagatggggatgagggcacaggtgacagttatacaagtcttgtaaacagatgaagctccctttgctggctctacactctcaataaaggggtccactcacaagactgccacagtgacttttctttgatccatgtagttcctcacctgtgtagcatctgaagcactggaccccgcaaagtgtgcactccatccattactgattaagtcagcttttcgcttaatgagttctcttgggatttggccactgggattgttgcataaatactccatatgttggctcaactcctggcttgggaatttaaatacagtgttgagcatggtggtgcacagctgtaaccccagcacttgggaagcagaagcaggatggctgtaagatcacagccagtctggtctgtataataagaccttctatcaaacctcacagttgcaggccaattgcaattcttgaatgctttccttggcaggattagttacaaatcctagagagattacccttgtggagtggatcattttatattttcaaggcaggtagggcaaggtctcagtgaagggagattctaacaatattcacaccttgggaagtcacccattcacctcagtaatggctaattagtgttttctctagtgcggtgagatcatctgccatttccattataatcgtgtgttccaggttctgtaaactctgggggagtggtaaatggaatgacctggctaggttctatgggggttatggtgttaagatggtggattgagaggtgaagacagggtggggtgggggatttagaacagaacaatcctgtataactcaggaatctctggaagagaagtttgtaatccatggagaaatttgtacttgaggtgagtgcacctgttgtcttattgactccatttattcattgagtgttgagaagacaaactttgttttatttgagacaaaatctattatcccctgttccagtctcccgtgtactttgggattacaggcatgcatgaccatgtctggttaagtcattagcatcttctggaaccaagtgtcaagaatcattagtagggaatttccctctgataaatgttacctgcaatatcca

SEQ ID NO: 25403 - DNA, 1289 bp, Mus musculus
gttagttaaatgaaaagaacacacaacattcatagcaaaacatctaaagtcctatattgtgtctgagtgaattcacactgaaatatggtggctaactggaaagataggaattttgagcaaattagttgatttcagtatgtaaaaggcatattgacattatatagtgacaggatacatatgaatatacatctgggagagcctctttaagcagcgaatttccaaggtatgtctggaataacagtttacactttgcaaagcttccacttgggtggatgaggcagtgactgaaaaacttaaggtaacagagatgagggtggagggtggtctctggacgagcgcggagctggcgtggtttagtggtgcgggagaagaacggaggttacacccggactggatgagggaagcgctctgctcccgggagaggcgctggagtccacgcaggcgctgtgggtatccaggaaggcgtcagtggccggaacgggacccgattggtctgtcatctcagaactttcaaaacatccaaatgacgtatgtttctctcacagtcatgtaaatatatccaggaagagatagacgggccagctttagctcagcggttacttcgacagtggttcagttcattaccagctattcgtagcaggttcgaacaacacaaccaaccacttacctaacccgtgagtgtttggttcgagacccgcgggcgctccctggcccttttgccgctgcgaatccgcggaactttggctacttttgcatgttaaaaaccctcagaacttcttgaataaattgcagtttcaaatactgcacattttatgtagttccagaaaaaaattgggggtggaggggttgtggggctcaacaacaacaggagaatttaatttttaaaattagagtacttagtaatatttttgttccaatagttaggtatacttgtatcttttatgtcatattcctcttgaaatcgggaggatttttttcatttagttaaaaaaaaatatatttttttatgtgattgtgtgactgtatatcacatatgtactgtcttaggtgctgggaaccgaattcagcttttaacagctgaatcatctatccagcctcttttgagtttaattgattttctgcgatactcctcagagttaaccatttcgggtgagctcatgtaagaccttttcagtgtgaagacacaagttttatttccaaaaacttttctgatgttaacactttgaaagtatttcttctttgggagctgtatctactacgttctccaaggacctgcttattgctttctt

SEQ ID NO: 25404 - DNA, 2131 bp, Mus musculus
atctcttctccaggaatgtctggccacaggcaaggccatgactcactagagcatgatgagcttcgagagatattcaatgacctcagcagcagcagtgaagatgaagaagacgtaaacatccttgacactgaggaagatctggagagacagctacaagacaagctaaatgaatccgacgagcaacaccaagaaaatgaaggaaccaatcagttggttatgggaattcagaagcagatagataacatgaaaggcaagctccaagaaacccaagacagggcaaagcgccaggaagatctcattatgaaggtagaaaacctggctctcaagaacaggtttcaggcagttctggatgagctcaaacaaaaagaagaccgcgaaaaggagcagcttagctctttgcaggaagagctggaatcacttctggagaagtgagcttgttgactttagtccttagactagtcagctcaagaaaaaattattttcagagtaaggtcttgaaatactttttttttctttgaaatgttcttattccctgagttttgttgaaaattttttgattgtttttcagaactatggtggtgggttttcattcttaagaaaataggattacatagacaggtttgttgtagggaagatataagaaagatgagtgaaatgaaaacacttgaacttttaatcacaggactttattacaatttgtttcctaaaagtttctagtcctttttttttttttttttggtgctaagatcagtaataagctagcctacaggcagtgaagttaatttcttttaaaagaaatatatttttttttacctcagcaagtttccatgttacagaaatgcaagtttttcataaaggttgtttcttatacaataaaagctactaattttcactgtttatgatgttgttctatgaatactgaaagttgaggtggttcatggagtttaatgactgaatggtgtagatcaagataaatcctgttcttttgtttttaggaaaaggaaagcaccaggtaaggaaatggagaaattcattgttgcattatatattaaggttcaggtccacccacttcatctggaggtttatgaacactgggtctagagccttcttaaactatcctagtttttatggatggatatctgtatctttttcttaagcactaaggttatctgtaaaatattggaagcagttatcagataaactattccacatgcttagattaagattatattttaactattgccaatttaactgctacaattatttaatagactgatgtttattcatattgtttcattagtatttcccagtatgaaaacctgtgtcctggtctgggattttaaaatttcatatacagagaaaaattctgtgtgtttttttaaatactaaaaagctgcccctaggcaaactaagtatgaattcagaatggaagtcatctggcccctttcattgagaacttgccttctgtattgctgttgacggctgccagagcctctgaagccctaactagtctgaacagcttgaggtcaaggcataccagtacatatcagtgacttgattgtatgatttttgggccgtgtaatttgtagcttaatccgtttgcttctattttcttctctctgaaatggaggtgatagtattaccagccgcacagggctattggactgacttaaatcataaggcaggcttacttagaacagtacctggaatatggtgagtgaagagttaacaaagaaacgttaccatttactaaactggatcataaaaggcattaaagagtgatagagaatagtaaggtgtttacaaagaaattttttatttttgactcactctgtatctcaggatggccttgaactcagttctctcaatcaagtgctgggactgtaggtgtgcatgggcaggcctggcttaggcaacagctgttttaattaggttttgtttcaaattcaacaaaggctcaaaccgtctattttggaaaaggtttagaatatctacagcataaaaattgactcaacttattcctgtagttttcttgtttgtttctggatatttttataataatactaaaaatggcataaggagtaattatctgttaataaaatttaaaagatgaagattgagatctaaatcc

SEQ ID NO: 25405 - DNA, 1143 bp, Mus musculus
gtgcatcagtaagtgtaaaaaaaaaaaactcaccaattttcttaagagccagttagtttaagaggtaaaatgatagaagtgtatttatcagtggaaagggataaaaaggaaagagtcactgtctcttcatatttatgcctccttcatttcatacccaggactgatttggtaggcctttccttcctgctctgttcttgcttccacccgtttctgtctctcttctgagacagggtctcactatgcagccttggcaggcctggaactcacagagctcagcctgcttctacctcccaaatgctggatgaaagatgtgcatcatcaccctcagtgtctaataggctggtcttgtctgtagggtctcttctgtctcatccttctaaggcagaggttctcaaccttcctaatgctgcgaccctttaatacagttcctcatgttgtggtgacccccaaccataatgggatttgcacatccctgggcattccttccagagagcagtgctccttgctggccccagttctgggtgagcttgggactgagttggcaatgctgttctcacctccagtctaccctttaaggccaggggtggagtgggcaggggatggccaactgtgtgacagacgctggtctggtcagtgaatgacgtattgtaaatgttataccctgttgggtttggggctatgcaaatctttctttaggaaggagtaaagttagctttgaggagcacttttcaggctcatgcttataaggtttcttaggattggtctatagcagcctttgctgtgatctgacttaacctcctactgaatcttggcctttgtttattgatgtcagtgttgaggaggagttcagttctatctgaatggaagctgcacactcactgcaaggcccccaagatctccaggaattcttcagtttatgtctccatggtgctcactcatgtctggctctagcggaatatcaacttctgcatgttcaaagactcaaggcagtccttctcaagattcctttttaacaattttaaatttatgtgcgtgcatgtgtgtttgtgtacgtgtgcatgtgcctttgtgtgtgtatgcgcgcgcgcacatgtgtgtgcatatgtgtgtatttgttgtgcatttgtgaagctcaaatgataa

SEQ ID NO: 25406 - DNA, 1167 bp, Mus musculus
ttgaatttagccaaaagaatcaacaaacccagactatgagcatttaaaagactactggtctggatgctttaaaaatatctatttcattttttaaaaaaagaaggtagggaaactgttctgattaaaaccaagggcagagacatggcaaccaaatgcaattcatgccccttgatcgaattctgaatttaattttaaaattaagattaaatttaaaagaacagattaaaaggacaatactgagagcatttgggaaggtctgatagtagactgtgtattattatactaatattaaattcttcaaatatgatcactcttttgtgattttataggagtcctagaaggtatgtgttatatcaaatgttctgatacctatagtgcttgcccatggttcttggaggatagaacccgtgtgtgtgcacatttgtgtgcaagtaactagtgaatttaggtttgtttggtttaaaaaaaaaaaaaaaaaaaaaaaaaacaactcagtatgcatacttcaccatactagtcttttgacttttggatacctttgagacattttaaggtggaaccctgaaaggttaaaagtgagtcaccaagtcggtggtgatgacaattccctttaatcctaatgccccagagacagaggcagatggatctctaagttggaggctaaagaacaagttccaggacagtcagggctacacagagaaaccctgtcaggaaagtacaaaacaaaaccaagtcacctaggagacagagggtatggaagtcagctctcaaggcaagggggtggggggtggggggtggggtaggctgtcttcagaaactgaggggtggggggtgggggtggggattggttggggaagcaaagtgaacactgaacattttggcttcctcctccctcggaattctggagagttcctgagatgctcagaagcaaggttgccatggtgagatttaactatgtatgtgaaactcactcttgccccatggacaaagatggagggtgtgagggacaccccctcccacaacccccagaggacagaaattcacacaggtgtcttcatgaaagccaaaggaaaacccctcagtctggtgtgactgagctcgtgaaggtgtgggagagcacagacgggagcaggtcaggggggcgccctggcagtggccggtgcttgg

SEQ ID NO: 25407 - DNA, 2755 bp, Mus musculus
ctctagtctaggcactttggaagcgttttctcttttacttcttacccaaagtggatactttctagcttaccttcattttatggatgtgaaggtatttagaaaatggatggatggtgcagggaggctgggtagacttgttgaggaccgcaggtccctcttgacttcttcttcagctcctttacacacagagacagcctgggcgaccactgtattcccagtggttgggtccaggcattcactaactgtagtgcaaggttgtcactgaccccatctgaccatctgctcttcctctttctctgcagaagctgctgatgggagctctaccctgggagggggcgctggcaccatgggtctgagcgctcgatacggaccccagtttaccctgcagcacgtgcctgactaccgccagaacgtgtacatccctggcagcaatgccacgctgaccaatgccgctggcaaacgagatggcaaggctccagcaggtggtaatggcaacaagaagaaatcgggcaagaaagagaagaagtaatatggaggccaggccttgaaccacaaggcagcctccctccccagccagtccagctcgtccttacttgtacccaggcctcagaatttcagggctcaccccaggatactggtaggagccagggccatgctccccgttgggaaacagaaacacgtgcccaagccaacaccccctctctataccctagggagttgaatatgcaaagagagttctgctgggacccccctattcaatcagtgattgtacccacatgggtagcagggtttgtgtgtgtggacatacacacacacacacacacacacacacacaaaccatgccacactcccttagttacagctgaactcctccatcttccaacccaggcaggcttatccatctcctgccgccctctccccaccccacccactccttcagtccctctctttgagcaaggtagctgggctgttggggtgaccggtgagctaagccggctcctagttctgaacggtagggagagtattacaatcttttggcctctccttcagttcagctttcccccaaagcatggtttggtaccagtcttctcttttccttccagagcctgagaccaatgcttaagttttgggggaacaggcaccctccctctggtactgatgatgcttgctggattttgggaaggcattttgctactaagcctcttttcaatgcctggggacaactagtcttttgtttttcattgtttgatgttcccactgcatgctgtgacttccctacacctcaaagaagagactcctttgcatgtctggagacagtagggggtggtaaactaaagggaagttgagagtgtatactgctgggagtggggcagtggacaaaacagcctgttaatagggtcttgcaaggggctctgtatgtacccaggggactggctcaatcctcacattctagccatagacaaacaccaggccagacccctccattctggttcagcctgggcagcttgggctgagccaccaggaccaatggatttaagctgacatttcagtccaagacgacgacttctaagtgagtttaagaccagagaggaaagaggggcctctgtgggtgctgggtactccagaggtgcccttggtgggaggaccagtggtcttagcaggaaggggggcccagcaaggtcattcttggaccctgggtctagtccagtagctagaaaaagggaccaagtggccataaagtcccagccaatgatggggcttttccagtgggcccctgtagacctcaagcccctggcctccaccttaccaggtgccatttcttctcagaaggccactgcccaggcccccaggccgcccccttgtggccagagaacggttaaagccccccagtgcctccttgtgcatagaacttcctctgccctagcccttacagtagtgtagaagatccccctcccccgctggtgtagaatagccaatagtatagtgtggtgtgcttttacgtgatggcgagtgggcagcgggcggtgggctgtacacagccgtctgtcctttgaatctcaatctgcctgcgcggcccgtgctgtgttttgtgctgtgtccacacgctgcggcgacccctccctgtactgacttctctataaaaagcttctcttcgcatagtcacgtagctcctgcccatcccccttccgatatctctcgcaagttttatactctaatatttatatggcttttttcttcgaaaattaaaaataaaaaaatggtttcttctgaaagtgtgaccgcgtctgtttaagagatggaacacagaacatgtgggtggagtcgagttgcttgtcttaaataatagactcaaagggtcatagttgtttgtgtcttggctttgtctcgatctatttttgaattgcgtgtgcttgtgcagtgtgcatctgactgtccaatatggagtgcatgtttcagattccctggcgtctctaatagtatgtgatgaactgtaatggtgcttgtggatcagtatgcgctggcggtatcgctggagagtccattgtgggggtggggagcttgaatgcgtgcgcaactgagtgcagatttattctcagggctgtctccaggcagaaaaaggagaccctgcatggaagggagggggcgggggagcaggagcgtgagtgggggtgggagggcgctggggagtttttcctagttcccgccccttccccactagctacctcccttcagctataggagggggctgatccag

SEQ ID NO: 25408 - DNA, 2755 bp, Mus musculus; identical to SEQ ID NO: 25407

SEQ ID NO: 25409 - DNA, 2755 bp, Mus musculus; identical to SEQ ID NO: 25407

SEQ ID NO: 25410 - DNA, 2755 bp, Mus musculus; identical to SEQ ID NO: 25407

SEQ ID NO: 25411 - DNA, 2755 bp, Mus musculus; identical to SEQ ID NO: 25407

SEQ ID NO: 25412 - DNA, 2755 bp, Mus musculus; identical to SEQ ID NO: 25407

SEQ ID NO: 25413 - DNA, 2755 bp, Mus musculus; identical to SEQ ID NO: 25407

SEQ ID NO: 25414 - DNA, 2755 bp, Mus musculus; identical to SEQ ID NO: 25407

SEQ ID NO: 25415 - DNA, 2755 bp, Mus musculus; identical to SEQ ID NO: 25407

SEQ ID NO: 25416 - DNA, 2755 bp, Mus musculus; identical to SEQ ID NO: 25407

SEQ ID NO: 25417 - DNA, 2755 bp, Mus musculus; identical to SEQ ID NO: 25407

SEQ ID NO: 25418 - DNA, 2755 bp, Mus musculus; identical to SEQ ID NO: 25407

SEQ ID NO: 25419 - DNA, 2755 bp, Mus musculus; identical to SEQ ID NO: 25407

SEQ ID NO: 25420 - DNA, 2755 bp, Mus musculus; identical to SEQ ID NO: 25407

SEQ ID NO: 25421 - DNA, 2755 bp, Mus musculus; identical to SEQ ID NO: 25407

SEQ ID NO: 25422 - DNA, 2755 bp, Mus musculus; identical to SEQ ID NO: 25407

SEQ ID NO: 25423 - DNA, 2755 bp, Mus musculus; identical to SEQ ID NO: 25407

SEQ ID NO: 25424 - DNA, 2755 bp, Mus musculus; identical to SEQ ID NO: 25407

SEQ ID NO: 25425 - DNA, 2755 bp, Mus musculus; identical to SEQ ID NO: 25407

SEQ ID NO: 25426 - DNA, 2755 bp, Mus musculus; identical to SEQ ID NO: 25407

SEQ ID NO: 25427 - DNA, 2755 bp, Mus musculus; identical to SEQ ID NO: 25407

SEQ ID NO: 25428 - DNA, 2755 bp, Mus musculus; identical to SEQ ID NO: 25407

SEQ ID NO: 25429 - DNA, 2755 bp, Mus musculus; identical to SEQ ID NO: 25407

SEQ ID NO: 25430 - DNA, 2247 bp, Mus musculus
gctgaccaaggatgatgccatggctcctggtcctgttaaggtacccaagaaaagtgaaggagtccccacaatcctggaagaagccaaggagctggttggccgtgcaagctaagctgggctttatggccattgctgctcctaggcgaagcccagactgtcgacctgcagcatgggcctaaatggtcaaggagatagtggccactccaccacctgaccctgtctttctgtctggcctgctgctctctgaacaccacatacagcttcagctgcctggaggccaaaaggaaggggcagtgtaggagtggcctgagcccagcccagccagccctggctgttgtattaccaaagcagggtccgtgtttgctgccttaaccctgtctcctctatgttacccagaggtcctggtctcagacagaacccagcctgctttctcagccccactctctagtgggccttccctaggtcaatcttgctgcatttgtgcttttcttttgtggtttctctggccctgagaatagcatgggacttgtgaacctttgggctaggtcttttcactgctgtcacctctgcttttcctcctggcaattatttattactagtgctgtggcattgggagctgcttctgcaaaagcaggaagcaaatcccacccttaccccaccttcctgggaaaggtctcccgggcaaagggtctcaaccactctccccattcgttccactgtggcccaggtctgagccataggcaggtagctagggcatagtgacagcgtggggtctgccccctgcccgctgccatgctttatgcccttgcctccctggtccctctgcaccagccccctcacctccaccctgcaactgagccctgctcccccatgccttccccagagctttggtgcatccatttggagtgtgggctgtagtgtgaccgtcccaacacctcaccccctccatccaagggattgggaggtggagcctcctggctgagaaattgttttgcaaatggatctatttttatatgaaaaaaaattttttaagaaaaataactttggtccccttccccctccataataaaagaggctttgatggtagggtcaagcattcctggggtcggtcagtcctgaacatggcctaaatattgatcccattcctcaagactaaatcgtgaggccaaggcagacccttccctagtcagttctgaggcaagagagatttctctgggtgggctgggccacaccatagggtagcaagatgctgtgttttcatgaatgtattaaattatcaagccaaacgtgcagatgctgggcggacgtggagaagtggcccagggtgcctgctccccatatgaacagtgagcccgactgggtggtccacactgcaggaagcacaggttctctggctgagggtcactgtgtggcctcctccgaggcccctttgagcttcccctccaaggcgacagagaaggaaggacactgtccgggcttgacactgaattggagttgccagagcatgggggagttagggcacacaagggccagtacagggggccttgtggccagggatgattgattgggatgctagaacttgtgtccaaaggaacagtggaagctcctgggctacgtcctgggaagactgaagtaggggttggctcttccctgagctgccaccttgctcgctgacatctggggctttgacccttttctttttttaatcacttttgctaaaatgcatttaattaaaaaaatttttaagtagaggggataaaatgcaaaccccttgcctcttgggcttttgggatgtcatcacctccagtttgatggatttgtttccaactgtcaataaagcattgaaacagaatctccctctagcctcctttgtaaaattctgcactggttcttttcacacgagtggtctgggcttctctttggtgctttcccactctgttgttgacctgtcaagtcaggcagaagctaaccagtccagcagtggagcttgggcatggctcagctccatggtggtttctgtgagtggcagcccccgtacagggctgttttcctcttttcttccagctgcttccattgtgacccttaggcttggggtcctaattttagctcacctccaacttcccactcccctagctcctccagatgccacagttttctggccagtaccaatgtcctccatccccaccgagttaaaggtgcttaaccctggcactggaatcctgagcctgcccaacctggatcagaagt

SEQ ID NO: 25431 - DNA, 1170 bp, Mus musculus
cctgtttctttagtttttgttgacctgggtctgtttctttttggtttttgttgttggtttgtttcgttggttggttgggttttcaaaacaggatttctctgtgtagctctgtctgtcctggaattctctctgttaaccacattggccctgagcattcagagatctacctgcctctgctgggatttaaaggtgtgtgccatcaccacccccagcatgggcctgcttcttggtcttggtcctttactccctggctgcacagctttgtgaaggatgcacaggaacagtataacaaactacggatgatgcactccaacatggagaccctctataaggagctaggtgactacttcgtctttgaccctaagaagttgtctgtagaggaattctttatggatctgcacaactttaggaatatgtttttggtgagcaaggggaaactgctaatttttcgtggggttcctaatgatccctggtaggtttacgtggtttcacatgtcctccatctggtttcccctccccttctccagcaagcagtcaaggaaaaccagaagcgccgggaaacagaagaaaagatgcggagagcaaaattagccaaggagaaggcagaaaaagagcgactggagaagcagcagaagcgcgagcagctcatcgacatgaacgcaggtgactgtgggaagggttagcgctggagggaaggctcaagcgctctctgtctgggttctcagggctaaatggagcttgtgacaaatggcttttggcagcctctgcctccaaactctgggtgctggattttatcgtggcttccttccctctcctttgctgggtcgtggattgtgtcttatcacccttgtgatctgagaattgctgccacactttacacttcacttctgcctgtcaaaacaaaaacaaaaaacattccctgacctgttttcattcctgctgctaaatattttgggtttccaaaatgtttccctgactcctcccatcttgtagtagctctcctttccccctatttcaccaatatgccattcctattaccgcatagaatgttgaatgcacacttgagatcataaatgggttgagcttctagaagggggtgaaaagctggccactctttctccagcagaagcatgtctttgttggagcatatggtctcaattactggccctc

SEQ ID NO: 25432 - DNA, 1149 bp, Mus musculus
tgaaaaattgagatgcggtgggtagctggagagatgagtcagcagttaagtgctctggctgttcttcaaggtgacctgggatggattcccagttcccacgtggcagctcacaactgtctgtaactccagctccagaggatctgacactattttctagcttccaggcagtgcacacacatggtacacagacagacgtgtaggcaaaatgctggtacacatacagtaaaaataaataatttttaaaaattaagacagaccatatcagcttacaatacctaaaatatttactttggttcttcacagagagttagctgctccctgtaggtagattctgtttaaggaggaaacgtattactgaccattgaagaaatgaaaaggagatgttggagcacttacttatcgtagagtggctaatgagattagctttgaaggagtacagttaaaacagaggatgggatggccatcctgccaggacagctgtgactcagtaatgtgggaggtggctttatccctaaccatggttttctaattcccctccctagccaagaaggatcaagaaggtggagaagaaaagaaatctgttcaaaagaagaaagtaaaagagctgaaagtgctggattcaaagacagcgcagaatctctgtgagttattctcgtgaccccagtggctagcactgtgcagctgttcctatagggacttgtgtccctgagtctaagatcccttgtgtgaaactcctcctgttaaattcctgcttgactacttcagtagcacagcagggtagcaagttcccgcttgacgtcgaggaagcaggggaagaggtcggggtgtgtctagtttagcgctaagacaaggcggtctcagattttaaccttggagtcccctggtttgttttattttactgaggggtaggggcggtgggtgttgacacgtgactttgctatggagcttagctgcccttgaactggtctcctcttgctggggttgggcaccaccatgcctggcagacttctttgatagttctactcctgtgtcagcaggaagtctagtagcacagggttccagcctcagtctcggggcacaaccttctgctttctagtaagaaatgagctgctgttgtggcttcagttaaaactacaattatgggctggt

SEQ ID NO: 25433 - DNA, 1190 bp, Mus musculus
aatattataaacgtatatgaaataaaaataacaattcactttccccctgaaattctgctttgaaaaaacccattgctaatggcttagagttcatatatagtttttttctaagcataaacattctatttccttgattcttagaaatcttgcagtcttagagctgagatgatattatagtttatgcccataaaccatttcatatatagaacaggtttttgttttcttggaagtgttggtttaggaaaagtaaaataccgcttttttttcaaatacccctcactaccccacctcccgtacccgctgtaggtttttaaaggtaaaattgttttgtagtcttagactgacctcaaactcatagaccaggttagacagatctgattctcttgtctcacccttccgagtcctgaaatgtcacgtgtgtgccaccactccggcttcagctaggttatttttatctaacaggttttgaacgtcattcttttttattggcacttaataggtttaccttattcttcgtggctctgtaaaatattatacgtaggtgtataaaataccacatgctgaatctgccttctgtttcacttatttaacatttctgcaatttctagactttaggtacattgaagcaaattctgaccttgctgtggatgataagaatttttaccattaccaatggtgtcataataaacatttctatgcatatttctgttatatttatgcatttatgttgaatagctttctagaagtggaccgcatgtcatgtgcattggatattgatggtgctattaatatcagatggtccttaaaaagtcagagtaacttatatttcatagctcaaagattttaactttgtattcatgagtaggagtctaggaatgagttttaggaaattattctctcaaaagatagtcagttgcttttatcagattctggtatcagttgggggttaagaaaataatttgagaaatctgaagcactggtgatgtcttgtttcctagttggtttgttccctgtcttatctctcatgtctgtgtcagtgcacctgggcaattctctttctgttttcttgggcaggaatgaacgagttctagaggcaatgacagagagagctgaaatggatgaggtcgaacgcttccagccacttctggacggattaaaaagtgggacctctattgccctcaaagtatgta

SEQ ID NO: 25434 - DNA, 1197 bp, Mus musculus
caatggttttctttttagaagggttttaaatttttaaatttttgttttttacttttggagatagggtttttctgtgtagctgtggctgtcctggaactcactatgtagaccaggctggccttgaattccccgagatctgcctgcttctgcctcttgaatgctaggattaaaggtgtgccaccataccagcctaaagaggcttgaaaccttaatacagcattgctgtctcttacacattattatagatagggataaagttggtgggctgtgtagttctaacaaaaatgatttcttcctttcttatcataaaaaccttggctgtgtaaactaaaagtactaagcaggtgcaagaaggtaaaagattggctctttggtgtttggcttgttaagttgcagatcgtgttgtgttaacatgtggattgcgctaatgcttctttctctttcttagctggagagatttaccagcatgaggattaagaaggagaaagaaaagcccaattctgctcatagaaactcctctgcatcgtacggagatgaccccactgctcagtcattgcaggacatctcagacgagcaagttcttgtcctctttgagcagatgctggtaagccaccgtccaagctctgaggcctctttcccagcacgtgtttatgggcatttgtctgtcggcctgtggtggttgtttttaagtgtgtggtctcctaagttgatgtttactattaaaaaaaaaaaaatctaggcccaatgaaataatggttaaatatgcaagtacaagtccacaagattggaatctgtgaattaaacttgggaatatctgattactgactaccttgttaatgtcttcctggcagtatctagccacaaacacgccgtatgagtggaccaagccctgaggtagtgtggtgaccattttgaggctaagttagagaagaagtagtagggaagcattgacattgagctttgtgcgaagaatacactggggagtgcaataggcctgaggtctctgtttcctggggaaatggaaagagagtgctgaagccagcttactaatagacggcctctgaggattgtatctgaagtctgtgtagttgtgaggtgtatgcatgcttgtgacttaatttgcggtcgttagtgagaacagggacactttgggtggacaccctgacatagccagaatgagtgattagggctcagagt

SEQ ID NO: 25435 - DNA, 1224 bp, Mus musculus
gtccctgccagcaagaggagaggaactggctttggagaagactcccatagaaaagtggctctgaggagggtgctgggaggagtctggaacttgaagagtgggtttctaatctcttgttccttgttttacaggccagaagcacccaatgagttctatgatggcgaccatgacaacgacaaggaaagtgatgtggagatttagagcagcatggatgctgtgtccccaagagttccttgtcacctctgtggtgggaaggaaagtatggtttccccaggtctgaactgggtacccccagggtgtttactaactctggtgaagggtttggaaaccatatgtggttctagaattaactcccctttccctcaaactctcacggcctgatgattgtccctctcagggatgagacatggacaggtctctggaacgttatgggtaatgagccccagcaactgtcctcagcccctcttcccctcatttgttccttctgtccttccaacacagagactgttagagatgaaagtttggacggtactaaagtcacctctgacttccttctgggttcccctactacagttcttgcttccatgcaaggtgaacctgaggggaggaaggcgtggctctctgaaaccttaactgcagatgaagtacagtggcaaggaggagagggtgtgaagctctaactggctttatgtccattttactgttttggatctaataaaccaattggttttttttttttttttgtacctttctgggattttaattcttgctagttaccgatgtatgatgtgaaaaggaaacagatgatgatgtgtataataaaattgttaccattcactcagtactttattagttaggccatgtgtgtattcaccatggattagtttcctcaaatggggaattaatgggacatttctgctgaagagttagattactgacctgagaagggtaaagatgtcttcaggtatgtgagcatgggtgtttgagatgaggatgttagctggtaaagatgtcctgagataaaacccagtaagtgcttggctctgttggatgtaagcaactgctcacagactgactgaggaacaagctggatcctgtgtgtaccatgcacagaccccttcctggaggagtctccagtcgggcatggtaactgtgggtgttgtcagtggtacaagaaaggagtgacaggtagctcactgtcttttcactcagcattggaattct

SEQ ID NO: 25436 - DNA, 1103 bp, Mus musculus
cagggccagggcttgctcaaggcaagccatcaagacttgcatggaagccaaatgttttgtctacttccctgactgcagtacctggcaggcctgactcaaccccagaggtacatatctctctgaggttagaaggatgtcaaccccgtgcctgtggtgatccggagaaagaaagggcagggtagataggggaacctgcctgggattgtgctttccctagatggtccttgatcctggaacggaaatgcaccccggagccacttagcttctgcctcctccctcccaggccttcagggttctctccagcttgcctcactctgaaagatggacgatggtcatcctaagagagccaacatcaagagctgtggttttcaaccttcctaatgctcagtgcgaccctttaataacagttaacatgagaatggtatggtgaccctcctcccaaccagaaaattattcttgttatttcataacggtaatcttgctactcttatgaatcgtaaggtagatatctatgttttccaatggtgttagaccccctgtgaaagggaccattcatctccccaaaggtcgcgtcccacagtttgagagccgcagagctagaataagcttagagtcaaaaaaggaggaaacagtctgtctccttggaaaccgaatgaggctaggctaagtgtttgcataaagcgagagggcagtgctcgctagtgacctctagtgggggagtatcagaagagaactgcttttctaggggtcttaggaattactgcgctatgctgtcttaggagagatgggtgcagaggatgctagctagctagctcccacagttcagtttagtagctgaggaaacggggacctgagagagtttcgctcttgctgctagggagaggctaatctggaatggaaactcatcctgctaagtggatgttttgtggtccttcccaaggttccctatcaacctccacacacaggcgtgactgtctccgtggggttgaggccctgactccatgccctagtctctcccacactccccaacactccatctctcctagctcctccagtctcctcacgctccttgcttcctccccttcctctttggaaagcagcca

SEQ ID NO: 25437 - DNA, 1183 bp, Mus musculus
gccctggcagtactagtgcgctactgccggcagcgggaggccaagagcggctaccaggctggtaagaaggagactaaggacctgtatgcccccaagcctagcggcaaagctgctaagggaagcaagagcaaagggaagaaaagcaagtcaccgaaacctgtgaagccagtggaggatgaagatgacaccgggctgcagaagtccctcaagttcaacctaatgagcgatgcccctggagacagtccccgaatccacctgcccctcaactacccaccaggcagccccgacttgggccgccattaccgctccaactccccactgccttctatccagctgcaaccccagtcaccctcggcctccaagaagcaccaggtggtgcaggacctgccgcctgcaaacacatttgtgggcactggggacaccacgtccacgggctccgagcagtactccgactacagctatcgcaccaacccccccaaataccccagcaagcaggtaggccagccctttcggcttagcacgccccagcccccaccccacccctaccacggggccatctggaccgaggtgtgggaatgatagagcaggtgtgtcttacccgccatgatcgactagatcatgagggagcctcctgaggtaactgtgggaggtgggaacactgagctcagggtactgaggcctcaactaagaaccctgctgccttgcccaatatggaggcttaggctgagtagaaactgatagggaggcttcctcatgtctcccctccccatgagggagaagcatgtgccttatcagatctcaggatgctgaactagctactgggtctttcaggtggagctaatggacaggtaaataggtttggagacagaagggcacaggcggatgtgggagaagactactccaaacctgggtctctattggagaccagctatataggtgcttctttggagaggacacggaagacctagaatctgggtggggactctactggggaggggggcacctccccacttgtgccttctatatgtactgtgtattaacttcttcctcatccccaggccctgggggctggccccacatcccctaccccagccctattcatgtggccttataataaagttctctatttttggagttttggtttcttattttctcggaactgagagaagcagcgagagagact

SEQ ID NO: 25438 - DNA, 1143 bp, Mus musculus
aagggtcttgctttatttatcttgtttaatctttctggggtgttgttaccctggaatcccccattaccctaaagatttctgtctatacccttgtttaagaactacttcaagggttagaggggcaggctcagtggtagagggcttgtctagaatggtgaaagtcttgggttccacctccagcaaataactgcacagacaatgtccgtgatttcgggggctctcaggataagatttcctcaaacactggagggaagattgtggatgccctcttcgatccctccctgatggtgtgactgtcccttgtccccacagctcttccccgcctgctgggacctggcttccgtgggataacgcccaaacccaccagttcagatgggtctcagacaacctcccctaccctgccgctcactaggctcagctttgacaggtaagagactgacattctgtcacatgtggcctcctgttcccaacgtgtacagaacttaatagtctctaattgcaccatctagatcaggttcccacggttcaaagaggagcagggacccaaagtgctgtggatggaaagatgcctttcactggatgtctgctcatgtctccccaaacacactgcgggacgccatctcatgggtaaggcttccccaggcctgaacagagtgagcttgcatgggtgagcatcctagtctagaaacaaggctaacatatattcatatggtgaggcctgtggcccccagcacgttcatggagacattgctgcccctctagcctctgccatgtgtttattcttctccatttgacagacatttatttaacacttctgagtagagaacaaggaaaataataattcttaccttcatggaggttagcacaaatgataataaatatctgctagatagcatgacttatcaaccttaactgttatgcatacattatcttgtttaatattgacagaagtcttgcaagggagatttaaccttcattccagacacaaggacactcaggctttggaatgttagcaatatacctgaggccacatggctcttaagtggtagaaccagacacgttcaagctgtaccacgtagtcagcgagtatatcttgtagaatcacctgattcagagtctaaggcataatagctgctcaataaa

SEQ ID NO: 25439 - DNA, 1145 bp, Mus musculus
tattataggaagtacagttaatccaaaagaggaacaggagggtgtgggggaagagaacacaggtaactgccacatgttcctacccagatacaagtgcagtgagagcttgcaggctaggatgcttctgtgccgtgttccctttctaatcacactccagaccacctccaaggaagggtaggctccttaagagaaacagtccccttagaaccaggttccttctgacatatgagctgcagagtgattctaaaagcttaaacagcaacctggctctgtgtcctgtggcagcctcttgtcttcatgctacttctagattctgattttgatttactctggctcctgttcctggatagttgaacaatttggtgagaatgttggtactgttttgtaagtaagaaagaaatttcaggaagttatgctaaaataagcttcagcaggtcaggagctggtctatcatcatcttttcaaattcagcatcctcatgtgctctctcccagctctctgctctctgcaagcacctagacaacctgtgggaagaacaccgaggcagagtggtgctgtttgcctggatgcagtttcttaaggaggagaccctcacctacctgaatattgtctctccttttgagctcaagatggggtctcagaaaaaagttcagagaagggcaacagcccaggcctcttccagcacagagcttggtgtgggaggagctgctgcggcggatgtagaccaagaagaaactgtggatgagagagctgtacaggatgtagagtcattgtcaagtctgatccaggagatcttggacttcaatcaagctcggcagacgaagtgcttcaatagtaaactgttcttgtgcagcatctgtttctgtgagaagctgggtagtgattgcatgtacttcttggagtgcaagcatgtatactgcaaagcctgtctgaaggattactttgaaatccagatcaaagatggtcaagttaaatgcctcaactgtccagagccacagtgcccttcagtggcgactcctggtcaggtactgtcctcttgtccatgtcatgtgccctccaggttcttttcacaaagggaatcatctcagaaatgtttcttttgtttcctttctgtatatcccagactggactaaactcatgatcct

SEQ ID NO: 25440 - DNA, 1764 bp, Mus musculus
atgaaattgaggaggacgacgatgatgaagacgacgacgacgactagttcattccttctgctcacaatatagaagtggaatggtttgccctgatcttctgtcaagtacacaaagagatcttgcaggatatttaggggccgtctattcactcttccagtgtagaaggaagaacagggttatattttcctttggttctactgattaaggcacatacattttccatgtaacataatctgataaaattatatgccaaaggatcagaaatgaaaactataggagattaaatattataatatgcccaaactgtgaatagttaaaaagtaaatatttattttctcccccaagctttaggttagggagagggtcaagagtttagcttttagaccatgtccaagcagcctcacgttgttggagcactctcagttccatccctcagctggggacagtcacagccccagccacactgtcctgggagcctgatccattctctgtacactgctcactcccatccgtgctgtggaggagcctgtgctctgtaactgaccagttgtcccagtgtcgttctgttctagtgcttgccagaatagaagtctatagtacattaaaagtatttttagtgccacaatccttgtgggtcacttgatatttatgaatagtgtattgaatccactgttttagagccaaatgtagaatttaggattctggctcagaattcctccagatacagagtcagagctgtgtctgccccattgtgttctcaactttctccctttgcctcccacctcttgtgggcaaggacagttttaatgttgatcccagcagtgtgtgtctttatttcctcactagagtaggaaaaagcccagtgtattcctcatgaatgctctctaaacctgtgaagagcatcatggctctaccctgaccttccgaaccctcgggtcctctctagtcacctacagcaactgggcttccttccctcccttcccctcccctcgtaaacagcagtgtctcgagtgataatagtagcttgatagctggattcctaattctgagttttattggctttttgaaaaactgtcttcttcatgattcggtaagtggcttggtagttacttggtggatgttttgaagggacagtaattcacctgtagcttgtgaacatgtgttttctactttgacactgaaaattaaggaattgcttaactgtcagctcagactgcttctggattgtcaatgaggatgcttaatctgaacaataaagtaatttaagatcatcctgtaattgaagtagacacggtgtcctgttgatcctgtcaccagagcactgactgaaattagaactgacttgtgtttctgtctgttctgctggttgggctgttttgttgttgggtttccttctagagatcgacccaagacctcaggtgtgctgagtctgagtctgccactaagtgacacacacgcagacatttaaagagaaaagagagagtcctcctttcttacacagggcacatattttgaacatgctcatttcacgggctttcatccacacattttatatcatcactgtagttaaaaaaaagataagtgggccgggcggtggtgacacacccctgtaatcccagcactcgggaggcagaggcaggcagatttctgagttcaaggccagcctggtctacagagtgagttccaggacagccagggctacacagagaaaccctgtctggaaaaaacaaaacaaacaaacacaaaaagtggaaggtaagaaaa

SEQ ID NO: 25441 - DNA, 1163 bp, Mus musculus
ctaacacactttttgataaatgatagcgatcattgtagctattgtgcagtttgttggtgaaatcttgaaagtgagacaaagcctttactgtcatgaaggaaacagcttggtcgtgcgtggctgttagcaagcccacagtggtgagcctgaggcttagttattcacctgatgatctttgtttcctcttttggtacaaaatcctcaccctcaattttaacatagaccattgggttttttagattattatttttgaggcagctaattttgagatggtataagtttagtagaattcgggggggggggttgtattgctgtgtgtgtatgactgttttgcctgcatgtacgtctgtgtgcctgatacctatggaggacagaagatgctggcagaccccctagaagtgcagttagagatttattgtgagctcccatgttggtgctagggattgaagcacaagtgttcttgtctgcagagccatctctccagcctcagtaaatttctttgccctgtgacataaatgattcctggaagactgctgtgtcgtggaaatgcctgatggaatgaagaggtttatctcaggctgcagaggtggctcagcgggtaagaggctgctcttccagaggtcctgagttcaattctcagcaaccacatggtggctcacaaccatctgtaatggggatttgatgccttcttctggtatgtctgaagacagctacagtgtactcacatacatgaaataaatttaaaaagaaaaagaaaaaagaggtttatccctacctcaggatcaaggcctgtttgacataaggtctgaaacttgccataaattgacatgagttttgggagaccttttgagtttggagaggctctgactcctgatttttttttttttttaactgtataatgcttgtgggtctagggctgattaaagaagataactttccaaataacttttttcttgaaatgtgggccatcactttttgtgactttggcctgcctctgtcaactgagatgcatattgtttaatctatttataaaaagaaacttcattttagattcacggaaaagctgcagagatgatggtgtacgcttataatctcagtgctggggaggcgagattgggagagcaagagttcaaggccagcagtagctacagagtgagggagtt

SEQ ID NO: 25442 - DNA, 1572 bp, Mus musculus
tggttgctgggatttgaacttaggacctttggaagggcagtcagtgctcttacccgctgaggcatctcgccagcccatatttcctgttttttaagacagggtttctctgtgtagccctggctgtcctggaactcactctgtagaccagctggtcttgaactcggggatctgcccaactctgcctcccaaatggtgggattaaaggcgtgcaccaccacacttagctcaaaaagattaatctttactccattcccatagtggcagggttgacagagggggaactctgtcactccccagaaactaacagtgtttagtgtttagagatcacagagatcgagggctgctctgagccactgtgttcctcttgataactgtgcagttttgcctctgcctactttgaccactgcttgctttacatttgttgcaggtttaatgcttgttcataacaagctggtggaccccctgtacagtatcaaggagaaggaaattcagaaaagccaatctgcgaagaagccatacagtgactagcctgtgccaggacgtggtattcagtacctcagagggataggcaggtctttccagaaagtctctgtaggagagagagtagaattacttttcagtccactctggctgctgcagatctgtggcttggtagatacatgttaaggagtttggctatggagaacattgttgattataattttcccctttttttttcagtactgggggctgaacctggggccttgtacatgccaaggaggtgccttgctaactgagctatgtccccaactttctgccccttttcataatggttttgtaaccatccgaagtctccatcactgactgtaattatattcttctgcccctgtgcacatgggcagcacacgcctgtcgagaactcctgtctgtatgtgtgctttttctagagttggcagggattagggcttgtgcactttggacataacctttctggagacttgagagcccctcttctgccagccttcccactgagaattttcattttaaagaatacacttccagaacttgaattatgcacaaggaagcagcccttcctgccagaaccaagaacctgggggagaagcctgtcccttgttcccattgtgtggattgtctttcctgttgtcagtagctagcctttctgtaaacaggccttctgggcatgtggggctaagatggctttcacaggtaaactcaaagcttccaaaggccagccttgtcttgttctctctcaagattccaacaagagaaaagtggaaaggcctcctgtctgagctctgttttcctcaacagattcttacacactccctagtaaggagatccgcgtgggtcacagacacgctatgatttcagtgtttttacccaaggtggggagctgacatctgcacatgcgctgtgctctgtggcctcctcagagctgagtgccaagattatacatgctactgctctctcctcgcttaactcaccccagcactcccaccttcgggtttatatcctctgtcctcagcatcagaactaaacccttcacccccctgtccttcaggctcccttccc

SEQ ID NO: 25443 - DNA, 1146 bp, Mus musculus
cctacgtgtttttttccttaactatttaaattatcaggtttagtggtcacttaggagtctgggacaggaagattctaagttcaagaatagcgtggtcaaagtaaaaagtgaaaagagggctggagatacagttcagtggtatagttcttgcctacagtgcacaaggccctgagtttgattcccagtgccacagaagtaaatgcctgttaaattaatagtgatccaaaacaattaagaataaaggtgtaaagtgaggttttattttattttatatttacttgtttgtttgataatttataaacagagtcactgtgtagtcttggctggattggaacttgctctgtagactaggctgcccttgaactcagagatccatgtgcctttgcctcctgagtgctaggattaaaggtgtggtgaatttggcttttaaatatacactttaaaattatcctgagtgttacattcatttataaatatcttttgcttcagatagattttgttatttccttttttgcagcatattttgactacaaagatgaatctggatttccaaagcccccatcgtataatgtggctacaacactgcccagttatgacgaggctgagagaaccaagactgaagctacgatccctttggttcctggaagagtaagcactggctttatctgtgttgttttgggctgcttagttggaattcacttattttcattatcccactattaagttattagaattgtcttgattactgctgattttaagcatatgtattttcttttggaataataagcattttttcccctgaatatgatgcactaggcagaaaatcactgacctgttcattttcctgtatttcaaaggatatttctactaccacctctctttcaggcctccaggggtaggtggaaaggactaaggaagtacattggttatgccttgatttgtatacactttggtattagctgttagggatgcctatgaagagaggaaatacaaatgacatcattgaattaaactcatgagacctagcgtcatcccagtaaacattgtacctcaaacattccagatcatgtaatttgtaagtttagattcctcccagcttgctggacatggaagctagcagatttaagattgatgcagataggagtt

SEQ ID NO: 25444 - DNA, 1732 bp, Mus musculus
atccaacgtcctcttacggtctctgaagttactgtacatgcagtgcacagacatacatgcagataaaacacccatagacataaaataaatctttagagagagcatgccagttatttacagttggagaaggggcttgatgttaagaactgaaaattgactttattggctactatgacgtccatgtataataatcttcaaattaggttgaaatgccaaatgggtgtctccgagcctctcttctatgactgtaccttgcttttagccaacctaacaggctaactagagtttgactgttcagtgtccttctctggcagatgttttctggcaaaggcttcctgcactgatgaagtcccctgagaagcgagagcacctgcaggaagtgaatcaccaccagaatggaggaacagtcacctgctttaaaaaataaagtactgttgaaaaagatcatttctctctatttgttcctaggtgtaaaatgttaatagttaatgcagaattctgtaatcatcgaatcattagtggttaatgtttgaaaaagctcttgcaatcaagtctgtgatgtattattaataatgccttatatattgtttgtagtcattttaaatagcatgagccatgtccctgtagtcagtagggggcaatcttgctttattcatcctccatctcaaagaagatttgaaattacagattagtgtaagctatgtatacggctggctgtttgaaaggggttttctcaaaagtcaaaactttggttatgacagcatttctgcacatagtccatatttcctgttcaaattaatctagaaatatgtttaattgtactgtgtgtgaacacctggaagcaaaaccatagtgcaaagttcattgtagtgttaccaaaaaatgttctcaattagtaaataagcattaatttttcatagtctacattcagaaattaccttttcattctgtagttctgtgtagttcatataaaatggaaagggcaaagacaagattcagattaaatattaaatattattctggaagctggctagactctcagagggtcaggaacacagaattagtttggaacttttgagaggatccctagcattctgtactccttgctttcacaactgttataatgtagaatgatgtgcttgctgcccaagtgctagttcactttggttgctatattaaactgtaaatacaatagaacattaataaatgtctcttgtgtagcaccttttactgtagattagtgtttcatttgggggcttacattggctgattatgaaaacattttctaatcttacacagagtatatcctaaaaattaaaactttatgtgtcttaggggtttattgctgtgataacacaccatgaccaagccaggtctagtggtgcacacctttaatcccagcactcacaagacagaggcaggtgaatctttgagttaaggccagccagagctacatagagaaaccttgtctacacacacacacacacacacacacacacacacacaacccaaaacaccacacacacacacacacacacacacacacacacacaacccaaaacaccctaccataatcaaaagcagcttgtaaagggtttctatctgtttagagctccacaacacagtccatcacggagggaagtgcaggtaggaatactcaaggccggctgcagcagagggcactactgctgcttgtggttggtttctcgtggcttgctatcttacagttccc

SEQ ID NO: 25445 - DNA, 1211 bp, Mus musculus
tcttggctagcatttgcagcttttgcttggcttgagttaacatcacttccaaagtgccagctggttcccacttctagacctggggtggctgtcagttgtgcctggagccaaggatggcttccgggatctttcttaaggtgcctgggctacttggtaccattgtagggaaaggctggttctcctgtaagcactctgggggctgagtttaggctagcaacatcttccaaggtaccatcaatgctcctcaagccaactggaagagagcaacgagcggcctttctcagcgatgggaggcatccttacgactgataggttctttgagctagtgtagttctgcatcaatggggcccagctggatcacagcctcaagggaacaacacataccaagttggtcaggggcagaaccaggcaggtacccatcattctagagcagcttggtctccagtgctgctccaagaaatagtggaggcgtgtgggcagcacacatttgcactgtacaattgaacatccggggcttccccggcttcccaatttatgcatttggtgagtagctccgtgcccttccccgctctgtaatggtggatgtcgatcctgtgtttccattttgattgtgggtgactgtgctgtttcttagcttgcttttctcttgtgtcctgtggttgatttcctgttagcagcactagagctgtgcccagcaccccactccaccacattcctgtgtctctgtagctccccctccccgcccctgttcatcccaccacaaaagttaccacagaaggtttcctttgtaaaaaatatttattttgaagctctattttaatagtatttattttagaaagtctactattgtaagagttcttctgtttgtgaagaaaaaaaaacaagttaaaaactgaatgtactgatctagaagatatctataaatatatattgttaaatatacacatggctgccattctcttcctgtgtcgtgttcagttgcctgacatcccacaaatcccacactctaggctgcatgggcatgggcacacagtgggctgggcgtctagactgaggagaccctcaccctgcctctgggaagctactgaagaactttgtacttcatagtgaagccagctgttgccatgggatgcaaaagcctgggtgccctgtcctcttacacagggtatctgggctttggagttttcttcttctttttgagatctagcctt

SEQ ID NO: 25446 - DNA, 1099 bp, Mus musculus
agtgggtaggtacttgttgcatgcaaaaagctatcgtgtctctggtccttgcccccagctgttgtgtgggtgggttttttttgttttttttgtttttttttttgttgttgtttttggttttggttttttctttgtgtggtattttgtccccatccctgcctctgattcaagaaatagcctgggtcagaagaggtaccccaggtaaaattgagagagcattaggcaaaaatcatgtggagcatttctggttcttttgtgtgagcagcccctagggaggaggcaaggagtcaggtagctgtaagtggagtgtacctattgctcttttctcaaggattcacccccacccccaccttggaagctactagtagtaatagtaacaccttatgatttagaataagttaattgtaaccataggtatttattgattggaggaagggagggttttattttcagctttatttatgcaacatttactggcttgtaaaaggcaagtataaaatcctgcatcttcatcgtctataactaatccatacatatacctgcccttgccacattgcagtgttcttgcacagaacggaaggaaagatagaagacaaacccctgcgatcagcaaaccacttacactaattgaatgtattagaagctttctgaaggggctggagatgttttcctcgaatgaggggtgtggagggaccccccccccaaaaaaaaaccctgatagcgcacacgtgcactctttctaagaagcctgggagcttcacccagggtccctccctcaatttgtatccacaggacagctgacccagtggcaggttgcactttggtgatcttggtctgcatacgtctgtggacagttgagctatataagccgtgtatgcgcacatgcacacgtgacacttacatacacagaccctctaccacacagaccctgtttcctggcaacccttcccaaaccctgactttgtgtacatagctgtaaacacggatttggggggttttggtttgcttccccacctcaccaaccccttgttctggtttggaaatgatgtctacagaattcttcctccccacagaagttgaccttgggactcacttgctc

SEQ ID NO: 25447 - DNA, 1122 bp, Mus musculus
cctgccggccacaggctgcgtcaagctggcccagcgaggctacgaccgcctgagacgccccggttgccgctgcaagcacacgaacagcgtcatctgcaaggcagccagtggggacaccaagaccagcaggtctgacaagcctttctgacactttggatgaaaaaaacatggtccctcctgccagtctcctgagactgaccttgctcatctgtcctctcctaaaaccctagattgggaagaaaccggcagagaacactactgcctagccttgagtccccaaaaggatgaagatgtactttggggattttcacagtcttgaaactttgttaaacagcagtgacagtgttagggtatggtggtagggggcccagttttcctatttcagaagacggaagacagatgcggacacagggtctgcaagttcagccactcaatggccttcccagcccctctgcttcctctcattttgccattctctctggctcctgctggagccttctacctgggaggaacagctaatgggaggcaagatacctcgaggaagaccctccgagccttgacttctatctttgccgcctccgtccatgcctgttggccttggcctcttgggaaggtgcaccgtagccattcctgctgtatgcacttgatgtccgagaacaaaatcgccggtaagctgctgcctcccgtgagtagcaggatggagaaggaaccacctggcagtgtgttcctcctagctttcaatcactaacttgggggttgtccgctcatcacgccatcctccagttcacagactggcctgcctgctatgcgtcctgagcactctttctactcggattctttgtagaaactcgctgggttaagaaggccaggatgacacaagcaagaccaaatatcattttgccaatgagtctgaggctgtggtctctggatccagccatgatgtttttatatgtttaattaaactagatgctattggtgtttaaacaataataatacaacaaccttgcttccttttgggccacccccaggaagggctgatttcaaaatctgggggtaagcaacctcaaggagcgtttcccctgcacatcgagaatggcaaagaagaggccgtacctcccattg

SEQ ID NO: 25448 - DNA, 1158 bp, Mus musculus
acccaggattaggaggccatgacagcttccaaggcagttgtcttaggggctgcagtcctgctcaaggccatggctgtggctgtggtcaaggccacaggctagtggaggtaaaggagtggatcgctgggccgcctggttaaggacatgaagatcaagtccttggaggagatctacctgttctccctgcccattaaggagtctgagattactgacatttcctgggtgcatccctaaaggatgaggttctgaaaatcatgccagtgcagaagcagactcgggctggccagcggaccaggttcaaagcttttgtccctattggggactacaatggtcttgttggtcttggtattaagaactccaagaaggttaacactgctatccgaggggacatcatcttggccaagctttccatcgttcctgtgtggagaggctactgggggaacaagattggcaagccccacactgttccatgaaaggtgacaggccactgtgactctgtgctgatgcatctcatctctgctccccagaggcactgtcattgtctctgctccttcttgtgcccaagaagctcctgatgatggccggtatagatgactgccacacttcagccagaggctgcgctgccaccctgggcaactttgccaaggccacctttgatgccatctccaagacttacctgattcccgacctctggaaagagactgtgttcaccaagtctccttatcaggaactcactgatcatcttgtgaaaacccacaccagagtctctcttcagaggacccagactccagctgtggctaccacataagcggttttaatacaagaaaaataaatgaattaagtctgggggtgggggagaaagaaagaacgaacctggggaacaagccaggaagcagcaatcttctgtggcccctgcttgacttcctcgatgatggactatggctgggttacataagccaaatcaagcctttcctctccaggttgcctcaggtcaatgttttagcacaacaacaaaaatcaaagacagaagttggtccaggaatggtgcactgcagtgacagacctgaccatattgttttggaaagggctatgggagtgtttaaaactttgagcttggagaagccactgagcactcaaaacttaatggaattatctgtg

SEQ ID NO: 25449 - DNA, 1147 bp, Mus musculus
ctagccttaattgatcttctgcctcactcagcaaacatatgaagtgcctgcacttcctgggcattgcactagatgctaggatgtagcaatgacatttggctgcccctgtgggtgtggaggcacagtactctgtggcaggcatggcattatttgtgtgttaacctcacacttggggaatcactagcccagagtcccatagcttcatccactggcctgtggttgtggattttgcgtggtccctttgtgcccagaatggagcctataggaccaaacctactagaatttggacttgcatttttgtatctgagcattgaatctgaggaaggcattttgggtgactggcaatttgccttccactatttttgaggagcatgaattctttagatgggaagactcattgcaatattggggttcaaaggttaaccagacaggtgggtcagctctgagactgtggaaagactgatagtggcataaatatgcctgtctttccactttatgacgaactaccccccaccccactacttgtaacttctgctttaacagaacatgtgatcgacgtgacttcttaccacttgttttcagtgtttgtactgtgttattgtgaagtgcttgctgcattgcacatcatattaattcctctatagtaattttcttcaatcagaccatcttgatcactactgctaatgaaaagccagtgattgtccactgtagcttacaaataaatacatagctatataggagtatatgtaggtatgtagtatatgcatttgtgttgtagctagtacttttacaggtctctgggttcagatttcctttatctgtgagtcagaggtgataaaaaaggccttcagcagttggcagagtttagctacatcattttaatatttcttctactttgtgaatgatgacgccaaacagcccaggagtcagtaacctgctcaaggtggcttcaaggcattcaaatacaagttggcaaattccaaagacattgtacttaacttgaagcaacactgtcatctaggttagcctaaaccatagctcctcttgtgtttttctctcaaatatgccaacatttccataaaatgacttcataaaaacaaacctcttaaactctatatggcttctccatccttggtatgggcacaga

SEQ ID NO: 25450 - DNA, 1197 bp, Mus musculus
tataagtgagagagatacggtactgtttgagagcagctccttttctgcgtgtggcttcataccgttccaaactatgtagattttataatagcttcagtgagaattggtaacatgcctgtatgactcacaacagatcttgaaaactatctttaattactggtaggacaaaaagggacattctggttattttaggcactggcttggaacactgtatatgcagaagaaagaagacaggcaatctggggaaaggaaggggacctgggaagcactgccttctttaaggaaagacacaccaatagatgagatcatcccaaaggcacagggaccacagagtgtgagtccttagtgacgagtcaggtgagctctggtgagcttggagaagccagccccaccagcagagcaggcacggcagggatgggacaagcagggacgacaattccagctggacactggtcccagtattttgctccctcttatataccgtgaggcagtatcaccgtgggatgaaccatggtagcacgttttgatctgtcagcactcaaggatcatggtagccttcgggagctttaggttttggttggtcaccccaacgatcagctgtagttgaatgtgtttcttatgtgcctggtttcagtgttagaaggtgaaatagagtgtgcaaaggacactgcaaaccacttcggatggaagttttctcattttccagactattttcggtcagcctggtctatcaagatcggtaaccaggtcttcaggaaagggttggcttctatctaggacatgcctgaaaggattttattttctgataaatggctgtatgaaaataccctcctaaataccctgcttaactacatatagatttcagtgtgtcaatattctattttgtatattaaacaaatgctatataatggggacaaatctatattatactgtgtatggcattattaagaagctttttcattattttttatcacagtaatttttaaatgtgtaaaaattaaaaaccagtgactcctgtttaaaaataaaagttgtagttttttattcatgctgaataacctgtagtttaaaaacctgtctttctactacacagtgagatgtcagactgtaaagttttgtgtggaaatgtttaacttttatttttcatttcaatttgctgttctggtattaccaaaccacacatttgtaatgaattgg

SEQ ID NO: 25451 - DNA, 1196 bp, Mus musculus
acagtcaaggtttctgcgtcttcaccctcagtggctgctgcttctcaggcagattccaagcagcagaggattctccttgatttttcaaaaggctcagcaagcaatgcgcagcagcagcagcagcagcagcagcagcagcagcagcagcagcagcagcagccgcagccagatttatccaaagccgtttcactgtccatgggactgtatatgggagagaccgaaacaaaagtgatggggaatgacttgggctacccacagcagggccagcttggcctctcctctggggaaacagactttcggcttctggaagaaagcattgcaaacctcaataggtcgaccagccgtccagagaaccccaagagttcaacacctgcagctgggtgtgctaccccgacagagaaggagtttccccagactcactctgatccatcttcagaacagcaaaatagaaaaagccagcctggcaccaacggtggcagtgtgaaattgtataccacagaccaaagcacctttgacatcttgcaggatttggagttttctgccgggtccccaggtaaagagacaaacgagagtccttggaggtcagacctgttgatagatgaaaacttgctttctcctttggcgggagaagatgatccattccttctggaaggggacgtgaatgaggattgcaagcctcttattttaccggacactaaacctaaaattcaggatactggagatacaatcttatcaagccccagcagtgtggcactgccccaagtgaaaacagagaaagatgatttcattgagctttgcacccctggggtaattaagcaagagaaactgggcccggtttattgccaggcaagcttttctgggacaaatataattgggaataaaatgtctgccatttctgttcatggcgtgagtacctctggaggacagatgtaccactatgacatgaatacagcatccctttctcagcagcaggatcagaagcctgtttttaatgtcattccaccaattcctgttggttctgaaaactggaataggtgccaagggtctggagaggacaacctgacttccttgggggctatgaacttcgcaggccgctcagtgttttctaatggatattcaaggtaagtcagcactttgctgtttcttaagaatgatacatttaagatagtttgataaacttcattcttttatcagtg

SEQ ID NO: 25452 - DNA, 1186 bp, Mus musculus
ttttgatggggattgcattgaatctgtagattgcttttggcaagatagccatttttacaatgttgatcttgccagtacatgagcatgggagacctttccatcttctgagatcttctttaatttctttcttcagagacttgaagttcttgtcatacagatcttttacttccttagttagagtcacaccaatgcattttatattatttgtgactattgagaggggttttgtttccctaatttctttctcagcctgtttattctttgtgtagagaaaggccattgacttttttgagttaattttatatccagctacttcatcaaagctgttcatcaggtttaggagttctctggtggaatttttaggatcacttatatatactatcatatcatctgcaaaaagtgacattttgacttcttcctttccaatttgtatccccttgatctccttttgttgttgaatttctctggctaggacttcaagtacaatgttgaataggtaggcagaaagtaggcagcctttcctagtccctgattttagtgggatgcttccagcttctcaccatttactttgatgttggcccctggtttgctgtagattgcttttatcatgtttaggtatgggccttgaattcctgatctttccaagacttttatcatgagtgggtattggattttgtcacatgctttctccacgtctaaggagatgatcatgtggttttgtctttgagtttgtttatataatggattacattgatggatttccctctattaaaccatccctgcatccctggaataaaacctacttggtaaggatggataattgttttaatgtgttcttggattcggttagcgagaattttattgtgtatttttgcatcgatattcataagggaaataggtctgaagttctctatctttgttggatatttctgtggtttaggtatcagagtaattatggcttcatagaatgagttgtgtagagtaccttctgcttctattttgttgaatagtctgtgaagaactggaattagatcttctttgaaagtctgatagaactctgcactaaacccatctggtcctgggctttttttggttgggagactattaatgactgcttctatttctttaggagatatgggactgtttagataattaacgtgatcctggtttaattttgttacttggt

SEQ ID NO: 25453 - DNA, 1248 bp, Mus musculus
ttctcaccagcttgtgctacagacactggttacctcttgagtaaacgatggaacaggtaacactgtttctcacagtgattgggactgctccaaaaataactcaataaggtccttcccaatcggagcgcatcccggagcactgaagcatgtcacgatgacttagaccataagtccgcactggaaaagacgcggttcatcctcctctcggtttcacactccgaatgtgtcccacaggacctgcctgtctgggctcaggtgtaaagctggacagggatgcggatcagatattagctctgcctctgacactgggtcctaaaaatgggatgaaaatgcttgtgtctggctgttacagccaggctgtgacgccgtgagtgctcacgttgcccatctcttgtgctgtagatctttccaaagtgaagctgatgcggtttgatgatcctctgttggggcctcggcgagttccggtcctggggagagagcacagtgagaagacactcatttccgagaacgccgttttccacgtggacctggtgagcaagaaagtccacctcaccgagaacgggctgcgcacggacatcggcgacaccatggtctacctggttcactgagctcatgcaaattggagagtcgggatggttttcggatacttctgctccgagaatctcaagctggctctaactagacttcatttctaactgctgagttctgtatgtagtcagaattatcccaattcttctttgatttctaatctaataaacttgcatttttttcacctttgggccatgttatttatttatttttaataaataattgctggtccctagaagtttttaatctttatacagaagtgtcaggatgcttcctttttttctatttttgttgtttcagacagggtctcactttagcccaggctggctttggaggctacataccctggagcaggggttaatggccactgggagccagctgtagaaactgaactcaggtcccctgcaagaaaagcaagtgatcttaactgttaaactaaccttctagcctgcttctttttcgttcttttcttttcttttcttttcttttcttttcttttcttttcttttcttttcttttcttttcttttcttttcttttcctttcttttttcctttcttttcctttctttctttctttctttctttctttctttctttctttctttctttctttctcctttctaataaaaaaatttgtatttacttagaagcattcagaa

SEQ ID NO: 25454 - DNA, 1196 bp, Mus musculus
cttttaattttctttgtatttttataacaaagatggaaagctctcagaagcccagccctcaaagcataaggttagaaagcgctaggatgacgagtagcttgtaaagtggtccggttgattctctgctcagaagcagcagctgcatgggaaggcacgtcgcagcagcctggggaaggaaggctggcttggacatgacatctgccctgtctttatttaccttcccttagggagatgcgcttatctacatggagccagaaaaacaagtgatgtcgaggtctgcagatgagtgcgtcgtggccctgtgtgaccagtggttagtccctcttgtaacaaggaaattgcgtgagtcactctggtcatttctgacattaagaagagcttcttttgttcactcccaggtacttggattatggagatgagaactggaagaaacagacatttcagtgcctgaagaacatggaaacgtaagatgggagaaagtgagaggggtgcggagtgtggctgatgaagggaaggatacattttggcctttgttcttcttagattctgcgaggagagcaggaagaattttgaagcttccttagactggctacaagaacatgcttgctcaagaacgtacggtttaggtcagcaaacttctcatacttgtgtttgaatgatttttgttagatagacagaaaatgcactgtttccccccttccctccccctttctcctggtgtttgctaggcgagaggatgagaaagaagaccaggatgtggttcccagtcacccatctaatgctcgatagagcctctgacccacatggcttttatattaccatctgtttatatatttaccttgtgtgtatgcgtgtgactatggtgtatgcataggtaaatgcacatctaggagcagggtgtgtatgcctgtgcctgtgtggaggccagtagaggatgtctggctctatatagggatcacctttcaccttacttcattgatacagtcttttgtggaacctggagctaggctagcagacagagccccagtgatcctcctatctctccccatagttctagggctcagggattcaggattttacataggtgctgcaatcaaaattctggtttttatgtgtgtgcagcaagagttcttacttactgagccctctctagccatatgaggtttttattaaaggactccagcggttcagttagc

SEQ ID NO: 25455 - DNA, 1088 bp, Mus musculus
cttttcttctagttcgttgttgtgagtgtaggtagatgatcgttttggtgtttaaagacagggtttctctttgtagcagtcctggacctcaccctgagaccaggctggccttgaattcacacaggtccatctgcctctgccttccgagtggctggattcaaggtgtgcgccaccccttctgggcacagtaactactttttagaatcttgttcctttacatttgaaggtaggcatggggaatttgagctgtcagtgagcagcttggttctttgtgaacctgacttcttttttttctcttagtttttcacacagggtctcatgtagcccaggctggcctcaggcttgctgtgtggctgagagtgaacttgaatatttggccctcttccttcctcgtcctaagtgtggggatcacaggcgtgtcctggcatccctggctcttactgtctaaagccagctctggtgtctcttcgtgtttaatagggaagaaaaggaactgctaaagtagacttcttgaaggagatcgagaaagaggcccagcagaagtgggaagctgagaaagtgtttgaagtcagtgcctcccggctggagaagcagaagcagagcaggtgagtcccagcagccgcggggtaactgccccaggacgagggaggccagaaagtgagacaatgtctgagtgggctgaaggtcccctgttctactgagtagtcaaggcaactctctctatggaattcttagagtttgttcttattaaaatgtaaaacaaaataaaataaaacaaaacacccaaaaatcctcatttatcagtgtgtgcgtcatgacatgtgtggaggtcagaggacaacttgcaggagtcccttcccttctactgtgtgggttctgagggttgaccttgggccttagcctgctgatccaccacaccagccgactcagatgtttaaaattagcatttttcactttttgacaaaggagaatgttctgaagttttatatttactgactgataaaaggaaagggtttttgttgttgttgagagattcttactgataattacctccaatacaaatacaattttgtagggtcactgtattt

SEQ ID NO: 25456 - DNA, 1108 bp, Mus musculus
gctttccccaagagcacaggggtgggagcaatctcctcagagaattgtaaggaaatgttccatttgtttaggggtgtgcggtattagaatttttccatgttagcatttaccaaaagggtacagttttgtctgttcacagagtggtttttgtttaggaagacttattgtgagcctttccaactttctccttctaatttgtcttctcttgctctcatactttggatttaccttttcttttttcatttctccctaccctgtgtacttgaagtgggaaaacccttccctcttttaataatggttagaagaattagtggtagtcttgagacattcgaaaatagacagtatgaattgtgatgacgtaaagagagtattttattctctgaatttgtgtacagctctcctttctagagtctacctatggcttttatatctgtgtattatagaacacgtgagaagaaaagagaagatggcaagtggagagactatgagcggtactacgagcggaatgagctgtatcgggagaagtatgactggagaaggggcaggagcaagagcaggagtaagagccgaggcttgagtcggagtagaagccggagcaggggccgcagcaaagaccgggatccaaacaggaacgttggtgagtgggcatcagccccagagggcttgtttgacaggtgggatagatttaagactggaactgtctcaaaaggctgggtattgaccttctgacagagacaggacgaatcttgtgcacccttgcaatcaagccagtttcttttaaaactattcctgttattataacatatatctaaatttaaataatttttataatgtactttttttttggttatgatcagaggaggtgacattccttttttttttattatgtattttcctcaattacatttccaatgctatcccaaaagtctcccacaccctcccccaatgtacttatttttattttatgtacattgttgatttgacatgtctgtgtgagggtgttgtgtcccctggaacaggagttacaggcagttgtgagctgacatggttactgggaattgaacctgtgtcctctggaagaacagccaatgcttttaactgctgagcc

SEQ ID NO: 25457 - DNA, 3336 bp, Mus musculus
tggataaatctgacctaggtttcttgctagtctgtttatcatgtggctgttttactatgcatttgtgcacagctaagcagatgtgtattctcctctctttaggaaacagaaacctcagatttgtttttgcatgatgatgatgatgaagatgaagatgaatatgagtctcgttcgtggcgaagatgaaatttgatgcgagttgtgtaatttttagaaatattgtttagaagaacaactttttagaattatttaaagaagtcaatgagccaaaaaatttttttctcttcaacacagtaggtttaaggacagcaagttgctattcaaacacatctcataattgtctatgatatcaaatcaccaaaggccgtgactttacacagttgtgaagatccacagaagtgactggattctctagaaccttaccttccacaccatctgtttctgctcttggtgctggattacaatgtaaagacagggtgttcagaaattttattttggattataaatctgctgataaaaatttcattaaatgtcaaaatcgcctggaatcttttaactcttagctattatgaatgggtcgtcagacagttggagatacttgtaatttaaataccttttcctttcaaggatggccttggaagaaaagtaaatttagttggtttttttttttttttaccatggaagagcccgctttatagtcagtctttctcagagtctgtgtggcaaagcttcagcaaaaccacggtctctgttcacaggagccacagggcacaggcgctggctctgctgcaccctcgcctcctcacacctgctctggggctttgccactcatcttccatgggtcgatatgtctgagcatcgcttcagttgtccccacccccacccctaccccttttaaataaacctcattttgccttttgcccttttgctcattcccttgtatctttctcatcccttttgattaatgagcctgactttttgaaataagtgattcagttgggcaatcaagaaccagtcatcagtaaaaggtttaaaccagcacctttataaataagtgacactttgatggaaatacaggcagaattttaggggacagagttactactggcttccctccccttaaagtttcagcatagtgacagttacacacaagggttaatggccggtagctgaaggtcttttcctacattgtaatgatgatggtgaggtgctgaggtggggattaggagtctggataagctagtaataaatgagattctaacttgacattgattagatgaccttatattttcataattttatagattttgctgtccatgaacacacactttagtaggcagtttcctttactgtgtgcatttttactgtacactgtacagagtgtctgttaagtaaaatatatatgtaaatttatgtccttgtgttctgaatgttagatggaaaagcagaggagcaacactacactgtactgccccctggagaaatgaatgatttctgtacataggatgtcacttttcaaggatacacatctgttttataatatgtgtggtgtgaaaatttgaaacttcctgtttgcttcagaaggttcttggtgatcactaagtgtgtcggggttttgttccctgaggtaaagactgtttcttaaaatagatacagttcgcttagaaacttaaaaccaccaggactctagatttacggagtgacaaggaattaggtcccaccttctgatcatctttctcctcttcatattgtcctggaatgacgtgtcaaacaccaggactcttagaagttcctgtagctttccctttgtagtgggacttcctctccaggttattgttgtgtttctgatgacaccgaggctaggcaaagccataaagaaggaacacattagaacagggaaccttcaataagcatcttgctcctcacttctccatcatctctaatgaaattttcttgatgtttgtggctcagtcggtatatatttggaaagattcattgtggtgaatattttgagtcctgaccatttaaacgtgatagagggaacaaaggatttatatattttttgtacaaagttttttcttaaactgtataattttgtaaataatttgtttggtttttttttcttttgtgtactaaaactaccagcgtatagatttcaataagaattgttgtatttttgtatttggagactgcaaatgacagtcacttagtgaagctgtaagaagagtctcagtagactgacagttgagcagaatgagattccttttcatatgatttttttttaaccttaagatcgacatcttatgcactcactatagagagagttgaggatttatttggctttttagttactgggggcagaggatgaacgagaacggtgctaatgtgagagatcatttttattaaggttttgggtccttccgtagtccttaaaaataactaaaattcttctccaatgtgtttaactcaaaaatgaatttaaaatatggattaattatactgttataaaacttaaggttagcataaaatagctgaatatgtgtatgtgtgtatatatatctccctttatccacatccaccagtccccaactgttagaatttctcttaaaagtgaattccacaccataacttgttttcttggcatttttatttatagagataacatttagcatttgagacaaattctgctgtcctagtgtataagctctgtgcagcagatccacagagagagctgccagtgtgaccagtcagtaagagtttctagatttctgcccaagtctaaagaggttaccccaaggaatgtggaattttctcagtttcttcttggagcattgggaaaatgacatcaccagctgagatagtggaaaacagtccttttaccatgaaaaagacccgtggtgatggatcattatttcacaaagaaaaaaaatcatgtgaaaaggaaggatgtttcctcgtgatgtatagtatgcctgtattatagtttttacaagattgtgaacttgtgtaatagtatataggagatattgttggatttctaactgtttatacatttaaattcatatatgtaatgtttgttttatcgattacaatctgaatttctaagaagcatgttgacttttgcaataaagatgcaatatggaatggttcacaattggggggaaaagagaaaaaaaaagatgaaaatattacaaatttaaaagaatctggaaaaatttatgaaccattccaaaaattataacaatcactaaaagagctgtaattctggcttgttctggaaagaaagaaacacgagtgtgagtttgcgtgtgggcccgagtgagtagtgcatgtgtg

SEQ ID NO: 25458 - DNA, 1174 bp, Mus musculus
tggcctagtgtgtgtttgtatttagggggtttgaaaaccaaataaatacagtattctaaaatggctctgatatttctggcattacccttgatgttggagacatttgtatgagtaaattattttcccaagtatcgtttgtaaagttaagctgtagaagtacagttattttaattgaccaacactagtgacaaatgctgtgggaattacagatgtgtgccgggtcctattttatagagttttctaattgagggttgaacaaaatgagaagtgatgtagtttatgggattgctagggaagttctgaggcaggacagttgctcaatagactgagtaagaacacgcccaggagatggatagctttaaaaatcaggcaggtgttctggtatgttcttcaggttctacctctgggtgatattgaagtcagaagactttgttaaaagtttttctgtaaacctcttttagagaaagtgggccccagaatacgtaatacacaaatactgtttgtattggcttagagacactaagaaaggaaagaattttcaagcgtctagtcacagtcccaagactgagaacttgaaaacaatagaagtgagagtataaataccagacgtaagggctgaggagaaggacgtttctgttttttaaacatctattctgtatattggtggttagagtagggatggctcctacagattcatgtgtttgaatgcttggttcatagagagtggcactactaggaggtatggccttgttagataaggtgtggccttggtggaggaagtgtcactgtggaggtgagctttaaggtctcatacatagaagctcaggttaaatccgcctggctgcctatggaaaacagtttccccttctgctgcctttggatcaagagggtagaactctgagctcctccagcaccgtgtctgcctgcatgctgccatgcttgttgggatgataatggtatgaacctgtgaaactgtaagccagccccagttaaaagttttcctttatacaagctgccttgatcttgttgtctcttctcagcaatgataccctaactgagacagaagttagtaccagggactggggtattgatgtgataggcctgactgattgtgtttggagaaaggtggatgtggggactttgggctaaatgggtcatacttgtaggaacatgg

SEQ ID NO: 25459 - DNA, 1888 bp, Mus musculus
atgttttgcatcagcttgggcttttaaattagatgtgaagtaagacttctttctacatttttatagttaatttagtgaaagatgtgaaagtgaaagcttgtgaaagatgctgggattggcagccccgcagactgaagtcctctgttcatccacagaacaggtacagcacgggcaagatttacctacccaccctcagccctgatctggagggaccaccagtaggggtgggagggtaattcagcttctgaggccctttcactccctggagtctttgctgaggcgatttacaaaggtgactgctgcagtgaaatttttctttaaaaaagtggaaacacaattaggaactagatggacatttccggctcatttctgcaagaccagcgaacagcagtcagtaattcttgtgctttttctcttatttcagatccaaaaagttaatccaagaatctgatcagcacctgaaagatgtagaaaagattttgcagaatgacaaacggtatctagtactggactgtgtccccgaggagaggaggaaactaattgtggcctatgttgatgacctggatcgccgaggtccacccccacctcccacagcatcagagcccactagacgatcaacaaaataattctaaatacccttccacgggctcgctgttaattgaaaatgcttgcatgagccagattttcaggtttttacatatatgcattagtcaacctattgcaaaatcacctgacgaacagaaggagaagcggttgtgggcagtctcagaacggaacactttgaaaatagttaatgcttttctttgtgtggcatgactgacatacatactcaaatataggctgtctctagtaaatttaaaatctcgaagctaaaagtcatccttttataaggtgtggaagccagtgacttggtgatgttcttactagcagtgttactcagcaagacaggagagtttgtggtaggagcttggaaataccacagactccaggaaaactgaagttggagtttgtttttgattttgttttttaagcgggtaaaagagaaaacactgaattgaattcttccagagactatggttattataatggacgtacttttacctttgtctctaaagagcagtttagttgtatttgttcacgtatgtgctttgattctcccctccggagttataggccaagtcttgtttaccccaggagaagatgtatttagtaatttcttctcaggtatgaaccacattcataactaacatgttggccagagtggaatcctggtttaaacattctttattctccattgaatgatctctaccaatattctcaattagacaacaaaactccctttctgggtgttcctgtaaactactcctgtttgaatgtttgaacttttgtttctaaaaagtttaagatgtttgaatgttgaatttatgtatttgaactacaataaaccaacccttttatatatgtggattgtaaatgattattgttacacaatatattttttaaaaactcgtagacctgttttttattttttctttgtttgctttcttgtttgggtcattgtttttttttttgtttgttttgttttgttttgaaaaaagcatgtgatatttgagacaacaaaatcttagaatataggttttaaaggcttgactataatgctgtatttctaatataaaagacaagaaattttgtagaaagcctattctccctttcttttgtgtgcctgtatgtgtgtgtatgtttatatgtgtgtctaatcagtcttttaattctacctgttaattaatagcaagaatattgtagttctttgtctttctagcatatcaaaggtttgcaccttttagacgtcctttctacctgtcatatgtcatgccgtgaacttacttac

SEQ ID NO: 25460 - DNA, 1182 bp, Mus musculus
ctacccctgtgtggtgtatgaccatgggcccaagagcgctcttgaataaaaatcctcttgcagtttgcagcaagaccgtttcttgtgggtgattttggggtgtcaactctcctgagtcagaacgtgggggagtcctcacgttgtggatctttcatttggtgcattggctgggaaacgcgaccacccctcacacccaagaaccgacttggaggtatggggatcccctcttgtgtgcgtgtctctgttttgagtgtctgttttgagtgtctgttttctgaaacgaacattggaacatgtgcttgttgtgttgggttgtttgtgtcttgtcctatgtttctgaagcacggcgaagtctgagtttggatccatctgagtttattgaatttgtgtcttggtttcagggttacgagatcgtgggttcgagtcccacctcgtgccttggttttagggttacaagatcgtggattcgagtcccacctcgtgccttggttttacatctggcagagtgaggaatgagtgtgcttctctggttttggtcgtctaggtagaggtggactacagtgtttgtagacgatggggggatggggttttctgaaatgcgtgcggtctgtatttgcagctgtccttttgggctgtgaggaccggaggactgtggttggcagatgtgctaggaggaccacaggctgccaccctgggggacgccctgggaagtaaggagagccagggatctttcattagcagcatataggtaaagccaataaaaaaaagttcaggtttttgaattacacagtagtctatttggaatgggagttctatcttagctccctccaccccctctggaccagaactagtattctctaaattgactctgtacctcaaggcacccacttcttacactcattgttactcatcgtttggacatacagaggatctgcctgtagctgatcgtggtgacctaaattcagaatctgtctacctataaggtcaagaaagatggatgactttggtctcctggaactgttattagaaagtaagtatactaacctatcaagcaactgtagggaagagagagagagagagaggtgtgccgcagggagagggagggcatggcttaagaggagagccatgatggattggcttgtactggtaaacaaagatctgagcctggggcaggctggctgt

SEQ ID NO: 25461 - DNA, 1194 bp, Mus musculus
gtagaatttgttactatagaactgtttgaaaggtatcttaacagttgagaccattttacagaggacctgcattcagtttccagcctgtcttcaatagcctgtaactcaatctctacgagatctgacaacttctggtgttctttgaggacagtgcacagacatggacactgccctacaccaaagacacacacacacacacacacacacacacacacacacacacacatcatttattttttaatttttatttttagctgcaaaatatttttattgtaaaaacagtcaactggggttgacaatacaaatgttatctcagaatatttccccttggttcctgaacttccaagttcccatcagcatttctctggtttttatggtcctttcaaacatgctgctgactgcatttatatgctgctttgaaacaaacacaaatccgtctgatagtaaaaccaaccaaaacaaaaggcaggaacaaagcccctagcctggttctataaacaattgtatgtttaatctgtttctgaaatcattttgcaatatatggaaatagagtagcagttgatatttctaaattgtgaccattgtccgagattgctttgagaactggtagttattctctttatgtttggagacagccattaggctgtaggcctgcttactgcatagcactggacgtgccgggcgcattctggcccctggcatgcttcagtaactaggttttcaaatgtgggaaaccaagctgaaaggtctgttttggtttttgttgttattgttgttgtttgtttttgtttttttcagagttctttccaaacatacacatcatttaaataaacaaaaacaaatgctaagaattgctatgttatctattcatggtaacaatacttgtacctttttgttggtgagatgttttaatttgttgattgtttaagtgaaccaatagtttacttccctattttatcagtttatgctttatctttacaatttccttctctattttctactttctcctttttatgtaaaaatttagataattgattttgtatttttaagtgggcatttaaaactttaaatctcactcaaatttctatcattcatatcctatgagatattttatgtaacattgttctatatcttcttcaaatatttcccagagttgtccagtaaaacaactgggttccaggattcactttggag

SEQ ID NO: 25462 - DNA, 1151 bp, Mus musculus
tctgcagtctccaaacgccaagttattgctgagcccccaatggcaacctattgacattctttctgaaagggccacaggcgtgagtggttgaaacggtctttctggagcaattaaatcaacctcctcagtggagaaatttgttacttctaagttttttgggttttgttttgttttttaatctagtaggattatagtcatcctctaaaatggcctttctctaacttcaaagtccactggttctatgggtcatttctttatcaagatatgcagaggtctatctcccaaggcctgaatcctaactctggactccattctaatcattctgctcagtcccttccaagaggcgagtgcttgccaacgttgcttcttgccacaagcctcccagatctcctccccttagaccgtcccagcttgagtcctgatgcagtcatgcattcctcgtaattcccctttgagacatggtgtgtgggtgttcagttctgtgtctggtggctatggacagacagtgcgtctccctgtgacctgtgctagctgtgaggcagctcggatatggaagagctgtttggtttgaaccgtgaagaaaactgtgtattgagttagctgagattaaagaaacaaacgaacaaacaaacaaaagctcatcacgtgactgttaatgtaaacctggttattaaaataattataaaattaccgttactgttctccagtcgtttgtgcatggaaaactaactcacctaatatactgagactctgggagactaggaaatggttcagtgggtaagagagcttgctgtgtaagaaagaagacctgagttccaatctcagtacccagttaaaaaactaggtatggcgaacatgtatgcccagaaccctggtactggggatggggtagagacaggaggatagctgggtttgctggtgtcaagttcatagagagactttggttcaatggtaaaaagtgttaaagcaggacatctgatgtccttgcctggtccccaggatcatgtgcgtgaatgcacagccgcatgtaaatgtacatgtgtaacacacacacacacacacacacacacacaccgtgcaagacaaaagaagaaacctctataatttggttagtaggtaaataagcatcagatctgataacagcagaggtt

SEQ ID NO: 25463 - DNA, 2479 bp, Mus musculus
gtttcttgtgcaccaggaaagtacttactattgttcactcttgaaatgactcattttctctttcccccatatatctctttccccttgtttctctttgggaaattgtcttcatctgcaggcacccaagtggatgagggtgtccgctcagctagcaaacgcattgtggcaccccctggaggccgttctaacatcacatccctgagttaagccctcccaaagagggaggcagaagcaagaagaaaaaaaaaaaattgaagccaaaatggtacaccgatatttaagaaggaacgtgaatccatgcagttgagatctaaagaatcactaagcctcaagccttatgtttcccaatgttatgctcgcttgcctagctttatgaattgctttggtttctgtttttgcatactctcaatttctttgaaccccacccccaccccacccccacttacatgcatgcgatcagacaggccactaaggtagattctgcatattatagtgttgagagcgtatgtagcactgcatcttacaacaaggggacagacaaagctgggatgtcgagaaaaaaacgaatgaaggcacgaagggcctttggatgattgggtggtgggagcccagggcaagatggagggcacaaaggggctggggtgggacgtgtactagggaggtgggtgggtggggtgagcagaagggcattgtgtgttgtattatgatgtgtgttaatttccatggaggatggtcacatatggcagtggtgctccatcacagtcccctgggatctgcagagatggcaggaggtctttgggttctggactttgtcatgtcctttcctagtagatcttgtttccttaccatgtattgaatgacagaatccagccatttcttccacctgtgatgccagttgcttgctcaggcctctttctcctgtggctttctagtcttctattcccagctgtgaagaccacacacagatgaacaaatggacaggtctcttcttctttagcttctttggggctcttccaaggctgccatggagaatgcagccccagctctatttaggggaggacaggtaagcttagacagccttcctttcagccctggggaggtactccccaccctcctctctagtgtctgcaaactgagttaggaccatggcagagctagagccaaaggcttcctttgctcatggcgaatggctaacctcctcatcccacacctgagcgcatttcccgatgttatttcttttgggagagctgactttctctattgttcctaaactttgctcccaacagtaatctctgcttccgagggagagtacagcagagatgtagggaacccagctttgagtagcaggagtgcactgtataaccacattttcaatgctaagccaagtgtttcctcgtctgctagcagatcccaggggctgggatatcactttttaattggtactaaatctctagggtgatatggataaagcgacatgatgcagttttcttggtgtgcaacacataagggcagtgggcagcagtggtagcctccctctttgtctgtcagagttggaagcccgtgttcctatcacaccatttccaaaatcaaccgtgagccagattctgtgagcaaggcaggggggctgtagaagccaagatactcttcctgcaggaaacgtggtagtgaccttggctcagacttctgtgctctagggacccactcggtgagaaatatcacactgcgcattaagtactctgaagagcagagcaggcctcgtacaccttcgaagtacttagagaaaactccatctctgcctgcaggtgttgtttggttttgctgggttttgttttttgttttttgttgttgttgttgttgttttttttttttgaggtggggaatttctgtttatttcattttgtagagctggacaattgagtccagggcctctcaaatgctaggcaaaactctgtcacggtgcttcatctttgctccccttacagccctggctgtaggctgtcataaaatttagaactagagaaatatgaacagtttggatacataaggatttggaaattgccgaggaagggattttcctgagaaagctattctgttctaatcttgaaaaaaggctttcacctcagaagaggaatcttgcttctttaaagctctcatggtgctttcattttaaaggagactttagaagaaaaagaatggaatgaagttttgagttacaattcaaatttggggatcaatccaggaacacagaaggacttttatacgcaaagggagtttgccagatctgaagcttgtatactaaatacctcaaaagctaggctcggcagcagcataggttgtagtaccatctgtggccaccagatgggggaagagacatgtaaatgaactgtaattctgcgcctcctcaactgtgtggttccccatgcctgagcccttccagggtctctctgatcatgaaaaataaactcctttgggtcatttg

SEQ ID NO: 25464 - DNA, 1555 bp, Mus musculus
actatattatgccagttttttggaagccttagttcgggatgtctgtatttcattggaaattgatgacttgaaaaagattaccaactcattgactgtgctctgcagtgaaaaacagaagcaagaaaagcaaagcaaagccaaaaagaagaagaaaggcgtggttcctggagggggattaaaggccaccatgaaagacgacctggcagattatggtggatatgaaggaggctatgtacaagactatgaagacttcatgtgacactttaccttctgctgtcttctttctttgcccacaatcccttcaacatgtagcacaacctcctttcctttcagttctgccaaatgctacaatcagaagtgcagtatctttgtgctggttacttaaccccttgacactcaggtgctaatgtgcaaatgagggaacttggatcttgttgccaaggggttaaaattgggaacctcagttgctactaaatcatagtttaaaaacaaaacaaacctaataatgttgtcattgttgctatccgattccatagcagcagtcactaaattggaaacaaaggttgcaacatgacaaaaaaaaaaagtgtagtatttaccagcaccattcagtaatacagccttaaccgtacctccttgaactacttcataacttgtcgagaaaagcagtttgcagcaagggcatgtgggatgcacctagtattaaaattgctttgtcttaaaattgaggtgaggatattaaaaacgtgtgaagaagactgcttatctcagagtgaagataactgtggctgaaaagtactagtttgatacttaagattttaatgaccaaaaccctccgacttggaagctgaagaaggtaaacttctccattattacagtgcaagtggtggactctccagtgcattgcctgtctagttatttatcagcctgtttctattgatggaggacttcatatgggggagggaactctgtttctgtttgcctgattcaagtgtctgagaaacaaatgttctaggctgcagtgggaaaactttgaacagggttttggcgtttccttttctttataaaacgtgctcagcaaactgcaccagttacctacagtttggtaaattgttatgttaacaattatgacatctgcagtgttttataaagcaactaatttaataaaatcactattgtgaggacttaaattttgtgttatatcccaagagatagttgagagtacagaatgccactcatgggtgggggtctctactcactaaagctaatcaatgcttgatgtagtcacagctttgaatgtttgtgtcttcaacagttacagagccttcctactcttaattattttgttgtttagatgctaaggctcaattaagtacctaggactatttatttgtagtaatggagcctgttactaagtttattgctgtaagcataaattggattacatcttaaataatttacccaaacttgtgtacccctcaccccaggttttcacaatcagaacaaaaaatgtttttgatttctcttccataggcaataggaatctcaaagctct

SEQ ID NO: 25465 - DNA, 3097 bp, Mus musculus
agtcaggaagacttaacttaaacatgtgagtgcgtgaaaggcaatttctggttaactttctgagttattgtctactaattctgtttcctaagcagatgccacatgtgacctgccttgttctggtgaagagccgtcggtagaacatgctgagggacattctgtggcatgcaacggacattgcaagttcccattttcatccagagcctttctgagtttcaagtttgaccaaaatgctataatgaaaatcttggacctttgagccagcaagagtattgcagaagtccctcgatctgagacctgttgcgtgtgagtggctgtctcctcaagccttacctttctcaggtatctgaaagaagtgcagggaggccatgtttctaaagagatgttctgtacagacgagaaactagaaagaaacacaagtttgcactgtaaatgcatttagaactttttatatggatttaccatttcagtgtttggaaccaagttttagttgcctgtgtttttttttgtctctcccttatttttgtgtgactgtgttttgttttatattctcatcaagagttgttttgattgcatcatcagcaagtagccatgtcaataggagtgtttcacctccccatcttagtgattgcaaaaagcttgcttattgaaaacttaaaggaacttaaaaccccagttaccaatgtactgggcatcagagctgaaccgtgaggtgaggatgcaggcgtttactcatctctgcctctaaccactgagagtctaaccttccaactggagctgcacagtgaacctcgagcacttcatcaggaccacatccacagcctggagagagatggagtcagtggggagctgatgctgtggatattgagctctgatgtttgctgtcaaaaacctgtgagtgctggagcagagagcatggaagcaatagctgacagttactccaggtcatgccttgactctcctgcctccgtccgttcagtattgtgtcgtgattatgcctgtgtgaaacgtctatgcgtattctagttgtgagtctgtgtggaaaacttcattcttagttctatattgcatctcaacgttgatctgtgtaagctggtattatgttaggttccagtttgcagtaatactagactgacatgcttttcattaatatcttgaagcccctgagttacaacgtgagaaagaaggggatctgcagtttaccagtaagtccagcatgtcactaggggaccgacccttgaagtaatgtacttagatcacacgtaggaatgtattttgtattttgctccttcagaattcttaaaccaaacacgggtgacagtgcccactttgcagagatcgcctgttgttgaggacaatcaccagagctttaaggaggcaatatgatgttggctgcccctgacctcgctgagaatctcttctggggtggactgtgctgttagagtgcatgtgtacacgtgcgtctgtcgtgtgcggttttaacaagtggtatccacaaagtatatctctgcttataaatagtactatagaaatctctatgctgtatatgtagcctatttaactgggggttctgcctaaccccatgggacttaaaaggaagggctattattgtaaggaattcacttggtattactactttgctttagcttttaaatgactgattttaaagaagaaattatatttattcatgaaagtgtcactcggtgctaagcaggagacttcacagtgatacagtatgtttggaatcttctatgcgactactttgtgaatccttctgtgacctttgctttttaatgcattatatgattgtgtttggaagcccttactgttcttgtcagaaatacagctgctttgcttgggtcttcttgagccatatttataattggtcccagcattccagatttctgttaaatggttaagggagtgaaaactgaagcttgcctggcagtgagccactgtcactccctgactgtcaccaagaaaccattgtgtgtgtgtgtgtgtgagagagagagagagagagagagagagagagagagagagagatattcttcttaagtgagcacttcagtcagtccctggtgcctgtagaggttggattctcagctctccatactagagcaaaatcaactagctagcacaaggtccatggcccttaaagtggttgactgtaagaaccaaccagtgatgtgctgcttcatttaatgcactgtggaacaaagcaagggcatggttggggtgcatttacaataactttaggctttaggtctctcaacaggctgaaatgttgagagagtaaggtttgtatgtgtgatgtgactcaactatgcagaaaatgttaagttggtgttcttgttaatgtaagtccagcgtacacacttcttcactgtacagtttagctgggagaccatatttagcacaggacgggatttcttctctgagctatgttagcgtttcttcataggatctagtgatgaggactctgaatatgcagtaatgtgcttctgtgtagtgccgcatttagagacagactctagagggaacagtagatacgtcggccttattattatttgtgtttgagaggtgagactttaaaatcgcttttaaacatccttaggatccaactgcatgtgttccgaggtgcagtgcactgtgaatctttttaagtctaagtttgtaggtgcttttatgtgtaacttaagtggttggaagaatgtttaataactttgtcctcaaccattgtactcaaagagacaaaggatacagtttacatactttctgtaagattttgttaagaaatagtgaatgaatgactctaggatttcaaacagagattccatcctgagacatgagcacttggaggggctggaaaacccaatagatcggatagcttggaaaacttggtgagccatgttgaaagagctaactagatttctgtaccaatatgtgaaagatagttgcccagaactgtcagagggattgtggtcactgcttgctgctttgacctttgaatatcattatttttatattaaatactaattagtaattagctatatagcagattaatattatgctgtaagacttggctaggcttttt

SEQ ID NO: 25466 - DNA, 2490 bp, Mus musculus
ttgagaaaagaggttcaaacgtgttataactagaattgaccatcagcaaaggacaccactcccaggtctaatggtattcttcacctttgtgtatgtagtgttactccttagagctcagtacagctggtgtcctaacacttcagaatacatttgtatagtttcttaaaagcctagaaatgggcttatagaaggcctctccacaccttcctatcaatatatgtaggattgtcactcctgaagcctaggtcagaaggcaggttgagatcagcagaatgagatttgtcataagggttttgctgttttaagtgtgttgtgggaaaggatcttgaaaagaacagatagcagttgctgggaggagtgaggaagaaactactacgcatttggcacttgagtgcttcctggaaggatgctcaggggagaaatgtggtcaccccctgcccaagcagaattgagcatgcagttctttccaggcattttctattccttggtgaagtattgttttctaagtatgatcgccaagcagtccatggttgctaatggaatttttttcgctctaaggaccagtgttcgagtcctttctgtgttgattctgtcaagctctaggctgagtttgggttttgtttgtttgtttggtttgtcattactttaatttgtttttaatgtgtatgtatgttttgcctgtatatttgtttgtataccacatgtgtgcctgtggtgcccagggaggtcagaaaaagtgtgtcggataacccgcccccctccaccccccggaactggggttcagagcaattggaaatggaacccaggccctctgccagagctctcaccctctctgttgttgataacaaggtagcccagagtgttgcacagtcatgtgcaaatgctggcagcactttccttgtgacaaacagcatttgtcactgaagtactctacagccattgaataatggagactcagcccaccctcctgggtagaactggatgaaagggcatttctgtcaacgtagttcatcaggaaggttgtttgtttaggttttccctgtatacatctttgtacttcgtgttaaagctcagaggcttcattttgagacatgttcagagtggaatatctaatttgaagccatccataaagagattacattaatctggagtcttagtgtagcacaggggttgggtctgtgtctctgtcacagtttaaaaggaattcacctcaagatgtgactagttgggcaggattgactaagggccctctgggaaaaggaaccccaggagtatcagtttcagggtgtgacttggtcctcctagtggacatcagctctttggtggaaggtaagtgtgtcagctagggggcgggggtggttttgttgatattgttactagtttgttaagtgtccttttctgagcatctgtttcagtatttctcaggctttttgtttgtgctacgtctctaatacatctgacaccatgagaatttgctgtaagtttaactcctgagcctcaagtagataaaagggctgtgttctctcaagtcagtgtctatagctgtgaaattggtgtgggagcacagaaaacactttgaggttctcgttggtagctttagagtggaacgggcagcatttcctaacactcagttcttaggatagtgagcttttaaagtagaaggtagggtgctttctaattttaattatttgatccaaatgtgtaaaacggtagctctagactggtgaagcatttgggacacagttggacattttaaaagccatttctcaagctttaaggcatttagcacagcctttgcagtgctcagcagaggcgcgaatgcaagcagaggcgcggccatgaggtcggtgtccgacgctggccgtggctggagagatgcagtaatacttgtggagtgtgagcggcagtggataggacacgtgacgtgcacggtgccttgggagagcatgggctggtcctgcaggactctgcatttcactgtgactgtgcagcacattttaggctgtgtttgaatgtctcacaagttactgttaagtgtcaaatgcaagaatccaagaaggagctgagcctttcattttacatgttgtttgaaattaggacaagagacaattcacttctgttgtgtaaatagtaatttttttttcagttcagcaaatagggcaaaacagtgaaaccattaacttctagtttttgaaaactatttttttatatttactgataagttttaaatcttatggtagttgtaaaaatgagtattgacttactagacttatgtataattcaaataatctgttggcttcaatgaaaccgtaatgaatcttcatgaatgttcatgtatttagctattttaagtgatattctcttaatttggatagtcttaggtcaggccagtagagatgatgcccacctgtaatcccagcacttgggaggcagaggcaggagagtctctgagtttgaggccagcctggtctacagagtgagttccaggac

SEQ ID NO: 25467 - DNA, 1356 bp, Mus musculus
ggcttcagaataagtagatttgtaaactgtttcttcattaattggttttgtcttatataaaatgatttaacatagaatctctgccagacttataacgacgctttatattttattgggagaaagatgtaagcaaatcctttacatgattatgtctatgataataggaaagtatttgctttactgtagttattagtcaaacatttagggaaaccaaagaggaacccccaaaatagctcgttgggtttactgtagtgtgacaacatcctttagtgctacatttatttagtgagcccctcccccaagtttggtgtttatgaataattggaactgcttttcacctacatcgatgtaactcataaatttctagtgactcgggtctgtgaattagtgatgctggagcacccaccgcccttccaaagatgtggggtgacccgacacctgtgctgtaacatctaacagcttttcagtgtgatgcacactagtttaggagctaaaaccatactgtaaagaatgcactgacagtgatggaaggccacccacgctggctttctgtcgaatactgtgagctttgctctaactctgtctgtaaggaattacccataaactgggctgcttgggcacagttactgctctgcctttggttctgttctgtttaaagtcattgctgttactggttattactctggaccagaaaggctaggaatgtataggataaacatgagaagttgttcgcattcatagaaatataaaaggtagaatttattcagagatgaaagtggcctgtgggaatgtcacctttatctcaggtcggcttggctcttaagctgcagtacagtggtgggcaggagataaaaatccgacctgtaacgtgcagtggttcttaggcttgagccagaaccaggcagaatgtccagcagagtgtcctattgcccctccctctcaggcaggagagtcctcagctacgtaactatgttgtcatctttccatggagcagaaagtctgtgtttcgacactcctgatgtgctatgaaactgcttgctatctcctaggtttagacttcttgaaactttttttcctgttttcagtagagaaacttctgtttatgctgtatgtgaagacaaccaaataaaaattgatgataaatgagaattttgtggtttttttgttcttttgatctgaaatcgtcatcttacatctagctcctacatcctttctctttaattaaatccaaatacagaatggaattagaaatatttattcagaatataagaacgtttgtaaaatattataaatgtctctgtataaataaatggagtttttttttttaaacaattctatatcaaataacacaaatta

SEQ ID NO: 25468 - DNA, 1507 bp, Mus musculus
agatgcaagttaggaagggatgacaggctgcctgccgaggtttgctccctccccacagcctgaaaaaaatccaagaacccttacttctaggtccacagttcctccgcagggaagccccgaaagcaatgatcctacctggccttagagtctgcgtttctaagtacataaatatatggtgacttggtgaaaacgttggcaatgtccagttttttgaataaatgggaaagggctatacaaccttttccttgtaactgtcgatgttggttgagggtgaagcaagaagacatttgcttatgtgaattatggaagctactgaactgcactgattaaatacatgatagcaggtgcctaggtaattttcctttttgtttaaccgggcgcttcctgaaccaacttttaaataggaaatggtttctattaacatgtctattcaggcaaacaaattatcttgattctaatttgtatgaggttaaaaaaacctactgtagatctctgtaggcagtcacctttcctaatcaaagccaattttggttcatcaaaaataggcagaacaaaaaggcccatcaggaaccacttcatagtttccttggactgtactccccattctgaactgaggtggataaactcaactcgggcagcgggaataggcaaaggagacatctatctatgactggctctggtacactgcaaccaagcccaggtatatccgccaagtgtgccttgccttgtgccggtaagaaagcctccactagagtcataataaaggctgtcatgtgatcagacagttgagacctacccttctcccccgtgtcatactcctggtgtacatgagtgctcagtgtccccagtgggaccttccactcactccattctgtgctgatgatatgtacgtgcctgaaactggatggtacctttaactgacacttagaaagcttttattagcttaagtgcgcatatccttccagatgcatgtatgcacaaggtcttcctcagtacctgcagcagaactttacaagggcttcagagaactctaaattagagctttggcagggttcttataaggaagagcaggccgagccacacagccttaggtgtttattctaaaaactgttagaagaggcttaataaggaccttgccaccgtgagggagacctggaagtcttctagttcctacatacagacattaccttaacagaaaggaaatgcttttcagttttttttttttttctccatcattggcgtggaccaaaactaccaggcttctgtattctatacattatggcccacaaaaaactctacgcaacaatataaaatgttagagctgccaagagttaaggttttatcatgttcaaagagaaaagagtgtagagaaaagcatgaacccctcgctctgctcttattggtccaaacacttccttctgtaaatgctttcggtgataaatgtttgattgggtgtacgtccagtcatcatatgaacacagtgccctaagagcaatcacgttcacta

SEQ ID NO: 25469 - DNA, 1209 bp, Mus musculus
ttcacatccacacatacatgtgtacaaatgtatattttcatacacctatgttctgtatgttattgctttaaactgtagctgacagcttccagtgttggtaacattgtgaatttcactgctgtgaaaatattttgaatttttatttttttcctcattagtattttagtcaagtacttaactattctcagcaatatcaaaggggatatttaatgaatatgtatttgaacaaactaccaagatttaagcagtagtgatataaggagaaatctcttgatatgcttattttttgagaggaaaaaaaggaaagtcacggacaatattgtattcatgaatgaaagccattttaatttttcattctttgatctggtattcgcatattcctgtgactttatgccctttaaaaaggctcactcttctttattcgtttccgtttctgtttccttcaggatatctattttacagcctcttttatcccatttgacaatgactacccttttcagctgttgagttttgaccacactgtggtcaaatatcttaggatatgtcccttgtggattccttatataggaggaccaggatccaacattcctgctgtcatgttcactgtcccgctcagtctgataggccacatgcggattgcttccgtgaagccctttagaagtatcttagctgttaagtaggtcttgttgaggatgtgtacagctcgccacagagggaaggagggcatgcgttttggacttagtccctggaacccatattagaacaaccttcaaggagcacagtgagtagtcagtaggctagcctgagctcttcagcaagaagccatctctgtacaataagaggaggtcaatggccccagcaagatgctgcctgcaatttgagagtataagtgcgtcttcaggctccaagaggtgatgtattactgcatggaaacagagttcaacaacagggtaagcagtaggaccatgaggttgctgagatgcacaatggaatcacataccaatgtgagacacactctggctgcattccaggctgaatgcaagtttcaagtgatatgtccctatctcccttgttttctgggggtttacttgttgacccatgggatctaagcagttgatgaccccccctccccaatcttcttaagaactcaggagactagacaggagcagtgaaagctcagagcctgtcaaggttacatagtgagttcaa

SEQ ID NO: 25470 - DNA, 1192 bp, Mus musculus
atataaattttgctgacaatggtataatttaagaagtgatagacaccgtgagaaggaggttatctgaagctagatggtttgcagcttatctgtctattgagcagcacgattttggacccagttctgccactggaaagatgaagtcatagaatttcattcactgagctgagtcagaaatgaatgaggtggtctatgtgaaaagcactttgggtagagcagatatctaactatagtttcatgtgatcataaaagtctctgggacaatagagctcttaacagcatttaaactgaaggaagatgctgccaatggtgtagggtttttgtttttgttttttttttgggttttttttgcaacagaaggagtagcaagtatagccatggtcactgcagaactaggtgacaggtggtcccccacgagcctcagaacacaagtgaaagaacagatgtgtgggggatgtaggcgaaagcagccgtagtctgactgacgccttgtagatgggagcattgcaatattcttaggtcaaaggacagtgggccaatccgaaaataatggcgacactcagaagagctctacagattcctgtcagtgggctggggagtgttgaaatagtgggatgggggcctggcctgttactatacaccttttgaaattaatgaggaaaaacatagcactgggaagtaattgctagaattgaatccagattgcacaggataggcatgagacataaagaagaggcagctaaaataactgttgggaggaaaagcctgtaaatctagatgcatacatatatgcctccatattcatttaaatcacagggaatggaagggagctagaaagatggagccattttctagagcaacccttccttcaagacagtgacttcacggaaagtcaaatgtaagaatgcagtcggttcctgatggtaaaataagagagcagctcctcacagacaggagcacagaaggcactgcaaggcccctgcgacatcacccttgaaaaggcagtcagcgcatttctgagttccaggccagcctggtctacaaagttccaggacagccagggctacacagagaaaccctgtcttgaaaaaccaaaaaaaaaaaaaaaaaaaaaaaaggaaaaggtaaaagaaagaaagaaagaaaggaaggaaggaaaggaaggaaggaaaggaaggaaggaaggaaggaa

SEQ ID NO: 25471 - DNA, 1911 bp, Mus musculus
ttagcaggactctggtatggttcttaactgtttatgttgtgtttctgagatgtttcatggggcagattgactatatgtttgtaggttatcttcctaaaaccctcagtacaagttctggcttacaaaatggacacaaatcttcaaaacaagtttacatttcatatggcattgataatcttcagtgagatttaatgttcacttaaaaaatctctactgctgatggtaagaaatttgcttgttgaattaagtatctgggattattctttaaaaattgacagtctcataattttcttaaagaataacatattttgtgttattcttaaggtgtgccaactaaacatgtgtaaggtatacaaatacaaatgaaaagtccatataagaaaaaagtaggcttaactaatactatagttttctaaagggagagtattatctaactgagggagaagtaattgaactgtttaattatgaatgaaaagttttatgtctttattagagattccttaggtgaatacctgttgtgttttgttttcatctcaaaccattgactgccatttgtctggggcaagggaagaaacaatcttcgctctctagagaaagacattcagtgttttattcttctgagaaactgtaaattatacttgtatggctatagctgagttctttttagttgcttagattttttttccccagtgttttgtggccattatagttaactgttttatttcccatctaccaggttgagcatccttaatccaaaatccaatgtctgggtcaggcatagtggcgtatgcatttagtcctagtacttaggaggtagaggcaaccagatctgtttgagatcaaggccagtctggtctacagagtgagttccaggccagccagagcaatataatcagaccctgtctcgaaaaacaaaacaaaataaaacaaaacaataacaacaacaacaataataaaatccagtatctgaaatgctccagaatccaaaattttaaactgacagcgtgacacaattggaaaatttcactctttatatgataggtcacaggtaaatttcagagacactgtaaatagtgtataaaactacttgaaactaatgaatacagtgtatgaaataagtacactccgtatttagacccggatgtgtatatgcaaaatctgaaaacagaatctaaactctgaaacattactgttggttccaagcattttggatagtgatactcaacctgtaaatacttttctaatgtttttaagtttggtaaatctttaaatataaacagaatcactgaagtatacatagtcatttatatttttatatttttggctaagcggggttggagggaaatatattcattttgagggataaactagggttttacttactcgttgtcgtcttgttttattgccttagttctatgaactaacaaccaaatggagatggtgtaaaacctttgttagcaaccaacatgtcacattaaattacatctttgacttggtgacaagaaggaaatttcttcagtagaagaaatgggtgtgttagttttggtagtaatcagagttgtattaatcaacagacatcattgtaaaagctaaattactagtgtccatgggtagataatagcattttcatttatttcctaaattaaagagatatttcctacataacagttcttctaaagggaaacctggcatatgattaaaaaatacatctcttgtcagcttggcttagacttgagtttctagtgctgggagtctagctcactgcctgatacgcacaaagccctgagttccctggctttgatccttggccctcaaactaacaaaccaacaaatcctagttagaaataagtcttcccgtagtagaggacaaagctttaccaagaaatgttgtcctctcatgagtttttccag

SEQ ID NO: 25472 - DNA, 2402 bp, Mus musculus
ccacttctgtcttcaagttttgcctgtttccactttttctcccaaaccatttctgctacagtgttccctgaaccgttgggtccatgctaagtcataaaccttatggacttgtttaccatttgcagttaccataagtgctttatcttctctatgcaccggcttaaactgggactgttgtgtgttggcatattctctatgcagcagttggtcaacttcaactcaaaacactgtttccttacgttccgttccggagtccatttcacaaacgtactctcagagcatgtcgctttctagagttgccggtaagctgttcgagctcaagctttttaaaattttatgttttggttttgctttattttttcacatctgaggtttctttcttcagtccacagaaaattttgtatgctaaatttgggaaacaaatctattacaagtcattaacccagttgaaatttaggtctgtcatcttaggctagcgtgcagtaaaggaagacctttgtagagtgaactgcctttcataccgctccagcgtcgtctccggcgtcgtcctgcttgtgctgatggtgtgactaggtgtatcgaatctgcttccgtttaacctcagacgttatcacacagcctaacgactcacattgagctctcagtcatgaactgcagaccacttttagttacaaagaggctagagcatgtcagtggcatgatgcttgccaagccagccctaggcatctaagataattacggtattttagtatgcggtgtactgccataggaccagaggtcagtaacagtgttctttctttcttgcttcaggtttatgtatatctgttaaagataacgtgcatgaattactttatctcaattatttgtcaccctattaaacacaagagattgcacagtgatttctgtccccttaatgaaagcgcctccttctgttctcctcttcccctcccttccacctccctcctcccaggtccccccccccccccccgttttttttcctgttgtagatttgttaatgctgcagaaagggctcctttgacttaagagaagataagtggaaatgaaaaagattcaggtaatcactcagcactttaccgtaattcagtagaatctacaatgactgctacattgccctacatatgtcataaagaatttgttctgaatgaaaagcttcttgattctagcagagagtcaattcgcctgtgaacttcacgatctgggccacttggatttagggatgacattttattctgagggttgatgaactgccacttaaagaattacatataatgaaattcgtctttattcagtaaacatttgtaatgggtagtaaataaagaacattagacttttcatcaaacaattgaggtttaattctttaaaatgtatccttactcattttactacattttaaattacattttacctttggaaaatggattagttatcaatgggctcttaaaatcgttgataaaaaaggttttactgtgttttttttaccatggacaagtctgataaaatatttgagctgctatatataagaataatatgtcattgagacatatcctaacaatattttgaaattatctctctctaatgggtgtcgtgagagttatctatgagtgagccactatttttatttttatatttaaaaagaaaataaaacttgtccattttcatgaatcatcattggttgatttcactttttgggtaaaagatgataatttgattttagggtttaatgtctttctcccctctttgcccagaagagtctggcttacccgctcatagagcagggcacatcttcacactgttttacacatgcactggaattttcgtagccctgtatgaataaggatatctttgctagtggcttccttcactacgaatagataacagaactggttcttacttagtcttgaaaactgcagcattgtattgcagtcaggatgcagctctccctcttctgtttgccttctccagaaatgtcccttggagctcttgaaaaagctgtttagtagctcaaattagcattgaatttattttagagtgaattggttcaggagtgcaacctcagataactgttagggccttcatcagacatgtgtgagaccgattaaaataaaattctgaagtttgtgttttgttttgttttttttgtccatggtgaggaaatgatctaattgtactcacttgaatcaaacaatatacatggtagtattggctggaattaatgtgcaggtctcaacattgtttctccagaaatacttctgaatttcagacgttctacaattttgatcatttctgtaaaagaaatggttattttattcagataccagtctcctttccaaatgcaaatgaattataggttttaaaatgtaatttttttgtccttacgtctg

SEQ ID NO: 25473 - DNA, 1100 bp, Mus musculus
gatctactgcaaaacgactttggtatcaggccggggatcgttttcgccgagatgccgtgcggaagactgcatttgcagaatctagacgatgcggtcaatgggtcggcctggaccatcttgttactgactgagaacttcctaagagacacctggtgtaacttccagttctacacttccctgatgaattctgtgagcaggcagcacaagtacaactccgtcatacccatgcggcccctgaacagccctcttccccgggaacggactcccttggcgctgcaaaccatcaatgccttagaggaagaaagtcaaggcttttccacacaagtggagagaattttccgggagtctgtatttgagaggcaacaaagtatatggaaagagacacgaagtgtgtcgcagaaacagttcattgcctgaaaccgagcacacaccgggccggctcctgttttgtaaacaaaatgatccatcttcacttgagagagtagtttctaagaaatgcttagacgtgagtctgcttccaagaaatctgtggcacacaagaaaggtacacttctgcagccctaggattgggctactttcgaatgacaaactcaagactgtcagagcttctgacacttttcttaaagttttcatagttcatgaatattcttaactcatttcttgtgttgagccataaacaggcacatgtggcaaaatacgatattgaaaattctcaaaagacttgagggaaatggctctggccaggacaggtctgaccacttcccttcctgcttctttcatgaattttagttaccacaaagcatcctggtgctgtcacacagaaacatgcagaatggggcacgtgcagtactgacatagtaagttggagatcagaagtagaggtcagggtcagggtcaccgttagtcccagcactagggaggcagaggcaggaagatctctctgagttcataggccagcctggcttacagagtgagttccagcatatccagggctacacaaagaaactgtctcggggggaaaaaatgtcagaacagtcaggcttttggaaataatccagccatgtgtggttttatttctgctggaatttggaactagttcc

SEQ ID NO: 25474 - DNA, 2753 bp, Mus musculus
aaattttggaccttaatgcagctattcatatgaaatacctaacaccaatgatctactttttcttggtttatatgtactcttcctacactaacctttggtattcagattccttttagccatttaaaagtccttttcttaataggtagttgatactttaaaataaaaacttaggtttattgtctgtgtatattacagaggaagaaaactgccttttaattgtttatagtgaataaagttgtgtttttaagaaaaccaaatgtgattaactgtagccaagccctattctgcactgcttaattttacgggggaaaataatctaccatagaacttttagtttaatagtgacacaattttcattgctatatcatgatataatttatttcttgctagtttgaaaatgtacagttttttgggttgttttttttctccattctatgatttataactagctatattatctgtttaaaaatcagactgttgtaactgttaggataaagaataatatgagacactatggtatggtaagtaaaataggaacatttttagtgagttctctgtcactgcattcctgggcttttataaagaagagaggacctgagtcctgtgagcattctggtgaactagttcttggttgagccattgccagcgtaggtcagcagttgtgagctcgtgtcacataagtgccatatgtcttatcctcacagtgtaatgcactgcgttcatttttatctctctccattttgtcttgtttctgcagtctaattagcagctctacaattaaacatttagaatgctgtgaatgtttcctatgtaaagatgtttagaattggtttgtattgtttgtgtcttgtaccttgtgtggattaagctgattgaaatgagattttgatccaagtgttcagaatagaatacacaatgatgggaaattgtataggttagaaagcttttctgctttttcaaaaattaaaaaacccagcagttgcttttcagctgtgccactcttcaccacaggtaacaagagctataaatgagtctccggttgtagagactttaacatatgacaccataggataatgactgactagcaattctagtcacttaaccattactgactagaagttaactaagccatcttaaaatgcgcccagggacaggcgcaggcacacatacttctgcatgcaagagcaaaatgaattcaagttgtcttgcttactaatttcagatgtcacagtgtaggagtgaacatgttttcaaccttttaggattcttgaagaccagatcactactccttagacgttgacaaacaaattaagaagagaagtttaagatttttcagacttaccatttgagttgttgtattgaagtcctatggctttttaaatgttccatctacttagttgtgaatgttttaagcaccaacgttaatgtgattgctaagcacgggcatatgtaaaattctatgtctccttgccagtagactctggatacttacactgtaattaaatggagtcaggtatagattttgccaggtttggcagacacgatgcctgcatttaatctgtgcctctcaaaacgtcctgatagtaaactattactataaatcatttttaatgagactattgagtcaaacttgaaatcaccagttacccagtgtcaggaatagtatgaatttagcttcatctctcagtagctggctaaattttgacagctatctgttcataagaaaatagatacccacacataaatgctatatgatgtttttcttcctcctatgacacggttcatagctggtcttttttctgtaattcttacataagttgttaaggagtttgaatttcccaaatatttttgtttggtcatgactcgatacatatttgaatatcataattgtatatatttttaaagtagaataaataatggaaagcaacttgatacacgagtttatactgaaattcaactggataaagatatgttttacaatattgcttagctaataatctgaacattcttttatctattaaaaagcatagtttgtggcttacaacttttcccctgggctaagtagtcacctttgacaatacagtggactgaaaagcaggttactgaaaggtttcatttatatctctgaactatccattttttttgtttgaatttctaaatgtaaaatctatgtttaaataggataaagctgactgttgacttttgttttcaaaaattagacaaattaatatataaataattcaaaggatttttgtttactttgaaaaagaattttctctgaattaaagatggttccacaggattacagcaatcagttccatgtaaaataaaaagaaaaaaattcagcaaattgccttcacttgtttctctcaggatttaattctttcttaaactcctttgaagaccatatagcttatcctgctgttagggtggtcagtgttgccatgtcaacttcaatagtttcgggtgtcatggggagacggtgttctgagattgcaaggtgtatagaaactagccaggtgtggtagtgcatgcctttaattctagcactgggaggcagaagcaggcggatctctatgaggccagcctggtctacagagtaggttccaggacagccagaaaggaaaggaaggaaaaagaaagaaaagggctggagaggtggctcagtggttaagagcaccgactgctcttccgaaggtcctgagttcaaatcccagcaaccacatggtggctcacaaccacccataatgaga

SEQ ID NO: 25475 - DNA, 1178 bp, Mus musculus
cgccactccgggaagacccgaggggcagtgggcagggagacccggcaaagcggcggaggaagaggcctcgctgaccggaagtacagcgagcacctacgcggaaggggcgggaccgggacgggctccagtgacccggatgtggtatctggggggcggggcggggggtgggaaggcgaggcgatgcagtgaggacgtggaagcgcgtgaggcctccgcggtgcgtgggcggcgctcctggggcgaggggcggggccagtgccgggaagtcgacggaaaggggcgtggccggccgttgcctaggaagggcgcgtcgtctctctgctcgtccggctgtgacggggaaggggtcccgctgcgttttggtcactgtgagtaccaagtttgggggatccccgagggactctcgagagctcattttagggatgcaggggctactccccggtggtagagagctttctagttggcaggaggtttcgtatgtggaggaggccagcttaggcagaaagcacatgttctcagagatgaggacaagactaagaccgtctaatccctgatctttaccttccggcccgctgacctgggcctggatgctaaagccctctgctttcgtctaaacagcgctaaatagtaaacagtattgcctaagataaatgcggattattacccgattcagtgtcgggaaaaggcagctaggagagagcggctggcacgtggtaagcacacggtaagtttcggttaaattaaaacaaccatccgttgagcatctcttagcaagctccttccacccttcaaacaatcagtgatagtgcgtctgtttcactgattagggagctaaggctccaacagcagcaaaggaactaatccgcctctgatcaacatggcgtttcttacagggcattccttatacgcttcccacgtgcgtaacaggaatcgggtgttcccgggttttgttttgttgttgttgtttttgttttgttttcttagtgaaagaggcagggtgggctccaggccgctgaggattaataaagagattctatgaggaggaaataacaggcaggtggtatgatcgaggcaaggccctgaggaaggcttgggtggggtgagtagaaccagagccggaagtccactcagcagcctggggcacttaaagcttctgctggggcaaatggtaaggcggc

SEQ ID NO: 25476 - DNA, 2363 bp, Mus musculus
gtgccatataagagggaagctgagaaaaaaggtttggataaatacctcggacattatattgattggtctacgagactatcaagataacaaagctgatgtaatcttaaagtataatgcagatgaagcaagaagtctgaaggcctatggagaacttccagaacatgccaaaatcaatgaaacggacacatttggtcctggggatgatgatgaaatccaatttgatgatattggagatgatgatgaagacattgatgacatctagcctgacctaagcatgctaccttccaagttctctgaagatagctccacacagtggcatcttgaccttcatctgttaagtaaaacttcatggcatgtgtatgacttgttaatgcaagctaatgaattttattttttgaagtactatatttctttgaaaaccaaagatgttgagttatcatcttaagtgacatgttaacactttgtgcttttgaatataattgaacctagcgcacagcagtgagcactgttaagagactgcctttccatttgtagcttcatttctggcacgggagtgttttgtgtcagcagttctgccaggtggccatcgtgagctgaagtaagtcctagtccagcacatctgcttcaggcctttgtactctagtcatctggctgcgttcgagacttctcagcagacttatagatgtgtacggctgcacttggagtcagacaagatatggctacttttgtacttatggagccatgccattttatactttcacgttgtatacattcgtttgatcctttaagttgttgccacccataaaaaggcatcttacagtgcagtttttaaattacatgggtagcaattttgagttttaaaaattagtcattgcagaaattaaatacttagaggagataatccattatcttgactttaggaatataatagttgacaatgtttatatataattttacttctctaaggcatacccaaaaatagaaaatgaaaaagagcagtgagtctgttctgatgcttgcattgcatagagaagttttccaacaaagcagctgttaataacacataaaatatgttttactttgcaaagtaggttgtgttaagtcattttcaaaaagttacctactatatcgaggctctggataattactatgtgttgattaaagttagttacagaattgtacaagctaagttttccttaaactaagcttaggttaaagggagaggagccacagctcaatgaaaacacggttcctgttttctaaatggaggcgcccagaaacacaataaaacatgttggtacaaaaactttttctttttaatatgttcattgtatctctggtatataacaaaaataaatgactgggtgatttctggtatatcatgagaggctttttttttttttttttaaattagactctgggatttaaatgggacttaactattttcccatttaaatgacgccagtattggggtcctgcagcctaaccctgctgcttagggagtgagtataaaccgcgactgtcagtcctcagatgccttcctttttaaagactagttctttctcaggtcttcttcttgacacctacaaatggtgcctgaccacaagacgacagtattcatcttcacttttattttttgattgcttgttttctagttaacccagaataatatagcttatgaaaatctcccagtcaggaagaaagaaagaaagagaaagaaaagcaaatatgattttcctgatcattgattggtggatctcttctagatggagatatgtagatctttgtaaaggttaattttataaagtgagagtagacatggtacccacacttagaagcagatcccacatccccagaaggacagtgtgtgtttagaaagaacacatcactggagctttttattgctctacacagtgtatctaaataagctgtcaactacaatttatcctattgctgctgtaaatttttatgacagaaagaaaacctgaccatggaccagctagcttgatggccttcagcagcaaacaagaaactgtccaagttaggaggtgaggactagtgcctgaagatgtcctctcagtccacaacatgtacaggtgcccatacacacatcagcactcgcacaaagatgctctggaggctatagtagtgtgtcttggtcattgcaaaccatcagaggcaaaccctgaggtattcccatttcctgtttcctgcttgcagtgtctacatttctctcccattctaatgaaggaatgattcttttataacatgagtgattttatgctgtttataaaagtaaatgttgacatgtgttagaattaaaatgacttagagaaatatctaaatgttttttttttctttcc

SEQ ID NO: 25477 - DNA, 1169 bp, Mus musculus
aagacaaagtatttaagccatgcccaaggtaccctggttttgttgaatgtttataaatagtgatatatgtgataggaagagacatcttttgaaaacagtagtatgttatagaacatactacatgtattttttaaatgtatgagtgctctgactgaatatacaactacatgccacaagagggcatcagatccctttatagatggacatgagccactgtgatagcttggaattgaacccaggacctctgtaagaaaagctagtgcttttaactgctgagccatctcaccagcccaataggactctttaacagaattaatgttttatatgttgtctttttcttctttatagtgttttggcagtgatggtaaactggtcctgcattactgcaaatcccaggcatggggatgagccagaaatgaacaacttgatattttcacagaagaaaaaaaatcagagacatttcggtgctgtgggaagagacttactatcaaatattcagcatgaatctgttaggacctgtgtttatgtataagaaaacatcatagagtatatagactaatgaatgagatttgtgtcaccataaaatcatcatgagagattgacgttagagtgtgccattactcccacacactcctgttccaggtcacgttagaaaggagactgaagttgtatgtggattgcaggtctcaggatgactgaaggcatttacttggttggcactatgttaattccgtgataagaactaatttactgaagggtttgtgttttgaggtaatttagtttttttgcttattcaggggacctctatttgggatatagaatgtttacatttatctgtattgctctgtaaaaaatagtgcactgatctaagttgtccggtagagggcagccagttggcaaaaaggcttgacagttttcatggctttgccaggtgattgggggcaagactgttgaacctaatttctagttaatgtgtaatccggaaagcagctgtgttgacacactggaggatgtgcatagtttaaaattaatcatgcagggacacagttttacaaattgtgagcagatgagtctcagctcttcagtcctgtcatttctggttcttgcgcctcatcctgggcattgtgatccatacctgctgtctcagcgctcaggacacctgagcagga

SEQ ID NO: 25478 - DNA, 2157 bp, Mus musculus
cgccgctgggtctatgatgccatcgtcaccgagtctggcgaggtcatcaacaccctgccatttagtgttcctgactaggagatgttatgcatagattcacggctagattcacccctctcctctctcccctctcccctctcccctctcccctctcccctctcccctctcccctctcgcctctcctctcccctcctcccccctgctcccctttctctctgcctgcgtgtgctttgtgtgtgagggtgtgcatttgtttgttttgaaacagggtcttattctgtagctcaggctggccttgaacttatggcaattctcttgccttagcttcccaagttgtattaatttaggtatagtacatcatgcctggcttctattccttctacatgcatgcatgcatacatacataccaacaaacattcatgaatgaatgtatggccctatagagaatatattttatatatgtacacttttaagtcaaacttctttctcttggatacgtgttggtgcaacagatggctgtagaccagacaatcattgtatagaccctctcagcttcctcagctggtgaccacaggctgcaagagtggacactcaggcttcctcattagcagcactctcaactctgccttgaagctacacctctcccttctcagggtgtctggtcgagaacaccgtaattttaaggtttgcagaactctgcatctgaaaagctgttacctagaacatacaaccaaatgtatgtttttcttagaatgtcacatattactaagaaaagccaacttgttctttgtactgtatatctttagtcttatttttttatattttaatgttcaacttaaatttggtaattacaatatttttattaccaaacattcatattgtactaaattgtatatagtttactaaattgagaagcaaagacttgaatatgctaaaagtctgtgactaacccatttccttactggatcagtatttcagggtttgttttttgtttgttctttaaggaagttagccttcagtgatacccagagtggcttgtatgtttactagttggatgtatggatgggcagctgacagaaagcatgacgtggctggctgtgttctaacatatggtagcaggtatctggaaagttgaattcggccttctatgtactcatttctttgtgctcatgtgcaagtgtgtgtgtgtgtgtgtatgtgtgtgtgtgtatatcttttgtgaacttacgtacatcagtgcaggtgcctgcagaggcctgcgatgttgggttcttcagagcttgcgttactggcttttatgaaccacttgaaatcagtgctgggaaccaccaaacttttcaagagcagtatgtgctttaaataactgaaccatctctccaacaccaaatgtactaattttccccattttgagtcagagtttcttttatgttcattgtctggggggctcgcaaatcctcagttactaacttaaggtctgtactgtgactcaatttacatttgaaacgatttcccagatgatattgatgtcacaggcctgggggccatgtatgaaaagcacttctttaagttacagtagatatgtaatgcaaggaagtatttaaacagtgggacttagtgacttggtactattttaaaccaccaagaattctgttttaaataaatgtgaagtgttgaaagctgggttttcagggtttcttttttcctccatgttttgacatgaaaatcccaaagattttactgtgcccatgggactcctgacacataacaggagaatgtaggttccctgctctgtttcccacagtttacccgcttttctggattccagttacttttgtggctgcctgttgaacccagggctttgtgcattcacagtaaatgtttatcactgaactgcacccaaaattctcaagtcacctttttggagtatctatgccctaagccaaacactatgccaagtgtctctcattttgtgaccatcagccctcacggtcctgagagaaaggtgagtgaaatcacacaagtcacatcttttggaagctcactgaggctaaaaggatggcggtccctttcacttatccattttctgaatagtgaacctgctgtactccgtgatgacttatttagtgtgcactgtttcagctcatgggaaggatggat

SEQ ID NO: 25479 - DNA, 1119 bp, Mus musculus
cacatactcaaatatacataatttaaagtattaaaaatacatttgtgaaaagaggaaaagtaagataaaggtaggccagtgttgagttctaatgtaactttcagagaaagaaggaaaagagagaaacccatcaaagttggtaagtgtggtctgagaccatttgaggcagagaaaacaccagattaactaatggtatttgcacatttgcaggcacctgagctacttcagtgtgtcactcccctcttggcactgtcaccttctttcttttgggttggccttctttcttttgcctgacgctcccacgttagttcatcagttactatgcaccagcctttgttctgtgtgagcttagtttctcattggaccttccagattgataagtgggtcacttcgtttattgtcccagaggattgaaaataatttatgagttaataaagtaggtactctgtttccatggtcatcactttgtttcctgtcttcagtaagatacctgatttgttcaatgaatcctattcttacattctttctggtactgtctcactcttaaacacttggatagccttgaagctcccctgaggacaggtgatttattcccatctgccagctggaggagtgagaccatgccccgatacaggactgggctgagacgcgttccactcactcctgtgagggctttccgtatgatggacttcttgcagtgttagtcagagaactccggcgtagggactggcaaagactgtgcagggcttgctgggcgtagatcagcaaagttcatggaggctctgcatctcctgagctattggcagccttgccgacaatgatggtcttacttagaggagactgttcccttctagacaagcatcttcctttaccctaagaaactgcctccgccacactgttgctcctcagcagttgtcgcaacagtttgctctgtccttagttaggcactcaagagtacacgtgtgacttttagcattggagttgtcctttgcattcttgagaccctggaaacacatgagaccttggcgtctaccgaccagcgaagagttgtatgtttcatctcatgcctactctcaggttcacacctattcaaggcctgctaaactgaattgtctgcag

SEQ ID NO: 25480 - DNA, 1189 bp, Mus musculus
acatttgtttctatcttaagttgttttataaagggaaggctttcatataactaaaggttggaatctgtttaatgcaggggttttggattgaaggatttttctagcagaagaaagcatcttgcagttttctggctgctgtaggatccgtcgtgaccatgtggctttggggacatttgggggtagctggactaatgcagctgcaagtgcaggttcaggctgtgtcattcaggctgtgtcatttcgtttctctgtcgctggttagtatttccctttaaaagccctgtgatgacctgtggactgtggggtgaggagatgtctgactcagtgttaggaaatataaatgcgcagatcgttctgaacctgaatctctgtattgttatggaagtgtatctcagtgacagtcactcagacagagcaggatcattgtacaaagccacaaagagtggctgttacccatggttttattaacagtatctagtacagaggggtatttttaagctattcatattcacagaagtcagagtaattctattgatatttattggaaggacatatatgccactaaaactaccttgttgtcagttgtgaaaaaactgatgaacaagtagtcttagactcacagagctgtagtcattactttctaatataaaaattcagtagccagatccgctacctgtgccttgttgattagagtaagtgtgccatgtggtacttaggagtcataggtgtcgaggcattagtctgctcccttttaagaaaaaaaaaaaacattatgtttatggaaatagacagtgtatgcttctatttaaacatcctactaacactctgttagtcactaaaatgctaaatatgtgcttgtgaatgtcttgtcacgatctgtttggaaaagaactaacttttaaatgatacatctttatcttcatagatgggtatcacatgttactaatatccaaatttatttagaaaatacgacattgaagaccacctaaaattaagttatccttttcatgtgagaaatattaaagctgagaagtttttatatgaatgaatttcttttttttttttttttctagtgtttattgggggaaggggaagggtgaaagaccatctcggagtggggatatgagggagagatagaggcagacaggcagacaggcagacagagagagaacaagacagaatgagggag

SEQ ID NO: 25481 - DNA, 1218 bp, Mus musculus
cctgggtcctgctgccatttagactcaaggagaggaattgagagagccctttaaagtcagtgctcgacaggtgaaattggcctgttgggtctgttttcagaactcaagactgtttgctggataattcataacttgatctctgtgtaaattatttacaactggatgtagttccacacaaattgcttcattgaaatgcaccattattggacacatcagtagcttctccatttgtacactgaattatatttgatttcaagcattcacataagcagtctatggtgcctccgattccagtgctctacaatattttacccctcatcaaaggtatatgcattagatggttttcaccttagagaagtcacatgtgaactaatagtattttttctgtgtgtctttgctttaataataattacagaattgaaactttttttaatgtgatctatctccttttgttttgttgttttgttttgaaacaggtggtgtttcaaatgggtacctgtcagttagcataagtgactggcatagcaatccagtgacagtgtccacccttgcccgctactaatcccatgaagactctcttattccctctgattctcatgtgagactttccgtttcttctgcctccactgacactgcttctgcagctgtgtccgccctggcccagcctctccagctatgacagctggggagttgcttttacctcctgaaaggggtcctgaccttgcagacatattagcctcaaattattagcttctgggttttgttcattagtctacctcctctgcaaacacagtcctcacttttcctggggggggggggggtgtcccagatggcttccagtctgcaaacggtacttggtcctggcaagggccttgtgtgatctgtccttcttcctccctcactatcccagcccttcttatgttattccatttacactcttgtcctgatgttctggaagacaccgtgcagaccatctcctagagactattgaagttccttccatttgggttgttttaatcctggatatccttgtgtgccccctcactattttggggtttcaatcaaatgtcagcttatttatgacactttctccgagctccatatgaaggaatagttctccaaatcttcggtttcaaactagctacacgggttattagacaggctatatattcttctttgtttattgtgtagtgagctcctccaccagaattcagattc

SEQ ID NO: 25482 - DNA, 1187 bp, Mus musculus
ctctctgccatgatgataatggactaagcttctgaaacattaagcaagcccctaattaaatgctgttttaaataagagtttccttggccattgtgcctctcttagagttactgttggctgtgatgaaacaacagggacaaagcaacttggtgaggaacacatttatctgacttactcttctatatcccagttagttcatcatccaagggagtcaggacaggaactcagtgaagtacagaaggaacctgaaggcaggagctgatagagatcataaaggggtgcagcttactggcttgctccctgtagcttgctcagcctgttttcttacagaacccagaactacctgcccaggaatggcaccacccacagaaggctgccccacccccatcaagcactgatcaagaaaatgccctacagcagtggttctcaacctgtaggttgtgacccctttgtggtctcatatcagatatacttcatattcaaatatttacagtacaattcagcaaatttagagttacgaaacagcaacaaaaataattttacagttgggttcactaaatggtaaaaagtaagcaatctagtagctaatgatgagtttagaagatgaggcctggctatagtctacaattgtagtactcaggagactgaatctggaggactgggagttcaaggtcagaatgggctacaaagaaacatcctgtctacattaaagtgggaagaggaggaggagcaggaggaggtggtagttactttgtatcaatcattttagtggaatacacaatgcatactttacaaagaaatacaatgtcattctctcgagctgaagttaggaaacatcacctgtatcctctcctgctctcttactgactcagccagtagtcatgttagtcgttttctgctgtccaaagctaactctattgactgttctaatgttgtgtagtagtggggctggagagatggctccgcagtgtttggtgttcccagcacctgcatgggagcttacaactatgcgtatctccagttatagaggatcctgtgccttcttcaggtccccaagggcttgtgcatatatgatgtagtatgcagacagacagtcatacaagcaaacacacatgcacaataaaaagtacgctaatcatttcagtaagtctttttaagatgtatagtagttttgcctattttaatgc

SEQ ID NO: 25483 - DNA, 1126 bp, Mus musculus
cctggggtctccagtctcttgagggttaggtgcatcttctctgactgaacccaaacccagcagtcctctactgtgtgtgtgttgggggcctcatatcagctggtgtatactgcttggttggtggtccagtgtctgagagatctagggtgtccaggttaattgagactgctggtactcctacagggttgccctcctcctaagcttctttcttcctttccctaattcaacaacaggggtcagctgctttggtccactggttgggtgcaaatatctgcatctgactcagctgcttgttgggtctttcggggggcagtcatgataggtccctttttgtgagtgctccttagcctcagtaatagtgtcaggctttgcgacctccccttgagctgtatcccactttgagcctatttctggaccttctttttttttttttttttttcaggctcctctccatttccatccctgcagttctttcagacaggaacaattatgggtcagagttttgactgtggaatgggaaccccatcccttacttgataccctttctgcttgaggtgggctcttcaagttccctctccccactgttgggcatttcatctaaggtccctcccattgagtcctgagtgtctgtcacctcccaggtctctgctacattctggagagtacccccaacctcctacctcctgaggttgcctgtttccattctttctgctggccctcagggcttcagtccttttcctcacccaataccagatcaggttcccttctacaccccccccccacttgtcccctttccctcccagctccccccgccccgtggttgctttcttttccttctcaagtgggacggaagagtcctcacttgagcccttcagtttattgacctttttgagttctgtggactgtatcttgggtattctgtattttctttttcttttttgctaatatccacttattagtgagtacataccatgcgtgtccttttgggtctgagttacctcactcaaggtgatattttctagttccatcaatttgtctgcaaaactcaggatgtcctccttcttaatagctgagtagtattccattgtgtaaatgaaccacattttctgtatcaattgttctgttg

SEQ ID NO: 25484 - DNA, 1146 bp, Mus musculus
aagaccagccttaagtcatgatgatctgatagaatgcatgggattattttaatcttcttgtattggttgaggattgttttgtgaccaattatatggttgattttggagaatgtaccatgatttgctggaaagaatgtgtattcttttgttttagggtgaaatgttctgtaggtacctattaaatccatttggttcataacctgtattagtttcactgtctctctgtttagtttctgtttcaatgacctgtccattggtgagagtggggtgttgaagtctcccactattattgtgtggggttcaatgtatgttttgaggtttagtaatgtttcttttatgaatgtaggtgctcttgcatttggggcataaatgttcagaattgagactttctcttgctggattttcccctttatgaatatgaagtgtccatccttatcatgcttgataacatttggttgaaagtctattttattggatattaggatggcaactccaacttgtttcttgggaccatttgcttggaagacctttttccatccttttactctgaaataatgtctgcctttgttattgaggtgtttttcttgtatgcagcaaaatgctggatcttgtttgtgtattcagtctgttagcttatgtctttttatagaggagttgagtccattaatattgagagattaaagtcagatgactattggctcctgttatgtttgtttttgtaggtggctttctttatgtgcggtggttctctccttttatctttgttatatgtttaatataccttggtgtaggtaccttccttgtgttggagttttccttctaggatcctctgtagggctggattggtagatagatactgtttgaatttggctttgtcctggaatatttttatttctctatttatgctgatgagagttttgttgggtatagtagctcgggctgggatttgatggtatagtggtgagcatagtttccttccaagtcatcatttcttatctgaactaaatcagcaacctcatagctgctttgtccacagcctgtttggccagttctaatcagttttcaaaggaaagcaaaattgagctattgactgtaaatagaattgtgtcactcttagacctgaagtcttcagtaattcccattgct

SEQ ID NO: 25485 - DNA, 1441 bp, Mus musculus
agagttcctgctgcctccgtttccctttggtttgcatgtttctaagcattttgtatgcggtttattcccctcactcactcactgctgtctttattttgtctctgtaaatagctggagaccatacaagcgcagctggactccctcacatgatgttctggaagactggcttccttcgccatcacattccggccacctcactctttcgcactgaagagagactgcccaagtatattttctagaggattcggtgacactattgctacagataatatgacttattgcatcttagacaaatagcagtgatgggagatcacaataggagcactgggtttcgagtgtgccttctcgcctcacaggagccaagagcaattgttgagaaaaacgaaagaagtaagaagtgaatgccatgctgttttttctttttttctctctctttaacaattattttattagatattttcttcatttacatttcaatgctattccaaaagtctcctataccctaaccccaccctgctccccaaccctcccactcctgcttcttggctctgacgttcccctgtactggggcatagaaagtttgcaagaccaaagggcctctgttttttctgtcagattgctttcagggatcagggaaggtctgtaggcagaaggtatgatggtgccctagcagagtatgaaaccttactcattacagtaattaattagggaagcagccgcaggccgtcaaatgttttggcatttgtcctgcagtgttcttttgcttgaagtatagtgcaagaaagaaatctaaaatggtaccagtactgctgtgagttcatcccactgcgctccccttgactccccctgaaggttcctgacgttaatgacttcaaaatcatctaggtttacatatatctctgcagattactaacagtgcacttctcagtgtttcagattgcaaatgaaaattgacctgtaatgagtatgacatgggaatcttacattttcactcgaaaactttatgcatcctccttttatggatatatgtgttcactggtttcagtcaataaaaattttctacctgagaattatttaaactcaagcgtacaatgtttttattttataaggtactttaagctgtgactctacataaatacatggtttcctgagagggaaaactcacttgaaacttgtgttaatgaaatgtcttcccttgtttccaggctcagacataggctgcttcatatgaaggaatgtggtttcagaacgtcctgcagttaagcaaacagagcagttacagttgagcacatttctcatgagagggtcctgggtactacagtgctcactcacccccaatcagagctcactatgcaccacagtacctgtactgttaatgaagaatgttgttgcatagaattgaaagttggggttattgcagaaggcaagtgatacaggtatt

SEQ ID NO: 25486 - DNA, 1207 bp, Mus musculus
gccaaaataaaataaaaagtctaccaaaaagaaaaaaaaaaaacaaacaaacaaaacatagattttgttttgtgtcagccaagtactcctgggcatggagcccgccctggagtgtggttgatatacccagtggcattccattggagaaaacccttgccagcaggtctcagttgaaaataccttctttgttagcaaggggacaatgtaattaattttggagaaagctctcttggctgctgagaagaaaatatatcctctagtgtttaagcggaatgctctgtagatgcctgttgagtctgtttgatttatgatatttgactccagcatttttctgtctacctggatgacctgtctactggcaagagtgaagtattaaaatcatccacgagagtccggagctgcggtggtggcggcgaaggcgagagtcatggctggacaagcttttaggaagtttcttctgctctttgacagagtattggttgaaaggagtgccgccgaaactgtaaccaaaggtggcattatgcttccagaaaagtctcaaggaaaagtgttgcaagcaacggtcgtggctgtggggtcaggagggaaaggaaagagtggagagattgagcctgtcagtgtgaaagttggagataaagttcttctcccagaatatggaggcaccaaagtagttctagatgacaaggattatttcttatttagagatagtgacattcttggaaagtatgtcaactgaaatcactgttgaaatggtgtcacgtgaagctgccattccactgatgtctgaactatttcatcatgtaaataacttccatgcctcccttttataataaacggatgatgcctaaactgacagccattgtctctgacctttagtttcactgtactgttacaaacatttccaaataaaatgatgtaaatgaaaaaaaaatcatccactattattttgtggaggtcaatgtatgattttagccttagtagtaatacttcttctataatcttgggtgcccttgtgtttggtacatgaatgtttagaattataatatcctcttggagaattttccctttgaaagcacaaacagttttcatgagattttccctatctctgattagttttagttttaagtcaattttgttggattattacaatggtgacacatgcttgcttttttggatacatttgcttggaatatctttttttttaccc

SEQ ID NO: 25487 - DNA, 1138 bp, Mus musculus
agagaaagactgcctgagtttcagatgctgttagctatgtatatagtccatagccttatgcaagataatacctctctctgggcttcagtctcctcattgctaagatggatgtaataaatgttccatttcttaactggtttgttgagaaaagtaaatgggtattatatttatatgccacacacttggaattgtatatcttaatgttagctatgatgatgatcatttgcagtttataatataaaaattgaaaaatcaaaattgtaacagatattatagcaaatacggaaataattctcagaagcaaaagctaacagttaaagtgattgcttcttggacatggtgtggggcactgggctatgcacagacaggctgatctccagttgagctgagatgctgaactccaggacctagtggtcataatttaccttcaggctaaactcctccccagttacctagcaacagaaaagatagcagctccctaaaaggggtggttcagcccctcctctcctctctcacttctctcattcctttgttctcttacctctcacttctctcctctgtcctctcctctcccctcccctcccctcctctcctctcttctcctctcttcctcttactttctttctctagccttccccccaccccctaccttcttctttctccctgcctttctacaataaagctctaaaaccatagtctgtgctcatcaagatccgctgtgctcactctcccatgcctgggaacctctcttccctctctcccataaccctggggctaaagggtgtggccttgggccccctaggttgggctgccccttgtccccctcaccccgtcgagtgggtcagaggcttggatgcccaccagggctgagtggaaagcgtctggcagccctcccgagtccagagcataggtggaactctggcaggacgtgggttcttcctccccccgtctttctccaggcccctttttagttcccacagacatggtactggggtgtacacatgggaaaattaggacatttaaaatctttgtgactatttaatttgacatatataaatgtattactttaacacagtggcaaatttcctgcctccatagaactaatgatagagttgtgataacagaaaagcttcttgtg

SEQ ID NO: 25488 - DNA, 1219 bp, Mus musculus
tctaatccggcttgaattggctcattttgccaccagagaacctatcacacataaaatacataaatctaaaagactattgtggttatttgaattggtttgtgaatcttaggattttttgtttcttctacgaagaatgaaattgtgactccggtgttaaatgtagatatatttacaattgctctgtttgcttaattagttacttcctttattaatatgtggtggccttaactcttctggctaattttggtttgtgtcttcttttaccagatatcagccatgtttttggcctcagttctcttgatattgcttttgatctttgcctctcagtctgtgggtgttttattccaatgggatatttgctttggagacaacagacagttagatgtagtttttgagtccaggcatccagtctatgaccttaatggtgagttgaaaccatttacatgtcaggttgttgctgagaaatgtttactgtttactaaatcctgtaatttgttggttcttcctttgcttggctgggttattgtttttcattttttcacttgctaaaattagaggtttcctagtttattaatatagacaagtggacttcctaacttttttttttttgtttgtccttcctttcctgaaatttatttatcatgctcttaggacctgagactattttttttttccctgcctctgggtccaggccttttgttttgtcctgagttctgttcttgatgtgaaaagaaaaaagtatctcttcatgaatgacaaggccctggtaacttattgactacttttccattaaagacaactaatatttattgaagttctttaatattaaccaattaaattggtcttgtggtgagtcgaacctatggctttgtgagtgctaactgctataccactgaattgtggtatactgccaagcccagaatctctatggatggagaagaatttacttaaatctctttcataatttcatgtctaaagtattttattaaattcattaatgatgttttattttgagcttacatagctttataagcctctctagttataaaacagagcatgatgttgactggcgttgtgttaggatgacgttctatctcatcttaaaaaactcactggttctcttttctcttttagccggccccagaaagtgtgcttatgtccatatctcccagtgcgcccactccagatctctacccacttgtacataatccagcatcca

SEQ ID NO: 25489 - DNA, 1217 bp, Mus musculus
cactaggctcaaagtgagcctgggctcctccacaagcctcaaagagattggcttttcttcaggaaggggcggagcagtaggtacgtttgcgcctcgggattggctcactcacgactagaaaaggcgttgctgccgtgtgtcccactggccattcgggagccgtgaaggacttctcgcgatactttggcgcaagggccggagccgcgtagcgagcgctggcagctgctgagggcggcggggccgcggctgggctggggccgctctggtgaggagcagcgcggactgccgcgcttctcgggctgtgcggcccaccgacccggctcgggaggatcgtgtggacagctcggtccccgcgggccgcgccccggtgagcggacgcccgccggcttttacctgggcggccgtgacaggtgcagagcgagcgcggcgccgcactcgctccccggcccgcccccctcaggcctcggccgcccggctcgggatgagccgcgggccccgaccgaacgtctgcggcttcgggcgcctggcaccgccgcggaggagcggccgccgcccctagggggaaggcgcagggagacggctgagcacgggcatgagctggccgcggcggcggctgctgcgggactaggacgccgccatgaacctgcaccaggtgctgaccggcgcggtgaaccccggcgaccactgcttcgccgtgggcagcgtcggcgagcagcgcttcacggtgagcgcgggagaggccgcacggcctccgctccaggcagcgcggtttggggcttaaaaagaaagaaagaaaatgtttgactgacttcttctggccaaagtagttcctccaaaatgttagaagaatcacgactttggggttcgggggatcagcgatgattttcccgctgcataggcctggaatgtggaattcatttacattcagtagttcggatttgctgctgctgctgcttttttttttcaggtcaaggttctaaggtcaagtctttgtagttaaaagagtgggtgtcttaaaatggttactgattattaagctagtttaaatgacaatagaatgaaagcggcgcctttctatttattttcccttaaaagttcaccgatgaaaaactttgccaagaaaatagtctccattcattcctcacgtcctttgagttacttaggcaacggccttgtagtccttgaaaagttttgttcgaggtaattcccgagggttt

SEQ ID NO: 25490 - DNA, 1655 bp, Mus musculus
tgaagatggacttgagaacaatagtagtgttactgtccctggtagacctgtagaagtgagctgtgcacatacaagtcgcttagcagtagcttataaacagcccactggtaatagtagatctcaggaatttgtgatgcatgtaagtatctttgaatgtgagtctacaggaggctcatgttggatccttgagcagacaattcatttagatgagttaagtacagtgttggattctggcattagtattgatagcaatttagtggcttataataaacaggagacatatttagtcagtaaagaaagtattacatcaaacacaaaacatttggttcacttagattggatgtctagagaagatggttctcatatcttaactgtagggattggctcaaaactttttatgtatggacctatggctggcaaggtacaagatcagactggaaaggaaaaccaggcatttcctctctgggacagtactaaaattgtacctctttctaaatttgtactgttacgaagtgtggacttggtttcttctgtagaaggtgccccaccttttcctgtttctttatcatgggtccgggatggcatccttgtggtaggaatggattgtgaaatgcatgtatattcccaatggcagccatctaataaacaagaacctgttatatcagagtcatacaatggaagcactccatctatactaagtttaataaaacaaagtaactcatcaagttctgggctacatcctccaaagaagactctgactcgatccatgaccagtcttgcacagaaaatctgtggaaagaaaagtatatttgacccctcagtggatatggaagattccggtctctttgaagccgctcatgtactttccccaactttacctcagtaccatcccctgcagcttttggaactcatggatcttggcaaagttcggagagccaaggccatcttgtcacatcttgtcaaatgcattgctggggaagttgtggctctgaatgaagctgaatccaatcatgagcgccgccttagatctctcaccatcagtgctagtggaagcaccaccagagacccgcaggcattcaacaaagctgacagcagagactacacagagatagactctgtccccccgcttcctttgtacgccttacttgcagcagatgatgacagctattgctcatctttggaaaaaactgggagtgagagttccttaaagaaatcaaaacagttatcaaaagaaagttatgatgagctttttcagacttcagttctgatgtctgataatcacatgttagaaacagatgaagaaaatactcagcccagagtcattgacctttcacaatacagtccaacttattttggtcctgagcatgctcaggttctttctggccacttacttcattctagcttaccagggctcaccaggatggagcagatgtctttgatggccttagccgatacaattgcaactacaagcactgatattggagaaagtagagacagaaatcaaggtaaaagtaaattctgtacaagatggaaagaaaaaagatagttttacttgttttttaagagtatgatcttacataaaatgatacggtgccttttttaaaagctaatataaaaatttggttttttttaacacttttaactctgataaatag

SEQ ID NO: 25491 - DNA, 1169 bp, Mus musculus
aggttttgttttgattcaagtataaagaaatagtcctctaaatgtgaaagaaatggagttgtaaatgttacttactcaccttccttttcaaacaatcggaatcaagctgttcaaaattccctattaaaaggagaaaattacaattagtagagttatagttatagaatcctgtaacataagaagtgagaaataagttgacgttcagccaaactatatttcaaattaacactatttgaatatatattctacgtttatacctgctgaagaacaaatctagctctactccagaaaacagaataaactagaaaaaagggctaggtagtgagaaagtaaaacaaatataaaaggaataggctatcagagttttcaaaaaacagtagagtagtaaataaacaatatgaagtttgccaaaaattggatatgttcactaatcatcactcaaaattaaaacttggtaaatattttaaattttgacagttccttgtgctactaatatgtaagaataaataagtagcgaatttcaaatattttgcttaaaattgattttaccttcaattttcatatttttacattttttgaactttgtgggggggggtgcaagagcatactgtggagtctaaggcaacttagagggctttccttccttccttccttccttccttccttccttccttccttcactatatgggtcccagggaacaagatgagatcatcaatcttgccagcttcatctttcaattttaattgatgcaaagcattcccaattctaaatttttagtctatataattataaagaggtgtacatttatatgaatgttcaaagcagcaccttttataatacaataagttgaaaactgtctataaaaagaaagtttacaattgtaagacaactatacactgcagtgccaccccagtacaagaatagctagatttctatgtcttgatgaggtcagttaaaataaacttaaaatgtaaacttttatctgtatattatccaatttactataaaaatctatatgagtgtttgaatattcataaaaagaaatcttacaggaaataatcaccttgttataataggtggttgatttagaattagaagaagactgggtccaaaataaacatgagttttatataatttctaagcatgcacctttgtttgtttgtttgtt

SEQ ID NO: 25492 - DNA, 1105 bp, Mus musculus
tgcttcaactttaagtgtgattgtaactttttatgatttttcaacaattatgtaaaagtttaaatgtttttgaaaaatacataatgccaatttgacaaagatacttacagctaaaataatcttaaatcctggtttctgtctgcataaaacagctttgtttttgttttttcccacttaactagatctagggggtatttgaagtttaacctgtgtatgtttgcttcataagatgttggtggaacaaaagtggaaaatgtggttcaggaactgtttgtattttttacagaaagggggagaatcaacatgaaaatttcttatattctccaacttttttaaaggttcagaagatagaaattatttttaagagacgtaaagaacatgatcacattttagtcatacatgtacttggttttggaaattccactagcaacagtaacatttgttgtttataaccattccaggcttggcagtgtcataacaaaacagccaatgattttgtcttcgttagttcctcctctctgatagctacagctggtctttcaagtgacaataggtaagagatgtagctgaaatgaagtgtatatggatagctaaatttattttttgttgtgtattcttttgtctaagtagttaggccttaggaatttttatcataaagattttttttcataaagcatttttagtggcataaaacttataaaattctagtaccatttaaaacaaaaactatcctttttttctccattaatttattttttattctcatattgagaattttaatgtttttagtgttctcatattgagactttagaagaaaggatgtggttgttggtgaaatgaacatttctttgtgtgttattttctatatatccagaaaatttgaagctgaaaaggtactatttatttattggccatattatttagttaacttgtttagtcttcaccatgccataattactaggtaggtcattttcataagaacatagggaactcagagcagcctgccagtttgcatgaacatccgtcttcttcactccacccactcatgcagagcagctaagctcttccgtcaggaccatgagcttgccaaccttctgatactcat

SEQ ID NO: 25493 - DNA, 1210 bp, Mus musculus
tgtgccataacacctactgccgcagtataaaactcttggtttttttttaagtttttaaattattttaaccttaatgttacttttaagaagctttaaatttattattattattttaaagatactgaatcaaataagtctcagtaggcaataaagatgttgtgtggcacacaaggcattttatattaaaaatttgtcagcagttttgatgatcagacattttagttaaattttgttttaattttatttcttttaagatgaatttagtctaaaaattctaaaaatgttatagcagtgtttttagaatcaaatgtgaaaacagtcaatttaagtatagtatttacaaatgtacaatgccctgcagatctacattgataggaaataaatgttatattttattattttgccaaaatattattttattataaaatttgaccaaaatatttaaaatttacaatgcctctatcttaaatatgataaccctatttctgtctgttttgtgctatatcttttctgattcagaattataaaaaaaaacttgaaaaaaatacttgatttttagccaatgagactggctgtagaataagtgtttaagggacagttacatactatttagctcaaatttatttttagttagaaccagaaatggccatttttatgtaatgaaatatggaaaactattaggaattgaagagtcaaagcaaagaaatgaagggctggtaaatgaattttgtaatatcctcaggatacttttattataaaagtgtattgttaaaggttttgtaattgtatttcatattttaaatatagtgagcaagttacagtgaaaacactgtcattatagagagtttatatgcacagagtaaactgtacctgtaaattgtgcaatagcaatatatgactatttgccatggaggaatctgtgacaacattacaaacaatattttctttgatgtagctaagttattttttagtaatctcttcacaaatcaagattcaaaaggctttaaacactttccataagaaagaaaatttactatcgtgtttattaaaatcaaaatgcttcagggatgatctattgagcattttaattgagagtttatatgaataacaacattatgtaagtccatatgtatttacatccagagtcatattttaaataaacaatcatgcagtgatttttttcgcatgcttttgttttaagaaatacttc

SEQ ID NO: 25494 - DNA, 1174 bp, Mus musculus
aaaagccagctgaaaaaagcaaaatgctcatagtatctgagcttatatgctcagggccaaaataaggcattattgttaatttattggggttaattaagtatattcaaaaataatcaactttgtatatgtgtacagatatacatttgtatatatgcatatatattcacaaataatcaactttgtactagaaaatatattttagagtatgtaagttagtccttggtagagtagtttcattcattcattcattgtttacaacactagggatcaaactcaaggctttgtatacactaggtggatactctatcacaaagctcaacagaatggttttcaatagaactaattagaatcatatagatgaatgcaagcaaaaattcactgatacagagctaaaaaccacaaagcatgaatgtaacgggtcttatgtttacatttcaggtaatacaagccagacacaaaagccagaattcatatatcttcccatggtaaaaattacaatccttgtgatatttgctaaacttcagtaatcttgaatttctttctttttgtcttcttaaaatctagaatggtcagctggagtgtgttcgctggatggtgagtgagacagaagccattgcggaattgagttgttccaaggatttcccaagccttattcattacgcaggttgctatgggcaggtatggaatttctaagtatcttctcttacatgactacttattttttattattaggtcatcaaaatcaaaacacaacatcataaataagttcaaagattttcacgaacattgatatttattataatattttaataaagacatgctcaaaacaacctagctatctcaaggcataaatagcgaaggtagctatattcatatagtagaattttgcatgaggaagtgttacttacaccaggctaataaaaatatataatttaaaactttcactgtaatttggtaccaactttaaattttgtaggaaaagaaacagaaagtaagactagtgggaaaaaaaaacagcccaaagtggttccagccattttgtgaagaatggaactacaattggctttttaatggttttcaatttggtatttttctattttttataataaatattttaaacatttatcaaaaagaaaaatgatagtgacttgttgagcacaaagccaaacaccaa

SEQ ID NO: 25495 - DNA, 1220 bp, Mus musculus
gactgctcttccaaaggtcctgagttcagatcccagccaccacatggtggctcacaaccacccgtaatgagatctgacgccctcttctggtgtctgaagacaggtacagggtacttacatataataaataaataaattttttttaaaaagcttttttcctactctttcctactcagcatcaaggagaagagggatgctattacagtgcatcatatacagttatgactgtaaatgaataaaagtagagtctcatgcccaagtggccttaattaagcttgtgaccctctggcttcagtttcacctctgcgctgcggtttcaggagtctgttactatgcctggctccctttcattgctgatgttttgattgtcatgcccagtatctgctaagtgctgatttataaagattaagaccttggtttgttttctttttaactcttcctccgcaccccatctcactatgtagtctgggctgccctgaatctggtaaccctcctatctcagctccccagaactaggacaatatgagtgcctaccacacatgactgctttcctttctctttatttagctgttgtttatttgtttgtttggttggttggttggtttttcgaggcaaggtttctctgtgcagccctggttatcctggaactcatgtaggccaggctggcctcaactttggagatttgtcagtctctgcctattgagtgctgggtttaaaggtgtgaagaattgtgtttgtaagtgcatgtacatgtgggtgctcacagaggccagaagaaggtgttggatcccctgaagcttgagtttataggctggattcagggaactgaatgtggatcctctgcaaagacagcagaactctcagccactcagctctctctccagcttccttgtttctggtataagatgggtctcccatagctcaggcttgcattgttcacagatggcctgaactcctagtcttcctgcctctgactctacaaagtactgtgattacaggcatggatcaccatgcccagaagatgaatgatatcaaagatgattagggggatatggatgtggttcagtaacagagtatttgcccaacttgtgtacagggacctggtttcaatctcttccatcacaaaaacaaaagaccattcatcttacaaaatgattactaaccataacatttttttttcctctgtaaaactaagagaaattctgttgtgggtctactat

SEQ ID NO: 25496 - DNA, 1239 bp, Mus musculus
aggcatggtgatgaacacctccaatctctgcacagtgacacaggcaggactgccacagaatcaaggccagacaggtctatgtggtaggggaacgtgtctgaaaaaaacacattgaaaaacaaagtagagatcaagcataggctaggtgtggttctgcaagtgtaatcccagcagcagacagctgaggcatcataaaatcctgaaagttaaggccagcctgagctaacagtggtaccttctcacatatagttatatgtataaatgtatacaaagactaagttagtattagctgcttatgtatataatttttaaaaaaaagatatatgcattaaaatggtaaaaaaagattaacgaaaatatctctttttcttatcactcacagctgataaagtactgggaggcattcctacctgaagccaaagccattgcctagccttacccctgtgaaggagacattggattccccagtgagatcatctagaaaccatctaaataaaccactctatattttatgaattacatgtgggttttttatatataaaaacatatgcgctgacattttattacaagctgcatgtcctgaccttctttgaattaagtggactgtggcatgacattctgcaatattttgctgaattgaacactattgtgtcttaaatacttgcactaaaaaagtgcactgcaaggccagaaaattttacaatcttctttcttttatgttctgtagtgtgtttaccctcattatgaagcaaattagcaatgcattgattaatgttcacttatacattcctgtacagaaattatgatttttgtgattatagtaataaaatgatattacttgtgaaatattagtaataaattatttgagtatataaacacgttagggatctttttttaataggaaaaatactttcttctataagtatatctttaatactataattccttaaatactttaactgataagaaacgccaaattcttttttttttttttctcatacacattcaactgtatttaaagtctggaaaatgctaaaagtagtaattatacaggaggctgaagagcaaacaggtgtgtctcctgcagtaaacactaggcagacacagctttacttgaggtatggagcagggaaaaatttgccctgttgacctaagttggtggcagacttgctcttgttcccaaatctgggtgtgcccttggagaggttgtacaacctctgacagggaacttgataaagg

SEQ ID NO: 25497 - DNA, 1177 bp, Mus musculus
taacaataaaaaggagtcagctataaatccaacacatagaacaacataagctctgaaatcaaggactgggtagttcaggaaataacagattagacagagtcagagagaagattagagatgtggtggggaatcttacgagaggcggagaatgagagaggtcgaagggcaggtggagggatttctacacacatatcaaaagcaatgtcagaaggaaatactttcccagaattcaacacagacataagttctgactgaaaacgaactgtctctagggagtcagttggaaatgcacaacaggaagggtgaagagtgaaatttaaaagctattagagagaaaaacgagattacagacaatgacgacaaggactccatcagatgatagacaatgatgacagaatgcactcaagcagccgacaaaataggactactagctccgacggacaaataaggctaagctacaatatggaagttgccaagttaacatggaggagtaattaaaggcgctgtatcaacatttactccagacagcttcaaaattaaacgaattctgactggcaaatagagtaacagctaggcctagagggaaacaatgtgggaagggaaaataatgagtgcatacactgactaaactattcaatacaagtagctttctgctttaagaaaataattccagactacggaaaaaggaagctggcttgtggggaaagagtgtaactactcttgccttgcacaggagaagggataaaataatgaaaactgtaagtaacgacaaagtacagatattaacattttacattaaaggctatagagatagctcagacgttaagagccttgacagctcttccagaggttctgagttcaattcctagcaaccacatgatggctcacaaccacctgtaaagggatctgacaccctcttccagtgtgtctgaagacagccacagtgtactcatgtgaataaaaatgaatttatctggagctggagagatggctcagcggttaagagcactgactgctcttctgaaggtcctgaattcaaatcctagcaaccacatgctggctcacaaccacccataatgagctctgacaccctcttctggagctgtctgaagacagctacagtgtacttaaatataaaaagatagatgtatttattttttaaaaaaagaattaatct

SEQ ID NO: 25498 - DNA, 1148 bp, Mus musculus
ttgtttgtttgtttcgagacagggtttctctgtatagctttggctgtcctggaactcactctgtagaccaggctggcctcgagctcagaaatccgcctgcctctgcctcccaagtgctgggattaggcatgggagataaaattagagtaacaaccaagggttgggcaaaaatgtgtatatcagaacatacatgtatacatctgttaacccgaggctgggttcagttcccagtactcacatcagccagctcgcaactgcctgtaactccagttccagaggatccaatgcccagtggcctctgtgggcatttgtacacttgtggtacctataaattcatgtatgcgcatgtgcgcgctcgcgcacacacacaaacacacacacgcacactcacacacgcacacacttgaaaaacaaaacatagactcttgcagtaaacaccaagagctctcgtgagagtggagaccgtgcgtgtgaagtgttcctctgcagtcttagggtgatcttataactcaccccaaatgccatgaggccttgatcgttgtgagagcagtgaagctaaatggtctgaggacagccatggtgccgctcactctcatcctgtctcccttcatgtgttccagcctgggttctgtcaggccacccttttgtcgcctacttcacaaggagtgtctgtaacgcttgttactcagtgccaatgtagagagtgagaggatggcagcctgagtctgactccggtcaattgttgtttcttgctagaagaccaagagcacagagcccaagcatttggaagcaccgaattgcaaaggtgctaacacatacattcgggtctgggtaattgaaagggaagactttattctagttatctcacagtacagagactaaagcaaatcccatgaaatggtcagatatgtgaaaattaatatgattgaagaaagcacactaaatacttttttgcatcttttgttgtttttgttatctatgctggtgccataagcaaaaggacagaggtcacatcaagtatcccttactcagacctactaaaatgtcccccacaatcctgcccatgctggcagggcctttagaaggggagactgtgtcattcagccagccccacttcttgcttgatgcttttttgcctggtcccgaga

SEQ ID NO: 25499 - DNA, 1198 bp, Mus musculus
tcaccctgtggcaggctgtctcttgaaaagttcagggcaaataacccatcttcctctggaggtcagctgggcacctgtgattgcagcctcacacattacctgaggtagcccgtgctgctgtcttagacatggaggggctgagttctaatgggctctgaaaccgtgtcaccttcccaagtacatttgttaatggactgggcttggctgggattttatgttcccttttgcccaatatgggcacttcttatgtacactgatgattttctaaattaggaaaaactttctacccttgatagttttatataaatatgtcagcaggtacaagaaaagactttatagtgatcaatattacagtttaccaggttgcttcttccctaatgggttggttgaataattgattggtgaataaatggttggtttgtttagtttctgtgcataagtgtgtgtgtgtgtgtgtgtgtgtgtgagagagaggggggggggaggttgggcatatctatatgtgcaccacacgtgtgccgtatgcacaagcccacagagaccagaaaagagcactgatctgatctcctggaactggagttatagttggctatgagctctcgtgtgggtgttggataccaatcccaggtcctctgcaagactgggaagtgcttttaactactgaggcatccctctgccaccatgttcttgaaaatcctggtgaatactgcttccattttaagtcatctggcttaaaggggagttggttattgtttttttgttgaaactgcctcactagggtttgaattcacccatgctagggttgaacttctggattcaaactactcttctgcctcagcctgaaagtgatttatggggcgttctgggagctatatttaagagactaacttaaaaaaaatatagtcatccatttcaaacttaattttgttcagagatgttaatcaaaaatccccaaagctttttaatatgtgtatttttcacggttttccattctttgtctggtcactaacagtttgaaaatgagagtcacagaaggaccacgctaatcagttttttttttttttttggctgtttcttcattcaaaactgaacagcatagtagtctgtaaaccataacttagaaatagcatcagcattgatttaaatattgtagcttatttaaaaatactttggcagggaagcagcatagttacctttc

SEQ ID NO: 25500 - DNA, 1265 bp, Mus musculus
tggcctctggcttgacaaatgggagcgccccttgcccatgggcaaatgtgcccaggtagtagacctgaccgctgacactgtggccttgatctctgaccttccttcccgaccaagggcgaagggctctcctatgcgaactccagagagatgtggtggctctgaccctttgtccctctgtccataaaacacaattgtatgttgttgatgcacagaaagaaaagcagctttcctctgtttttcagattttccaaatgtggtcatcgaaggagttcttcatgggatatttttctctcacctgcagcccaggtagaaaccctacccggctggaagaagctgaagtgagtgtcgatgccgatggcaagaaaatcgatatctctaccaagttaaccgaaactctgagacacaatagctctagctagtgggaaaattcacagttccagcttcctttggagcagggacatttctattagaatggtgcttttaaaattagaaactgaaccggggtggggtcagtttaagaccaattatgtgagaagtgaaagggaaattacaagagaggttaggaaaaggaggccacagtggattactgggagtgtcacaaaatagagccagcctctgcttcagtcacactacctgctaattggaaatcatgtcttgagtcacgctgtgatactgaacaacttcggtggccttttgctcagaccttggacaccctcatctttgcgccatgagagttctctcagtgggggatactgtattctggagtgtgggcacctgaagagtatcccggagcccactgtgccggtctgaggatccagttatactgacagtagaacacactttcatttccattacagtggggatgcctcccacctacagattagctgccagcatcagtgctggagatgaaatgggtgttgggaccacccttgagagcactctagaaaggcgctgtatgggaagtctgacctccctcatcctctccctccagtactggaaagtatgagtgcgcctctgaaaaccagctgacacccctggcgaagttccaggggccgttccatatagaaagtacgtactctaaacactaaaatcagactgcaaaattcttgtcctgcaggaatgggacatggggtcacagtggccacaataggagcaaacagactgtttgtggcacggttccctcaatggtgtacacccacgccgctgttcaggttcctcttcactgacatcacgtatggattaaagtgagttagatgctcgatgct

SEQ ID NO: 25501 - DNA, 1136 bp, Mus musculus
atgctgctgctgtggggaaagggctcccactgtggctgctaatttgctaggactccaggacacgggtgttcctagttttgatcattctgtgtcctatgggctctggagtcacacctgtcacttacagacttgctgctactcttgttgctgaggcaagaaaacgcagtggcttagtcagagagccagatgctgctattctgctctgctagggttttgtaactctctcaagcaaaaaccagggctgagaaggcctgttctgtgggatccatgtgcggttaaaccaatgtatgtgctcaatgcttggttagctggttagatgccaagaggcgagtgacctaggaccaaagtcacctgagtatatggcagaggcagagccaccatgatagctcacctttctacccagctttcagaggccgtcttcccttcaaaatgaaatcgctgacccatttggtcaaattctggcttgaggtcctggggactttcatcctgtgccatgttaaggtctctgatttggtttagactctggcgtctctttccttcgggggtcaggtttgtcatacaccttcacttcttgtctgtgcccatcctctgtcctgtctcctgtgggattctgatgacatgaaacactcacgtttctttatatctgctgtcatccctccttctgcctcacccagggatgagcatctatggtgagacatttccggatgagaacttcaaactgaagcactatggcattggctgggtcagcatggccaatgctggaccagacaccaacggatcccagttcttcatcaccttgaccaagcccacctggttggatggcaaacacgttgtatttggaaaagtcctagatgggatggtaatttgaaagatctttttttctctcactctcaaaatacacaaagccttatatttatgattaataaatcagtgattcattggaccttcaaatgtgttcttagatacccactatatgatgggtagagtttttgaaggtgaacaaattatacatgggatagtattttaactgctaaaggcattaaagcagatatggaagaagttaggcacttcagttaatttaagaaacataaccaaataaaccaaggactgaatatgcattcagtgaaatattattt

SEQ ID NO: 25502 - DNA, 2125 bp, Mus musculus
taataagtgaactcgaccggcagatcagagaggttttgaccaaaaacagtgccagttaaaaaccaccggggaaacgtttgcagatacgctaggtctgcagtttgatattttgtaaaatcctcaaaagcaagggaagtggctactttggaatgctctttataatttttataagctgaattttatatgttactgtatatagtatttatttgattttacttacgctacctctccaatgctggcttcattttaattgtgttttatatgctcatttaaaatgacttttcagtgttcttcagtttaaaatctgttgtttgactttaaaaacagcctttcacaacttgtcccaggagaactgaccacagtagttcccactgtataatttttatgttgagccaagagagaatatgttgcactttaaacacgctgtgtcctgctccctttgagtgtagatatcttcaagttgaagccaattataagtgtagccatttttaaaaagcatttatatgaccagtctttttcccctcaacctgtggtatttgcagatgacaactttgaaaataaagcagtctcgggcagagacgctgtgtgacatgttggctgacaaattagtcattgcttaaacacagttcatgcagattaaacacaaatcaagttccaaatttcattggactccacttgaagaccatgagaaaatagcttggtctgaccacaatctcctgctcatgactctctgaggcttcttgttaaaatggttgcctttgtttctcagtgatagcgatacagctcaggaatggactatggaaactgatacctagcgacattagctgagaacaccacggagctgcttccctccctctgcagtcagtctgttttcagaggcaccccagcgagcccagtgcaagcccgtaaccctccagagctccttcacactgcgctctccaaaccaccccatcctcacagcgagcttatccctacctctgcgtgacactgagcaggcagattagcaatctcccaggtcatgcagcatcttgaaacaaagtaagaattctgattcccaaaaataacaaatttaagtgtatactttagcaggtgtgtactaattaccagtaacttcaacacaagcaaagcaggttacatggtaatgttcattcagtatatttcttgtttgtgaaattgaaacctctataggcatcatatgcttcttgtctttaacaaagtctttgtcttctaagagcaaccccgcagtaaacaacagaggggttgctggacttgagggtgacgagacagatgatcatagcagggatttgaaatatgaattatggttacatggtcctgattttttttttttggtgacatgaatggaacagaagtattttgttttagaaggtcctggcccagcgttggttcttcctcctgtatcctgtgaggcctggagcttttcaaacactagagggggccttagagtaagtggaaaggacttctaaaatgtgtgtgtgctttgccttccagaaagccatctttgggctactgtaatatgacaaataaaatcctcactgtgtgcatccttgagttgtgtggtcggtctctttgtttctaaatggagtgggtaaggtgctggcctcctccggtttattggtgtttcctgggctcttcctctgcacacttgaaaggacataaagtgaggagaagctgaaatggtacattcccttcctcagcaatagctagcacattcctgcgtggtgcttcacatattcacaccgatctttgttcaggagctgtcagtgcatgggtgcaaatgcagcagctagtgcgtgtgtctctgtgaagtctgtagttttcacttctaaagacgacacatgagaggggtgcccggtatctgcaaggttgagtcagcactgggtctgtatgcactttgagaattcctttacagggctgtcccagtgacacagatactgttgtgtagactgagttaggttatactggggctctgtacaaatgaaggaggtcgtatgacttcctctactgactgccttggttacatactgataggagttcatgggttgttccagtatgaattgtctgtgtgtctgaagatacttgagagtagactgacctagctattaca

SEQ ID NO: 25503 - DNA, 1196 bp, Mus musculus
tctgtgtctaggagaaggttaacatgtgtgcatattcattccaggaaagtagacaagttttgaataacttataaccaccaagagtcgcaaggctgatgagtatatttcactatataaattcatcagtgttttagaggtagtaaaaatcacagtattgtgctaaagggaattcagtggaagaactgttgcctaacaagcataaagccctggttccctcaacaaaacaaaacaaagaaaaagatgcacacatttgaaaatgaatgcgtatgacttgagacctcaggccttattcaaacaagagaaggtgacagtcagtgtgcacacttgtacatctgcagcagaggagagagtaccgaagtgtccagtgtgcactcaagaggcagaggcagatctctgtgagtttaaggctagccttgtctacatagcaagttccaggccagccagagctactaaatattcattagcaataattatgtgggctgtatgactttattttttggaacaagtgcacagctatttaggtaagttttagtaagtgtaagtattgaggtgctgtgttggtcaataagcacacacttgagaactcctgaggcccatggaggctggctcagttggagctttggagccgggtgtggtggcgcataactttaatcccagcactcaggaggcagaggcaggcggatactacagacagggtagtggaaggaaatacaagtttccatgaactttacgataattcccatttcatttgtaggtcaaataacaggatattagacctttcttatacaatgacactggaagactatggcctagtgaaaatgcgtgagatctttgtatcggagtcatctcaggtaagtgtagttacaattcctgacccaggagtgtgctaaggtgtttatgggtgtgtcccattcacttttctttcacattgtagggtgtgcctgctgtggatcagaagccatcttcgcctcctcccgctccctgcccttctgagatccagatggaacccagagagaccttagagtacaaggctgccctcgagctggagatgtggaaagagatgcaggaagacatatttgaaagtcaggtagattgacattgtactctaaaatctctgctttatcacagagtttattttctccttctctacaactgcatcttctctccatgatgtctacagttttactatgagattt

SEQ ID NO: 25504 - DNA, 1174 bp, Mus musculus
cctgggtctggtatgcactgtgtctgtatggaacatgctgggtctccgttctttcacctgctcactctctcagccacgtctaccatagtcttcactccagagctcatacgttcataaagaaacctacgccacattccttttctatgtggcctgttcagtaattttaaaatactttacttcagaatattgtttttatgtatagaaaaataaagcttcctagaaaaaaaatgaaaggaaaccttttgcaatgctgcgcccatgaaaatggccaacttcttaattaaatccatatagcaaggtttcagatgtgtataatgggccaggtcttgtggcacaggcctgaattccagcacatgagaggttaagataagacaagtgtgaccccaaggccagcttaggttacatagtaagtaccaggccagactgggtaacagtacgttcaggaccaaactgggctctataataagacctatcgaaaattaataaactatgggaaggcacagtctgacatagctgtggttttgtctgtgtagttcttgctagcctggcaggagttgacccgaaggacattgttgcagtattgaatgaggaaggaggctaccatcagattggaccagcggagcactgtactgacccctttattttgtcggtgacgattgcatttgccacccagttggaacaggtaagacattccctcggactaatggcttttattgactgtttgaagtcacatttgttttctgtgagcacttgtacttgcatgcacattcccacacgtggactcatacccctcatacatgttgtttaaaaagtataaaaatgtttgcaatgttttcacaccagtaagcactttttctgtagatttcaacatcttgacaacaagagaatagagcaatttcagggttaagggacagtgtttgtacttgtatatgtggcgttgtgaggagtaaggaagaggaattctacagtggctcttttgaataatatactgtttgatgaaattagcaatgccaggaacatttgggttggggattatattttattgtgtgtagacttacaaatgttagcctgttgtcatggatgctagcagaagatagtatgctcctgtgtcaggatcagaggactttcttatgtagtgaacaacatcaaaatgggtgtgttttcttgagcctct

SEQ ID NO: 25505 - DNA, 2301 bp, Mus musculus
agagaaaacagttgcccaaatattaaaaacaactttcttgaacagttcctgttttgtggcatctgcattgatttcagtatgactgatggtactgttattcgtgaatcatattgacattctctctgtgaaatcatggtacagtcactgcccagaggtactgaggaaaatgtactatgggattggcaaacggtggcggtaaataatcagcagttgttggcaatgcgagctcggcttctgtggcgccactgtgtgaagtgcagctgcagaagaagcaggagcgccaggaacgtttgtttaatgtcactctctgcttccagatgataatatatactagatggcaagaaatgagtcctggagaagtaatgtatgggagagtttaaaaaacacactaaggaaaggatgacaatgtgaaacttgtttcagtgtgtaaggctggagccccttaagagcctactgccccgtggccacatttctctcagaagcagaaacccgaggacgtgccatagagtggtggctgcctgtgatgcctctcttcagatgcagaaaagagtcctactcccagcaataagcaccgggtcactctgttgccctctgtgcacactagtctcgtgtgttcagctttgctagttctctgacatttcctgtcttgagcataataatgtggctgattggagaatgttctggagagggtgggctgggtgcgttgcctccatagctttcacagtgcctgcatatgcacagcgtaacagttctgttatgcgccaagtccatcccactttgcaagtgtgctctgttttacgccatgaggacacaggcatagtttgtgtctcatcctgtcagccgggtggtcgagagttaaaaaggctggccagacagatgctgttgatcatatcacacattcgtcttctacttagaaacccgtcgctcctcctccctgcgctctcctctctgtcttaagtgtgagccttcaggtatgcttatttattttttttgtctcaaggtaacatttaaaatatgtattaaaggaaatgaatccacatttttttacttccttattgaatttacaggtatttaattgtattttgtaatttatttttcttattagccaaaagttcaatgtgttgtttttgataaattgggcgcccacatgaacatcccaggtcaggacatcgtttatctttatttttgattttaaagacctacactcaactgagaaaatatttgctgtataatttgatcaacagtttccattctctttgtatactgtcatgatatctaaactgcaggagttaaatactgagttttttattttgtttgctctgagcaaggtagatggatattttggccatttataatgtgaaaccacttctttacagtatttgaccaaatttgtgtgtctatgatatttgtaaatacatgcgatatctgtatttcttatcataaacctatttagttttattctcagtagggtttttggactgtacagtgtttatatgatctgaactccttatacataagaaggtgtgtatattaatccaattatggacttaaatattttaaaagtatgaatacccttatttgctgcaaaggccagtgtgtagacatttgctttttagcaatatttttaagtgctccgttttcgtgctggagaagaagtctttggcacacagactggtcagtaataggtgatgcaggtatgtccaggttaagccaacaatgttttgcatttctatgcttcttttctgtcaacactaatgaaatcaacattgcctgaatgtctgaatactgaaacacagccctgtttaaaagtatgtaactgaaaaaaaaaaaaaaagaaataaataaaggtagtttttttaaactcgctctttcccctttcctctaaccatgagtgaactaatgtttttcattgctgcacagagctttaaaaatgaacttctgttcgtttactacttactctaagaggcagggcagaaggaagctgcttttgtcattttgtgtctgtctctgttcgatgggagcacagttgttaggagcacatcacaggaaggatctaagcttgctttgttttcatttttaaatctttggagttacttaatagagcaattggttaaagctgtcctctaacaacttaataaaaagtgattttatttctgttttgaaaacaaagtcatgctatttttgaaagttcagttaattaattttaagtgaataaagtcatttcagatgaggaacataaatatatttgcaccagtaatttgacttctcgttatgataggtcctttaagcattttaccaaac

SEQ ID NO: 25506 - DNA, 1184 bp, Mus musculus
atctttattgcatcctcatcaagacttctcccagttatcctgttgttgcccggtggcatggagatcctacagctttgaatcagtaggactaaccctttcacatgtcccacatgttcacagatgatatagatttgggggtgggccaattcagagccctggtcctaggtcattgctgagctggtcagtatgctggctctccctcatctataccactatggccagtttttcagcactgctccagctgggacacccagtgctgtcctgagtaggaggcagggtcagatttcttgttcttatgccctaggctggctcacccataccattgcctccagagtcagctcactgtgctgcccagtcaatcacaaatgctgcagtttgtgatgggatgggatagctttcgcactcccaacagctcagagcgggctcacttgtgccttcaccaccagtgccagctccactgtgttgtacagtagcggtacagagcctgctctcctgagttctgctgccttcgaggggcagggccagttcatctgctctcaggatcctggcaccagctctcctgacggctgcaggtgacaaagggaaagggtgcatcataccccaccacctcctggcagacaaatggttggtccagctctcctgcccttgggtctggctcacctttgccgctaccacccaggtcatctctgctgtgctgtcccagcaaggtgcagggcacatttgttctcccctggtgctgcagctggtgaaggatagggctacctctcctgtgctcgtgaccttgtgggcatgattctcaactgctggagtcagccgttcctcactcacacccttggccaacttacccttgccaccagggccagtaccactgtacagcctagggtccattcttccaagtgctgctgctggtgatggttgagaattgggccagctttccagagagctgtagccagtgagaggtggggcccgttctgcacagcccttggacattcatgtggttcctaacggctgtgcagatcagggaaatccccatgttcaccagtggtactatgagtcgtggacattgatgctgtcacaggctccgatatgggctttagctgctgttcaggccgagacctcactgtgaccccaggtgatagggctgaccacttacaacaggctacctctctctgccctccagtctc

SEQ ID NO: 25507 - DNA, 1106 bp, Mus musculus
gaaatataagaagtaatatttggccatcttcctgaaacatgttcttactccaaacttcctatggaattagctggtagagtactgcagtataaatagtcaattgatacgatgagttagttatatttatatatttctacgacaagtcttaaggaaagaactggagtggggactcatggctgtgtggaaatttaactaactaggtaaagatactctctggctttttgaacactcgagtataaaatggtctcccatggcagagaccagcagtccttcacgtacacatagctgctgtggggaatggaggcagtgttaagatctaaacaaagactctaacaaactatgtacttgaaaacagttgtctgagtgctatgtttaagcccaggcacctcaaggtacttaagaaaaataccttaagagagatccaactaaactcagaactggcccctagacatccggcctagagttgagagtgaccgctgtgcctttgtatcaatcgcaggcaaaaggatgcggagcctctctgctagcccagttttctgttcagacttaacccagatccattccatgaatgatgtttctctctttccttacaggcagacagccccatccggcctgggatcacaaatgcagttaaatgtggaggtcctctgccaagaacttacagctaacatagtgaaattggaaaaggtaggttgatgtttcctgagtacaggagcaatccggtcattcctttccagcgctactggccttgttgggttttttgtttgtttgtttctataaagaaacggaatttaatctcattttctgcaaaataccaattaggttggcccattgtttgtgtccttggctggacatgggaccacgggtaagtggccagtgacactggggttcatggagagatgcatttgggtgtcaaccagagactattggccagccccagatgtagatatccagctcacttaaaacatatttaatccctgttactgccttggctggaaggaaagaataaagttttaaattaccttgctcaaggtggcagagatagaaggcttaactggggaagtagaatttgaaccacaaggccaagtatggttagaggtccgctt

SEQ ID NO: 25508 - DNA, 1191 bp, Mus musculus
tggaggccgagtcactaggatgtctgtgtggtgaccttctggagatgctgcctgggacttgctttacctttgttgtgttctctcagagcttgttggctcagaatacttctctcgggggaaattccaggtgcatcatggtaactagtttgggaaaagaaaaaaaaaaatttaaaaattgctatattcttaacaaaatgagaagatttgcattttccttaataatgtaagttaagagagaaagttacatcgcccgtgttcttgtattatgaccaaaagaaaaaccataggtaacaggtgatgtgtgtcttccagccatttgtgcttgtgtttttccgttgtaaggaatcgcactgattttttttttttttttttttttttttttgtatactgatggttggttggttggttggttggctttaccgacctataagttgttactataaacagactgatgtctttaatgttatattatgtatgtgcttatatgctatggattgcatatgatgtgtgtgctcccattcgtttccttctcttccccagtaccatcaactacagcacgtccctccctctggctcagggaatcaagtttcagtgatactgcgtgggcttggcgtcccttagccattcctgtggctgctcggaagaagcctgaaaggaccctgacttgccccggataaatgatggctttgagtacggacagcagtgtctaatctccagtgattcccagacccctgtctaaatcaagatactcatttatcaaaagttcaaaattaaatattcacaacctagctgcatttagcaaaagataggtttggtgagtttttatgttactaattactttttttattacagctaatcatttcttagtgaagtacatgccatcataggaggttggggccatggaaaatgcaataggaaggaagaagtctttgcagtggagaaatgtcttctaagcagtgctgaatcctcatggtcccgtcctggcaggggttgaaggggagaggtacccccacatgctggggacctcagcacagtttcatgtgcatgatttgcagtgctccaaatgacaatgggccatttttgggtgaggtgaggaacttaacactgttgtgaatggttgctgggatgtgtcaacccctgggttcaaatctcagtaccaccacaacaaagataatgctctaaaaataatgc

SEQ ID NO: 25509 - DNA, 1225 bp, Mus musculus
catgttaaagcttgtatgttcacagaaaataacaaccagaacgcagacctgacaacatccatccttgggggtgctgagctgcctgatcctccctcacactacctcaatgatgtctcctaaaaagatcagcctccaaaacagcttcaaaggagggtgatgacatcaatcgacctcaatttatcagccatacagactgatctagtcagtgctgaattctctccgtatacagaaactggacaacaaatgccacagctagatttcttaagactattttccagttctccttgccctcccccaaaataaatatttcaccccaaattagcaagaagcaattttaagagaactatgccccattcccaagaggggaagtaaatgatttttggttgttcattgggagatgggtgtttgctgtcatttaaaaagggacagttataagtacttatgatcttggacagggaggaaacgaaatagggaggtctatataaacgaaatatttgggggtctctttctctttcctatacccttctttctctcctctctagtattaggttgaaaagaaaggggagaaggttgaaaagaaaaaggcagaatataagaacattgtagagggttggcgagatggctcagcggttaagaacactgactgctcttctgaaggtcctgagttcaaatcccagcaaccacatgatggctcacaaccatccgtaatgagatctgatgccctcttctggtgtgtctgaagacagctacagtgtacttagatatgataataaaaaaatctaaaaaaataacaaaaaacagttgattaagaaaaaagaacattgtagaaatatcatatagaaataacaaaataaaagggtagatgaataaatctactcttaaaccaaagaatattttatagccacattggtagagaactttgtatattaaaattatattttgttacattgatatagatttttgagtattgttgcaaatttgaggttatattttcttatattggtacagaactttgtatagtgacacaaaatttgaggttagttttgttaccacgtgctgtttattatgtttcaactcttgtataaggtattggatctgagtaactcatttgtaggtgtaatgtaaagttctcgtttcttttaaggttgtcattacaaactgtttaggataatttagaaatacaagtttatagacattcaaactcatggttatattatgagactag

SEQ ID NO: 25510 - DNA, 1140 bp, Mus musculus
ctaactaactaactaactagttaattttgtcgccctatttgtgttcttcagtggcttccccagaaggcagtctaggtagcgccttacagagcatggcagctcctcctcagcttctggtctgggcttcgtagatctcactgctttcctgggcgctctccccctttgctttcaaagcctgtttcattcttgcaccagacacaaagtgggaagagaggtcacccacactggaaacatgaccgtgcttagctataaatccttagtttggattttgagacttgaaggattgacttcttcattggctacattgataggtgatttgatgtgaccccctggggtagaaccagcaaacggccccaaagttaaaatgatataatcttgttaataaatacaaagaactctaatgtcttaaattattactaaagaattgctatatcatcttcatcattctttttccttatagctagaagcatccttatctgccgccaaaaagcagttagcagatgaaactttacttaaagtggatttggagaatcgctgtcagagccttactgaggacttggagtttcgtaaaaatatgtatgaagaggtaatagcataaagattttgttttgtttttctttttttttctttcccccaagacaggatttctctgcatagtcctggccatcatggagctccctctgttgcctaggctggtctcaacctcagagatttgcctgcccggcttcccgagtgctgagactaaaggtgtgcaccacccctgcctggaaatgtttccttggaaagggaacagagactgggcgtggggacttgaatactagcgtaggaaatttaggatttcagggtcatccttgccatgtagttagcttgagaatagcctgggctactttagacattatctcaaaaaaccatgggctgctaaggtgccttatcaggcatttactgttgagccaaacagtccgcatctgatccctaagcccacgttgtgggaggaaaatctacccctgcagattgtcctctgacctctgtaacaaagccgcacacaggaaagacaaaaacaaacaagtattttttttgccataaggaaaggtagctaaatacagagatggtaggatttagggataggagatgccttgcaga

SEQ ID NO: 25511 - DNA, 1813 bp, Mus musculus
tggaaacgaggttattccagtgtcgttagacataaggtttatgcctgtgtcagtggtctcccatgtcatatcttgagtagttaagcccaaagtgtctcagtactttcctctcccaggtacgtctggcccctttccacatacttctatttttgacttccacattgctttgtctgtaaattgtcactccctgtgggtggtttttgctttgttttatagcggggccaattggaaaatctgacagtgttctcttcagaggtggggaatcatcccacttacaggaacagatcacgtgatacatcttggttttgtttgtaaaagatttttttctcacatgttaaatgttatatgaatgaataaattattagttggcaacagtgttagaaaattgatgaagttatttaaaatagtttccattgtttggactccactgttcatgtagggtgttagtcatgtaatgaggtggttatgggcatcgcatacaagaggccttacagagaggtcctgtagctgcctagcacttgctgagtgcctccactaaattatgtccgggaagaactataaaagaactctctcgcctctgtttctgtctctcttgctctatctgtcttccactcctcagtctctctctctctctctctctctctctctctctctctctctctctctcacacacacacacacacacacacatcccatttggagatgtgggtattgttttatgagacctgcctttgcttctgaaaggaagagtctctggttacagagttggtttggaatatagaatgcttccttcgcacacgtcactacagtcaagtttctattgtacggcatctttgttagtgctcccctagacagtaaatgcttagtggatggaatactgaaaaaataaccttgagttgatgacctagctatctagaaattgtttaaattgatagttttaggagtgagtctgaagagataggtgtgtatggtgatgtacgtcagcaaagcaagcgtgctttcctgtttcatcagctggttaccagaagggcttgggtttgaaggtcttggtgaattacgcttcctcatttcttagttccagcttcctaggtaaggctgacagtggcttcctgtccttacttacagcttgagaatgccagactctcctcagagatgaacacttccactgtcaacagtgcccgggaagagctgatggagagccggatgaggatcgagagcctctcctcacagctctctaacctgcagaaagaggtaagcagcgtcttcctttgagcaggactgaggtgtagctggaaggctggccacctgcgccatcgctgcctccctggtgctacttctcttttgtcccagatgagacatattttctcctggattttcttttatatagtgctttctggattcttttatatagtgctttctggattcttttatatagtgctttctggattcttttatatagtgctttctggattcttttatatagtgctttctggattcttttatatagtgctttctggatttttttttatatagtgctttctggattcttttatatagtgctttctggattcttttatatagtgctttctggattttttttttttatatagtgctttctggattttcttttatatagtgctttctggattttttttttttttttttttttgtggttgttgttgttgtccattgcttaaatattgtgaggctttgtggaggtgcacaccagtaatcccagcatcagagaggcagagataagattgctgcaagttcaaggttggccagggctacatagtaagatgctgcctccgac

SEQ ID NO: 25512 - DNA, 1114 bp, Mus musculus
ggactggtgtattgattgcttctttggctcagctttactccctcaggaacagcttattccgggcaaagctggcatatgcaagagacaaaaaaaaaatcttgtctttgctagtcctaagtgtctgatttaaaaacagaaagctgtcagatcataggagttttgtttgtggtttcgagggctggcttgtgttgtaaattcttaagggcctatctaattgagcagtgaccgtgatccttgcttgtaattttcatctctcctcagttttgtcccctttaaaattcagacccttcctggtgggtgcggtgttgatgacattgctttttgcaaagagcctgtctggggtcatggatttgattatttcatagttctctgtatgtgtgaagtaaccttgttatgttgtgttttgtgactaggatcaaccaatgggaggctgggagatgatcagaaaaattggagacacatcagtcagttacaaatatacctcaagatatgtgctgaaggctggccagactgtcacagtaagtgagctcaatcatctaattttcttttcttttcttttttttttttaaaagatttatttatttattatatgtaagtacactgtagctgttttcagacactccagaagagggaggcagattttgttacagatggttgtgagccaccatatggttgctgggatttgaactccagacctttggaagagccgtcgggtgctcttacccactgagccatctcaccagccctaattttattttcttaatcacagataaggtagttgtaccaaaaaccaaaacaacagtttgaccgaaagagaagcattttagaaatggtctttaaaatgcctttgtattagtagggtatgtgtgctgtgaaatatttaaaaattctgccttagagcagtgaaaagaattgatatttggatgattttgtctgtttagttgggtataataaaatagttgcttcctgactgatcctcctcgtgcaaggattctgcatggcatcaagatctgtaggaagccaacaccagcatccgcctaaaacaacagctgcctaaactgccttggataagctttcatgttttgctatcttgccgctccattttacccttagc

SEQ ID NO: 25513 - DNA, 1529 bp, Mus musculus
aaaaaaaaaccacagtttgtagaatttttcttattaagattagatcttgctatgtctgtgacctcagctggcctgagtttctattttaagtgagaaaatcttaactgtttacaggcctaggtcagcttttatttgttttgtgggaaaaactggtgtagtcagagtggaagctcagttgtggggtttgttgaagtgagcccttagagaatgctggaaagcatgaggtgtgagctggctcattttaagtagggagtgcagcgctttagtgactgggggaaatggctggcctttagaacactgtaatattgctggtactgactttccttctgtttcccctctcagggagccccaagagcatccaataaaagctgtgccattatgtgaacttgtcaagacatggtcgatcttcctcaagctagaagcatggagtcctgtatacagtgcagagccttctcagaagcacatgatatttttgtatttcctttatgtgaatttttaagctgcgaatctgatggccttaatttcctttttgacactgaaagttttgtaaaagaaatcctatccatacacgttgtaagatgtgaattattgacactgagctaactgtactgtttggaaaggggccctcaagtttttggcatttttctttcctttttgtatgtgtgtatgtaattttttttttttaagttcttttaaggggggacaaggagggtaagaaaaccactgcgtgtccgggcataattgaagcttgctctccctagatgggtggtctgctctcggtccttctctgctctctataaaatggtgctgtgcgggagggaggggggaagtttttcaatatatgaacttttgtatggaatttttttgtaataagtgatcaaggttacaaattttttttttaaatagaaaagagaagaaaaacgttgtaagaaggcaatattaatctagtcaccatgtacgcactctggatggaggttctacagagctgttgattggtcaactacttctcttacattgttgactcatgaggggagcgggcaggcggggtgagggtgggggaaggctttctcttcaaattcgctagttgagtttttaagatagtgtaacatgcttacatttcttatccgacattaacaaataaaacgctgttttcctattaatctactgttctttttaaccctttaaaccagcaggtctcagcctgtgggttgtgaccccttgggggaggtgactggcccttttaaaggggccacctaagaccaccagaaaacacagatatttgcagtatgactcatgacagtagcaaagttataaactttgaactagcaatgaaaatgactctatggttggtgtcaccacagcatgaggaactgtgttaaagggaagggtgagaaccgctgctttaggcagatgctgacagagtagaactgttttcgtttactttggctcacgtgaactgcacttctcagtgatgctttacaattgaggaagagagatgaatgctcagactcctcggtgctctgttggca

SEQ ID NO: 25514 - DNA, 1236 bp, Mus musculus
tttcattaacacaggataccacacagaaagaaagccctgcttaaaattcaccatgtttgtggtgaggtttgaaagaagtttaaataacaaacacacccacgcctcactcctagccacaagtttctttgctcctcgctgaatcctctgaaggattcctttctcttaggacactctaattctctgctttgaatagctgcacggtgctcccttagatacatgcagcattatacacgtgtcatgtcttcttttcttcttatcactaacaatgctctgatcagatattgcacagtggcatgagcatgactgtaggataaacttctggaactgaagtttctacgtcatgaatatatactgcaacatttaacaatattgttctgcagaaatttattttccaacctactatgaaaagagacaatgcttccgttttctgtaagttacttttataggaatgttcattcacaccctgacttgattagaaagttactgagtggctgcaaggaaataaaagttatcagtacatgcacaaaaaagatatggaacaacattcagtgcataaagtgaacttaattaattaagacttttttaaaaattcacataagattgttttctgtcccaggcaaccttcctgttttctgaagtactgtgttttctgaagacagatgcaagtgggagaaattgattaacttaactccagactatgttaataaaaacaaagccatcccagtgtgatccccatcacacccctgtatctgcccatttaaacccaaaacatgtttgggcacagagctccgtgttcagtcacgtacagcctgcctcttctgggtggagaatagtctggccaagtctgatatacctacccctgcctgtcaactggactagatagtagggctggcagggcaggcattagcacccgtgcactgaggccttcctctttcctaaaagcttctaacactaactaccttctaccttcagagttgggggtagcagcaaatctgggatccagagatgaaaaccaggtcaggacagtatgtgggccacttgccagttgagtgggcagggtgccagaggtgtgtcctctcctggttgtccagggcaggagatggaacccagactccaggagaagggaggaggcagggcctcccatggagctggagagtctaaagagtgcctgcctaaagaacaaggaacattttagcccctgagcacagaacaagcagataggaggaagccacagga

SEQ ID NO: 25515 - DNA, 1738 bp, Mus musculus
ggccggggggtgtaagcccatccgtgctgggatgttgtttggctgggatgtgtagatttaaggctgtttcttagtctgccttaagcacagtctgacattcctaactgtgcctctctgcctttatttcttaaggatgttttcaacgggatgatttttatattcgatgttgtttatgttttcttccagatatactgtattttaccatttgggaaatttacataagtcaaaatgtagtaaatttttttcttactcagttgagctctctatataggcaattcagatatcttcctgatgacaatttgatgtgtaaatgtaatttaactttctttttgatgttgatgcagttctggagatgttagccttagaggtctctgcactcgctcttccctgtcctggcttgtgcagtgtgcctgcctgcttttcggtaattacatcacttctgctccttttacagaaggagacgttttacttttgaggtgggtacgtgctgatcttcaagcactgtgtgtgttgcttggtgaggtaggaagggtgcattgctgtggctcttgcggtgcatggacctggcccagggaaacgtggtctcaggacttctggtggcttcttgatgcataagaaacggggacctttctctaccgcttgtttgctgtgctctggctttacaatttgggtctggggatgtagctctgtgacagaacaccagctaatgtctggtccctcagtcagtctctagaacacaagcatgcatgcacgtgcacacacacacacgcacgcactcacacgatggggggggggggggattaaagtctgtccccgtgtaacagtatctgatggggcattgtctggaagacggtgtttcctgttctctgaaggcaggttttgcagatccagaagggtcccctgctattctcttctttgtgtaaccgagtccatactagctcagtgactgttttagaggccatcctagtagatgcacaagaggtcactgacatctcatggggtgatcgtcttcctcgaaccctcaaataacagtggccaacttatgcgatggctcgtttgaaaccgaataattgtcgatacctagtccgccttctgtgggacggggagaagcaagagtgaagggtggatggaagagagaagtgtttgatccggtctgatctcagtttcctccggcccaggagcagggctgacagtggcacaggcttttcttccccagcctctatctgtcaccctcaggttgtgctaaaccagaagaacagggagtgctgattgtccctcctgtagctcgcccaggagcctgtgtggtggcctttaggcctggccagcccaacgtcatggttccctccccagcccttctgttctgtgtacttttctcttcctacgtgtctctgtgtagcgtctacactgacagttttagagactttgtgggtggctgttgcctttttcaagcctttcaggaaaaaaaaatcatgtaaccgtttgtcacccttgccatggttggtgctagcatcttttgtgaagtttgttgttgttgttgttgtttttggtttttgagttccagattattggaatcttattttaatttatttttctccgttggaaaataaaacaggaaaaatgatttaacatccatctcacagagttgcttgactgtttagttccaaggtcctcctgttcagcttctgttgctcgtcttgttcctgctctggcttgctttgttggtaacaatgctggacct

SEQ ID NO: 25516 - DNA, 1187 bp, Mus musculus
ccggcgggcgggaggacgcggcggctgcggcggcggaaggggcggtggcagcggcggcggcggcggcggcggcgcgcaggtcggcgcggaggcgcgtgcggccgcgcctgctcgctgcggtgcggaggaggccggcgctctccagggtcggcgccgggctcggggcgggctgaggggcgggctgagcggccccgcctcccgcgtgctgcaccgagcgccgcggccccgccgcgcctttaaaccgcggggccggccgcgctcgcgggcactcggcggcgggcggcgagcggcgagcgtgccgcggctgtgtagtggcgctgtgactctttctctctctatcactctcccccggctccttagcgggagcgccggccagggacccgagccgcgccgtacgcagcgtccacccgcctgctccgcaggtccccgagcgtcgggcggcgatggagcccgggcccgcggcgccctcgtctggcgccccgcggcccgcccgggatggggacgcgccgctggctgccgccgccggggtggacctgcccggcacggccgtgccctccggccaagaggatgctactacggctgggaggcaggctggcggcggggtgcgcggagagggaaccccagcggcgggcgatgggctgggcagacctctggggcccacccccagccagagccgcttccaggtggacccggtttccgagaacgccgggcgggccgcggcggctgcggcggcggcggcggcggctgcggctgcggccggggcggcgggcaaggagacccccgcggccgggaaagccggcggtgagagcggcgtggccaagggcagcgaggaagccaagggccgcttccgcgtgaacttcgtggacccggctgcctcgtcgtcggcggacgacagcctgtcggatgcggcgggggtcggtggcgacgggcccaacgtgagcttccagaacggcggggacacggtgctgagcgagggcagcagcctgcactcggggggtggcagtggacaccaccagcagtactactatgacacccacaccaacacctactacctgcgcaccttcggccacaacaccatggacgcggtgcccaggatcgaccactaccggcacacggccgcgcagctgggcgagaagctgctccggcccagcctggcagagctccacgatgagctggaaaaggtgagc

SEQ ID NO: 25517 - DNA, 1193 bp, Mus musculus
aagacacccacattgctatttagctttgggaaaagtagctgattagaaacacacatattcagttttcttatgacagagatggaaagagatgtcttttttgtgtatattacagactttatattccagagtgaaaactggaaaaaaagattaataaattgccagacaggcctggtttttgtggttttatttgaataattgaacagctaagggagttggtgaaattgactaagagtttcttttttaatgtttggaatcagcattgacctctgctgtctggaaagcatttaacagccatgtaaagcccaactaggattgccattatgatgcactaacatctggtcaccttaaagaaaagctacttctatatatttctgttaaggttaagtctactaacgagttgtcatctttacatcagagtctatgtaaggagaagaacaataatagcctaagtggcaagggaaaattcactcagtgatgttgaagcacgaaaatcagttttaaaaactggattttctacatgtaatgataatagctgtgttttgttatcctgtgttgactatggagtaaagatgtgaaggtttaactttagactgagcacctgtgttccaaaccattccttttacccatcatgttttcatgaagtcttgtcaggcctgtgtcccaatgaggactgaacagatagagaataagaaacgaagagctacagaattagatatggaactttaacccagaaagagaagtgagactgtactctgatttgtgacaagtctacagagctgttgaccaagagcaggcagggtcagtgtggaggtcattcagagtggatctggggtcctgtgaatccttctgtattggttggtggggaagaattttaaacagggagatggctgcagatgccttgaatcccatcactcgggcacaggcagccagatctcttgagttcaaggctggcttgctctagagcaaattccaagacagccagggctacacagagaggccctgtcttgaaaaattaaaaacaagcaagcacatacacacaaatactaaacaaaaacccccaaacaaacaaacaaaacaaacagaaaaggattttacatagttaatgttggtatttcagatgtggagaagggtatggcagccagatgataggatagcttgtggtaaagagccaaggcctgactctgtttatcatc

SEQ ID NO: 25518 - DNA, 1103 bp, Mus musculus
gggcagggaggtatggagagttgtatagaatgaaaagcctgtggctccggtggggatttgcccgtctttagggcttgttttagaaatgggtggcatggttctatccacagtgaacactctcagttttgcccgaggcagggtctcactaccaatctcagagctgggactagtcacagactgtgatcctctgtctgcagattatctgacaggtggaaccttcaggctcacgacactgcatctagctttactccagttctttaagagctgttattcatgtaacagcatttattaagtacctactgaatactttgcattctttaagacattaggcagaaagacagaccaggacagattacctgtgtgatgggagtaagcacaggagccatgtcgtgatgctctgtttacctgtgtggtgggcgtaagcacaggagccatgtcgtgatgctctgtttgacaccacaggctcagattgtgctgctggtgatccttctcctggccatcgccgacttcgtcatagggacgtttatctcactggagagcaagaagcccaagggtttctttggctataaatgtaagtaaaaagatggaatactttcttaagtgcaaattacagcactgtgctgttaactaaatttagttcattttaggtaatttatactgtaattatgtttggtctggtgagtcactctaattaataatttaggttttgccctctttatatataggctgtacaattagagtaaaatcactttcatttttatcttttgtgtttgaatattaacagcagcagggggtagagtggagtgaagcagctttactaaggaggaggcaccagcctggctctcaccgtgtctccagttttgtgtttctcggtactgggaatgtgaaaaagtatctttaggtgattttattgttgcatacacatcctagagtttacttactttaaaatgtctatgatgtcatcagactacataaagttacagaacctgttatttatattgtctatcattaaccaaaattttacttggtatgtgacattttaaacataacagtttaaaagtgctattgattgtgaaagcagacagaagttgcaaaaatcatga

SEQ ID NO: 25519 - DNA, 1082 bp, Mus musculus
cgttgttgtcaagagtcttttattcaaagtttctactcctgggattgtcttcctgaaaaatggcacaaagaggcagtttctgtctgtgcatatttgattagatataattgtaattagttttaggcatatgttgaataagttacagagctgggataagaattatgttttccattgacttggagatgatttgctatgagcagagttgtacttgatgtgtcaatctgaggcatcactttggctaacgcagcactgtttagttgaggggctgacacaggcaagagctaagtccgcctagtgtgagagcttgggaattaccgctttttacctaaattataaagattgttacacgtcattgtttactatttaagctgttcttgatatgtaattcaaaataagtttgttggtattctctctactctttaaagtattattgcttttgatgacatgatcgagccgtacagacttcacgaagatgataaagaacaggacattgcagataagatgaaagaagatgagccttggcgaatcacagataatgagcttgagctttataagactaaggtatattcttcacttctgtgtccttttcattaatcttacatagaattcaatagaattactgctgctgtaaataccaagcactgtgatttaatatagctacataaattaaacttgcattaaagacatttaatatatgaatgaagcagcatccaatatatttctaaatgttactttattacacaaaatctatttttgttttgctgttttacaaaccatgctgctgctgcttcctcctcctcctcttctccctcttcctcctcctcctcctcttctccctcttcctcctcctcgtcttcttcttcctcctcctcctcctcgtcttcttcttcttcctcctcctcttctccctcttcctcctcctcctcctcttctccctcttcctcctcctcgtcttcttcttcctcctcctcctcctcgtcttcttcttcttcctcctcctctttttcttctttgtttgtcttcctccctcttcttctttggtagtgctaaagatctagcccatagctacatgggcatacaca

SEQ ID NO: 25520 - DNA, 3362 bp, Mus musculus
tggcttcatttcatctcagtatctctctcatcctggtcctaggagtcttccagtcgcacggaaaggcgctgtgtccagtgctctgtatatggcttggttagaagctctctcgaaggacctgccaccagtcctcctggttcgtgggaatcatcagagcgtccttaccttctactcataactgttctgcaccatggacttcctctaaggatggcacttcagtgcccagtcaaagtgactgtatcgtcaggaacaccacagcatcgcagtggcagacggggactgcttcactacttcattattggaaagcacatggaaagttgccccattgatagatagatggagacttcagttgtagtctactccagatctcaatcttaatgactgctaattctttcttgttggactgaagttcatgagagtaaaattttcctttgctacttgaaagcaataagagtgagttattttttgattgctgaaaggagtgcaaagcctttagccttgaggtgccttctgaaataaccaaatttcatccagagacctgtcgtcttttgtaaatttctagaatgttaaactctgccttcagatgttattcttgtttttaatctctgttatcctaagtggacactgcttttctcctcccaccgaccagttagtgttgagaactgtgtgttttgtattacttttgtaaaagtatctgttagatactgaagaggattaggacaagctaataaaatatgtggggaaagtatccaaaaaatggagcccaaggttaggtttatatgaatatatatatatacatatatagagggagagctaggaaaaagaggcccagaccaactttcggttagaattatgaattatttcttttaaatcatagagatgactgatgatctacccagtaattcttgtataatgcttttaaaaaagaatcatgttttttttttaaacaaaaccgtgagatcatttgtattatttttaaaagatctcttgatttagaattttctctcaaatgtgagggacttttatgacatgctaacatattttttttagaggaaatttagacaaagcagtgccatttaatagaacatttcaataaacactatggggatttcactgtcctatgccatcctttatttaaaaaaaaaagattaaaattttaccaatggttaaaaggagcactgtttccttagtgaaatggttttaggcttcatttattcaagtatcaagtacagttagttttaatacactcaggattgaacagattgttctgaacattgaaacttaatccattcttaatactttaaaacttgtgttaaagaaaactgccagtttgtgcgtttgaccttgtctgctaatgcactcgacagcgtgcatgtgcacatgtgctgcctgaaagctttatatgcagacagacagcgcgcatgtgcacacgtgctatcctgaaagctttatatacagttgtcagtgtgatgtttctcagcttcaaggaaggattttctaaaaacatttcaagggattcatatctacatgtctgtatgtgtgtatgttatacatacacaggtgcatatgtgtatatgtaatgaaatttatgttgccagtgtttcagattttaaagtgatcacgatttggtagattacagatatttttttgttgttgttttagttttttctttttctttttttaagtaaacagtcaagtcaggtcaagcaagacgttaaagatttcacggaggacagagacaatttgaagaccatagtgtgacttcatacagttatccagttaggtaaagggctaacaagtggatgatctctaagtttcggtggagaacggtcccagatttttgtcatcttaagggaaatgtcagaaaagcgttctcagttgtggggtacttgtgctgcgcggatgcagactgggtcagtaccagccggatatctactcatttccattcagaatattaagaaaacaggttaaatgatttttaaaaaaagttttatttacattataatacaatattttccatttgttgtaaattttgcagagtttagggcagtataaaagagtcccaccaggaaaccataccatgcgtgaatttgctgaatggaagctagggcgtgggccgagcgctgctatcttgaaatgtgcacaggtagacttgcctgccttttacttttaaagcttccccccccccccattcaggaaacttcactgtgacctgtatgacagaaactaatatcatacatgttacacgtgtgtttaaaggacacacagtgaatctcgatgcacctaacagggagggagggtgatactgtttgtgatgtgatgttagcagcaggtttccacctttaaaaactaccattacggtggctaacactggctgcctggtcaaacagtctcaaggttgcagtcgtactctataaagtgaaaattctcaaccattagttcttagagatgctagctagcattaaagctatttttattttatgccgacttttgattattttgatgccaaattattttttagtcctaatcgttgataataacttaaaaataattatgcagtggcctttgagctcattattatgataggtaaaacatccggtgggttcaaaggggacattggtgttgattattaacaggtaactaaatcagatatttatttgttgcgtctttctctttgtgcttttaagttttcctctctactttttttcatattgctttctgacgtgtgtatgtgtgtgtgtgtgtattttttttaagactatggaaataatttaaagagttgagctctggtgattatctgctaagtttgaaatgtaatattttgataatactgtactgttcctgtgacagacgcctttgtaatgttttaaccctgagcattgcggttgctgctttgtacagaagttactgcaataaaggaagtggagtcatcacaagtttaatacttactcttgcctttacctgtcatgtcacttaggtgcctgtgtctgaagtggccgcggtgaagtggagcgaactggtttccacctctagtctcccgatggctgactgttacttctggctttttactaaactgttcagggcactgcttgtagcctttctagttcctagtctggggccaggcttctcagggggaaactaaaggattaaaagggactcatgttccttaagtttattttttcgctcctgggattttttgtttgtttgcttgtttatcttggtaagctgatttgcagtttacaaagcattttcccttgctcatttgggacccttcagtgtgttacacgtgcttttactcttaagaaagcaacttagagcagttacaaagtttgctaaaggttatagaagttgctaaagacatt

SEQ ID NO: 25521 - DNA, 2993 bp, Mus musculus
ccccggagtcgggtctgctttctaaagtgtaggagacttgaaggatcagggtcctccttccctccaggcgatgagactgcaaaccacacaagcccttgtctccactagaactactatgtcaagtcaacagctccttctttgcggctcttagtaacccttacctggctagaccgttgtgtacaagtgtttagttccaatgtcgaggcttcaggtgctgcttctcttcttcttaacgagcttttagttattaagacaaattaccatggaggtgcctgtctcgtctatactgcatactctgaccatatctttccaaagtgcaccctctggtgaagtattcttaaattgtgcactttaatgggagaaaaacaaaaaaaaacaaacaaacaaacaaaaaaacccacgtaccacaatgatttgacctttcttttgttgtgaagcatcccttgtcatgtcagtgtatacccagtgattttgcttctcaggctgactggccaatgactcctgggtgagaattgagaaccaggactctggctcgtgtatctcctcctctctcagtgttggagtcgctgactgagtgaggtgcattggcttaaggagcgcaaattatcttcaatattgtgtatctgtcttgattgcattaattttcttattcctgttacggtctttgtggatgctcttcctatggataacagtctatgttaacatttttcttccactgaatgttttccttgctccttggttattttaaacttgtaaacagatgggagtggtttgcagtgctgggtcattgacagaggtttgcccaaacatacagtctttttgagtgcatcttttactatacacaggaattggtggagaaagaaacactaggtaaaatgtacccatattcccctccaaacattgttatggctgacatcatcaaccagactcataggggtaatactgtggtcattgttaaccaatcaataaacttatttccatttcatactgataattactcaaacatctttttaatgtctgttgtgatatgtggaactatgtggaacattactctctttgtataaaattaaagaaaatgtataatgtgggtgaaattgttttgttttccatgactccatgaatattagtcaatgaattgtaatgagttctcaaaggtaacagatttgctgtttgtttaaaatcattggaaccttcaaaggaggggaatcctctgcaggcccagactgatagcgttcctgcagggttttcctgttagcactgtagaaatgtgttctgttatttgagccttggtaaggcaccattgcctagtgttcttcttggtgtgctcagttgttctcagcctctgggctgtgaccacagatatatcacatatcagatatatcacatatcagatatatcacatatcagatatttgcattaaaattcatgacagtagcaaaattacagttatgaagtagcaacaaaaataattttatggctagggagtcaccacaaatgaggaacggaattaaagggttgcagcattaggaaggttgagagctgctgcctagaagatgagtccagaaagaagcatcatattgttatccacgttttaaaataatttctaataaatgtaagctagtgtttttcaaacttttattatctggagtgcttgctaaaatactgagtttagcttcttcctctcccttcgttaaaaataaaaaggcattaccactggcaatgcaaggaattaatgtaggaaggtttccctcccttgtacccatgcctcttccacagctgaagccatctctggggcctccgattagtgtcctctggctgcccaaacaaaactccttagacaccatgtctcaagacaacagactgtttcatctcaattctgtagggttctagggctttctgtgtgctgagatcaaagcttgtattgcaaggcaatgatcttttctggggccctgtataagggatgacttatatcctgcagttctctggttctagaatctgctcctgtgggactttttgtttgtttggttttggtttatttgtttgttttgtcccattacttccatcttctcaggcaacaagtgcgggtccttaggtcccttcttagcctggcctaagatctcatgtgatttaaggtttctaattagcaaccgtattccacctgcagccttaacaccctttggccatgtatctctgttccaggatctagggattaaggcatgggcatcttcacacagacaccagctagtgagtgtgaattgaattaaattgtatcaggtccaggaatgtaaatacatggacgctcagaataattgtgaactctgccttctcttttctgttttgtgaaccatggcaagaagatggcaaggcttttactctatgattattggaaaactgaactgattgtaatactttgaagtggaagtgtccatgactttgtaggataatgaaattcctttcattgacataaataaagaacttcagaatgtaaacaagaagggtcctgtgtattgaatctcaacggggctggaagcagcaggaggctcctaacagaaatgctcaacatctgtgcaaacttaatctaaagttaaactggtaacttactccagccagggaactgatagtttatgatgtccattgaaatggcatatttctcgacttcagtggattgattttactctttcaaaattatttgggcaagtatgactttacagctagggagagagagataaaggccccagtcagaggttcgttttgtttctgtaactttggactttagagatgcagtgtttagggaacagagatagctttcctaaagccacacggtaagaggagaacctgactccatgttccgtgcttttcacttcgtcactgacactgcgagtcgttactcagcaatgctagaggtgatcagagagcggagaacaacagacatggagtgggaattttgctttcgttacgaaagcacagaaataagaatgcgctttcattccaat

SEQ ID NO: 25522 - DNA, 1223 bp, Mus musculus
cacacaaaaccggtctagtctgaatgggtttattgtccatagttgccaggttgcgctccaggatgtactggataggagcaagtcattatcagtggattgataaggccagtaacatttccagtctttaaagcagataaatatgtagctttgtaatgagttccttctaacattaatttaaggctgatgagatgacccagaggataaaggaacttaccttgatgatatgagttcaattccaggaacctacactataaacagagaatagacttctgcaagttgctttctgatagcctatatgacatcctgcttggcatatactctgtctgtctgtctgtctatttatctacttctctcttgatatgataaaactaaaattaaatcaagttcctttggcaggttcaaataccttaaatttaatctaaatttaatttgagattataaaaaacaagaatggtattagcatagaacaaacattcttcctagaagagtatgtcagctagcttttataacaatttgatacaaggtacaatcactggaaagtaggaagccctgtctgagaaaatgcctctgttaaaaactggctggggctggagagatggctcagccgttaaaggctaggctcacaaccaaaaatataagagttcggttcccagcacccacaatttatgaaattcctagccaaatggatggacctggagggcatcatcctgagtgaggtaacacattcacaaaggaactcacacaatatgtactcactgataagtggatattagcccaaaacctaggatacccaagatataagatacaatttcctaaacacatgaaactcaagaaaaatgaagactgaagtgtggacactaggcccctccttagaagtgggaacaaaacacccttggaaggagttacagagacaaagtttggagctgagatgaaaggatggaccatgtagagactgccttatccagggatccaccccataatcagcatccaaaccctgacaccattgcatacactagcaagattttaacgaaaggacccagatgtagctgtctcttgtgagactatgccggggcctagcaaacacagaagtggatgcccacagtcagctaatggatggatcacagggctcccaatggaggagctagagaaagtacccaaggagctaaagggatctgcaaccctataggtggatcaacattatgaactaaccagtaccccggagc

SEQ ID NO: 25523 - DNA, 1161 bp, Mus musculus
atacacagcataagccaaactagatggttggtcacagcttgacctttgtcgtcttaatcaattcatttggaagctttgaagtatcatacagtcaagtcttgacacagctgacacataaaccttgatgatagggaacagaaaataccagaaaggaaaaaaaatggaattaaagaaaaggaaaaaaaaaagcagacaggtaattgctaagttggaaacagtacaggtgtttttgtctcctccccccacccccaaacactcccctcctcccagatcagtgaggtctgtctgaccttttggtgcggtatagcatattttaataatgagtttcactcctttcttgtttcctcataggtggactcacattattgtcccagctgcttagaaaacatgccgtcagctgaagccaaattaaaaaagaataggtaagaacaggatgaatttttgtgttttccatttcttgttggttttgaggatattttttattggatattttctttatttacatttcaaatgttaccccctttccaggtcttccctctagaaaccccctatctcatcccccctctccctgcctctatgagtttactccccaacccatccacccactcccaccttccagccctggcattcccctacactggggtggttttgaggattttggggccgaaacagggtcttattccatggaccagactgacctcatattctgatctcccccagcctaagtgctggggttacaccacagttgttttaagaatcggttaaggaaacacacaggatcaaacactcctttttttcatgtttgagcatcaccattgcctaagataactttgatcttattttttaatataatgtctattttagaaggcttctagattaagaattattttgaaattagcacagtcctcttccctattgttaaaaaacagtattgtattagtcacgtcgccataggcttcttgtgattggccctggttcttagactttcactggtcttgatgactgcattagtctgcatagtctgcctcttttctctatttagtcactactcatggatatctattttacacagcaggggcaatagtgctttattttgttgcttttctcccttgagcgttctatcccagagccaccgggatagaatgtacccttttcatgtac

SEQ ID NO: 25524 - DNA, 1216 bp, Mus musculus
gcacaacattgccactcaggggctctgaggaagaaagggcgctctaaagtcccagtaaatgaatcctgggataagtaccatttcccttgctttgtagtttccatggtagctgaatgtgttcagatgtgggcagagagcacagctatgcttccccacatgtcttcagaggatcggcgggcctaaaacaagctgtcatgaacatagctgcttaccactatagcagtactaagagccttatgtctgatcccttcccactctgtggggaacacgcacatgggtgaactggagtgaccaatggagtccccatcagtgtgttcattttgtatctttttgggcgggaggcaaaagttgacctgcggtttaaaaaaagtattttgaccatttttatgtctatttggtattttcttttatatcatctaaaaaaaatttagtactaatcattgtagtggcataaaagtgatttaactaatttgaagtcataccctcagagagggtacctaagatgatatgcttttaaggaacttcctgtgaaatactttgacaaactgaaaagaagagccttagagtccatttgactgggagactgtctgcctgcctgcagctgggactggagcatccacatcacctgtgtctgcagtggctcactcgctgcctctgggcaggagactgttcagtcttagaaagtttggatttaactgaattgtagatggtaagggaaatttgatgttgtattgtattttttgtttttaattaaaacgggtcaattttccaaatgttgctggacttatgtttctttttaccctttggtattaaatgtgaaataagtaaaagcatattatataaatgggaatttttttcaattttttaagactggattattttttgttgagtaggggtggctatgcaatttgaggtaaaatcttcatatatagcttgttagtctttttttttataagcccttgaatactggcattctaaatctttccatgatggtaaaaatacccattgactaccaagaagttgatagtatggttgaaataagaacagacaggaagctgatggtggtaacccacacctttaatctcagcacttgggaggtagaaactggtgggtctctgagtttggagccaaccagagctacatatcgagaccctgtctttaaaagagagagagagagagaacagcatttatgcattcatagagcctcatctgtggc

SEQ ID NO: 25525 - DNA, 1272 bp, Mus musculus
ccctaagaggtagggccttttaccagaccagccagtgccacagccaagacagtagtcctgtcccactaacagccattgtctagtctgtacctaaagttgtctcccagcccccattctaccccattattttagtattggtattggatccaatcagggcaagaacattgtatgttattaaaaagtttctttgaaagctaaaaagttttccctctgcccaactcattaaaaaaaaaaaaaaagtttggtttttgtttgtttgagacaaggtctcattatatagccctggctagcctggaatttgttatgtagaccaggttagccctggaactcatagagatccacttaactctcaaaagctgagattaaatgtctgcacttaccaggcccagttcaaaatggtattttgtttgtgtttttgagacatggtctcatcatgtaaatctggctgtcctggagaatgttatgtgaaccaggctggctttgaactcagagatccatctgcctctgcctcctgagttctgtgattaaatgtgtgtgccacttctcccatcccccaaatggtattctttttaaggccagagggtatgtcgtcgtctagaagtcccacattccagatctgattgtttcctcctgtagctagcccacaggctttcaagggtcattttccttcttgtgtggatgtggcatttcctcttgcctgtagtgagcctcctcccacagccccccaagtgagggccaaaccagcttgggggaggggaaggggctccccaaagaggcaacatcacatgggtaggggttgagggctctgtgggatgggatggtcctgctggactgaccctggagggccaggctaggcacagcttagaggagcccggctgccccatgctaagcacagcattggtctttctccatctcttccctcttctgtctgtgttttggtttccctgcttctgttctgtggtcctggggtcttcattctctagatggtcagtgtgcactggaacagagatgagacctcaagctatgacagggaaggcctaggagaaaggcgtcctctaggcggaggcctgagaagagcaccgggtgcagcaggcggtcacgtgacggtcttcctccataaatgagatggaggcttcagcaggggtttcacatccacgcaagaggcagctgtgctctgtgtgatctgaggctaggagtctgcctcctccccttccacccccaggccttccatgcagtgctggggttagggttgtctggctgtgggcttgatat

SEQ ID NO: 25526 - DNA, 1825 bp, Mus musculus
cagagtttataccctgggtgctggggtcgcactgtgttttatatatatatatatatatatgaaatgtgtatatatatattatatattttttttggttgggtttgtttttaattcagtcatatacaatgatggcaagcccgagcctcaaagaatgtcgtatcttaatgctagagaatgaggtggaaaggaaggtgagtgtctatgagcacccaggcctcagggcgaagtcttgaagggtccttcttccctcttctgcagagggaccagagatgctaagatggaaaggaagaccagctctcccaaaatagtatggctttacaaagcctagtggccgtggggtgtttgggccacagggaaaggctggcccggggtgggacacctggggccctgagctggcctctccctcccctgtcacatggtgctaggttggggtctgctttggagtggggtgcccacagggacccacagaactgtctccagtccctgaagacacagggtctttggctggtttctgtttggattctgtttctgtcccccttttaacaatgtgaagtgactgaggttggatttcctcttcctgctaccccaagcccccacatctctttaactgccagtccagtgtccaccagccatttgttctgacatcctggccatgcaagggtcccaagacgggcacaaagtgggtccaggcatgggaggtggccttggtcaatgtcacagagctgttggaagcagtgccaagagctaaattcaggcccctgattctgagccccgtgctcttccagtaccacactgcctctgagcctgccttcgggaccctactgtgttccaggtcccgtctgtccctcagtcacatagctgtggtcattccaggacatggggacaaaccactctttcccagccaggtgcctttgagccttcccttccaagacctgcacttttcccgctgtgttctcttgtttccagagtccatccatcttactagctggggtcgtcttcattatgagctattccttcctggagttctccactgtggtggagagtgtgggatgctcagagggacctgcgtgcatggttttggtgtgcagagagccatgtcacatcatgtttctcactggggtcttggaacctgtggatcccagtccctatgtgatatgctcaaatgccctgtcaacaagctagaaccagactcagggttaggtcagtgtgcatgcccttagccacacttcccacctgtcagtgaggatggctcctatattctgaaagctactctgagaccctgtgagagctgagttagatggttggagtggcctttagatagcatgcagctctgttagtctctgcttctggtctccattgaaagcaagcaggtttgagaccctggcagagcaggggagtggttctctctggtccatttccctctaagaccctggaaactgctgctgtgtccctttcagtgctgggcctagaggctgccacaagttgcagatgtggggtcttgggaagtagatacgttcatcttagtatctctcaatgacaatgtccactgattgactggaaacgtttggaaaaacacaaaaacaagttggaaggaaattacttctgttgttcaggccacaccctgtcccttcttcagtctctaccaacagcgtttgccttatgggtgcagctcaccggcagctgcctcattcattccaggttctagagctttctatggggcgggtacctcggtgcgcatagggaatgaggacgaagctaaaatggacctttcaaaccccgatgtatgagcaatgggtgcttgtgagtctgctcatttccagaggag

SEQ ID NO: 25527 - DNA, 2676 bp, Mus musculus
aatggcgccacgcaaggggaaggaaaagaaggaagagcaggtcatcagcctgggacctcaggtggctgagggagagaatgtgtttggtgtctgccacatctttgcatccttcaatgacacctttgtccatgttaccgatctttctggcaagtgagtatttctgcagaaaggcataaaactggcctcagggggaccagttgatgggatttgccctaaagaattactgttttacttaatttcccactaattataagaaaacactgtgttttacggagctgaggataaacttgaacttaggatgctcctgtctctgcccccttgctgggattttatcaaccagagcttgctgactcaaaggagtttagctatgtaggggtctttgaaccccataaacacaacttacagctgtcttgttcagacccagcatatatatatatgcttaagatgctgttagactgctcattggggttcagtaagtgttctgtgtacccttgttgaaaaatgacacggttctgcctttgtccccagggaaaccatctgccgagtgactggtgggatgaaggtgaaggctgaccgagatgagtcctctccatatgcagccatgttggctgcccaggatgtggcccagaggtgcaaggagttgggcatcactgccctgcacatcaaactccgggccacaggaggaaacaggtacagaagatggggggtggatttgcgatctcatctggtctgtctgaggcatgtatgtatgttcctagttagggatagcagggaatagattaggaggagctagggtttggggctagcctgggctaaacagtgagttcctcctcaaaaaaatgggtaatgtgttcctttgtgtttattgaataaccacggcttacccaggtagtaagcaagactgagatagccttgggtggcacctcactttgcaggaaactcgggcttttaatcaacatgcaggaggttacatggtttcagtctgtggtaaatactaggaagtatggagttggtggtaggggtgacttaaatgggggcctgggatcccagcatgtttctgccctgtcccctcccccctaccaccaccaaaataaaggtagaaaaaaaattacatgagtgtgtgtaccatgtgcatacctggggtcaaaaagggcaatgaatctcttggcactggtgttgcagatggttgtaagccaccgtgtgggcagtaagaagagtccaggcccactgctaagatggcagtactattaagccgtctctttgccctcatttagcaattttgaaaaggattttgtgttgtgaagttggagatttaagtatggctccctcaagtatttaactgttggcttctccatttagaagtgaattaaaattaagttgctgactaggccaacaatccttcattttctaggaccaagacccctggacctggagcccagtcagccctcagagctcttgctcgctctgggatgaagattgggcggattggtaagtgtcccctctggttacacttggggttgctttcaagcattgaccccttccaaaccctgcaatgtgcctaatgggtcagctttgtctggttacttttgtaaggagtacgtaaaaggcattatgagaggcgtatctctgtagtggatacaatttttccctatgttggggtaacttaatgttccgactctgatttcagagccttctgtggcttaccaggtgactccactgattgccctcagtctctgctgaccttcataacagtggctcctgtcacgtggtgtaaagagcaaacagccacacttgctcactgtagggtctcttctactacagtcggtaggctctgagttaaactcggtgtttttcacctttgattgtccaccttctcagagcctgtgtccacttccaaatggggttgggatgagaaattggcaggtggggcaccccgtgattgctgaccattggagatacatttgggggaaaataaagtctactgctagttagacttgtggctacaatgatatttttttttttctcacagaggatgtcacccccattccctctgatagcactcgaagaaaagggggtcgtcgtggtcgccgtctgtgaacaggacttctcattattttctgttaataaattgctttgtgtaagctattttggttctggtgttgtgttttatgcactttgatgtttcacctgcatgtatgtgagggcctggaactctggagttagagacagttgtgagctgtcaatgtgggtgctgggaattgaaccagggtcttcctgctaatccatctctccaggtgtttttcttcattactgtttttttttttttttttggttttttttttttggttttttgagacagggtttctctgtgtagccctggctgtcgtggaactcactttgtagaccaggctggcctcgaactcagaaatccgcctgcctctgcctcctgagtgctgggattaaaggcgtgggccaccacgcccagctctccaggtgtttttttgtttgttttttttttaacgttaaaatcctaggatgtttattacaaaggtaaaccctgatccttgagatgagcttatcggtaggatttctggtatcgggcacgggcaccaggacctccaaactttggattcgcagtgacgggggtcagctacaagcagggtctgatcgtattgg

SEQ ID NO: 25528 - DNA, 1177 bp, Mus musculus
actaaagaaactagttcagtataactggggtctgcatgctgagccacatctcagggaggatgctgtcagggtctctgggggaagggacaatgagactccagggaaatcatacagtcacactgttacaggaaatgctttttagaattccccactcagcaggtggccatctgatgtcactagaagaaaggctaaattagacattccagctctcgccttgcttccttcccatgtggctgtgtggcctgggcgctcctcttctcccctctggacttaaggctttcctgttaggccagtggagtgggtggatactgcttagcttggggtcactgtgaaggtcagctgggctctaagagctctgaagtgctgtgctgtgctgggtgtctggctgttatggggtgggagtgggcctagaagaccccaactccttgaagtttgcattacaaagcccctccctcacccatttcctctccccttcccctgaccaagcctttaatcagaggcgggatgtttctgtttttggttttcaaggcgattaaatcccctccagtttctgtcaaccgtaacagtagtccagctgtcccagctcctaccccagaaggagtccaggctgtgaacaccacaaagaaggcctcaggcaccactgcccagagctcctcctctgagagtgaggacggggacgaggacttgattcctgccacacaaccctccacctatggtaagcgctgctgcagtgggtgctgttcggccaggacgggccccagccacgcatgccctccccactgaggccagaaggcactaaccaggtggcctagcagaggcattggcgaggactggggactcagccttaggcactgtattgttcccttaatgaggaaagctcgtctgcctcattttgaaggaattacattcgaggcttctgtgtgctggctccaagcctgaaagccagagggagcattctggtggctacaggaaccaggctagtctaaaccagagctctgctatagccacctggccgtggggtacactattagcctggcagtgagcttccatccccttagcatagaaaaaggagacaggtaacattttatacttattctcttcccagaacctaaggtgactgagtgtctttgtatgtggcgaggccctctggtagcgcaatcatcttcagttatatatc

SEQ ID NO: 25529 - DNA, 1236 bp, Mus musculus
cacagtttcctgcctctgccccctctgtgggtgaggggtacagagtgggccaaagatctcacccactgagccagtccagagcagcgattacctatcaagtcaaacccagtaaacgagctacatgaccttgagcaacgtttgtgacctcctagaataacatcatctgtaaagtgaactctatcatcacgtattgggaagaagttcaaacacagtgatctatttgataacagtcctaaaactggccagtgagatctgtcctggcactggtcctcagatactacattcttgatgttacagagaacaagcaagaagggggggaaaaaaaatccctgttcttgtgaaattcacattctgttgggggatggggtgggggggtggaacaaacttatacctgtaataaagcctcttctaacagcttcctggcaggtggccttcctaggaagaaggaacctgggtaacacagcccaaactgtggacagcagtgtcaaacccagctaggaagaatggggcttaatgacttcctgccggtagaagggtggaatcaaagttcaagggactaagctgtctgaagacttacagcacgcgtgcgcgcacacacacacacacacacacacacacacactccccactctgcttccttccagactccagttcgatggtggttcctttctctaggtgtgtgccagatactgggtgggatgctgtatgctctctgggggcctgtttgtatagtagtggagtcgtccagaaatcaaccagagaaggaaacgaaactgaacgccagggcggagtgctggggggaggggggaaggggtgtcagcaaagatgcttcacgccaaactcgagagtaacgagagtaacggaggctccttcctctttgatgactctagcttgtgtcaagttaactggcaaaaccagtcagagctgggcgtggtggcgcacgcctttaatcccagcactcgggaggcagaggcaggcggatttctgagttcgaggccagcctggtctacaaagtgagtgccaggacagccagggctacacagagaaaacctgtctcgaaaaacaaaaaaaaaaaaaaaaaaacccagtcaggacagcaccacaagagaaggacgcagttctagggtcgggagaacctggatggttctgtgcagcctatgggctgtggccagtcagccgatagtagtgagtgagctgctgccgtcctgtcacctcgtcggctgcttgggaccctga

SEQ ID NO: 25530 - DNA, 1099 bp, Mus musculus
cagcccagcccccactcaccaccttctaggcacattattctcatcacctctctcaacttggccaagcaagagtgccagaaacttattttcctacttcatgctgaacttggcctggtgtgcgctctattgtgcttgcctgcctccctggccttcctcgactcccctgccccgacatacacacacacacacacacacacacacacacgcacacgcacacgcgcgcacacacacacatgcacacgcacatgcacacactcacaccacttccttccaccacttccttcctcccccctctccctccctttctctttctcttctctccctcttcctgggtttggctcttgtatggaatgctgtatctcattcacggggatctcctgtctgcactgttttctttgcatgactttatatgcagtaagtatgttgaaaaacaaacaaaaaacaaaaaaggagaaaaacactcaacaaaatcaaacgacacgtttttttttggacaaaaaataataacattcaaggtaatagtctcagtgtccaacttggacttacgttgctgcctctccgtgcttttggtctctctgtggctatgttttgccagcatgagaccctgttccctctggaagttgctaggggaggaagagccatgcgtccaggggtttggagacagctttatcctctcggcttttctgagggtcgatgggagcagaagtggaagggatgtttaatccagaactttctggtattcccctttcgcctacatgtgagctatatcccgggctcttctctcaaatcctgctgcccagggacaagtacagggtagaagagtggctctcttgtctaagccgctccactgtagcctctgcccttggtagagacactgctacccaggcccaagaatgggcccttgtcctgccccagaaccaggcttcttcataaggctcagcaaacccattgtccccagccactccccagataaaggtaaaggagggtgtggcctttaccaggggacactgcaatctccatgcaggatctacaatcccttcttcaagcctcagtttctccatcaatgttcctacccagactgatggagggtcagagtaaa

SEQ ID NO: 25531 - DNA, 1173 bp, Mus musculus
cccatcgcctttgacaatgccacccactattacctctacaaccgcctcatggacttcctcaccagccgagagattgtcaacaggcagatccatgacattgtgcagagctgccagcctggcgaggtggtcattcgcgacaccctctatcgccttggggttgcccagatcaagacggaggcccaggaggaaggagaggaagaggaagtagcctcagtggtggaataagccaggtttttatgtacagggcctgcatcatctctctcaagccataatctggcccttgcccagggcagtcctattgagggacctgcagtcctctttagggagggcctctgactgctggaactgaccaaagagcttccatttcatgagcacagtggggcctcgacctctggggctcaggagaggcgctgggaagcctctccttgacctgagagagcacgtggaggcaggacatgatgttcttaaggatctggtgctgataggaaggccggggcctggttgcccagacccacaaccacccgggttcctgcaccaggtggagccgccattgagctaagctgtcccgcggggaggagctctggctcctgtcttgtgggcttcctagcctgccttgctggcttatttactcttggaatcccttggggcccttcattctccctaaaggaggggtgcattctctgttcctccaactctccctgttcccacaccttggggcagttgaggagaaggaacagctcctccaggactctctcagccccgggtttgggggaagagaatccttcctcctttctctggccactgctactataccctacgtcctctgggtcctcagaccctcaccacagaggggatgtggcccgtggttgtgacatagctgacaagcagtaggaaaactcccttctgtgaaggggaagcagatagggccataagcaaacagcagcatgggctcaggtgcccgcggtttgcttagggcccaggattggccaagtgctatttaatttattgagagggtgggataggtggctttccctctcgttcttcccccaacaagaataaagtttattaaattatctggttttgatgaagcaagagcctgttcaatgctgtgtcccttggctctggaagtgggtgcttgttggtcccttgtcaggaggaataggtggaaggagg

SEQ ID NO: 25532 - DNA, 1128 bp, Mus musculus
ttctgacataatgagcaggtatgggttagtttgactttttgaagttagtgacttatgtgtaagtcattcctgttgtctcacccagaagaatctgggactgaggtttgctttaatggagtgaagagagtgaacttgagcacattgggacaaactgaacctcatagaaaagctcccacggcaaaccacgtggtgcgacagaggtcagctcaggcacgttgggaaggggtttgtctaccaactcctgcggtgtccagtgcttgagtgagaagatcctgaggccggggccttagataaagtcacttttacactcgtaatcttaactcttctcgctgggctcatttccttagttattacccatgtgtttttaaaaagggaatcaaaagagaatatttgtcagctacaaaatgcctttatgcatacaagctcttttatttttttctaggaaaagccagccaaagtcaaagtggaattggcttcgggtgtctcctccaaaggttctgtgattaaaagaaatcagcagtctgtcaccactgagcaaaacccctctaaggaaaatgcttcaaaactgactctggagaactcagaagctgtaagccagctcttaaacgtggctcctccaggagaagggggtgaggacagagagtgggaggaagtgattgtctccgatgctcatgttttggtcaaggaagttcctgggaatcgtggtacagcggtaactaagatgcctgttgtcaagagtggtgcccaggctgagatctctctggggacaactgagaatgacagtcctggaccggacatactgccatcggctgaggggaccagctcctccagtttactccaagctcacaaaaagtctccagggtaggcatgcgagtgtaattacctgttatggggactatgtttagaacagcagctaagcagaggcccacgtttgctctgttagggatccttacagcagtcccgagaggggcagcagagcccagagaggctcagcaccactgcctagagacacagcatggtctactgactgctccgccatccgggccttgtacatcttttcttgttagtcttccgaacagtagtcttcagctagtcttcctagcagtagctcagatcttactgggacag

SEQ ID NO: 25533 - DNA, 1719 bp, Mus musculus
atatttataaaagttatcttgctcactttgaacattagagtgtaaaatatttcctggttgtttgcagagaagtagaaccctgaatgctgttaaatgactatcgtttatttaaaatacagagtgtacatgtctgtgtattttatgacaaggtcttatatagcacaggctggcctcaaatacgctaagtagccaaggatgattgtaaactgttggtctccctgcttctgcctccaggtgctggagttaacaggtcctagggatggagtaagctagtgagtatacagacctgctatgaaaggaacacagttcaggggagtgaaaggttagatcaccaagatctgtactgtccagaaaggaagagacctggctggatctagatcctggtaaaccccacagtaagatcagagttcaggagcttgcctccaagagcagtgttagaagtaggtcctgtttctagatggggagagtcccaggttcaccacagctccaaagagctcagaagcatatgctcacgttgtagccaaagtctgggtgagcctactcaggagtactgtcctccctgtgagccgagtggctgtagtgctgtgctcaggagtactgtcctccctgtgagccgagtggctgtagtgtctcggacagaagaagactggcaggtgccgagttcattctaagcagggtcaatgggacaggtatgatttatataaagtctttcagcacagtgagtggtgaactttgagactgcctgaagtgatagatgaattcatcagactaatgcttctggctacattgtagcaaaaccagtgagcctctgcagggatgtttctggcagcttgacatttaagaacatgttaccaggattaactcctaagctgcaaaggacagaaaagagtaggtttggggactaatgcctcttcatttacggcgacggctcgagctctccacaacacccatccagccacccacacacaccggtgagtgtcctcacttctgagttctcaaggaggtgctgtagggatagctgaagactctttgcatggaagtgaacccttccgcatagccccaatgtctgggagtctggtgtccaggagaacttagaagtgctttatggagagtacttgagctgagggcaaatggaggcctgaggtggaggagtgtcactctggtatgtgcaggcaagactgaatctccagaaaagtagaattctccaggtgagaagctttacagttttgcctaatttttttgttctttagtgctcttcttggactcttaattctggtggtgttttaatttgaacttgggctttaaattaagttgaagagaggatgaatttcgccgggcgtggtggtgcacgcctttaatcctagtactcgggagacagaggcaggcggatttctgagttcgaggccagcctggtctacaaagtgagttccaggacagccaggactacacagagaaaccctgtctcgaaaaaaaacaaaacaaaacaaacaaaaaaaaaaaaaagaaaggatgaatttctacttagactcaaaatgggcacagtggcctgtgaggcacttgacttggaggctggggcaggaaaagactttgaggccaacctgagatagctgttgagaccttgccaaaagaagagaaaagaaaactagctagctgttggagacccatttgtcttccaactcatttatacacacacacacacacacacacatatatatatat

SEQ ID NO: 25534 - DNA, 1113 bp, Mus musculus
caattttaatccagaaatgaatattagcttcaaataagtctatagtggttgaaactgtcttggttaagttaatatacttaaacttataaacatgcttatatagcatatctaagtaagttgtatataaaaggcttttttttcctatgagtttccactgtgtatcagcaagtttaaaataggcacacttcaatgaagagtcaatttttgttttttgagtatgtgtcatgagtcaaagcaggtggcaccagtaactttgacttcctctgaaaattaggacaaccatgtttaactctcaaaatgagattgaatgtgtaagggcatgagagttttcttaatttcaagaggataatatataagaaagaataagcttcaaactagactctagaagcactcagttgcttccattggtcagtgtcttaattagaggtgtctgttgttatgacaaagcatcctgaccaaaagcaactttgggagtttagcttagaattccatagcacaaccgaggggagtcggggtaggaacttggaggcaaaatcaagccatggaggattgctgctgcttggttgctcaaaatgctttacaacagcacctaggaccacctaggtgggacttcaaggacctgcaccacaggcttgcccacagctagtctagtgggagcattttacagattgagattccctcttccatatgactctgtcatatgtaaaagctgacataaaacttgccagcattcaaattcaagggacagataccattaaggttgtctgtttgaatccagtgaagtgagcctttctcagaccttaaccatgtataataattagccctatgacatgggtgaagagatggctcaccatctcttcttgggtaagagcatttgttgctctttgagaaaattggagctctattccaagcaccagggtggcagctcacagtcatccatacacacacgtacataaatgcagagttgatggtcttaagttggcaatcctcgtgcctctgcttcctgaatactgggactacaggtatggcccactacttaatactttcaatactgacatgagaaatagttccctcacagcctctctcaactgttaaaatattatggtcataagc

SEQ ID NO: 25535 - DNA, 1401 bp, Mus musculus
atttagtgttgtatgtttagtctcttagctcgaggctggcctggtctacagagtgagttccaggatagccagggctaagtaagaccttgtctttttaaagaaagaaaagcttctagtatctgaggaacattgaaaaataaactgacctgatgtcatcctgaccccaggagctcagttactaactttaaacttgaggccttcctttctgtgagtctgtatttggggagggtgagttggagatgtaggtggggtttggatgatgaggcctaagctaacgagcagagcggtgtgtttgggctgctctgcctctgcacctaaattgggacttagaagtaaagctacgcgtgagctcactcgcatctggcctagaacagtttctcaggcactcagcagccttcagaaagaagtatcttcatttttacctaattttattgttccaatttcctgtgtgtttcttaataaacaagcagaatttttgtcctgctttatccaggtattaaagacgagaagttggatccactgagttagtatgtttccttgaaaaagaaaagtgattaaacttaagtttaagccttcttttgtattgtaacttattcataaaaaacttgaactcttaaaccagttgaacatcattggacacagtggtcgtgcacattattacatgtacatggtcttatcatgttctgaaataagagatttatcaataaataattcgttagtattgactgcttttaaaggtacatttataaggccaggttcagtgacataattgcttatagtctcagacactgggaggcagaggcaagagaatcatttgatcttaggagttaatggcagtagacaagagttccttctcaacagtaggtgtttgcagtgggttaccaagagagggggtttttgccttaagcataatactcttgcgactaaaatatgtcattcttggaaaggcgagctaagatgttaagtgtccaccttgtaagaaatgggaactgagttaatccctagaaccagcattttaaaagccagcaagctccaatggcaaaagctacacttagaagacctgtcttggggaaagaaaactgaaggaagaaagggagggaggggccagagtgggctgggcatcgtgtgcagcacatgccctgaatcctagaaagtccatctcttgtgagcaaggtcctgtctcaaaacagcagccagcaggctgtgatgaagtgtactctaagcaaagccatgggccttgttggatagcctgagtaagcccagtcaatgagttccaggtccacagtggaagacctgattccaaagggtaaagttaagaaaatgcttctaccctaagggtggcttgaaataagcatgagaaatctagtcttagaccttctgcctctcacattatgtaggtta

SEQ ID NO: 25536 - DNA, 3163 bp, Mus musculus
gcatgtactgccttgtgaaagtttaggttggtgattttccagataaaaacacagcatttccaagtgattattgtcctacttgtacctaatttggggagtacttgtaacatcttttttctgtttcaattttttaataggtttctaagcatgaattgtggaagagaagcagcagagcagacgattggagcagcgtttgtttctccccaaacctagacattttagttcatatgtacactagccagtggttgtggacaaccatttacttggtgtaaagaacttcatttcggtataaactggctctgggtagcactgcggatcctgagctgtagccactgtccttgtgaatattaactgaggtagtgaaacatggtgtccggttttctattgcattttttttcaagtggaaaagttaactaaatggttgacacacaaattggtggagaaattgtgcatatgccaatttttattttatttttttgttaaaatcttttattttgaactatactgctttgagatctcatttcagaagaacggcatgaacagtcttcagccacagttgtgatggttgtaaatgttcacaattgtgtgttcttagggttttccatccctggggtttgcaagttgttaacttaaaacattctttaaatggctggcttcttgtttgcaagccagctgatatggtagcaaccaaagattccagtgtttgagcatttgaaagactctgcctgcttacctgtgctagaaataacagcatctaaagtgaagacttaagaaaaaaaacatagcgactactagattctctttaggactctgcattaactctataatgttcttgctattaaaaaaaagcatatttgtcacggaaatttagttaccgtcttacaactgaacatgtatgtgtgttgcttagataaatgtaatcactgtaaacatctatacgatctgggattttgtttttattttgaaatgggagctttttgtttacaagttcattaaaaactaaaaactgtttctgtaaggaagtgaaatttttttaaacaacaaaatgccttggctgactcactatgaagtgtgtgtgtgtgtgtgtgtacatatatatacatatatatgcacacatatatataccatccccagttttttgttttgttttatattttgagacagagtctcattttgtagctctagctggcctggaactttatagatcaggctggcctagaactctcagatcctcctgactctgcctctctaaagagctgggactgaaaaaaatgagccaccatgtccagctttccctaattttttgatagactacttcaagccatttgttatatgatattcctttgctgcaaaaggtttggttttgggtttttggggggggggggctgttcttgatctgaagagaaaggtattctttggctttctgtttgtagctcacaggcacactaccccgtgctacagctgtgggagctttggcattgacttctgccgccactgactagcagatgaactgatgacagtgaaagtgttaaagggtttaactatattacaaaatatgtttcttcaaaatccctgtgaaatggctgtaaggttgtcatacagtgtgaagttagtgattgttgatcctcaagccccacctctctaagtacctgtgcacgcttcccccagtctttcttggttgctcttcagttgtttctctgatccaagagaaggaaaaacttacagtaattctttaaatggtgtaatttattcatttacagcatgtcaagataaattaaaaagaaaatttgtctgaaaatgctgccaggagcctattgtgtaactaggtgttgtgtataatcttgaattgtaaattgacccatgtttggtaagattgtatcagaattgatttgtagtagttttccttttcttctcccccccccccttttttttgaaacagcaataattaactccatgattgccacattctgtcaccaagagatgtgttattaccgtaaagctgaaataatcttctgaggtggatctgatggtggggtggcagcttcatgcttgtcagtttcttgactaataaaccctttgatacttttagcgggaaatcagtctcataaagctattttgagtatagtttgtgtaaaataaaactgttcagctttggcaatagctttccaagttgaactccctctctctatctagcaggatattttttcagtgcttttatttactatgcacttagactatgcactttttctgaaatatttttgtaacacttttttgtatttttgccatttgaaaaggttgtggtgttgttggtatgtcattaagttgcaggtttgaaactgctgttagctttgtgactcagaatctagaaatgttctgtcctggtattttgtcgtcccatctacagctggagctggaatccgttgatcttctagctaccattcattttcttcacagttcacaaagaagagcgtgaaattcagtgaatgcagttactaatcctgtctggaaatgaatctcatttcaccaaatcaattgtgtttttccactaaaatgatggtgtatgttgaagacatcactctgagattggaagacctcaccactaaaggctccatccacagtggctggctcagctgaactttaggttgccattcttttctttgttcaccattgggtgatgcagctttttaactgttgggagatggccattctaactactgttgaatgtctctgttttgggaaggtaaaataagaaaataaaaaaagaatatatatgaagggagaggctggttgtctctcccatgtggttgtgaatatgctcttatgacccacaagtggacatacaaggcttatctttgctgtgatttcctctctgctttaagtctatcatactgtaaatatttcagagtgtactgtaacacgagctgaattgtgataaatcatgaactgcagagacagacggtgtagtctaagccagtaggctgttctccctggagattgctgggaataataaagaatagtttattgtaactcaactagaatgagccatgaagattgcaaaaacggccatcaaaacatctttaattttacaacatccgtgtaggtgtactaaaagtgggcctcccgactggtcttgtctgtattgcgctgagtctttctaggccaa

SEQ ID NO: 25537 - DNA, 1148 bp, Mus musculus
tcttaacaatttctcattaaataaggctgatgcgtgccttttttccccgtcataggggctgacaagttactacctctcacaacaacaaaacttgggtttttagagcattggggattggatgcaaggtctcatgaatgccaggtaagctctctacagctcccagccctggcaagctttgtttcctcgtttctgtatccgccttaggccttgtttgtatgtacatccacttatgtattatccttgtaaattctatgaacccgtatagtttaagtctcaataactgatgatgtgtaaaagatttgcccagtaaataccttaatgcgcgaataatacacaaggtaaacttgataaaggttttagcataagaggtcttatataggagaaaatgggaatgagaaattgatgtaaataaacttgcttaggaaaaatactaggtagaatttggcaaaagcagccgtctgaatctcttagcataattctgccaggcaggcaggacggcctgggttaaaggatctttccctttattaatctcttaagagatggagtgacttctccctgggaaggtctatggattctataacatcacccattctgctgcttctggagcttaaagatgtctattctaggactagactcagagacagcccttctacagactttgactggactacaaattaaactggcaccaactgggtcactagaagaaccaaaatctgttgtccacataaatacaagaatcccacaaaatctgagactgtcagaaaattggtgcttagatcccaccctcatccacaggacagggcttaggtctcctagaaactggaagagcagagaaagctataatgaataaaggtggtcttgtagacattgtctgggaggccctttgatacataaaactggaaattgtaaatatacaggtatacagattttcaacttctgtattaaaaaagagaaaaacacctctcgagttctctcatgattgcagtttcccaaaatactatcagctcaatacataccacagactattctgaggtggcatagtctagtctcagacctccagtcattttcaggagggaccctcatgagtaagtgtgtttaaatgaagccatctggctttggtccccaccatctccgccagatctaaccac

SEQ ID NO: 25538 - DNA, 1091 bp, Mus musculus
tgtccacctaaaatcatttgcagtgcacagaggaagggccatattccttgtgttcttccttggtgaactgtatgtatctcctggaagatggacagtaaggctaaggtgcacctgtccatccacacttgtactgggggagcaaggatgttgattttcatggtcctggaagccagaggagtgatctgcatcttgtaggaaccagtgcctgagttcatggggtcaccaccagacagacagcactgggttggcactgaagtctttgctgacattgacatcacacttagagatggaatggaaggtaagttcatcgtatcccacacccagaaagaaaggtggaagaacccctgggggcagcagagttggttcttgccagtaacaatgacctggccatcgggcagctcctaactcttctccagggagaaggatgcagcagcaggcatgtcttatgggaagtcccaggcaacatggcacaggttccccttgatgttaacagttggccgtggtgaggctgtagcttgctcaggagcttcatgagtagtctagaaggtcttgtccaacaggatcacataaggaaggatatagtccctgtagatgagcaatgtgggtgaccctgtctccagagtccattgggatgcaagtggtactatgaagacagcacagccttggtggctatgtgcatggctgggtgttgatgatctgggtcatctattcatgactggcttagggttcggggagcagcaccaagcgctcctacgggaccacacatgtcacatagtataaagtatggtggtgtgtcttgtcattcaagttggtgacagttaaatcctccatggatacctcagggtcaggactcttctcttgctctaggccttgttacccacccatgtaggaaacatggctaacgccaccatcacaccccaatacattgggctaccccaccatgaagcaggagacagacttggaagcatgctcacctatgaagccagctctgttagtgccagtgaaacaatatctgcctccatggcaattggtgacaggtggacccggcagcggaggatctgagagaagcctgtgcttgccaggtaaatgtg

SEQ ID NO: 25539 - DNA, 1134 bp, Mus musculus
gtggcattagttcggcaagatggctacaaacttcatggccgcaccattagacttgcgcaagtggaagtggcagtagagtctcagagaagactctgaacaggtcactggaaccaaaccttctcccagagtcaggcacctatgtctcctttatttattaagctggtttgtattatacacgagtccttcgtgtgctccgtttcggatttagtcacattggctgtatctctacagcgtcttattgggtttgtgtgacctgtttggtctcatcgggagtcctgccactaggcatttgaacaataggacacgtgtcgtggcctttatcaaaatgtttacaaaaatcatttaaattggtactctgatgattgaatccaaaatcttcttacctgtgttttcatctaactgctggaattagtgcagcaccttgtatcttatattttgggaagagggaaaaggtagggattggtttgacgtttaggtacgtagatgacgatgccttacccttgtatatgtttaagtcatgtgggctggcgtgtagagagatttcctaagactcctatctcatgcttgtagtccttgccagggtcacactcacacccctttctggtcccttttggaagggctaaagggtcaggccagccagtcttcctttcttgttggtaaggtgaatatatttattactaaactggtctcgagtctaagaacaggcaagccctggttgccgtgacaatacaactcaatcccagagagactaaaagcctccatacatctcaagttggagaaatagactttggggacttggcatgatggctgtcaattcaaaaataaaaacaaaatattaaggtggataatattttttacagtttataatttacacaaaagtaattgcctcccttgcatggactcagaatgaaccaggctatcctcctttctgggttggagaggacaagagacttcatagcagcaacaacaaaaatgaatacaatcagagtcctcgggcgcattgtaaagcagttgctgtcaccttcaccattccagtttttaaatcctgagtcaaaagcaccaagaaaaagaaatttttttgtatatttattattgacaaaaagaccaaagttctctcagttctgcatatgtttt

SEQ ID NO: 25540 - DNA, 1197 bp, Mus musculus
ttgaagggtgtaaaaagcggcaggggagagcccgctgctggaagagcccaggcaagagaggatagagtgttttattctggttctttggagagggtcttactaagcagccctgaactcgtgcttcactctctttggtgatgggactgcagtgcagggcatctcatccctaccaccatagtggagtttcagagatagcttacaacctgatgcaagtcgctgtgcgtacatctatttccttagtattttctcttgctgcttcttcttttattatttatttattttgcaatttagaatttgacttttgtgctaggtcttgatcattgatattttgcccaataaatacttgttaaatgaatgaagttggatgatgtcagtgaagatatgggtcaattttattttattttttaatatgtgtgtacatctatttatatggctacacctaggcatgcatgcagtcacaggactatttgcagtagtcaaattttgtctttaaactgtgtgggttctggggattgacttcagggcatcaggcttggtggcaagcaccctttacctgctgagccatttcgccagcccaagatgtagatgcattttcgggtcttgcttggtgtgctgttgcatgactttgatcacagcactagatctctgtcagtttgaagtcagccagatctatgtattaaattctagtccagccagagctactttttattttttccttagatggggtttccctgtgtggtcctggctgtcctcaaacttagagatctttctacctctctgcctcccaagtgctggggttaatgtgacctttgtttctggaaaaaaaaataggggacttggatgaacgggtatctgaatgagaagatggactagtgtttgagtttaattttttaaaaaggaatgggacatgccccttcagcaccctaaatcctcaccaaaataaagcttactgttaccaaagcaacttggtcagacttttgtcctctgcctgttcgagttccatgaacacagacacagtcttctgtatctttgatctcgtctaaggtccagctcagatgtgatagctcacacacactctcatcttcctcaagtggtgacctatacgaaatgcagctaagatgggggccgtaaactcttccaaataagaaactcgaggccctgaccaatttgtgagcctgtgtaaggttccccagcgtg

SEQ ID NO: 25541 - DNA, 2184 bp, Mus musculus
gaatatgagatcttcaaaatggagcaagacacccgaggccgctacctgctgttcaatggccagaggcccagcgatggctccagcccagacagaccagagaagagagccacatcctaccagatgcccttggtccagtgtgcctcttcctcaccaagagctgaagagttgttggaagacagtcaaggtcatctgtatggcagggcagcagggaggacagctgggtccctgttgcttcctgcctttgtcagcctttggactctcccacattggcgcatcctcagatagaagacatttcctgaaccaagactctttaccgtgtatgactttccttcacacagagaaaggacattgattcttttgatgcacttgaatgccttgagacctgccgttgcctctcctctccccacctcttccagcctctgcgccatgagcagtgtgtttgaagtttcagctttgaatgtcttcccgcccgatccgtggcctgagaacttcatagaggtgtgattgcactttatgtctgcagagagctggggcgagtgtgtttaggggtggcagctgccttcttctctctgtcccctgactcctgactgtgtttctgagctgagcttaaaagatacaaatgacaagctgcagctctctctgccattgcttctctttatctctccaaatcccttccacactcgaggttttcgacactggaacccagtgcagcgttggcttgggaccgccatgaagaccccatgtttgcgacaggagagcctgggttggtgttgagtacataagagacgaggcaaggttcagctaagtctttgtcccagccttaatgctaaccaacactttcagaaatgttgagtagagaggtgtccctaaagcttcaatggaacttaaactctgttgacaagcgagtgccggttttcacttgttgagaagagatgtgtgccatatacttggtttggtggctacagagtacagcctgctgcttaaccctcagaggagactgatccagttgggaaattcagagcagctcctgctccaggcagccagaagcagcagtggggggtgggggtggggattccttgtgttaagtgccacacaactgacaaggagatctgtggagtttttctccaagtgaaccaatcccctgtgtcctggctcacactgtggttagggtgggcacatccactctgccatctttaacacacagaaaccaaacatcagtgctccagtagcttactaatggaaagaggttggggtgagactcacccacagatgagccactctgctaggagccagctgtccctgtgctccttggtggggtctaggaggagtcaccctgttactagaattaccagcttgattcggcttcctctctgcatttccctggttctgccccacctgcgaggtccagagccatctcattcagggttcgccgcttcacagtcatccgaagggaggaggggatggccgccacccattcctttgtattattgcaactggtgctataaacaccaagtgctattgctcacagagacccatgaaggtaggtggaggagagacaaaaaacctagctggaactgaaagcagacatggagaccaggacccaggagaagagtcagtcgtgtatttaagagttcactttgtgaagcagtagctttcagtgcggtgttaaattataacgaaggcatggagtaccagagtgctttatatttagattatattttaagtcatggtgcatacttgagggggtttattaaaaatgaaagtactaacttaatgtctactaagtttaataaacaaagaatttggaagtaaccccacgaaatacgtcttctttgtcgactcaatgaattctgacactgtcttcaaagtgtgagcctatagacacacttcagtgaccaagagttgggtttatagccactttggttcactgcaacccacctggactcatctatctctaccctttaacaatatgctgcatatatgcccacaaagggatgatagatattaacatagtgtaagcaggatgagtctgtgaagtttgtgtgatcactttctgatgtaatatacatctctacagagaaataataacagcttattcataactcactgacacattgaagtatgtcaccatcactcccaagtgcattcatctcggcttggttatatcatgctaacagcaatagg

SEQ ID NO: 25542 - DNA, 1719 bp, Mus musculus
tagatgtctgactgaggagacggtgcatggcgccacctgaccctgctcatgcgaccattgatggtcacagagccagtgggagcgtggttgttccctcacaggctgtttacatgtgtgtggaggatcaggcccagattggacgtgctactcagtgacctagaaatggcactgtcagctcctcccattctctctgtccacttgcattgtacccgagccttgttggcaccatggaccatgaagaggcagaacaaaaacacgagagactctttttctaggaatataaaccataagaataaacaacatacttcaatggagtggggccttgtctcaaggtaaaaaagaaatttatccgtcagcatattagatacattcaaattgttgagtcttttcggaaacaagctttggacaaaagctttataatttttagctcagtagcccttgtgtgtgactataaaatatggaaggtagcatattaaagtgctgttgtaaatgtcttcagccctcccaaaaaaagtattgctttttcttttttcttaacaacaaaaagtatgactgttcaaacctacttggctcttgaccaaaataggactaggtaagactatttatatttatctagaatgacaggtgacgttcctgccaatctagtgtgcatgcatttcttacctccaaagtaattttggtttggagttaataatttaacatgagttatgctaggtactgcaaaaaataaaaagttagccaggagggaaaaaactggttttaaaagacatacttttggactgggttaccagtctttcatactgcacagttcgcccatggctatttcctaaaagttagttttgaagcattcctctttttaccctgtatggctaaggcccattcatgcttcgtgaactgacgaggttgcaagcagtagtgcatgctagagagtagtgctgaatggaataggactgtcaccacactccaccatgaataaagcatgcttagtcatgctagattcctgaaccctaggaaaagcattgctacggtactggtccccttgttgtgggagtgctcctacagattggcatcctctgccaggtgggcttgagtggctgggtgtctctgaacaatccctgtgcagattacaggtctgacacaaaacactaatgcaaggtttatgctttcccctaagttacctgcaccggtcttttggtcaccagcttattctctttaattacattgagattatgaataaagtggtcttccaaatttgtatttaaaaagggaattggtatttccaagatcaatattatgtttcaatccaaccagaaatactggtgcttgttgaagcaaattagcagacttttaaaatatatttggcagtactcaaaagttactttagactgtgttatggcccaggttattcaataaaaccgtgtggagggtcggttttacttgtatccaccataaacagcaattctcaacgcactctgaagcaacagtgagcttggttttaaacagcagagtatttaggcagtgcccgcctcccgccacccccatcaggagccagcgtgcaggattcaggttattttgcttggtgtctcaggaacatttgtccctcgtgtgcactttttatttttctacttgtattaagtcttcgttcttgtgagcttagtcagaaatggaaaacgtggtcttcacagcaagcagcgctctcgcgccctccctaggaaagcc

SEQ ID NO: 25543 - DNA, 1454 bp, Mus musculus
tgttgctgctggtgttggtgaatttgaagctcatacctccaagaacgggcagaccctcgagcatgctcttctggcttacaccatgggtgtgaaacagctgattgttagtgtcaacaaaatggattccaccgagccaccatacagtcagaagagatacgaggaaatcattaaggaagtcagcacctacattaagaaaattggctacaaccctgacacagtagcatttgtgccattttctggttgaaatagtgacaacatgctggagccaagtgctaatatgccttggttcaagggatggaaagtcacctgcaaagatggcagcgccagtggcaccatactgctggaagctttggattgtatcctaccacaaactcgtccaactgacaagcctctgtgactgcccctccaggatgtctataaaattagaggcattggcactgtccctgtgggccaagtggagactggtgttctcaaacctggcatggtggttacctttgctccagtcaatgtaacaactgaagtcaagtctgttgaaatgcaccatgaagctttgagtgaagctcttcctggggacaatgtgggcttcaatgtaaagaatgtgtcggtcaaagatgttagacgaggcaatgttgctggtgacagcaaaaacgacccaccaatggaagcagctggcttcactgctcaggtgattatcctgaaccatccaggccaaatcagtgctggctatgctcctgttctggattgtcacacagcccacatagcatgcaagtttgctgagcttaaagaaaagatcgatcgtcgttctggtaagaagctggaagatggccccaaattcctgaagtctggtgatgctgccattgttgatatggtccctggcaagcccatgtgtgttgagagcttctctgaccatcctccacttggtcgttttgcttgtgacacgaggcagacagttgctgtgggtgtcatcaaagctgtggacaagaggctgctggagctggcaaagttaccaagtctgcccagaaagctcagaaggctaaatgaatattacccctaacacctgccaccccagtcttaatcagtggtggaagaacggtctcagaactgtttgtctcaattggccatttaagtttaatagtaaaagactggttaatgataacaatgcatcgtaaaaccttcagaaggaaagaatgttttgtggattattttgtgtgtgtgtgtgtgtgtgtgtgtgtgtgtgtgtgtgtgtgtgtgtcagttttaagttattagttttcaaaatcagtactttttaatggaaacaacttgaccaaaaatctgtcacagaattctgagaccattaaaacaagtttaatgaggaaaaaaagagaaagaaacagaaggaccactcccaaatttcttctgtgaagtcagtattactgcaatactaaatcagttaaatacacaataacattacc

SEQ ID NO: 25544 - DNA, 3217 bp, Mus musculus
gacactggaagacttactgcagtcagacttgcagctcctggataattgcttgattctcttcggaaactgttaatcttttatttgttgccagtaccaataaatcattgcttttgttcagatggcatcactagtgtttgtagtgtaatcgtgatacatgcagttgtaaataaaagtcactacttttgccaagcttaagtcttcgtcattctatataaatgcattctctctctttttatttgaaaatttgctaacctcttgttttaggagttgtgtctagtatcacattgactaaaagttactctatctctagaggaacagaacgccacagggattaggagtactgtctatacacatggagagtttagacaggatttgaaacctccatgtatgtgtaatgtttggatgcatggatttggaatggttaaccaagttcaagtacattctgacttattttatcaaaaagcatttgggtatctaggctttacaaatttgttaaaaaacccaatttataaacacccagtactcttacctatcactggtagttaacagatttacaaatattttggttttaggttagcttcactgttgatatccttgggtacctgccttccaaatggtgggattgtaggcctgtaccactaaacctggtctcatgccaagattttaactttctgcataaacctaaacattagagtcaactatttcctttaataatgcaggtattaaaactgaattcagaaaaatttggaaattataatacatggagattatttaatttaaaaattaaaaaatatggaaaattagaatcaaatctattatctaaattcaccaaaacattcactctatatagatagagaacatgatttaagcttaaaatgagttgtcccagctgtttgtttgaaagatcttccacaaaagactggataagcaaatacttgttgttctaagcttttaaaacatttaatattggcaaatttaatgtttaaatactttattttgttttatgtttatgtgtgtttggcttccatgtatgtgtatattcgtgtgagtgagtgtggtgcccagcagaggggtgacagctggtgggaactgccatgtgggtgatgggaactgagcccaggcctctataagactgctgctccatccccacacattaatcttgtaattcattattttaaaagcatatataagactaataacttgtaattcatttaatacatttgagggcattcttacctatatagtgcagaggtttgcctttggatactaatgtacttatacgtaattatgagaaaaaaaaaaccaaactctggatgttgttgaagtagtgttgaaatagtccttttctgaaacttgtgtcattaagtaatgtttagttcatgtgtatgtgagctcagtaactggtctgtgataatgtctgtattttatgtatttcacagtttgttgacttaaagtgaaagaaagacaaaaaaagtaaacgtttataatacctgtaaaccatcctgaagttgttaatcacacctgaaatggagaagaagatgaacatgaaaagttgtagtttatacttagcctctttggtaatcattaaagtgcctcgtcttggctgtaaatggtctcatcctatttgacttgaaaaacggagtaaaagtggtttcacatttgcaaaggaccagacatcaaactttttgttgttcatatgatttctgtaactttgttgcaacatacaaacatcccacatcattcaagttataagtggtgaatgctagtgggaagctgacatgtgtcacaagttttattacaaaaaacccaaatatgcatagttgagatgtaaaccatcaagctaaaatgctattttctgttaaaatagtatatcaatatatatttataaatataaataagtatatttacatgtaacaattttcctgaaaagaacatgaagaatatgtagccttggctgtctaatcattagccatccattaatgcttactagaaaactaatatttattttgtcagccataaaaaaaaccaagaatctgtatgcatctcgtatctcacatcaggttgcctaattgagacatacagtgaaatgctgtcagcagaaacacagtattgctataggaagtcttttcagagaaagcctaacaataagactagcacttgttacttcactcaggtgttcctcttggtcctttataaatgtattttggctatctgctgccaagtaccaaactgccccatctcagtacatgaatgtattggatggaggtagtcacctagccttctgccaaccatatttttctaaacgattagatatgtgtaagacgttttttgcagtgttcatagtttgtgctattagtgtacatttaataccagcattgcttatggttgtcgttagtaataaattgagagtcttgggaccatgatgtcagcaacgagatacagtcctgtatgtgacagagagtcgcacccctgtcagattttaacaatatagtcacctgaacaagactagcacagtgacaccatcagctgacatgccaaaatggattgaggatatcttacaaggccaaatctctaaaataaatttcccagtattacccagggaaaaagtctcttgataggttatccagtccctagtggtcagccctaaatacatacaagcaatactaaatggacttgacaggttatatacatgcatatgtgtatatattttctattgctgtgacaatccctggccaaggtgtgttatagaagagttcattggtacttactgtttcagagggtgagtctatgactgttatgttggggagcgtggcagaggcaagcaggcatggtcctggggtggtagctgaatgcttgcttgcaatctgatccagaactatgaggcaaagagagccagctgggcatggtgtgggcctttgcaatcgcagcaggaaagagaggggttatgttactttaattacattttaaaataaaagactgctgatacgtaccttatttgaatcaataccaatacccttggtttcttttttattactccaaagacaagttttgtctatagtttcttaagtgttgtttatatatgaaaatcttatttgtctactcacctcatttgattatcatgtttgagaaatattgatccgggggaaattgggatttcctcctaaaatttttagtctcattaataaaatacattttaatatatgtttatttgtttgtt

SEQ ID NO: 25545 - DNA, 1100 bp, Mus musculus
ctctaaaaaacgcctgctgcccagctcccaccacggcctttctgactcagtttatgtacaggcccagcagtgccctgagagctgagagaggccctcaggtcagtctgaggcagcagcccgtgaagcaaagctgtgagagtgaagagcagctgtaggcagttctcaactgtagaaggtcaggacacggatgctcagagtgtctcagtgagcatggctctggacagtccgggtcttggtgagcatggctctgcagtgtccagctgagtcagcagagggcatcacgactagagtggagacagctgaggacctgcgaggctctctgtaactctcaattttgggtgattaaaaaatacttttcaagactttgctgtttcccagtatgtcaagagcctcataataagaacacagtgccatccaaaaggctttgtacaggaacaggatggagaataggtttaagaatagcactttcggggctggagagatggctcagcagttaagagcactgactgctcctccgaaggtcctgagttcaaatcccagcaaccacatggtggctaacaaccatctgtaatgagatctgacaccctcttctggggtgtctgaagacagctacagtgtgcttacatataataaataaataaatctttaaaaaaaaagaatagcactttcacatgtatctggtcaaataatagcttgaaattcatgcagataacctccctttgaacaaactagtaatgaagctggcagtatatttttaagagcaagagcaacatcagaaatccgtcatttttgctgtactgatagtaaacatcccagctacagagtcagtgtccgtgcatgtgccatcgcctgtgatgtcacgcgagtgacatgcagttagaataccaagtgttcgtaactgtgttgccacatgctaacacgactgtgaagggatacaaaactagttccgctagcaaaataagcaaatgtaatgtcagtggtttgccttgttgctaagtgattctgtgcgtatgctacggtcccttctacctggaattgttttacatcctttaagagagtccctgaaccactagcagccacaggtcatgagccgaaggcct

SEQ ID NO: 25546 - DNA, 1333 bp, Mus musculus
acttcttggtatctaattatagcccccatcgtgccccaaataaccttacatcctccagatgcagaattgcttattgtcctgacttaaaagttcgcaaacaagtgtatcctttatgttatcagcttcactaacgtgtggttcctcttgctttgtggttctgttctgtatattataactcagtgaacgtcggttccttgaggaccagaacaatatcccatcctcctctgtgccctttgctctgactcatccagagcaggcagtgtttgctgactgtatagttactcagatgtagcctgggtctcttcttagagtcacatcttaaggttcgtgcagtaccttgccctgggtagtatcatttatttcatttgaaagtgtttcatcttttccgagtaaccgccaagatggccgaagtggagcagaagaagaagcgcaccttccccaagttcacctaccgtggcatagacctcgacctgtcttatgagctcgacatgtcttatgagcaactgatgcagctgtacagcgcccgccagaggaggcgcctgaatcgtggtcttcggtggaagcagcactcactgctcaagcgcttgagaaaggccaagaaggaggcgccacccatggagaagccggaggtggtgaagacacacctgagggacatgatcatcctgccggagatggtgggtagcatggtgggcgtgtacaacggcaagaccttcaaccaggtggagatcaaaccagagatgatcggccactacctgggcgagttctccatcacctacaaacctgtgaagcaccgccgcccgggatcggtgccacccactcctcccgattcatccccctcaagtagccgaggccattaaagactggttttggtccctggagggggggggggggggaatgtttcatatatgtccagagctgagctgggggggcagagggtgtatctcagaatatggtctttgcattaatggcataattagaagaaattacttttcattgattccctaggcacagccagagctgaacattctgttgtggccgttactgctcctcctcatcagttaagtcctctaaggaatgagcagggagtagtcattccatggcgaagctaccttgtagagatgctagcaccttgtattaggcaatctttttatctcaaaggccagatactaacatgttaattaataatggctaactctttttgttagaattttggcatcattctgtaattttctaaactttttgtcagttgaatttacttttacatttagataaaaggttgcttattattactattgttattgctattaatcgttatcattctctctacagcgtt

SEQ ID NO: 25547 - DNA, 1393 bp, Mus musculus
ttgagtctgaactgtccgctctgtgtaaatcctgtctgcaggaagactaaatccttcttcaccagccaacagctgtgaccctgcctgaggacccgtgggatttgcagatgtgcagcctccagacacctgcggtggggacgatggggacagaagccacgtttgtctgggcacaaactgtgatttctctcttgcctgtgttttatcttattttatcttatttctcgcttgccctatgtaggccaaactggcttccagtgtgcctcccgctcccgtttcctgggcgctagttagcatcacagacatacaacattgtgttccttggaggatagactcgaaattcttactgagatttctattttcatatacaagtatagtgactgatcctggggtcaatttatcaatatggaatatctgtctactgggacatcccaggaatgagtttcacagttttattttatgagtcgcacacaaattctacacttattgcccaaaacaacttcctacaacattgtggtgtgtctcctcatgtgctaccagtggtgactgagatgtttacagtcttatggatatagctatcacttaagtgagtattgtgagtttatgaaatgtaatttgtaaaagaattaggctgagcgcacagcttgggatcatgtgctcacctgcatcaaacacaaaacacgatggtacctactcttttcccgagtccatggctacgggagtgtgagtgagttggagcggtcacctggcactgcttctgttgacagtgtagccactgtccactgccactgtggtgactgcaagagtctcatctccctccctggaaactgaaacaagtgcatgtttcaagagtgctaagattccccgggcgcatagcctaataaacgtgtgcaagttcagtctttgctgtgtacgccttcatttgagtccacagtgcctcagggaaggggactctgccttcttcctgtctccagggacagtgccaccaggaaatgctactgatggatatgggcttagctccccaggggccagggaaccttccagtgccatcctaatcttgactgagtgcttattttataaagttgactgtgtctgatagccttgaattttctttgtgaataagttcttaatataaaaattacatggttatagactaggccatttgtaaaacacaaagaaataactaatgtaataattatcattttattctaatcttttcctgcatatatgtgtgtatacacacacacatatatacatacatatatatatgtatatatatatatatacacacacacatacatatatatacatacacatatatatgcacatacacatacatgcatgcatatatagacatatatacacatacatacatatacacatacatatatgcaca

SEQ ID NO: 25548 - DNA, 1990 bp, Mus musculus
gcttaagatctggaaccactcctacagatagtattgaactaccatgtggatgctgggatgtggcaagccctctggacaaacagccagttctcttaactgctgagctaccttgctagctcctactgcagttttgaaaaaaaaataaattattaggtccgaccagcatctaatactgttctcactttcctctgaaaaatcaaagcaattagtttgaaaggtgaaatctcttcctgtcagatggttcactgaactgttcctctctgcatggtttatgaaggcgtgtggattgtgttgaattattactacagtgagctaactgttagagtgtggaaagttagctcatcgtagtaataattttaatgtgattagatacagttttaaaataagcactctttctctcattcatttaacagagaaaatatggcacctgtcctcatggagggtatggcttgggcttggaacgatttcttagctggattctgaacaggtatcacatccgagatgtgtgcctgtaccctcgatttctccagcgctgcaggccataaccatggggccctcaagcacgaaggaaatgaaaagttaagactgcctctgcaaaagaacaaacgcccaaatcgtcccttgacttcctgttgggggtagtagctttctcttgactttcccattatcagaaaaagcagtaggtatcacttgaacatcaagtgacattgatgctcctttaatgaatatactcattacaaaattttgaggaaatatatgtcatgtcactctttagtatggagatattttattgtgctataggttacaatcattgtattaaataaaccatacatgattatacagtttttaattatggtctgacatccagtaaaattccatctttttgtccttttaagtgtcgctgggattctcgaattcaagcatctaaaagagaaattggctgtttgacataaaagatactggagtcaaatacatagccctttacattcactgttagtcttttccttattcatatagtgtttataattctgaggggtatgagttgacaggggaaattaatgaaggggaaatggattataatttgcaatgaacatgattggatggtgggttattcaaatgattccaaccccgttagcctttagtttaagaacggggcagatggggcttccctctttgtaattcctgagtaacaaaagtaaatctgtttgcaaagactttgcacctgaatcttagccaccgtagacagctacgtcatccctgcctggtccttgggtgccatctgcactgccttgccgactcagcagggctaccagtggctgaagtgcagttgctctccccagatgcatgccgtgtgttctaatgggctgtatcccactaaccaataaatgagcagtggttaaaaaacaaaccaaaacactttgctgacttattttctcaatgttgaccatctctgactcacattttaaatcttagacagttttatttgttataattattggattctgaagttgctattattagagtttcatgatagtgacagaatgagttttttaaaatttgacggatgcttgggtcctagttacaactttttgtactttttagttgttagttttaaatacattaaattccctactgttctcaagtcagtaaatgactgatggaaacgggccattgtgacctagtacctggacgaagcagtaagctgtgcccagtcttagcagtaggcttcactctggtgaagggttgaggttaggctcagtttaccttgaattttatgtaaattgtataaataggttgatagttaaaacacaaagagaaccaggattggataagaaagatatcagactatgggacccaaggcctgaccatgagtgaccacaggccccatccatgtgtactttgtctcactgagattcttgctctactttcaggatcacaaaagccatccctcacccctttcaaggagcagcttgcagacagcccagtttct

SEQ ID NO: 25549 - DNA, 2119 bp, Mus musculus
gttaggcttttcactactgtgaagagacaccatgaccaaggcaactcttataaaggacaacatttaattggggctggcttacagttttagaggtgggaagtggcagcatgcaggcagacatgatgctggagaagctgagagttctacatcttggtttgcaattagcagaagaggacactctcttccacaggcagccaggagaacgggcactgggtggaggagtctgatcataggacctcagagcccacccctacaatgacacatttcttcaaataaggacacatctcctagtgccacgtcccatggtccaagcatattcagactaccacagcctttttaatttacaaaatgcatgtgtattttttcatggaaagaagtattaactgcaaaattatagtactgagttattgggtctctaattctggagactaaagctactaacaatgttcttaaattaacacctttctaaaaacttggctctaacatcttcagtgctgttaatttctattgtctttctcactctctctgctattctcttctgctttttccacatgtaggctccaggaggccatgagctgagctgtgacttctgggaactggtggggctggccccggctggaggagctgataacctgatcaacgaggagtctgatgtggatgtccagctcaacaaccggcacatgatgatccggggagagaacatgtccaaaatcctgaaagcgcgctccatgatcaccaggtgtttccgggaccacttcttcgacaggggctactgtgaagtaagtgcctgcctgcctgcctgctacaggtcaccttttgcaaatggtcccggtgctgtttggaagtgatggccacagcacacttgtctgctccttctccccttaacaggttaccactccaacactggtgcagacgcaggtggaaggtggggccacgctcttcaagcttgactatttcggggaagaagcgtttttgacccagtcctcacagttgtacctggagacctgccttccagccctgggagatgttttttgtatagcccagtcatacagggccgaacagtccaggacacgaaggcacctggctgagtatgtaattgtcttaccaaagcggctccttgggctggggggagaggtcagctggtagagtgcctgcttagcatataaaggttaagtccccagcatcacagagaagtgggcctggtggcacatgctggtaatctcacttgggaagtagaggcaggaagatgagatgttcagggccaggctgggctattataagaccctgccaaagcagaaagaaaaggcggtcggttcgttaggccacagctaaaatctgattttcctgtgaggtttcagtgaggcttgtgagatacccacagctcactctgttccccgagggtcaaaccttcgcgtccgtgtaaagtaggagcggcgctcgctcagctgtgtctgttcttcaggttcactcacgtggaagctgagtgtcctttcctgaccttcgaggacctcctgaaccgtttagaggacctagtgtgtgatgtggtggacagagtcctgaagtcaccagtggcaagcatagtgtatgagctcaacccggtaggtgtagtgtcgtctccaaatgaaaggatcccagtctttggggaagacagcatccctctattcttggaggcttggtgaaccaagtgaataatgtttcgaatatttaatactggtaaattgccagtgactgtattttagtttatagaagaggcagctagttgataagtgtttcttcatctgaaatactcattccgaatagtaatctgtctgcagaactgttttctatggtaaagagtttattgttactctatgtgtaatggtgcaggtggaaggcagagaacaacttcgtggagttgggcctcctcccacctccaaccttggtccacgggtaccaatcaggctttcatggcaaggactttacctgctgagccatctctccagggtctacatcccctgcttgtatttttactttatattacatatatttatatttatatacggatggatattttgcctgatgtatgtctgtgcagcatatgcatgccgtgtctctgaaagccagaagaaggtgctggatc

SEQ ID NO: 25550 - DNA, 1125 bp, Mus musculus
ttccattctgcggggcacccttcttttttcctttctcttcttttcttttctttctttcttccttcctttctttctttttttttttttaataaaaaagggttctttgctgtcagtttcttggaataatttaaagggagaaatattttttttaggaacttgcatcctaagtagaaatatttctttttcatctttatgtgtgtatctgtgtacatggtgtgtgcgcgtgagtgtgtgtgtgtggagaggtcctcaccgtctaccctgtttgagacaggctctcatgttcaccccagtgcacaccaggcaccccccatctcactgtaggacactcaggttgcaggtgcatgctacagcatcaactttgtggatgctggggttcccacctcaggttctcaggcttgcacaggaggccctctactcgctaagccttctctccagccctacattttaataggtcaaggcttacagaaatggtgatttatatgtgctgttaatagcatatgtagatctagtgtggcactttatgataactgagacttggtgattgttgacagaaagcctgtgattgtaaagaaaggagcaattaattgtgtgtgtgtgtagaaattgctattaatattaatataatacccaaacctcattgtgtggtgatatagcatgagctgtttctcctgctgattctgtcttactgcattttgagagccagagccaaccagctacctgctgtgttcaaactttaagatggagttgtgacttcagactcagtgaaaacagcccaggtgttctttaactgatgagggtgaacaacaaaacattgtgtgtctataccatgaatagtcccgagccttgaaaggaatgaagtgaagcaaccagccgtataaggatgtgtgatgtatgaacccacggacaggaaaatcggcaagcccaaagatacagaaggaagagctgctggtttagtggtgttgtacaggattcccagaggtacggctgagaactgggtgagctttggcattgtggaaggaaggtaagggcagttctgttgttagttcactatggctaccatagcaaaacaccatcccagagacttaaagaatataagtctatgttctcccaattctgcaggtg

SEQ ID NO: 25551 - DNA, 1138 bp, Mus musculus
ttttaaaagatgaaatagattatgatcccatttctcagtttgctattaatgtaatggaactgggctcagaatcttataagaacacctataaatttcagttctcagttttcctatttgtatgaaaataaggacctggtgcaaattagatgcaaattagaaagacaaactgtgtagcctgagagatcagtgccagagaaggacctctaggtacctcattagcatggagacctctgtcttgagcctacttgacggtaagatacgtttcttctgcgtgagaagcatagcacttgttctgtctggcaggggggctggaagtcgcctaagcctcaggtgtgtgcccaccaagtctccgggcctcgacctaccttaccttaccttaccaaacttcctggcatgggtttatgtcccactgaagacatttgaacaaagatgtaaacatgaagattaacagaaagacgggtgctgcccaacaggtttccaatgactctgccccacttctgtattttggatgtgatcatagggtggctcctgggtgccttggataggattacagtctgataaggaaaaccatgagtcacaggatagttcagcagggtgaagatatgccttttactgtggggtttccatgagagtctcagacatggtcaggttgttagttcaccaaactgtccttggtcacatgtgctaaggccttaggcactgctgtcctggcattcttctctgaagtatccctctatacaaggagtgttgctatacagatagatggccttggcagcacgtgttgttgctaatgtactgacattcttgattcacctgattctggggtgaagagctcttttccagggtcccctcatttcctccctctttttatggacttgtttgctctcgttggtttgcttggttgatgatgttgtccttctaagccttgtcttattacttgatatttttctggtgaccctcattcactttccgcctgaccttaacacatctttcaaaaccctctgtgtcaccagcaggtctgtgaaacagataacaccaccctgcagccgaaggctggagcccagggagagcccacagtggtcagtcagcggaagctctgaggtagcattaggccgtggtcacgagtacaagagcaggt

SEQ ID NO: 25552 - DNA, 1202 bp, Mus musculus
aatatgctctgtgtcactaagctaaaagccagccagttttagtgaataaaaataaaagttcctttggtctttatggggatgacaagaaatgtcccgagggggcattcttgctcccttagctattctttctaacattttttgtagccatttagggaccagtcgggaggactgtccttccttgctcccagatactgtgtcactcattgtaaaggagggcattccaaatagctgagagactcagaggttccaggtcacctgcggcagactgtacgtgagtcttaaaacttggctgttaacttccaaggtgcagtttggctgcagggcagcattacagagcttgagttgttccctaggtctctggaatccaccaagttccgcctatagtgtttggccaggctgcctctgggatgagctgtttctgtcttccccacgtttgaattcgctcacgctttgagacaggcaggcatcagcaacagcagtttttagcccagacagctctcagcaccgtcagctcagcacagcttcagagggctctgcctggtgggaagctctgcagggctctacctgggcagtagctacagagccctcccctctcagcaccttgctccgcccactcgttccaggctgtcgattgccggtagggaaactggagagaccaggattcctcttccattcttgctgttgttaaggaaaacagaccaaccatctgcatctagaccagccttcctctccctcgctcccttttagaggaggttttcctgcctggaatctggtaagtgtgggcaaaggctctgtctcctttcttggtctgtgcagaacggtctcgtgttgtggatctgtgagctttaacctacatgtgctagaatttagaggagtctttgagcttacaccttctctcgcttatagtgctccttgaatatttttagcatgccttgatacctgtatcaaaaatatagcatattttttccattactgatgtgcttaaacctgtgtcatcttgcctgaagcttcttctcactgtacagcgcaaaaaatgattatggagatagttctctggtgccttccccatgaataaatgatgcatttgtcattgctgttttcctgaaatgtcaaaaatagacacagtgaaaggatctgtcacacagagttcagaaatttggtacaaaattctaggttgaaataaggacagatcttttcttttt

SEQ ID NO: 25553 - DNA, 1182 bp, Mus musculus
ctcaagctgtttgtcaggaacagtaagatggttctttgggtaaaggggctttccaccaaggctgataaccagagtgtgaaacacagttacacgctgaagttgagaaccaactctcacaagctgtacacacacaggtgggcatgcatgtatacacacatgcacatacactcccctccttaaatatataaatgtgataatagaaatgactgctaggcttttttggttgcactcatacaattagcatcatggcaatatctactttgctacggtttccagtcagatgggtttcaagcagtggctcattttactctgtacttcccagcaagaggaactttttttttttttttttttttttttttttaaataggtttgccggttgtctgcatctattctctgtggcttacacattttgttttattttgagtcagtcttgttcctcagccaacctgcagtcttccagcctgggattataagtgcataccaccacactcggctcatgtttattaatagattccttactcacctttcctttgaatatgctgttcttatccatttctaagttactggtacaatctcatctgatcggaagctaagcagggtcgggcctggttagcacttggatgggagaccattactactctctctacttaaatcatgtatcttctactacacaagggttttcccttaacatatgccccactgtcttacccgcattaaattttgcccaagtcctcccacacagcacgattttacagtttcttacatttgcctcctaaaaactgtctgtatgcggctaggggtcagaagattctggggcttgtcagatcacactgacagaatcatccctgcgtccttcctgccacccccgctccagatgaagagatgatggagcctgctctgtccaccggatagcaacatgcttttctcaacgctgtgcatccatctatcccttgcccagtgagacagccacgcactctctgtttggttccaccgaattctttggaccttgaatctatcccacgtggctttgaccatgaaaacctttctcagcatccttccctcacattctgtgctcacttgatttccttccctcacattctgtgctcacttgatttccttccctcacattcaccttggcttctccccagaattatgcatttatcctttgatagaaacaccagg

SEQ ID NO: 25554 - DNA, 1154 bp, Mus musculus
ggacatgtgcatgcagaggtgaaagaacaagcttttagagttggttcttcactcccatcaagtgcattcctgagatttaaggtcttcaggcttggcagcaagcacccttgttgaaccatgtcactggccccaataataacatttcctgattaccaaggtttacatggtaagtaatagctattagaaattttatatagaaaataatcctcagatgtctaagagaatataataattgagtttttaagtgaaagttaatttttagggttcagtttttatagatcaaatgggtttatcaactatctaagcgcgtacctgctttcttttctccagccatcagtggtgagaaagttcaagttctgagctcattgcttcacttcctagaagctcaggagaaccacccggagctgactgatgtcaggcaggaggatccgtcagttcacgggcttcctgtcagggttagaatgacctatctgttcatgagatggctaaggcttcgagcatgaaccattgtcagggagatcgtcacagtggggtgaagatataaaacctagtcacatgggcgcaggaaggaattttcatatcactggggtaagaacagggcaaagtttgctgatagctcagaaggttgaagtgaaaactaaagtccccgagttcagtccccagagcccacatgaaaacagcgtcttccagagcccacaggactgacacaggcaggaactcacagagacagtgtgcataaagctgcacaagttcggggagggagggggggtggaatcccagcatggagaaggggacgtagacggagccctgtctctctccaagaagctgcatgcagttgatgccttctgggaaagagaaaaccaactttctccaatggagcaacgttgagtacatcaactgcactccagggcaggccccttgctgggaggagctagccaacacaaaacagatcccctgtttgtgtatgtgtgtgcgcgagttttggttcggtttggtttaatttgttatatttttatctttggggtttgttttgattttaggggtttcttaagagaggcagaatttgaagttgggtgtgtagggacatagtctctaggaggacttagttgggggcaggaaaggatatgatcaaaatatattgtttgagaaaacat

SEQ ID NO: 25555 - DNA, 1155 bp, Mus musculus
atgcttctcaaaggatggtcctaacacctgtcctgtaggcctcagggggagctttttagaaatgcaaaatttcaggccccagcacagaaagcctgaatcagaaaccggagtttacccctctcccaacaccgttgtagttccacaaactccacccggggattcttgtccatgttaacgactgagaaaggctcccccacacttcagcttcaggatattttggggcaataatttctctatgatccctctcagtcacatagagattacttcctgtttcatgtctaaatttatctccttaaagctttgaagggtggagcccgcagtcttcaaaagtgtaagatactgctcttacatgcctttgtgggtaacagcccagggtgggtctcagcagaaggggaaccaaggaggagatgaagacacagctggcaccgagaagggtataccagggctgatcttttgctctcctccccttgaccatcatttaataactggcttctccaagacccattcaaaagaggagcaagcatagtctgccacggttgagttttaaaggttagttagcagcatgggtctaaggcgttggggacagtgtatagtggagatgctgagagtctcactcattgcccaatattcgtccagaagtttcctgaagaaagaaaggagcgggggaagcagagtgtacaggcctccgtgaactgaggacagataaggaataaaaagaagacagtgatttagaacttggtgtttagtttagaggactgaacaatgtctttttagcatcctggtactttcatctgcgctaccttggcatttacccgagctcattgatgttgacaaagagtaaatcctcaagctcacacaccatcacccttgtgtagcaacgactatcgccttcctctcaggaaagcgtgtccttctggactgaactttcatttcctgtcatcaaaccaatgccggcatctttgcacattcttagttgtggtgtgtgtgtgtgtgtgtgtgtgtgtgtgtgtctgcagaggccagaaaagggtggtagatcctctggagctggagttatgggtgcttgtgggctactcagtgtgggtgctgggaactgaacttaggtcctctgaaagagcagcaagtactctaaaatgttcagccatctctccagac

SEQ ID NO: 25556 - DNA, 1233 bp, Mus musculus
caaacatgtatgtatggagagaaaactagcaacaactctttttataggaatatgagatgttggaattacgttatttaagctgggcagtgatgacacacacttttaatctcagcactcagaaggcagaggaaggggcagatctctgagtttgagaccagcttggtgtacatagtgagttccaggacagccagaaatacagagagaaatcctgtctaacaacaacaacaaaaattacattatttatctaaactgtcttttgcttttgtcctgttgtaagactttgtgaattaatttgttctgtaagaatgatgtgtggggcctgtaaatattgctcagtggtacagtgctcagctaatatgtggaaggttctggacttgctcatcattactagaggggaaaatgagttattagagtaaatatgtatgtgtatcagatattttcattttgaccactcataagagcaatgaaaatggcattattatagattgagttatgtcattagcacggaaaaagaaccctttctctttttcagagttattttatttatgtgtatatgtggagacctgagtgtatatgtgtgctaatggagaccagaagagggcatcagatactggaactggaattacaggcaggtgtgagcactcagtgtgaatgctaaaagctgagcccacttcctctgcaagtgttcttaacatctctcaaccccgaaagaacctttcagtcatcgggcttaataacttcattttatcaatgggaaaaacagaggcaatctgtcttacactggagcacagctgaagtctcagctctggtctcaaatttctcttccactgctttctactcttcaagtggtttagacatctaaaaaagtcttaagagtgtggtggtgcatgcctttaatcccagcactcgggaggccgaggcaaataggtctctgtgagtttaagaccatccttgtctacaaagaaagttcagaagagccagggctacactgagaaacctgtcaaaaaaaattcttagagctaaggtaatggctcacttaatagattgcctgctgcaaagtgtgaagaccagagattggatcccagaactgacctaaaggatggggtcatagacagccgaatcaatgacctctagggtcagtgaaagactgtctaatgtagaaagcaactgaggaagacagccagtgtcaaccttcagtgtcctgttgtgtgtgtgcacatgtactcacataaa

SEQ ID NO: 25557 - DNA, 2807 bp, Mus musculus
tcgatcccaaagcagcgattgagtccggacacgatgaccatgagagccacattaagcagaatgctcacgtggatgacgactctcacaccccatcatcctcagacgtcggcgtcagtgtgattgtgaagaatgtccgcaacatcgactcctccgagggggtggaaaaagatggccacaatcccacaggcaatggtttgcataatgggttcctcacggcatcctctcttgacagctatggtaaggatggagccaagtccttaaaaggagacacacctgcctcggaggtgactcttaaggacccggcattcagccagttcagccccatctccagcgccgaggagtttgaggacgatgagaagatagaggtggacgacccgcctgataaggaggaggcgcgggccggtttcagatcgaatgtgctgacgggctcagcaccccagcaggacttcgacaaactgaaggcacttggaggggaaaactccagcaagactggagtctctacatcaggccacacggataaaaacaaggtcaagagggaggcagaaagcaattctataaccctgagtgtttatgagccatttaaggtcagaaaagcagaggataagttgaaggagaactctgagaagatgcttgagagcagggtccttgacgggaagccgagctccgagaagagcgactccggcatcgctgctgccgcatcttccaaaacgaagccgtcctccaagctctcctcgtgcatagcggccattgcggcgctcagcgctaaaaaggctgcgtccgactcctgcaaagagcctgtggccaactccagggaagcctccccgttaccaaaagaagtgaatgacagtcccaaagctgccgacaagtctcccgagtcccagaatctcatcgatggcaccaagaaggcctccctgaagccatcagacagtcccaggagcgtatccagtgagaacagcagcaaagggtcaccatcctcacccgtgggctctaccccagccatccccaaagtccgcatcaagaccatcaagacatcgtctggggagatcaagaggactgtgaccagagtgctgccagaagtggacctggactctggaaagaagccttctgagcaggcagcgtccgtgatggcgtctgtgacatcactcctgtcatcttcagcatcagccacggtcctctcctccccgcccagggcacctctgcagacggccatggttacaagtgcagtttcctctgcagagctgacccccaaacaggtcaccatcaagcccgtggcgacagcttttcttcccgtgtctgccgtcaagacggcagggtctcaagtcatcaatctgaagctcgccaacaacacaacggtgaaagccacggtcatatccgccgcctctgttcagagtgccagtagcgccatcatcaaagctgccaatgccatccagcagcaaaccgttgtggtgccggcatccagcctggccaatgccaaactcgtgccaaagactgtgcaccttgccaaccttaaccttctgcctcagggtgcccaggccacctctgaactccgccaagtgctcaccaaacctcagcagcaaataaagcaggcaataatcaatgcagcggcctcgcagccacctaagaaggtgtctcgggtccaggtggtgtcgtccttgcagagttctgtggtggaagctttcaacaaggtgctgagcagcgtcaacccagtcccggtttacacccccaacctcagtcctcctgccaacgcagggatcacgttaccgatgcgtgggtacaagtgcttggagtgcggggacgcctttgccctggagaagagcctgagccagcactacgacaggcgaagcgtgcgcatcgaagtgacgtgcaaccactgtaccaagaaccttgttttttacaacaaatgcagcctcctttctcacgcccgcgggcataaggagaaaggcgtggtgatgcagtgctcccacctgatcctaaagccggtcccggcagaccagatgatagttcctccatccagcaatactgctgcttccactctgcagagctctgtgggagctgccacacacactgtcccaaaagtccagcctggcatagccggggcagttatctcagctccggcaagcacacccatgagcccagccatgcccctagacgaagacccctccaagctctgtagacacagtctcaagtgtttggagtgtaatgaagtcttccaggatgagccgtccctggccacacatttccagcacgctgcagacaccagtggacaagtagagtatcatttacatttcggtgtttcggggacgaggctggagccgcgagtgctttgacaaatgtcttgaattacggtggagaggggtgtgtgtgtgtgtgtttgtgtgtgtgtgtgtgttcaggcaagcacaggaaagggaaaagatggttttcatagtataggtgcagtgctgaaatacaagggtaattcttcagccagatagaaaagtgtgtgctctggttggattatgttaggtaattgagtaggcattggaagtctgattcttagcagtaaattcagtgtcctcccatcatatggagcgtttagcttggattacattggcacagtatctgagtcttttagttttggaattttgacaattactggtatttatagcagtaaaatgacttaaacatccaccgagtactacttaaaggcactctacttagagactgtggttcaaagtgtgtttaagtaatggtcatggtgattttaactacaaattgcaaaccatctggctcaataaacctttgtgtctgtgacctttttgaggtga

SEQ ID NO: 25558 - DNA, 1168 bp, Mus musculus
aaattggattaactggggttaatttcttttttcctgaggcaagttctggattgtgggaattgcagctcctgttgggcctgtgagctcggtagcgtgcgatagagtacctgtgagcacagtttacatgaagaccttgcttaaccctttgctctgggacaaaaatgcaaaagagacagaactggaaacattaaagccgtgttttctttatctcacactttggcaggagcctgcctccgtagtaattcttatttttgttttacaggatgacagtaacatgtaaccttcaggtttgctcttccctcgggcattagagtcctttctagcagtgtttaggatgagcctctaactaactgtactgcttaactaaggtgatttgcataccagccgtgcctagcaggaccaatcgtgtctccccctttggtttatttagaagacttgcactgtctgccagatgctgcttcctaaccagtgcagctatgcgtcacaccagagaatccatcagcacaaatctccctacacctgccccgagtgcggggccatctgcaggtcggtgcacttccagaaccacatcaccaagaactgcctgcactacacgcggagagttggttttcggtcagtatgtccttcactgataactgcgctgcggttttgacgggcctgtgcacatgcgtaataattctcagggttacctggcgataactacagctcacagatcctctaggaatcattggtagttgagttgatccatttgaatcctttaatgccccgttggccttgccagtccgtacagatgaggataaggggcaaggtagatgcatgcttggagctcgggcatgaccagcaaacagcctttgcatcctttgtcctcacgtagcctctgcaggagtactgtgtgtttctgtatctcttactgtttctttcctaacaaatacaggcatgatggattgtggtaaccacacagaagggcccggtgaataaccttttctgatatccatctttggagtttccccttgaaactcccctcgtgcctcctccctcacagttccagcctcttcgtctttacactgaccctggagattcccagatgtgtgtttttgacatctgctgactttcatgttactttagccagtgtcaggtgatgttctactttgctctcagactttgtttc

SEQ ID NO: 25559 - DNA, 1201 bp, Mus musculus
ggcactaagacaggtggtaacggcaggctctacagtcagtccagtacatgatgtccttccctaatccaggatccccacgatcttactgtgtcccctgtcctgatctggccctcgtggtccattagcctcactacacacacacacacacacacacacacacacacacacacacacacttcttcaaaatgttaaagatgctccaaacattgaccatttgtactgtggtccattagcctcactacatacacacacacacacacacacacacacacacacacacacacacacacacacacacttcttcaaaatgttaaagatgctccaaacattgaccatttgtacttcgtgatctacactcttaaacacacagaactgtctttactatgttgcaagcagaaaaaggcaaagtactttccaaaagccaggagaaacctctgcgggctgtgagatatgttcatgtcaccctgttgacacagtgacgttcactctcggcgttcggtggtctgtgctaatgacagtgttgtttctctaacagatgtgtacattgcaatgttgtgtactctgatgtggctgcactgaagtctcacattcaaggctctcactgtgaagtcttctacaagtgccctatctgtccaatggcgtttaagtctgccccaagcacacattcccacgcctacacgcagcatcctggcgtcaagataggagaaccaaagtaagtcaccccatggctgagtttactccgctgctctagtgctcatttagaggaggttgtcattgtagcaaatacaatttaaaacctggacatttgtcggctatgttaattgtgatgtgtgaagttctgctcgtggctcagcaagtcaccctaccttttccagggaaagtcggtatccgctcagcaaaggaacacgtgcccagttttattctttgctttagtgtttagttttttttttttaaagatttatttatttactatatctaagtacactgtagctgtcttcagacataccagaagagggagtgagatctcattacgaatggttgtaagccaccatgtggttgctgggaattgaactcaggaccttcggaagagcagtcagtgctcttaacctctgagctatctctctccagcccccacccattttattcttaagatgatttttttagcaagtaagttttaggaaaaaattaaaatataaaaaca

SEQ ID NO: 25560 - DNA, 1264 bp, Mus musculus
ttttctagttagagtaccatcattgagctgtattgctttgtttgacctcacctaaagaaacaaaaatcactccacattctttcttgggttaggatgcactgttcagttgaattgtccttttcaatctttatttttcaaagagaggaaggagggaggagggtggagagagagacagagacacagagagaaagaggtagagagagagacagagacacagagagaaagaggtagagagagattgatggtttgattttgatgtttcttgctgtgtgttacagtaccggaaggctttgtacaaacatgcccatcgcagcatggttaagctttctgaacaaatgttgctgagtgtgtcttagagccgaagacttacctgctgtgattgagcaatgtcgattgtcttgaaaagcttgcctcacagctaaaatgttctcgtgtgtctcctgtcaatgacttctacccccgagttccttagatgctaagtagtggctttgacgtgagccgaggctgactgactgtatctcgctgcgcttcttctgttctagaataatctataagtgttccatgtgcgacactgtgttcactctgcaaaccttgctgtatcgccactttgaccagcacactgacaaccagaaggtgtctgttttcaagtgtccagactgttctcttttatatgcccagaagcaacttatgatggaccatatcaaggtgtgtgtgcgcgtctctcctcccgtctaagtgaaccgcagattcatgcatggttgtaggccctggccgagctgcagatttcttagagcatgctgctacattgaggggaagagatggatgctggcccattgccacatgctgtcttcatgttctgttggctttggggtgctgtgtatccaggagtctcgctctgtctccccaagactgctgaaaaggaacaggtgtgcatgctctggtttaaaagaataataaagttattagggctctctgtatgtacatgaaactgatgactgtgaagttttctctaaaatatgaggtttatttttgtttaattatgtctgtttgggtatgtgcatggggttcaaatgcccttagagacagaggtcagactctcctggagctggaacaggctgtcataatctgtggcgtgggcactgggaaatgaacccgggtcttctgcaagttcaatatgtgcccttaactgctgaactatctctttagcttttgtagttgtctgttctgagaattctgtcatacgggatgaagaaataggagtttt

SEQ ID NO: 25561 - DNA, 1212 bp, Mus musculus
gaactccacacaagttaaaacagttaatgtttctttatctggctccctccctccccctccccccccactttatttttgagacggagtctcactatatcaccctagcctgcatagaacttgctacatggactagactggcctcaaatttacagccatctgcctgccttagtggatttaaaggtgtttgctaccatgctcggctccactgtttttaattcatcttggtttatttaaaaaattttttgtggcaagagggtcactgtgtagcccaggctggcctggaacttgctgtgtaagagatctttctgcctctgtctcctgagtgctaggattacaggtgtgcagcgccatgtctgacttctcccttatgtgtttaaaaatgtctatttctagtttaggagatacttctctgaatgattgtcaaattctgttgaaacggtgtgatttgtgataggcgtttcttttctctttactatgcagtctatgcatggaacattgaaaagtattgaagggcctccaaacttgggtataaacttgcctttgagcgttaagcctgcaactcagaattcagcaaaccacagcagagaggatgccaagtccgtgaatgggaaagagaaactggaaaagaagtctccatctcctgcaaagaagtccacagaacccaagaagatggccagtctcgggtggacgtgttgggagtgtgaccgtctgttcacacagagggatgtgtatctgtctcacatgaggaaagagcatgggaaggtcagtgagagtgacagccatgctccggcaccaggaggggacgccggtggatgctggtgaccctccgtcattcagtctctgccagtagttaggattagtgtgacctcgatgtccgtgtgcctcacttaaagcaagtggaatggacattcccaaccccttccagtccgacctgccttctcttgtacactcagtagtagccgtgacttgtcggtcatgtctgttgatcggtcatgtctgttgatcgctgaggatgctgcagatgaggctaaggctcatccgagtgcttgtgaccagcaaggaagagaggaggtgcagaggcaccagtgatgctgccagcctggttctgctgctgccctctgggtacccaggtaccattgcacaccaggctgggcagaaggaatgaagcatatttgggcagtgggttccacagaactttagtctggcagtgag

SEQ ID NO: 25562 - DNA, 1166 bp, Mus musculus
ttaagtaagttacctctcctggatagctgcattttaatctcatgagtgaataagcatttccaggtacaaacacaagttgcatttgtgctttgaggaatctaggctagcatttcatcatgagttgcagaggggagaggggacagggatccagaaggggccatctgcagcccggggcatctctagtgtaaattcctagggctgcactgtgccactgtgaagaaaacagaaaatccagttttctccagttttgtttatttttttatttttaagattgaagccatctagaattgcaaattaaataatgctttagccaaacctacgcagaaatttgctcttttaatcagtaccttttacaaaagcctagggataggaccttttcccagtagggagtgggagtcatagcactgcttgttttatttggaggccccagtgtcagctctgcctccctgagcctctgcagtgagcagccatagttccactctctgtcttgtgctcacaggcactgcccagactcccggcggaccttcaccaagcggctgatgctggagaggcacatacagctgatgcacgggatcaaggaccctgatgtaaaagagctgagtgatgacgctggtgatgttaccaacgatgaggaggaggaggcggagataaaggaggacgccaaggtcagacatctcagctctgctctttcactgtcacctgtgctgacaagtgtcccctgttcactctcaacagcattttgtgtagttgtagcttaagtcagatcttgtcaagtactacagtaatcccttgtagcccttcccggctcccagctgctcctgaaagacaacctctcaaaggatctcttaatctacctcataaaattctatatttgacttagggaaattgtccattaaagaagtgtattaagcacatgctagtgactggctgcgtcaggagtggcaggtgtgcagagggactctctgggatggtagaagatcagatcccacactcaagccatattcttctctttatgggtagtgagcctctgtcagctgatggtgtgtatatgcaggagcccacacacacagcattgggtgttctgcttgctgttaaagttacagaaagcaccaaacagcagtttttcctagctttgatggcaggatcagtctagaagaggctgacac

SEQ ID NO: 25563 - DNA, 1276 bp, Mus musculus
gtaacagcggcagttcctgaattcgaaccaaccattttgtatgttacaaatttgaatgagttcaataataacaggctatcatgccttttttagtgttttttaatttttagaactcgccacataaattgtaagtgattgtgggtctcacaacactagcaacttttaagtgtcttagcaccacacgcagcgtgcctgctcctagcaaccgagggctccaaggacaacatcacccaggtgaggatgtggcctgagccaccccagacagcgtcagccttccaggccctacctctgtccacagtggacaaaagaggtcaggagttcagtagggtgtccttcagtccatctgggagagtgaggaagaagagattcaaaaagtggagacagtggagctggcgagttttctaggttagttcacaggctgacttacagggcactaggaggcaggctaggaaaagggcagcctgtggtcagagttgaaagtcataattagacctatagctctctattgtcaggttttgtcatagaactcaccaactattccgaagacatatatatacttcaagggtatcaagtatatctctggttcttgatagggacaaaagggcaggtttgacttaaccctttgctgtctacacagttgggttcctgttctgggtgctactgccaaatgttctggtacttaagtgtcgagacgcccagcctcaccaccgacttagcactgcagcagcctgtactctgcaactggccatagacgagccaccaggcttctagagtcgtctcagcaccctctcaaggtcacctgactggagcactgccgacgacgtgctcttggtcacatccctgtatagttctctgggaaagctataaatatatatattttggttattgttttgtgttttccgttacattttatatcttgtatttatcgcccgatatgttttgtacttttgttttcctaaaacaaagaaatccatgtgtgtgtatatagagacttgcatgctagactgtagtcaatgttcagttccttgaaaagtcttgctgctgtcgggtgtgcaccttacaccgccgcgactgtattcaacccatttcacatgtaaataaatgaggaacgtctggcccttgagcttcttcaagagagttattggtgggtctctgacatcatacagtcgggggagtgactcattgggggacaggctgcagaacactgcaggcttctttccccctctgaagaatggcttctggttcctatcggcgaccaacttgtcgccactctgcc

SEQ ID NO: 25564 - DNA, 1161 bp, Mus musculus
tgtgtgtgtgtatgtgtgtgtgtgtgtaagctgtcctctgggcacagcaggaatggcagctgccctcttgaagcatctatgattacctgcaagacacttgcatgaagtatctgtctgccatggaggggcagggctcattggactgaccccttcctaaggatttatacagctaacggttgctaagtgggagagtccacacgaggggaggggcaggtttatagacagttaacagcagctgagagaagaattctttactatttattttatgtgaatgagtgtctttgcctctgtgtatgtctgtgcaccatgcatatctggtgtcgggagagagcgtgggatcccctgggactggagttgcagatggccgtgtgggtgtgggagttgaacccaggtcctctggaagaagtgcttttaacctctgagccatctcccaacccctgaaaattctctctttaagggcacaaatttctatatatttcccatacctataagtgacactgattaaactaatagtttcagcaagccacacaacagtctgtgagcgttggagctgaaataagcagctggactaggcctatggtgatctcagtgcacagccaagaacccttgagtaagccctgctgggttccctgtggctgggctggaaaacccttgagtaagccctgctgggttccctgtggctgggctggaagggtgcgggaacaacataccagaaacagcagacactcacgcaaagggagggagggcaaggttccaggcgcccaggagtggggtaagcaggagggcttagcaagtactttcagcttggactagtgaagctaaatatcctgagaatgaattcttattaaatttatgacctaggcctgagagatgtctcagcgggtagaggtgctaacaggaaggtctattgatctaggtcagtgcctggatcccacaaggaggtcctttgaacacacatacatggtgacagcatgaatgtacctgagagtgtgtgtgtgtgtgtgtgtgtgtgtgtgcgcgcgcgcgcgcacgtgcacacacacacgcgcgcacacacacacacacacacacacacacacacacacacaatcataaataaaatttaaaacctggccactgggaagaagacagatcaaactgacagaaactgacacacaatct

SEQ ID NO: 25565 - DNA, 3422 bp, Mus musculus
cccatttctttcccaagttaagtgttgtacagagcatctgtcagtttttttttttggattttctttctttttcttttttaggactcagcaagaagcagctgccaaaaaattcttttgaccttcattttcctatatgtacatcatgtatgtatgtgcaaatgttgtctttttgagggaatttagtatttaaattgcttcatagtctaagttattaaattttgtatgaaataactcttgaaaacattcacttttcagtaaaaaataaatgttaaagacaaccacattttgttcatagtactacatgtctttaaatgtcagtgagtctgtggtaggcagagtgcagcctctgaacagagtaatggcaagtcaagacttaaagacagtcggggcagccactggctgtgggtgataccctctgtgtctattattggagggttctttatttatgtaaataaacttatctttttcccccagaatatgaggtctaaacaagagcaccctattcatgtaaccaaaggcatttttagaagtgagaattccctaatacgagactggatttagccatcctttggccctaacatagctccttctgggatcagtgacttgtctgagagctttaatctaaatgccaggagtcagcgcatttaatgaaatgcttttctcctgtgttcagtgtgcatttcatttttaaaggagattttggtggaaaaaccaactagtttcttgcctccatcattttggtgagaacagtcctatggtgagaacttttcgggggtatttcccggtagtgtattcactccggatggggggcactgtcctgaaaatgttccggtaatgtcaatgatagtatggaaataatttttatacttttaatttgtgaaattcatttctcccattttgtcgaacatgtagtttagctccaattgcatgttctgcggctattttaatttacaggccttaccagtacactctggtttacattcaatctctgtaacccaagtttatgacttgcaaactcttaaacagaggggactgtagtggaagcagctttgagctaattgaaagcaaatttgtaaagtaaatacttaactgtttgtcctttaaacactaaaaataaggatgttgtgaaacatccattagtgaattaaccaggaaacactgggctggaaagagttgctgtcagcccagagttagtcgtagggatttgcgaaaccatctgtggcattttaaagtgcagatttcacttttcttttcacagctgggctagactttcgctggcttcaagacaatttacctcttactaaagtaatgggctcgtttgctatgggatccagaacaacactgtttagtatgtccttccaaaattgttgtaagcctttgtaagtttcctctcaagtgtcatttgcatttttgtctgacaacctgaaatctatagaagactttatgagaacacttacattgtggcactacctagcttgcaccgtgtgtgcagtcttgcattttctgctggcatttatcctagaagtgtcacagcacactcacagtgactccacaaaactcactgcagcacacagtgctcctgcttcctcctctgtggagctagcatttgacactcgtgctctaacggagtgtcatcttccagaactcacttacatttttaaaaacttccagacaagtgtcagattgtagactgtgagtcttgggaaatcttcctgagataaaggctacgaaagccactgttacaaagtccgcagtcatgtgtgcctgaatgctaaaggaatcccaaatctgggcagtgtacactttcaggctcaagtccaaggggaagtacactggtcattcctaatgcgattgcagacagtcagtatagtggagcaggagcaggggtccttttacttctaaatttcttttaaaaaatcactcagcaaggtagttcacatagtctgtctgtatttgtttctatcaaaatcattaaatctaaatagctcacttctgagcaaaaccctgctctgtgggaaattatcactgccagaactccttcatgtctgtagtgtcttgtgtgattggaataattcaacttctcacaccagcaagtattttacaggtgccttggattgagacaaaatttattttaaaactttaaatctttatttatgatgccacttttaaaagaaatctcaattatgtaaaattgtcgatgggcttgtttaatatgccgcttgtgatagaattatttaaatgcttttttcagttaaaacttcaccgtgaagtcacagacaataaccagtattttatcatgtattgaaggcacataagtgtttttcagagtatggcccatgggccaaccattcagttcctggaatgcttattaagaatacagattccaaggccaattcgagtccatccatgtcacaactcaggtgggcttcagagtgtccattccccagacaccacagacatggcacactgacaggtgacaagcactagaatgggggtaggggaaaggtttgctgggtgtttattatgggctcagagccgagccatgcacattttcactgtcactgagaccggcgtctgctggttcttctgtactcttgagtgttcgctcaccaactctccactcactaacaactacaaaccaagtccgggttgtcggctgacctctcggctcccgggtgatgactctgaaacctgtacaatcatctttggctcatggcagagcataaccgcgcccatggtgaagcttgcctgccaaagcccttgccttcctgacggtcaccactgctcatctcagatgccgcgcacgtcactagcgtgaggaaaatgggaaagacttgaataagggttgctcacctgctgctctcggagaatcagtcttgtaaaggacagcccgctgtggttacccatgctgactctgcagcgcccacatgctggttggaggaaggcagtgaacgctttagtcatcaggaactttgtgagatcagggtgggatcagctcttacaacttcttaaatctgtatgctgcccgttttaatatatttctcttctgatgttcaagtttaaaagggttttctatccactgtcaattttaattatataacattttgtcaaggttttgtttggttttgttttccctttctgattgttacttgatgctagctggaattcaagaaatgtcaatgactttattcaaataaaagaaatattttagtaaattggttttttcctccattgatgtctgtatcctgctgtcctgtttccagttgctcacagagcagctgtaagagaggaactctattcattccgcttgtaatttccagtcagagcccatcatatgggggaagcaaggctagtcacatccagtcaagagcaatgagaagatgaatatatgactgctcacttgtgctcacacctgccctact

SEQ ID NO: 25566 - DNA, 1184 bp, Mus musculus
agtgcttagtatctgctggttttatgtctggtttattccccatccgctcgaatgatagagactgtacttgacgaagcctgtgtctagcatttgaacattgtaaagtgcagttctcacagtggagggtggtatggtaaacggcatcatttgtgcccatagcttgcagctgcctgtggaaggtggatagagagcacacttggcaatcgtggacagttgtgtgtgcccttttaagcatctccacatcagaatatgtttttctaccccagaaagttctctggcactataagcacactctccccatagcctatccctgttttgatttctgttacttcatatttgttctccctagtaaaattatatagtgcgtataaaacaaaaaaaatgattttaagtgaaaaagttcaagtcggtttatagccctgtgttggtcatgttctggtttgggtatttgtcaacacttggcatgttaaccgtatttcagagtcacagatgtgtagagaattgcagttaacttgtgcttactttttagcggatgacatcttcgagagcataggcgatcgggagctgagacaggtgtttgaaggacagaatcgtattcatctggagatcaagcagctgaaccggcagctggatatgattcttgatgaacagaggaggtacgtctcgtccctgacagaggagatctccaggagaggagcaggaaccccgggacagcctgggcaggtaagctcagacacggaggagagtgggaacagcgctgtgctctgggtggccagtggatgctaagctgcctgctcaccgtgtttccctccaggtctctcagcaggaactggacaccgttgtgaagagccagcaggagattctgagacaagtgaatgaggtgaagtaagtacccagctgtcctgcttcaggggtctgtacccgtgtcctaatgaaatgtgtgtgcccgctgtcccgggttaggtgccctgcagcagggtgagctgcacatccgagggtcaggttaggaggaaacagataatatatgcaaattgcaaacatctaaattttaaaaattatcgtaagctgaaaaaagaagaaaaaatgctttagccaagaagttttctgtagtaatgagaccaggtgtgcctctctggaaagtatggaaagaatgtggagtgacatgtcctaactccctgagaaac

SEQ ID NO: 25567 - DNA, 1218 bp, Mus musculus
ctccacaccaatactgctttgtactcatacggcacattaccgttttaagtacttccaaaactgtagattgttctgtacaacccaagcaaggaggaaaaagatgtatagccatttttttttttcagctgtttgccaagtccagacaaaggctgtttctcggggtcacacagtcaaccccagaaagtcccggtctggatttgtggtcctgactgttgagcacacggcctctccagaggtcactcagtctgtagtgcaccgagttctgcttccctggacgcctctccggctctccccaggacaagcagcatagagcagcgcatcacacttgaaataattcactccgcacagtggatggggccagccaggatggtcacagctgctcactgctgtgagacccagtctccttagttcctgccattagctgcaacaacttagtaccgatctgacttaaacggtttagggaaaatagaagtattattgctgtccagttgagaaaagcaagtgtgagagaccagagctggtgcgtttggaaataggtgggcagggttttgagtgatttgaacacggcatcatcatgcaggagactgggaacgcatgggaagagccttagacacttcctgttatctccagctgaacatgtctgctgcgctgacttagggagaaaggtttggggtagttctgctatcagtcttccataagtaataaatacaaatacccgacaagtcagtcctcaactgtgaaacaagtcacagcacctcctaaaaccgtttttcaatttgtagatgaccacgacgttctttctttcctgactttccaactgaccgagcctggaaaagagccagtgagtatacacgtttctccagttcattttcagttctcaggggtgttgctccagctgtagactctgagaagaccgacctcagcctgggtcttgtttcagttcactgccatttggtcttactgtgtccttggcaaaaccgacgtctgtttagtggccatctcttggtgtatagtgctaaatgagacagatgcttagagtaaatgctcattaaatggtaactatgattttgggtagtaataaaactaagagtgaactgtctgtagttaactaagagactatcttgaagctagtgtcggactagtgagtgtgaggacaggcgacaagctgtctcagcagtctcttacttttgacctgttgtttctctgaaaaagcctaca

SEQ ID NO: 25568 - DNA, 1131 bp, Mus musculus
aaagaatgatgacgttttcaatgaaagatactaaaataagtctattttctttatttctagaaaaataatcctgctatagtagttataggcaacaatggacaaatcaattatgaccatcaaaagtaagtgatttctgcattggttttgttttcagcttgtttttgcaatccttgagaaatacattgcttcaaatctcaacactcttcaaacgaaatcagcgtgttcccttccactagctgctgtattgtcagtaggcaaaaaggcatgcgttctcttcttgttttgaagttctttctgtgagccacactttccaggttaattgaaaggtatctttcaaaaataaatttagctttcaccaaattaacgagtagccagtctgagccaccatttttcaatgtcagtgtcactttaaggcagtcagtgagttgcagagtctctaggtggtaagtgtaagctccttgcttctccgcgcctggctctgctcttcctaccgtggagactacaatgctgccggttctgtataaaccccatggagtggtttaaaatagaaatgcctaggtcagcccttcagagtctgcttcagctggcttggaaggagtttatatagacttgtatctttaaaccctcctcaaggggctgagaatgtagctgagtaaaatgatagcatttacagtttgaatacttgccgagcatgtatacgacagtacgttcagttcctaacagcacaaaatataaaaactgtaaagccccccggaatgatgtggatgccatcctggtcccatacgtagcatatcctatagcatgttacccctcccttcagcgtgtgtgatgttggccttcctttccagtgttgccagagttctgacaggaaagcctttgtcttctaactgacaaggactgtcataagcctcgttgtaacttggtgtttttgaatctacagtgatggtgccactcaagctttagcgagttgtcagagggactttcgtaataaaccctatcctgtccgggcaaagattacgtattaccagaagacactgacagtaagtgacagtaatcaaatactcggggatctaatactgcttttttttttttttttttaattcttgacagaagataatgtaattaaatgtg

SEQ ID NO: 25569 - DNA, 1197 bp, Mus musculus
gcgttttgtattagcttgtaccttgcttggtgattgatggtcactgtgggaactgaccagatgggaacacctataaccacctacaatgaaccagtcagcctatgactccgccctctcgttgtaggcgtggcatgactccgcccacttggtgtgggcgtggcattctagctgcactgtcccacatgtcatacattcagcagcccactctgtacaggtgcatttgtggcttgttttgttttcagacaggatctttctatgttgcccttgcagcggcaaactcctgagttgggactgtacccacacctgcacaggtgacacaagctcacgagcttgcccaaggttacgcttctaactgggttgagagctagttagatcgcatggcttctctcctgtaggatttcctacaagttacaagctcgtctcgtctttcattcggagcaacagaaacgagcacagcttcattgtatcttggatataatgctatttttgtttcaccagtgtgaactcacagtttagctggggttaagctgctcttgggtttgtttcattatgctatgggtgcatgatgtttccatggggacaagggcacacacacacacacatgtccagtggcctgaccttctctgcctgctcttgtcggcctcagttttgtcatggtcaacagcgttgcaatggaaggggatggttgtatcatatgctctgaagaggaagctgaactcagagagatctctcgtaaactgaattgctcccaagaggtaggagacctctgcgctcatgtctcccaaaggctccacagtcagatgccctggctgttagtcacccggctcctcttccctctcttagtggtaaccactgggattgatgggctaacaaggtgactcctgaccagcaggtgccgggatccagtcagtgtgaccgtgagcccgagccgaggctccccttgtccgctccagtgttgctgcaggtgagctgggggaggagtctaagggccgccacccgccaccaggagtttctgagaatatcactgatgtcagcttcatttggccagcactacccgctctaccgggccagcgatgctaactgttcaggtgaagatgcggctcccccagaggaaaggaacgtcccctttgaggagaaatatgatgttctttctcgggaggcctcacaaaaggtatgtggtgatgtgacctcatgcca

SEQ ID NO: 25570 - DNA, 2038 bp, Mus musculus
tcctcctgagagggtctccatgtttagcccaggctggcctcatgatcccctgggctctgcctcccgcgtgctgggattatagctgtatagcataatgctggctcactgtagtgttacctgtgagggacgagaaaagtacacatattttcctattgcaaactgaaatttgttgttgatattttagaaaatttgtgctgctgcaattaaattttttttcttaaagatttatttattattatatgtaagtactctgtagctgtcttcagacaccccagaagagagggtcagatcttattactgatggttgtgagccaccatgtacttgctgggatttgaactcaggaccttcagaagagcagttaactcttaactgctgagccatctctccagcccctacaattaaaatgtttacagttgtcatcgaccgagaactttacattttctttaatgctgccatattttatatattacttagaacatgaagagtgtcgagcaggctttgattccagctgcatgcttttaaaacctctcttctagcctgtcagtacctttctcgagccatctgtcctctacaggtatattcctttctctgtacagtggcagccgacaggccaaatggtgtgggggacaggaggaacgcttctgagagccatccctttataggctagataacaataacttacagctatgcctgcacaccccacagatagatctcatgaaacctaaatatctactcagattcttgcccaaattgttcatacccacttcagtactagatgatgctgggtctgatggggttggtagcaaatctaggagaccacgttgaatctacatttgacttctgcccacttgcaaaaaaaaggagatctggggaggtgagactgtatttcattagttttaaatgtcctttgcatgtttatttgtttctttgatactatttgttttttgaactgtggtactaaagcagtgacattcattcaccaggcaatatgtgtcgagcaactcggggactgtgcgtagccttccctctgaatgtgatgtgagggctgtgtagaatcctgtgtgagactcaatagccgcagtccacctggctgctgcatagatcctacccaatatggctgagctgtgttaagaaagaggtgatgataaaggattgattaccaaggctgaggtgacagtttgaggtggatgtgggtcctgagggaacaggatgatatcagggatttgggtctgaaagtcaggtgtcactcagggtggacagtgtcctgagaaagcgaactgccggtgaggcaggtgtgggggtgttctgagcttctgacacatggacagccagtgggattcccagccgagagagactgaccgcatccacaggagaggtagaacgtggggaggctggtcagttggctgcccacaggatgctatcaccccagcctgggctcctgctcttctctttgggagagtcccaaatgcccctgtatgacgtcttcctctgatgactctgttttcctctgatgactccattctcctgcccgggctgggctgatacatctaccactgaaggaagtgcagagaaagagagcagtgatcttacatccacagtccctgagtgacctacaactcacccacccccacccctgttatctcaggagccagcctaggagggaactctgaaaccttcgccagcatttagtcccttctctgcctgccaccccagtgttgcagatgaaacccagggtccctgtgaagcaacaggtcattagcgatgaaaagcaggtgccctttggagggtgcgctggttttccagtatcctgaccccacccgagaaaccagctgttttccttatatgaagtcatgttaaaaggggatgtgtttcttttcatttctttggtttgattttgtgagacagggtcttactatgttgccccagctggtcttgacctcaggattttcctcccttgatttccccagggctgaacttacacagccgtcagtgtattgctgttatttcgtctcatcttcctcctcttttccttctgtt

SEQ ID NO: 25571 - DNA, 1127 bp, Mus musculus
cagagccttgtgccctgctactacatacgctcttctcctgagtgttggacttgactcaggctgagccccctgccccagcaggttcattgcagaagaggccacagcctccggggccaagtgtgtgctcacccacagcccgacctggatcatcgaccccatcgacggcacctgcaactttgtgcacaggtgagcaggagttgggagtatgcaattacgggcctccgtgtgaccccataaagtattaaaaacataagtgtatggtagatttctagtcttgtaagagagaatcaaatcttaaaaggttttccacttgtgactctaaagaatatataaagaaattaatttttaaaaatatttttggcaaggcacgtggcttttaattttagtactcaggagacagaggtaggtaatagatctctgagttttaggtcagctaagccaatacagtaagaccctgagtgtgtgtgtgtgtgtgtgtgtgtgtgtgtgtgtgtgtgtgtgtgtgtgtgtgtatgtgtgtatacactttgggggggtgactaggtatgctggtgagcatctgtaatcccagcatttgagaggtggagataggaaagtcagaagacgttcaaggccagcttgagtgacattttagggggttctttgtttctttaagtgtttttgtttactgctgacctatagcacaaaggccaagataggatcacaagtttgagactagctttccctatacttaaatattttactgtactttaaaaacaattgcctatagatgagactaatttaggagtttgtctacagctataagacattgaattgaattgaattgaactgaattgaattgaattgaattgcggctcctttaagaagttgcccctggaaaagagggttcagaaaggaagcctggggctgaggtacagaaccaaaatatgtcagtgacatttgagagtcactccttcaggagccaacgttgtgactgcagacggggcttacaggaataaggctgaagggctagcggtccctgacagtgacaggtatgggagctgtgtatacttgccaagagccatgtattaggaaccaaagacgcagaggcaagataggaaacgtggcttccctggagggtgggtatt

SEQ ID NO: 25572 - DNA, 1354 bp, Mus musculus
agtcagggaaacacatcacccccctctgcctgctgtgtggtgaaatccaggctattccactcccattctggtctctcccagttttacatgtcacagaaccatccatcatagctctgagatggggcagcttcggtgctcagtactgtgaagccctggctacgttcccactagggcagggtaggtatcaagagccaccacacctcccacccggccagcttcattccttagctgcgtgtagggactccaccctcgcctgtgggctctttttcctctgatgtgaagttgctgtacgagactgacgtccatgcaggcttccataacccaaatgtctgttcgctctgtccacaggtggaccccttgacctcatgtcgtgcagagtcgtagctgctggcaccagagagatggcagtgctcatagctcaggccctacaaactattaactacggccgagacgatgagaagtgagccacacacagctcgaaggctaaaaacgcagcagcaacctgggaaagagctgtcccggtggcttaagttccaggacagtctaccatagctctccctgggccttgcctcggtgcttagctgattctctctaatctcgtgtagccccttttcaggtcggtacgtgttcttttcatcagagccaaacccagatcttgtgaggggtgtgttagtcatccatcctgattgtttttccagaatgcaaatctcaggtgatacagctttagaacgggctctcaggccctcccctgaccgtggtaagacggaatgcaataaatcagaattatagtggtctgctttgggtcttcctccagcctctggttctcaggcaaggctgttactgctattaccccactggtcgtctatgctcagcttggatgtctggcacccgaccatggcgacggtgaaaactttccctaaatatcagtctcctgatctacaggttgtatttaactacacatagataatctttagccatttttttatactgccttcagttgaccttcagggagtacgtgtatcgtataaattaaaatgctgtatacagaaccctttatcgaagcccacgtgtactgaaagtggaaaaaaaatgagaaactgaaaaacagtgctaaaatattttgtgacaaacatttttgtaaacataaagtctttcaggagttgcaactttttaaacagtggaattttgggggggtagggggacgctggggtagaactcaggctctcatgcagagtagatggactttgtaccactgagctatatcccagcactagggaccagaattttggttccaagttaagctgggggcctagactgttgtgccaggtgactgcagacaaggcccaggtggttc

SEQ ID NO: 25573 - DNA, 1150 bp, Mus musculus
gtgattctcaaccctgtgggttgccgctcctttaggggtcgaacaacccttttagaggagttacctgagaccatcggaaaacatttatattatgatttgccacagtagccaagttacagctataaaatggcaacaaaaaataattttatagtcaacatgaggaatggtattaaagggtcacagcattgggaaggttgagaaccactgccatggagacctacctgcctttctcaattaaccaaataataaacgccctgccatccatagcagggggtcagccaggtatgggtttgtgctctggtttgtatcctcagggaagccactagcctcttgcttatggcctgcccttatatcagaactctcgagggacatccctgggcatcacaggaaagccaccaaatgcatagcgtcagggggatttgctgtcttgctttgtgtttagtgaatttatctccaacattctccaaacagctacagtgcggtgtcctgtacaaattctcccctgtagttccgttgtcactggggtgtgctgtgtcagtgaccagctcctgcttcggtgaagtggctgttgcgtttggtggcaaagaacagtgacatcagtctgtcacattttatcaaagccatggcctgttgctgtcttgtctgttctcttaaaaataatccgatacataaagatgtaaaagttatatatttatgagatacatgtgatatttcaatgtgcactatgtaattaatgtttaagtcagtaaagcctacctggtgatttgccatttcttttatgagaaaacattcaagcgatttgttctagcattttaaagtatatggtactaatcattatagacaggcactttactgtgcacaattaattattatttaaaagttcaaagattgtaacatctcccatggctcaatagattgcctcaccttaatattaaaggaaaccagaaatgtcttgttgggctgctccacagcttagacagattgaaaaaccatttgcattctgcactccgggttcttggtatagctcagaatttggtgcctgtgcctctcctcagatggaaacaacatttatctctgtttttcctatggaggcaaagtgtaattagagcaaatgtttaaaagtgtaagcagggtccagggaggtggctgg

SEQ ID NO: 25574 - DNA, 1150 bp, Mus musculus
tagccaaacgcagcggtgaagtcactttatggatgcggctggaggggcaggcagagaggtgcaagctaaatacgcgtgcctagggtagtgagacaactgaaagaatccacgggtcccaaaggtcgccttccacccgcagggttatgggtggttctcccagctctcgtgggagcgtttgtaactcacccgacgacagatgaccaataccctgggtactaacagtaccgtggtgcagaagtctagggcttccctcccctcctcgggagtcccctccagtccaccctgctcctctctgcccgacgcccagggttccagctgtcaggaccaagagcggggcttgggaaccgcccgctagtctttgggaggggcggggacagcaagcgggacagccagctgctattggaggggaaggcgagggcggaggggccgagcggggtcaagtcccgggagcgcacggccggccgcagtcacgccgcagtcgggagagccagcgcccgagcgcagacgcgcccgccatgagggagattgtgcacatccaggcgggccagtgcgggaaccagatcggtaccaaggtgggtccgggcgcgcgtggcgctcccgcgggtgggcgggtagcggcgccggcctcggaggacccaaccttgcttctccgagccaggctgaccctgctcactcctgggagagcaagtcccggagagcccgccctgagtccccgcgggcagactcagtgatccggtccagagagtgggccagctgaccctcgggatccggctcgaagtagaccaccggtcccagctgtgggttccagagggtgcgccctggggcccgactcagagagtgggccaccggtcccgaagggcgcgtcctcgagaactggccccggggactgaaccccaggatcctgaagcgacctggcggggagaggaagccatgggtctcagggggctgactcggggttccgacccagggtttgcgcccgagtctgagggctccggggagccggtcacaggtcccggtgcgggtggcagggacttctcaggctcccggtctgactctctgtcccttcgccgttccctcgcaagttttgggaagtgatcagtgatgagcacggcatcgaccaggccggaggctacgtgggcgactcagcgct

SEQ ID NO: 25575 - DNA, 1104 bp, Mus musculus
catggccgctacctgaccgtcgccactgtcttccggggccccatgtccatgaaggaggtggacgagcagatgctggccatccagaacaagaacagcagctactttgtggagtggatccccaacaatgtcaaggtagctgtgtgcgacatcccaccacggggcctgaagatggcctccaccttcattggcaatagcactgccatccaggagctattcaagcgcatctccgagcagttctcggccatgttccgccgcaaggccttcctgcactggttcaccggtgagggcatggacgagatggagttcaccgaggccgagagtaacatgaatgacctggtgtccgagtaccagcagtaccaggacgccacggtcaatgatggggaagaggcatttgaagacgaggatgaagaagagatcaacgaatagggagccataagatgctacagtgaacgtctgctcttttcttagccttgatggtgtgggaatggtgccctggtctaagcatgtcactggcccctctcaaaccaaatgcaccacactgttctccaggttacctggaacagtcccagcagaccagggagatctcatataggaaccctgaaagcaaagtagggggctcacacagggctaaagaaagtgaccaccttttgttaagcccccttcccaccccatcagagttagaatagggatttgtttttcatcctcggtgataaaaactaaagccacacagtgctgccttaagtgaatgcacactatggaactttatgacaatccattcataataaaatgctaaacctgatcatcggtctcttgaacttcatcaaagcactgtcatgtggtctcatttttcaggtatctatttggtgagatagcagaacatcacatctatccaggaaatagctgtttggagtagggcctgctgtgtgtgggtcaggcttcaactggctacctgccacacggctaaaccttgccattcccatccctgtgcagaagagggcaagggtgaggtgggtaccactgacatccccacaggtgcaaacttttgtcattcttctagtacaagagaaaccccactctcctgcccctaggcttgccagaacctgg

SEQ ID NO: 25576 - DNA, 1142 bp, Mus musculus
gaagcttgttaaacaagagtggcctgtgcagcctcagagcagggatgttaaacattgtatgcattactttccaaactggcatgctgttaagtgaaggcttttctggaggctcaggcctcctcataagagaagtggcgtctgaggctaacaccaggattatgctgagcatttaagtgagtaactggaaagaaaagaaacttggatacaatagtagtagctagcagtactgtgcatactgagataggagcaagacatgagagcctctgtgtgagacagacttgcttttgttgttattgctttagagatataaacatgccaagattctcctgtgcctcacgtaaattacaagattctcctgtgcctcacgtaaattacaagaatattttaaactactgagtttttgaagtttgtcactgtttgccctgatatctgaagcacaggaaactcagcagctgaactgttgtgtgttgtctctctagctccttcctgctgagcatgttgcccaccgtactcattatcgcttttctactctacaccataagaagagggcccgctggcattggtcggaccggccggggaatgggtggactcttcagcgttggggaaaccacagccaaggtcttaaaggatgagatagatgtgaagtttaaagatgtggctggctgtgaggaggccaagctagaaataatggaattcgtgaatttcttgaaaaacccaaagcaatatcaagacctaggagcaaaaatcccaaaggtaaaaatctacttggagagaattaactccaaggtgtgtgtctctaaagatgtcactaatgacctagtcaactcgttgttcatcctttctgaacgttgtttctgtctgattcagtttttttttttccttaagatttatttattcattatatgtaagtacactgtagctgtcctcagacactccagaagagggagtcagatctcattatggatggttgtgagccaccatgtggttgctgggatttgaactcctgaccttcggaagagcagtcgggtgctcttacccactgagccatctcaccagccctctgatccagttctatagcttgttttctatatctcatttataaattttgtgtattcctgcaagtgttttctctcctcatggaa

SEQ ID NO: 25577 - DNA, 1190 bp, Mus musculus
caagctgtggggtttgaggtatctttaagatattcttgctcctttttcctaagtcaatgaagcttgccagagaagtttcccttgaatccaaggtcaagacctgctctggggtctcttagcctcaatctgagctcagcttgtggaagctgtgtgcaggtctgtgtgtggagagagagagtcctggtgtgaagtctaagctcttcaggttgtttcttcatcaactagagctaaaccatccctctctctagtcagatgtctcaccaaaaagagtcaaagaagaaaggaaaggaagtgtggacgaataaagaagacgagaggcaagtgtggctggggctcccgccaagtctggaagaggtgtctgctggaatctttcctcccagtgcagcatcaggcccaggcgccagctctgtgaggctgtttgtgtgaggccgtttcttgggagtggtgtggagccctggtctgctgggctctgctgtaggtgctgtgggcactgtgctgggcagtactgggctgcactgcccctgtgttggttttaagcttttatttgcttctggaaggagtgttacttctgtgtgctggctctagtcactccaccaaaagagagctcccctttcctcatgccctgccagctaagctggggtaggtcccccaaacctttcccggggggcctggctgctgtcctctgttcctggtagtcccatgtccttatagtgtcccacttgcctctgaaggagaatagaagttgctctctggccctcagggtccccatcatgccctgcatccagagacagtttgggagctctctgcacaggccactatggattccagcagcaactgggatgtccatactcaagaccggccttgaactctgtgtgtgactgaagatgcccttgaactcttccttctgcttccccattcccaagtcctgagaatacagacttggactgctatacttgactctttttggttgttattcttgagacagattttgctatgtagccttggctgttctgaaactcatggcaactctcctgcctcagcatctcaagcgttggaatcacaggtgtggaccaccatacccgttatgggatgcttgtcaagtcccaactgtcctttcaacaggatctcttgacaagcctgggtgtcccttgaagacggtgggaacctcttgctatctacaaagagctgtc

SEQ ID NO: 25578 - DNA, 3644 bp, Mus musculus
tgtcggtcccccccacacacacacacaggttctccacaaaatccaggtctgtggacaagtccgatgaggagctccagtttcccaaagagctcatggaggactggagcacgatggaggtgtgtgtggactgcaaaaagttcatctccgagatcatcagctcaagccggcgcagcctggtgctggctaacaaaagagccaggttgaaaaggaagacacagtctttctacatgtcctcggcgggcccctcggagtactgcccttcagaacggactatcaacgagatctgagccctgtgccttcccgctcttttgtgtgcagagcgggcagtgcaacagtgctgcaggactcttcccaggggtttccttcacaggctccgtctgcagcaggtcaggcctgggctgcacctgagacacagactcaaggctgtgttcatatcagccgatggttggtaggaggcaggtcagccacttggtcatttgcactcagaaagcctaaaacttgattttgtgtatgtgagtcgggaagctagaaacttccttagttcagttcctcaatgttcttcggataatttcctgactaaggcaaaaagcttcttgtgtgtgaagtctgtctgacggagtgtggatgttagcacagttgtaagcagtaagtcatattggcattccacgtgacagtgttcctagctcatgtacataatgtccaaagccctgccacacaccggctccctggggtgggccaggttggctgtcttctcacagcacaaatctagaaggccttgctgataattctctttggggctctggctgcatccagcgcagaacaatcatgtgagctgtacaccgcacgggtggcccttctctgagctcagggtctgccccggcacaagcctcagtgtttcctgagctgctaacaggccttcattcctattgtgaatgtaatatggttttgaatagttttataatacacgtctaagaattaagattttgtggaagtttgaggaaaaaggaagactaaaatttcatccaacagatgagctggttttggttaactgataggctgtaacagcagggatgccagcagaaaggagctatggctcatacattttcacctacattttccataactttatagtgtggccatcgtgactaaattaaccacagtttggtatctgagtctcaaactgaagattatttttataaatgaattttaaaagaaaaaccttggctgttttaaaatctcaagaaaatgaacctgctgccatgcataattttttgatgcttttgcactaggtatcttgtaaatgtcactgcatttctgatgaagggcgactgacaggtagaggtagtattgtgtgtctgaaattgttcagctcctatgacgcaccatgggctgccctcatttccatatgcttagaaataactgggcaatcaaattaccactaatgtttgggaaatgagtgaaggcacatgcacagtgtaactcctgaaagctctgacaaaccaccctcattaccaccactgatgacatctccatttgataaaaggcatgccagtcgcatttcaccatcattaagatacagtaacatttcccattaaattgacaacgacacctcagaaatattccagtagtcatttctaatgcattgaaatttatagtttagtaaatgcctttaaattacttatactgacgaaataaactttaccagttgactaacgtaatgcatgttagtagttcatctgtactgcatgtagaagtgggccgccagaaaacccttacagtccagctgtttttaagactaagagctgtaaaaattgcagtgtgtgaatcccatttatacagttttccctgagaccaccagaacgttacaccacagttagataggaccaccactgctatggctccaggcatacatacattccagactggtttcctggaaggaagcaagaaagaaggaatacacctgtgtggctttataagcatgcacatagggtagcatgcttctgtaaaatgatgattaattagcatttgacttcccacataagacactgagcccaccactccataagtcacaggtcacattcacaagtcagtgatctagtaaatgtcacagattggacctcattccttcagcctcacagtactgtgcatagtgtttgggcattaggacccctttaccagaacatcaggatataaattttccagcacattaatgggatttgccaagtgtgttaagagttcaagtgtataccatgcccagtaaacaacctgcaggaagtagtggggaaaaagggcacgagacaaggtagaaagtatagaaataaaattagcattgtttgggagacaccaaaaaagacatgtgcaagactggctcttccccccacgccccaagcactcataccaagctaggattccataggctagggctttgggccagggagctgatgctgctggtgtgacttggtttaaaagtcctagctgacacggttcaagcttcctgttcctccagccaccttgtgcaggaccgtttgtcctgctttcctgctgtgttgctctcttagtttgacatttgtttatggctgaccccagagtctgatgcatctcctgaatcgatctgaatgtccctcctgacccctccaggtgtgagcaccagccattggtcccacagaccttgaggtcagagtatgtaaaaatgcttgtaaatattgtaacatactcattaatatttgaaagtcattctgtcattggcaatggaaattaattctcccaagataagcaaaaattaaataattgattttgcacattgacttaatgaccttaattacttgatttcaagtctcagccctttaaaattaaacccaaaagttattatacagtcattctaaaaatgatgttttgaagagatatgtggttaataccgtgaactcacgccatgaaatctgtaaggtttttatttttctaactgtactaatggaggactaaacttgaggtatgaatgtaggagacatggaagtttttaaattatgttgctatttgttcaaataaaacagaaattttgcacattgaaggaccatgaagaaatgtgtcccactgactgggctctgacctggcttcccaaatgtaagcagagaatggctgacattccagggaaaacgacagtgctgagtgtgctccagtgagtagtatttcagccaggagtgatgccacatgcctttatttccagcattccagaagtagaagcagaaaatctttgggatttcagggccagcctggtctacacagtgagaccttgtctctctctctctctctttttttttaaggtattttattttagaatttttgaagggggaaataaactggctttcatcataacttctgtgttgaattcctattgtaaaatggtgatatctttcaggaattaagcttttaaaaatcactcagtttgtaaagacaaagttggtacttgcagcagcagtttaaaaatattttaaagccgggaggtggtggcgcacacctttactcttagcacttgggaggcagaggcaggtagagctacaagtttgaggccagtctggttggcagagtgagctccaggacagccagggaaagaatttgtctcttttgtctctacatacatacatgcatac

SEQ ID NO: 25579 - DNA, 1162 bp, Mus musculus
gcctataagtgactaatgtcattgacaaaaatcataagaggccattgagaaagcatgtgagtttatatatttatcttaaattgagcaaatttaaatgttttaagagagcaaagataagcattaaaaagtaattcaacttactctaagtaacgaatgatgaatattttgactgcccattctgtgtttctgtgcagagggttttattgtcttattttggtgatactaggaattagatcaagggcttcctacatgctaggcaaacattaccactgagctatacccacagtgtctcagttatgtagccctggctggcctagaactcccagaaggttgcttgcctctgtgtacagtttcttagtttagctgctttatccactggtcttcttaagaaataagtgtatgccagcccactatccaaattatttattcttttcatcacttgctgttgcaaataaaatgattttatttatttatttagttttggatgtcttgactttttttatagtgtgtgtatgtgtgtgtgtgcttgtacatatgagcgagtataagccttagagtttgtagcaatcaggccaactttgaggagcaggctctgtctgtcacactgtgggctctggagattgacctcaggtcagcagtcttgccagcaaggaagtaaggaagtgcctttaccccctgagccagctcgctggcctaaaaatggttttttgaaattaaaatctaaagataccatgcctagttatggttgcacaggcctttaatcccagtagttgggaggcagaggcaggcatatctctgagtttgaggccagcctggactatagaaggggagttccaggacagctagagctacacagagaaaacattgtctaccattaaaaaaaaaaaaccaaaaaaccaacaacccaaaacaaaacaaaaacaataatctaaccaaccaagcccccccccccaaaaaacaaaaaccctaaagatagctagatactgtaaaacttaaaaaaaattacaatatttataatttaatgttttttagaagtcaaaatattactccttcttcattttcatctcttgtaagactgacatgactttagagaattaatctattactagaattatacgtaaatccaccaacagagaatctcttgtagttttcaacttttgag

SEQ ID NO: 25580 - DNA, 1182 bp, Mus musculus
gttctgcctccttccaggtctgcgttcttttgattatcctccattccctcccaaaagaattgcttccattgacttatttgcgggcaaccagcaataacggttgataaccaaccagttcagattgcttcttatgttgctcaaaagtttcacctcttaaaaggctcaatttttattggcactgggtatttgccattagttttagaagcctaaaactctacaagtggtatttatctactttataatgttataagttgctttcctgtttttgttttgttttgttttttgggggggttgtttgtttgtttttgagacagtgtctctttgtttagtttgtctggctggcctggaactcaagagatcctcaggtctctgactcctgggtgctaggaataaaattacaccaccaccaccaggcgtaattttgtaaatcttaatgtgtggtttctccatagatggatgtccatggcagaataagagaaattcttgcagagactatacgagaagaattagcaccggatcaacaacatttatcaacagaagatctgatcaaagctctaagacgtcgaggaatcattgatgatgtaatgaaagaacttaattttgtgactgtgagtagcagtttacaacataaggtccacactcgtggcttctcttagaactaccataagttcactctgtctagtaatagccatttttcctagtttttaagaagaatttatatgtatggctgttttgcctacatgtaggtctggtgctcacagtgttcggggacagctgtgatcctctggaactggaatgagccaccagcacgatgctggtggggggaattgatctcaggtcctctggaagagcaagtgctccaaactgctgagtcatcactgctgcccctgtaatgttcttccctctgtcgctgcttgtgtttccagactgggtttctatgagtagctctggttggcctgaaactcattttatagaccaaggtcttaaattcacagagattgcctgttgtctgcctcctgagtgctgggactaagggcatttgtgttcattgtcaccgcctggctccttttctgagaggttctaagttggccccaccgtgagttggcaaatagagagttcatgagataggagttgttggacactgtatttctttcgctgacgtgacagaaacttacgctatgc

SEQ ID NO: 25581 - DNA, 1197 bp, Mus musculus
tctaacgcaattgatggtctagatcaatacggaccctaactacataaaaacatttccacggataaagcttagggattccccggtgcgacttacaatgcaatatatctgcaatctacaaacgctacaggtcgcaggcaacgaaagtctcagctagcagacaggccttgatagggctgacaaagatgctaatcggacagccgcttctagggataacttccaggtttgtttgtttgcaagctaaaagcttgaagcagaaacatgtgcccggctctcctaaggccaggtggcgcttcccgggtcggggtggcgatcgcgtcaactcaagtagagactcaccatcaggagtgtaaagttcgttaggtcggggaccgactccccgcagggaacgaacatgactgcagtgggcgtgggagcagcttgagcgcccgccgggatagcgaggccacctccttgggacagaaggcgcaactcgcgatcgtccggggtccttcgggtccttcgggtcctgcaggcgtccagcgcgctgcctgcgcgcagggcagaacgaggctggagcgcgcggcgggtagcgctccccggggggcgtaggtcgaggactggcgacggaggacgtggggaccgcgcgcgcgggatccgcgaggacgaggaggcggagcggtggacggcgtcgatcaggcggctcacaggccagccccggcgtctgtcagtcccgcaccgtttgaagacagttaagttagttggggcgccgcggctgccggattcccgccctgccaggtctgacgcggccgcggcgctttgtgctccgcccgccgctgatgctgcgcgcccgggacgacgggctccgccgctgcaccgtgtgaggtgggcgactagcggccgcgaggcgccagcgccggcatgtcgctgcctccggagaaagcctcggagctgaagcagctcatccaccagcagctgagcaaggtgaggacctcgggcggaccggtccccgcaaccggagctgcggagcgggcgcgggcgggcgggcgggccggcaagcttcggtcgggtgtgagagccgagggagccgctgtgaaccggaggcggtcccggcgctttccagatgtccacgtacaagttagcccgaggccagatgtttagggtccctttacaccaggaaggccgatggcagtaagaagttatgggagacggggcgctcaa

SEQ ID NO: 25582 - DNA, 3009 bp, Mus musculus
taatcaagaaattttgctgtttgattttgaggttttaagtatttgcaactatagaaagtgtttccagttactatggagaagaacaaattattttatgaaggaaagcatagtagagttaatttttaaaaatctggttttaggttacagctttagttctgtgttattttcttccataaatagctttgatctgttttcttattgtgccaataaccatctatgttagatctgtgatgcattctccttctccgtttgtgttgtgtcctttaacagaaagcacagctgagtacaagctagctggagtaactttgctgttttgctgcttgttgcatgcacacaggaatggaaatcaactccttttccccttccccagcgccgtttgatctcttccaagatgcaccagcagcccgttcactactacacacagtccaaaaggcctttaaagtgacagtgtatataacttttgtactagtcagcctcctgacactataaatggaaaggctttttgttgacacatcatcaccaaaacaattttttgggatgttctggagactaacttgggaaagcattgctattatcctcataagcatttgggaggagggaaaatataattttattccgtttggagaatataggaatatgtcttttattttctaaaacaataagctaaaatgatgagtttttataattttaatttgaaaatcgaataaatattttcttaaagattgttttgagtggtaatgtgtttaccttttgtagaattgctctataggtgatattatccacacaacgactttacaggtgatattatccacacaatgactttacaggtgatattatccacacaaccactttacaggtgatattatccacacaacgactttttcttgtaattaaaaatactagtaacctggcaccacagtctatacaatggtttgtagccaagcagcacattagcatttgctagtttagaagtggaaacacttctaagttttcatctcatacccattacaaagatggatgtttctaatatatgcatgaatgtttatggtatgatcctacacatcttcgtttcttttaagacaatttggaaacataagttgacatttttcagaaaatgtgcatgcaattgaaattccatgtctcaggatttttaatgtgttgtttcaatgagttcctgtcttttgacacttttgactttgatgacaaagttatacacctttttattgactaaactgcatacatattacgggtaagttataagatggtagatataattctatgagccttttttgcaccaaaattctgtagctattctaagttttttgcaggaaactaaggctgtccaatggttgtatttttcaaagcctgtggcatgaccagctttcccgtgtagtttattggagttggttctcagtatcatgtacgcacctaggaggtgtgcctgccgctgcagcacatgcaggactgctgacagtggaaagcaatgtaaatgaaagaatcagatgggattagacaaggcttcacatttataaaatgaatgtctctgtaacataggtactggtaatttgggggggcattttaactttaacatattgtattttttttcaaacttttatacttcttaagcaaccttgattcaagtgcaagtcttgatttgtactgttgttctatcggttgtggcatgaatatacaagctttttttccttccttccagcatgttttctcttctttggttctctttgtatttactgcttttctctttttcttctgtttccctccctcctttcccctctgttgtttttgttttggtgttttgttcctgtcttcattatttcaggtatttctttccccctctggattccccacgggctggatcaagatggtccagttgtgcccagctccttcctcctcctgctcctctgctagagcactcttgcgatgccaacctccagtatcctcaccctcgcagaggatacctctctcggcctcttaaccccttacctgagaatgaaggggtgtaaaatactgacgtaaaggccttatccagatgcttgtaaatgcttttattctgggctgctttttggtttcttcattttcttttagaagatccttcttatttagggcatgtcttgcatgtatcacaactcaagtgtttgaaaccaaacctttttttgtacttctgcacaaggaagccttggcttcactagttggttacctttgatgagaggagcttcagaaaaagcaatattaactgtgaaagattcccagtatctgattcaaagtgcctgccttgtaaattctgtgtggagttgttaccatagagttcaggtttgtctgttgataggtagcttcataggagagcgtatcattgtgaacttcactctggacttcagacattaagaaatgttttgaattttatacgctgatgttacagatgactgtaaaataaatcattcctgtgtataaagcagcaaatcataaggatatttttgtcttttttttctttttttaaaggaaaatgcctttcactactgggaattaatacttaaggattttgtaattatcctccaagtaggttatttaataaaaatatttttaaaaatgtgaatctgttgtcttataaaaaagccacatgtacttgggttttgagagtctgtataggctgacctggaggtgaatatgtagcctagcacagtcttgagctcctcacataacctacatttacctccctgggattacaggcttgtccccatacctggctaaaatggatgcactttaagataatttagacatggcgtccttttcccatgtcacaaaacaaaaccaaacacaagaaaacacaagccagaacaacctcaggggataagcaagtcttacacttaaaaagtacagtgccaggtgagatggctcagtgggtaaagatgcctgccaccagacctgaccacccgagttcactctagaaaccacacacatggtggtaggaaagaaccaacccctgcaggcagttct

SEQ ID NO: 25583 - DNA, 1143 bp, Mus musculus
ttggccaagacagacggtcagtgtttacctccagaatcatgaaaagaaaaaaaagaatgaaaaaaaatagagaatattgtcaataattcagaattctttttaaaaagattcttttaaaccgtacttattaccagagcattagtagtaactagtaatactagttatagtattacaatactataattcttacctgtttttaactttgtataaaagacatgcagcatgcattctttttctttggctttttttgctttaccttttcttgctaaaggactgtgtagtcagccattttccttagtgtgttgtgttgtgttgtgttctatgagtgttagtgaatgcttaggctatttgatatgctggaacagtctagtgcctgtgccttgtcggctgacccactccaccacccctgtcctgtgcgtgtctctgttgagtgcaactgatggttcacacataaggttcgtgacttacactgaggttcctttagaatagtttttggagcagctacaccaatatagttgcctcccagtggtctgtaatgatttgtgttgacatatgacctctcctcacagagtggtattttttttataccttttgagtagctctgtagtgggacttctttgttttgatttgtattcttctgattgctaatgaagttaagtacttttatacttttattggtcttttaggtagtttctttgtgaagttccatttcatggatttccttatatcttttggtaggtcatgaaagttttacctatttcctttcagtctgtgacttgtccccccgaccccctttttttcttcaagatagggtctcactgtatagctctagttagacttggatgaactctgttgtccaggctgggtttgaacttctgtgagtcttcctgtctcagcctccctgatgctgtgatgtcatgtgggatccaccatgcctggcttattagccttttcacgttttttatttttaaattacttctttaattttattttatgaggtattttattggtgtgaggaagtcagatttcctggaactggaggtacagatggttgtgagctgtcatgtgggtgctggaaattgaacctgggtcttctgaaagagtagccagtgctcttaactgcttactcagctttccagcctc

SEQ ID NO: 25584 - DNA, 1203 bp, Mus musculus
gaaaaagtatccatgccctgggttatccagagtaaatctggtttagcaaacatgagagaaactccttctctgaggaccggatttgaagatggagaacctaactttacatccagtcaagatatttcttccgaaagtagggaacccttggaagctggtaagatgatggattcaacatctggctccagtgagcaggacctgattggccaagctctcctggacaagccagctctaaaccaccggtctgggccagctgtaccgaacctccctgagttgatccagaagactgtggatcaaggtcaaagattatcatctactcgtctgtcagctgccagcagtgaagctagcagccaggttcctaatccgggtgcctctggaacccagcacaatcctgcaccccacatttcagctcatgcttctgttgctaaggtgatgaaccagcctgctgtgtgtcctgccctctggactgggcactctctatacatagctcctggcgccccatctgggaatgccaccttgtcacagtgccatgcaggcatgcaggtctgtgggatttcagggtattctccgtatcctgctgctgcaccagagcttgtggcttctgggctgtacttaggaccaagtcttgcctctggattgatggctccctcttctctttacaacctgtgctctactgctgcaccccagaacttgcttagtacagcaaagccatttcctatggttacaaactgtgaaactgagccacgggactcagggatgatgcctgcgtttggtaagatgcattttcttctctagtactgcttgttgttactacctaaaagttgatttcttttcaaatgggtccacaaagcgaggtttttttttttttttctaaagcaatggtgttcggaattaatttctttaattttttttaacctttaagatttatttatgtgtgtgtgtgtttatgagtgtatgcacacacacatgtgcacatgtatgcacacacacatgtgcaagtgcctacagaggctacaagagggtagcggatcctttggagctggagttgcacgtggttgtgagctgcctgacctgcatgctgggatctgacttaggtccttgttgttgagcagccagctctccagccccctccctttagttagttgtttttccctatttaaagacacaggatgtcaggttgaccttacacttgctatgtagggaaaa

SEQ ID NO: 25585 - DNA, 1184 bp, Mus musculus
tcctgcccatgcgtaataccagacagtggccatggtgtctgaagctctgtcagtagcatacttgaagccacctgagacttatttttccatttaattgctgccaattgcaagaacaccagaagccattggaaactggtatttttggaaaatttggtgtaatgaagttcaagatatactcaaaaagtacgaggtttcaccaaacgagtgtgctttccctctgtgcgtcccatgaagatgaagttgaggtaaagcctgtggtacatttattaggagagcagatttcctaggaagtattcccagtcccaaaaaaggaaaacagaactgtgtgcagcaacgcatgtgtattcttcactgcctcgacagttgtgtgccttgtgtatagcgacaacatccacaggtcctgcacccagaagaccatgtgtggctaatatgcccattccttcaggttggagagcaagaatgatgggccctcattggccagcagttgtcacttcatgtggacactgaggatctggtgggctgcccctgccttaagtggccccttgtctttagctctgcttgactgaaacaattatgcatgctttgttaaatgaaaatttggaactacctccagcccgggacattggttatctgaggtgagctcttgaacaagctaaagcctgccgagcccaaggtccgagctgctctttgctgtgtgtgggaagtatttataaaaccaagccacctcagaaccccattgccaaagattttgtggcaaatagcatgtcccaacttacctcagggtagcgtgagattctcagcacatggggaccatgtccggctggcggtccctggaagagtggggtggcatggttgtgcttgggttcccagccacacttgctgtctgttcaggtgattgttttatactcacaactgaagaaatgctaagtgagaatactacgtgacagggtaaattacaggagccactgaacaggactgctgtggtgtcgaaagatttcaagggaattctcaaggcctttggggtgtgtagtgtagtgtagtgtagtgatcgctggtgcagtcacattatcaggaccagcttttactcttaactttttttttttggaagtaaaacagagcaaatgaaatttacattcttgaggcaaaagttaaagtcttgacaaaaatacagcatttgaaactga

SEQ ID NO: 25586 - DNA, 1457 bp, Mus musculus
ttttggtagctacagttcatttgttaatatttgtttcagattttcaaaaccgggtctgcatacgaccaaaaataaagcaaatttaaatggtcaaaagttctccctgacctatttaagtgcccttcctgcacaccattcagttgttggcatcaagaactcactgttgagttgacttaagcaagagcgtgatgtcagagtccttggagccttggccttaggcctgactagcaaaggagcgtgtggtgaggatgtgtgggtcttggagttggaaatttgcagaacaggggcaggagaagcagtgagaagggtgtcacgtattcttcaaatagtaactgtgcttggtctccattggcccatgtgtatggtatttgccaattttgaattgagtagggtatccatttaaaaaaagaaagggaaggaaagaaagaaaagtcatatacctaagggacaggaaagtttggacctcatgtctttcctgatgaccggaatggcctcaggacacttctttcccagaatccctctttcaccatgaactttggccttttaaagagactttcctcttatactctgagcttctcacaggtgagtgctgagtgaggctcactgagttgattttccctgtgggttttttttcctttccctttgtgacgtctgtgtcctttgttcattctaaccagtcaaaacaagttgatatctcctgtgtctccaggattgagctttgaaaattaaggtgtattcttccttatacagcattgatagtcactaacagtaattacagatcctgagtatcccgtggcaattatttggttattttgataagaatggtcctcttagcaggaagaatgcaccctgatgcagaacacttgagggcagagtgggacgtggcttattctgaggattcacttgaatggccttgataagaaaggactctcagtctcagagcatggctccttagggagtgagccatggggatcattgctgttttctctgggaaataatctaaagaacaaacctcgggagatgagcgaatggctcgctcactgccacagcgtcgcctctgcctcctcctggccgcctccctttgtccagccttttctgccttgaatgttgcccgatttaaaggttagcaaacagtccctgaaccgaggacacatgcagggagtgctggtgggcgtctgctcggcagggctgtgaagcctaacccctggtcaagcgtgcaaactctcacggagcgtacttccgagggcctgaggcttccagctgaaacccaacttcctttttgtttgaacaagatgaaatctctccccctttttaatccaaacatatagtaaaagacacgttttgtcacatttgacaattccattcaagatgctgcacaaaacaacagcatctctgcatcatccttttccaattaaatgtttattctttatcctggatttgacttggggaagggtaac

SEQ ID NO: 25587 - DNA, 1335 bp, Mus musculus
caaattgtgtatctgaaattggcttctagtgctcctaatggtgttaaatggatgagtagaattttgtttttaaatatacttaagtgatctatgtctacccccaaaccactgaaatcatagaacgtagagaatgaatgatgctttccttccttggtgccgtctgagaacatagccctgatgccaggagtcactggatgctgacgtctctctctgttctttaggtatctacttggtctttgcctttgagaagcagcagtgagcacgttgctttagagcagcactccatcctcccaggtggagcagaccatctcagaaacatttgacagctgtttgtttattttaatagtaagttctcaatgtgtaggatgctgccacaaacttcagtgtatgaatttgacacttactgtctgtgacaggttagcataatgtgtgtacatagggatgagttgtcttgaagatctatttttaagtactgttgtaattgttcccctctactgtcaaaactctagcaaggcatgtcagagcagctgacctccccagtgctgtgatgtgtgagcagctgacctccccagtgctgggatgtgtgaatgtgtttacagagctgatttgacagtcgctagaattggcagaggaacgttcacgtttccttacagtgtttttcaagatttaatggattgtgttctgtatacttgaatgtaagtgttcaatatatattgctaaagttataagattaaattttgattttagattgtcctaagagctacctggctagattttgaccgtgtttcaataaaataactatttgctaatacactgcaattctgagactctatagacgaacttagatggcagcacagagttagtgtggactggttggatgttctctttagaatttcttaccgtagcaattagcatatctaattactgaggttgtgattaaggtacgagtaacttcactggacagtgattccatggctagatttccttaaggttttgtgaaaatgccacgtcctaattgtgttccataatgttttccgatggatgtgtgcacgtgcagtaggaacagcacagtgagatgcatttcagatgaatcctcaccaataagacaactcactcaccaatgctgtatccttccaggtcccaacatgcagctcctgcccgtctcacaacactgggactccctccctaaggcagaccccgctgtctaattgtctttcagacattaactgttgagacgttaatggtgtagtagtcggcgtggctgccttccaagggtttacttgctgtcccacagccatcatgattgtcattgtcagttagagagccgtcttctag

SEQ ID NO: 25588 - DNA, 2031 bp, Mus musculus
attgatggttatcccaagcagcaagaagagaaatgtggaggtcttgggcccttccctgaggactcagagaaaactggcctgggtctgagatgggctctagtcattatacctactgtcaaagacataggagagtttccatgatgtcaccctacagaaacagttcaagcagctgcctttttccttttgtgttcctctctgttgaacgtccatccctccacccctccttgcagaagttcagtgactcaggatggattcttgaggacaagaatgggaaggtggtcttttccattgtttcaacaaataagactttgcccagcattcttggaacctaaatgtttaattttgtcatgacttgtagtacctgatgagaaaggtgtggcttttcattgcagtatccagaaagagtcccttctcttgggttcagtgatgaaaatggttcagatgggctgttcagatacgtctaggcctgtcacacagtgtatgctcaggttgtttccaaatgaagatcaggggctggagacagagatctcaggttaagagtgcttgcaactttcagaggactttagtttggttcccaacacacatatcaagtggcttagaactacctgtacctccaattaaaggtacttcagcactctcctttagtctttgctggcacccgcacatacatgcagatacctacacgtaaataaaaaatcaaaagaagagcatgtgggccatttttgggaatgacacaacttgaactagaggtagttggcttggggacaaagctgcacagcagtaggacctagaacatggacttgtttgggtctagaatttactcgggaacagtccagtgtatagtgttgatggagagaagctgaggagttgtctgtccctccccatccttctggtaacctaacctgtacagagagctgcaagcctgtcagagctggctcacacaccacttcagtgcccctgagcacattagggactcttaacagcaagcaaagactaagtagagtcactcataagtagtggaccctgtctgataactgagtggcagagagaagatagagatttctcaaaaacagagccctgttgaaacttctactctgtagtgggcttaaagtcgtatgttcacacacttctcagggtgtaacaggtggttcctgcagctttgagtgatacttactgaggccccttaacttagatgtattaattcctgagtaaggcgctttagtacataaggtaccctggcaggaatagagatagattattcttcacggtgtggagacctggtcctctaaccggacttgtgaaatgtatgcactagaggtgatggtgttcccccaaccttattgtgtggatctatcagtgcaaaagagcctcttaagagaagatgctgtctcagtgtgaattaagtaggcaggcctcattatgtgaatttgcttgcttaaactctgttgaagtgttgtatctatacaggcgatcagggattcttcacagacagaacatacatgaatgcagaagccagaggttcccttttgcctactatttcttccacagccaccatccacttttaagcaaaatccatttcatctggcttgaaatatgtgaaataaaataaaaaatacgttccttggctttcactcggcagtgttcatgagactcttattctcaatagctgtacattgttcattctcatgattgtacagtattccgtgtatgaataaacaacattatacagtggtggtttgattcatttctagcttgggaaccacaggtagccaggaaatgagtttttgtgtaggtatccacatttcctactaggaataagattccagagtcatagcgcatgcaccaattcatattcattatcagctacccagaagctgcaattaccctgcgttcttgataaagtcaactgggatttgagtgagaatggaggcttaaagatatgtttaaatacttggtccctagttggtagatgagaagaattggaggtgtggccttggaggaggtgtcactaaggaaagacccaaattaata

SEQ ID NO: 25589 - DNA, 1215 bp, Mus musculus
gggtttctacatcatgttttattacatggatgcagtgtaaaactgactcaggtctgtgcccaaacacacagacacactcacacaaaggaagattaaatctgttttaaaagaaatggtgtttacggctactgaaactgttgcaagttccgttaacagtgatggagtttcccaaacatttgacaagtttccctttggagaccttttgttagtgtctaaaaaaaattcctgattgttttgcaattgtgtgtgcctgtgcatggtcatacacaggtggggggggggggggttagagatggtggggaaatgaaatcagaggcaaatctggcttccggttttgtgggctctgctgataaattttcttcctggccaatgtgctactgatcttaagcccatgtcttaagtatgtattttgctgggtgacctttcctgcagtctggcaaacaagacctagaaggtgattaaaagaatgtaagatgtaaggccctgatacagtgcagtctgccactagaagaaggagtgtgtgtgtgtgtgtgtgtgtgtgtacacatgggtgagtatacttacctatgtggaggccagatgttaacttgagtgtctttgattattgttctctaccttttcggatctgtgttgtttgtgtgtgtgtgtgtttgaagtacttgtgtaatacaaggtcctctcaatctgtgtgtgcagaggaccaaggagattgagcctttccatctatcactctcttcccgactcctttcggacaagggtctctgtgaactacaccagtggccagaaagcctccgtgattctcctgtctagcccccatccctctcctggggatcacaagagcatacaaccacgcctggctttttaagtgggtgccgggatttgaactggggcccttacacttaactagcgaacattctcactctctgagccatggcccctggccttgtattttgagactcttcactaatccagaagctcaccatttcgtctagagccgctggtctctgtctcctgggatctccagtgtagatctccctgtcccccagtgctgcagttacagacaggcatcgccacagccagctttatatggatgctggggcctccagctgcagaagaagcactttgccttctgagcatctccccggcactatgctgtagaatttttctttatgtgggtgtgtgtgtgagtactggtgattgaatatagttttttaa

SEQ ID NO: 25590 - DNA, 1193 bp, Mus musculus
tcccctgggattttcagaggtacacggttagaatgctacaatgttaccactgtgccttccaatgtttatatcatcggaaacataacataatcaaagtggctgtgatttaacaaaaaaaacgattcaagtgttacctacctgtgtagccgaagtagtgtgcagtgaccgagacgtttctgaatacatggtcagattttttttggaaaaaatacaaaaattaaaaaaaaaaaaaaaaaagaaaaaaagaaaaaaaaactaaaaaagaaagtcaagttcaaaaaccgtcaaatgagaaaattgcaaggagtgtgacagagctgattgatttttgttgctttcttgatttttttttcaaaatgggtttactaaaaagtagatgacttacctgcctcctccttcgtctgaaaaaaaaaaaaaatgccaaccaatcatgcagcattataacaagccttataagccctaaagcattaagttgcacttttgtgaggaggggtaacgcagtattctctctggccagtatgagtgaagtttatacttaacatttgatagaaacatagatcaaactacggcacagcaactcatcagatagctagcgttgactctgggcacaattgaaccaattcccatcgtaagtctttccaacaatggactttggtgtgtagtgcagtgaacacataggactcctacgtaagcatttgtcagcatccttttgtctctaactcggttctgttttgacagccacacaatcttggcatgtattaaggaaaaaaaaaatccctgttgaagtagtttttccacctatcagcactgagtaaatgccataactccgcggaaatggtctaaataccccatttgttgtcctgaactaccagttacatagtgacgaaacacatctgtaaattttatgcaaccaatggcaaacctatcattattttgaaactgtgtatgtaaaagttatatttttacatgtagactcttgttattatgtgttttaatacattgtatcagttttttgtttttttttaaactgtgtggttttaaaaagtcatttaaatgaaatagtgagctacaagaatctgaaatttatgttcatttctgaaaatgtaagaacaaataagatagttaccacgtggtcaccttttacaaacccatgaacattttgattagctgtgtgcatgtgtgtgcgtgtgtgc

SEQ ID NO: 25591 - DNA, 1140 bp, Mus musculus
aaaaatagactgtagtacaccctagtaggaaaaaaaaactaaatttaaaaataaaaaaatatatttggcttatttttcgcaggagtaatccttttataccatggatattacaaaaaaaaatgtcagattctgagtatttcttctttgtagatttttggaatcattatgagtaaaagtttgttactttattttgctatttaaaagatgttattttaccatgtgttactgaaaggaaactgtatggtagagcttctgtttgtttttgttttcaggttttttttgtttgtttgtttttagttgtaggtcgcagtatgaactttttttttgtttctcgttatgttttgttttgtttttgcgactgtacacatagctgcagcattaaaaacttttaaaaaattgtttaaaaaaaaagaaaaaaagggaaaacgttttaaaaaaaaagataaacagttacaccttgttttcaatgtgtggctgagtgcctcaattttttcatgtttttggtgtatttctgatttgtagaagtgtccaaacaggttgtgtgccggacttccttcaagaggcccacagcccagcttggtctagacctgttcccatctgtagttactcgatgaagtcatgtacatgaccgttctgtagcaataaatgtgccatttttataaactgtctctgacacttttttcatttcacctctcgtgcacatagccctcttctgtaagaccaaagccactcttcctgtattctgagtgttggaggtactgaccgttgaacaaaacattaaaaaaaaaatcacaaaaacaaattgaaaggcaaagtccttggtttctcaagaagagatgcccccttaatgaaaatggaacaggatgcttgcaagcacacagaaagctgtctagaggagtaactaattaaaggattgtgattaatgcacctgtaacactggagcaatgcactcgaagagccctgaactgtgccagtgtttggggttgtgcggcaggttgctgagtctgcagcccaaacctcctggatcagttggttggctatttttgcagaacattctcagctagacctttccaatcgaaataaatacaaatgaaactccaggacaattttattttgtatcacttgttgaaagctgcctat

SEQ ID NO: 25592 - DNA, 1233 bp, Mus musculus
tgtgtgtgtgtgtatcaccttgtttctgccttatcataaaagaggctccatcctgatgaccttgtctgatctgaatgaaccgccaagggtctcatctctgaacaccacaaccagtttatctttccaccctgttaatgaggattaaactccactgtgaatttctgaggagacaaactacatccaaaccatggcaattgaccattaaagcctgtaccctagtgaggtgtatggatatgtggacacaaagcagagcgcagtgaatctcggcatgcatttttagtatgtttatggaaccccaagaggtcgttgactctagataaaaatccatgcattaaattgaaattatatgtacagtgaaaatatgcgaacatgatgaatttgaatacaaacttcaacagcgtcaaactaagatatggtatcaagtatgtaggatattaaaagtacggttggggcaggtctgcgtggagccgcggttgcgggtctctattccgcaggatggggtttgtgaaagttgtcaagaataaggcctactttaaaagataccaagtgagatttcgaaggcggcaagagggtaaaactgactactatgctcgaaaacaattggtgatccaggacaagaataagtacaacacacccaaatataggatgatagttcgtgtaactaacagagatatcatctgccagattgcatatgcccgtatagaaggggatatgatcatctgtgcagcatatgcatatgaacttccaaaatatggtgtgaaagttggcctgacaaattatgctgcagcctattgcactggcctgctgctggcccacagcttctgaataggtttggcatggacaagatctatgaaggccaagtggaggtgaatggaggtgaatacaatgtgggaagcatcgatggtcagcctggtgccttcacttgctatctggatacaggtcttgcccgaactacaactggcaataaagtttttggggccctgaaaggagctgtggatggaggcttgtctatccctcatagtaccaaatgattccctgattatgactctgaaagcaaggagttcaatgcagaggtacatcggaagcacatcatgggtcaaaatgtggcagactacatgcgctacctaatggaggaagatgaagatgcgtataagaaacagttccctcagtacatcaagaacaacgtaactccagacatgatggaggagatgtataagaaagctcatgctgcta

SEQ ID NO: 25593 - DNA, 3184 bp, Mus musculus
cctctcggctgcagagcacttttctatgattcgtgcatctcgaaacaaaaatggtcctgcactaggagggttatcgtgtagtcctaatctgcctggtcaaaccacagtccaagtcagggtcccctatcgtgtggtagggctagtggttggaccaaaaggagcaacaattaagagaattcagcaacagacccacacgtacatagttactccgagcagagataaggagccagtctttgaagtcacagggatgcccgaaaatgttgatcgagcacgagaagagatagaaatgcatatcgccatgcgtaccggaaactacatagagctcaatgaagaaaatgatttccattataacggtaccgatgtgagctttgaaggtggcactcttggctctgcatggctctcttccaatccagttcctccaagccgagcaagaatgatgtctaactatcgcaatgatagttctagctctctaggaagtggctccactgattcctattttgggagcaataggctagctgactttagtccaacaagcccatttagcacagggaacttttggtttggagatacactaccatctgtaggctcagaagatcttacagtagactctcctgcctttgactctttaccaacatctgctcaaactatctggactccatttgaaccagttaacccactctctggctttgggagtgatccttctggtaacatgaagactcagcgtagaggaagtcagccatcaactcctcgtctgtctcctacatttcctgagagcatagaacacccacttgctcgaagggtgaggagtgacccacctagtacaggcaaccatgttggccttccaatatacatccctgctttttctaatggtaccaatagttactcctcttccaatggtggttccacctctagctcacctccagaatcaagaagaaagcacgactgtgtgatttgctttgagaatgaagttattgctgccctagttccatgtggccacaacctcttctgcatggaatgtgccaacaagatctgtgaaaagagaacgccgtcatgtccagtttgccagacagctgttactcaggcaatccaaattcactcttaactatatatatatacataaatactatatctctatatggactcataaaggcatgggtataatggtacccccagtaaacttcctaatgaattcttatgactgttatcaggctttattgggattaggctaaagttgttagtacacttataaaaggctgctatggtaacactaacctaagtggtctcttgtctattagtttggtttgaattattaatactatcttgtagactcagagacatagcttgtataggaattgttaaagtggaagttgtacttggctgtgtaacctaagagcaaaatgtatccatctgagattgtagtcagtgggtcccagagcctagccgcactaagagtttatggagggtgcctggcatctcagatgactgacacttccagtgctgccttcttcacactgccagttttgacaaaaacaggtttgtttttttattttacaacaacttctgcctaattctgcaggattgcaagtaactttttaaagcattgattacttactagtaataatagggctgatggcagtttactagatcactggttataatttgggacaaaaactgctacattgactctcatctcgcccagagtgctcaaggctggtatgttcagtggatcaggaatacagttgtctttgattgtgaattcctacccattgcctctctcagtgaatgtggaaatggccgcctgggttttcccatttcaggatgggcttttggaagcacctatattggctgaaaatttgagaatgcgaacattccattcattagtctgatcaagctattaattaatatttagactgtagctcaaaatgtgaaacattttttgttcaatccatatttgtcttgcacattataaatatatttttattttttagtaatgtaggggatggggagggagataataatgcccttggcatgattcatgaaagcagctgtgacaacctccaatcagtttacttcatttcaaacctatttccaatcacaaggaaagatttctttaagacacacttgtacatttcacctgtggatgttttaacgtcatcctcagtatgtccccaaatttgctggtatggaaaggacaaaacattatagtggtgggtttttctactaattattttttgaagcgttattttcccaacacaaaagagctttttttctcagtataacaaaaattgaaatcttatgtgtattcaatagtaaatagacaaaattttattttttatttccacttgaagagttacatttcgtataaagtttacaaataacggtttttattttgatttttttcagtataaaaaagttgccttgatggcatattatgatgtaatgctaactgcttgtaggatagttgattgtcagtattgaatcctaatctctagctgccgtcttgtagatatggacgaatgccaccaagcatgtgtttcctattttgttgcatcgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaagtttaaaaccatatattttatgataaagggcctttaacttaagatggccaaagcactgatattatatatttgctgtaaagagaattataagagttttatttttctgatattaaaagttacttaataaagacttgtttccattaacttgaatgtattctccttggtgttttttcatataatttcatctgagacaaactagttacttaagaatgaaattttcctaccaaattttcctcctttctaacttacactcctggttgtaatgtaagagagagagagacagagagagagtatgtgtgtgcgcacatgcatgttcctggtgttaaatgtgttttttctagtctacattcacctcttcaggaactgtctaccttactttctgtgagacaggttctcttattgaacctggagctcattggttctggtagattggctctgcagagagcttccggg

SEQ ID NO: 25594 - DNA, 1064 bp, Mus musculus
gccttattaagcagtaaaacttttgaaaaatgagccgtttattggcaggagctatttacacaaatcagaatattataccatttctttttctctctctcctgtctctgtggacctccggggcttctgagatagacagtactgcctagccattcgaaatgcccaagccagctggggttgttgggctctcctctcccttcctccttcctcacagctcctgctcttgcgtggttagtgagcctctactcagtgtttcctgtcctcgctgctcaggcgagggaagacgacaactgatagtcttagagttcacctttctgtcgggggcggcattgttctgattgctgccatcgtctccgatccttgatgagttttatacgattgatgtggagagaatttaattgatattcatagcccatagctgctcccctctccctggtgttgtggaagatttagtttccaccgaattcactcaaaaagctgtcctgttggcaccagcaaaccacacgctcttttagaaaacatctttgcttgttttgtgtcctgaccctgctctctggcctccttcctctgtagatacttctgacctataggtgcctttatgagaattgagggtctgataccgtgccccaaggaatagctgatgcaatgagtgatgtttttcagggattttagcatcaaattaaataaatgaatgaaacttttaagtccttcttttcttttatttttttaatgcaggaaggactgaggagacgtcgggtgacgacaatcatttctctgtgttgctgtaaaggctttcacacagtttaagatgcttttctcagtagctccagagttgatgttcttgttcaacctaaagcaggctctggactcgcccagaccgttgcacttgtagtttacgacttcatgtgtcctccctcggcaagtcattcccttctctgggcctcagctgcctcgtctgtgaaatgaggggttggactattgtgccagctctggcttctaagtgaccttgcccgccctgcagcaggttgagatgcgctctttaccttttttctgctgtgtgaggggga

SEQ ID NO: 25595 - DNA, 1943 bp, Mus musculus
aggacctgcgccctcacagcctccacacttgtgcttctttccgttaggtctgtctgctgctgctggcatcggtgtggatgacctccggcgattgtgcattctcaggatgagctttgtgaagggctggggcccagactaccccaggcagagcatcaaggaaaccccgtgctggattgagattcaccttcaccgagctctgcagctcttggatgaagtcctgcacaccatgcccattgcggacccacagcctttagactgagatctcacaccacggacgccctaaccatttccaggatggtggactatgaaatatactcgtgtttataatctgaagatctattgcattttgttctgctctgtcttttcctaaagggttgagagatgtgtttgctgccttgctcttagcagacagaaactgaattaaaacttcttttctattttagaactttcaggtgtggctcagtgcttgaagatcagaaagatgcagttcttgctgagtcttccctgctggttctgtatggaggagtcggccagtgctgggcgctcagccctttagtgtgtgcgagcgccttgcatgccgaggagagtcagagctgctgattgtaaggctgagaagttctcacagttaagccacctgccccttagtgggcgagttattaaacgcactgtgctcacgtggcgctgggccagccagctctaccaagagcaactttactctcctttaaaaaccttttagcaacctttgattcacaatggtttttgcaagttaaacagtgaaggtgaattaaattcatactgtcttgcagacttcagggtttcttccccaagacaaaacactaatctgtgtgcatattgacaattccttacaattatcagtcaaagaaatgccatttaaaattacaatttttttaatccctaatggatgaccactatcaagatgtatactttgccctgttaaacagtaaatgaattcttctatatttctaggcacaaggttagttatttaaaaaaaaaaaaaaaagcctaggggagggatttttcccttaattcctagggagaaggttttgtataaaacactaaaagcagtgtcactctgcctgctgcttcactgttctgcaaggtggcagtacttcaactgaaataatgaatattttggaaactgctaaattctatgttaaatactgtgcagaataatggaaacagtgcagttggtaacaggtggtttggatatttttgtacttgatttgatgtgtgacttcttttcatatactgttaaaatcatgtatgttttgacattgtttaaaattcagtttttgtatcttagggcaagactgcagacttttttataccttttggttataagccctgtgtttgccatccttgatcacttggcggtgactttgtagagattgaagtggaggagttaagacacattgactgtaccacagacacacatgtatactttctacctagttactagcgtaaataaaactgagtcactatacgaagtggaattctagatttggtttttaaaatgctttccttttgcacttttgagtccagtctcagtggcaagacaccttctgctaaatgacaggtggcagccagttgtaccatgcagcgctggttccctcccactctaccaggactttcccatggacactgtgcatcatgtgtagttggttattttttgagtttttattttactgtagcaaaaaaaaaaaaaaaaacttggataaatagtgtgaataaaatcaagaccatggagatgtttttaccctgagagttttctgtgagttttaaattgcagtaggcatttgagctctggaaaccccgtgcatagcagttctctttgtgccaacagaaatgaccacgtcctgcagcctgctgcggaaggttccagaggctctgagaaaccagagtgctgcagtgactggggtcca

SEQ ID NO: 25596 - DNA, 1201 bp, Mus musculus
taattttatgattgggggtcatcacaacttgaagaactgtatcagagggttgcagcgctaggaagggtgggaactactgcttcacagaagtgaatgctaaacaccagtgctcagtatgagttctaataaataactaaggaaatagctaaggaagagtttgaggtaaaggcacatttggtaagactttatttagtatgcctttgcaatagtgaggagaccggaatttataatggttttggagtatcaaaactagctttattttataattaagccatttcaaactttaagcatttttaaaactatgggcattgagtcttttgacttaaatggaacagtttttcttccccaaataattgtatctaccttgtgaaatgtgttctcatgtctctttttctttcttaggtcatcctgctcaccagatgtcttgacagtttttcttgcaacattggccattggttttcactgccttcaaaagatcaaaattactccagaaattggagagttggatttaaaagaaaaaacttgaacaaatggacaatatgtctataacaaatacaccaacaagtaacgatgcctgtctgagcattgtacatagtttgatgtgtcatagacaaggtggggaaagtgaaacctttgcaaaaagagcaattgagagtttggtaaagaagctgaaagagaaaaaagatgaattggattctttaataacagctataactacaaatggagctcatcctagcaagtgtgtcaccatacagagaacattggatggacgacttcaggttagtcttgtatgtcttctgtgctggtagagtaatagatatttttaaatttcctcttaagttactaccaatttaatgtgagctccacctccatatatttatttaatatatttagatttatttttatcacttctgtgtgtacagatactgaaagaggcgagaagagagcattcccagatgctgccatccagctgcttgtcataatagagcactgggcattctcagtgctgggccatctctcaagctcagtgactctgtgtcttggcatactgtgtatctcttgccagtgtgcatgatgagagtatgtggaagagtacacaaaagatggctgttatcatttttatgttattattaaaaaattgtgcagtgaagaaaatgggaaaaccaacgagaagccctgtattgagagctaacccctgtcc

SEQ ID NO: 25597 - DNA, 1127 bp, Mus musculus
tgctacttcttttcaatcccagggtttaggggcaatgatttcagtcttgtttgaacattgaaatttcttggagagctttacaaaacactgatgcctgactcctacccacagaaattttgatttagttggactgggctgtgtagccatcttagaaaccacagtagttgagccttagggtcctcatcttttaagctggttggtcgttttacattctttctcttttttatttgtttaggagacagggtcctatgatgtagatgtggctagccttgaactttgggcaataacaggcctgtgatatcttttttttttttttaagattttatttattatacgtaagtacactgtagctgtcttcagacaccagaagagggaatcaggtcttgttatggatggttgtgaaccaccatgtggttgctgggatttgaactcaggacctctagaagagcagtcagtgctcttaactgctgagccccaggcctgtgataatttgctcagttcggctttacgttcctgttaatgctgtgatagattcatgcagaaggtaaccattgcaactctgatttagtgggtccttcttcctctcttgtctacctccccttcctgtccccctcactttattttcaaattatttgtattgtttagtaacaaattttaggatgcttttcttatgataatgaaattggtctcaaacatttaaagtcccaatagaatttggtttctttttaaaaagatttatttctattaattaaaaaaaatccaatgtatatggatttttcctgcttgtatgacttcaccactgtgtacctggtatgggggtggtaaggagagggggctgtggatcccctgaaattggagttacagatggtggtgagccaccacataggttctgggacatgaatccatgtcctggaagtacattcactggtttttaacctttgagccatatctccagtcccttattaatttttagctacacatatgtgtgtgtgtctttgcaggtgactaaggaggccacacacccaaggtggatgctaggaaccaaactccagtctctgcagaaggaacagtgtgtgctcctgtctagtcagttcttcagctctggaatttggttgtgttaagggatt

SEQ ID NO: 25598 - DNA, 1264 bp, Mus musculus
agccctggcattcctggaactcactctgtagaccaggccagcctcgaactcagagatcctcctgcctctgcctccggagtgctgggaattgaggacgtacactgctccccctggactgtacacctggcaggaaatgcctttaaaaaaaaaaaaaaaagatttatttatttgagtacactgtaactgtcttcagacacaccagaagagggcattagatcccatttcagatggttgtgagtcaccatgtggttgctgggaattgagcttagggcctctaaaaaagcaatcagtgctcttaaccactgagctatctccccagcccaacccaggaagtactatctttcaatccaagggtaacatcagtgttcatgagtcatgttctgaaagaaccctgaagtttgttggagaaatgttagtgtttgtggcattcacctgtctagatgctttgagggacaaagtttgttcttcttttgagattttagcaagctgacctgaaactcactctgtgtccctgactttcttccatgcatgtgttgttatcatagccatgaaccacaatggtcaggaacaaaacttaaaaatgctcaccccagaatggtggcagtacagagcggtttgtaggtacataccagtgtgtgtttatactctataggcaaaggggacttcttcccatcttcctgcttaagattgacttgaagttctgaaggtgtgttcagactgcttagtgtacacgaccttgggttcagtccacagggccaccccagagaggcagtcttacaatggcattgcagttttaagtatgggtggacacgatggttaatttaacataagtagcagtctgttcaatacaataatgaagtaaatcattgattgaaagatgaatacacaggtacgagtctagtactgaagcaggagaatctcaacttcaaagccagaatgtctacaaaagaactcacaatgtgattgcaagatggttcagtggttagggctcttgtgtctctgagcctccacatttaagtttaattccaggacccatatggtggacagaaagaaccaatttccagaagttattttctgattaccctcccccgcccccacttgccacacacacacacaccataaataaatgaacaaaaatgaagagaaacgtttattttttttcatgtttttatttaattctgtctatgaaatctaaatattgaatgttacaagtatacaaatgtgttgctggttttttgggtttttttgctcagtttgttaacgg

SEQ ID NO: 25599 - DNA, 2256 bp, Mus musculus
ctcatgggaaaacaagattccagagtcttcattttcatctgtagctagctcctcttgactctcagccttcctagctaatgcaggtgtgtgtgtgtgtgtgtgtgtgtgtgtgtgtgtgtaaagcataacagattaatttctcaaaggtcaaagggatgattcccatccccaatctgcacgtgttagccctagggggtggtgggcaggcactgacataaaagcgcaatgtctgatgggcttttcaaatcaaccccatctttctcctctgccaggacactgctgcacacagcatgagggaggctgagcagcaaagctggaatccccagagcgaccagcagcgtttcagctggctggacagatcaaataacacttgggctggttaacaaaagatgcaagtgggaaggtgttggaagccagagtgtggaaatttacccagcgttgtttctttgacagggaaggggactttgtccgaatgacgctacattcctgcagcccaaaggcatcctgccgagcatcctctgtcaaggtgctgcagataagtgggtgaaagaggatgtcctctcgtctgaagcctctgaagggtcctggcctggcagctgagttctttttgtacttgggacagcagatgtaactgcagagctcgtgcgagagtgtgactttgcccaactcctgactcaccagactggttggggttttggaatcaaaacggaacttgtagaaagataaactggcagaaagaaaaagaagcccctagaatcgtctagaatccattaactgagtctgctcttgctgctcagagcacagagggaggctgtgatccgattaagctctgggcccacttaagtaaagcaacaagcgcgcgcgcagcaagcagctcctgcacttgagccacacagaaggattcaaagttgccggatactttttatactctgagatccatggagatagaagataacgatacaggcttttatttctaataatgccggatctagaagatgtgcgaaccattttaagcatccaggagggttcttgaatcgcaggagttggtggcaaaccctccaagtgcaggtaacaacaaccttagcagcatccggctaagcaggtcgggatgcaaggacttgcagcccttcctgtcccctgacagctggcagcagcgacctcaccaggagccaaagcatccctcagttgtgagatttgacagaatgaggtgtgctggggaagccactagctggaacctggcctttcctgactgcccctgcattttccagccggccccggaccactgaggcaacaatggctgagaaaggtgactgcatcgccagcgtctacgggtatgaccttggtgggcgcttcattgacttccaaccccttggctttggggtcaacgggctggtgctgtcagctacggacagcagggcttgccggaaggtggccgtgaagaagatcgttctgagtgacgcccgcagcatgaagcacgcgctccgagagatcaaaatcatccggcgcctggaccacgacaacattgtcaaggtgtacgaggtgctgggacccaaggggagcgatctgcagggcgagctcttcaagtttagcgtggcctatatcgtccaagagtacatggagactgacctggcgtgcctgctggagcagggcacgctgactgaggaccacgccaagctgttcatgtatcagctgctccgtgggctcaagtacatccactctgcgaacgtgctgcacagagacctgaagcccgccaacatcttcatcagcacggaggaccttgtgctcaagattggggatttcgggttggcaaggatcgtggatcaacattactcacacaaggtaggttggcctggaaaggctgctgctagtggcctgtgggatcctcaagggtgcacacagttgttccagagggtttatgatcaggagacagttgtgagtgtgaggggaggcagaaaggtgcagaaagatccacggcctgggacgttggccgggatggaggaatctagttcctagtcatggctctgccacatgcctttggccaataacactgggccgcacaagtgaaaggtcagattaaacaatgtcagaaacttcttcccgagctctgtgtggttggtgaagttttcttttgcatctgctggtcctgggtgtcttcatcatcctctcagagctcaggagaccccagaagactccccacactgggaacactatcctctagtttgctcccctcaccagggctggcccatcctgggtccc

SEQ ID NO: 25600 - DNA, 1135 bp, Mus musculus
ctttaagttgcttaaagtaagacagagaaaatgtgagattgtggtcatgttgatcatggaccaagacacactggtagggagtagcctattgttagatatgggagatgactgatgtatgcagacgataccttaataccacttaagcttgacaccaatttcctagatggagccaacagactgtatgtcatgtcgaacatccctgtgccatgtagtttctgtcagggatttacaacttgatcttgtcactcagaagagtggcacctcccgggttgtcacttcctatttcattcaccaccacaggggctgcctgaccttggtcagacccagtctctgcttttatatacagtaagtaattcattcctgactctcctgtctacggggaacctttcctaaatcctagtccttgctgattatttggaaaatgtagaaagaatttataatcctaacaagctggtttaaaagacacacaattcacgtattttatttacaagcataagcctagattgggcagatgtagggctatagtaacttactccccagctataaagtctcttgttacttgctgtttctcctggccatgtggttctggtccatggctgctgcttcctcctctgtcttcctctcttctctctctgcctgaacacacacacatatacacactcactctcgaacttccagtcccacctttctctccccactgcccaatcacagactgtagccttttattgacaagttaaataggggacaaagagggttcatgagttatcactttgagtacatgaggatctgttcttgggggtgatgtgtgtgccaacgacatcttgagaaaccagtatttagcatgagaatacaagcagcatcaaccaacccactacgggaaaggcccaaacgtagacttgacattatgttgcttttacatcatggggggaaattttgcttcagattttcttcactcatgccttcccctttcttaggctgacgttgaactgtgctcgccttccaccacgttgtttaccgaagtctcacctagttttgggatccatatagtgttcagcatctctgtcgctgggtctcagaatcctttgaaccgtggcagtttcttatcttctcctgttttctcaggaaactgagaagt

SEQ ID NO: 25601 - DNA, 1196 bp, Mus musculus
tacaataacagtttcagtgactgtaaacatagcagtgggtcactgtgaacactaagagattctttatgtcttgcctttgtcgtggtttaggggaggcccaggctgtgagtagatggatcaccttgttaggccctggatgctgcgtaggctccctctgttcctcagcgtgtccttccccaccgctggctgacagtttgctgtgcccagacactcgcacttcaggcagggcggtgcttgggactaaagctgttagcctgacccctcttttcctggcagctgctctctgatgatctttgcttgtttcctgccctcagcccaaaggtttgttaggaggctgagtgaatttatacactgagtcctacccgaggaccagtcttggctcagccttacctcatttcccattcttaaaatgccaaaaagtgtaaagtttgttacttagtcaactttacagggcaggactgtacctcaccatatgtgtgtcctgtgtaccccatgtattagctttgtcccagctctgctgtcttaggtaatgcagatctggatccctctcacagacagagctctgccaccgtggtctctgcctttgcctagttgtgtcctagaccatgctgctcttcaacccctagagcgcacatccacttgtcgcttgtatcctggtagctctgacagtgagtggtgtgttaagggacgtgtgcgtggttggcctttgacttgtgaatgaagattctgactactatgtgtgtttgactaggggataatcaaaaggtcagaatcagtacaacaaaggctggtgtatgcatgttaaggacgttttgggagacgttttacattatgtaatttgcagctatggtttagcggcctctaggactgtcatttatatataatgctgggacttaatagtattcaggatggggagtcaggaagggtagagtattctggatggggagttaggaagggtaggtggacatatgggagcccttgaaacaagagttggaattcaagaagatggcctggaatccatgcagcgtctcaccgcctccagcttcagtgatgtttatatcctgcagaagaagctagtgtccttaggagcagctggcctaggactggagaagctaaaggaagatcccagggcaattgtagcagctaaaagcctggctggaggccaggctgttttccccataccaaggtgagacagc

SEQ ID NO: 25602 - DNA, 1141 bp, Mus musculus
tgacataacagctgaaggagatggtttggggatatcctttggtaactctttttttctttttgtgagattcactctgtcaatcaaaagctgtgtgtgtctgtacccaagtggaagtggcattagatgtgaggtgggattttttttttaacttcagttcagatggacaataccaaaagttgatcatagctaattatttattgtctcttcattacataattgatgtctcttagctcctcccaaactttcttgagcatccttttgaaactgtctacaagctagcacacctgagctgtgtggtggctgttctagtttctttaagaacacagggagtgagaggtagatggtcttagaaatgaggcagactatagacacaccaggctgctgtcttttgacatgtagacttaggaggaaaagcgaagggatcttttcttagaggaaaatgtttgccacctgatggagcagtccaacatctttgtaacagctggtgcacacttaattccaacactcaacctcaaaagggtggtttcatggaaagataaagctgagtgagcttcgagaggcattgacagaccgctttgttgaggagtggaattctctttccaagagttggaagacctgggagacaaaatttacaaagtgaagtatttaaagcatccctacacagtccctggggctctcttctctggaccaagggaatgtgctatcctttgacttccagagtccaggcagcaggactcctatagtgaatatagggggagaacccagaccaacagtgaaggaagattataaatctagtgtgcaggaatgattgaaatcccagaaactctgatctttaggcctggtaggctcatctatccctagttgttccttttacttatttgtgttttgatcgctctccctacttctatagactgtaagcaataaagattagataatgtattcacatagttcaaatttcagaagagatgagaaggaccacagtggttgtatctttccgacctttgacctcaatcaggaaattcctttcttgtaagccactaacatcatcagtttcttgtggatctctgtagacctgttgttattcttatgtatgcagtggcttgtatgtatctatcattttacagagaaacaattcctctct

SEQ ID NO: 25603 - DNA, 1245 bp, Mus musculus
accacttcgaccgcacaccccatctgccctatcccaggcttctagaggcaccgcccactcgctttctccaggacaggactggagccaagaactcagcatcaaccccaccccacatcccagaaaaagcggaggtggggtgtggggggatggggaacgggcggggccgactggtggagggcgggacctgttatcagggggcggggctggcggcggtgcggtgggattggctgcccttgcgcctgcgcagccttctggcggcggcctgtgctaggtcggagcggggcggtggcgggtagctggggcgtctagagaagggaaggggaacgtggtagagcagggagcgcttgggtccccgaggcagccccgagtgagcccgatgtattttccttatatgatcaggcctctcgtaaccggcgctgctggtttggagcctgagaggattatgaaaacgtggcaggtgatggggtcaggggacctggagcggggaagcagaggggagagggactgagtggggaggccaggcttcggggaggggataggtttaggggtacccacgcctccagctgcaagccctgccaatgatgacatgaccactgcgcaatctgagttctgggaaccaggtgatggagtgtgctgagaacactgaggccaggcgagctggaggcggcctaagcagagagaggggcccggggcgaggggaagataagagctcggggccccggggcggccaagtggcctgggctgagcgtgggaacagggcgtgggtggtgctgttgctttcttttaactcgtcaatcactgtctacccttaagccagctttgtgtgtgtttcaccagctcccttgaagtggggactacctttttaatctctctctcccgctttttttttcttttttctttctcctaacagggttatctgctgttctgaaactcgccctatagactaagctaggaattatgtgattcgcctaaatgctggagttaaaggcgtgcttcaccacacctgggtctaaccacctttttaaaaaaaaattatttatttatttattttttattttttgtgaaaacgtcagacacgtggcaaggttcgtgttggggaacatactgtttgctgtttcacatctactcattaaaactgtattttaaaaccttgcacgtttacttcaccctatgtacacttcacacacacacacacacacacgtttgttacagttctcttaggaattttcacgcagcgactgcaaa

SEQ ID NO: 25604 - DNA, 1099 bp, Mus musculus
ctccccaatttttgtgatttttaaattgatgtgccctttattatgtgtttaagccagaaattagtatctctgtgggttttttagattaatattgaaataagcattattgtccgtagagccgggtatggcttgcacctataaactcaagagtttagggggctgaggcgaaagcttgccacacctccccgaccaaggtgaactgcagaataagactctgtcttaataaatagaaaaaaaaatatgtaaggtatgttactctggcacacacaactgaggtctgttcactttacccactggtgtctttaagtagattctttaacatcagcatttcaacaacattaaacatttatttttatgttactgtaaactaagacacaatatttgtttaaataaccactaattcataaagcctttgtgtttctcaactcatactctggataaagtagaaggcattttgttgtctgttttcaacaggaaatctgttctaaagatgctgaggtcgtcttgtgtggaggaacagagagcatgagccagtccccctactgtgtcagaaatgtgcgcttcggaaccaaatttggattagatctcaaggtttggaccattaactatcttatataaattcttctatttatattaaaagttttaataatatatcattttaagggagaaaagagtaactttgaacccagctttgttcatggaatagcaccaagatttgtatggtttaaaatttacaggccagacgggcgtggtggcgtacacctttaatcccagcactcgggaggcagaggcaggtggatttctgagttctaggccagcttggtctacaaagtgagttccaggacagccagggctatacagagaaaccctgtctcgaaaaaccaaaaaaaaaaaaaaaaatttacaggccatgtcaaatctcattagttttagtgtttgaatctacaaaggattatacttcacatctcaaagacaccatggggagagtggaggaagaagagaagtagattcatgaatgatccttaggactagacttttgctgtggattgtgggaggtcagcttctggggcggtgtcttttgactaggtttcttcatcac

SEQ ID NO: 25605 - DNA, 1203 bp, Mus musculus
cacacacacacacatatatatatatgtatatatatatatatatatatacacatacacacacacatacatatgtgtgtatatatatatatatacacacatacacacacatatatatgtgtgtgtatatatatatatatacatatatatatatatgtatatatataatacacacacacacatataattgcacatgccacccagcatgtgtgtggaagtcagaggacagcttgcaggagaatgcttctcttcttccaccacgtgggttctagggattgaatttaagtcttcaggcttggtggaaagttcctttacctgctgagccattttattggccccagtagcgacttttctatcctttcttaggcgtcgaggtggaaagtacgcagtgggatcagcttgcattggaggtggccaaggcatcgccttgatcatccagaacacagcctgaaggcatcacaagcacactgcccacacttactgggccaggccacggaacacaggagaccttcgagtcagccctgctgagacagtgattgtatgtgaccaagccttgatgaggcaagatgcattgggttctgtctacttcatacctgtctgacgtgttagaataaaaacaccaaccatcggaggccttaagagaaatggtatctgtcagtagtcaccactgtatgccttccatggagtaatacaaactgaataaatgttgccttaactccagctaaccttttcttgttggtttttttaattacataaagtgtctcattgtaccgggttgtaagcgtgcagttcagtaccattgaggacactgacaggactgtgccaatagcgacactgcctactgtcaggatctttcatcttgtaccgctgaaactgtttctattcttaaaatgtgtcatttttatgtgccatgtgtccctgggtatgggcatgtgtgttgtagataccctcaaagaccagaagagggcattagatctcccagagctgaagttatacccagttgtgagctgtcctttgtgggtgctctggacctctcgatgtgcagtgacttcattaaccacgggacgcctctccagcccctcccccccccccttctcattttaagaaatgattctccattcccctctcacagtctgagcaaccaccattctattctctgtctctgcatgcttccctgctctgggaagctcatgtgagcgaacccac

SEQ ID NO: 25606 - DNA, 1172 bp, Mus musculus
catttcagggtgcaggtactaatggattacccacaaaaggaccaacagaagtctcggataaaaagaaagactagtgtgggtctcctgaaggcccttggctgtttgcaaatggacctaatgatatgaagccttctttgtctctgaccttttttctctgagaccaggaatctagataatagtttagcttctgcctgatactgatccgggagcacatgatatttatatttaaaattccagtagttatatttaatgatctcacccctgagtttctttttcattaaagtagctttcatttctattattccaatttactgatatgaacaaatagaaggtccgtgtgagcagacgctcagaacagagcccttggcccttcgagttctttcttacgagtttgccgttctcacttctgtgggctcctataccttgagtgggatgagtcttagtgggaaacagtgccgtccgaggtgggatgcgatgagaagatgtgatcactgcaggcgcagcggcgagtggacagctggccgagaccagctccaaggcagctggagaaggaaggacgggagcttccttgaaaaatgtaacctggacatcgttgtcaatcccacaacccctgactctctgtgcttctagtcctgacggtgtattaaacgtccatttaacttgtggttcctgctttttgtcttttcatacttgaaagttttttttgttgctgatgtttttttagagtttggtttggtttggttttagataaggtttctctgtgcagccctgctgtcttagactttgttctgtagaccaggctgaactataacttacagagatctgcctgcctatgccttcctaatgctggaattaaaggcatgcaccattgttcattgctgccccagcgatgtgtgtgtgtgtgtgtttgtatgtatgtatataggtcaacaagtaaaatcttagaacagcgatgaagacagtgggtgagtggaagtcactgccacagtgagtgacttccacagcaaaggcttgcctgattttgtctaaagcagctgagggtctggtcttgagaaaagccaatcccgtacctgaagcctataatcccagctacctgggggctgaggcaagaggactcaagttcacacctggcttttgctacagaatgagtttgagtctaacttaggcacatc

SEQ ID NO: 25607 - DNA, 1136 bp, Mus musculus
ttataatgacaaatacttaagcagaatatttattgtcataaaagccatggtcatcaataatacatgcaaaaatctacaagtggaccagagaatatagaaattaccttgtcaccaaaaattgaataagcggagttttgcgcttacaacatgtgtctcattgctatttggttggcacattcctctgctgatttctatgtagcaacctgccttcagtagccagctgtgctgcactggccgttacatttataattacttacaattctatgtaagtgacaagcacatgcttatgcttaatggttggaatcgtgctgtctggtgtggagacagcgccagggtcaaggtttgggtcaggttgtgagatgctcacacgttccctgaggtagtcctagggacaaacatattctgtggtgttgtgcagaattaggtgactctgtgaacaggagtttgattttaattttttttttttttttttaccctttctatgtagtcttccctacaccagtaaacttgtgaaaaccttattgtataactttatcagacaagaaaagccacctccgcccggaacccatgtcttccctcagcagtcggatgggggaggactgctgtatggactggcatcaggagtagcaagtaagtccttccgtccttcacgtcctctgtctgtggaacctcttctgattggccacacgcagttctcctcacttggttgctgccaggagccattctattgagtctgggtagctggctaagtgtaaaagtgcaaaggcgttaaaatggcaaccctcccattctctgtagtgattcatgttaaatgtatgcaaataatgagtagattatttagctgtagaacataattgttcaagacgaatgtttatacgtaattatggatatcatgcaaggtctggctctgaagagaaagtaacatcaagccgtcggatgcttttcactcggtgcctgtaggcaacatctttctgttcagagactccattggctggggtttcactgcacaatctcagagctttgttcagtgacaaattggtagacttggaagactttgcagctaactctgcagcagcgtgggatggggttgctgaagaaaagccctttcctccctcacagtaggcgtcgtttctgcc

SEQ ID NO: 25608 - DNA, 1201 bp, Mus musculus
ctgcttgagaggattcctgagaaagaactgtcctggggacactcagctagcttcctgtgagtccagggcgttcaaagaaacagactgaaaactcaaggttttctgatgaaagatgtctgttttagaaggtgtcaaaggactgggatgcggagacatgggggtgtgcatgccatgtggctctgagcccaggtggatgcagcttacgactctgttggccatggtaactggtaatatacggcatcgcggatgatggtcttaatctttcagggtagagtaaataataaatcctacttgtagtatgtgacaatttgtctttatgaggttgtcgatcccttggccagggaagtattcagacctctgggagcctgtcttattgtgtggtcagatctgtccagtgtaagaaggcatggctttaccagttatgaatcactgtacccttgtaggttagccagaaaacccacaccacattcattcatcatttctaagctcacttaatcatcttatacattaaaaagctagagctgctgtgggtctgtgtcttgccccactactggggtgctgggcagacaagagtggagatgttaggctgattttactctgggctgccactgtcgggtgctggactacagggaagcaccaacacacccctcagggggccggaaaaacacagtctaacatgtgggaggctgaagctggggcttccaagttcccaggtattcagtcgctgttggaaaaccacacagaggagtcgaggacaaaggattagaggtccacgggcctgcaatgaggctgggcctggagcctcccaaattcctggacatccaggcatacatatgtgcaagacatacatacatgtattatctttataaaaattgtaggcatttaaatatagtgacagtaattcattacatcacaggacaatctgggcaagacctccaagagtataacatagtgtttgttgaaggaatgaagcacaagtaagggccattcgttaggcgaagtcaagagatataaatgcagtgctgcaatgggcagagccagcaaaacgcatcaaacggaaacaccactttcgccgtcgtgaggtctccctttcctcgggggtgtgggttctgtggagcaggaaggacagaggaagggtcgtggttgagagagcctcctctagagtcggaacattagtgtgggtccacacgtgctgtcgtgg

SEQ ID NO: 25609 - DNA, 1140 bp, Mus musculus
tcctggcccttcttttcatcaggaggcagtgcagaaaaataacctaaaagtaggagtgctttgtcacgcatgcaggcctttggctggtgtgcattcttcataagtggtatgtaaatgataacgtaagcaatgagaaaaattgagagtggaaccttttatttgtagattctaaattgattctttctgggtatgggtattgctaaagttaatttttctttacatcttttagtacatgaaattagtatgttaattgtttataacaaaatcataaatatttcaggcttcaatcttgatttttatttggcaaaaataaagaatttcgtatacacatttttacatatcaaaaaattaatctgaagaacgtgaaacttgcaagcctcgctgttttcctgtttactaaaacagtgatgggtcacagtggtgtgcagacgccagaccaccacgaagaggggtgtttgctctctggggaccatgtctggacagcttcacatgccacagttttgcagtatgacagctggggacagaagaggtctgtaggaaaacctcgagtctaggtgctttgccaggcggggtggggctttgcgttgtgggttgagtgcacactgtattgttttaaaaagacttttttttttttaagatttatttatatatgtgagtacactgttgctctcttgagacacaccaaaagagggcatcagatcccataacagatggttgtgagccaccatgtgattgctgggaattgaactcaggacctctggaagagcagtcagtgctcttaaccactgagccatctctccagcccccagtggaaaagactttttaagtgggggtgcttaaggggcagtttcaagacagggtttctgtgtacccctggttgtcttggaactcactctgtactgtatgtcaggctgacagacgtcctcctccttctgcctcctgagtgctgcgattaaagacatgggctacgacacttaggaaaagacgtaagtgaaacttaacaagaatatagattattagcatttacttcagttaattatcataaaatcagcatgccgagttaagttaaatggttcttgtgtaaccagaatcttttcttagccattttcctaacaccttttctttctaccagcaaagaaa

SEQ ID NO: 25610 - DNA, 1142 bp, Mus musculus
gttgttctcaaatttatttctaaccttactattaaactcatcatttctgatactatctttccagctcctaagagttcagtttcgctcttaggtgttgtctgtatgccacctccttacaggcaagtccctcaccgggtgagtaaacgccacagcatttctttcctgtcgggtcagtggtgctctttgggaatcattggcaatgagtttctattgtagacagtagcctgaaagaaccggttggaagtttggtacccttggggcgctgactggctgatgcatcttagggtagcctggctgggctctctgagatcagttctgtagatccattcatcttaatgctgttcagtttccctgatcctaggcggatggtggggttctctgagtccttgaggccttttcaagtggctcgtgcacacgtacatatgcacacaccagtctctctggtccactgcttgttaaagagtaaagcatctctgcttctgccaaatacaggaaggccaggtgtgggcatgaaagatctgatggatgtttaacataggaatgttcagtcaggcttgtgtatgggacctgcgcctcccagtcctaattgcctgagttctagagtatacaatcatccacttctcttaatgtccacctattccttgtctccgacttttctcatctgttgccatgatgttaaattcaggtggtatatttacaattcccacatgtatatacctgccttaaacccagactaatcagctgtctccttgaactctctgcttgcctaacaggtgggcatctcaaatatggcatacccacaggggatgtggtcttcttgaagcttctacccaaccaccttcctcgccttgctttttccagaatactctctaaacttacagtctaagagtgaatcattcaggagagagagcagaagtagagtcaccgtaatcataaaaggcttctcctggtaggagacacagttgccatcaacccagatcttagcacattcccgaggtgtacattccatgggctctgttggtagccatgacgattacttcacccactgtggaagtcagtgtggaagtgcctgaaaaacacatagaactgccaggttctcatccggctgcattacacctgagcatataaccaaaggagtgagc

SEQ ID NO: 25611 - DNA, 1171 bp, Mus musculus
gccatagcctcaaactcacaaagatctatttgcctctctgcctctctgcctctgcctcccaagtgctgggattaaaggcatgtgcatcactgctcggcaaatatctccaatttccatatctatcaggcctatattgtagatatcctaaaatatatttaaccattattacattattgtacactttcattgtttccagtgtttcttatcaatttgtaactaatgagcagtttgtaaataaattaactcacatttcggttatataatttggggctctttttgtttgcttgttattcgaggcagggtggctctaacgccctgcctgaaggagactttgatttattgtctgtctccatccatctcttaagtcagggtcacaggtgtacactaccatgtctagcttatcttctggtgtagttttaaaactggaactttactgagtcacaccgtaagaggatatctgtatttccacaatcagtacatcgcctccttttcttcctcctcctcctcctcttcctctccctcttcctcctcctaacctcgtgtgggctcgcacctcagcaacaggtgttctcatggttgccactgccgtagccatgatgcagaagcccagtgtacatgtgaatttcttctgctgagcctgacattttaggcagttctttatatcctcaccattataagctagtgtcccacatagacttactggtatttgcatacttgagaacctccacgtcacatcttaaatacaccttttctagagaacagagggacaggccattgccaggcaatgtttgtttagcatgcaagaaaacttgggtttgctctcacccctcagttgggagcacagaagtattttttctgattccaaattctccttaactgtggatttaattttcataaactcctgctttcattttgtttaaatgtatctaggtggtttgcctacatgtgtgtatgtgtaccatatgcatacagtgcccaagggggccagaagagcaagtcatagctcttgggtctgaagatacagttggttgggagccactataaccactgagccatctctcttcctcataaactactttaaaaattgatagctattagtattaatgaaaccatgaaacaaattattacccaagggatacccatctcaaattgtccctgccttctgaaataa

SEQ ID NO: 25612 - DNA, 1198 bp, Mus musculus
actgtcgaatcctcgcccaaggaatgagtcctgttttaaaattgagccctttcgtttttccagttttgctcattttataaattttcaacactaagcacaattaatatacatgttcattattaaagttggaagtggctcctaagcataatggaagttgacttttgctctgtgtactacgccagcagaactctgcagtgtagtaggcaggcatcctcagctctactgaggtagctgctatcctcagttcacatgactgggtagcatctcactcccatgagttctgaataacccagaaacttcctggttctttggtcttttctttttgttatcaaattacttatcctaaataaagcaaatttaatactgactccctaggtctaagagtctgcacctctcagcattaccaagaatataaagtagaaattaaaaaaaaaaatagtttgtggctacaaagcagtggaagtggatcctgtggcttcagaggaagctgcaggccgccacggttccctcctctgctctgtgcatcggtttactggtgaagagagccagctttgccctccgtggatcgctggtgcatcctgggtgctgtggggagactaatgagctgcaggcctgcctgcaccagcaagtcctcgagctccagacgcactctctttactctttataattaagggcctgaagccattatttcagacttcccctcctcctgccccgttgtgctcacttggctgttttatgggctatttgtgcgtactttctaagcaagcccggagtacacatgcaaaatctgtcagtttaacctctgacaggaaactattcagatttggtaaatacattttaagtgtatgcttttaccagttctaaattaatatgaaggtgttcttccttttttaagtgtaagtattatgtgcagaactatatttatgggaattggtttttagtttgcttaaacccaaagatactcattttcagcttcaagtagaaaaggcctcgtccttacggagggtgggtgttcacatttcagataaatgtgtttcaaaaaaactttgagggactttctattcctcagaactcctcagactttcatttgggactggatgaggggaggattaagttaaaatggtgaagagattaggcctgttcttctcatgtcgttttataggctggtgtttgcagccctgcaagttaaaggacagga

SEQ ID NO: 25613 - DNA, 1525 bp, Mus musculus
gattttttttttttttttggcagaagaaaaggaaaggaagaccggctgggttcagcaaggaaaaaaagggggatgtaactcgtggatacggtttttttcccccacccttccaacatcttgttttactttgtaaacattttctcttttaaacccgggctccatccggtgccctccagacctccgaggtgcgaggaggtggtgtgttttttcattgggggctttgcatattttggttttgggggttttgagagaccctccagacatctcacgaggggtgaagtctactcggtcccctccctcaagtcttcgcgtgcacagaattcgaggagatccggttactaaggatatagaagaaaaaaaataaatcgtgcctgccttttttttttaattgcctgcttctccccacccccaaattaagttgcttagcaagggggaaagaggctttttcctccctttagtagctcagcctaacgtctttcgtttttttttttttttttttgcccccgaggatcttccatgtaggaagccgaggctggcgagcccgacactcgggagccactgtaggggggccttttttgggggaggcgtctaccggggttgcctcggccgcccccagggaagcggcggccgcgttcctccagggcacgccggggcccgaaagccgcgcagggcgcgggccgcgccgggtggggcagccgaagcgcagccccccgatccccggcaggcgcccctgggcccccgcgcgcgccccggcctctgggagactggcgcatgccacggagcgcccctcgggccgccgccgcttctgcccgggcccctgctgttgctgctgtcgcctgcgcctgctgccccaactcggcgcccgacttcttcatggtgtgcggaggtcatgttcgctccttagccggcaaacgacttttctcctcgcctcctcgccccgcatgttcaggaccaaacgatctgcgctcgtccggcgtctctggaggagccgtgcgcccggcggcgaggacgaggaggagggcgtggggggtggcggcggaggaggcgagctgcggggagaaggggcgacggacggccgggcttatggggctggtggcggcggtgcgggcagggctggctgctgcctgggcaaggcagtccgaggtgccaaaggtcaccaccatccccatcccccaacctcgggtgccggggcggccgggggcgccgaggcggatctgaaggcgctcacgcactcggtgctcaagaaactcaaggagcggcagctggagctgctgcttcaggccgtggagtcccgcggcggtacgcgcaccgcgtgcctcctgctgcccggccgcctggactgcaggctgggcccgggggcgcccgccagcgcgcagcccgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaaccc

SEQ ID NO: 25614 - DNA, 2300 bp, Mus musculus
ggaagcaactcttaatttaggctatttctgaggccttatcccgctcgaaacagcaggaccaggttatcaacggtcccagagtctgtgcttctggggacaagtagacactggggctgaggctgcaggctcagatgagacgagaagggaagatgacagcagtaagcctcgtaattaaaggtggattaagatgtcttccctccattagcactgtagaccctacagctagcccaggcttaccctacagctagcccaggcttaccctacagctagcccaggcttaccctacagctagcccaggcttaccctcactccctcttttgtttttatactgcttatggggacactccacatgaatgcaccgtgtacaaatgtgtctatgtatattcgagaaggagaaaaagaacccggtctctgtcaccaccaacggttgtctgccatttttgtcttgcagattcccaacttcttctggagcctggggatcggtcacactggtgcgtggtggcatactgggaggagaagactcgcgtggggaggctctactgtgtccaagagccctccctggatatcttctatgatctacctcaggggaatggcttttgcctcggacagctcaattcggacaacaagagtcagctggtacagaaagtgcggagcaagatcggctgtggcatccagctgacgcgggaagtggatggcgtgtgggtttacaaccgcagcagttaccccatcttcatcaagtccgccacactggacaacccggactccaggacgctgttggtgcacaaagtgttccctggtttctccatcaaggcttttgactatgagaaagcctacagcctgcagcggcccaatgaccacgagttcatgcagcaaccatggacgggtttcaccgtgcagatcagctttgtgaagggctggggccagtgctacacccgccagttcatcagcagctgcccgtgctggctggaggtcatcttcaacagccggtagtcggtcgtgtggtggggagaagaggacagggcggatcgtgagccgagcaggccaccgttcaaactacttgctgctaacctttcccgagtgattgcttttcatgcaaactctttggttggtgttgttattgccattcattgttggttttgttttgttctgttctggtttgtttttttttttttttcctcctcctttctcgtcatccgtgtgtcccgcttgtcttgttctttgagaaattagcttatggtgcggatttttgttgggttgtgtgtgtgtgttttgtttttgttttgaggtggtgggtgtggttggcaggacaccccctccccccatatacgaagacaggaaacgagagtcagcactgccaagcatggtgtgtgaaagtgggcaccaccttccctttggatcagcgtttcggttgtccgtgcgtaggggtgtacccgagcgacagatgggggaagtgcttttttgtgtgtgtgttctttatggatgcccccggctgagaggctcatagtgccaagctgtgtgtctctctagccttttggacacgctcggtggggcagaggcagtacctgggcagactggcagcaggtgccaagctctgctccagcctgccgaagctgccccgccccgccccgcccccgcccccacaggacacgggcctatccacaggcttctgagaagccagcctgctagaaggctgaaccagaaccaattgttttcatccctgtcttactgccgcctgtcacccgctgccattgtcgagtctgtcttttttggccatctgctcctggatctctctcttgagatgggcttcccaagggctgccgggacagccccagtcacagtattgctaccccagtaccctctcaggcccttccaccgggtcccagccgtggtggttttttcatcaggtttctcccagatgtggaaagtcagctcagcaccccatcccccatcctgtgtgctgagctctgtagaccagcgaggggcatcagggagggacctgcgcagtgcccccccttcctgctgagaagggtgtagccccgtcacaacaaaggtaccatcccttggctggctcccagcccttctctcagctcatacgctcgctcgtatgatactttgacactgttcttagctcaatgagcatgtttagaatttaacataagctatttttctaactacaaaggtttaaatgaacaagagaagcattctcattggaaatttagcattgtagtgctttgagagaggaaaggactccttaaaagaaaaaaaaagctgagatttattaaagaaaaatgtattttatg

SEQ ID NO: 25615 - DNA, 1215 bp, Mus musculus
ggggtccccactggaatcctgtgttcctgggcccctgtcctgcagtgcctctgttctgtccactgctagcttccaaagggctggactgactgccttaggacctgccctggctcctgttactggcaaacggggccagaaacgaggctggcaaattacaaccaaatgcaggtcttgttccgagcaactgttgagggaagagcccactgctgactccacagatcttggagcctccttcatgatcccatgccgcatcccaggcaagacccacaagccctacctccaaggctgctggggagagggggaatcattgggtcctgactgggacggtttggtaggcagccagatagacaatgaagttcttcaggctagaaacaaagtcctggtttcttgggaggctctggtcccagggagcaaccacttctataaaggctagggaggaggaggaggccatcagagaggctggtcttactgggatgactggtggctcctccccctcatctctggggagctggaacccacactttgatgacaccccccccagaacatgtgtccaagcccatgcactggacctgggcatacctagaccatggtggaggctctaaaccagtggttctcaacctgtgggtcacgacccctgtaggggactcgaatgaccctttcacaagggtcacacatcagatatcctgtgtatccgatatttacctgacgattcataacggtagcaaaaattgacaattacggagtagcaacaaaaataattttgtggttggggttcaccactgcatgaggaagattaaagggttgcagcatcagggaggttgagaaccactgctctgtaggcctcctggttgaattcaggctgtctcgagtaaggatggtttctcctaactgtcccaagtctagaagagtagaaagcgatcagggtggaggagggagagttcccgagttctctgtggctgtctccaactcaagtgttcaggtcccaagatggggcctctgaagagggctgctgagaaaaaggaataggggtcacggccaccccagctttgatctctttccttttcttctcctccttcctagccttcttttctctgctgcttgctgccttgtctcccatcccagcccttaggctgagcctggagcccagggacacgataagccccacaggaggtgtggagggaagagcagggcaggtggagtagccagagaagacac

SEQ ID NO: 25616 - DNA, 1165 bp, Mus musculus
tggtgtgagatccggaaggtgccaagaggtctgtataggcggggagcagtgagtgaggccttcctctgtgcacacttgttgaatgagttaagttttgcaggagggacattttgacaagcacagaaccacactgctctcatggtcaacttgagtggtgagccatctatctgtctgtctatctatctatgcctttccgcattttgtacaaaaggaaatcagagagccactactagggtccagctacccgctgccttgcagtcacattcgcccaggttttggctgtaccctcttggggaagaaatagggcactctgggcttttctcaattgcaaaaaaaaaaaaaaaaaagtctcacagcactacagcactttgagtgaggaaaaaacatttaaaggaggaaaaattgtgattttagaaggttcagtccatggtcatctggctctgttgtttttgagcctgtggtgagccagaagcatcacggaggaaggggcatgaagaagtaaaactgcttaccctgtggcagccaggaagcaaaaagaataagaaagaggaaggcgccaagatggagacatacatgtgtgtgtgttttcccatgtgccttctcgacttcctcttcacatcctgtgtttgcttaacatgttcttttcagcttactctcttcggataggagatggtactgtgggtaaagcacttgcaaattcaaggactggagttcagattcctcacacccatttcaaagcagatgtggcacagctgtaacccagtgccggggaggcagagatggggttccctggagccagctggttagagctagactagccaagtccgcaagctctaggtctattgagagatcctgcctcagttaacaagatgggaagtaatcaagaaagacacccaacatcaacccctgacctccacatacatactcgcatgcatgtgaacacacatatacgtacatgcacaacacacatatgtacacacacacatgcacacgtgaaaaaaattaacatcataatgctgacatttacaggagatcttccttcttaacagatccttaaatgtaaatatggtggtattttctatatacggaacacagagcagacctccagactcatttatctacccaactgcagcatttatacccactggtgagcaaagagctccca

SEQ ID NO: 25617 - DNA, 1183 bp, Mus musculus
gagagagagagagagagagaaacatttttttttaatctagaaaaaaaatttatggtttcagaggttttggccatcactgagggcagggtgggaaagaacagagcagttcactttgtgaggtacaggagtagagtagtaacagaaactgccaggggcaagatacaacacacatacacacacacacacatacagacagcagtatgtccacacacatgtgagtatgtacacacacacacacaaacacacacagcagtatgtccacacacatgtgaatatgtacacacacacacacacacacacacacacacacggccaccaccacacataggcctctttcctccaacaggcccaaggtgctgccacctcccaacactgtggaatctgactccatctgtgactcagccattcatcgaatcagtgttctcatgatccgtctgcagaaatctcctcccagacacacctggatgtcaggatcttctgcccgtatctaaatcaaatcaatttcaaagggaagaaatgttattccgggaaacagcctgagctggtgtccttaggctaacacctcaagctcggtggaacagacagagtgggggagggacaggcagatagacaaacagatggacagatggacagatggatggatggatgaacagagggaaggggtctactactgaacaggtagtagactgtccaccggctagctctgtacttcttcctgctgctagcttaggcagacttcacttagacttggacacctgcatctgagatagatccaggtagccaggcctctgcaggggctttcgatagatgtttatggtttgtagtctgagggaaactgacattcctgccattagagtgcattccttaaactttctgcatgctctgaggtttgatgggagcatgcacgcacctggcctgactgcacctggccatacagaccgtctgtatgctttagaggaagagggacttccccagagtgcctctccctgtatccataaccccccgccccagaagagagacagaggtggccggctttactcgggaccaagactagacccatcatccagagacacttttaaaaaatctgcgattgacacagctttgtaagaaatagttctgctaaatccactctgcttgtttttatttgatctgatgactgctttaaatggaatttttaaaaaca

SEQ ID NO: 25618 - DNA, 1193 bp, Mus musculus
aagaagccagaactgctgtgtttatctttatactttacaccacctcccccctctgcatggcaactggccaccatacaattatgctaaataaacttgcatacctatttagtccgagatcttgatttgcacccgactctgtttattaccctggcactgtctgcacctctcacatgatacaagagaccgggcactcaattccctgatgcatttcaagcagccccgggcacttacagccctcatctgcgaccttctgggcagagtgcctactggggtctgagcttcctggctgctgtcattgtcctcccactacaggaaacagctgagcagttggctggattgttggatcttgaaataacaccaggtgccactcatttgagctgtcgtttgtgagttgcccaagttccctcctgctttctttgtggccagggaggcagtgtcagtctctaggttttgccaggatactcagggggactagaagtatcacacaaggctttgaatctggcacaggaccagaggccacgtggtgacttcagtctcatgctcttcctgtcacagcgtggagtcacaggtgggccactgttttctagtttcctggtctggagtgtggccgtgctgtgtggtgcatatcactggggctaagcctgtttcttctctggtgcagtgcggctggtctgttgcaccgtggggttggtgcttggagggtattttaggtttatattaccgtaacaaaacatcagagtcaggctcggtttagaaagcaacgaggtttctttacttcatatgtgtagaggtttaaggatgtggtaccatcagcctctagaaagtgtgtgtggtggcagcagggctaccctgggaagtcacaaaaccacacttgagggtcagtctgtggccctctagggacaaggccagaccccagaccaggcaggggggtgagagatgagcagataaaagcatcgagggtgggggtggggatggggtcagttcagatttggggatctgctcaagttatggagcacagtagaacccagcagtgagccaggcaggcagaagggagccaggagggaaggcccagcaggacatgcagaaggggacaggaatatgatccagagacacagacctacccagtaagtcatgaattaggctctcactcccaaaccttggttgacctcaactgtagaatgaaaacagatttt

SEQ ID NO: 25619 - DNA, 1162 bp, Mus musculus
cagaacaagctagcatagccaatcagaccaaccttgccaggtggaggccaagcttttggcactatttgctgtgttcagctggtgccacttcggatgacattaaaacatctcttgcttgtgtggattcaggtgacagggaccccagacctgatttctttttttcattgctcttctctctggcgcatcttcgtaccagtgtctctggttcgaaggagagatagaggcatggaatcgaatgccttgtgtttaggacttcctggagttcgggaagagtccctggagaaggcagttggctggctctcaggagtccaaagtgagctagctgggaacgagctgtggctttcaggtgactgttttcaggtggtctcaatttgaactgctggtcagcaatgaagaaagcctcatttattttgtgagtctgttaagacagagacagacttgtggggtgaatgaaggacacgcccactggccgctccaaactccgccctgtccccagcccccaggcttcctggatgctctttggtgcactttaccttgctatgcataaacctacagtgcattcagacttctggcctagcatccacactgtccactcctgactaagccttggtttcctcgcgcctccgtggttctcttgtctccgacttttgcacaccccaaccccagcaactcagctgtcctgcgacacgctcatggtagtcctttagtttgcaatgtttcattccactcctgtgcaaacccaattcgctctttagaagtcactgtgcctgcttcctactctgagaagtcttcccggattacactcctacatcagtgtggtctgaaaggggagaagagtgcagagcggctgcatgctcggtgctggggagcctttggaaggcctggcaaagaaaggtgtgaggctccagagaagtgtggagattgaggcgggaaaggagaatgggagctctgttgactggcgagagaataacgttcacagagtcaaagagaagcctggaatttcctttcaattatttctggttattggccttgcttccttacagtgacatggagcccctcaatttacctgggctgccagttatgtccccgcagcacatctgtgttcagttatgtccccgcagcacatctgtgtccaggctgtcagcttgcttataaggctatc

SEQ ID NO: 25620 - DNA, 1102 bp, Mus musculus
ctttctatgggttctaggcagacacactccaagatgactgtcatagtttagtgggaacatcttcaagggctctgcagcttgaggccccaatgctaattcttaatgggtcactgtaacctgggtgctggaagagcagatgagctagggaacatggaacagtggcataggaaggccaagcatcttacagtcttctgtggtttgtgacacatgggacatctggtcaacaaggactccctctctggcccctcccccattcctgagaacacccagctgttcaagagttaatagccttttcccccaggtgaccagacagctctgggagggggacctgacagaatcaaccagtcagaacctcccagaaggcagtttacaaaaagggcgtggtgtgggcaagctggggagagggtgccaggccacacctctgtaatggtggctggcccacccccaagtggggatggcattgagtcagactgtgaagtgagtgtttgctgatggagagaggaggcagtgggggtgctccttcctcagacttcatgaccccacccaggccaggtctcatgacccccagaatctgcagctctgtgcttatacttaagggctggtacttcctggctcgagtgtgtgtgtgtgtgtgtgtgtgtgtgtgtgtgtgtgtggtttgagtgatcactgtacagtgtttgatttggttaagttacaatcacgaccctttaaggagaaaacatataattctagtaattttattgggctcaggtttcaggcaaatggaaacaaaattgcctctaaaaataaaacacagacacagagaattgaataaaacaacaataataaaaagcctcccttgcctgaagataagtggtaaggcttttttttttttttttttttgaaatattagagaaaaggaggaggatagggggagggaaaaaataaaacactccaccgcccttgctttcgtttccgttttacctttcctaaagggttgatttgcgtattctaaagaaacgcagggaaagccactggagcaattggtccttgtcccgcgttcaacagtacaggtggacgaaaggggctggctgccaaatacttctggttggagggaggg

SEQ ID NO: 25621 - DNA, 1123 bp, Mus musculus
gtacatctgtatgcatgtttgtgtgtgtgtctgtgtgtgtgtgtttgtgtgactgtgtgattgtgtgtgtatgtatatatgcatgtgtgtgtgcatgtctgtgactgtgtgattgtgtgtgtatgtatacatgcatgcgtgtgtgcaggtccttttcctagaatggtactaggaccggccttttgaaagacacttgtcaagtcttcggctagcaggctaaaggagaccagataattttaggtgaaatgtgttcagaaatagctcttgggggacaccactagtcttttattatattatccttggatgatgaatgatattggtactactgggagaatggagccctgggacctgtcctagtggttgggggaagactgcgggatggagtggcaaacagcttccttatcacggcagctgattcagaggaaccatccagtcatacctgacctctcttcctaccctaccctgcagaagcacttaggtgggaatgccttatgggtttaatgttaggaagcccagtaaatttaccaaccatgaccagtctctcagctgaatcagttactctgaaagctctcctgagctagggcagatgggtaggcaggcatggggctttacgaaggtgttgagaggaagtgacactaagaactggctacgtctaaggccggtatggaagcccacttaaatgctgtatacgagatgggctccttcgggctagctctaggtgtggattgctaaagagagagcctacagggaaggtagagccctggagatgtgtgcctttaatacttctcgttgcacccatagtgtttacttagtaagcacctccttggtggcaggcacagggataaattatgtgaaaggtgagacagcaaatctgatttaattttctttggagaacacagatacctcgtcctaaaaaccatctattcttggcaacagtcctaagcaaaggaaattgttacaaaccccattttactgacgaggcagctgagaaagtgtaaccgggtgttttggggatgcaaaggaaaataaggcctcactgaaggggcttgggcaaaacagaatgctaccggctatggaaagcaatgagccaatcaatccatcaagggccgactcagctaccagg

SEQ ID NO: 25622 - DNA, 1159 bp, Mus musculus
tatgacaagagtcccctggaaggtagaagtttagcacccccagcgttactggggagactgtctctcttgctggagtgggtttcatcgcctccatgtggacatcagcatgttagcttctgtgagacatgtggctgaactaaacaggaaggacaggatcagagaaagataggctaggccttcctggctttcaaatccccacaggtagctccaggaatcccagatcctgcctcacttctgacaggccactgccatatctagacatcccctggaaaggagagtcatcattggctcacccccacactccctcagtgttcaaaccccttttgctaacacttgagggatggatggggctaacagccaccacctgcctggctccccccacccccacccctccaaatgtcacagaacctagtcatccaggcctcagctctttgctccttgagttgaggtttctccaggcctgggcgttgctggtgacacccttctacagggtttaagcccctgatccccctttccatatttgaccacaggtctcccgtggaaggaggtagagtcctttgggttgtgatgggctgtgttgcgagtcacactcgggctggttctgggttgggaactttgctggcccacgctttcttgaatttgtatttggtttctcgagatcccaggaagaagaatccacctgcttgcaaggcctgggcctggagtctcagagccccaagctgtgcgggtccacgagactcagctcttcctagatcaactgccttggcttcttcatgtgcaaacgcaaacgcaaaactgccagagaagacagtagacgctatccctcctgaagctcccaagggagcccctgcctgccagtgccaccagatgacagtccaccagggaggatcttcctcagatctccgtcctcatcagtcacctgctgggcagctgcctcttaaattcctgtctgcagtccagacagtcgccaatatgcacactttaccccagcagccaagcggctgtagctgcaccagactcagaaccaacagagggacccaggggagggcatccggtgtcaggcttctgtttttatttgtaaaggtaatgacttcttataaactcactttttcagatgactggctagttctttttgtcgtttgttattattttttttttc

SEQ ID NO: 25623 - DNA, 1203 bp, Mus musculus
accctcagaaaacaaacggtggggttatcttaacaatgatgaaagatacattgtttaaatctcagatctcagtaaagagatcccatttgcttgtagactcatgacacaatcagtgtatttaaaatgaaattaccagtccttatttgacagtgcagctggtatgctggtgttcgggcactggtgaaaatcataagaaatcaattaccgccaataaagctttccatatacctcatccctaaactacacccagcactgagggttaacttgaaaatctgtctcttcttcatttgggtctccccatgaaattccagagacccgggaagtacctccatgaagtcagagtcccacacctaatgctactctaaaggaaggtagttcaggcctgtcttggcagtgaactaccaagaaatgattttccaagacttcttagaacctctgtatactaaccacctatgtgttcattggctagcttctgagtcttagagtggaccccaggtttcacaaatgctagagatgtaggatcccttgggaaaaggggtgttttttggtttgctattttgggatggaaggtaaggatttgtaccttttttctgtcttgaagtaatttttaaacaaccaaatacgcaacataagaacagatacaaagctttagcgtgttggaaaacgctctgattagtgtacaacttccaaaccagctgttacccttcctctctctggctttaaggttcctggctggttgcagtggtaaacactaagtaactttatgtttctaaggctgtattaaattgtgcccttcacagtgttgtgtcatagggggttggctttggggagctgagaagaaacctgccttgaagggccagtgcctagctggttgcacatttgtccttgcctctgtagggtggtggattattggcttatagaggtagtttacagagactggtttaaatcacgagaataactaaccaacccctggcctctgaaccatgtatgtacatataccgatccagcctatttcttggtaaaatgcagaattcaaattgggcacacattagaccagctttaccttcgacttcatttacgcttttattgactctgacataaggtgtgagtatttgactttctttgttggtggcagtgatctgtaacactcagcactttctaggtgagctaaaccaagaaaatccacagtgactggctaaggct

SEQ ID NO: 25624 - DNA, 1303 bp, Mus musculus
atgtacacagacgttcttttctctgcacgtgtcaagggaaggtgaccagtcccagccatgcctgggacaagggtcccagatatgcaatgctaagtgccaaccaaagtgagtcctaggggtcctgggaggagttgtccccttaggtgtcctcaggacttattctcatactgatgtcatcctagctgataactgtgttgggttatgccatggctgtcaatatttttaggactcaacccctgtattctgtattcattactgtggatgcaacctaagatttacaataaataacacaaagaacaatggagttgagtatggaatgaaaagaggcaacgagctagggatgatctgtgtaggtgtaagtacactttgtgtccttaggagttcttgtaacagaaaccgtgtgaaactatagatgtcttctcctataagggaaaacatggtgtttgatgctttggtctctatttcccagtctgtcctgcttaagaagccagaatgtggtttctatttggtggatgctgtcttaaaattactaaatgtgtcatccggaagcaggtaaaggagtcagtatccctgtggagttctgtcctactctcacggtgcttaccagctaagctgagctcaggagccaagggaaaccctgctcctgctctctggtggtcctcagtggctgatgcagtgcactgtgatggagatactaaaacaagtgtgttatttgtaagtcttctctcagtgattgtcagacaactgtggtgtgtgtgtgtgtgtgtgtgtgtgtgtgtgtgtgtgtgtgagaaacagtgagctgaggctttattatagctgatttccagttaaaattgtgaaatacgtatttcttgtccacaccaaatatttcagtctatttaatgtattaaagaaatagttctgcttaagaaaatgttgcttaaatgttctgtgatttctggtgcatttttatacagatctgtgtgtgtctgtgcattcactttctgcctttgctctctgtgttaactgtcctgttgccctcggaaggtggacactattcgtagcattaaaaagaaatatttgagttatttaccatgtcattatgggatccagtttgttttgatttgggtataaggtggtctttctgagatgattacattttggtatctactgtctaaattatgtgaatgcaaaaagaaaaagggattttgtatatgtgcaggtatattcttaagtctttttttttttttttttttttttgatgtggcacacacggactttgcctatgcctttctcagacataggcataggccctccttac

SEQ ID NO: 25625 - DNA, 1234 bp, Mus musculus
acaataaaaccagagtttctatctatctgatttttttttttttttaattgtagttgcacttgtagatcagattatcagaggcaggagcactcccggattggagcatacttgttttagctaaaataggtaaaggctaggaaagggcacaaaactgctgcctttgtgtcactccatacgacaccctgttacagctcagggatggatttagatataatctgagagtatataacttcctatataaacttaagagtttttttaaagtaacagttacatctagttgacaaattggtatttgggtaatttattttgaactctttggttacctcgtttctgctataaagaaatttgtaggtaactctacggggcaatgccgtgatttcagagagaattctaattctggaaaccagttgtttgggaactgtggtttttacgatattatttattagttgacctgaacagtgagagcagactgcttacatattttcctttgtaggaagtcttgcctgttttacaaggatttgttttataaaaatcagtgtaactgttagttggcaaaatcagcccatacagtcagactagcctgctcccgtgactgtctgttaggaagcctttgccttccttaggttgtgcttccattcctcggcggagtggcatgctgtaggtatgattcttaattctgtctgtaggtaggttgttgattctaagtagctttcgtttgttcgtctgtcttatgtcttagaccagctttgtggtgttcttggctcatctcataatactgttgttcagtttatatcagaagagttaaactgtgcaaatattgtatgaaatgtttcagttaccataatttaaaggggtgggatggcatctttctgtatagaaaacttttataaataaagttgacttttcatattaagcgtctgatttatgcctttatatagacctggcattatgagtttgttgatccctcttttattcttcactgtaaaattgctgagtagaaatttaatgaatgttaatattcataatctatttgtttcttcagtgaattaactgaattgttgacataaatcaagagaatccttgcgtaacttttaagttactgctaactggggcaggtattgaagatctcctggtaatgtctcaattggagagagtgggtctttccttcagtcttcagggctgtcagcggtaccaaaaaagtgtccttgaatccttggcccctcccctgtgagga

SEQ ID NO: 25626 - DNA, 1149 bp, Mus musculus
cccagatacctctgttggttgcagaagagctgagaatagaattggtaccctcgggcggactctggcccgggggctgaaggaaaaagggcaggaggagagagctctgggtggttaccttggggaggagagattctggctagctcaggcggcttgggttggtggtcgtggctggagcacaaggaaattttctggtgggaggttagacacgcagcttgttagatatatctactttgttgctccagcatggcggatcctgataagaggtagtcaatggtttgttttcaggtgtttattgtagaaaggcagagagtagagaagcagagggcggcatggccacgtggagagagaggggaagagagaggtgagagtaagagcaagagaataaaaggtaagagagagagagcgaggaggggacaagcagctccttttatagtggtctgggctaccttgctgttgtcaggtagtagtggggaggtaactaggagtggctacccagacagaataccagggacttggggcattgcctatgtgactgatggccacacacctctctgcagggggctgtggggggctgtagctgtgacaggagccaggggcccaggaggtgtggctgaactcctaatgtcccatgaaggcagaagtcaccacctaccaggtctccggggttccaggcttgtgctctactggagaccaggctgtctgtgcacagttcaccaccccacattttgaggtttcaaacccttggtctctcagcctgtgatcaggatgtagctctcaactattgctccagcactgctgcatgccaccaggctccctgccatgatcatggactgagtgttcaaaagtgtaagcaaggccccactcaaatgccttctcttatagttgttgtcttggctatggtgtctctacagcaatatctcactgaccaagacaggagttggtactgggactgaagtattgctgtgacaggccagaccatgttgctagttggtagagtgtggactttgggaatttagattaggaaagaagttgagctgtttaagtggggcttaatgggccattctagaaggagcatggaagacagtggtggttctaagagcaatatagattatgaccagcccaactcaagaggcttcagaggggaagaat

SEQ ID NO: 25627 - DNA, 1140 bp, Mus musculus
ctcgcatagggcctaccattttctctcctgtttcaggaaagattgattttatggttacatgttgtatcccttatcagtttatacaggtagcataactgacaagggcaattgaaccgtatccatcctaagtgtttagtggagctcctgagatagcctgagcctcactcactacagtaaatttttacctgcagtattaccttaacttttgcacattaaacagatgtatatttcctctcaaaaggagatgtagctttttttggttggtgaaaacctcctaggtgtattagacttttagaaatgtcactggtttaagggaagaattgaccttaatcataaagggtggaagaaaggacatcagtactcaaattgaagtggaaccaggcaggaccttagaagcagtccctttcagatgtctctgttttgttttgtggcaagcttcattttctcatctctaaatcaacttggtttggcctctccttgtgcttggtaaaagatagtattgttggtttccccagtcatatagtaagtgaccagcagagacttaacccgagtttccagaggaaaggtaggaaggcggagttcagcagaattaaactctgttttgcttagggcagacccatgttagcttgtattttaaaaactttatctcagtccacagtgcagaaagtgatggtggtacatactcattttaatatcaccgaatacatgccagactcgcttcacatacttgacatatacattgtattctcctaattctatgaagacaacaaacacacataaactttcacctatattatcctttgagaggagaaatgctaaaattttaaacactagttatctgattttagaatcttgagttcatgtttgatttcattgttcaggtgtcctcggaactaggtgggattcctaatttttctatttatgggataaattaaatgataaataccatccttttgtatcataaaagtggaagaaaaacagagcccctctaaaaaacccaaccccccaaaaaaacaaacaagcaagcaaaccaaaccgaaacaacaaaacccaaaaactataatctgaaagaaagagaaggggaagaaatatccaggacactcagaatgatggtttctggcacagactatattcagatga

SEQ ID NO: 25628 - DNA, 1195 bp, Mus musculus
tgttaagcaatataatgacttggttattttcatttgtatataaagagttaggattatatgttaagttggtgggtagattgtgttgactattttcagttgtcagtttgactatatctggaaatgaactacaatccagaaatcaagggcatacctgatcttgagcttggaagacccacccagggttttgatgaggatcatgaggtgaaattcacaagctttaattcagatcttgaggcttagtaaccatgcttattaaaatctataatgaaaaggaattgaagaaaagctcagacccatgtgtggttgcacacacctttaatcacagcacttaagagacaggcattaagatttctgagttcaaggccagcctgatctatagagcaagttctagaacagtcaagcataggcatcaaaggaaaccatggaaaacacaaagttggtgaagatataattgaacaagaggcccatattccaggctcagcaaacacagaacttggcagtttcggccacgtaattctggctttagagtcaagaagatctttccacagctaaggaaagttgctgagaccagatgtgtggcaggggtgtcccttcatggaggcccagagaagccattgtgtgaagctgagaaagtgaagcctggatcgccttggatacctccagatgttggagatgccagaatcgtggtacacttgtcaaggagagctgctaacaggcagtataaccagcccaagagagagaagtgtattgaaatgaacaaagctgaaaggagatggaaatctgaagagcattttgacatcaggcatggagtttggagtttgcccagctggttttcagtcttactttccttcagtatttgtttaggaatagtaatgttatagcctgtgtcatgatatgttggaagtatgggatctgcttttttatttttattttatagggggttacagttaaaagattgcataaatctccggagatttgaactcttaaaccttgttgagactgtgatagactatgaggactttcaaagttgaactaaatgcattttgcattatgatgtggttacaagcctatggggcctagggagtgaaatgtggtggtttgaatagattcatttgtttgaataaggaatggcaggcactattaggtctggtactgttggaggaagtgtgtcactgtggaggtgggctttgaagtt

SEQ ID NO: 25629 - DNA, 1256 bp, Mus musculus
aaagagataatttccagttgtcaatgaatcatgatattcttggctataagtaggtactttttgtatgttccctctagtaaacatgaagaacttttctgactatgatgtggcaggttcctgacatcatctgaacactttccttttttcttagcagttttgcttttgtttctgtgggtttgatagatcgattctctctctctctctctctctctctctctctctctctctctctctctctctctcacatacacacacacacacacacacacacacacacacacacacacacacacacacactgcctccctctgtctctggttttttcgagatattggctgtcctggaactcatagagatctgctgcctcttccttttgagtgtgccaattcggctggtttgatgtctgctttttttatttagttttaaattgagataatatacatacacaaagtcacactagtatcatcactgtctaattcaggaacagttttcttattccaaaaaaggtcctatattcagtagtcactccgtataattcatctgttccatagcatctactagtctactttctgtctgtgggtttgcctgtcatgagcatttcttatcgatggaatcacacaacactggccttttatgtctgactcattttcatttagcataatgtcctccagattcatttgtgttgtagtgagtaccagtgatctatgcctttgtgttctgttctgtgaatgtattggctggtgttgagttatttctacttattggctagtaccagtgttcatctacatgagcataagttttatttgggcataggttttcagttctcttgagtggacatttaggaatggaattgatacataatcatctatggttaactttatttatttaacagaacatcttatgtttgagctcaggctggtctcaaactctctgtgacgacaaggctagtcatgaactagtcatgagctcctggaactcctgcctctaattcctgagtattgggaaggtccaccacttttgacttttctttcctttcccctcagatatggaattacactcaagcatcacccaacatcacactctgataaatatattgacatggaatttcagttttgtgtaattatcatagggtgttgttttgggtatatctttatcttcctttttaaaagtctgttttatttatgtgtatgtgtgttttacctgcatgtatgtctgaacccatagacagtagaagatggcattggagcctctggaag

SEQ ID NO: 25630 - DNA, 1187 bp, Mus musculus
taacttttacatctttgtcaaatattatttgggcatatttgtataggtctgtttcttttttttttttttttttttttaaagatttatttattacatataagtacactgtagctgtcttcagacactccagaagagggagtcagatcttgttgtagatggttgtgagccaccatgtggttgctgggatttgaactctggacctttggaagagcagtcgggtgctcttacccactgagccatctcaccagccctataggtctgtttctatttctgtggtttctgttatcttccattgaactacctacctgcctgtcacctgatatctgttgtgatataacacaatctttttttttttttttttttttttttttggtttttcgagacagggtttctctgtattgccctggctgtcctggaactcactctgtagaccaggctggccttgaactcagaaatccacctgcctctgcctcccaagtgctgggattaaaggcattcaccaccacgcccggcttgatataacacaatctagaatcttgattattgaagttgtattgtgaagctgggatagattgatttcctctccgtttgtggtttggtgctgagagttgattgaataccttgcccatgcaacgcaaccactctcatcactgagctacatagccctctgttcttttaaaagaaagattaaaacagttcttcgagttcttttgtcttttctatgtacagtttagaagaatatcagcatgagtctacaaaatgtcctgctgagatttagttaactatttaacatctattataatttaggggaagatggttgagaaaaaaaacctacacgaagaatacatttgttcttggatttttttcctctagtttttgtagcttttaacatataaactcagtatgcttattatatttttacatataattttaattttttgagagtgttttatataaagctgtggggtgcttttttgttctggtttgtttgtcactacccttgttcactgttagtttttagagatgcaattttagtatttcatttttagcctattcagccttttattttcttggattactctaccaaatagaactttcaacacatattgagcataatcacttgtcttagttactattctgttgcttgggggaaacatcatgaccaaggcagtttacacaaggaagca

SEQ ID NO: 25631 - DNA, 1205 bp, Mus musculus
acttgtttgtttaattagtgacagttttgtagcatgctgttgtatattagggaagtcttagttttgaaaacattttcattaaagagttggtagtgaagaagcaaatagggatttgtattagcataatctgacagtaaagtggttagtatacgaaccaagactagtttctaaaatgaagaggagagcaaaatttgatttaataacataactgaaatggaagttccaagaggagatagcttctgaatattatagtctatgtgttatggtatgtgtaatattaccatcagaaaaaaatctgattttacaatattttaggtaggatttttaaaaaacatacttgacaataacttatctttttccctctccctttttagaatatggtttctagttttagggtttctgagttacaagtgttactgggctttgctggacggaataaaagtgggcgcaagcatgacctcctgatgagggcgttgcatttattgaagagtggctgcagccctgcggttcagattaaaattcgagaattatatagacgccgatacccacggacacttgaaggactttgtgatctttccacaatcaaatcatcggttttcagcttggatggtagctcatcacccgtagaacctgacttgcctgtggctgggatccactcgttgccttcgacttcaattacacctcattcaccgtcatctcctgttggttctgtactgctgcaagacactaagcccacctttgagatgcagcagccgtctccgcccattcctcctgtccatcctgatgtgcagttaaaaaacctgcctttctatgatgtccttgatgttctcatcaagcccacgagtttaggtgagtattaagagaaattactttttaattaaaaattttttagaagcaaataaaataaccttcaactactactgatttgttattaatatcttaacattgaaagccaggattggcaagatggctcagagggtaataaagatgttttcagctggacgtggtggcgcacgcctttaatcccagcactcgggaaggcagaggcaggtgtatttctgagttcgaggccagcctggtctacaaagtgagttccaggacagccagggctacacagagaaaccctgtctcgaaaaaccaaaaaaaaaaaaaaaaaaaaagaccggggagaacctgttcctggagcagactctgctcttgcacac

SEQ ID NO: 25632 - DNA, 2372 bp, Mus musculus
gtacatagttttgtttcaaacttgatatattggtagccaaggatggctttttactcttaggactgcaggcctatatgatcctgcctagctagcaagtcgggtttataatgatagttgcaaaggtcaagcaataggaattaatcagcctgaattctttaacatcaaccatctttaatgagattttaatgatttgctaatggggtgcctattaggttttcatatttttgtgtatttaactcaatctttttggcatgggagaaatggaataggtatacattaattaggtgttactgtagggatgtgcaatagggaataactagggcatagttcattcaaatcaaaataaaaccattttcattgtcagacatctgagattcctgatttagctctataggccttcacttctccagctctgtcctctacagcacatacaacttgtttcataaactcagacctctccactgcacactgcctgctgtgcttgacagttgttgcatggcgctagcatctccaaaatgctgaacttttccattgcaattgggctgtgccttcaacagcctagctccctttcagtaactccaaccatgccacatggtgcccaacctcagctgctctctgtggcaccttcttgcctccagtactacctgggtagttcaactgcaagcatgagatatagtcttaactctcctggacaaaaagctgatcctgagaaaatattgccagattttcaatcctcggtgatgctggtatcttcttaatcactgttgatttctcagctttagccagccagcatctattgttccaggaaagcaaaggtttcattgcttgggtgcagaactctggccaatcatcactgatttttttttagtccaactgaggcaagatttttaattcctcaaattgaatggccctgattaagtcttttaggtactttgagactttcctctgaaacttcacaagccaggcctgcatcacctatattgcaaatgttcctatcttctgagcttctacacaagcagcagccactgaaactctgagtaggcaatggcttttccagcccagagttcagatgtctccataattcttcagtgacacacggcctggtctgctctgtcacagcaataacacagtaagaaaacaccatgactaaaagtagcttgggaagatagggtttgtttcagcttgcagttctctaatacagtccattgttggaaatcacaacagaaaactcaaggtaggaactgaagcggaatccatggaggagtactgcttactgacttatggtccacgggataagccatgagtaacatcttgctttcttataaaacccaggatcacttgcccagggatggcgttgcccacagtggacttgtccatcccatatcaattgttagtgaagaaaatggccagtgtgatggatgcttgggtgaggttctctcctcccagatcaccctagtttgtgtgaagtggacagaaactaaccagcacaccaggtttatgtattttcataagtatattgtattccctagacatcctaccctggtcagttttcatctaagacgtctgaatcctgaccttatcacctactttttggcattgtcctaagtggcagtacagtcatgcatatatactgaagacaactttgttttctacatttccagtatctcttgttttttataaatgatgtggaatagcagctaggcagtttttagtgtcttcatgtaagggtaaaaactagttttagaaggacccttgagcctaactggattctgattacttaagactttgacattaagtcaagatgatagaaatgtctatttgttaagcaggtatgatagcacgtgttgcagccatggagatgatgtctagatgccctcattaccatcctagttctgccttggcacagtggttcttgggtttctaaggaagttgaactttccctttcctctttttcccttctccatgatcctctcttttgtccctacctccttacccacccctcagccccccttggttcttttgtttgtttggtgaagaattgaccttgaatctttctgatgtctctgcctctcagaccctgctagtgctaggattgcagactttttcaccaagtctagtttggtgtggtgttgcgggttgaagccaaggcctcatccatgccaggcatgctgtctccctgcagtggattgtgcagtcttcatcctcatacttgttgagtttggtgttgattggcaggtgtgggaggccaacttgaatattttgctctctttctgaatctcattacttgttactaagatattcattcccaatataaacagtccataatgttgcttagttccttaaatatgtgaaaatatttatcttacaaagta

SEQ ID NO: 25633 - DNA, 1136 bp, Mus musculus
attttaatttaatacatttcccttctgctttctggaagttgattttgatctgcagtttatttctattcttgctcttcttaagattgtaagcacaatgcttatgctttggataaaatccatacttttaaaagtaagtggtagttatattacccatgcctatggagtcttgcctcttgaatttagttttatttgaataaaatgtagtggaaaagagtagactaaaaataatataccctgaaaatatcttaacacacacagagggacatttaagactagcatatgtttgttttatgtataatttgtgattttgtattttcatcttcttcgtgaaactagctaaccccagtgagaacacattgatcacatagtcattgtgtgcaaggactctactaaggatagcagtgagggctcactgttcaggacaaaattctcagcagccatctgttgttgtaacctttgctaagttgttgggtaaatgaccatcatcttcatgtgtgttagaaacagatatttctaaaggattgacttaagactctcaattaaaaggcttggaaaaaagttagtgaatatttctttttactaaagtaactatttagcagtaattcagaaaaaaactatgaatcactaatcctactaagttttcaaattatgagaatttgaatgcttttttaatgtgggagaatgtatattctgattttgagtataaatgaaagatttttttactttgtattgttttgttttttgtgtgttgtgtgtcttaaatgtgcctgaacattttataaaattaactttaacttatagagatcgtacttatatttaaggctgataaatggccaatataaaccaatattctggtttttaaatattgaaaaacttttagcagttgataaatagagcagagacagttactctcagaaaaattctaaatattaaaagttttgtagcaattagatacctaagcagtttagattttacttctgttttactgtaatgcactttttggtaattagtggttaggtatatagtttttatgtaagtagtcataatgtgcagttttggtattgatgatttaataattttatagtaatactaaagtagaacaccaagaatggagagaagacagttttcatagattc

SEQ ID NO: 25634 - DNA, 1106 bp, Mus musculus
atccacaacggtggcttgtgggacagttgatttcagtttctacgttactggatggattctacacaccagttaatcttttgttacaataaacagcaataaagttatgtaaatagttaacttttctaattaaagatgtaatcactgatatagactaacaacaacttctgtttaatccagtatgaaggaaaaatagaagaagtcttatttcctgaatgaatactttctatggagatttgttctattttgttgaagtaatgaagtgtcaataactggccagaatttgggttctacttttcttctttaggttttctgttcttcatgatcccatcaaagcaaataatctttgtactgtgcatttttctcttgtcgtttacgctttgatgttgtttgctgatatgtgcagagtaaagtgctgggacttggttgctctttataattatgtttaagaatactacacagatgttctgatataaagtgttattttattttgggttactatacattcttgtagaattttctgcagacttgagactttttttttcccccagaaagtcacatcctttgagtgaaatatgcttgagttaagttgtggctagaatactggtaggattttcttcacagtgttcaaaaatatttaatgttggaaaacatcagaacatacttagaggtggaaataactgaattcttcctaagaatttaattgatttcatatattttacaggataatgtagtatactatcttggttggaattcttcccattttaatggcactaatacataaattatatttaagatctctgatcataattctcatcaatataatttcagcagtgactttcaagtttaaagaaaagtcagtggtaaatgacagagggtggtactaaatctcattttcctaattttttttttaaaagaaatcttttgtgagcacacacacacaccaaatatttgaaatgaattgagcaaaagtgcccaaagtcccactttaaaacacacctctcacgtggcagtgctgggcgtatttaccacttgcttcatttaggttccttaatttttagtttcctaaatttattattttcctgatgcctagtgatctctacttttgc

SEQ ID NO: 25635 - DNA, 1164 bp, Mus musculus
gctttcagttgctcgtgtttgatgatcttcccttttgatagggctttcgagccatcaaagatatggaaagcaaagcaaacccctgcgatcacagtggttactgcattgtggcccctggcttgcttgaccttagccagcccaggtaaaggtttcttcccctaggatgttctgctattgctgctttacatacagagccagtttctgttacccacgtaaccaggaaaaataacctggcttctgtagtgtggtgtgttataaagaagtgatgcagttgccatcattctgtttacccaggagagtctcgaggactcctcactaggggtcactgaagtcccatgagtactgaaggttgcagtgcttccttagctctcgtaacatgcctctgcttttgtcgttgtcctgcatctgtcactttgcatgtcaacagttcatgaaattacaaacgaagtcactttagttgactagcatattaaagttgggattgctttgcagctgtctctgaaggcataccaagtattttctttctgcacttggctctgtatttacatggttgttgcaaagctcttctttccttaatgtcacgttttatgaagatcctgataagcagagtctctgtaatgcagatttctgtttaactagatagactagaattaagagatcttccacctcgccattatctgagatatctacacccaaggagtggtggctaatgctgtagtcacttggccaacctgcattttcatccccaccccacctcctttttaaaaaaatacacatagacctatgaacgggctttcttgctttacttaacgttaggcagtatagctgctgcacagctctcactagctagcttaatacttgatatctgttctgagacaattgtaaaggcaaatgaaataggtcagataagtttagtttgttctagaacactaatgaaaacatgatcataggtaagggatagtgattgtaatccgttggtcctaaccttttacatcacacaagcttccattagaggagtagtagtgaatttgaagggaaggtgttgaatttaaacagtcatgttgaatgaagttaagtcaatagacttaaaatattgacctaatgtgtcttcaatcagtcctggacactcacctttgacttttgcgaataaagatattcattagt

SEQ ID NO: 25636 - DNA, 1163 bp, Mus musculus
caagttggtgaaattccaggtgagaaacaaaaagccttagccttttgtccactgatacagttgtgtcaatatttgaagggttttttgttttggggggttttttgggtttttttttcttctttagctggactctagcctggaagtaccaaagtctaatggcctgcagtcagtgatgaggctgggctcaagtaaggactcagacatctatctgaccggctgggtctgtgacaccatggaaagctgcaggaccattgagctgtatccctgtatccctgtatccctgtatccctgtatccctgtatccctgtatccctgtatccctgtatccctgtatccctgtatccctgtatccctgtatccctgtatccctgtatccctgtatccctgtatccctgtatccctgtatccctgtatccctgtatccctgtatccctgtatccctgtatccctgtatccctggacccctggatccctgtacccctgtatccctgtatccctgtacccctgtacccctgtatccctgtacccctgtatcccaatacccccgtacccctatagccctgtatccctatatccctgtacccctgcatccctgcatccctgtatccctgtatccctgtatccctgcatccctgcatccctgcatccctgcatccctgcatccctgcatccctgcatccctgcatccctgcatccctgcatccctgcatccctgcatccctgtacctgtgcttccttagtcagggtctcccaaaagcttttctcccaacagtgccgctgccctggacttctgtgtagccaaagcaggaattaagatgcagagctggaagtagagaagtgtcaaggacaggagaaagagagaaggaagagatggcagcttgttacagattgaccctgacagactctgtcagcaactcaggatgcatacagtgtgaggagaatctgtgaatttaccccagaggaaaagacagggcagagagcaatgagcagacaattcccatatgtgtacacacacacacacacacacacacacatacacacacaccagagagagagagagaacattctactatcataacatttctcataactttatgtaagcctcaagtacatataatagaatttggcaaagaccaaaatgaaaacttgtcactaaacatgaa

SEQ ID NO: 25637 - DNA, 1199 bp, Mus musculus
tgtgggcacaacatgaggcctcccagatctatcccaagggaaggataacggtaagattttgtggcagtgaataaagaccttgaacggagacacctaaaatgtaaaacaccaggtctggtgaaatggaggggtagatgggtagcaaggaaacttctagcagagaggagagcctagaaaaggcacaggcaggatgacaggttgtgaggcattgctggagagcaacactctgggcttggaactgtaactgattttcccaagttagaggtggtccacatctcaggaacctagggaatgggtgggtgggattgttaggaggggccttgtggataaaagtacgcccagatcaacagaagtatcaacagtttaattgagagagtttggtaatggtttcattaggtcttgacaggtcctctaagcaatgcaaagcaagcagggcagactgaagatggcaagaaattcggctatgtgtggtacatggtggagccgggcttgccctatcccaagagcagcacaccaacacttatgaaatacaccaataccagcgtggaagcacgagaccccctactgccatagagatagtagagcacttgtcagagggaggtggcagagagggatgtggtgtggactctgagctgaggatcctctccacgttgtgatggggtaggaggggccgagagaaaagagcagcaggacaggcagacagatagacagacagacagacagacagacagacagacagacagacagacagacagactggggtgggggaaccaaggtgtgaggatctgagagctcctagtctcttggtgtctgtaaagtggtggaaagaattatctactttccacagggtcaaggtcctccaatacttcttcctgatgtttttctgcacttgaccctggatttttttggaactggggggaaaaaaaaacaacccaaaccatacatgttttagcacataggtgctcggatgagttctctgaggggtgtggttcgtaataatttaattagcccagcttttttcggaaaaaaagtgttaattagtttttgcttaaaatataccatcttgataacctctccttctccacttgtttcccctgagtgaagccccaattttccatccacaccctgcagcaagtcccaacctgggtaccactgttattattacaaggaaagaaagttaaaaaaatagcttgtacagt

SEQ ID NO: 25638 - DNA, 1772 bp, Mus musculus
tctctcctctctcctctctctctcctctctctctctctctctctctctctctctctctctctctctcgggagagatgaaaagggaaagggtgaaaggaagacaaggagaggaatggggaacatggggaacagagagagtcagttaggaatcaccttagaggtctgctcatagcagcggcccacagagtcctctctatacaacatcctgcagatgcaaagactagctagatatgtccttgggtttgcaacatggactctctcaaggttaggtggtcagtcctagagaaggagcggatggcatagaagacccagaccatggtgtggggatttctcccacccctaatcttgtctggagcctttgtggttaggataccagtcattgacaagaacttggggagcagcagaattatatcctgctttctccccagcaccccctcccctttgcctatgtttcacggaggctgcagacagagagggcctgctgtggacttagagggctctgagtccagtttcattagctgtgtgagcaacggcaagggaccttaaggaagtggaccctggattaagcccggaacactggcatgctgaccttcctctctccttctcctcctaactcagccctcctcctcctcctaactcaaccctcctccttctcggctcttgacatcactgcctttgcctggtgggtagctccaccttccacgggaagccccatgggtttgcatagctctggcacggaggagagaaacccaagagctggggttgccacaccacctacccgtgtggctagaccacgtgtgacccctcagctccatccccgggacggggtgtcttgcttgctgctgcccagcttctcttctgcctctaccctggagccttgcttttcttggagatggcctgtggagtcacccaccacgccggtggagcacaattaccacactgccaggcctggcagacactgcctcccgcagagctcctcgcgggctcgctgtgctgttgtgtggggccagagtaggacaggccctatgctccggctggcaatgccccgctcctgagcctccccaccctgtggggtgagctttattcccctcagctgtggtgagggctgcaccaggtcctccgagggggctgtttgttgcccctggtaagtgaaaggattaccttcagtgttgattgtcctttttttgtaatcctcctgccgttctgttctgttgtgtgctgtgcaacattttgctacatagactattttatagcagaaagctagaaaaatatttattatgactactaaagcaatagtgtatcaatgaatgggcggagacattaggaattgtgtaaatgcttagattcactttgggtggatttttttgtactttatttataactaataaaaatgatctgcattgctaactacacctcaggagtgcagagtgtttgtttctgtgcctgcccgaggcagggcgaagaagtttctaaagaacctcagttggccaatgtatttccccaaaggctcgtaggttgcttggtccccggctaggcgcttcctgagaaggcagcctttatgggggggggggggagctagagggaggatgttagttactgtggttggccccccagtcgtaccatgggaacttaacctcctctttactcgcaagctaccatgtggtaaccttctctgtcactcactctcttctgccatagttttccgctcctctgactgggcccaaagcaacaggttgacaattgtggaccaagacgtccaaaaccgtgagccc

SEQ ID NO: 25639 - DNA, 1094 bp, Mus musculus
gtgggacaaacattccccgcgtggggctgtagcaacgtctgtcaggtcccccttgtgtttcatctcctgcgcgcgcgtagagcaaatgctagagcgatttcagctgatagaaaaacaaaaaagaaaaaaaaaacacaaaaaaattaaaaaaaaacatggcacgttgctagtttacagggttttgtgagtttaaatgccttatatttaacaatcataatttatgactaacttgtagatatcgtgggttcttatttaattatttttatagttgttttgcatttttaattataatttatttatttagaaaggatactaatgttttttattgctcctattacctcattttggcgtcgtttctgggagtggaatgctttgcatgcgttggtacgatgacaactgcgaaacaaacaaacaaacaaacaaaccattttaaataaaagtctgcgaactttattttgtccaaactatcagggtgtgtgattgcaagctgtcctactgtggtgctggcctctttggatacattccatacgaaatgcaaacctttgattctgtatgctgtgatctagtgacaagctccaatatagtgagtgtatttagcacatatataaatattatttgcactcgtcagcagactggggtaatcctttcacttgtcactcgtgccccctcccccaggcctctttccccacctcaagtctgctctctgtcttccctcccctccctacattcctaagccctctcatccctctatcccgaggacagttactaagctatacttgggatcccactcagaaggtttcagaactggggtccttcagacacaatgaatatgctcatctgaaagagaggctgttttattaggtggggcccagaaggcccgctctgatcaagggtaagtcagtccctggaccccctgagtcagtcctcagctccgagagagggagtctagaagggtgatctcttggttcaccctgattaagaaagaatatgtcaccgtcccaggtgagaccacacaggtgggtctctctctctctctctctcttctctctctctctcctctctctctctctcctctctctctcctctctctctct

SEQ ID NO: 25640 - DNA, 1551 bp, Mus musculus
tgggaaattccttttctttctctgtgcctcagtttccgtctccttccagtggggagaaagaaccgtgtgtccccatgccccccccccccgccccacatcacctagatctgagagttaacaccctccagccctgatgtgctttcggttctctcaggggagtctctgagggtttagtgagaaaggagacggaaagtcccaagtgacacagtattagtgtatgctttctgtaccgctccgagagatgggaggacagagttctggaggtgggggaaatctgccaaattctaactcgagtgtagctcttagttgtgtgcagaaaataccaggtctcctggcattctttaactgtcctttgccccttactcttctcaacccacctcctctcttccctcctccccctcccctcctccctccacttcttctcccccacctcatttgcactgctctcggaaacctcaacccgtagccagtcttagtgtcctcgtatgctcagagcaggaaatggtatgctgatcagataaaaggagaaattccacgaagttaaacaagcccaggataagttttggagtcgtgaccaaaaaaaatgacagtggccaattggacttgagagagatccttccaggacaaccatcgtgaaggaatggctgcctgcctcatcccaggccccgtcttctggtgtgtccttcaatctctgtggactgcctattggggtaggggggcagcaggtgttgaggaaggtgatcactcaggcgatgtctcggcctggcggaactctgaggagtggaggaacagcacacagtgcttatggtgaaggtcaggcgtgctgagtgtggcctcagtcaactctggtcgccatcgagaacacggtctccagtacaaaggctggcccaggaaagaaagtcagggtgttagaaagctgccgaccaaaagccacaagaacttgtgacttctttcctgctgctcctctgatggctgtgtccaagccgtgatgtcctctgaagatggctgtggctcagaggtcattgggggtggtctaggtgggtcactcctctctgaggccactctgttctttcctttgaggctctcctgaaaggctggtaggaaaagagattggcagggacccaggagggaactggaaccagtgtcccagattctagtcctggctcttcactggcaaactgggagatgctggaaatccccaaccccatcccaatggcttgctgggcctcagcgtcctcagctgtgacacagggaagttgattggatgctccctaaatttctcccaaaacacatccagtgattcttcctaacatcaacacatccttcacctctgtagagttgccctcagccagccttgccgctgagaggtctcctgtgcgcacatacatacacctgcttccgaggccctggcacacaggccgagtgagagggcagggcgggttcggcttgcttcctttttgttcaggctctttgaacgctccaggctaacattaggacctgggcagggtaggggttgatccttcacccccctcccctttccacgtacttgga

SEQ ID NO: 25641 - DNA, 1208 bp, Mus musculus
tgctgctagtcacgtgactcttttttttttttttccagacgcctaccttgtatgcatctcttccaccaactgtgtgtggaccagtggctcgccatgagcaagaaatgccccatctgccgagtggacattgagacacagctaggagccgacagctgagggaggagctagccagtggacaccccgtttccttcaccaggtcccccccccacggccatagcccttgcagccaaactttgccttctgagccatttgacgtagagaagaagcctgcaagcacattttttttttctttttggtggaaagaggagttggtagcggtgtctgagggagaggaggggtagggtgggaagacccacccatcaggaatggtgactgcctcatcgccttgctgtgcagctgggagggagctggccgtgcctagagcaggggcgggaagggggcgccccagctgctgaggactggatgttatctcgagggtactagctggtgatcggcccctcaatcctgacctttgagggattgtgtatatacctcttgaccacgtagaaaccatgtaggggtctctagctattctgtggatggcagccagagcatgttagcttaagaaaaatgtcgtgtgtggtgctctcgtcatctgtggtggacatgtcgctattactgaactcgcaccaaatatttctcattgagtttcttgttttggtgcctgaccgaaccaaccaaccaaccaaccaaccaaccaaccaacgacagccccaatcttcccatctttatgagcgaaaagaaaaaaaaagaaaaaggaaaaaaaaaaaaagaaaaatcaaaggtgaaaaacaaacaaacaaacaaacaagccaaattctgtttacggtgaaaaaagttgataatttttcacccaggttgggaggggggaatcctcgtttgttgttttgtttttttttcccccttgggctttgtttttctcatgtttacagtgcacggagtgtaagaggggatgggcttaaaaggagcagactgggtctcactgggtttctgaggctttcaggcaaggtgaggagggcagaaccccagccagtgagggggttccccaccttgcagtgggctcctcagtcctcaggcccatggcttagccccagtagctttcctaggttccacactgaaccagggaggacaatgcctccagctacagcctaccctctagccccacccca

SEQ ID NO: 25642 - DNA, 1115 bp, Mus musculus
aagtgctgctcagaaaaggcattgagttatgaacgctaacttctgccagggagcccgtcaaactgatgtttcttgaccgctacccatcatatgcaggtagagagtattccctacccttctgctgggcccacggacaccccagatctcaggtgagaaggttagtggaccagaccccatctgacccactaggagttctctctaagaagcaggttgccatatagaagctcgtggcagaaggagacattggaaactcatatagcatcctccttttcctcaggcatttaaaaatgccattggggggctcccttctctgtctttcacagcctcagtcccggtttaggacgtgatacctgcctgctctccatctagcaagaccccagcttgtcgtcacactgtgtgacccctgtcacctactctacaatgcctcttgaccttgacgagttctccaggtttcacacatttacctgggatgctgtccccgtgtcctggagcactggctgctctgcagggctcagtggggagatggcctataagtagaggagggactagcagtcatgagcactgctatggtcccccctaagacagactggaatctgaaaggccaaatgcaaatcccgtccctgcatctcagtagccccggggctctgtagctcttctggatccagtcaatgatcttactttcttctcccgtttctgtgataaaatactttgaccaagaccaaagcatcttaagggaacaagtgtctcagctcacagctcacagcatactctatcagggtgggaaagtcgagggaaccggaagttgaagtggctgcagcagtcagcagagggctatgaatacaccgtgcttctagctcccttcctccatttctatgtaacccagcatctcccaccaagaaaacagtcctcccacaattaaggtgggtcttaattagtttaaccaagcttaatccctctaggtatgccctgaggcccatctcccagatggctctagaccttgtcaagttgacagtttacactaaccatcatgtgtacctaacaagataagatgcctaatgtctgtcccggacacgggaggccctaatggaagccttcactgtcttgtcttcagcaac

SEQ ID NO: 25643 - DNA, 1107 bp, Mus musculus
cagctcctaactgattttgttcatgccccagagactcccttccctccatttgtcagtttgtatccagaaacaaatttgtggacttggtgttcaaagcaaaataaagatgaggaaagtgaggaatataactgagtagctgggtggaggggggtgttacaggatatttgaatctgtttctaattagggtggggctcagcagacatctttaatctctccggcttgaatacaaacaaacttttatacgcatctttaatcccaaacgacgaaggtaaagtttgtggaaagaagcactcacgtgtgaaagtgatgtctaaatgagtcgcagacaaagtgatgaaccagagacagggtttctctgtgtagcccaggctgtcctggcacccactttgtagaccaggctggcctcgaactcagaaatctgactgcctctgcctcccaagtgctggaactaaagatgtgtgccatcacgcttttgacagaaaagggtatgcccaactctcaggagaagagagaggaaagggaagctacgtaagggagagacagtacaggagaagagagaacagttcgggaatatggtagagtttgtggagagcagcagctcagcagagttgagagagagagagagagagtggagcagcacagagagggagaaataggcagttttacctggagaattgtacagagacacatggaagagagaacaaactagacacaggtgaagatggaacgaacaacagaacaagaagcagccagaagattggaacagattgctagagttagaggccaggcagagcaattcagaggcccagagaaaagccagactgaatgagtcagctgggagaggcgtctgagccagaacagctgagttgaaccagccagccagagttcagaaagaacaagaaagggagagcttcctcagcagccagtctcagaggctgaaaaccattctaggccgagattagattgtcctgagacttagcttctaggactaggcctaggttagtagaaggaggcagtaagccttggtgaggacaattacattgggccaataaaagttacttttacagatcaggtcagtgtagggctaacagccaggctctaagatgt

SEQ ID NO: 25644 - DNA, 1103 bp, Mus musculus
gatgatgctagatcatgcccgtatgacttggataggataggaatgtctttggaggcctcagttggttttggtgcaagttcaagttcagcaagcaccagctagggtcactaagtggaaaccagcccagccctggggcgcctgcaggctactgggagcaggcagccatcattgctccttgattcaggaagattctgctggctgtttcgtctgaaccccaaggcaacatgtcctgactatggattttttttcctagagcttaagaaggtagaagatacgtcatacttaaatgtataatgtcagagctgggcacgaaggtgcctgtgtgagtcccgcactccagcactgtggatatctaggcagcgaatcatgacaagctcctctttcaaaaaaactaaagaaacaactgaacacactaaccagccaaccgaaaagtgtcaatacatagagtttaagggacagaataaaatgtttcataaacctaagagaagaaattggaaacagtattaaaatgtgctggactgctcggtcctttggaatccattatgcctcaggcattgtgctggacacaataaatgtgtgatttcagtgaggtggctaaggcaggacaaacaagacagtgtcaacatagttgcggtatgtcttgaccagctagagacctttgctacgaggtaatagacagactgtgaagtttgccaggtgagagtgggggagggtggatacgaaaccaaaacaggcctggggagaggcgaggtctgggaaaaggatgcatttgtagatgaggtcagagacgggagtaaccagttttgcccaagggcagaggtgtggaagataggcttttcctagagttgttatttggaacattgtgggatagatagggctcactaagcaaagtttgagaacatttcagacagaggaagtggtatgaacccatcactgcatggcacatttagacagtgatacagatgttggtccaggtgggtggggcttgccatgagcaagcatcagaggtgggttggtggcaggagggttgctatgggtgctgtgaggctgcggaggaggaggtgtggactgaagtgggtgtgctgacaactgagtgttggtgt

SEQ ID NO: 25645 - DNA, 1148 bp, Mus musculus
ctagcatgcgcttgtcagcacagttccaaagcatgacctgcctggtttgctagttcagtcatttgttcacctactgttagcaaattagcaccacaaggaatttaagacagatgttgcctgcttcttttgtactgtgtcacgggcttgcaaaagcctggggcacaatttagtcttagttttgactttttttttttttttttttttttttttttgttaaaggcaaagagccgagccccaattcctgtttccctgtatgtgtgtgatgtgacttccatgtgtatataaaactattgcaccctaaccaaacttcctcagactgtgcactgtttgttgaaaataatcacgtattttagttcaatgctgttgtattttttctttttatttaaaacactacttattctctaacaaatttcaaagggtagtgatctaaaaaaatcactggaaactaggaaatgtttctgttgttgctttgttctttaaagagtgcaaaggtcacggaatcttttgctcttcttaccttgaacatgaattgtcagccattgtgtggctaggaaccagtgcacttggcgttcacagatctgctgttgctgggactgagcgtggacttgatgcagtgacaacaaatcactgcgtagacggaatgttttccaaatgtgcaactcaagtttgtaaaatgaatttggttctttacatcattatttaggttttgtttccatttagtatttaatggtctttggagaaaaaaaaaacagagtgttatatatatattttttggtgcaagataagattttgttttttgaaataagtctgtagcataaaggttaaactattttaagataaaataaaaatagagtgtatttaaacagtgactctttctgagaatgttttcttcctgtctcagttaataaggtggagtctgggaggaacctttcccaagctatcctttggagatgaaaacgtgttacattttgttaacagaccactcattataagaagcctagttttctaatcaatatctgtatcctgtctttaagatatgttactaaggcatgtcagatcaaggggaaagcagtttaatgggattaggggttggctcagttggtaaagtacttgccagacctgaggacctgggtttgatctcctgcacc

SEQ ID NO: 25646 - DNA, 1212 bp, Mus musculus
tgtttgagtagttttcttctctgccttctaaaaatatgtatacaagagaaatcaaaatataccataagaaatcagatgcaaagcacattgatagtactgtcttaacagtatttaaaacaattagtaaagggtcatagaaacttcagggactttaggaaatgccagcagaggaattttgtggcatcacttactaccttttttcctataatgttgtagttactagtgaagtacttttaaaaagcaatacctagaattagaacactatgtgttgtgcagagggggagtgaagtaatattggctcagaagacatcacatgtttctggttttgttttcatgcggtgttgctatgttctttgccttccctcctcaaataccttggtgacatcctcattacaggatgagacccaccacttttattcagtgcacacacattgaccaaggacctactctgtacaaagcactgtgcagggtggatgtttggaggccctgagaagaatgagacacagcctgcctgcatgctcctgcatgggtctgcctggctccatctgcctggcctttctgttttcttacatgaagacaggtttattcattattctcctggttgttcagttcttgtgtagactccttctgtagggatgcatttgagcatgtgctcgatgatgttgtctggcgtaatctcatttgacctgccctctgctcaccaccttctcatcttttcttcagtctactactgtcctgctaaccaggctgtaaagccatgatctccagtgtcagtgcatcattgctcactctcctagatagaaaccaaagacccagaggccagagcaaaacagagcttctggaaactcactgctgggttatctttgcactttcacatcttgctttaggattaatttattgagttttactgttacacattttttttttttacttgaattaaaatactcaacaaagcagaaacataatttctggtctgtgttttccagaaaatcattggtaagagaatacagtggagggtatgacttgaagtttttgcagcttatatctatctccccgaatggcacagccccattttaaagaatgttttcgcattacttattttcatgttaaaaatgttctgttcaagtctacacaacagatagtttccctgacattttctttagtctttttagccatcccctttctttgggtgtgctgcggactgggttagag

SEQ ID NO: 25647 - DNA, 1177 bp, Mus musculus
agcaaagttgggtttattgtgggaagaacagtgtacactcatggggtagattaggctcctcagtctctctaaaatgccatgtatgtatggatgtatgtgtgattctgaaattacattttaaaaaggataatgtgttttggtgctaggcatgggtgcacatgtcttaatttcagcacttgagaggcagagataggcagatctttctaagtttgaggctaccctgatctacatagcaaattccaggccagccaagtctatatagttgttttgttttgttttgttttgttttttaaagcagcttatggggtgccttatacaggtttatagaaagaattagttctggcaaaattaaaacaagtcaaaaagagaggggatgatggggctggtgtgatggctcagtgggtaagagcacccgactgctcttccgaaggtccaaagttcaaatcccagcaaccacatggtggctcacaaccatccgtaatgagatttgagtccctcttctggagtgtctgaagacagctacagtgtacttatatataataaaaataagtaaataaataagtatataatgtcaaaaaaagagagagagagagagagagaggggatgatgagatggccctggttaagaacactgctgcttttccagaggacgtgggtccaaagttccagacccacatggtggatcagaaatgtctgtaactccatttccaaggaatctgaccctcttctgatctttgtgggcattgcacacacacactacatagacatacatgtaggtaaatacattaaataaggtttaaaatagacaagaggaattaaaatttctttttttttaaagatttatttatttattatatgtaagtacactgtagctgtcttcagacactttttcttctcacccagaagagggcatcaaatctcattttggatggttgtgagtcattatgtggttgctgagatttgaactcatgaccagagaaaccagcagtcggcagagcagtcagcactcttaaccgctgagccatttctccagcttgaattaaatgttttttaaagctatatataagtcaccaggaggtcaagacattttatggttgtaaacatgattcatcaccacgtatgtgaggttttttttttttttttttttttttttttttttttttttaggcaaaaccag

SEQ ID NO: 25648 - DNA, 1211 bp, Mus musculus
acccccgatactaagacttctaagctgtgttgagtgatgaggtccaactgcttgggagtacagtgtacacactgtctcaaaaaacaacgaacaaacaaacaaaaaaagtaagacaaaacaataagaacaaacaaacaaaaaacctcagtaggccaaggcaggatgggtgcaggtctgaggctagctaaagctgcatatggagattcttacaaactacacataaacaaaactacacacatgaacatacgcacaaggaccggcagtgcagctcagtggtagagagggcttgcctggcatataagttcctcagacacacatgtccacgtacatgtgcatacagtcaacaccaagggatggtgatagagttcagtagccaaaggcttgactagcgtaaatgagttccccagtttggttcctggtaccacaaaaaagaaacaaataaataaaaggtttgccttaatgctttctttctctacttctcttatttaattttcagtagaggttgatgccgtctcttccatgtctttatttctggcttgttttcttcctctaggacgccatagaggctgaacttaccaagaaagtagacatgatgggcctgtgaggacagccatgtagacgtggtcaggggaaggaggtgactgttcttagagatgatgatgtctctattagtaaaacaacagggttcgcttctgcctttaaactttgtggcctgaatacagtttgcatatgaaaaggcatttcttgttatctgttgctcacggtacacctcaagggttacctgctacttactgaacacctcacagttaagaatctttccataagtgggtaggggggctggtgagatggctcagtgggtaagagcacccgactgctcttccgaaggtccagagttcaaatcccagcaaccacatggtggctcacaaccatccccaacaagatctgactccctcttctggtgtgtctgaagacagcttcagtgtacttacatataataataaataaatctttaaaaaaaaaaaaaaaaaaaaataagtgggtaggggctggggaaatggctatgagttttagagtgctttttgctcttgctgaagacccgggttctattctcagtgcccatatggtggcttgaaagcatccctgactccttccagggaatctgacaccctcttctaccatctgcaagcaccaggcacacatgtggtacacag

SEQ ID NO: 25649 - DNA, 2294 bp, Mus musculus
gtctacaaagtgagttccaggacagccagggctatacagagagaccctgtttcgaaaaaccaaaaaaatatatatatttgtttttacttatgcatatgagtgaatgttctgcctgcttgtctggtacccatggtgggtctcagatccctggaactgaagttcatcagttgtgagctgtcatgtgcgtgatgggaaccggatccagaccctccgcaggggcagtggctgcggtggcgcacactcacactcacacttttaaccagtgaaccatctctccagcaccaagatatctaccaaaacaactcattttatgttttaggatgattttgattattttcatgaaactgcttgttggggacctgattgtttaaattgcgttgtcctctcaggcacagctgagatgtcctccattctcgaggagaggattctgggagctgacacgtctgttgacctggaggagactgggcgtgtgttaagcattggtgatggtattgcgcgagtgcacgggctgaggaatgttcaagcagaggagatggtggaattctcttcaggcttaaaggtaaattataaagtgggaggtttgctatttcaggatctgtagctttgctctctcatttagtaattcagagcttgtcaagagttaaagcatttaagtctcattttgcctcatttcttctctattataggttgtaaagagagtaagctagaaagagtttgactaagccaagttccattgtctctcttcccctcatgtgctgataaataagttgtagcccgaggcaccaaaattgaaagtttagcaaacatttgcataaatttcagcgagtccctatcagttcctttgtagctgtggagacttggcaaaagtgtttgtgtacatgaactaagttcttttcccagtacaaataacctgcctcatcctgttgagacttgatgctctagagaagggggaggtgggagcatcctctcaggcaaatgggggaatggggcgaagagcttctggagggggggctggggaggggagcagcatttggaatgtaaataaataaaacaacctgaagaaagaacagatccatcactgacagggaggcagtgtgtagctgtgagttccgcagatgcttggggaggttgggggctgcgctccagtgtgcagtgtggcggtcaggacagcctggagggtctcctgcctctggtcatctcgggtcaggcacccactcttagctagtccatgaagtcttaaccagaggagcagagcagggagaaggcaacagtgtggtgtgctgccgtgtgatattgtcccaccggtctcattgtcctttatcctttgtgcagggtatgtccctgaacttggaacccgacaatgttggagttgtcgtgtttgggaatgacaagctaattaaagaaggagacgttgtgaagaggacaggcgccatcgtggatgtccccgttggcgaggagctgttgggccgtgtggttgacgccctcggtaatgctattgatggaaaggtgggttactgcttatgggtgctctcgtggccgacatcacagctaatcgctctgagggttcctttgattcatttttaattcttgatatttttatagggtccaattggttccaagacccgcagacgagtgggcctgaaagcccctggaattatcccccgaatctctgtgcgggagccgatgcagaccggcatcaaggctgtggatagcctggtgcccattggccggggtcagcgtgagctgattattggtgacagacagactgggtaatgactcaaaatctgttaaaagttctaactaacatggattgctagtaaataattatgcatcttgggatggtgaatgctgtggttgtaatgaggcagaagcaggtgaaaattaacagtggtatagcacaactgtgcttggggatcctgcatttagtgacatttttgcctctcttaaaggaaaacatcgattgccattgacacaatcatcaaccagaaacgtttcaacgatgggaccgacgagaagaagaagctgtactgcatctacgtcgcgattggtcagaagcggtccactgtggctcagctggtgaagagactgacggatgcgggtactagagagctctggtcccctggcctctatagataatcttggaacagcctctgcctaaccaaggccgatgctcttcaatcagctggcccctggatttgtttttttaagatgaggtctcaagcagctctggctgaccttaaacaatctcttgcttctacttcctggttggggaactagaagtgtgtgcgaccatg

SEQ ID NO: 25650 - DNA, 1147 bp, Mus musculus
cgaagccccctctctcaattcatgaatagaatgagggtggtggacaattttgtgtcgtaacctttagtttaaaatctgtctaggtacctttgtgactgtaactttttctcctcagatgccatgaagtacaccatcgtggtgtcagccactgcctctgacgctgccccgcttcagtacttggctccctactccggctgctccatgggagagtactttagagacaacggcaagcacgctttgatcatctatgacgatctatccaagcaggtcaaaggatgtcttttataacctgtgtacttgcatcttagtggaaattaacagacgcaccttgtttaacaggtggattttatcacattctgtaccacaggctgtcgcttaccgccagatgtctctgttgctccgccgaccccctggtcgtgaggcctatcctggtgatgtgttctacctacactcccgcctgctggagagagcagccaagatgaacgattcctttggtggtggctctttgactgccttaccagtcattgaaacacaggctggtgatgtgtccgcttacattccaacaaatgttatttccatcactgacggacaggtattagattgactaaaattagtgtaaaaatgattgattattctaaggcactagttgagactaacaagcatgaacttatttgtaaattgcctttacgttcttatggaacacgataaacctagaactgaagagaatagggtctatagagacgcctcggtggctgagagcacttgctgctctgtggaggaccagggtttggatcccagcacccatttgactgctcataaccatctgtaactccaggtctggggtgatgggctagtcttactatccatgtagctgagcatggcttagaccgtccagctttgttgtgtccgcctcctaagggttaagattaaagcatgtgtcctctgcacccgccggggcatcttttggtttatatacactcattattttctagccctaggtaactttaaagcatatttgagaagttatattactaccttgttgtagtttgttgagattgggacttggtgtagtctagactggccagggattgcatgtagctgagactagctttgaatttgcagtggtcctcctgcctctgagtgctga

SEQ ID NO: 25651 - DNA, 1439 bp, Mus musculus
tccctcttgggcaatatcaggtataaatggagttggtggcctttattgtgactagtgcatttttatcgtagtcttgctttccctggaggtgggggttgggttggaatctggtcttgctgcatactagccctgcctggtcttggcattcactatgtagcctgagtgttctcagtatttggcagtcctgtctcagcctcccaagtgctaggatcacaggtgtaaactacctaccatgtttaggaaagtttaacagttccctgtaggttagccttgtcattgaatctttactcgggtcatttgcacgagtcatttactcttttgtttctatttccaaacgagtcatttactcttttgtttctatttccaaacaggtctgatgggaaaatctcagaacagtcagacgcaaagctcaaagagattgtaacaaacttcttggctgggtttgaaccataaagccctgtcactgtcaccagatactgctttggttttgtcatttattctggtaaaatcagcaccatttgtaaagggttactcttgtattcctgatgtacagaaatcacatgaataaaagttccatactgtgtgctagtttgtgtgggggtgggctcaggtgtgtaccaggatttgtgtggtggtcagaggacagccagcctgtatgacagtaccctccttccaccgggaatttaatgcaggtttttatttaaagcacgacttcatgttgagttccataagttagttttgtaagacagagcttactgtgtgacctcagcaatggctagcctaggctattcttgtagcagtctgtctgccatagctggcaaattgctctcttaccctgttcttgctggtgcagtcagcatggatagataattcaaagctgtccactatgaaattcggaagtactttgtgattgattaaaaagagaactctgctccggaaatgtgtcttggttgatgagtccctggcgcccatgaagctctagtcttgatccccagagtcacatcagctttcgagggatgcacactaggattcctcatctctttgagaaccaaggaaggaggatcaggcagtcaaggttgttaccaaccacatagaaaatgtaaggccagcctgagataaatgagaccatgtctaaaatctgttatgacccacatttttctaatgttgttacatggtattggagactacattggcctcatggttgtgcgagggcttttatttttgagactgggtttcataacccagcctggctaaaacttagaatgctgaagctgcaggtgaccttgaactctttgatcctcccaccaaagctctcagtaatgagctggggaggggtttatactttcaagtactccttaagaaaagagagacacttaggagtgctctgtgtacatgtacatctgcatgccacaagagggcatgagattccttaatggttg

SEQ ID NO: 25652 - DNA, 1197 bp, Mus musculus
aggccagcatgtgtgtaggtactgtgtaggccagcatgtttgatcccctggagcatgggctacagcctggccatggctgttgggaactgtctttttggaagagaaatacaagttcttaaccactccagcctttattctgttccacactttgtttttctttttagaggttccaattatagacactctaaaatacatatatataattctgtgtttttattgttagtgttgtaaatgctccttacatggtagcctttgcactattaacttttattttttggagactttttttcttcttagagtaaaagcagtataggaaagttcagaataaagaaagcggggaaaatccactgcttccactgcgcctgcactcggagcattgagatgagagccatgtctgagttgttcttcttcatctaatttatctttcctgtttgatataactgggaaaatacagtgttatgttctcatccagtgtaaccgtagaactgtttttttatgttgctcttgactttcatgctcattattattattttggtttagattgttaggagacggtcttactatgtgtagtcttggctgcctggaactctgtttagagcagcctggctttgaactcataggaatccacctgtgcctgcctcctgtgtgaccacacctggctggctgtattatttgaaaatgatgctataagattcctattgaatatatttcccctaatttactcaagtcttctgcaacagtattttgcagttgtaagaatgagaagttctatctttatatatgtcaacttctatttccccctatatttattcaaatgattacatttcaaattcaaaataaaaagaaatcttttaagtcagataaactaaaaaaagtcagtaaaatgagaaaatgcaaaatacggttcaaatatattagaaaataatacatgtacctctacaaaccgaaacaaaacaaaaaacagccaaccaaagaaacaaaataccattgtttattgttatttagtactattggtaataaatgatctcaaaggaaaagaagatgtatgtgacactgctgtctgggctgccaggctgagctcactccatggccttccctttgctgctgtgatatctaggatccttaagcaggacccctttgctcctcttcttgttcctggacatcttgtaaacctgggcgcagtgctttcaacactct

SEQ ID NO: 25653 - DNA, 1102 bp, Mus musculus
gggggtcattgaattcaaaccatcttctcacttcaccccgttttctgcaggctgtgtctttaacgaccctgtttcttgatgaactcttgtgttaacggcatactcagttttttccttggggaaaactgccttctcatgctttgctcattccaatgaagtgagcatctaagatgtaagtattgacctcccaagttctttggcatcaaattcatcttggagacataaagagatgaaaaaggccaacacggaaaactgatgaactagaatcaaagtgttccccacgaggaaaagagacccagaggtgcgctcgtgatttgattcagttcactgaccgtgtacatgatacttgcacgtgtttttagggaggaggttgcagttttttgagagcttccagtatccttgcttcagaaccagactgttgcacaggccagaacattttatctctattttaaatggacacacctgagctgcatttttggatacaagaaatgcatatgcatataaaatacatatctgtgagagtcgatgattttgaactgaatcaggatacatatgagacaatactttggttggcttcagaagggatgaactgggtggctaaggaacagcgttggcaataattttttactatacagtactagattcaaaactccctgcaaaggtaagaactggtatatgttcatctactatggggcatggttttctctgtgtgtttctataacatttatcacacaaatttggtatctgcatgagcttattcttcttttctagaatggggatcacaggcttcatgcttggatattgagccaaattcaaattattatcaaaaaaatcactaattccttcttaattctgtattcctattgcacaacaggtaacagttcgtggacaaacaccgcacctttctattactttagatatactgactactcaaagaatttttctatgttaacagagactttcacaagataaccttgcccagagtaaggaaaagcatgctgatctccagtcccttagctttctaggttcaactctcagcagaactgagatttctcaaggatgcctttacctctttccctgtctatgacaaatgagctctcaa

SEQ ID NO: 25654 - DNA, 1182 bp, Mus musculus
ttaggagtcatagcatggcctgactgtcttcccccttctctgttggttcagcttcttataggccacagggttatagacgtcatctctttttatcattgtggacctacaatgtatgataaatattaataaaaaccattctttctggggccaaagcaagaggttagtagaactggtttgcagtattgaccacatccctaatttctagagctactgtggctgacatgttttggagaattcctttctcaggttaaggatggttccactccctcgtggtgggactcaagttagtcatcctaagggctttagcctgggagagctggccccaccacttatctgccatatgatggcatgggtgaggagagatgttgtcctcttgccctttaccacctgtggcaggcaggtgagctgggcgcaaggtcataagagcaggagagctgtccctgcccctcactagctgcagcactagagagagcttgccctgctggcatgggcacacgtgagcttgatttgacggcatgagagcaggagagttggctctgccccttgctagctgcagtagcggatgatctagacagggaagtattggagacctcaccctggtggtgtggctgctggagacctgtcaggcgggtggaccagctcagatatcacccgggccctgatccaggacaccgactctgtctattccaatatctatcatatctataaactgctagagcccctgaagctgcagggtccaaagctgcaagatcttcatgacacaggacaacaaaaggattccaagaggagtcctggtgaggaaccagtatttatagtggagcagaagccagagtcctggaaccagaccaatgactcattgcaatgaacatttccaagatatatgaacaaaacagtatgctgtgtgacacactgtgacacactacagctcccaagataagaattttcttttcttttggttaagaggttgaaagggtagagggtggatacaaggggatggggagatgagagggcctggggctcatgatgcaaaattcacaaaggacaaataagaaattaaagaaaaaggaatggggtcactaacatagagcagtaccaacagaaggcataatagagctaaaagttacctctctccctgcatactcttaggttttcctttatagagagggttgggtctgcatctat

SEQ ID NO: 25655 - DNA, 1104 bp, Mus musculus
tgggccagctttacttctgccacccaacattctagacttaactactggttaaagacaaaaacaaagaaaaggaggcaggctttggaggctcccttgacattgtgacagtcacagggcaccccaagacacttgtcatatctatgacattgtttgaaagtcactagatcctcacctggaagagactttataaacttccaagatcattggacttagggtaagagtacctacatttccaggatttagactcattgcgtctccacaggaggcctctgttttctttcatgcaagttagcttgccttaaccctgttctgacgcttaccgagttattaaaatgctgaaatgaaagcattggctggaagctgctctgcaaacccagtgaacgttgctgtacgtgaagaagcctcttgtattttgtgtgatcagacagtgttctaaaaacgctggggagggagggagtgatcatcgtagctgaatgtttgcagacttgccccaggtgccatagtttgtccttagcagagtcattctcctggatctttacctagagagtcatgtttcttgtgtaatgtggagtggcttcttccactgtgggaagaaagggatggcagtcagaaacagaataaagaatcttcatatgtgcgtagagttccttagatgtgattctttttacttacgaaatagaaagatgccccctaagacctatctcatataatgataatcaagatgtggtcagatatggggaggcacacatgacaaggggtgatgcttgccttgttctttatagttccttcagacattagtgcatagtgtgtagtcttcccagcaattggatgacatacggagagaagacatttttcttggcttacactgtaacaggaagaacactatgtctggagaacttagttaacttatcccaggtcacagaacttgaatgactcgagtttagaatcagacctagatgttgagactttaattcctatctctacagagatagggatctctcttgctgattcttcccatttgactttgaaaaaatggttcctctcattcaagttgccagcttgttctagggtaatgagtcatttgcagaaaacaactgagaacct

SEQ ID NO: 25656 - DNA, 1185 bp, Mus musculus
tataatgggatacttgtgcagccaattatcacctagaatgagggattcttactaaatgacttctctcttttctatagcaagttatgtatgaagagacattttgtcctcacagttatgaagagacagagtctgtcatgtagctccccagggtgagggaggtggcggatgatggtgcgcacgcactgcccagctgcgcactcttgctcctgacatcttacaatgcacctattctcagctctcccggctaacatgggctgtacctgcaggaggtgggtcgctctttggaatttggcttttacaggggctgtaggtctcagagctgtgagttagggggagctggaaggggcagaagagaagttgatttctgaacagaagcaaaagaaggacgcagaggggcccacagagctcagcctcctgggccctggatgccaatgctggtgctaattatctcactttaactacactcttcctcagcatcatgaggccactcgttaatttattcatccatctaatcaaaaggattttcttcaatcactatttgttgcacaccaggcaatattgtagagaagaaactggctcttgttccttaaatatcccgttggggaaatgtttccggtctgactcgtaagctatgtcaaagtaggaataagacagaaaggcttctccgtagcaactcatctgggaaggaaggtgtcaacaattctcaaaagatgccttgggactcactggtcaatttcactgagtgatagggccaatctgtctaattgaaaccaaagataagaggcactgttgagcagagcaagatgagatgtgagtgagagacatctattctggggtctggaagacacgtgtgcttggtggtattgatatatttaacctgggggtgggggagatgtcctagggatgtcagtgtagagaaagaaagagaagacatcactgtagacgagaaagtacagaatccaggggaaaaaaagaagaaagaatagaggctcttataaaagcaaaactgagaaactaagatggcaaaaataccgtagaggccagaaaaagcatcaaaccaggtctgagtgtgatgctgagcctactgcaagtggaggaaggaaatgactgcatctaagagcatacacacatggatgagtgcctgcttcagtgtagtgacagtgtttctggggctgcatgagaggg

SEQ ID NO: 25657 - DNA, 1453 bp, Mus musculus
ctttttaaaaacagtaaaattcatgtttttaaccagttcatgtaaaactatcttgtgatgcccgagtgttccactgaccccgtgtggctgtgacagagcaatggctgggctccatcacagagagtctgtttccacactgtttacaaccagctcagaaagccctctgaactatactcaagacccgctgggattacaacgccctgcatctgcggagctgccccagccgtgacagtcaggcggtcactgctgtcggcggctccagtggatttaggagcccagcaactctgctggctagaaggtgaggccagtggtagcacgtgggattaaaagccaactgttccatccgtgtttcctctgggttggctgactagggcggttttaaggcatcttcagtagaaatgagtctcgtacctctgaaggcccgcagccgtgggtgaatgtgcatgttagctagttatttttataagaggagattcgagcatgtcagtgcctgttcctagaatagcgatccgtggcaggaatcatcttaactacaagtcaccgtggaacttaaatagttttgacagatcacttttctttctccttagaggtggtgtatcaatgtctgacccagttaaattttatatgaattgcgccttctgtttggatacagtgttgggagagaatatccaattgattaactgaggacaaactgaccaagtgactccttcatgtaaataaaggttttaaagcatcttcgtcttccaggtcgagtgccccagctgctgcccttatggtctagtgccacctgctggtaagacgcagaactgtcctgacttcatgaatgccagatggagaatgcatctcagcattggcctttgtccagaactcatactgtcaaatagtgttgttccttcctttggggaactgtttcctgggcagaggtggccttggttaaggatcgtttccttgccctgtgcctgtttctccgttatgtgcggagtgtccacacaaggagagcaagatactccccgggcctcggtgaggatccaggcacccagactcatggcttctaaactgctaaaagcaactgttttgtttccatgttgctgcagtgatctggaatgtgctttactaagacaaatattacagaaccaaaaaaaaaaaaaaaaggatgctaagttcctataagacttgttctcggctatactgtcacttggtgtatcagtttattcaaaagaaaaaaaatttaagtgaagaggtcagacctttgtgagctattgcctgtgaggaattacatgtgtttagcagatgcctgagagtatttttctaaacagaactcctaccattttatttcttctttcaaaaaaaaatctgtcattatatattaaattttttgttttatatatcagaataaaacctttttcttttgagttaccgtgtgttattgatatagcactacttctctgttact

SEQ ID NO: 25658 - DNA, 1932 bp, Mus musculus
aatggggacgtgatccctgagtccacctttcctgtaaagagaaagctgcctgaaggccatttagggccggaagaccagagggatggggaggagccccagctcaccctagatgctgatgcaagttcgggttcagagaaaggtctgggcgctgtgcctttgaagagacagaagagtgaaatcaggacggaggggtcggggcccagtgaagactcactgcaggcgctagccttggaccccagcaagtacgaagggcgttcctacgaggaaaagaaacagttccttagagattattttcacaggagaccatatcctagtagaaaagaagtggagctgctgtcttcactcttgtgggtgtggaaaattgacgtggcttcattctttgggaagagaaggtatatttgcatgaaagcaataaaaactcacaagccttctgtacttctaggttttgatatgtctgaacttaaaaatgtcaaacacagactgaactttggtgagtgtgaatcacaaaagctgtagaagagaaagtctgaagtccggctgactttggacatcccattcccacctctcactcttgttctaagtgtctgaggcccttcaaggcgttccaggtgctcagaaagcctgaaaaggaagcacacacttccacagatgagctgttctctgcagttcgctttgcggctgtttcagtttttccttctgtcatgtaaattaaatctttggtattccatgcacgccttgtttccccacgagtgtcagtgtcagtagcaacagcctgcaatctacaaatacttggtttttcattttaggggatttctgcttgtttgagaatacttgattaatagaaaattaaagcatcgctccctcctagtttacagacatcggctagtgacagtacgtgtctagagaagccagtgctctggatgtgtgtggcccctaaggacacacttgaaagcattagcttttcattctctgagtgctgtttgtttaagacacagatttgatttacaccttttcaagtgttccctgacagctatatttttaatatcataattcattaaaaaaaaacaaacctcaaatgttttccatttattaaactatcctgaatctgagatctggtgtgtagtaataatcaagtgttgctttgcaaataaagtctctgtaggaacagaaatgctttatggtgcaaactgtcttttgctgtgatgacaagtcatttctctattcagaggtaagacagacttttagtgcctttagagtaaacggaaaccacgcaggtgcttccttcctcagggtcgcttgtagcctagcaggaaggaggaacccgggacagacatgtgggtcctgctcttgactgagacacaacttgagatggaattcgggtttcaggcataaggtgtcaagcagaccagaagctcttcctgtggttagagtagctcggggtagatgtgttagagttaggtgttcaggtgaaggggatggtgagtcagtgaattttcacagtcctgtggatgccaaatcttgtttgtttgtttttccttctgtgataagaactaatgtacagcaccagaattgataatgaggaccagccagctctggtccaaaccatccctcggtgatgcgcagcaagcagggggtttggcccaccttcagaatatgagggcttgatggcctctgagaagcactgcagtgttgctatatagcatttttaaatataatacttgcatgtgattactaaaatggattttgaggcaattatttgtgacttggtatactctgttgtaaattcagagcttgttggactttattttttttttttttaattttcagagtgtctatttttgaattaaaatttgttaaaccactgaaaataaaactgttcaattcttgtaacgctaagacattactcttaagtcaagcagggtggtgtatact

SEQ ID NO: 25659 - DNA, 1170 bp, Mus musculus
cttaatggcagaaaattcactaagtttatttctgttgatgtgttttatttaaaggacaggatggagtacagattgaacttctgagagaagtgggtttaggtgattgcttagagtcagcaagtgaggagtttggactaaatccattgtttctatagcccttaagttaataggagttgatgagttagcagggcactgcaacatggccttccagtcggaagcgtcagctgggagagcgcactgtcctccgagctgggatcttggcagtgaagcacacagatggagagtttaagggaggcctggtgacttgttcctctgtctaagactctcttctcttttggcagagataccggacaaaaccatactgctgtagtctctgtaggtactcaacaaaggtgctcacttccctcaaaaatcacctgcatcgatatcatgaagatgaggctgaccaggagctgatgatcccctgccccaactgcccgttctcctcccagcccagggtggtgggcaagcacttcagaatgttccacgcgcctgcacgcaaagtccagagctacacagtgaacattctgggtgagacgaagacatccaggagtgacgtgataagcttcacgtgtctaaagtgtaacttttccaacactctgtactacagcatgaagaagcacgtgctggtggcccatttcaattacttaattaactcctactttggtttgcgaactgaggaaacaggagagcaaccaaaagcaagcgatcctgtttctgtggataaaatcctgccatttgacaagtactactgtaaaaaatgcagtgccatcgccagtagtcaggacgccctgatgtatcacattttgacatcagatgcacatagggacttggagaataagctgaggtctgtgatctcagaacacatcaagaggactgggtttctgaagcagatgcatattgctccaaaaccagtgacccacttggctttaccgcccaacagcagtgctccgagcattgcggcccctccaccctgcttccagcttgctttgccacagaacagtcaaagctctggcactgtgcagtcagtgactgtgaccccaggcacttctgggagccttacacactccccacctaccactgcccagtctcacgtagctttggtctccagctctttgcctgtgtgccaga

SEQ ID NO: 25660 - DNA, 1175 bp, Mus musculus
attatgtgtgtgcagaatagacagcttccatatgagttctgagaactgaacctgcaagagcaacaagtgctctgaactgctgagccatctctccagtcctgttcagttatgagttctttattctggatatatcagaaatgtaatttaaaaaaattcccctctttttgtggaatttttgcttttttgatggtgcccctggaggcattaactttgttgaagtctgcctagtagactttttcttttgttttgtgtactttttggtgccatagtgaggctctgttggcagatccaaagccatcaaaatgtattcctaggttttcatctaagagtctgcagtttagcttctgttttaatgctaagttctgatgctggagggaagagtcatgcttctgtcttgcatggttgtagtttcctcagcaccacctgctacaaatgatgctgtaatgtgttaactagctctgctgaaaccatatttgtatgtgtgcatgttagttacagttctttcttcttttttaaggaaaatctccaaaatgtttcaaattcctgtgcagaatcttgacaacatcaggaaggtgcggaagagggtgaaaggcatccttgtggatattggccttgacagctgcaaggagctgatgaaggtgagtgacaggggacagcgaggccagagagtggccaggtaatgaggagtccagtgttagaagtcacagagcaggcctttggagtggagattggagagttgagaatggataaaattcctcaaaaaaatgggatttcctaaagctttgaaagacagtaggatgaaatctaagagatgtaaggtaatgacagatcactaaggtaccggcatcccacggggctctctgagaagggatagaaactatcgggggctcttcaacaatatttatacttacctacttattgttaagaatcctggtaacttagttgttcactactagatttcagttacaaataaagcctaattcaaagcctgaaatattcttaataagattaagaaactggccaggaattccagctcagaggcagaacacttatttagtttgcatagttctctgaaccaaattttctacaaaatgtaaaaattcaaatggataccttctgggtttccacagccagggatgaagtaagcacagagtgacccgtggtcatgagtagac

SEQ ID NO: 25661 - DNA, 1152 bp, Mus musculus
gatgttttagccacagcggctgctctactagtctgtgcttctgctagcacacatggcccccttggtgcctgcccctggacccagcacaggtctgtatgttctgggtggctgtctatataccaccacgctcaggtgcacacactggtcccccgagccactgtccaggatcaccttgctacatccctgtcaccctcagatacggtcagagatgggaagatgtagcacgggtcctatgcagatggtttgctccttacacagtgctttggagtgtggtttgggctctgtgtgaaggcttgcttctcttctctcacaggaacgccgatgcccaggtaccacatgactccccagaaccagccgcacacccaaatctgtgtgggattgaccacgaggcgctgaataagcaaataatggagtacaaacgcaagaaggagcgagggcttcagtgtcagagtctggcgccaccatcagggcgggagcaggcacctgaaccgacccgtctgctccggaagagagagaaggtgcgatcccggtggcagcaccgggacgcttcccccagaagcttccttttgggcgaggaggacgaggacgaggacagcagcacagagtgggaatgccacgcccacgaggcagaggatgatgatgatcatcaggaagaggagctcggagctgacagaggcgcacagcggggcctctgtggcaagagagagcaggggtagggctggggcctccgagctgccgcccctgcctgtgggtcagactgcaggacagagcctctggtgtaccttctgtcgtagtcactcacggaggcggcctgacctcagcggcaggagaactgcacccatcggactgcacctgcagacctccgcagccagtcctcagcgattggtacctacctggtcccggataaataaacgattttgtatttactctgagaattttgtgtatacgcacaatgtattttaaacatatctgcctctcttgtctcccttctaacgtaggactcctgttccctgagtctccctcccagctttgtgcctcactgaagctaattggtgctaccctatgtaacatgggaattgggccgtcattggagcacaggcaaccatgagggttacacccatgctgtccttaaagctaactcttccttccccg

SEQ ID NO: 25662 - DNA, 1130 bp, Mus musculus
tctgttggccgttctcagtcacttcttataattgtaaagggtcctgagaccccaacttttgagaattggtgagctgcttggatatagtgaagctattcagtgtcttagttcttaggtttctgtcgctgtgatgaaattccgtggccaacaaaccgatttgggaggaaagggtttgtttgacttacacttctgtgtcattgttcatccctgcatcaggacaggaacgcagacggtaggaacctgggggcgggagccgatgcagaggccatggaggctgctgcttattggcttgctcctcaggggtttctcagcctgctttcttacagacctcctgctcctctctatagctcttgccctcccttcatatattactccatttcaggaagaagactgtgctgggaacccacgggtggggctcatccagcatatctgtttgtctgtctgtgtactgtctcatgttctgtatgagggtcactgggcatcccttccatagagagtgtctgcagccatcaaggaaggatcagaagcacgttagcagagtggaacacatctttgagactgttgtgattgcctgaagtttcaagggattgcagggcctagacctcattagtctggtctgtatcacattactgagctgtaccaaaatctttcgggtctagcagggatgtcaggtcggagtccttccagggagtgcccactgagtataggatgctgtgagtccaattcaaacaacttgttaattaggcctcggtcccttggaagagtgaagaccggagatggtatggtgcatcctatatgatgaggcagtatagaaaaggactcaccaaagctctgcttcccctctcccccccaccccccgccccgccccatcaatgacccgttgtcagtagctctctcagacgccccttctgcctccatagtgagcaagtcttcttatctcctggtaaatttgtgagtttcgtgtagtttatgtttggttcctctccactaagtgtcacgtgctctctcctcaggcatcttctgatatctcagcaaaccctgagaaatgttccacccatagtgtttgttcaagacaaaagagacttggtcctggctgaggtgagcttttaccgtgattagccttttttttt

SEQ ID NO: 25663 - DNA, 1158 bp, Mus musculus
ccctcccaacccaatcttgttttcttgatctaggaagaagttttggtatgaaggtccctccctggggtctcacttgacccccaggccatccaagcatgagttcctcacgaagaccacctcaaagaagactaggaaggaagacagcatccgcctgagggtcctgaacggccttctctacaaatcattgacggaactgctgtgcactcctcaagtgagccaggaggtctacgacctgaatgtggagctgtccaaggtgagcgagcagaggccggggttggggcttaggactgtggtgaggtttataaagagagcgtggggcccaccatcttcctagaaggggctgtgagcagtgcggtggggcccacggggttgagctgagagaagggaggttagcgtgggtgtctgtgacccgacttcccctgggtgaatgctctctggctgccatcaccagaataactggcaagaggcaggagaagctgtagcgcctatctccagcacgctgtgcgaactgtgcagactgaacgtaaagtgacaagcgttggggggcctttcaggtctctgtgacttcagacttctcagcctgccgagtgtactggaagacgggggtctctgcggagcagaacaagcacacggagtcggtgctgcagaggagcgctgcctacatgaggtgatggggtttgcttcctacgagtaacgccttctaactgaaccttaagtgccttggccgcttgtctgtaggtaaactttacaatttcgtttgcattgaggatttttgcctttcaggaaaatcttagaagcgtctccttgattcctagagtataaattgcattttcctgtgagacctaacctaatcagatttctcaaaagtctcgtggggctccacaggtccttccagggtgctgtgaggcaagaactattttgactgcattaaagttggctcttgattccactgctgcccaagcttgctgagacacacggtgcctgatttacctaaaagcatcctggataaacaaggaaaagagtaaaaagagcaccattgtaaatgttggtccttggcgggaagcacaggcaggtctctaatgtctgctgaggcaccgtcctccctaaggtcctccctaggtgagaattcctgctggagtgaaccactgaagagcagac

SEQ ID NO: 25664 - DNA, 1241 bp, Mus musculus
tatgtggttctgggctccaaggagaatcagggtagcacacttcctggttctgaagaggccagtcagcaggagaacctggccggaggtgacagtggtagtgatggcaaagacagcactgatgtccaagacagcttgcagaccctagggtccgcctcctagagcctgcctgcctgagcactgcaggtccttgtattttagccacattgttcttgggaaccttgctctgtggtccctgaatgggacctgaatggctctcctttcaaagctttagcagcaaccttctgcataacctgtgtgatcatggaggcacacctagacacagaacctgctgtgcgggagtcaaggaagccagcccgaggactgccgtgcagccctttcttggcttctccacgctgccgtcacatgctgctcagtactgttctgactgtgtcctgcagctttctgcttggaatgccaaacaggaagtggggacaactcgaggtccccagcttccagcctttgcattatttatctgtttgtttgttttccttggagtagaatcatcaagtactgcccttgctttctgtggaaactgccctgcccggccctccctctttttgaagaagaatggtccctttcctgagggagaaggtgataggtgttagactagtacacaagcagaatttgtagctctaaggaaagaacacgcagaaattaaattgcattctctaacctgaaaaaataaaaatataaaaaggagtacacgtttgttgtgggaattcattggtcagtccttacctggtgctttgggtttagtctccagggcacctctgccgaggaaacattccacctggtggggtgttgggttttgctgaagagttataaaactaccgaggctttcatttttgagaggacattgctcttcccagtttctgtctatagggactggggagtcgagttggctgtaaataatcacaataatccccattttgacctttattggattggtagttaaatctgtagaaggcaggttcgtctttccattattaataacttaactttgttgtattgcatatgaaatgagtatttctactttatgacacttaagatgttggcaagccattaaaaatggacagactaagccagtggtgaggaacccctttgatcccagctctccatctagaggcaggcagacctcgagttctaagctagtctgatctacacagcaagtcctgggcctgctgggactacaagttaagagc

SEQ ID NO: 25665 - DNA, 1202 bp, Mus musculus
ccagtccactccctccccctccagatgtagccaggtgcacagtgtgccctcatcacatgccctcctgaggcagtgaccatgacattggttttgtgctgagatgactaagggcctgcatgcttgccagagtctcatggtggccctgcttctcttctctcttcagaggccacaagaggaaactaaatgaggaagacgctgccagcgagtccagcggggagtccagcaacgatgatgaggagggcagcagttcagaagcagatgagatggccgctgctctggaggcggagcttaatgacctcatgtgacttggacccgccccataccagcccttggcttgggtcctttttctccagaaaaacatatattttgcagagctccacatacagaaacacattattttgcagaaataagtgtttgtaagaagttttactataggaaagtctacttttttaagcagcaaagtgttctgaggagttggtgtgtgatgccaaagagctcaacggggcctctcatggtgagcgtggatagatacgtgatgtctggtcatgtagtgagggccttgggggcttgcctttgaatgctatagcatatttagtgtgaggactggggacccagtaagatttagagagcaatatagcaaaacctgtcatcttggacctttttcacagctgatgctatcataattttgaaggatttttaagtaaaacagcagtgtacatatgtgtgtacaggacaccaagactcgcaggcaggcctgagagccccagccactcttccggccctcggcggacctgcagatgacctggagttcctgattcaggtccctgtctgcagcccgggctgcctgggccacagcctgccagtgtgggcagtgtgacgaaaggcggcctgtactgccctaagaaatctgatgtaaagtttttgtatatttcatattccacccaccagattctgcttccatttaataaaaccctttttgtaagctgtgtgttctctggtgtgtcacagcagtgtgcggtcctctcttcaaattccctctcagcagcccaatgccatgttgggttagggtgaccatgcctgagcttgtcagagtttgtagaacagcacagtggcccctgtcttcaaagctgtctgaacagaagggccatagtcattctcttcccagcttgttctgctaagctgtggtaatggaagaagtctag

SEQ ID NO: 25666 - DNA, 1522 bp, Mus musculus
ttcatcacaaccgtgaccttcttgtggaaagtgtcagccatcactgtggtcagctgcctcccactctacgtgctcaagtacttgaagagaaagctgtcccctcccagctactccaagctgtcctcctgagtggggcatgaggccaggtagagactcatgcgctgggcagcatgagggactggcactgctggcgggctgagggcgagctcacccagcattgcactgcgtgaacagctactgagaggaagtgacagcctcggcacagctgggcaggcttcgctcctgagcgccagaagtgtaatttctgcggtggtgaactgcagaaagccattcctgatcagactgcaggggccatgcctgcacatgccattgcacctcaggagacagtgggtaactcgtcctcttcagatgcagttttgcttttcagcggacaccacacacacaagcccaggtggccaagcggtgacactgctgtcctaattccgttgcagctatgaatgtaaaccattcctcaaggcactgctgttagctgatgcattttatatctgtaaaaccatactcagaactgtttacgtagaactcagctgtcctgtgctgccacagcaccaaccacaatgctttgctccctgagtaggagtcctcgtccgtgtgcttatacccggcactcgtctgagcctgtgatggcagagcctctgtcgaaggctgcactgagggctcatgggagctctttagaggaattctggccttagagttagccccaggagttgtgcgtgcagctctgcactgtacagcgtgttcctgtcacacagtggacctcttggcctcggctcttcacgctcgggagcaggctgtgggagtctcctttgcactagtactttgtatatgcctgtgctcttcagcttgacctcccctcagacgtggccactgagaccctgacttccttggggaaggaagcgcacgctgtgagaggagccttggggagagccttaaccggccgtgagtgtgtgcaggccctccacccgctcctccctgtgagcaaataaagctgctcagccatccatcccagatgcctttgacctgagcgcctttgttcttagcaacctgtgagcatattcccctgacagacgaaactgcaaccagaaaagctgtttctcccattctccacacggtgtcactgtttgctgacagttcacgggctggtttcctccctgctctaagagggagcccagaccagcttgtctgacctcagcttatctgacctgacttcgagatgcccccatgccctcattgatacagcgtgaattaagaaagtgccagaaggctatgagccaaggccacagtgccagggtcagggtgtagactgagtgctggtcactcactcctcctgtatgctgggtagaaaggaacacacaggaagctaacagcatgcttgtcaagagttatagaaagcctcacaagaccatgaacctctgcggttcagctgctttgatgcagagcagaccttcccacagtggtgaatatg

SEQ ID NO: 25667 - DNA, 1163 bp, Mus musculus
tccaaaaggggattatactaaggagcctcaggtaggactgtagagagagagaggctgttcacaagtgctggccacagagcacaagtcacaggcatgcagaagaagctacagtgaatatgcccctgcgggatgaccagaacctatcgtggtgacactgccaaagaagtgacagattatctgcacaaaaatggagacaaactgagcagagtggtgcatgtctataaataatcccagcacgtactaggctgaatcaggacaaattgaggccagcttgggctatatagtaagtttcagtctaatcttggttacaaagtaagaccctatatcaaaaaggaagggagggtagtagatgtttataccaatttatttaaataaccccaagttgggaataaccaagatatatttacacaaatgaaaaattggttcagcaagtatggcttatccaccgtgagataccattcagttgtaaggaaggcactgtgcacacccacagcacagatctccagggcatgacatggaatctgggaagccatccataaaatggactttctacctaagtctccacagtagccctacaatgaaagagagagacagagagagagagacagagagagaatgaatatgagagaatatagagagaatatgagaaagaatatgagagaatagagagagaatatagagagaatatgagagaatatagagagaatatgagagattatagagagaatatgagagaatatagagagaatatgagagaatatagagagaatatgagagaatatagagagaatatgagagaatatagagagaatatgagagattatagagagaatatgagagattatagagagaatatgagagcgaatgagaatatgaatgagttaggtgccatgcttgatggctgagtgtggacacatttgggtactagtgtgaagaaagttagggtttctctgtattagatggttgcatgtgagtctgacatcatccaaaatttaacaagaacactggacatggtggtacaacaccacgtaatcccaccactaaggaggctgaagcaggaggatcacaggttcaaggcctgactgggctttctaggaagtttctctttgtccttggctgtaagaactgtttcaaaaagcaaaggttaataagaaaactctgat

SEQ ID NO: 25668 - DNA, 1176 bp, Mus musculus
ctgcattgtaccccaaatcctctttctttaccttagccccagctaaaacttttccacttttagtaggggtaaacagtattttattgtaatggtattatgggacgataaatgggttggcatattttattttattttccaattttttttattagatattcatttacatttcaaatggtatttcaaaagtcccctataccctccccctgccctgctcccctacccatcccctcccacttcttggccctggcatccccctgtactggggcttataaagtttgcaagaccatattttcacgtacctattgaatgtatttccatttcccatttactatataaataggataataactcatctaaggcctcctccttccttgtccaattaagacctgagccccagccctggagtgtcgaggggattaccctgtgtgatcaaccctgtgcatgtgtgtgctgctgtacttctgccagacactggcctgtgactttatacagtggactaatattacagccctgttgaagcaatttctgtgatgaaactgaagcagtcggatgctttgcccaggagcacaggctgctgtggttgtcaagcccacccatcttagatctcggtctggtctcttcctcgcccctcagtggcacacttagagtggccctcctgtgggctgggacactgtggtagggacaacttgaagacacattctgcatgtttcctctagcttcccttgaagtggccctgcttccttgtagtggcctacagggaagtggggaccagactgcaacactgcctgcgattgttgtgggggtctccaggcttcaatgcatcagtctaggttctctgggaaccacaaacaagagccatttccttacagtgtggaaacatggcacgagagggcctgcgaacccttgtggtagccaagaggactctgacagaagagcaataccaggattttgaggtgagctgcatcagtccttgtcactcaaggctcttcctccttatgaaaactttgttttctccatgaaggccaatcttcctgtgcaagtataaggccagtgtttctgaagtttgggggcatggactatcttcctccttcctcttaattggggggcggggaatgagtgtcataaaggcaggtaattccatctcctcagcagaagctgagagtctcatccctcact

SEQ ID NO: 25669 - DNA, 1099 bp, Mus musculus
tctatgtccaacactgtgtcctgctttaatcaaccattcttagccaggctggctcctggcagtatagggagagttaaacttcaggagtattacctttctaccaataatgattacttttcagaagtaggtcataaggctactaaaccatgctaacgtggggctgggtagcgtcattctccagcccagtgctgtgaccgagtcaatgatgacttagcttcctagtttatgccttacttagaggagcagaagttgctattacaccaactcacggatgtgaaccaggcacagagactcagattttcttttttctagagccccttccattggtttagactattaacacgacatgcttagagaaaaactcctaagcctccctgtcagagtgaccattctgtggagactttgcatctcctaacagatgtcccagggcacagtcagtgtgtgaccagccctccttgtggagctgcagcgctttctcaccctgcctgtgctcactgctaatcttcctacacagggacgctcactcagaatgaaatggtatttaagcggctccatctgggcactgtctcctacggaacggacactatggacgaaatccaaagtcacgtcctgaattcctacctgcaggtatgtgagtgtatttctgaatgccatcttctctcagtgcacccaccgtggtgagctaatatgctgattggattattttactttttatcattaccctcctatcagctctagtatctcaaccaagaaactatgactagcatatctgtatcagcagattcgtgggaaatatgatgagctttaatcatttatttgttttttaatgaattctttctaaaaatagtttagtaaacagtattttaaagggtaattaatagaatactggctttgctgtttcctaataatccctttgtctttatttatacttaaaaccttctcacattaaaaaacaaatacgttctgttttttatcttttcagtgactaaggtaggtacctcagcaccatgctcccttggcagctcacaaagtactttctgaactcactatggaagctacactgcaggaaggaagctatccaactcaaaattttggagtc

SEQ ID NO: 25670 - DNA, 1137 bp, Mus musculus
cttagacaatctcagtgaactccaggcagtggctgtactcacagtaaaacagcagaaatggtgaaagttaggaacacagtggaggtagccaatagaatcatcagaaatagtaaaaagttagaggagtacaatagaaaaaccaaacagaatcacatgctgtcctcacctgcaggatgttcaggaacttgtgtttttcaataaaagaggagactgggcattgtaatatatgcctttagttccagcactctgaggcagagacagacaggtctctgtgagtttggggccatgctgatcttcacagtgagttccagacatctaggactacatagaaaaaccctgactcaaaaagagtagagaataaaggttggccaatcttaagagcagtgaaaatcaaagacatagaaggagatccaatccagtattgctcctgtctagggggagcgcagggacaaggagtggagcagggtctgagggatgggccgtccaggggctgccccacctgggggtccatctcatgtgtagccaccaaacccagacacttgctatgctgggaaatgcttgctgacaggaacccgatgtagatctctctgagaggctccgtcagagccttatggatgcagatggggatgcttgcagccaaatatcagactgagcacgggaactccattggaggagttgggggaaggactgaagcagctgaaggggtttgcaatcccatgggaggaacaacagtatcaaccaaccagacccccaaagctcccgggaacaaaaccaccaaccaagctgtatatgtggcagacgatggccttatctagcatcagtgggaagggaagccctaggtcttgtgaagtctcgatgccccaaagtaggggaatgctaaggcggtgggtgggtgaatgggtgagcacccttgtggaggcaggggttgggggtagagtgggggagttttcagggggaaattgggaagggggataacatttaaatgtgaataaacaaaataactttaaaaagcaaaaagaacagaaattagaggcatggtatccaaaagccaatagagtatgctgctgcacatctgtagttccagctacttggacagctaaggagactcttgagtctgagttcaaagccagcctaggc

SEQ ID NO: 25671 - DNA, 1162 bp, Mus musculus
gttgctgtgaagagacagcatggccaaggcaacttataaaagaaagcatttaattgggggctagattagtttcagagagtgagtccactaccattgtggctgggagcttgctactaggcaggcaggcaggcaggcaggcagtatagtagtagctgaaagattatatctgatctgtaggttggaggcagagagcgggggtggggggggtggggggggctggtatgggcttttgaaacctccaagcccactttcagtgacacaccttctccaaggccatacttcctaatccttcctaaaacagttccgccaacaagggaccaagcattcaaacatgagattttggaggccattctcaattcaaagcactacaggtgattagtaaaatttggcctgatgttattccagatgaaatgtactgtaacagaagactgcttagctctctggtcttactttaactaggtaccagctggaggatgagtctgcccatttggatgaaatgccactgatgatgtctgaagaaggctttgagaatgatgaaagtgattaccacacattacctcgagctaggataacacggagaaagagaggactggagtggtttgtctgtggaggatggaagttcctctgtaccaggtttgtcgtctgttgctacctgattattacatatgtaactttagcagctagcttaggtgttaggtgttatgtctgttatgttggtatgaagactaaggaaaatgctgtcattgtggaggatactagcaacatcagtccacatcagaggatgctgttctgaaagggaaaaatacgattgattattttatgagacattttaatgattaaaacctggggaaattaggaactttgtactgatgcatagtaaaatgtcatgtggaatgtcggtgtaaatggcattctttctttgtcaaaagggttaatatgaactttaaaagtataatttaatgacagtgtaattatgtgcattattcagctttaatgatttgacttggaatagaattcttctgtttaatcaagttattaagttaaaaattcttcagatttcaaggcatttccatggtattaagttaacacggtctgattgcctttgactggataaagtgcagctgtttgcctcgcatgccatcccacggagtcacgtgtccat

SEQ ID NO: 25672 - DNA, 1183 bp, Mus musculus
atacctctacaacaaaattaaaatttggtaactacaacataaccctcaattttaaagtttcttttatgaagcatagtattattttctttgggtaagaaactacatgagtatgggacttccacttaaagcatggtctgaacattttaattgcattgctaaaccatggctccactaaacagtttaacttctctaaatcttcattctaccctacaaaccatctatccacagagtattgtgtaaagttctgcctaagtacaaaatggggctaatagtcagttacagaaagtgcgggggggggggcagggacagagatggagagagacagagagaagaaagagacaatgagccactggcatcacaatttcaaagaatcaaagtttggtaacaagatggcttaagggcaccgtaagcacttcccttttcaaagtcgtcatcaggcaacgccaatggaggcggggcctatcgtagccacacctccggaacgatccttcgctgttctgtgacgccatcagatggcgccgcgcgggggcggggcgccgccctggggtgcgcttcggccctgactggaaactgagtagactcggctgggagattccgccgagctgaggctgtggggcaggcaggccggagcatggcggaccagattcccctgtaccccgtgcgcagcgcgggcgccgcagccagccacagacgtgcggcctactacagctccgccgggcccgggcccggtgccgaccggcgcggcaggtaacggcgggcccgacccttcccggctccaaggggcttccccgccggcccacggtctgcacggagcccttgagccgggcgcgggcgggccgcggattccagagcccggggccacgggccgagccgcacccagggattcggagacgccgcccgcctctcccgtcgcttcgggagccccaaaacttagtgtgtgggcgagcaggccggtgacaggtgccactcgccatagcgagggtgacaaacacgcctggcagatcagcactgagtcttccagacgtggagcgcttgttaggcccactttatacttagccacaagtgtacacagggctttctgttgacaggaggtgttctggaagagtagagtgaaggtttagagaggctagatggtttagtggggccatagtatagcaatgcagtgaaatgtccagaccttgtg

SEQ ID NO: 25673 - DNA, 1438 bp, Mus musculus
gaggtggtgcctgaggcggcgggtgaatggcagaccctgaccaatgtgttctgatgccttggaaagaggtcagagcaccctccatggagctgcacgtgagggctagagccctagaggctctgttctgaaacttcaagtggtagtaccacgctaatgttttagctaaaattatttgaagaatcattgtcattcaaagactcacaggaaagcgactgggaagtgcacaaatgtagcgttgtcattgccgacaaatgacagagctgggcactgccatgggcgctcaccttctcatggcagtgtgtgtgcgtagcagatgaactgggtctgaatatcattgcggtgagatttgtattagcaaaagacacatcaacatgggagaacacacgtatggtagcgcatgaagttcggaggcagtgccatcacaagcggatgtttctccactttttactctgcattttgctaattagtaacaatcagttctttttagcccgctcttaagttcacgcaactgatgccttgagagactgctgggccagctctctccagcacagaacctaacccctagttctgtgaacacaggcgctgcctcagcagggctgtggagggggcctgacctgcaggcgagggccagctgctcacacggatgaatctgtccggtcacgtgggttaggtcactgcagaagcacaagccataccctgtgagcgggaagtgacagagtcgtctaagggacagtagctgtccctgtccactcagtaaatgtatccgtattttaaggctaaggacacagagcccagcgactgtcctcacgcatacggaggtgtgttgtctcaggagactcttagtgtcatcaggcagtgccccaggggacacagacacgtcccaaaccaaagcctcctgcacggagcagtgtgtgcttcagcattccaaagacagacggttcccacgtgacagcagcccctgaagctctttgtatgttctctatgtaaatacctgtgtacagagacagacacgtgggcctccctccatgtggctgaggagtgcgtgttgtaaatagaagcagtcctcctcctcttcctcacagagcacatctggggccactccccggtgcacctcagacccgtgtcctgttcactgttaataaatggatatctttttcactgtaacagaaagctgggctctattttttttctgaaaaaaaataattgcctttattttctctcattgcctccttggtctcagaagagagcagttttattataaatattatgtggacttgttcactagagtcctgaagagagacatttcactgttattttgaaagggcatcttttgattgtgttcacttttgtcatctgtatataagtaatattgacagtgacataaaaacttttgttatgtgaaaatatttaagtcagagaactgttaaatattattact

SEQ ID NO: 25674 - DNA, 1172 bp, Mus musculus
tgatgagttcggtggggggaatctcaggaactctggactgagtgggtcttaaaggcgttcctgaggtaatttgtgtcccaaatgtgtttaaagacagcccaagtggtctaagatttctgaatgtcaatcctttatttttaattctatttatttaagaaatataactacttacaccatgttttgtgttggggtaaaatgtcagatattagaagggttattgcaacgtcttagagtgtgaacaatctcttggaactgtagagtttatttcttggtgtggtgttagagatctgtgggtaaaactttatggcatcttgggatagcttttggtaggcatatttggggtgtcgccttttctaacctcatagttttgttctgtctcagcaagccttagaaaacagtgggctgtcttcacttccagttgcagctcctcccagcgactgcagccatgctcagacggctacagtgtccacacagagtccacacgcctccagtgtctctgcagagcaagctgatcccatggatgcagagcaggaaaagggacaggaaagccctgaaaagacggataagaaagagaaaaaacttctgaagaagaaatccccgttcctacctggtaatttcctgtgctgttcagacacttccatctgctgtgctcctcttaggaagtgagcccccccttttctgaagtgttttcttcatggcgtgctctcaagctgaagtgcagttgactggtgttgagaaataaaaggcgaacgaccttctgaggagttgtcatgtccttagctcagaggctgctttcctgtgccagtcacagggcagggcctcagcctgtccttgtcttctgactgtttccttctaccagctctccatccattgctctccatccgttgtctcttcagctcttgctttggttgctccttgccctgtggtcccttgtctcaccgtgtcctgcagactctcctcattcttcctgggtcctgcctcagctgccagcctggctgacccttacctttccctttgctccagggctgctcccccggcccagcctgtgcttggcctccttccttgcactgatctagatgccatctttcttcacagttgggttcctgctgtaccagagctgctctcaggggcttttctgcagctgtctctgcagactgacctaggtgtgctgt

SEQ ID NO: 25675 - DNA, 1173 bp, Mus musculus
agagaagcaaaataatacgtgaactgtcaacagttactgatggaaacgtcactcttgcaggacccctgtgccagtgccagaagaaccatgaaggagcgagctgagtgggttttcagggccggtgggcgggcagaggtaacagtggccttcagtgcagccatgtcttctgagggaacaggagaaggttgagagagagcaggtggtgtgaggagagctgagtgagactgggaagctgtggaagcagtgaacaacccagacttgctgtgacctcagaaagagtccctctgttgagttgggagcagccatgggcctggttgaagcagcaggctgggcggggttatgaggttgaatggctgtgccttggggtagacaatagttgggacagccagcagggctgacatgggagtaagtagactgagaaagctatggaagaatggtcttgcaaaaaccgccatgggctttgcttgcgatagggaaaggtttgtctgaaacaggctgaacatttatgaggcgcctgtagtctatgactgcatccctagaagatgctttgcctggagggacagttggagcctggacattggacacctggcagagttctctcattctgaaatattcacagcgattcttcttctctctgactaggtgaaaggccattcaagtgcagtgagtgtggaaaagcttttaaccagaaaggggcgctgcagacccatatgatcaagcacacaggagagaagccacacgcttgtgccttttgtcctgccgccttttctcagaaggggaacctgcagtcccatgttcagagggtccactcagaggtgagcatggtgtttgggctctgagcactataacagtgtcatagatgtctcttgagttaatggttaccctgagaaatgatgttacagttttgaaaatgcagattgagtttatgtacagtagcctattttagcaaaaatccactgatgggaacatgctgttttgttgctgacagaccttggctggtgtggcactcagtgtgtagctcaggctgaccttggactcatggcagtcttctcgcttcagctcctgagtgttggaattacaaggtgcaccactggagcaggcgcttgggactttagtaatgcggaagaaataaaagatcctgtctgtcttcttactacaaataaatattttgaa

SEQ ID NO: 25676 - DNA, 1440 bp, Mus musculus
ggggccgtgccgatggacggcagcaagattctgctcaggagcagccgcaaggaggtggagggtgcggccagcgcccaggaagacactgaggccacggtgccgtgctccttctgtaagagccggttcgagcgcaagaaggacctggagctgcatgtgcaccaggcccacaagccgttcaagtgcaggctgtgcagctatgtcaccctgcgggaggagtctctgctcagccacatagagagggaccacatcaccgcacaggtgcccaatggcagcgaggcctgtgtggagaacggcaaacctgagctgagccctggggagtttccctgcgaggtgtgtggccaggccttcagccagacctggttcctgaaggcacacatgaagaaacaccggggctcctttgaccacggctgccacatctgcggccggagattcaaagagccttggttcctcaagaaccatatgaaggcgcatggacccaaggcaggaagcaagaacagacccaagagtgagctggatcccattgccaccatcaacaatgtggtgcaggaggaagtcattgtcgctggcctgtccctctatgaggtctgcacaaagtgcgggaacctgtttacaaacctggacagcttgaacgcccataacgccatacaccgtaaagttgaagccagccggattcgagccccggctgaggagggggactcagaggaccccctggacactaagcagttcttcttacagtgcctgaatctgacaccatatgtggctggtgatgtgtcccccggtgggcaggctggacggcgggtggctgaattggaccccgtcaacagctatcaggcctggcagctagctaccaggggtaaggtggctgagccggccgagtacctcaagtacgggacctgggacgaggcgctggcaggggatgtagcctttgacaaagacaagcgtgagtatatactggtgagccaggaaaaacgcaagcgtgaacaggatgctccggctacccaagctcccccgaggaagagggccagtgtacctggggaccccatgctttctggccaccttgatccccggccaacctcacgccccaaccgcagggcctcggccaccactggccagggcaagtcctctgagtgcttcgagtgcggcaagatcttccgcacctaccaccagatggtgctccactcccgcgtgcaccgccgtgcacgccgtgacagggatcctgaaggggacagagcagcgcgtgcccgttgcggttcactcagcgagggtgactcggcttcccagccaagcagccctggctcagcctgcgccattgctgactcccctggcctggctgaggaagtggtggatgacagtggtgaagaggctgtgcctgaacccgcatcaggtgagcaggcgtacctgggcggatgaggttcaagtaccccgtgtagccctttgccc

SEQ ID NO: 25677 - DNA, 1163 bp, Mus musculus
gggggcccctgtgctctgtgggcctctggccccgatggatatcgacagaccagagctggacatggccaggagcctcccagcgctgcagtgcaggggcccctggccaaacccaaacaggagggcagctccaggttggcaccttccccgggcagtgggagcctcagcagaagtaccacccccacaccctcagtgataacccgtgttggtgcccagccctcggccaatagcaaaccagtggagaaactcgggggcccagcagtggggactggctttacccctccgaataagcacagtgccccagactctctgaaagccaaattcagtcctcagcctcagggtcagcctccattgaaaggtgaaggaggctctcctctacctccccgagaaccctctgtgaaggcggcccaggagctgagaacactagccacctgcgcagcggggtccagaggggaggcggccttgcaagccccacctggtgcgcctcccaccttaaactccgccaagcaggagccggcagctgaggggcaggagaagcgcttggatatcctcagtatctttaagacgtacattccaaaggacttcgccaccctctaccagggctggggtgtcagcagccctgggcccgagcacagaggtaagaagggctggctccctcctccctggctgctcagaaggtcacagtgtgcttaccttgcctgagccaccagggcacataccggcaagttgctgcctcctcttgacctaggtaccctagctctcaacaggtgtccctctccagagcttgtgtgtctggggcagcaggcagcaggcagcaacctttgaccatccccttcctgtgttgctctgttctgcaacttgacagaagcatgcagacctgaccacatgacccgtcacttagaaaacattggtgcacttgcccaccgtgtttgtctattgaagggacgtgtacgtctttcatttgtgtataaatagtacagaaggcacatacgcagtaccctgcaggcagggtcttgcaggaaatgggtgtgtgcataaagaacggagggttgagctgtcctctgagtcctcaagcagtacttacggtgtccccatccctccttctgtgtcgttcttcacaggcaacagctgcttaggtgggcccacttgtgttccggagtttggat

SEQ ID NO: 25678 - DNA, 1056 bp, Mus musculus
ggcctggtgagcaccaccggatgagtgactttgttcacagattaatgggggtcgccaggcctgagggtgaagacggctttatatacctcttccttagtcacgcaagttcacgtttctgcggtggggtgaaggcccgagcagaggctgcgaacccacgcgacgtgcgcagtcggaactgtattccgcaggtagcagcgattcctttccccgttgctgtgacactgtgtgtgatggcgatacttctgcaagttccagatgtttgcacatatgattttatgcattatcacgaattaccgctgccttgaatgaaaacgttctgtgaaattttttgcaaaagctttactagtttttttttattgtgaaattttgtaaaggcaggaaatggattaagacgagcatgctaaatatatttttcaaaaaaaaaagcaataattttacatgtacagaaattatcctaacctttaatactggtgagagcgacagtttacttaacccggtaatggatcagcgcggtttttgtaggaaatgggcttctgatacaaagacttgtttaaacacacatgtatacacgaaccctggcgcgtggttctctgttctaatgatctgttggattgttattattattattatattattattattattattgttgttgttattgttagttaatgtttgattccaggttctatttgttactgttttaattacttgaccgttcaggtgactgctgcacttgcaagcaatgcaatgttaactggctagcagatatatatatatatatacatatatatatacacacatatatacatatatatatatatatgtgtgtgtgtgtgtgtgtatataattttttttacttacttttcctgatactcctacagcaggtttgtatgagagcggcttgccgtgtcggagcgcttgggaatagccatcattctgaggcgttacttggagcaggagcaggtcgtagagatacattcctctctccgcctgaggcagcgtagtacctttctgttgacggcgtttgttctttttgctaggttccccatcatttct

SEQ ID NO: 25679 - DNA, 1060 bp, Mus musculus
cactctgtgtgtcccctgccctctccagctgccctcttctgactcctgcctcgctctctggctcacaccagcccagcccccaccatcccctgcttcactgtgtgacgtgtcttctcttacgcttttcctcctttcaagtacacattacacagagtttctcaaatacttcaggtgattcactcattcttaattcccagaatgaaggtttaacttcacgaacaataaatacattgtggactcttctcctctggggagttgctcactgctcctttccacacttctgctggttcttgaagtctatgcagtcttaggtggagacagtttagcctctcccgcgtagtacaatttccaagtcaagtggactttgcctttttggttctaaaaagtattagatattttaaaaagtttctccaatatttgcttatttatttttttaagtccaggaagacactggtttctggaagtaaggtgttccaggcggcacaaggcaactctttcaacgtaaaagagctctgctgtcccagcgggctgtagggatgccccttccccttggctgctgtgtgcacaccacggcttctctgcagctgggactggagtcgctctccatttatgctccacaggtgaccagttccaccgtgggcatcacagggctggcagcagtgaccttttcacctcctgggaaccagtcgagttgacacctgtctgggtggatgagggtgtcttccaggtcaaacagtgcctgcagtcccccaggaaggacctgtaagatgagacacctgcctgtcagcacccgaagaacgagttttgttgttttaatgcttataaatcaggcaacttcaaattgcaacttttgttcactgaaaaaaaaaaaaaccaagcatgccccacagacaaggttttccggttacacgtttttgacactaatgattaacacacactgcagagccctgggacatgcctgagtgacgtggccgccaagcaacatgtccctttttcaccgactccactaagcattcgttgaggtgggaagatgcagaagcccatagagtttgtatttctt

SEQ ID NO: 25680 - DNA, 1148 bp, Mus musculus
gctttccaaacagcgatggacattaccctcagactgagccaaaaccagctttcccttttagtcgctgcttcttagtagaggttttaggtacagagaagagaaaagcaagctctgtattgctaatagtgtagcctaaattctccgaaatcacaaagcctctccctgacaaaaacaaaaacaaaagcaaaaaccaacaacaacaaaaaaacaaaacaacaataaaaacaacaacaaaaccaaagtcctgtaggctgtaaactaaccctgttgcctgtgtctgtcatgtttaaagacatcatgcaggaacacatatgaaagcagagcctcttcctctggctacaggtcctgctgcagcaggagtaaagatgaaagcattcttgcccaactttcttgaagttgctgttcaacattaacgatgtaggcttttcctgaaatacagcttagacgcaggtatgttacataggattgggaagaggaacacaaagaggtctcgggacactctctccccctctaggacctgtgttctgccctcctggggagcaggaggcagaaaagtgacttctgtttctcaagggtaaaggacagtgtgcttgcccttttctttcaggccctgaggatcctgtatcccttctccttgtgtgtattctggacagtccttaaaaaaaaatcattagacccaacacaacttaaatctcagaaaagatgtcaatgtgtttcagcgcctgggcacacaattaatctccatctatctccggtaatataaacacacctgtgggatgctttccactgagtacatgaaaggagcctcataataaatctcagactgatcgccttatcatgactgacagagccgctgcaggctccttctttatgagtataatttgggagtgtataaaagcagcagattgatttgcgcagagcccttcccttcctccagtatttattccaagctgtgcaactccctctttttttttattaaaaaaatgtactcacaaaatatggttcctatatttaatttttataaccacatgtgtgtgtgcgcgcacacacacagagcgcgtgcacacacatatatacataaacacacacacagaggagagagagagagagagagagagagagagagagagagagttattacttaaagc

SEQ ID NO: 25681 - DNA, 1196 bp, Mus musculus
cagatgccacaatatcggaggacaaaactcaccaataatctcatgcagctgtgaaccctgctagttacagcaacaactggcctgacaagatatgcctaccggtacaatagtggcgttagtgttatgggagtagctaatcttttatggattggtattaaggaccactccccaagatggaactcacgcctgtcaccaataataagatggagatcctgtggctagtttggtgacaggcctacaaaagcgtctactactactattattttgccaaatagatatagtattaaactgacccctaaagactgtactatatccacagattaggacatctcacacccctttattagagacgcttctatttgctgcagatggctattaacataaagattacaactgttccaggtgctcagccctacatatgacatcaacgtcttaacaatcttcatgggagagggactggaaagattgtaagaacactacagtggatactaaaacagaactgttttctggatacctcagagtggttgtttcatgtgaatttgtggcatttgtagcagtatgcctgggacctgtgtcggatcaaactaaagtcccaacacttaggggggaggttgtcaggagagctcctatctgaagagttattgtcaagtgacggctgttgggcagagtccgttttctgcaaggacacaggtcctgaggtgctccatagagggtcctctccccgaatatacagagagcatcaagtggtctcagtgggtttaaaaagacagaagccatgaagatgggagggaaagagggatggcggagggatacaggaagggctttcgatggggaacggggtggcggagggatacatgaaggattgttggtgatggaacggggtggattcgatcaaaacacattatatacatgtatggagctctcaaacaatgattcagtagttaagtagaaaaggataactgcttgtctttgctgcttcggagctcatgagcagctatgggggcggagggcatcctaggtattttatccttgcaggcagtgtccggccactgcccccagcccggagcctccgttccaaaatggaacaaagccgtaggcttggtgttcatgtccaggctgacggcacacgagcatccgagcatcccggtgacaaagcgcttccccattctgtgcctatcgatctcccatcagtcatt

SEQ ID NO: 25682 - DNA, 1250 bp, Mus musculus
tctggacaccctccgtgcgcatgctcgctggaaaggtcctcaagaaagcttccacgagagcagcgcctcgggggtcctgtggatctgtgtctcgcttcaacagtgtcttggcagtatttttctccatgttaataactttcaatttcaaacttaatgaaatatttttattttaagccccacctcccaccttcccctctctcccatcttttctgtcttattgaacagacccggggatgcccactttattagcttccagatgccttataggtctgtccaggtcgcagcttccagggccatctttcacagcctttggctcctaggatcagccacccccatcttcgtggttagccctatactctggatcagccatgacctctcagatcatctcagaagtggaagctaccgtgaaccatctagtcaacctgcacctgcaggtctcttacacctgcctctctctgggcttctgttttgattgagatgacgtggcttcggagagtgtgggtcacttcttctgcaaattggccgaggagaagtgcgagggcacggagcctctccttgagttgcagaacgatcgcgggggccatgcactcttccaggatgtgcagaagccaacgcaagatgaacggggtaaaacccaggaggccatggaagctgccttggccttggagaagaacctgaaccaggccctcctggatctgcatgccctgggttctgcccgcacagaccctcatctctgacttcttgggaaaccatttcctggataaggaggtgatgctcatcaagaagatgggcaaccacctgaccaagctccataggctggcatggacacaaccagcacagacgggcacacccaagacatctctggacaagtatctatctctttgagcacgactaggaggcctctgtgcctccctcctctgctctgcaccgaccagcctcaagacctctacctgaatgaacctctcaagccactgggcagctttgtaaccaccacggagcctctcccaagtcttggaccaagtaaaaataaagttttttttttaaagcaggagaggagaggagaggagagagagagagagagagagagagagagagagagagagagcgcttctacaaacaaagtaactgtggaatagcgtcttctgctttctctatcaagtgtcccaaaaagccatagtaaccgagttctctaaagatcctgaatggctaatgcatcgtccattttcatagaccagttaacttgggtggga

SEQ ID NO: 25683 - DNA, 1152 bp, Mus musculus
ggctcggggaccacaagccttcacaacctacccattgtctccatctttggagcacgctcttccagaagggtcagcggttacattgctgtgttctactgaagcaaagcttagccccaaaatcacttcattgaaaacagatcccaagcaaaaaaaaaaaaaaaaaaaaaaaaaaacccaagagccacctttattaccatctgagttagtaactcttcttagcgtttagacatgagcagtatctctatgcatgggagtagataagcaagaaagagtctcataaccatgaacagggctgcctattaactccattcccaacttctgcacatgactattcgccctcttggaaacaggtccaaagtataggcattgctccgaaatctaacagtatgtcttaaaaataaatacagcacaaatgctagccaggcatccacaggccattaaagatctgcatgcttgttgaagctacagccgtaatgaggcctctgggatcaaacctgaagactgccccgtccagcagtgccactccatgtgaccatctgcactggcgagcttcacagtccattttcactagaaggagctcgtgtgcccatcacattctggaattcaaagttacagtagagattcacattcgtttaagtgacacttgaacttctgcatcgctccacattaattcattatggttgaaatggaagaatcttcaatgggtgaatctttttcaatctgattgaggctgttacattttataggtgctatttttcaaagcagtactgacagcactcgaagttattaaattgctgaatcaaaagacggacctgcactcacatttatgaactatgatggactggctggggccgcgctgccggaggttaagatgttggtggcattaaacttcatcacagaaccaactgacagcagtatttacccacacggtttactttaatggtttggaagtagcttagcccatctctggattcaaatgaactgagcaagtagttcggaatcataattatcagtggtgcaaggaattcagaggctcattctgtacccaagacggtttccttccgttttctagtgagtagtggattgctggggcccaagcaagtggtctttcttgccttctaagaataatatttttctcatttcccccaactt

SEQ ID NO: 25684 - DNA, 1172 bp, Mus musculus
gttccattccatcccgctggggcctccattcttttgcagctactgagcccagttagtaagtatgtaaatcttttattgtacttttcacttctttaattttcactttctcttttataacctctgtttcttcactgtgaataacttatttttatgtgtatctcaggaaatatacagttttgctcaaaacatttttatacttacattaaaactcctgtctatttattctagcattggatttttctcaatattaacttcagacaattttcttactacattgtgactttctaggatcttgctgtgattggtgactgtgtgccagacctcttgcctattttgtatgtctgggtcatatttggaattttatttcatgaagttacttcattggaatttaacatgcaacataattttgtgcactgtggttccattgctgcctgaatgttttatgcttttataggtcattttagttttctcagtttctgggaattgactgggtttcctactgaaccccactgcctgagaggacagaaggctttctggccacccaattttttgcctttcgatcatttagactgaggtttgattttgcagtattttactttgtagagcattttactggttgctgagatacttcttcttgtccaactggcttacagctatctagaatagcagttgtatcgtttgtgcaaagtgtagaaacttcacacatatttgctcttcttcagcatcccttttgtatgagattgtttgtgtagctacatgaatgagaaccaccttgaatagtgtcacagtttttccttaaactgtgtaaaatatacataagaaataccagtctttgggcaaccagcatcaagtatccttggtttattgttgttgctgttgtttgttttgtcactatcttcctatcttgtcgacagtgaggctaccagccagtatatatacagttccacaaaagcacacttgatagcattacctagaacaggcatcagtacttgaaaatccttttggacatctctggtttgatgatattaattaaaaaagaaagacaactattggacactagtttgcaagggccattgcaacccagttctgaagctatccaaaatcaatgagtcctgcaccccttgcttatttatgcagtcagcgttggagaagtgtcagtggggcaattccat

SEQ ID NO: 25685 - DNA, 1177 bp, Mus musculus
ccccgtggagttccgaaaccacctgaaagagcagcaccccgacattgagaaccctgacctcgcgtacttgcatgctggtaaggaatggaaactggaaagcattcacgctctaacaggtctcactgcgttctccacagtgctcagggtgctcttcctagagttctgtgacttcctcccatgggatccagtgttgatggagtctgtttccggccccgtttgggggttcatcttgctccttccccattctgcatttaaagaggccctttcacctgttttttaatcacatatgcaaatctaacaaaattattgtggagcgtcaatgttaatagcaaacatttaaagcatagtcagatactgatgttggaatctttgaggttttgtttttattaattgggggagcttatctttattatttaaaatgttatgctatattctttatatcactgttttctcataataacatggaggttggaagcatgggactgaggaggagactcaggcgcctttaatgttccatgagatgagcctgtgcgggtatggctacctcttggaatgacgtgagatatgatgtaatgtgtgatatatagcagagactctgggtaaagcaaaatgattcttgtcatctagctttctatataattgaaaagtgtgcctgggcatagaatctctgaacaacaaggaaacacagggctgaggtcatgtgttctgtttgagaaggtatgctccccagagtcaaaagagtgtcctgtgatatggtcctgccagcaccgtggtatgtacagccagtggatcctggcctcctgaaggaaatggctactcacctctgctttaccagacccgggatttcttagtgtatgtctgtgagggagccattgggtgagacatgcatggaactattagctcaggatgctgtgtggataggaactggtgaagcacagctggtgaagacaggctgtgtgtgtaaaccaagggccattttcaggtatgtggttttgctcatgtgatagccacatcagagaacttggtagataaattaagctaggataatagtgccagcaagccaatctctgtctctgtcactccatggagtactatttatactctccaaacatcacgtgtcctccacgtgccttgcctcagcatgtgcgtccaagcagcctgagtccaggggagcagc

SEQ ID NO: 25686 - DNA, 1104 bp, Mus musculus
ccaccatatcagtaagaactgacattatatatcccaaggcaatatcttatttaaaatgtgtctgttagatacataatttcatacagttattttatggacttttatatttgtgttacatagcatgctttctttgtaatttaaaaaataagttattttttcttcattactgtgaatactgatgacttaataaatgtgtatacctaatctttattttaaatcttgtccttgaagttaattgctattttaaattctgattatgtttcttttatgctacctgaaatcagtatgaagtttgtatttacttacatgtggtcactgaagctagagcaactttttatgatttaaagctgtacattttcctgattagtaatatgaattgtattttcttttatacaattggctaagcagtacagttctagggatcttctttaaaatttctgtataaaacaatctgtgttggttttatattcttattaagatctttattttatcctgttaattagtttcgttgttaactacaaataattgttggaaatactgttgattactttaaggaactcagaaaccccactgctctctgctatgactttagggttactgccatggagctgaaccctcccggggagtgctgcttgtagggtagatgagtgatcaaggctctgtagatacctgtgtcttgagatgctgcactgcactattccaacatccagatgtgtctgaggtctgccagctgtctccacggaagcttggcaacagtgagacgagtaaagacaaacaaacactgcgttagatctgaaatgctgccgtccacagttgacataaatgtgtagtggcattctgtctgttttgcctgtaaagttgtagttgtcttttattttgtttgcctggccacctaaattcaaaatatggttaaatagcacttcattaaaattgtattactgttgcataatgttggccttcatatggttaactcataatttggttttgtcaatgtcaaaatcaaaccaatgactgtccaagtcaacaactttgaaaacatttgccctaaatttaatgcataaactataaaggtttttctcttgttttctgttgcgatatcttgtc

SEQ ID NO: 25687 - DNA, 1227 bp, Mus musculus
tttttcaaaaattagctagtcctctacgtggcctgttagtgagttcttcctgtgtgatccgtgcgctcttcccgctggtgattcctgttgcatacacatctctttgtgtccctgttattttatactgttaccctgactctagtataaagtcagggaccacaattcctttacattgaatttcattccttatatttctgtgacattattgcagaaacagaaagaataaccattaaattcatatctttgatatttttgaaacagtctttctttgccatcttggctggcctagaacttctggttcctactgctgcctcctctgagtgccaggatgatatgtgtttgccttcaaattttcttttaggtgaattgtaatggctacagttgatgataatgctcactatttatctttccttgtttcacatttattattatgtaataactgactctacagtatgcttttggtaactagataatggtaggcttctgcataacaaaattatagttaatttttttcttctagaaaatatgcttatgtggttgtgcgtgtacatgtgggggtgtgttttgtgggtgcatgtgtggggatgatgagtggatgtgtgttggtgtttgtgtggagagtagagttccactcctcagacaccagtaaatcctctttctgttactttgagtgttgcccagagctctctaggtagggcagcttagctgtgtagtgaacctggagtttgcctatcctacctcttgattgctggtattatgaatagaggccagcatgcccagctttttgaggggcggcaggcgaggggggagggagaaagagagagtgtaagtatgtgtgtgtgtgtgtgtgtgtgtgtgtgtgtgtgtgtgtgtatgtgtgtgtatgcgttctcccacctgagggggtcacaagtgcaggagttcctgacagttgtgacctgccctttgtgcttgttaggaaacaaattcagaccctcggcaagagtagcatgtgatctaacaaggaggcattcctccaggccccagacccagctttgaaaaatgtgttttgagcattgaatttctgtcttctcctgtggcatacacttggccgactgtggttccctagatcatttcgccttttcatagcatgttgcaaaaatgggaatacagtttttaagataaagaaaaattctcacaagaggtaataacatattattgaagatataggagcatacattttgttgt

SEQ ID NO: 25688 - DNA, 1166 bp, Mus musculus
gcagttcccactaaagtcactatcaaagttgggacttcactctacaccgtagtggtcacttggacattctttgtttctcccagtgtactgcggcaggtaggcttttctctcttgtctgcttttcagtctcttgggtgaatgtcaacacaaatatctgtctcacagcatgtccggattccacaggcttcaggctctttctgtttttccatcatcatcatcatcatcaccaccaccaccaccaccatcatcatcatcatcatcatcatcatcaccaccatgtctttttttcactgtgctgtttttattttttgtcacgtagattttttttatactataattattacgatgatgacttaaattttaaaaagttcctagaaataacatgaaactcaattttggtgttaactcagtgtttgggctgttccataaaatgtcatattgtgtctgtaagactcaggaaaatgattcctttttggtctttatttcagcagaagctggctttccagcaatgatttgtcgtttcagacttgggtactagcgaatcatgtatgtaattgagttttcctctttgtgtttactgctgggatgctggggtcctaaactgtgacccttcttgagcatgtggaaggactttagggagcacaatttatttactacagttatttccagtttcattttttctctcttcatgaggaagtcccattttatgtgagtgatatattttaacaagctcacataaatcaaagccctcataattcaggagtagtattgtggaaggaacttttaaagttaagtcaatactttcctacaagttcatgtatctttagcccttttgttttatgtctctctctggagcactatacaaccctattatttgatacttttagaaaatgttctttccatatcaaatgaaacatttttgcacactttaagatactgtttctctcattttattttgtagacctttgtcttattttaggcaagacttgcttttaagatttctgtcctgttgataggtgtttgcttcccatccagaaaggatacttactctccctttatagcatgtcttgttttccttcagtgtatcagaaattgtttattatatcttggttatgatatgcagatgttggtatgtttctgagaatgattgagactttcttgttccc

SEQ ID NO: 25689 - DNA, 1177 bp, Mus musculus
gccctggctgtcctggaactcactttgtagaccaggctggcctcaaactcagaaacctgcctgcctctgcctcctgagtgctgggattaaaggcatgcaccaccaccacccggcatgttcatgttcttatgttctgtaattaattttttcccccttcagttgaccatttggcctatttgtctatccagcttgtgatgccattattcacattacttttcaaaagctttgtatttgttaatttagtattagtgctcctatatcagtcacaagtttcagccctctggttctccatagtccccttccctaataacattaatcttgaatttgtactctatcttctcttgtaaccaacttaggggttgatttgtttttccccctgtctctataacattttatataagtttcaaagcctgtgtatctgtgtattgtggtttttactttctttgttcctgatcttttgtgcttttgttcttttggaaatgttatgttttttctccaactcccagttcctctgtgctgatgatcttagtgggcttttttttttttttttttttgcaaggcttgtagtgtctcccttaccaggcagggttttctgtacttcttcacatcagttttgatgttttctttcatatgttttattatctcagtgtattctaaacttgctcttattttcttctttgacccactccttatttatgagcatcttctttaaatgatgcatattaattgatttcattttaatgatctatttgtgtgtgtgtgtgtgtgtgtggtgtgcgcgcgcatatgcttagtccacttagtgttgttcatatatatgtgttcgggactgatccctcaaggatcagaagagtgagttgggtgcctggactgggagctgcaggcagtttggttctggaaaccaagccccgtcctgtcctgtcaaaagagtcaagtggtgctgactccagtgctcagccatctctccagatcctaatttcaacgatttatgaatttatcatatagcttttgtgatggtactctggctggcttccttccctgactaccttgtggacagtcttggagtctatgctgtgcgttggacattgttttgattgtgtgggacatatttttgaaataggagtttttaagctacttattaccttattgtttgaatttctatatctttatccaattc

SEQ ID NO: 25690 - DNA, 1138 bp, Mus musculus
gtaacctacagaccgttcttggtgaggaatctggctgctttctgcccttgtccaaaaaaaaaaaaaaaaaccaattaccctaggctaaagtcaagagttttggattaatgacattgtcagaggagagataaagacaacctagtattagctttgttgtgtggttgttagtggtcagtcttatgcagacctatgatgaaaaagaacaagctgaacaaggaaaaatacataatgtacaattcgaggagaaaccaggagaacccggaactataaagtagaagacatgagttccggtgctggaggagctaaaatgtttaaagaaaagccagctggtaagtagaatcaatgctctcaggataaaccacacccaactaaccttccaatttgtgaaaatcaaataaagaaaagcttaagcaatgaagaaaaccattgaaaacagaaagttgattgaaatgtttttgactgagggggtcaagtttggactccagcaagcagcttaacttagcagctttgtccatgtggttctggcttcagagtcaagggtacaagaaaggtgttgtggaacctctctttctatctaaaaaaaagctgctggggccaggtgggccctgtatggaagcccagagaggtcactatgttgatctgggaaggtgaagcctggattgagttagagatccaaaggtggtatagatgctaagagttgtgggggtacctacccgagttctgcagactttgtgtggaattagcccaagaaagagaaatgaatttcagtcaacaaagctgaagttagttggagacatgaagagtggtctgacatttcatgctaatgcagaatgtggagtttgccctgctggttttaggtcctgctttggcccagtattttctacttatggaatggtagtatatatattctctgccactgtatggtggaggtatgtgatctgccttttgattttgattttacaaggggttacggttaagagattgcatgaatctcagaagagacattgaacagtgttgatactgtgatagataggggacttttgaagttgggcattgaatgcatttttgcattatggtatggctataagcctttggtagccacgtagtggaatgtggcttttgaacaagaataattcct

SEQ ID NO: 25691 - DNA, 1190 bp, Mus musculus
aacatcactatacccgaggaggagcattcacacaattctgaggaatttcaaatacatccacaccagtcatctggtactctccaatgtagaaatcctgcagattgttctattttagatgataataccaatttgggtatgtctaaagtactctgtgctcctgattcagtgacagttgtgactgagcaagaatctaattttagtgaaggtcactccttttgtgagaccttacagcagccccttgttaaggacaaaagtatgaaacccagggagatagtgtcccctaacactccctctaacctcagcctcccaggctgtcttcagagtgaaaacctagcgagctctgctgtggactgtgagacagcaaagaaaaaccgtgatgtgttggatgctgttggggatagaagtacaccctgtgaagatgagggaggcagtgtggatgatagtgaagaaaaaattcttgacaagtccccctgccctggagacccagatgggggccattctgccgaatctacttcctctgtggtaatgaaaataccaagagaacaactggacctggatggcggtggccagaacaaggttggatgtgagcagacttctgaagatttaaaagatgtgcaagcaaatcctattcttgagaataaggaaattctgataaattcacaagaagaagctgaagtcattttggaagaggatgccccaacctcgaatggcacagctgacagtaatgatgtttatgagactataataagtattgatgacaaagggcaaacaatgtacagttttggcaggtttgattcgtccataattagaataaaaactgaagatggtgaattggtagaacagccagaagagggtctgacggcgacaggagggagagttagtgagttgcccctgaaagactgtgctcaggggttgaagaagaagaaagttgaaggtggttcttttggtgagtccacacgaatccggtgtgatgattgtggtttcttagcagatggactgagtggcctgaatgttcatatagccatgaagcatcctacaaaagagaagcactttcattgtttactatgtggaaaatccttctatactgagagcaaccttcaccagcatttggctagtgctggtcacatgagaaatgaacaggccagtgtagaagagcttccagaaggaggggccaccttcaaatgtgtcaa

SEQ ID NO: 25692 - DNA, 1113 bp, Mus musculus
gtggccagatagctgcaaataagacagacttcgaagttcacgttaaacagtgccatggaagagagatgcagtttcattgtcagacttgtgacttttctagtccgtcaaggagagacttggaggagcacgtgcacagtaatcagcatcagcacatgacacctgtcctcagctgtcagtgttgttcctttatttccttgaatgaaacaggtcttagagaccatatgaaggagaagcatggcatgggctttttctgcacctcttgtaatctgttcttgtctgagaaagatgtggaagaacacagagcaaccgagtcacataatagtttagtggttcaaccaaagacggcttcatcattgagtggtgattctgttctacctttcagtactgtagaatcagaaaacccggccgattctagagaagactcagggaaggccgcgcaggaaggacctgctgagtccagggcaagccatggaactgaagcacggcattcaagtaagccgcagtttcagtgtaagaagtgtttttataaaacgaggtcctccactgttctcacgagacacataaagcttcgacatggacaggactatcattttctctgtaaagcatgcaatctttattctttgagcaaagaaggaatggagaagcacattaaaagaagcaaacatcttgaaaatgctaagaaaaacaatattggtttaagttttgaagagtgcattgaaagagtatgtataggtgcaaatgataaaaaagaagagtccagtgtttctggaagtggaaggcccgaaggccatgttggtgtgcaatcacaggagcattcccaacgtgaacagagtatgctaacacccaaggagcttccacagtctggtgtcatcaccaaagaggatgaattaggcttagccactactccaaagagagggaggcccaaaggcagcatttctcggacttgttcacactgtggacttttggcctctagtattacaaatttgactgtgcacatcaggcgtaaacacagtcaccagtatagttacttgtgcaaagtatgtaagtattatactgtaactaaaggagatatggaacgtcattgtgccaccaagaaacataaaggacgggtag

SEQ ID NO: 25693 - DNA, 1840 bp, Mus musculus
attgctttgtgagtcagcagtggtccacggatttggctgtggctgcggctgccacctcctcctcctcttcctccttctcctctgacttcccttcttcttccccctcctctttctcttttgtagcctggcttggcactggcagtcactgtgtcacctagattgggaccttaatcataaggcagtcatcttgtcttggtttttgggattacaggtatgaaccaccacacacagcaagattgcctatagaactttagacttgtggtcagattcagtcaagtatgaaggttaatttcatcttgtttttctccgtcaggtccagagtaagcgttttgtattttctttgttcaaagctttaatagcatgtctgtttatttcacaggttgtaaactccagttaaatccaactctaacgacgaaacatcatcagaactttattgagaatggattctgagaataaacatgacaatgatgaggatgaaagtgttaagggagcaaaagatccgaggagtgtttcatcccgcgatgacagttctgagcctgtatctgatgacatggcaaatgtctctgagaattttacgagcaaaagagttttttccgagtcgtccaactcggacggtgttgctgcggaggaatacagaagtgagcgtgcttccaagcgactgagaacagaggcactggagcctgagacaagagagcagggtgcctgtgggttgggcactgtggaagctaatgtccatttggctgaaatgggaaaggaggcctttccagcaaactgctcagaaggaggcagcgctcttcccagtgttttctccccatcttgtgattttagcacatctaatattcttcctctgaaagtagatgaagtgaaaaagcctgctcgggaaatggtttcccttgttcctgaaagacacaatccttttcctccagaagaaaggagcattagttgtagctttggaagtgtagagacaggactcaggtgcggcgtgtgtggctgttcattttcctcttgctctgctttggaaaagcatgtggagtgtcatgtggaagaggggaaggaacggacctgctgccactgtagccacagagcagagagcagctcatctcctcatgagcatgtcagacatactcatgggccgcagaaagtcttttcctgtgatctctgtggcttccaatgtgcagaagaaaacctgttgaatgcacattatcttggcaaaacacaccttcgtcgtcagaaccttgctgctcgtggaggattcgtacagatcttaacaaaaccatcttttcctaaaaaagcctgtgtcatgggaacaaaaaatgttagaacaaaaccaagagcttctaaaccaatagcaaagactggggattcaagagtagtgccgagtactgggaatgactttaaagactgcagaggagccccttctgaagacagtgctggtggtagtgagctccttgttgaaatggtgccatctaggaaaatctcatcaggcaaagcacatgtagttgaggaaaatgttagttttggtgtagctcaaaatcctgaaaatcagaacaaacagctagggggcttagtaagctcagagggtcttttaaataaaccagaatccactaaaaatgccctacagatggcgcatgtcagtatcagtaccacctcaaggccaagatctgagcgaaacctcctagtgttgggtaatagctttcgcagacgaagtggcacttttactttaaagggccaggcaaagaaaaggtttaatcttctaggaattaataaaaggggtacaaatgaaactcagaggatgtatatgaaacactttagaacacagatgaaaacaaacgcacagcca

SEQ ID NO: 25694 - DNA, 1200 bp, Mus musculus
aacatttttgcctatggacctctgccaggctgtatagtctgcacaggtgttcttgctgtatcctgttggtactccctgaagtcttgatccttgggggagggcaggtgggaagcatgactgctttgggactgagtctaggtagaatatactcttagtgttcttgctaagagggactggaggagcaacttaactttcctgccagtctcagagtctactgccatcaagctgagtcctgcaggtggtgtcggggtacccgggtaattgactgtccaagatctccatcctggagcggccccatgtccacctagactcagcacccgtgatggtgattctaatctttgctggggcaggagtacagtgtaggtgacagggcagaggacaggggagacatgactgctttgggacggagtctaggtagaatacactcttagtgttcttgcttttatagatgcagttcactatgttcaccatacgaaagggaactaagccttttgaaatagtatcaaacaatttgtaggttcatttaaacctatcagacacattcttgggcaattttataaagagcttcatgtatttataattgaggaattgtgttgtactctcttaggacagtgaggaggtagagttgttggaacccaagtattcatgaactagttctgtgtgattaaagcaggttctcgtatgcccatttattaaaaattgccccagagttatctagtaaatgtattttagtttgttaaatatattcttgacagaattattcattcaactttataactcaattataaggattttcctggaagagtattcttttgccttgtagaatcagagactgtattttgtgaactctttcccaaattgatgtttctgataggagaggcctagctggaagggctgggcactcctagcacctctagtttcctgagactgcacatcagcagtagaaggctttcatagacagactctaggagtggacttgaaattagggtaggtgacaccatcatgatataggttcagcaggaaatccagtttgaaatggcagatggggagagtgaactttcctgtattctactcagccgtggctgctgcagctcttagttatatgtctggccttgtgttgcaggaggaaagaaccctttgtaggataataacttctagggcttatgctgttttgaatttctcaaggggaaaggtggtgag

SEQ ID NO: 25695 - DNA, 1302 bp, Mus musculus
tttgtagtgagggggtggggagaggaggtgtcacactgaacctcttcttgagaaccatcaggctgaattataaagtcagaccagactgctagctggaacaggggtgctccctagagagaaatcaggaggaggagtcaccaccttcatggatactgactcgtcagcccgcagctgatagctgggttgtttgtttgctagtttgcttgcttctctctcttaggctcaactacatagaaggaaccaaaatgctggctgcatatctgtatgaggtgtctcagctgaagaactgagaagtctcagtttcctcggagtgctgttcctacccagaaacaatctgccctctctctcttccagctttctcgggaaagtggaagtttcttttccctatctctttctcaggtcacaggcagacaggcaagaatggagacattgcctccagctgtcacctgtcagctgtgtcaggcagttggacgtggtcagtcctgagacttactggggacaactgactggccatgattgggggtaggagggtgtctcagatgtggtcagtgtgacttcacctccaggaagtagccagagtccaaaagctccaagtctgtgggaggtactgcccaccatggactgaggctcagggaatatccaggaaggaaatgagagcatccattagctccttgtgctgtgacagcaccatggtgacccgtcactgtgctctgtatcccatcttaagaccctagctgaccatcactggtgtcccctcctgttgctgtccccttgaacttatcccaacagtccccatggaagcaccagtccagttgcagctactactaataaatgtgacaatgagcctctggaggaactgccgtggtctgactttcttggggaatacacatacagttgttcattggtgtgcaacttgctttgtggaacacatgcatatatgtattggataatgtttgggtacctgtcacctcatattgaaaggtgatggccagaactcatagcacaagacttatgtccaccctctgtctccacatcaaattcttaaagcggcagccccgggatttaggcagcaaagatgagcttggagcatcttgtggcgaaggataatgtcagagatgtagaagccagcctgagagcacacaacccaaggagtagctgaaagggagtattaggatagtagaggatcggaaagctgaggcagaagaattgccatgaggtcaatgccagcctggagtatgatgtgaaactctgtctcaagatggtaaacaaaatcgcttctgagttaaaactgcagaagaaata

SEQ ID NO: 25696 - DNA, 1223 bp, Mus musculus
agcagagagaggggaaactaatcaggatatattgtatgaggggggggaaaatctatttttttctaaattaatttattttatgcatatgagtacaccaccattgctgtcttcagacacaccagaagagggcaccagaccccactacagatggttgcgagctaccatgtggttgctgggaattgaactcagaacctctggaagagcagtcagtcagtgctcttaaccactgagccatccctccagccccaaaaatctatttttaataaatgagaaaaccacacttaaaaaacataaacataggggctggcaagatggctcagtggttaagaacgccgccgactgcttttctgaaggtcccgagttcaaatcccagcaaccacatggtggctcacaaccatccgtaacgaaatctgatgccctcttctggagtgtctgaggacagctacagtgtacttacatataataaataaataaatctttaaaaaaacataaacataaaaaataagtaagcatgttcgaatgctgatattgtcccctgcaaactccttgtggcagtttgccatcaccacagggtttttctgatcaactgtaggtgccagcagaggcacaagggctgcggggcaggggtacagccaacttgggtcacagttagcatcacagtggttaccattgctctgtaagggaaagagatgacccgagactgatttgtctttgtgtcactgaatcctcctctagtctcagagaattatgcaagcgtgtcctggagaggtggcaaggcctttaggggaaagccctggggtcctctctgccaccattttatttaccagaatctgtggattgtgtgtgtgtgtgtgtgtgtgtgtgtgttagcaacatgtctgctgtctgctggtccctacaaagactggggaagagagcatcggattccctggtgttgaagtggttgagatgtttcacctgggttctgggacttgaactcgggttctctggaagggcagaaagcactcttaactgctgagccatctcccagccctgagttccattaatgtcctgactgatgatccattctgttgtcttagttgtctacatgcagaatttcgaaaatgtagcattcagttgcaaattgtagctcttgtagccattacttcaaaatgagttaagttgtatctcagactcaggctacagtgtttcattgagtctattgattcttttttttttttttt

SEQ ID NO: 25697 - DNA, 1134 bp, Mus musculus
ttgtttagtttatgtgggagaacaaaaggtgtcaggacctttcccctttgtgggcttatgattgggaacccagagtttagtttcgagcagcatctgttgaggaagctgttaacagctctctgtatagagtccatggaagatgatggaagcagagcaaggtgttagtttctcatggtgacaatagtggagagcagcgaggccagctctctagggcatgcattgtgcacaagataatgttagcaaaactgagctgcccttttttgccaaagtggttctagaagtaaggaaaatatgctgtggtagttttccatcagaggaggcagggggtgaggtctctgcattgagggtcactcaagcatctttttgctcatgtgtctttctagttggtggaccaactgggtgatcccagccatctcagccctggctgtagctctgatgtatcgcctctacatggcagaagattgacttgtctctccgaagccgaagaactaaaagactgccccagagcggggagaaaagaagccagtgttaatcacttccactgacagaaacctccccctgagaacgtaattgtaatatatctgtttccctttcctcctgtgctagtagaacaaacaagggactctttgtactcttcaacttttcaaatgtgcctttttactcaacttcatggtgatgtttcttcactacataatttacttattgtaaacacgatctttttaaaatatatctggcttgtaaagtataccatatgtgtctgtctgtttggtgtattttatttagtgcttagtgtttcagattatttaacagaattgcttaatgtgctaattattcacaccctgttgtctgtgtctcgaagtaaagcagcagccctggtgctagcttgttcttgtcttaattgctcagtggtaatcgcaatcagcctgcatgtgcctatttcatgtttctgtattgcattcctatctctgacaagataactgaatgaagcaaaggacagaagagaagaatgtaagtctccacaccgccaggaggacttggtaggggttagtgtgcaggtctgtggtagcatttttggatagcagagagctaaggacagaaacagaagtgtgttattgtcttgaataatttattcct

SEQ ID NO: 25698 - DNA, 1111 bp, Mus musculus
tccagcccaggtttttttttttaaaatcagttttgctggtctaaggactgaaactaggaccttacatatggataccataagctacactcctagactacaggaacagtttagatcagagggaactgtctttgatagttctttattgtgtgtgttttggtgtcttccatgatcttgagtaaagccagagtgttgaagtgccatcatgtcagaacatcacagatctttagggagagtttcctgggaggagggaaggtttagaaagtgctgtgggtaaaatgaaaatgtgtcagagataggctgaggattttgactgtattatgggaatgatgtgtgaagttgctgttatgtgttgtcaagttttcagcttttcttttctttctctagaatatctggcttaggttggacaatcatcttaagagaagccagtggcaaagaacacatcatgcagcattcgaatctttccgtaaatgacaactctgtcactgttttttggcatgacaaaaattggccacatgtagacacgttgtccaccctggatttgtatggtgccacaccaatttttatggagcagtataaaggccctaacacaagttggtaagttctgattgagcagcttgttggtgaggattcctggaaccccaatattaggtggtgtattattaatttgattgtatcctagagatcttcctgtcctgcattgttccagaagattctgggtgtgtcacacgtagctctaaatttcttgaaacttataacagtaatactgatactctatgttaaaactttgttagatgatttgtggattttctacctatttctacaaataaccagtgatatataagctgggcacggtggcgcatgcctttaaacccagcactcagaaggcagaggcacgggggccagcctggtctacagagtgagttgcaggccatccagggctacacagagaaaccttgtcttgaaaaaaaaaaaaacccaaaaaacaccaaaaaaaccactccccagtgacataattatgatattcttggtgctggagaggtgactcagaggttaagagtatcatctgctcttccagacattctgagttcaattcccagcaaccagatggtgg

SEQ ID NO: 25699 - DNA, 1113 bp, Mus musculus
tacacatgtgcagggaggcctgggtccagtctgtgcatactcatacagtcagattggtggctcagtccccgagatgttcaagtgtcaaggttagttgactctgtcttcctgtggagttcttatcccctcgggggcccctcacccctttaactggagtttttttgctgagtctctgccctgtagatttgcgttgattcatcttttcctgggcaactgaagacagagtgttctttgtagagaactactgtctcagtcaatctcatagtcactgtggtggtctttggttgcccatggaactctgcctatgtcccagtttttgtccaagttggtgagggattcctatagcatgttatttgtgggaagtagtgtttttggatagataagttttagtagtattttctagccaaatattttatctgtggttttgacagatttgtacactttttttttttctttcagtccctatacattgcctcccgacactacatttgtggataactacccagactcaatgaccttttatggagataaaggctttcagctgcatatcgacattcatggcagtaagacttacttcctgtgtagcaccttccacaatctcttctgcaggagaggtaaacctaagtcaacttgttcccttctgaagttagtgggttgtagagaagagaaagtataatccaggttaagaattctccttccagtttataatctgccagccctgctctgttccctgacccttctctttgcatgaggcttgtgaagtacagacagcctctcactctctctgtaacctctagagggaggcttggctcatcttttctgatatttacttccaaatctccccttctatttccaggaattttgtaaatgtggtcacagggtgaatgtcacaactaggatctagtttttctcgtttgcagtgcctcagagtttgccatttgccacgttttcgaaactagggctgggaaaacgcagaatgcacgacctgccctgtgctttgggagagtgtttcatgatttcttaacgcctagggtatgtctgcttgagtgcaagtttaacattgttggtgagtgtattttatagggaaaatgtaacttcattttgcatcattat

SEQ ID NO: 25700 - DNA, 1220 bp, Mus musculus
aatcaatgggccgatgtcatcatgtctcctgggatccctagggtggttgggtcactcaggagatgggtaagggggtgggtgcgtagcagagaaaccatgagcaagggtgggagagctggaagtttagactcaagggaactggttgataagagtggaaggcattgagaaacttctgtccagggctgagtgacaccctcttggaaacaggaacaaaggactctctccagttgcctctaacttcagcaagcgccttggtcttatgcaggggtgaggacacggtaaggactgactgagtagctgtgggataaaatgtagtcacacgatgtgtaggagagggttttggagtgtattatttccagtctgctcaacagtcgcagttcctgtggaattgaacctttaccctgaaatgtgttcatcttctttgtgaattacagagttgcattgtagtggatatgaccttgctggatgaggacaagaagcccatctggtatgtgagttctccagtgtgcttgagatctgcctgccttcctgatttcccgcagccggcttactctttcgagtacatggacagcgtaggaggagtgtgcgcagacctagggtggtttgaaaataccgatgaatacttcattgtcagactggacatttacctcagtgtagcaaaattacaacaatggtttgggaggcaataaatgctgagttagcagtagggagtcttgttattagtaagctgtttgttttttacaactttgtttttattgaaagttaaaataaagcatatttgtggtagtctgtttggtgtcttattttctaatacaaattatggtttgtgactacagtgtttagaagttgacatttttaataaagcatgcctcagtgaagatcaatataaaggtatgcagtaaattaatacagtggctgtttttcttattcctagctaactccccaataacaacacagagagaccaagatttattttcaacttaaagtacgactataagtaggccttataattctaatctagatcgaatcctttaatctaatatggctacctcccagcctaaatcactgagattcttgcatttttaagttagtcttgctctctgggcttcaggtttgctctggaccccttcctcgtgccctcttctcttttcctctttctctccctcctcccctggttggcaggagtcctgccctattccctctattgccttgttgacttt

SEQ ID NO: 25701 - DNA, 1201 bp, Mus musculus
cctaaatacccgggcgtggtggcacaggccttttaataccagcactcgggaggcagaaacaggcggatttctgagttcaaggccagcctggtctacagagcgagttccaggacagccagagctatacagagaaaccctgtctcgaaaaccaaaaaaaaaaaaaaccaaaaaaaaaaaaaaaaaaaaaaaaaaaccgattggcattaagaaggtgcagggtggagccctagaggaatctcagctggtggttggagttgtgctcaagaagactctctccagtgctaggtttgacatgcagcctataagaacccgagcattgccagcattgccctcttaaatgttgagcttgaactgaaaccagaaaaagataatgctgaaatcagagttcacacagtggaaggttaccaggcaattgatggtgccaaatggaacattctctattacaagttagagaagttggctccatccatctggagccaaagttatcttgtctaaactccttattggggatgtagccatccagtactttgctgataggaacaagttctgtgctgtcggtgtgcctgaggaggatctgaagaggatgatgaaggcttgtggaggttcaattcagatcattgtggatgctctgattccacaggtgctgggctgctgcctggtgtttgaagagatccaaattgaaggagagaggtacaatttcttcaccaccggccctaaagacaaaacacgtaccatcatcttctgtggtggcgctgagcagtttatggaggagacaaagaggtccatgatgccatcatgattgtgagaagggtcatcaagaatgactctgtggtggctgtggtggagccatagaaatggagctgtccaaagtcctgcgggattactcaaggacaattccagggtaacaccagctgttgattggggcatatgccaaggccctggagattattccacaacagcaatgtgacaacgctgggtttaatttcacaaacaacctcaacaagctgccggctcgacattcacaggagacttgggtttgatgccacaaacttcaataagcttctggctcaacatgcacagggggcatgtggtatagggtggacatcaacaatgaggacatcgcaggcaacttccaggtatttgtgagggagccagccatggtgcatatcaatgctctgacaacagcttttgaggctgcatg

SEQ ID NO: 25702 - DNA, 1156 bp, Mus musculus
caggtcctttcagcgaaatcttgctagtgtatgcaatggtgtcatcgtttggaggctaattatgggatggatccctggatatggcagtctctagatggttcatccttttgtctcagctccaaactttgtctctgtaactccttccattggtgattgtttccaattctaagaaggggcaaagtgtccacactttggtcttcgttcttcttcagtttcatgtgttttgcaaattgtatcttatatctcgggtatactaagtttctgggctaatatccacttatcagtgagtacatctcatttgagttcttttgtgattgtgttacctcactcaggatgatgccctccaggtccaaccatttgcctaggaatttcataaattcattccttttaatagctgagtagtactccattgtgtaaatgtaccacatttttttgtatccattcctctgttggatacattactctgttgaggggcatctgggttcttttcagcttctggctattataaataaggctgctatgaacatagtggagcatgtgtccttcttaccggttgggacgtcttctggatatatgcccaggagaggtattgcaggatcctctggtagtactatgtccaattttctgaggaacaaccagactgatttccagagtggttgtacaagcttgcaatgccaccaacaatggaggagtgttcctctttctccacatcctcgtcagcatctgctttcacctgaatttttgatcttagccattctgactgatgtgagatggaatctcagggttgttttgatttgcatttcactgatgattaaggatgcttaggcgaagtcctactccaaaaatcttcaatgaattagatctctgagacgatcttagctgctgcatatacctttattggggttatacctttattggggtgggcttatacacatacactttatttggattggaccaaaggttatatggttttgggaaaaggggtgagaatatccagggtgcacaaagattggctaaaggctaagactactaatatgcctcactagcatggcagaggcattccaggaatttcacttgcaggactacatgacattactcaggtagttgacccccagagaagagaaagcctagctgacaaagctagtctgccattttg

SEQ ID NO: 25703 - DNA, 1208 bp, Mus musculus
cccaggccttcaggtccaagggtctctttgagatacagccctggcagtattaagtagtgacagcatactagtaaaaggtgtctccagagacaaactcttctcagattttctgtattatgtaaagtattttatttttttgtacattttaaattttatgaaagttgcatcatttcccccactcctttctccctccagccccttccacagcccttccttccacctcctgtgttctccctttcgctttcatcgtgatagcaacttcccagattgtgcatgcgcgcgcgcgcacacacacacacacgtaaatgtgtacacaatatataaacaacctacttttatccctcatccttttgctagagtcattcattctacctgatataagaatcaggaagagaccagatggtgtccctaaaagtttttgcagtctctgtgaagaggatacgagtagtgagacatttcctgagggtggaggagctgatgcaacaataccagctaactcactggaaacatcagtccggcttaggatgcataatttacgcttatgcttaacagccaatttaatttactcccacctttaaattcttaacttctctgccccaggcccagatattttctttttctgaggcttttaacttctgaattaaaaacacttataataattttatttcggttgaatttatcctcatagagcctgatattttggcctccagtgaagtttttatttttcttttaaatctttgctctggggctagagagatggcccaaccctgactttaaaagtgcttgctgttcctcagagaccctgagttttattcctggcatatgcttgggcagcccatgtctgctttatctcaagcaccaagagattcttctccctgtctctgtgattcttgaaacttcattagcaggcatgattttgtcctgtgccatctgtgcctttgaagtgtcggttagtttaatgtgagtatggtgctctgatcttaggtaattcagtttcacaggaagatcattcatgagttcacattagagcctggttttagctggacatggaactcctacctaaaatcctagcacttagaagttataggcaagaaaaccaggagtccaagatcagcttctgcttatgtagcaagttcaaggtcagcctaggctacctaagactttcaaacaaaagaaaccactggctgtttgctagggctgggtcatgg

SEQ ID NO: 25704 - DNA, 1148 bp, Mus musculus
accttgaatgacatcagctaaataattaaaaattgtgatacattatgtgagaaaaattgtaaaactatgtctgataccagaaatagtttcctgcttgtgactaccctttgaggatagcattttggtttattttaaattggttaatttgtaagtagtctggcacctctacttacttatcattgtgttagagaatgatgagaccaggttttaaaagttattttggaatgtagactgttgattcagttcaaagttctgcagtggtgttattaaaactattaagcgatagtatttaaagatttctccattcagaaaatatttccagctgcacatgcttttaaaaaaatcagggtaaacatcttaggtcagacctgctggctttgtcatccaaacatatctatagctttacatttttcctctttttctagggtcaaaattgagatattgcaggaaaaggctcagtgccaacatgttaaagagttgtggcatcttgacttataaggagcaaggcacttacttttgatggaatgttacaaagaatttcattttctgatatgtttcatctaatatgatagatgaattatatggagatagtgtaagcattcactattggattaagaactattggagaagtgtaggcttgtgtgcaaaataatgcaagacacttaactatttttttgtaaaactttatttttaaacaactgaagctatatctagtgtgagttgacagtccccacatctacattagatggcaggtgttgtcacatagtcactgtattaatgatgaaggttgagatgacttcatgtttcaaaaatatgcacatgtcctggcaatcatggctcatagaagtctcaggactgtccccaacatgtttcaagtaaacatagcttgtttcctactcttccccatggtgccgtgtggttaggatctacccattaaatgtcaagagtattcttatctttatctaaatatttctaataatcaatttgtgctattctgtaggacaaatctttattatgaaaacaacaacccttgatgaatttccatttacatgctttatatgacctgtccaactcaatttgaaatgattaggttctgatacttgatgaataaaaatcaaagcatttattgagaaatcagatttgcaaat

SEQ ID NO: 25705 - DNA, 1221 bp, Mus musculus
ttgtacatttgatagtcttatgtaaattacttttgatatctcaaatctgttattttaaaaatcttacttttttaaaaaagtttttattgattctttgagagttttacatcatgcatcctagacccacttatcttcaggtcccctcatatccaaccttcacccttgtaactcccccacccccaaataaaacacacacacaaagtatagaaagctgtagtttgtcacagtgtgtcccacagtacatctctctattgatacatcttcacttgcaaatgttcattgtaatgagtaattggtctggtttgagatcttggtttctgtgacaacatcaatactggatccttacagggacttccccctgatatcctgttattgccctatgtcatagagatcctgcaactttggatcaacaggaccgacccctttatgtatcccaatcattcgtagatggtggagtaaaattttatttgtaattcaagtgtaatttagaaaatgcaattgttttttaccataaagctcataacttacagcagagattaaaaagcttatgtgttctttatgcaaaagcatttgaataataaatttttttggattggaacttgtgttaagatctatagaatctgagaacagtcaaaggaactttgttactttttagtcatttgtattgttgttactattatagttcagtgcattgaagagaattctacatatgagcaagttcttagagaaatcctgttgtagcatcagtctgctatattacttctacccagagtaaaaatgtagctctttgggtctatgtgattgttcagtttgtctaaaattcataaagaactttaacctagttgataaccagaaaggtgacacttatttcataggcagtgcaagtgatgaacattttgaagaatgtgtaatattttgtctaaaaccattctgttgacattataactgttaattttaattttcaactgacaattatgacagtgtatcagtgaattatattaaaacaattacacatttacagcacagacagggtttataatattatataacttatcactaaatatgacaatagatcttttcaaatagtcaagtataattgtgccttagtcattaaagtggatgtgtgggaactataaggattttaatagtaagctgggtatcatgcacatgatttcctttattagtgttgcccttgtgtcactggtttattattaagtttgt

SEQ ID NO: 25706 - DNA, 1163 bp, Mus musculus
tagttacattaagataaaatcacagatgaattacatggaattaattggacttcagaagttctttagattaaaagcttttttaacttgatattatcaactgattctaatttaagattgcatcttcactattgttttagatctgtgcttattaagaattatataaatcaatttaagctagaaaaaagctgtattctatgctgtcttagaaactttatagtgtttattcagttaatagttgtaaatcacttggaaagagtaaagctcaatgtgtacccaagaatattcttacttctagatgtgctaattggctcccatgagtaagaattttttagtgtgtcattgataagaagggaaagttggtactatagttgggatgctaatgtaaaactatgctgttgatagatttatatgttagtattttgtaactgtaagttaacccgtattgaaaagcatatgaagccaaacagaatttttaagaggcttatttatagaaataagtgtgggtttatcgttttgtttttatgcctagatttttagatacactgcagctgtccacagaagatatccttgcactgaagatcacatacacggatagtgggttgaaggactgccttcagtccatcattcaggctggaggccacagggatgtgagggctgctatcaccaggatgagtttttatcttttgaatgacaaactgtctttgaaggatgatattggtccatgtggcgttactttaaaatccttggcttggcacactgtgctgaacaggtgagtataaacttaaggccgccagtttgagtgacttgatttgaatttgtttaggatcatcttcaaacctttgtagagaagagtgtatatttgtgcagttgctatcatgagagaaatgctttatacagaaagtaaaactaaacttcaggatagtctgctatctgtgaaaaataataacaaaagaaaaacttgacctcagttctagcatgtctgaagaaacttttttataataaggatgcaacatggctgaagcacgctgaatgtttattcctgtccatattttaaacgaatggagccatagtagattgacaaatagatttggtacacctgctactggctgtttttgtttgcctatgttttcttctcaaataaatgatttgagttttctttctgt

SEQ ID NO: 25707 - DNA, 1219 bp, Mus musculus
attgctccaagtcctgtttactgctcaactcactctgttatgattgtgtgcatgctgcactaccaacatagttctgatattacatgagctcccattggaggtgttgaagaatgtacagttcactattctttactgcttttctaaaactcaacagtatttggaagttggaaacattctgctacctagaatttaagtaaaaaaaaattgtgttctaatgttggctcttattacccattctcaagacatatgcatgctgcatgcgtgtatataggtggaattgcatgctgggtacttctgtatgtgcacatgtacacgcacaggagtgagggatgggggttcggtgtaagatcagtaaatctccctagcctcaaggatgaggtaagcaatgcagttaggagagttaaccaacccctacctcatcatctttaggttttttgtgttataagaacttgtaaattttgttcataacgacctgatagatggaataattttttatgttctttgtacataacaggtcaacgtgaaatgagaccagtgcgacctcgtgactcattgctgtctacttccctgaacaggcagtatgtgtttgttactccgtctctgctgtcagcagtctgtagccttttagacaacctcttggcagttactccaagagatgctgcaaatgcttttcaacaagctcatctcatagaactcctctgtaggtaagagataagggcataaacataaggtgtatgtgcctaacagtatattttcattcgttcttctacccttagtttttcattttcctaatattaacgagcttctgatgatggtttttgaatagcagcaaagccttagctgtcgtgttcaggcccatctaagattacagcttattccttgcctggtgttgttttgtcctgtacagggtattgctgaccgcagcttaaaggggtgagcgtgtggaaggctagggtgcagatactccatgttgtgctgaatgtgacatctcgttcttcctagctactttctcctagcatgcccaccttcttttaaatatatgcatatgtttatttctctgccattctctcttcttacttttgaacagtgctgtctgaaatatcttttttctccttgctaaatcatactgccttttctttctactggaaaaaaaccaaaacccttcatttctgtcctaggttttctgttgcttggataaaacactaaccaaaagcaactt

SEQ ID NO: 25708 - DNA, 1139 bp, Mus musculus
tttgtccagggttagtccctcccacatggggctaggcccactcacatcaattagcagaagggtcattggtgagcaaggggagggggtagagggctttcagaggggaaagcaggaaaggggataacatttgaaatataaataaagaaaatatcaaagtaagtaagtaagtaaataaataaataaatgagtatgctccacagacataccctcaggacaatgaggaggaggcaattcctgaattgtgacttcttctgttcaggtgtatcaaattaacaactgatgctaactgtgacaacttaactttttaggattctttgtttgtcacacttatctaacagtatattcctgttttctgaaatactctgagaaaccttaaatattctttacctggaaaagctctttctctctatttatattcagggttatatggaaacttaatattgtggtgttttgtctttaataagaaacacagtaactgtctatggggtgccctttatccttgacagcacggtggatgcttccctcatagaaatgtgcatccaagaactcaagaccccactgcctttaccatctgctgttgaacatattcaggctcaggtaagcatcttggatctgcctctcacatgtgtcagggggcctctgccttaagggccaaacagcaaattctgctaaggagatctacccacaagaaaaagatggaaatctctcagtatatgtgtggtgttatgtaccttttaaactaggttacttaaaattagtaagagagactgggattggagaatagtggatattttccctaattccatcattaatcactactaaatgtttaatttcttggagtattattttataaagggatactggtataacccacttactactatgattttaggatgtgtctgatatgtctttatttttacctaggttaaacttgttagactagcatgtatgtttgtctttctttctttctttctttctttctttctttctttctttctttctttctttctttctttctttcttcctttctttcttccttccttccttccttccttccttccttccttccttcctttctttctttctttctttctttctttctttctttcttttttgacaggtttctctgtgtagaccag

SEQ ID NO: 25709 - DNA, 1233 bp, Mus musculus
tgtcttgaatattctaagtttctgggctaacatccacttatcagtgagtacatatcatgtgagttcttttgtgattgggttacctcactcaggattttgaaagaccaaaatctgtaggcaactactaagatgaaagattcctcatatatagacatttatgttgtaattttattcttgacctaattacaaaagataaagtctcaggttgatttaaaaaaaaactcatttatattctgtagtaaagaaaccacaagaggctaaagagacaaattcaaagcctgagaatatctttttccacaaagattttgctgaatttagaggatatttgtgtggctacaaatttgagacaaaacttctataaagaagaagaaaaataaaaacaaacaaaaacaaaagagatgagattggcatcccacacagacaaagctggacacttgagaacaggaaagggcaagaccaagcaaaaaagaaaattgccattgggaagaaagcaaaagcacagaaaatacaataaaagccagtatttgcttatcttcaaagaggtcaaaaagacattgtatccataatacataaagacactgtttcaaagagcagagaacaataaagagctgaaattgaaaaaaaaaaaacactttacagaatcacattattattacattgctggtaatgtactattacaaacaattatgtcagtaacaaggcagaaaagcaacacaagattaaaagaaggaatttataaaccactatttaaataagaatcacttctaaatagtatttcagaacatactgctcagtagggattaatttatctagtagataaatcaaaggaaagaatagaaggtttgtaattgcaaaagtatgcaactatacagcgatttgacaaatactacatagcaacgaataaataattattagatttcaaaaacaagatcaaaatgaaaacaaataccaaggaggaagaaggtgcaagatgaaacattccattacagaaccctcttagaaatcacagtaaattatctcagcattctcatgaagatataaaagcattaaagaaaaaaaaaactagtgtaacctagagtgacaggatgagataaaactatgatggtaaatttgttgtgtgagtgtctaagagctaaagtaaaggcaacaatagggaaagtacatgttgtagaattggaaatgaaaagcataaggaaggatctattaggcatagtttgggtatgaagagtcctt

SEQ ID NO: 25710 - DNA, 1184 bp, Mus musculus
cctggcagacaaacatgggtttaagcaagagtacttagatacactctacagatacgcaaaattccagtatgagttgtggaaattactttggagctgcagagtatctttacttctttagagttttggtcccagcaacagatagctttaagttcgctttggggaaaactggcctctgaaatcgtaatgcagaattgggatgcagccatggaagaccttactcgattaaaagagaccatagacaataattctgtgagttctccactccagtctcttcagcagtgaacatggctcattcattggtctcttatttgtttttatcaaccatccaaagggccgtgataacattattgatctcttcctttaccaaccacagtaccttaatgcaattcagacaatgtgtccacatactctccgctatttgactactgccgtcataaccaaaaaagatgtgcggaaacgccagcaggtgctgaaagtgattcaacaggagtcttacacacataaagacccaattatggaatttgttgaatgcctatatgttaactttgattttgacggggctcagaaaaagctgagagaatgtgaatcagtgctcatgaatgacttcttcctggtagcgtgtctggagaacttcattgagaatacccgtatcttcatatttgagatgttttgtcgtatccaccagtgtatcagcattaatatgttagcagacaaactgaatatgactccagaagaagctgaaagatggattgtgaatttgattagaaatgcgaggttggatgccaagattgattctaaactaggtcatgtggtaatgggcaacaatgcagtctcaccctaccagcaagtgattgaaaagactaaaagtctttcttttagaagctaaatgttggccatgaatctcgaaaagaaacttaatcagaatagtagatcagaggctcccaactgggaaacccaagactctggcttctatttaaggattataaagaaaagaagaaaaaggaataagtgaaagacacagtagccattgtgtataaaggatgacaattaacatgtttgctacaaattttggagaatttaaataaaatcggctatgattaaaaaaaatcttgaaggtcaactgatgaatgaacagataataaaaacccagacacaatacaatatgattctatatgtttttataa

SEQ ID NO: 25711 - DNA, 1189 bp, Mus musculus
ttctctagactcagctttgcctctatgacagtcacaacctcgcatctttcatcagaatgcagtcgtgtctaagagtgggtattttgtgataatgtttactatagatcatttgttaattttgatgccttcattttagctaatttcagaatttttattaggtaatgtctaggtcctgttctttgagtatcttagagtgtgttgaaaggatccgctgagcatttacaaacatggtttgtagctctaaccctgaagttacttggggactttgctttgattgccaagggagcttctggtttctgatgcaatactaaccaatattgcatcatagtaatgaattaaagcatgtatatctgtagagcaagagaattgctaattatagtctgtgtccaagtgttcttttcatatttaaaagcaaccatttttaatatttaatcacctatcattaactttattgataattgtgtatgtatgtagtcatggggaatgttcagaaaataaaagaatattctcaaatggaaactggagataagcactgttaaaagttactgtaacaaactcctctatagaataaacttcttagactctttgggaagcttcatggtagtggtcccaatggtcaagccttattgcaggagaaaaaacctgaagtctgtacagatgcctcattaatgataatgtgtggtaagaagagagacgtgaagaaatagggagtaccactattacattttattattgtttatcactaccaaatgttaaatgtatcttgtctggtcaatcatccttgtaaataagttctcaataggaaaaaagagtaaagcacagctttgcattaataaacatatgcacagaggtgattcattgtattctgaaatagttttctttttgaatgagtgctttggttctctgttgtgaagcaactttatattgatcttcaattctatttgtacttttataatgtgcattagggaaaatgtgtaagtggtttgtaagtaaatagttttatttctttttgtattaaacttttgatttttacatgtttctttttgaggatatttttatttgcattgtcagagtgctcacataaaaaaagaacttaaaatttgctcactcatgtgcttttctttttaatgttttatcagagtactatttgcttatcaggagaacatactttagctctattcataatcta

SEQ ID NO: 25712 - DNA, 1205 bp, Mus musculus
gtgtaattccatgatggcgtcagcggtgctgtctgtgtctcgggtctctcggccgctgggccgctgggccgctgggccgctgggccgctgggccgctgggccgctgggccgctgggccgctgggccgctgggccgctgggccgctgggccgctgggccgctgggccgctgggccgctgggccgctgggccgctgggccgggccctccccgggttggggcggcccatgtcgaatggcgcccacggcgaggagggttcagctcggatgtggaaggccctcacctacttcgtggcgctgcccggggtgggagtgagcatgctcaacgtgttcctcaagtcggggcacgaagagcaggagagacccccgtacgttacatcaggaccaagccctttccctggggagacggtaaccataccctcttccacaaccctcatgtgaacccacttccaaccggctttgaagatgagtaaagagaacctggcctcccccaggcaacaagggaccacagcactggttttggacccttctctgtgtggaccacgaaagcccattggatgctaagctcatctctcctttcctcagatggcgaccattactctgatcttccatccctttgcttgtaagaggagatggcttaaataaataacttaaactcaaaaaaaaaaaaaagactctcacactgtaatccaggctggtcttgaactcaccatgtatcctaaactgatctcaaactcacagcaattctctgcttcagattctaggactccaggtataagccaccatgcctgactattttttaattactttattaatgaattaaaactagatatagttgtattatatctttagatatgtggttctcaaccgtcctaattttgcaatactttaatgcagctccttatcttgtggtgacccctaaccactaagttttcttttttttttttaagatttatttatttatttatttttaaagatttatttattattatatgtaagtacattgtagctgtcttcagacacaccagaagagggagtcagatcttgttacggatggttgtgagccaccatgtggttgctgggacccgaactctggaccttcggaagagcagtcgggtgctcttacccactgagccatctcaccagccccaccactaagttttcttgttgctacttcctaactgtaatcctgctactgttaagaatcat

SEQ ID NO: 25713 - DNA, 1166 bp, Mus musculus
gtcgtggggtggcagcttggtggcatggccatcgttagggctcatgggctgacctcagaggtgaaatggttttgatgcaggcggcttgactgtggagaaagcaagcccagtagataagtccatcagccaagctcagaggactggcgcttgacaccaagccatgttattaaaatgaagacagtctcaagtcagcaagaagcctcagcagataaagtgcttgctgcgcaagctttgtgacctgagacaactccctgatcccacatacatgtagaagataagagactccacagagctgtccactgcctctgcacatgctcagtagcgtgtgtccccaccccaccccaccccctccatgcacaaacactagaacaatactaaagacaaattaaaaaaatgaagacagttgtggcagaggtaattgtgctgcagcctgcagggttctcatgatttgatcaagagcattaagctttggggtctttgaaaagctttcagcttattggggggggggtgattagacacggcttggaaagggggaatcctttgccagagagcagaggtgagtgcttgagtgccatcttgtgcatctctgtgctttgggaatgtgaagtcagtagctgtccaaaaccgggtcctgagggggctaactgtgatgaaggtaagaacaggtatgacccagtaggggctaaggaaatggaacagacagtgaagtgcttgccttgcaagcgtggggacccaagaaaggtcaggtgtggcagtgcacagttgcaaccccagctcaggagaggtgaattcaggagaacctctggggctcaccaccagccaaaccagcctcgctgaattagccagggagagaagcttggcccttcaggaacaacacccaggattgatctcaggtacacacacacacacacacacacacacacacacacacacaccaagagcatagtgcaggcagagatacaacatagcaagcaggtgccagttaagcaccagacctaatatgtgtccttagtttttggtggaggtctcttgttctgcattgcagtgaggggcttaggagactaaagtagccctctttgggagttcctccttggcaagtgaggttcgaggctggtatgtaggcagggttgggcctggaagcatggggacacctgcgacaaggaagt

SEQ ID NO: 25714 - DNA, 2025 bp, Mus musculus
tcttgggtattctcatttggttcttgaagacagagtcttgctatatagcccaggctgggtttgaacttgctgcagttgatgctcctgcctcagttttcaggcgctgggatttatttgcccggctgctgatgtgctgttcggcttctttcttttaggactcacaccgctttgggaagcacttgagacaagccatgatggacattatcaccttgtttggcctcaccgccaattccaaaaagtaactgtcggagccgcacggaaggaaaatggactctagtgatacaaaccaaatgaataggtgttgctcctgaccataggacaggcagaaaattgttcttataaaactcagttttccttccagaaggtttaccgtcggtctccctagaacaaccgtaggctccaccgtttgacttgtgaccctactacatccagagatgccttggctccaggaatattgggcacagtcccccgaagtcttttgaatcggctcctaatggataaagggatttaaatgctggtgaatccctggattttgggggttgtatcaatatgtgttggaggtgacagacttcctcagtggtgaccctgtggatacttgggacttgacttcacccaggcagtgagagcatcaccttgtggaaagagaaagtggcttcagagccagtggaggtaacagctctagctaacacacctgtaacacactaatggaatggttaggcctggggattaaggttctgctatgaatgacagccaccatcgctttgggagtccacatttgactccacatttcctggaagcaggataccacctcctcagtgccaccttcgaaacccagtgccttaacgatgggagcccattggcaagtggggccatagagaaggcttagcatgtgaagcctttgggtggatatgtgagggtgctgcttcccctcacaagttcctgcatagagatgtccctaagtaagcacttcccccaccctagaagatgaggtccctggtggagggagcgatgcagaatctcattggccaccagttccattaagcaacaaaataacagatgtgtccacagagggaagtgaggggcttggtagtcaaaggctaccaagttggacaccagctggagagtgtggcagccattggcaaggagagtgagaccctggtcactgagtcaggcatactgacacaggcagccaaagccttgtcatggcagccaggagatagagatcctggcagatacaccaacgggctcatcttctaatcccacccagtcagattccaaccagagcaaattcgatagaaggctaggtcattttggtgacagactcgggggtctcaagtaatgggtgctttgtacccaaataccatccctctgtgagagtgcctttcttgacaacatccaatagactgtaaagcaactccgtttggtattccatgtaaacatagcataatggagtggcctcccctacctgttaccatcctgtcctgacaagtttagctcttcgtgttttaaatcatgtatttattttccagtgcccctttggccttgcttgattcctactcgtgtgctagctgtaacagaagtgagggtggggtggccagaagtacagagaggtgctggctgaacagctcatgcgtgttttataagtatccatgaatacaaaaaaaagaatcacacctacaagggccaaagtttttttcctactaaaaacaagaaaacaaaaggcaacataaatatatagcagagacaactgtaagtcaaagccgcctgaccgcgctcttaggactacttgctaacctctgttactcggagtattcctgctagtacccaagtgtgacattcctctctcaggtctccagtgtccttccttgctgctcctgagcagttaccaatgcaattttttactccttccaaggcagaagagtgggctttcactgtaagtgttcaaaggaggaggtaagactactatgtatttaatgtggaacaaaacatagtcttaccgcagccaaggttcgaatttggttttct

SEQ ID NO: 25715 - DNA, 2565 bp, Mus musculus
cagatgtccgtctcctcctctgcaggaccgaccagccaagcatgccaagcgacccatcagttaatggccctgtatgatgagtgacgtccactgctgctgactgaggactgcaggccaccaccacccaggggctctggagggctcacccagagctactgagccaccactactgcactctgcaagagatcagaaccagcagcctttctgtttctagattctaagatgctgtacagagagactcagacatgtaaaacactgcacattgacaaataccaagaatttttttgcgtatgtttatattgtattgatctaaatactgggtagcctgtgacaccagatcttgccgcccatgtaataatagtaatgatacatagttcagatggttgtaagaatagttttataaagtgactacacagatctattgtattcgaaacataactatttgacaattattagtgtgaccaaagtattaggcagttttcatacattttccaccttgtacaaaattctgaattcatttttcttccaggttggcacggagctgtcgatggaaaagccctctgcgtgttatattttggttgttctgacttacaaagtgattttgaataagaaatacttggtgtttttttataacccactttcaattggtaactgttttctgtattgtttcaggcggatcaaatgcttgagtcttggtggagattaagtatttattgctacaacttagttgatgaattgctgttcttgtaaagccatatgttctgttaaggtctggtttgctcagagcgtttctttctgcaggtgaaacactagaatattggagtgtacatggctgtggttagaattttaggggggttggggggtgtttgttttttgttttgttttggtagttcatccgccttttaacccattcaccaaaatgtcccttgtcagcaagtatcactgatggctatttcagagtggtctgcacccacactgctctgtgtcacagaggtgagtctggaatgctcatgtggtgacagggtagagtgtgcccatcacgcgggctggctgtaacagaatcacaacctggcatccaagcatgtttcttgttttactgtaccttgtgaggttttcacttgtaaaccagtggattttagaactggtttgtgtgtatatagtgattatggatactaattcagtgtaatttataattttctatgtcagcgtaaacacatcctagcctcctccaacagctgaagcaatggcctgtgcactgccgcggcatcgggtgaagagctcagtcacctcgcctcttgcacttttagatgcagatcagtttttcattctataatagaaaatattcacatatttttacatcatttgttttttcctgaccagtatttaaaaccaaaaggatattctgaaaaaatggccaacaagttttttagaaccagcatcccaagcagtgtgcctacatgacatcgcgtatggagatagagtcgagtgtccaatgccttactccttactcgcttctcactgtacacagtgcaagggaccacctcaggtggccgaggcaggcctggtcaccaggctcagtgggcagcaggaagccctgggactggtggcgaggggctcggtggcctgtgcttgcccgctcaggacccttcagtcacagctccttcagaagagactgcgttctctggaacctggtgccaccagaggacagggctccttctgctcgtctcagggatggttgacctgcgtggcccaggacctcacattgctggcggatggcattctcctgtctcacctggttgacaagccttgctgaccccagccaggacttggctcctcctagtcagcccacactgcctccttgctgtggactgggctggcttttctgtcccactgtccactgggaaaggaacgcttgggtactgttcttgggaaaggacttaggcttgcttgtcataaggagaggctgtgagggtgaaaggggacaaggtgtgttgggttggagggtgccagccagggcttgtgatgagttcctgctccttttcatttctgtgtattggccgaatgaattgcaagactaacagacgtctacagtacagtacctgtatcacaagtaataacaaaataaagcctgatgctttgtttctataaacttcctcgtgagcctttttggggttctaatagccacatagtgagcctctgccaaaaagtcctctttagctttcacctgtccttactcttgggcatgccagctactgaagaaacagtgttgtgacccccacacgccttgagcctccagtgcctaacacgtttgcttggcaccttgttgctgagagtgaaccaccaccacttgccgtcttgagatggtctgcctggtcctccagcttagcttgccatatgtgtcgttcccggccctgcctgctgttattgccagcaaacagcattagtgacagttctacagattcccattgctgtcattaaagcgtactccctgctaaacacatggtgcaggaagagagacaacttttgctctgttttttgagactatataatcctgactatcctgaa

SEQ ID NO: 25716 - DNA, 1134 bp, Mus musculus
taggagagtgtggacagaggagagacacagaggctgccatggggtagggaagcaagaagagcaccctgggctccgggccaagaaagcaaggcccagaggcatcacaaatgggtccagcatggccaagatggaacatagaagttaagtaaattagtgtgtgtattagggttctctagagtcaaagaacttacgggtagtttctatagtaagggaatttgttgatgacttacagtctgtagtccagctcccaacaatggtcagcagcagctgtgaatggaagtccaaggatctagtagttgctcagtcccacaaggcaaacaggcgaagaagagagagtcttccttcttccaatatccttatgtaggtctccagcagaaggtgtagtcagtttaaaggtaatgtgctaccacacctttaatctcaaatgaccttgaactcagagatctccttgccttaatctggaattctggattatatttcattccagatatagtcaagttgacaaccaggaatagccactacaaagtgataactcagaattatcgatgggaggtagattctagcagcctggaggctactgtgctttatagggatattaaaatataaaggctgtgtgtgtctttcattcaggaacataagccgttgaggcaggtagcaaacctggcaccaggatttattaataaataattaatacaacagatggcacccaacattatgtcgcagtgagaccaacctgttcatctgcatttcagaatttctgcggctccaggactagctcctccttagtggcttcattttgtgttttctgattagcattgtctctcaaagccttttgactcttcatagtatagttaccctttcatttccacagctgtggagttgtaatgactttgagtctgatcaccagctgattgatctcaggcatccagaatgttgctttgtctatgacctgccaagcccctcaagaaagaggtggcctttgaacttccatagtggtattcctcctctgccattttctccagctgagtctgtgtattatatcctgtgacttttgtgtgagaacttcctccagctgtcataatttccttagctgtttattattcagtaactgcaggaggactattcttgttcaga

SEQ ID NO: 25717 - DNA, 1186 bp, Mus musculus
gggtacacttgattgagattttaggcacatgtttctgaattggaaatagtttatctcttgttttttgtttgaacaggttgctataacaaaataccatagcttgagtatttaaagtacagaaatttatttacagttctggagactataagtcaagatctgagttttggacaatgcagatttcaggtgagggtccctttctggtctatagacactgtctcttgatatattcttactctgccttttttcagagagcaagtactctgacatttcttcctataaagatactgagttcatgtaacagttcttacttactgcaaagatagcaagacttcattatagaagttgagagcaatataaaatatcagtggatgagccttttatactgtgtagccccacctggtcttgaacttaatgatatccgtgcctcaactttcacaaatttcttcaaccttaaggttgaccatgcccaaacaaacccaggaagaggctcacctgtggctttccccagaacttcttaccctgtccagcttaaacctttccagaccaagggctgggctcccctactgtagccctggcttctcattttcatataaacttgccattttggccatgcacttttttggtccttggctcttctcttggtctacttgccctttcttctgttttcctctttcactccctccacccctgttcagtctggatccttccagatgcctctggccgaactcttccttatagctacaataaaatacctaggagtggccatgtcctcattttcattaaaggtatacttctaagctctgcttcatttattcccccttaaaaagtggtaaaatgtatttagcataaaatttttcctatcccctccacccctcttttcaatagggtcttttttttttttaaagatttatttattttatgtatgtgagtacagtgtatctgtcttcagacacactagaagagggcatccaatcccattacagatggttgtgagccaccatgtggttgctgggatttgaactcagtacctctagaagagcagttagtgctcttaatcactgagccacttctccagctccctcaaaagggtcttcttatagcctaggctggccttgaatttacaaagattacaattacaaagatcccctgcttcttgttaattaagattaacttaatatcagtagaa

SEQ ID NO: 25718 - DNA, 1139 bp, Mus musculus
gttttaaaaaccaattttctatggggtatgctggtgtgtttgagattgaacccaagactttcgatttaagcatgctaagcatgtactctatctctgagctacttctctaacacttttataactatgccatatttgtattctttagctgtcaccacagttagtagtattgaaaaagaaggtacgatttatagtaggggcaaattttatgtttattgagaaaagtattgattctttaaggaatgatagatgataatacaattaaaaatgaaagcatatcaattttcctgtcttgattatttttagggaatggattttttaatccattttctccgagagagtaattcagtaatggacagctaaactacttgactattgttattattgttgttgtttgtttgacagggtctctctgcgtaaccttggctatcctagaacctgatatgtagactagtcttgactccactaactcaagagatcctattgcttctgcctcctgagtgttagaaatcaaaggtctaagctgcttgctattttagctctcacatcatcagtgcctcccttagctactgtggccctgaccttattccctattcctgagcagtcttgctctctgagaacctttctcattttgtgctttctgatgtaaaaatataatttcctagaagtcagatccttaagagattcactgctcccttcagttgacgtccttgatggaatcctagacagactttttttttttttttttgagggtgggggctttgctaccattgttcagtgacctcatgtcagagtttggatatctttagttcaattttttccaagctaggatctgagcccttgtcttgtttcttcagtagtctgtctagcttttgccactccttcaatgcccagcttatttctctgttttagcaatagtagccctagtgatcccactctctcagttcttactgacatcaagcagataatgtgtacacatatactgttttcagttttgcttctttctctcttttgcatcctccaaccattgctgccatactgctttgattgttactttagattcaggagttggtaagccaggaagatagtatagaattcatttatgccatctttataattcaggaatggattctcagattaga

SEQ ID NO: 25719 - DNA, 1126 bp, Mus musculus
tagatagctaagtagagcctagctgctggagggcgctgctcaggagctgtgtgaacaccctctgaggaggtgggaacaaatgttctgtggctacaatgttgatccatatactgtctcagacacttagtgtcttgccacttcaggttttccctctgaccagttgcttctctttgcttcatggccttctcttttcagcagttttcactggattcagggctaccctcacacacaaggattgtagctcaatcctaatattttccaagaccccatttccaaagaggctcataccctaagttccagggtggcatgaatttcagggacactattccccccaccatgaggtataacccggcagcctggaggacctgtgaggtcaggggctgggctgggcctgcggatgaggtgggagctcacagcgcccgcccacttcttccctgcatctcccatgtgctgtgcttccgcaggtacatgtactttaccaacatgcaggaccatgctgccaagatcgagcgagcctccctggatggcacagagcgggaggtcctcttcaccacaggcctcatccgtcccgtggcccttgtggtggacaatgctctgggcaagctcttctgggtggatgccgacctaaagcgaatcgaaagctgtgacctctctggtatgcaccctggatgtctccagccactgagtcctcagtctgcaactgttgggggtgaccctaccgtgcgctcccagccttccttactaccaataggggtagcagttaaaatcttgctcggcttgctgtgagcctggcattgtgctgtgagcctggcagctctgtattcatatgtaatccaaataccatgggggcctggctgtgagcccctggactacggatcctagtgccttttcttctagtaaaagctgtgtgattggggaggtggctcagttggtaaagagcttcctatgcaatagaaggatctgaattctgatccccagcacccttataaacagccaaggtctatggcccatgcctgcagtcccagccaaggactgtggcccatgcctgcagtcccaacagaggactgtggcacatgcctgcagtcccagctgaggactgtggcccatgactgcaatcccagtgtta

SEQ ID NO: 25720 - DNA, 1151 bp, Mus musculus
tagacaaaccaccacaaggtgtatatgataaaaatcctcactgacctgttaggttatcaagtcatagctataggttcgactctccttttcttcatattcttcttcctgttcatcctcttcttcctttctctcttcttcctttccctctttttcctcctctccttcctccccttcttcttctgttagtggtaggttcgactccccttcatattcttcttcctgttcatcctcttcctttttctcttcttcctcttcctttccatcttcttcctcctctccttcctccccttcttcctctgttagtggtgaagatagtggctggttcttcaactccacgctgggcaagtggttccaggctgtcacctcccagacagtcaccttgagtactatggatgactgtagcttttgtgtaagaaagcgccatggtacaaatcataagtcctgtgactttcagaccctcccctccccttgtctgcctcagacactttcctgcaccacccagtccttcccacttctccttgcctgccccagataccccttagctgcatttgcctacccatcactcgctgtacatccttgccttgctccaccctttgacccaagagcctcacacctgccctatgccccttgcctggctctgcagcctgggtcccctctccgtgcataagaagagaggtatccctctgctctccattcctactctcctggccactgaattaaaagaacaaggtttgaacatcgaaagccaagagcctgagtcctaaacagtggaaatgaagggagagaggttgggcttcaggtctcatgtctatctagttgacagcctgccagtgtcctctggtggattccatcatgggacctagagtctggtgtcctgttggggctctttctagtttgttctgtgtattcgtaaatgggcatatcactaagatctaagttgagggccatcgtgatgactcagtgggtaaaggtgtttgaaatcatgcctgatggatggcctggtttcaaatcctgggacccatgtggtgcaaggagagaaccagctctcaccatttgtcctctgaacttcacacggtgtcgtgaaaggtgtgcgtacacacatatgcataaaaccaaccaaataaataaacttgtttttaaaagagccgggt

SEQ ID NO: 25721 - DNA, 1214 bp, Mus musculus
aagtgttgtgtgaaaaacagaatcagatgtcatacagctgctactgatgggtcacagtacagaagtgcttaggagaaaacaacaataaatgtagtctatgagggtgtgcaaatgaaaaacacagtgagggtaataagtttctacataaattgtactagttttactagcagaattttgaaaggtaaaatatgagacagtccctcaagataagatctgagtaaaaagaactgtgatgttggctgtgaacacatagatgccactctttccataataataaactgcttgaaactttatttttagaattgaccaaaactatattaaagcttataaagtattgtatgcttgatgaaaaccaagaaagacaaaatcaaaagaacattggggcagccaggcagggtggtttatgctgataatcccagtgtttgggaggctgaatcacatgcacttggaaaagtttaaggtaaacccaggccacacagtacgctctctctcaaaacagtcatagaagaagccgggtcctcagcactgaacaacagcgaccacaacaaaggttaaaggagggttggggaggaagcggctgcagagctacttaaagaacagggtagatcctggcgattgagcggctgctatagtgttacttgtctatgattccagcactcagagagtgaggcaggaggattagaagttctggtcattcttggtaagtagagcatttgagaccagcccgagaaataagagaccttgcctctttttttttttaaaggagagttaccttaacagatattaaagattattgtattataatggttatgatcaaacttgatgcattggttaggaatgaacaatagtgaacagagaattctaaaacaagcagagtgcacgtgggaagtgagtgctacctctgcttctggggaaaaataggctaggcttccaaatacagtttaaataaacaatctaaaatgattaggaaaagatctgcctagggccgtgagagttaagagcatgtgctgctcttaacaggacccgagtttagttcccgacacccatgctgtgctgtttccggcactacagggagactgacaccctcttgtcctctgagggtttgtgtgttcatgtgtatacatgtaattaaaaagaaaataaaacttgaccaaaaaagtgtcagagccaaatgtggtggtgtactcctttaatcccaacacccagaaagtaga

SEQ ID NO: 25722 - DNA, 1150 bp, Mus musculus
ctcagacagtcagtctgtcagctctaacacagatgcagacaccactcaggaaaaagacaatgcaagtaagtaagggagctgctgtgaggtgccagttatgctcctcaggagggtctgtagcatgccctaggagggtctgtagcatgccctaggagggtctgtagcatgccctaggagggtctgtagcatgccctaggagggtctgtagcatgtcctaggagggttttttggtttttgttccttgtttttgtgttttttgtttttaagatttatttatgtttgttagtacactgtcgctgtcttcagatacaccagaagaggagaataatcagatcccattacagatggttgtgagccaccatgtggttgctgggatttgaactcagaacctctggaagagcagtcagtgctcttaaccactgagccatctctccagcccagcctcagtggttttgaaactccaaattgatagaaactgagacttgaggcatttcagctagaaatgcacttggtagtacacaacatacttttcgtccatagcagtttatatcaattccaaatttagagccaacatctctatgtatttctgaatacttggtaattggacattgaaatattcagcatatgtacctatcatgctcaaggaagacattttcaagtcattagtgatgggtaatggtgttagaggccccgtaagagcttggctggttcatcaggctacccaggtctatctccagccagtctaggaacaggatggacccagagttcattatagcttcaagacttccattcatttaactatttgattagcattttttgaggtgaatcaacctagttcactaggctccgaagtgtgccaagagtgtttggatgtggctattatagggtgtgtgattgctactacagaaagtagcaatccaggaagcttggggccagttttatgttggtggagtgcctaatggaaactggggttggtggtgaacaaagagaaaaggaagagaagaaatgttacagaggccaaagacagcacagtggagtttgagtgctgggacctctgtggaggctgtgatgccgcacatcagcaggttctcctgtctgactcgtctctactagagtcgtctgtgagaaaagttggccttggttacccaca

SEQ ID NO: 25723 - DNA, 1114 bp, Mus musculus
caggacagccagggctacacagagaaatcctgtctcgaaaaaacaaacaaacaaaacaaaacaaaacaaaacaaaagaatcacacaccagactgggcagtggtagcaaaaacctttaatcccagctctcaggaggcagaggcaggctgatctctgagttcgaagccagcctggtctacacagtgggtccaggacagccaggaattcctgtctggaaaaaccaaagaaaagaaaagaagaaaagaaaaaagagaagggaaaggaagggaaggaaggaagaaagatagaaagaaaaagatagaaagaaaaggaaagaaagagaaagaaagaaagggaaagaaagaaagaaagaaagaaagagaaagaaaagaaaagagggagggaaaagcatataccaagcagtctcactttgatgtaatagaaagtaaaaaaaattttttttttttaattaatttatttattatatgtaagtacactgttgccgtcttcagacactccagaagagggagtcagattttgttacggatggttgtgagccaccatgtggttgctgggatttgaactctttttttgctgggatttgaacttgaccttcggaagagcagtcgggtgctcttacccactgagccatctcaccagcccaaaagtaaaaatttttgacggaaaaaggtttttcatttgtttcatagctgagaattcatattttcatataattaatatagttagcttaagtgcagttttcctaccaaagtttaaatagttaagtcatgaatttcagcttcaagttgcatttttaaagaagattaattattatatatatacattctagctgcctttagatacaccagaagagggtatcagatcccagtatagatggttgtgagccaccatgtggttgctgggaattgaacccgggacctctggaagcacagtcagtgttcttaaccactgatctatctcccagccccccaaattgcatttttttgagggaggggagttctcaaactctgcagggtctagcagggatatttgctgccagcttggagttttggatattaatagctgctggccattggggatattgtgagaacacagtgagaggaatcaaattcagg

SEQ ID NO: 25724 - DNA, 1159 bp, Mus musculus
agtttctggctgagcactccaagcccagctccagctcagcccgacatgacagcgccgctctgcctgtgcatctgtctggctcagttccagacagtaacacagcagagctgtcacatgctgctccacgtgacaagcggcggctgggggctccatcccacgcagaagacaaggccctcagtggcccctcagctctacaccttaccccagctagctgaatcctgcgggtctgccagcggggcgtgggtctccaggcctctcttgccctcccaggtaggctggggagcggggtgaggcggtgaagagcatctcccaggtgcaaggtcggcgcagaggccctggccagcaacctccctgctggcccagggcacctgcgggaaaagacactgaacatggcccagggcagagatacgaaggatgtttctctctccccccacacacatgtaatccaatcgccagcctgtctgtcccaacagctgctcaaagtcatccccctttgtgctggctcccacaggtgtccctggagtagagccaggcacagctctgcacctgcagagaagcgggaccccaggggccacttcagcaacacagggtggcaggcagaggggatgtctttggggagagacagccccagctctatagtcataagttaccacgcacatcctacgtggccaaaccctgtcccttcacagatcccgttttctcattgtaaaatgtgaggtttggaggtgacaaatctgtgagtgggcttcagctggaggtagatcgagggtcacgggcaggcagaggccggggcttcagctggaagagagcctggtccttagaccgtatttttggactcagggtctggcctttccttttaacagatggggaaactgagactgagcgtagccaaggctaggcggggtgtacagtctttcttggtgttccaggcctctttgttccccccttcacattgaagttcccaggctacaaatgctcccacctcagccctcccttcctccgtcagctatccccagtcaatgctcagaactgctgtgcgactctgacctgggtgcctttctctgggccctgcctccttttctgcggtctgagagaatatctctaaacctctatgagatagatgttgtggtaaaatcccagctaacagcttccacctggc

SEQ ID NO: 25725 - DNA, 1173 bp, Mus musculus
ggtctcttgggactgctggccagccagtgtgggctacttggtgggacacaggccagtgaaagattctgtgtcaaaacaaacaggcaaaaaacatggtagaggctggtgagatggcttggtgagtgaaggcacctgtcacaaagattgatcttttaagacccacgtggtggaaggagagagccaactcctgcaagttgtcctctgaccatgacaggcatgttcacagatgtacatacatacagggtttaagaagggaaagaagcagacgggcagtggcggcccatgcctttaatccctgcacttgggaggcagaggcaggcggatttctgagtttgaggccagcctggtctacagagtgagttccaggacagccagggctacacagagaaaccctgtctcgaaaaaccaaaaaaggaaaaaaaaaagggggggggggaagaagccaagcatgtgacacacccctgtagttcccgcactccagcggtagagacaggaggatggagaatccaaagtccactcttagttggattacatagtgagacttgtggagcagaaggggaagggatgctaggctgctcctgccagtgagctcccctgctcagaacacctcaaataatgtacccagtggccagggtgaagccgagtcaagtagaagacactgcctgggaagtggaagaagagagccatacggaggtggagcgagaggccagtcccaccatacagagagcctcaaggggacagacttgggagagagagccagccaggggacagggtgggagtgtggtgtgactgccagctggtttccttgaggaatgcagggctctcccagatgctgtacccatttctacaggaggaccccaccccttcatacctccacagtcccctgtccctttctcttccctctccatccccccacatttctgcccttctcacctatttcctctccttgcctaccccccccaacacaccccttttgtcacctctagccctgcagcctccttacccagcagcaggcacatgatggtggtaaaaatagctcctttcaacagagtgtgaatggaatggagggggcagaggcaggagacaaggctgggcccccagggctcctgatcccctccctgctcagtcacacacttgctcagatggttcacctcaggctctgtcaccctacac

SEQ ID NO: 25726 - DNA, 1174 bp, Mus musculus
tgggatcctggatctgaccaggtgccttctgggtggttcttgcagtatttttctgtgccctttggagaggaggacaggttgatgaggaaggtgttaatagtatagcctctgccagtgccacccacagccttcagttaacatcagatacccatgtcccctctgggctgtgtactttcttcctgtcccaggagctagaggtgtgatggtgaataggagatgctgccctggagttgggtacagtgtgggccaggagcgatgaggagacaagagcaggacatcccactaacaagagtcatgttcccagtgggcaggtggtgcatgcctttaatcccagcactcgaaaagcagaggtgggtgaatctcgagttcaaggccatcctagtcaacagagtgagttctaggatagtcaggttatgcagagaaacccagtgtccaaaaacaaagcaagtttcctttcctggaaatccaccagtctcttgtttttccttgaaggagtgtttggatgccccacaactgtggccaatgtggagacagtggctgtgtcccccaccatttgccgtcgtgggggcacctggtttgctggctttggccgagaacgcaattcaggtaccaaattgtttaacatctctggccatgtcaaccacccctgcactgtggaggaagagatgtctgtgccactgaaagagctgattgagaaacatgctggtaagcctggagccaactcaggggctgtgcttgggagagggcacggtgggagagccatgacaatccttttgcaaattgtcacaggtggtgtcacaggtggctgggacaacctccttgctgtgattcctggtggctcatctactccactgattcccaaatctgtgtgtgagaccgtgctaatggacttcgatgcactggtgcaggctcagacaggcctgggcacggctgcagttattgttatggatcgctcggtaatggacctcatgccccataaacctcctcccagcctgggtgtgttccctccctgagcctctctgaaaattctcctgcctggctcttggctcccaattcctacagactaaaaccctgtacagtgggagagcatgggccagagcactggacccaagtcagggttgttgtgggagggaggctaagatgtctgtgcactgttccttgtctcctagacaga

SEQ ID NO: 25727 - DNA, 1210 bp, Mus musculus
agcgccctgaactctgtgccaagagaatgtggcccagagagctggctggctgagttaaaagcagtcaagatggatcatagaaattagtaaatagtaactcggaattatggataccaacagcatggacagtaggcagttgcccaactcagtctataaaggctgtgtgtgtctttcattcaggaacataaaccactgaggtggtagtgatcttactccaggatttattaaaatattcctactgtactaatggttgaatgtttgttggatggataaatgattggataggtagaaaggcagatggatggaagtaggtagatggcaggtgcaggaatcttttcaaaaaagatttattttattttattttatgtgtataggcatttttccagtaattatgtgtgtgtgtgtgtgtgtgtgtgtgtgtgtgtgtgtgtgtgtgtgtatgtgtgtgtgtgtgtgtgtgtgtgtatctcacatgcacacgcctggtatcatggatgccctggagctacagttacagacaatttgtgagctaccataaggatgttagaaattgaacctgaaagactatactttcagggatcatttctatagttcgttactagagaagtttctctgactgtgtagagcacctgaaaccacgaggacgagacatagcgtcccctcctgagcgtgaagctggctctaggtgctgcttgattgcagctgcctcttgccattgatgatcgttcttctctccttcgggagggtgagagggagggaacgcagtctgagtggaaaaaaaaaaaagaaattgaacctgagtgctctagaggagtggccagtgctcttcaatgctgagccatctctccagttgcaggtacagaatcttatctcccaccctcaccccctttttggacatggtgtccctctgtagcctaaactggcctataactcactatgtaaccccgactaacctcaaactgatggcaaccctcctgctttggccttttcagtgttgaacttataggcatgagctttgtactggctggtttagtgtcaacttgacacgagctggagttatcacagagaaaggagcctcccttgaggaaatgcctccatgagatccagctgagaggcattttctcaattagtgataaagggtgggagggcccattgggagtagtgccatccctgggctggttgtcttgggttctataagaaagcaagctga

SEQ ID NO: 25728 - DNA, 1174 bp, Mus musculus
gacttcgagaggacgggatccaaaagcgtgtgatacaggagggccgaggagagttgccggactttcaggatggcactaaggtttgtgtccatcctctccccactttcccagcgtctcttctgaagcgcggtgcgcatgcgaggcgggaggaggccgtaggtgagaggttgcgcatgcccagagagcagctgccagtcaggctacctctcacatgccgagctcgacgctgattggtctggatttaagtgggagttaattcagatatgtctactccgccccttggctttgctttaggactgcattggacaggggtgggtgtcagtcatctcaaaatggtttggtgtgggtgtgacctcagtgctgatacccgtacctgaaggttcaaagctcatgcagttttgagtaaaggggccttctgaaaccatctaggacaattctcattgtttacatagggaaactgaggtcctggaactaaaaaaaacacagagtcccagagatccagttttccagaccaaactcctatgtcagcgttctgatagatggtagcattgcttttatatctgggcaccaagttcaggtgcccctccctaaggcactccatacctctaggttcccctgctttgttgctgtagatctctaatcacagttgtggagctgataccagtgaagccaaaagcaagaattctgtgaatgaatgtatgccctctggccagtggtgttaagccagcaggcagagagtctagtctgatgtggtgaggggtaaatgctgagagcagagggcaggcatgtggtggtagtgatcagctgtgcttgaaaaggggatctacaagctgggcctggtggcccatgcctacagtctcagccgctggtgaagctgggctacagcatgagttcaaggccagctcaggacactcaatgagaccctgtcttaaaattagagagatggagatagagaacaggctttggaaggagcctggcaagagggatgctagatggaaaagcttaggataaactaatataagactaatctgtgagcaggggcacgtggtaaatagaagcaggcaggattaaacaatcactggggctcaggaggggggaccgtcttctgctggtgaggtggcttagtggatagagtgcttgctgccaacctgatggcctgggtcagatccccagg

SEQ ID NO: 25729 - DNA, 1174 bp, Mus musculus
aacctcccatttaatagctgtttcccagggctgtttcccagggcctgccaaagtaccctgccctggaaacagctttgtgcgcatcctgggaggtgttctgcccaggaaacatcagtttaggtgggagacgcatcgggccaaagcctggctgaaagaccctgcccttacccgcccccccccccccgtccttcccctccacaatcatatgtgtgcagtgcttatcctggtcggcgtgggactggaggtggccccctctccaggtgagtgtccttcctgcctgggtcctcagcaaaccctcccaactccccacacaaggcacacaagccacctcccaggagaaaggggggccttcccaggcagccatcatccccagggacccctagtcctgagctgtccgtttctttctaccttaggtgtctccagtgccatcttctttgtgccgggcatcctgctgttagtcccaggaggtaagagtgacaagagggtggggcatgggtggggtggggtggggccaggcaccctcactgacagatatcacccccacagtctaccatgtgatcttcatctactgcgctgtcaagggccgccggggcttccaattcttctacctgccctactttgagaagtgagctgcaactggccagtggctcaccagtgatccaaggcctcaggtcacctccacgtgtccacagggtattcctccaacctacacctggttctgttcctttcacctggaaggcagaggcccctgggaccctcacaaccaccaggcccctttgaatttgctcaggaagtttagagcatgccagcctgggaatattgcctcttacctgatgtgtgccttaacttattcctgggttctggactcctgggttggtgtaattttgtgctaataaaagggtaattatttccaacaaggacagttgcactttcctgggccagcaagcctggcccagcacactaacgaccacagtcccctcctacagagggactgtgtgtaaaggacccacctagagctctagaggaccaccaacttcccaaggacaacctggatggcctcaggtgtgcccatggtcaccattatgcccagggcagagctggatgaagtagtcccaccctgtctgccttcatccctgaggagattcaacactgccccctagccaagggcaccaag

SEQ ID NO: 25730 - DNA, 1219 bp, Mus musculus
atcagaaaggccacgaccagcctcctaagggaaggggaatgccaccaaggttgcatgaagagggcactgttgacccaactctgaaaggattgaggggtgcatcgggcagaggccatgttctagaccctatttctgcttgcctggtccccattctggaggctgggcacacaccatctacttctctccacccttaccttaccctgttcagtttctgaagcggaaccccactcagcgaattgggggtggcctgggagatgctgctgatgtccaggtgagtctggttatgtcacagtgaactggggccggaggatgacgtggatatagcagggagataggcaaggggagtaattgacatattcccgggcgccctctaccctcagaggcacccctttttccggcacatcaattgggatgatctcttggcccgccgcgtggaccctcccttcaggccaagtctggtgagtatatgggggtcattttggccacatggcatgtggaggtcctgtcctttggagtcctttaattccccacacggattttcccacagcaatcagaagaggatgtgagccagtttgatgcacgattcacacggcagacgccggtagatagtccagatgacacagccctcagtgagagtgccaaccaagccttcctggtgagggcctgggggttatggggaccgaaggattgtagctagggattggagatgccagcatcacctggcctggcctcttccccacagggctttacatatgtggcaccttctgtcctggacagcatcaaagagggcttctccttccagcccaagctgcgttctcccagacgccttaacagcagtccccgcacccccatcaggtacccaggagcagggcaggcgtgtgcctggggcagggttccctagcatggactagtacctgtgggctactcggccaagctttcctttaaaggctggcctcaggcccctgctcagtgtgggaccccaggccctgtacatctgtaacagaggctgctaaagtggtagtttgtggacctacaacttgtgtgcccaagtagataaagtgcctcacctcccttccctgctgccagtattactgaccaggcccggaggctctgactcagccttgctttctcttgcagccccctcaagttctctccctttgaggggttccggcccagtcccggcccaccagagcccatggagccatctctacctccactc

SEQ ID NO: 25731 - DNA, 1196 bp, Mus musculus
actttgtagacctggttggccttgaactcactagagctcctgcctatctctgactcccaagtgatgggattaaaggcatgctccacccaccagtttggttgcactctttcctgttgtggcatgaggcatcctgtagtcaactcattaatctccttctgcccccccacccccgaggtctgctatctgtacttctaagtggtggtgtcatataaagtgagttccaggacagccaaggccacagagaaatggggccagtggggaagtaatggattctgtctccctgaacttaaggagcccagattagcggtgggaacagtggagctgtcccaccccagagctgggcacaggacagcacttggtttaaggaacactattcccactccaccacccccaggcctgtctccagacttgcaatccatggagcagattaggcgtattatgcggcccacagacgtgcctgaccagggcctactgtgtgatctcctgtggtctgaccctgacaaggatgttcaaggctggggcgagaatgaccgtggtgtctcctttacctttggggctgaggtggtagccaagttcctgcacaagcatgatttggacctcatctgcagagcacatcaggtgggctggtggcctggggcgggctgggggtgggggtggggtgcctaacttacagactaaaccgttcctgccctggcccaggttgtagaagatggctatgagttctttgccaagagacagttggtgacactcttctcagctcccaactactgtggagagtttgacaatgctggtgccatgatgagtgtggatgagaccctcatgtgttccttccaggtgggtgtggggaagaggctgcccaatagacgcctggctcaaccccaggaccctgatgagtgttttctcttccagatcctcaagcccgctgataagaataagggcaagtatgggcagttcagcggcctgaaccccggaggccggcccatcactccaccccgcaattctgccaaagccaagaaatagcctccatgtgctgcccttctgccccagatcgtttgtacagaaatcatgctgccatgggtcacactggcctctcaggcccacccgtcacggggaacacacagcgttaagtgtctttcctttattttttaaagaatcaatagcagcatctaatctcccagggctccctcccaccagca

SEQ ID NO: 25732 - DNA, 1186 bp, Mus musculus
tgtgatctcctgtggccccagcctggcccagcccccagggaggggcccgcttgcctcagctcctgctgccaccaacccagccactgtctagcacccctcccctgtccccactcccaccccctagggtccttgctcccagtatcttcctacagggaagaagagcaaccctcagcagccctcttgcccctccatggggtgaagccacactcagtgggtgtgtcacttcaggctctgtgggctgtgctcagtctgtggcccagcacccctgccctagaaaggggcaacacagggtactacttgaactttcctatcacagctcccatgccacagagggacagacccctgctgtcctgccctcttgccactggtgagagaaggcccttgtctcctcagactaggaggtctcccacagtgacagctcctgggtccttgttcaggaaaagcctgtgtgttaccactgcctcatcaggaggctgccattggcagtggctgctgctggcctccctgcaagtcccctcttcttcctgttgcgtgcctggactcaggagcatagaaaagacaattgtggattgggccacactggcctagcctgaacctagatccctaaccctgggctgggtgaggctcacctgcccaggaccacagtgggacagcctgggcaggtgggtggcacagcataagaacccagctggggccagccctccctgtcctggctggtcagtgtgcccccacccacactgtccagccccttagcccatgtcatgtcagtggccactgcccacaggtgccaccttgcccaccgcatgaccccttgtgccagtcgcgcagctgtgtgtggtgtcgcgccctctccccttgggggctgggtgggcacaccctcccctcttgtctactcactcctagggcgtttctttgccgatttttgaatgtgattttaaagagtggaaaatgagactatgcgtttttataaaaaatggtgcctgactcctcgctgtctcagactctttgtgcctggtgactatttttcagtcacttcagtctggggcctgaaaggggaggagcttagtaacccgtcctcccctccctggtggagtaattattccgctcgcctcccacataagcaggagtagccgtagtagttctcgtcagctgtcatggttggaatggctgggggtatactggtttc

SEQ ID NO: 25733 - DNA, 1198 bp, Mus musculus
cctcacccatgctgatgcccagccccgctctgtgcagtaccctcctccactgatccccccacgtggggaggtgaatgcagctgacgctttcgacattggctcctttgatgaggaggacacaaaaggaatcaaggtactgcacctgcttggctctgagccctgagcctgagcctgagcctgagcctgagcctgagcctgagcctgagcctgagcctgagcctgagcctgagcctgagcctgagcctgagcctgagcctgagcctgagcctgagcctgagcctgagcctgagcctgagcctgagcctgagcctgagcctgagcctgagcctgagccctgagcctagcctggtctggatgaccctttgcccctcctctgcccctgtgagatcctgtggctaccctgtgaactgtgggtcttacttcctcatcccccagtctccctggggatggtggttacaggtgaccatgcctagcttagggccctacacaggcctgtggctgataatgtcctggcaccctttgtctacccatgtatccctgccatgtccacctggtgaagttactggacagtgaccaggaactgtaccgcaacttccctctcaccatctctgagcggtggcaacaggaggtggcagagactgtctttgataccatcaatgctgaaacagaccggctggaggcacgaaagaaggccaaaaacaaacagctgggccacgaggagggtgaggacttacggcctgttttacactgcagaaatgaaaagcaggttctgctaagaaactgaccaagaccagctagaaagtggctgggtgagggtgggtgctgagcctgcatcccatgtcttgtacagactatgccctgggtaaggactgcatcgtgcatggctacatgtccaagatgggcaaccccttcctgacccagtggcagcggcgatacttctacttgttccccaaccggctcgagtggaggggtgaaggcgaggctccggtaagaaaaggttctggcgggacatggtgtgggccccagggtgggccccaggaccttccttcacagcctgctctgtcttctcaccctgcagcagagcctcctgaccatggaggagatccagtcagtggaagagacacagatcaaggaacgcaagtgtctcctgcttaagatccgaggtggcaagcagtttgtcctgcagtgtgatgtaagt

SEQ ID NO: 25734 - DNA, 1179 bp, Mus musculus
ggtggagttctacgaagaggtaagatgggcgaagtctactgagataaaggtgcgtaagcaccttgctgtgtctgaggcccctggcatctagcttcatgccgtggccacagacaatcatctataggtattccttctaccagatcaagaaatatgagaagctggagacagaggaggaacgtgtggtccgcagccgagagatctttgactcctatattatgaaagaactgctggcctgctcacatgtaagagtcctgtggggtgtgaactcatgtgttgatcccagcaacgtgggattagaaggaaagaaagagccttatataagattcacagccacctctgtcctctccagcccttttcaaagaatgctacggagcatgtccagggccacctggtgaagaagcaggtgcctccagatctcttccaggttcgtgctgggtgcttctcctcttgcccccattctgcccagatcaggccctcccgccttaagtcagctggggccctggagcctggggcaccgcagacttagtcaccaattcccagctctctccccacagccatacattgaggagatttgtcagaacctccgaggggacgtgttccagaagttcatagagaggtaagtaggagaagcagcctgccctggctctgagcagccaggtgtggggtctgtctctgtcccatcacagggactcttgagaggtcacatagatccaacgtcctcttctcccaccctgtatctccctgtgctatggagtgtcagggtctagcagggctgtacctgaagtacacgcttccctctgtggtgagaaccaccagtgtctaggcagaacgctaggaacagctctttcagtcaccgccacccagccatgggaggtacagcgggctgagtaggtgacatcactgggaatgtgagtgagcagcaggtgctgtaccctggtggaggtctgactggcgagcatttctctgattgcagcaggacaacatggttcaggctgcagaggcttgttggcctgagctaaccataggctcaggaggtctctatgtccacgtgtcaggaccctggaagggcagtgggtggatcggactctgatgacggcccagtgccttgatgcttgcttgagtgtgtcttctccttcttccccagtgacaagttcacacggttctgccagtggaagaatg

SEQ ID NO: 25735 - DNA, 1092 bp, Mus musculus
gttgcgtgtctctcctccgttaaactctcccggcttctgcaggaggagccaacagccctagaaacaccaggcctggcaggtctcaatggtgctgtgagttgtctgaagctttgctccatgtctgtcatagcccttttttcttgtccctgagcttgatgctgtccaacactcataatacagtccccattctgccatcaccccctaaacttttccactagtcacccacttgtcctttgttgcacttacttggggttatcaaaagctcttcagaggagctggaactctgcccctcccccccccccccgaaatgcccatatcattgctacccaggcatattctaagacaggcatcattaatactccccacccattgctgcccaccaactgcccttttccatttgtcctctttctgcctgagcagggcttttctagaatttgtgtcctcagaaggagcagcatgtttctccaggtgggggaaacagaagactggttgaatccccacctgcctctctaagccaggcttttctgggctctggtttagcatggccctctgagcccaggcctgtgtataacctagcagctcactgacctggtgccttttaaggggagtcctgattgaaaacctaccctctgcctgcagccttggaagtgtgtgtgcatgtgcctctgtgtgtctggctaagtgtgctgcacatatgtgcagggaaggaggggagcatgatggctcccactcctcatcgcccttcttcaagccccatcaagctgccccctttgactttgcattgaacggcctgtccaaagatcctctctctagggcagcagagagctttttgcactttagaaaaaaaaaaaaaatgaaagaaagaaaatggtcggaactgttctgggtcaatatttagagtatgaggagatgctcagcagaggcctgtggccagagtttgtcagtgatacatgcaaatttgcactctgctccccatctataggagattgataattgatagcacagccttgccccgccttctcttagccccaaacatatcccttcccacttcccaccccatttcctggaatctagcctcagactttcctaaac

SEQ ID NO: 25736 - DNA, 1218 bp, Mus musculus
tctgaggcagggtctcactctaactggtctgaaactcactatgtagtccagtctagcctgggactcactgagacccttctgctctccttatcagtacactgggggtagaggtgtgcaccaccccacccaactcctacagggttatttctgtttgtaactatgattttcagaaacattggtcttgtcatctataactttggacaaagcttttcctctttttgataaactagacaactagcgtttatcttctttgcattggtagatatggagttaaatgagttggagtctggaaatggtgatgaggaaggggtggacagagaagcccgacgcatgaacaataagcgatctgtgcttaccagccctgttgctaatggagtgaacctggattacgatggacttggcaaagcctgccgaagtcttccaagtctgaagaaaactttgtctggagactcatcctcagactctacccggggatcccacaatggccaagtttgggatccccaatgtagccctaaaaaggataggcaagtgcatctcacccattttgaacttgaaggtcttcgatgtcttgtagataagttagagtcactgccactgcacaagaagtgtgtccccacaggaatagaagacgaagatgctctgattgctgatgtaaaggtaagcagccattgacgtgtgcagaaaagtcaagtttcttgatttggagggagaaaaagtacaggtatggatgcttcaattacaaggaagttaattaatatgtgcctgtgtaagtaagtgctgcccagtgtttcaatttctagagtgacattgagtcactcttttggaaatgggaacatacatgtatctagtgttgatttaaacttagtgctaaaaacgaagcttaccactaagagtgttgggtggacagagcaggtaagatggctctgtgagtagacctgattgcctgagtataattcctggagatggtatatcaggtacattcatatatatttttatttttgttttctgaggcaggatctcactctaactggtctggaaccactatgtagaccagtctagcctgggactccctgagacccttctgctctccttatcagtcataagcatgggaaccttgctttagttcctagggcctgtattttttaaaaaagaacaaaaacaaaggcaaaagttaatgcagtggtgtccacctgtgaccctaacattcctaccgtgaga

SEQ ID NO: 25737 - DNA, 1178 bp, Mus musculus
accctaaatgtctctctctttctttttttaaaggtggatttcattgactgggtagataacatgtggccaaggcacttgaaagaaagtcagacagaatcaacaaatgccatcttagagatgcagtaccctaaagtgcaaaagtaagtgacttgttcttgtgcactttcctcagtgttctgtgaggtacagcattcattgataacaaggaataggctatcccttttgtagctttgctgtttttaatcatcaaattggtaagagtatgtgagaaattacatagcacatgatctcataataaaggggaaagattttatggtcctggaaatgtgacatagaactgaattcctttaagaagatatggtgtgtcatgcctggtttcagggccagcctactctagtagcaaattcaggacagccaggaaaccttgcctcaaaccttccaaaaaggaaagaaagataacctactagaagtttattagatgccaaatagaggggttcactaggaagagaatgtctttttggtgggcaggtctctttatcagtgtactaattaatgctgctgcttctctttgggtcaggtactgtctaatgagtgttcgaggctgctatactgacttccatgtggattttggaggtacttctgtttggtatcacatccaccaaggtggaaaggtatggtcatagtaggattggaattagaaatgatttgcatgcttaatatactctggaaacctcgtaacatagtactaggagacatcatccattctatgtgaagagaattgtagatggctaccttttgtagctattcaactggagtttagtaggccagtgtcattctaccaatatttggccagttcttaaagcaaaaggtttctaggtgaagctgaagagagttttaggaggacagtatcatttttgtatctgtaagaaaagtaatgtagaggaagagagcataagttttggatatattaaccaaaagtccagcaaattagaattcagccacctctccctgtctggaggtattgttatgaaatgtgaccaaagggagcattaagtctttttaaggattggaaaaagtgccttcaattataaaagagttacattctgataataataaaatatattctatctcctaatgagtttttctaaatagtatatcagaattacaatctagaatta

SEQ ID NO: 25738 - DNA, 1119 bp, Mus musculus
gtgtaacagatgcatggctgttgtggaacttcctttgtagaccaggctggcctcaaagccccagagatccacctgcctctgcctgccaagtgctgggattaaaggcatgtacacatgcacaacccttaattcatactcttgaaacagtctttaaaccgtcactgaaacagtatatatctcagtaagtcttttgtcttgcaagttacctggtccctgttgcttcatgtttgaaataaatactgacagtgatcatgtcagattgtagggttaagtgaggtattgaagaagagaaccagtacttgatagtgtagtaacatgatgagtattgttattctctgatgtggttatgattatccttctcaagtaatttccttctgtattactgattatcttaacacaggatgccttgttagtaactatggcttaaacttctttcatgtagggagtcgtcggatggtggatgtcatggatgtgaacacacagaaggggattgaaatgaccatggcacaatggacacgatactatgagactccagaggaagagcgagaaaaactctataatgttatcagcctagagtttagccacaccaggcttgagaatatggtgcagcggccttccacggttagtctttttcccacattctcatttatcttttttttctctcttgttctctctctctctcttccttcttccctccctctctctcttccttccttaaagcttattgatttgtgtgtatgtgcttcacatcatgaatccctgtcttgctcacctccccatctcctcataactgcccttcacccttgcaacttccttcttcctttctaaaataaaaaacaaacaaaataaaacatagaaaatatctcattgtggaagctgtagtatgtcacagtcacagtttgttctacagtatgtccctctgtccacacatcttcacttacaaatgtttattgcagcaagtcattggtctgtttcaagatctctggcttctgtgacaccatcaatattggatcctcaccaagacttttcccagctatcttgtctccctgtgtcgtagagatcctgcactattaatcagtaggactggccttttcatgaatcctaattgttagcagatga

SEQ ID NO: 25739 - DNA, 2046 bp, Mus musculus
tcaaacatgggtactggaaactgaaagagtagtatgcaactattaagcactgagctaattttccagccctgatttaagtgtttttaaatgtccttatactgaggagctatgataggtatttagtaggtttgagttggttttttactgtgaatttatatctctagacttaaagaggtagcagaaatcaaattcagctgagttttaggccactgtgatcttaagaattacagacaaacagggctacacaaagaaatcctatcttaaaaacaaacaaaacaaaacagaaacaaacaaaaaaaaaaccctataaacttcacaggttggaagcccagtggtttattacaactttgttttattttgtgcattttgagactatcagccaatctgagcttagagaaaggaacgtgaatgctttggactagcagctcagactggaagtcacattctctacgaggggagcactgactgcttggtagagaaaaggaaaagtgcatgatttttacctttgtatccttttttttttttcacagcgtggtaccatgcgtcgtcgctatgaagatgatggcatttcagatgatgaaattgaagggaaaagaacttttgacttggaagagaagctccaaaccaacaaatataatgccaattttgttacttttatggagggaaaaggtcagtatcattttgattcagaccctgaactccttgatgtaagagtcatcaacttgagattttagcaactgtgcaacgttaaaatatcacctgttgatgttaattttactcataatgctcattctctgccagatttgaagtaatcttttattagaacaagaaggttactgggaaaaacacctttttctgaattcttggcttgagtttaactaaaaatggcacaggtatgatggcacatgcctgtagtcattgcactttggagatagaaacagaaggatcaggaatggtctatgtataagttataatgtatgtataagtaatggtaagttaaggccagactctgctacatgaaactttggatagaaggagagggagaaagatatcaaaacaaaaaagtacaatgaaatttcttttatgatgttggattccttatgtgttatgtagccttgacccttaggaaactgtggaaaaattggacatataatgttcaaactattttagccattaagagacataatttctagttagaatgtatgaagtgactcattaacacaactacctacaagccctgatttttcagtatactttccatatttaataagagatgtaaaatattgtatgcacagagtaacaaacactataaatacctttttacttaaaatttccttcatagtttttttcaatgattcttctctttctaatttttccccatggtttcagattttaatgtagagtatatccagcggggtggcttgagagaccctctcattttcaagaattctgatggacttggaataaagtaagtgctctctggtcctaagcctgagatggttgtaaaatggcttttacacccgggaattcggacagtggcaaatttgagaccccagagcagtaggaaattgaggataatttcccagttactttgtgaagtatgactcttgtctcactggtgattcatatacctagaaataaaaactgtagatgaacttaaaaaccagttaagtctcttgagtctatcagtctgatagaattgctgctaacattgtgggatttcttcctataaaaatgtgtaatcatttatattttaaaagtatttaaacttaatggtgtttctggaaagtgcttcatactttccagatccacactgactggagaagaagtgcttcttatttactggtgtttatttcacaggatgccggatccagacttcacagtgaatgatgtcaaaatgtgtgtgggtaagtaacaaacttttggcctgcctcttcatctttgagggttaggaaccttaaaatatatgttttattagaaagaattgtttaattagcagctcagaattttccttaaaggacatttaaaaagaaaacagctgggcat

SEQ ID NO: 25740 - DNA, 1132 bp, Mus musculus
aaaccagagcatatcaaggtgaaaacaaacactgttggtgatttggtataggggaatagaaacaagtcttttgttctatgctggctcaaggtgattatttatttatttatttatttatttacccatcctgggaaaagtctggtataaagatctttaatcttaaaactataaggttttaagaatcagtgaacctatctataccttattgtaataggaatgaaaatttcaggaattcaacaagggctttctttaggaatataggaaagccaaacagcaatatttcttattctttttaattaactctgtgaccctttaatacagttagtgttgttgtgatccccccaccataattattttcattgctacttcataactaattttgctactgttttaaagcctaatgtaaatacatattctgatggttttatgtgacccttttgcaagggtcattcaactcccaaaggtattgctatacaggtttttaccgcagtaacctctctgggtcgctttactgtaatgtagctgagtgtggtgctttgaatgctaaatgtcctttgtagtctggaggtttgaattcttggtccccagttcgtgggagtatttgattaggtttagaaggtgttgctggagatgtgtcactagggcagtatttgagatttaaaataccatttctttttcttttttgttttttgagacagggtttctctgtagccctggctgacctggaactcactttgtagaccaggctggccttgaactcagaaatccacctctctctacctcccaagtgctgggattaaaggcatctgccaccactacccggcatgccatttcattttattctcttgctttcaatgccattttcaatgtgagcccttagctgtttgtgccatatctgctgtctgctgccacaattccctgtcatgataaggtcttatccctctggaaccaataagccaaaataaattattttgtaaggtgtcttggccatgatgttttttctcaacaataagaaagtaaccaaaacactctgttggtggagtgagaaaaggtgtggattctctggtttctctttatagtatacaaatctctgaccttttacatagttgacttcgtttttactaagtcatta

SEQ ID NO: 25741 - DNA, 1193 bp, Mus musculus
ttttcattgcattttatttattgtgtgctcatttgttccatgttgcggatatgaaggccatcagacaacttgggaaagtttgttctttccttctactgcatgggttttgaagattacaacttcagattgtcagctttggctaccatcttaatggacctggagtccaacaattagtctagtctgactagccagcaaatcccaagactgtttcttctttcccaacagtgggactataggtatcttctctgctaccactttgacctctagctttttgttatttgaagaggcttgttgaaatgttgggatacatgggtgtggagttggacgtgtgcatatgatacgggtctggagataccaggtattggtatcttttgtcttttcttactgagtcagttctcttcctaattgctactctagatagccacttgccctggagattccatctctgcttccggagcactgaaatcatgtctagtgtgcacacccagttttatgtgggtggtgggatccaaactctgatcttgttacttatctgtgggtttggaggattgaatttatgtctgcatcccagaccttgagatcctcttccttgacctcctgagactagtattacaggtgtgtatcaccacttgtaaatgcttggtttatgtggtaatcaaacacagggactcatgtatgctaagcaagcactcctttaactgagctacaaccccacccctaattaaccttggtggactttatttttttttcatctgttgaagagtgaagtgaaactaattaagtattagagttgtaatgcagtattccatatcttcttagctctgggctcaggccccagcaccacaaaacaaaggtgtggaaatagtgtaagtttttaaagctttttaacattgtagggcaaacttattatcctagtgtttatgccccaattatcacaatattgtttttattttactcttatcctgggtgtattctggccaaaccaaattaaattacctgcttaggtttttccacctctatgtaatattgttttctggttcctgttttagtgtcccccccccccccccatctctgtctctctctatatattgtagatgggctttctagccctatgtagtcttgactggcctttgaactcactttgtagatcccccccaccccccaaactcagagatctgtctgcctctgccttc

SEQ ID NO: 25742 - DNA, 1189 bp, Mus musculus
ctgtcctgtctgcaggagatgcacttccatcccaaggctttgaaggatgtgaagggccaaattggggccccgatgcctgggaaggtcatagacatcaaggtggcagcaggggacaaggtggctaagggccagcccctctgtgtgctcagcgccatgaagatggagactgtggtgacttcgcccatggagggcactatccgaaaggttcatgttaccaaggacatgactctggaaggcgacgacctcatcctagagattgagtgatcttactccagcctggcagcctggccgaccctaccccaagcctctcaacagaagctgtgcagccagggcaggcccaggccagccagtacctgagagtaggaaggccaggcccttgaggtcctgtcccatgggacagcacacacactacctgcaatggcctgcccattcccttcagctatttgtccttttcttactggcaggtagttgctcacatattcatctcttgccaaataagggcctgctcctcgtgggagaccacaggtgtacagtcggtggccttgtacctgggggaggtggcttagggcttctacctctgggggtagagggaagacctaattcacaggtcctgggaaatttgctcaataaaagtggccttcccttgccctccacactaggtcatgtacagtctaccgcaccctagtgacagtgtgggtgtatttctctcaaactcccatgggatctaggccagatctgctgctttttttttctttttctttaaacttcctagaccttggtaaagtaggccccgcaagcctgtctgtctagtgttcacggggtgcttggtagagcaggccactgcctaccacccctcacctccctaccacccctcacctcccaaccaccagcctcacaggctagaggagacaagagctccttagggaggcaggcgcatgactgtgagtgccactagtaaatgactacatgtccattttccatcaccagtttcagggagtgggtttcagaacaaccttaaatgtaggggacttaaaaggatattcacaaatttttaaaaaggcaaaggaaaacaaaccattcttgaagtgtggtgggcaggtaagagtggaggtgcttgggagagtccttaccactttcagggctgtgacctttgtcctggattcctccagggactgggtgaagcagaggg

SEQ ID NO: 25743 - DNA, 1145 bp, Mus musculus
ttgatgccattcaggccagaattctcgattcctaagtttaacacagatcactttcaacctcatatggccagtcagctccaacctgaatctactctctaggctgcacatctcgtactagtgattttcagtgtcccttataccctgggtagaacagctcaacttgattttagaaccctatccccagggctaggcctgaaccttggttcctcctaccacaactttggctggtggaacagacatgaagtagaaagccatgtgagaagagagagacttcagctctgctgtcccccagctctgcctgactcagacctgaattcccaccttcaggtccagcaagttcaagatgatggccaaaggctacagaaggcctatgctggagacaaggctgaggaaattggccgtcacatgcaggcagtggctgaggcctgggcccagctccagggaagttctgctgcccgccgacagctgttactggataccacggacaaattccgattctttaaggctgtccgagagttgatgctgtggatggatgggattaacctgcagatggatgcccaggagcggccccggtgagacccatagtgcctggtgtccttcacaagttgtatgatgctactggtggctgtggtggggctgggacagcctgtaataccacctttgtcttggcccagggatgtgtcctctgcagatttagtcatcaaaaaccaacaaggaatcaaagcagagatagaggccagagcagacaggttctcctcctgcattgacatggggcaggagctgctggcccggagccactatgctgctgaggaggtaggcaagacctggagagaatctggctagatgcacctaacagggcccatgcctgtaatttctgttcattttgtttatttgtgaattattgtttgtttgcttaagacaggggctcgccatgtagctcaggctggtcacggttctcttactctatcctgccaagtgctttgacattgcccatcttctgctttttgtcattctctcttagcaagaattctttcactctctcctcccgatgctgtccatagatttctaaaacctcacttctcctcccaggactgttttcctcccctctcgacgttaagttaaaagtcatcgctgtattttggtgg

SEQ ID NO: 25744 - DNA, 1329 bp, Mus musculus
tttctaaaatgaaaacctcactctctttttctacctcctcccatcatatttcccctctgtctgctacaggctgccccaagtcagtccttgtgtatgagctgatgtctccctgtcccctgcaggcagagatgagctcatggctgagagtggtgaatgcagccattgccactgcatcctctgcccctggagagtcagaagagccagtggtgcccagtgccagccggggtctgacccgggccatgaccatgcccccagtgtcacagcctgagggttccatcgtgcttcgaagcaaggatggcagagaaagagagcgagaaaaacgattcagcttctttaagaagaacaagtagtcggggcaagactcccaggccagctccctccctctgttcagaaaactgccagggactgtcgacagagaccaccctcttggcaggacaactgcctgctgctagggtctgctgctaaggtcaacccatcaccaggaactgtcactggggacaaaagagtgttcccacaaccttctcttctgctatttaattcaactggtggtgggacccaggctacccctaataccacccattcctaccttgtcacctcttcccaagccttatacctccacccatccccccaccatggtgcagatagtgccaccctcaacgtgggctatgtgggaaccattgtccctgcctcagggtcattgtgccaccacagctagggtgtgccatccaccattcagttctttgcctctgggatcagccaggaccctcagagctgaagcaggcaggacctgagggcaggagcgccagatgatgaagtcggaggcgctgaagccttccctgcctatcctgcctcaccctctgactcaaggggctgcttgtttccagccactctaggtggctcccaagtgtgagttgttcaggagtagccacatccttgagcctatccaaggaggtgattaaacagctcgacttctctcactgcctctgggtgttgttgctttcctgaccgtagcctctcctggtctcctgcatgtcagatagccactgtacgcccagcttctgagcccccacaaactgtgtgatcctgagagcctccctgcccagtctccccatgatagtgatctgtttcactgggctgacctatgctaagcctctgtttaaaccaaagacatccactgtgggttgggctgatgataattaacagtattcatgatcaaaggaagcaagtcactctccctggtgcacacttttttgttaaatttcttgccgtgcatgcaaggcaagcactctaaactacaactcctcgctaattttcctcactcccaagtgt

SEQ ID NO: 25745 - DNA, 1202 bp, Mus musculus
acccaagctacttggaaacatttctttaccaaatccatgtttcccactcatttcagaaggcattgtctaattgtaattacacatttttaaaattaattttttttggtttgtttttcgagatggggttttctggcagtcttggctgtcctggaacctcctcgggatctgctatcacctaaccttgtacattgtattttgggatctcttcccaaatttgtgggggctccacaactaatgctctactaacagttcccatttttttcttttttaagatttatttatttatttattatatgtaagtacactgtagctgtcctcagacacttcagaagagagagtcagatctcgctatggatggttatgagccaccatgtggttgctgagatttgaactcctgaccttcggaagagcagtccggtgctcttacccactgagccatctcaccagcccagttcccatttttctatacaatttcatttcaccccctttctccctccctgcctcttttagacatggcttttctgtgtagtcaaggctgtccaagaactggctgtgtaatccagactagccttgaactcacactcctacctcagcctcccaagtgctggttaattacaggtgtgtgatatcatttctagcctccagttttatcgttttttattatgtgagttgggtggtgatgagcacattcaggcggctctgtgagttggaggccagcctggtctaagagcaacttccagaacactaagggctacagagagaagcaatgtctcaaacaaacagacaaaacaaaaccccataccccaagacaaccaaaccaaaccaaaccctaacatgtgtaagtagtaccaagttcccagaaaaaaagaaaaaaagaaaaaagccctgctagaatatcctccacttggaacacagaggcactatgtttgtctgttctgtttttcctgtcattaccaaggtctggtagtaacttttctaatttttgtcagttgaaaaggtgtaaagttttattcacaactcgacgtagtttgtttttgtcttgtttctaatgaatttcaaaataccttgttcttatcatttgtgcgaatgtacatttcctgctttccgtcttctgtctggattttaggtctcagcctttgggttgagctgtcgagttttcctcatattgtagctatttctacttggttcagatatcttgtcat

SEQ ID NO: 25746 - DNA, 1190 bp, Mus musculus
agtgtgccttaatttcctttagttcttctatatctaacatgcttaattggcttcaggaatacggcaatgtgggatgaattttacaatgtaaggactattgataccaaacttagaaaaatcaatagtacagaatttagtatagagcgttattattagtacagtatagtccaatctgttccacccatggtgtggaaaagggaaggaaaatgacttttagttacagacttcaactaaactagaacattgtgatatatttaaagacttgttaatacagacaagacattttttgctggtgggtagagaggtagggtgatggctgcaagtttgaaaccggcagcctggttctccatagcaggtttcagggctacatagcaacatcctggggggggggggggagaaacatcaaagattttaatttaaagttagagaggcagtgtaagaattaaaatggaatgaaaaggtcccaacagaattctagcatggcacatctgtggagtatgagtggcccagagggaaaaggaaacatctgagtatagtatagccataatcctggctagtcatgagcatgaggcaggcaagagaaccacacatttgataacaggctatgcaacttttttaagaccccttttcagagtttgggattgtaatgcagttgtgaagggctctcacagtatacaagcccagaactgtcaaaattaaactttggcatttgccttgagtctgtccattcaagactagcctgggtaatatactgagagcttgtctcaggaaaaaatgatgtatgggatgaagtgacttttactgtattttcagtccttagaatgtgattttcacactgtatctgaatctctactagcataaaatggtgtgccttaaaaattatttttgccacatatagtggatatatgcctataatctagcattggggcatggaggctggaggatcaggttttcaaggttatccttagtgaacaatgagttccaggccagtccaagacctgtctgggaggtgaggggggaatgagcagtgctgttttgtatttaagaaggctaatttacatcagcctctttttgaaattctgaccatcagccaaaataactactactggagctgggattgcgggtcagggtttcacttgaatgaaatcagtccattctcatctgctgggttagtaatgttactgtataaa

SEQ ID NO: 25747 - DNA, 1388 bp, Mus musculus
cttttacaagttgacgtataaactttcaaacatgttcagtgtccttagcaataattcttatattgaaacatcctgtcaaactgtttgctgactctttactccaggggctaattggaactttctgtttttttggtttgtttgattttgttttttctattttctctgatgagtttgtggaattaccttattttgggaatgctaatattgttaacattgaaagtaatagaatgtcttcctactatcatgaaagatttgctgtttaattttggagaaaggcctttgttggggactgtttagccttcccagtgattctctcaccttcaagctgttttcatttttagaaattgttgatactagggaagggaacaataaacttaaaagtgagttatcaaggtatgattttgtgagatgttctttgaagttctaagtgggaaagccctttgagctttgctgtaaagcccctgtactgtgctctctttcaggtgggatgtgtgtgggctgaaatcccaagctgcggttgtgcatgagaatacacccttcgtggtgccccatctccgggacgttctcggctctgtgcattcagtccccaggaaccgtggaccttaatttaccttgttaagttctttctctttcctattctctctcctgctcaatttcctgttctcctgtttgctcttctgtagcttcccctttgagttctgctctcccagcatgcctcctatgcagaaaccggtggggctgtgctgtctcctcccttcctcctgactgcagtcagtgggtattggatttgggagtgaccttgttgagaatcactgctcctagttttctattttggcccaaagactagacttagaaatttggagcaccttccagtgaaataaatggtttttcaaattagggtatgtgtgctttgagaaagttcttgtttgggcttgtttctgggttctttatttatttgtaccctgaacagaagatgggggagtgtttaaagtttaagctacttagcttttggctaacactgaggtttttaaattttgctttttaaaatagtagatgactttaggtactaaattaaaaaaagaggttctacagaactcaagtaggcatctctgtttcaatgaagacatctcctactggtctacttctgttgaagccagttagctagtggtttagagctgtagatctttacttgctggagaattaatcattgtgtatacttgcatctgctgttaacactcagtaaacatatctcccttgacttattttcaggaaaaaggtgaaggtttgaggaagaagaggtagctttcatctttgggaaaaatgaaggtatggctcccacagagttatttagctactccataggccagaactacctcatgatgcacttc

SEQ ID NO: 25748 - DNA, 1569 bp, Mus musculus
cccgatcattcctaagtgatggtaactgattttggggtgttgatgcataacagtggctcagaatttttttttcctgtttaatggaatcagtcttgatatagaagttgagagattggagcattctagtttgagtttcttttgtattgggccactgggataggtatttgtccagtcggcagtggatgaaatctcttctgtgtaggagtagaattcttagtaagctggtgttagtgattataatatttcttcttcatctgcttgatctttgcttgaaataaggtcatttataccaagtccatattttggaatttcccctcccccaatgaaagtctttttgtcaatttgccccaaaccaagagttgtttaggtgaccagtgactggggtagaggtctgggctattactttgtgatagcaacccttcttgcgtctgtttcttcaaggcaaacgaatgcacgtgcagttgtccaccagccggcttaggaccgcgcccgggatgggagaccagagcggctgctatcggtgcgggaaagaggggcactggtccaaagagtgtccaatagatcgttcgggccgcgtggcagacttgaccgagcaatataatgagcaatatggagcagtgcgtacgccttacaccatgagttatggggattcattgtattacaacaacacgtacggagcgctcgatgcctactacaagcgctgccgtgctgcccggtcctatgaggcagtggcagctgcagctgcctctgcgtatagtaactatgcagagcagactttgtctcagctgccacaagtccagaacacagccatggccagtcacctcacctccacctctctcgatccctacaatagacatctgttgccgccttcaggagctgcagcagcagcagcagctgctgctgcttgtactgcagcttctacttcatattacgggcgggatcggagccccctgcgtcgcgctacaggcccagtcctcactgttggagagggctacggttacgggcatgacagtgagttgtcccaagcttcagcagctgctcggaattccctgtacgacatggcccggtatgagcgggagcagtatgcggatcgggcgcggtactcagccttttaaagtttgaggtgagagtgggggggtgtcacctgttggttttgccatccctcctgtggcctaaaaggttccaattacgctgctttgcttgctgctgctgcagggctagagtgaggttactaacatggttcagtctacagacacatctttaaatgctgaagtttgaggtaaacatcctttgctcttgtgtctattttttccatggcttttaatagtgggggtcattctcattgtaattgtgtctgtaagaacaaacagtggtatactggtgaatcttgggtcaaacctgcatgtggtaatttgatctgggatccagatattcagacttggttaggtgtactccttctcagagtctgtagaatttcttcgctgtgcggcattagtttttttcgagttgctgtgatccattatgctgtgaaagggtctgaccactaagaaaaagcttgtaattagttaa

SEQ ID NO: 25749 - DNA, 1232 bp, Mus musculus
tagagttttaaaattacataaagatacttataattttggtaacttgagactcagaaggactacattggaaagtgggggttgctttttaagtaggggcgggagcttggctatcgccgggaggtctgggtaggttgactgatgcaatatccacgttgcggggcgtggtgacgctcagctagggaccggtgcggaattgtggtgacagaacttgaattttgtcaggatgtgcacgtgtaagtgacaaaatgtgaaagcttaacaaagttgggagccacgaagctacaggttgccccactgacgcacggcaccttgttcattctgcctaatggctggccgcgctttgaagaattccgcgtttctagctccaccttcagatggacctcttgcccaatcagtggcttcagtttcactaggctgggtgctcattggctttcatataaaaggtccaggttactgacgtttccacctcttcctggcctctcaggtaattggcgttccgggtaaccaatcaggaagaggatctccgggaacgccagccttttactttaccgaacggccaatccggtgggtaggttcacccctctttctacccagagtcactgctgtggccgccgccattttagcgttttgtcagaaccgtccgcgctgcaaggaggaggacctgcaggtatccatgcggtgagatactccacgttcttccactgtgttcttttctctgttaaaaaaacttacctgactccggtgggtgtcagggttggcatagtggggttgcggtctgcgcacccgtccctgagagccgacatcggtcctcgacttagtgcggtaagcctgaaacaaccttcctccaagtcctcgttctctactcccggaatagctttcttttgtccaccttaccctctgctttgctcaatcttctttggggtttccacctagataaatcttagatttaggctggagaatctgtcatgccctgggcattgttggcttcctcaccaaactgtagcaccagtctttgaccagttcttctgtaggagcctgtaatgacatgccccacccccacccccaccccagaggactcctcctactcgggcattttctatatttccctgctttttatctggttgatcccggaactcactactccgagtgaaattcccacttttccggaaatggttgctaagagaggaagagctaatttgaagtaattataattagcaagtctagtagttaga

SEQ ID NO: 25750 - DNA, 1067 bp, Mus musculus
ttggaaatccgcctgcctctgcctcccaagtgctgggattaaaggtgtgcgccaacaggcctggcctgaataatgtattctgaataggtagagacaataaagccagtctatctggagggctggtaataactaaggagactggatgggtaggtttgttagaccacgaagcttggatccccgtccccggtttttcctttagaccaagtcacactatataggcctggcaagcttgggacttgctgtatagaccgtctggcatttaactccagcggtggtattgtctggagactatttccacttggggattggtcacagggtgagggctgtctgtctgtctgcacactgtggggatagtggttcccttggcttgttagcaggctcttccccttcagaccgggagccagtccagtttagtggagtgaattggtcttgtttgctactgtaaccccaacctccaggaattttggcataagaaagatgattaaactgagagaaaatgatttctataccctatgcatttctgggtgcatattgagatgtggctgtgcattttagatcccctctgaaagggcctgtgcaggacagcagaacttgtattacagatctcaggtggcttttactcagtctcaggtgctgcagaatgaagccatggccatatttaatgtcatattgttactttttaaggggcctatttcctagccttaaattatagactaattttctgctatagaatccagtagcttattttctgtctctgccttttgtttgactttttctttcttttgtggcagttttgggaggtagtatgctctatttgttattttactcccaatcatcctgttctcatgaagttccccctgctttctgcctgttcacctttaagttctccattcagcacctttcccggttatctccatcttaagaagctgcgttgcagagggtcatgactaaagttgcttgctcaatgagtatgggattatgtgaagcagccagtgggtgagaaaaatgtgatgagggaatttggaccctgtgaagaatgttcgtttgtacttgtttacagctgattg

SEQ ID NO: 25751 - DNA, 1102 bp, Mus musculus
ttctaattcctgtactgtacacaaccctcccaccccgcagcttgtcaaaagtccttgcacatctgctggtccttcaggcattttgtctatcaagccaagtcagtggacaacagaacagcatgactgcataaagtcatagtgaaaacaccttccctagatttatgcactagttttattttattattatttttattatttgtttatttatttatttgagatctgtctgtgtaacagtactggttatcctggaatttaccatttagaccagattggcctcaaactcacaagagatctgcctgcctctgccttccgagtgctgggattaaaggtgcaagcctccactcctggacggagtaatgttctttcatagaagacagcacatggggagctagatagttacctaaattctatttttaaatgatgttaaatgagagtttccagaagaaaatttcttacaagtgatttctggtctaactctgagtcatttgaaactgtgtgggaagcttgagatggcagtactgggaactcagtcttgtttaacctagagaaaaacttgagacttgcctctggcttgctgaatttgaatgctggctctctgctgcctcttcgctgtgtgactattggccagtcaggacttctgcctcattttgtcaaccagcatttttttttctgtctaagtttgtgagacagggtatcattatgtagcagtggctggcctggaatccaatgtgtggatcaggctcacctcatactcagctgtttgcctgcctctgtctggtgagtgctgtaattaaaggtatgcaccaccataatcagccttttctttgtcatactatattttattttattaagacagggtcttctgtgtcaagttggtcggtgtcccaactccatatgtagctgaagatgaccttgaaatccatctttctgtcttcatatcccaagtgctagtattgttggcaatccaccatgtccagtgtatgtggtgttcaggattggaatgactaggcctcctgcatgttaggaagcactctgccaaccgaattgtagccttccttatctgacaatgatcatggttctaagtgctgcttaaaagtcgtct

SEQ ID NO: 25752 - DNA, 2588 bp, Mus musculus
aagggagagagaggaagaggtagggtagggtgcagacccaggttatcaccaccctctctcatacctctcccaatggtggcttttcattccctccctctatcatgtgggccttccccaggagaggacccttttgtgtttggcagtaacctgctttgtttctttgcctcagcagcacatcttgctactggctttagatctgtggttttccctctacccagccatctccccagaatgggaatttcttttatattttaatttttttcctggctcccttttatttttgtgcgcgatacttaaggttgtttggaggtgatacaaccgacagctgatgtcaggcggcgcgtttttctttttagatgcgagggaggccaggaaagggttactttagctatttcctctgtgcccagctatgccagcagtccaggggccctgcctgtccttctgtagaggctgttgagactgagatcctgtgggacagtcagttggtccgtgtccaaatccccgcttaccactgatgttttagctgatggtgactggcatagtcccaattccctatctctccaagtaggtggtgttagaaatcttaattcttttcccttcttttgtatggactacaaataaaacttggggcgattcgtggtttggaaacctggttgtcattgtcttgattgcactgtcaggtgagccagtttgacatccaggaagacgtgacagctagaagaaaggcagcctgaagacccagagtgggtgtggaagggtgcttgagtgtggggattggaatggtttcctggcgaccaatggaattaagctcatcttaaatagcatgccatctttgggactagagagttcagatcaagtggttggactttctcagcaatcaattttagttgatcacgtcaaatttcagtaaacatgcccattacctctacttatgtttgaccaatgtccctgatttttttcccagttcaggaaaaacaaaaataaaccaaaagctacacagtacagcaggatggttctggctgcgatctggctgggctgggtactgggtactggcagctgcaaaggcctccaggtagtgggcttgaggggatgttgagcctggggtctgggaaaggagctgtagtggtgtgggagtgacaccactatctggtactgccctgtggttggaggaatgagggcattgggaatttgaagcatatggggtgttctggccaatcctcgtacttcgcctgttgaacttcaccacggagcatccttcctgtttcctgccaagctaagccatcacagcacctgagactccttttccctgtctgcatctattacggtttttagatgtcttctggctgggtttatatttgaaggtgttataacagacatatttttgagaaggggctggggtacaaatattatcaagtagggatgctaagattggatgaagagtccagagttctttatatacttctggggtggaagacctgggtagtttcaaccaggaataaaatggaggcatgaacttggtgggtaaatgaaagaagactagataagtggaacgataactgaaacctgatagtccttggggaagaatgctttagagcgcttttgggtcttgcaaaagggagagtgtgtgtgtgtgtgcttgtatgtgtaagtgcatgtatgtatgtatgtgtgtatatatatatatatatatatacacacatttacatacatatatgtgtgtgtgtgcacgcagctgataagttgattgggagggttgtatattggcttcatatgaacttggctgtgacagtagcttgccccagatgtcttcttccttctgcccatcatgtaaaaatgccttattattacgagttctttttttgtggttaagtgggataagtctcaggctgtgtaggggtcagagttcttttattttcttctctttctgctcatcgcctccccttcaggtgctttgctgctcattttcattcttttgcaggactgggtagaatgggaggataggtttcttgatactttctctgtgatggtagaatgacttgagggccaaggtacaggcttggcgtgactgggggaatagagggttgaatgcaggctgagatcgtggcttttgtatttacagtattcctttgtcgttttcctttccagttcttgttctgccacagtcacaattccatggttcctgcaaaaacccaaacaccaccaccaaacaaactaaatccctcccactcccaaaaccagctcaatacacttccagggcctgtgctgaccttcattgcagtccaaactcttcaaggcggtttggcctattgaatcggtctaatggtcggccatctgtagatccacatgcattgttgcctcagcccttggggttttcactaaagccagaagaaactacacagctaaatcatttgccactttcctttctcttgcagattgtttaaaaacatccttttatttaaattaccaacctgtgttaattctataacccaatcatactttgctttttatagatttctgagttccaagttcttaaaagttggctttggtgaatgggaggacagaaatgtaatgagtgttttggggaaccg

SEQ ID NO: 25753 - DNA, 2117 bp, Mus musculus
gacctggatgtagctggcaacagctgggtgctgttgtgtgtccagtttgggacccactaggtagcatgccctgcccccctaattgctaaccctctgtctgctgctttatcagactacgcgtttgttcacatggagaaggaagcagatgccaaagccgccatcgcgcagctcaacggcaaagaagtgaagggcaagcgcatcaacgtggaactctcaaccaaggggcagaagaaggggcctgccctggctatccagtctggggacaagaccaagaaaccaggggctggggacacagcattccctggaactggtggcttctctgccaccttcgactaccagcaggcttttggcaacagcactggtggctttgatgggcaagcccgtcagcccacaccaccattctttggtcgcgaccgcagccccctgcgccgttcacctcctcgagcctcttatgtggcgcctctgacggcccagccagccacctaccgggcccaaccctcagtgtctctgggagctgcatatagggcccagccttccgcctctttgggtgttggctatcggactcagcccatggcagctcaggcagcttcttaccgtgctcagccctctgtctcccttggggccccatacaggggtcagctggctagccctagttcccagtctgctgcagcttcctcgcttggcccatatggtggagtccagccctcagcctcagccctttccacttatgggggtcaggcagctgcagcttcttcgcttaattcctatggggctcagggctcctcccttgcttcctatggtaaccagccatcctcttatggcgcccaggctgcctcttcgtatggggttcgtgcggctgcttcttcctataacacacaaggagcagcttcttccctaggttcctatggggctcaagcagcctcctatggtgcccagtctgcagcctcctcactagcttatggagcccaggcagcgtcttacagtgcccagccctcagcctcttacagtgcccagtctgccccatatgctgcacaacaggctgcttcttattcttcccagcctgctgcttatgtggcacaaccagccacagctgctgcctatgctagccagccagctgcctatgctgcacaagccactaccccaatggctggttcctatggggctcaaccagttgttcagacccagctgaatagctatggggctcaagcatctattggcctgtcaggctcatatggagctcagtctgctgctgcggccactggctcctatggggcggcagctgcttacggggctcagccttctgccaccctggcagctccttaccgcactcagtcatcagcctcattggctgcttcctatgctgcccagcagcatccccaggctgctgcctcctaccgtggccagccgggcagtgcctacgatgggacaggccagccatcagcagcctacctgtctatgtcccagggggccgttgccaacgccaacagcaccccgccgccctatgagcgtacccgcctctccccaccccgggccagctacgacgatccctacaaaaaggctgtcgccatgtcaaaaaggtactgtatgccccccccgcctcagcccctagctggggcttagggcaaggggctgaggttggcatgggagggaaacaggagccattggcccctcccttgatcttacttctatgggatgtccaaaagtcatgagggtgagtgtctgaacagttctggccattgggatttaggtggggcatagtgctcagcctggggtgataccaacaaacttagggtcctcattctaggaggcccctatgaaccgatggagccacattttgcaggattggctcatagatttttcccactgtctgaaggatccttaaactcactcctttgttctggttttggtgggatggatgtgaaagaaagtagtccttttggcactcactggctgaaggcaagcttatgaggtgcgtccaccctgggaagttggggaccctactttcgtccgtcgttctgttgataaaccaaggtctttttgtgcagggcccatgagtgggaatagcttgtttgggaatgtagaccagactcaccttggctggtttggaagggagcttc

SEQ ID NO: 25754 - DNA, 1129 bp, Mus musculus
ttccaaatccaagggatcccacaccgtcttctggcttccacaggcgcccatccacaatgtgtggcacacatatctagaaacatagacatatgaagaaaataaaaataactcggtagagctgggcattgtggtacatatttttagtcctagcatttgggagacaacagaaagcggagcgctgtgggctcaaatctagcctgatccacatggtgagtgagttctaggccaaccgaggatgagaacttgtctcaaaacagtttttaaagaaaatactctagaataaaacagaactaagcaccaccaccagtagagtgcacagaaataagacacactggtgctgaatatttcatagcctgtgtgtgtctgtccttcctttcctttatgtttttttttgagacagggtttctctgtgtagccctggctgttctggaactcactctgtagaccatgctggcctcaaactcagaaatttgcctgcctctgcctcccaagtgctgaaatgaaaggtgtgtgcactacgtgtttcttttctttttaattaactaattaattaacatctcaaacactggctcccccttcgtggtacccctctcacagagtcccttcccctcccctcttcctttctcctgtgagagtgtgcccgcttccctgtatcccccacccctggcacatcatttctgccagattaggcacatcctctccaactgaggccaggcagggcatctctgttggcgaattgataccacagtcaggctacagctttagggagagtctttgccccagtcgttaggggacccacatggagactgagctgcatgtctgctacataatgtgccgagggcctcgttccaacctgtgtgtgctctttggttggtagctcagtctctgagtgttcccgagggtctaggttagttgactctgttgggctttctgggggggttcctatcccttgcctatgtttcttaatgcatctaactcatcttttaggcttttaacagctcttttcttttctaatggtcaaagcaccccctctctgctctgaggtgggatagacctgtccttttgaatggtccattgcacagcgtcacacttctgctcagtgtgtaagtgatgttgccttgaatttaat

SEQ ID NO: 25755 - DNA, 1202 bp, Mus musculus
tctttcccacaccctctcatccctagatgtgtcatcactagtctgaggagatttcctcagaggggtaccggggccctggggttatgtaaggagcatgtgatctcatgtctgtgggatgctcggcagtcctctatctgggagaacgtgagtaagtcataaacagacgtctacttattccccaggagggctggagacagaggatgactacggctaccagggccatgttcagacctgcaacttctcagcacagatggcaaaagtctacatcaatgattcagtggagctgagccggaatgaaaatagtgagtgggggtccctgtaggtgggtccaggtcgatactgctgggccaaggtaccactggcactgccttcccctttcagagatagcagcctggctggcccagaaaggacctatctcagttgccattaacgccttcggcatgcaggtgaggtcctgacctctctgtccctccccatctcgccagtgccttcctcccttctccttgacgctggccccctgcttcgttttcttctcagttctatcgccacgggattgctcacccattccggcccctctgcagcccttggttcatcgaccatgctgtgttgctggtgggctatggcaaccgtgagttccgctggcctcctgcttcccttccgtctacctcaggccccagtcagaggctagatagcagcctcttaggccttctgagggggatcaccctggtcatgcctgagaaccttgtcctgaaccccagcctcagaaaaacacccgtgtattttgtaggcagagaagctggggctgggggaggttggagggttgttctagaggcaactggacaagtgctttctctaagccttgtatgtacatgaggtctccatgaggatggtaggtgggccttacaggcgctgctgttttcgtacttcttgttacaccataggcccactgacgatatttaaagggtgcagtgtatgaatctctgagtggagaagggtctctgacttcttgtactccatcttgttccccaggctctaacattccttactgggccatcaagaacagctggggcagtgactggggtgaggaggtgagttttgcccggttggcctctgacccccctccagcctctcccttacccaagccctctaaccaagcccactgtcttgcagggttactactacttgtaccgtggatctggagc

SEQ ID NO: 25756 - DNA, 1195 bp, Mus musculus
gagggaattgccacaggcaaatggctacttctttctgcctagcatgaaggactccctaaagccaaactgaatgttgtcttgggaagagaatatcttgtcactggggtgatataagccaagtatgaaaaatccccaggaggggacatgaggagcaagacctctttcctttagcatgtatggacacagtgcctgatgtctatctctgcagggagaagtggagtttgctcgaatcatgaccatggtggaccccaatgcagctggggttgtgaccttccaagccttcattgacttcatgacccgagagactgccgagacagacacggctgaacaagtggtagcctccttcaaaatcctggcaggagacaaggtgaatctcactcggtggaggggctgcaaggctaggacatgacccaagacccatggtcccttaatgtctcctcttttctagaactacattaccccagaggagctgcggagagagctcccagccgagcaggctgagtactgcatccgtcggatggcgccctacaagggatctggggctccatctggagctctggactacgtggctttctctagtgccctctatggagagagtgacctctgacattctccgtggaaaaggagagggggcacttcctgtggtggattcagctgtccctcagggccaggccttcaggtcatccagtgccatgcttctgaataaagatcaggctgtgggcctctcccatctgtttttgttttgtttttgttgttgttttagatttattttatatgagtatattatcactgtcttatcactgtcttcagacacaccagaagagggcattggatcccattaccaatggatgtgagccaccatgtgattgatgggaattgaactcctcaggacctctggaaaagcactcagcttttggttcttaaggggaacctgagccctggaggtccttggtgggccgtctaccccaccctgacccaccagggatccctaaggaccccccttttccttcagagactaagcacttacaccacacaaggagagcaggctacctctttattgcccttagagaaggccggtcacaactttcctggatgtggaaagggaccagaaaactgacagcatcagaccgaggagcaccaaagcaaaaagacagagcctgctgaggacagatctagttttatgacgagcatattt

SEQ ID NO: 25757 - DNA, 1467 bp, Mus musculus
caagagccactcgtactctaaccccctgagctatcactccagccctgacagagtgcttttatcagtcatttttattagtgattgttggggttatgttggctttgttgagaccaggatttcctaggctagccttaaaattaataatccttttcccccagttccttgagtgctgggattatggtgtgtgctaccatgccagacatgatttaaatcttgacttgagggaaggatgaggtcaagtggcaattcatttaagtctaagtctccccccatgtaattctgccttcctggcagggttattctgatgtaggtaattagataactatcctgaacattgacagtttgtgccggagctcgctcagaactcgccgcccctaactacatctttctgtgctgctgttttctctccatcccccaggctcagaagtacaacttgtggagtatgaggcctcagccgctggtctcatccgctccttctgtgagcggtttcccgaggatgggcccgagttggaggaggttcttatccagctggctgcagcagatgcccgattctggaggaaccaggcccaggaggccccacctggccaggcttgagaagatctgtgtggtctctcccctctttgtcaaaccagggctgtcagtagctctgagttgtgtgtgattaggagtcaggggagggaggggcaggagcttggactttggtgctacctcagctgagggtggtgatgcgaaccccttccatttgtcagcactttgcagtttaccgtatgtcctcagtttctggatctgcactgccatctatggccggagctcaacagggtgcctagtccggttttccacatgggaaggtggcaattctgagaagtgactgttctagacccggcaggtggcatgtgacagagccagggctcaaagcattctcaccaaatccagcgctcttcgtgtattacttttatagccagaaaaataaatatgacgaccaccatctctgcagtgtatgtttctttctcttccagttcaaagccaggggagggcacactacatcactttaggcttccaatccacaataagattttgaatatcatttccaaaggaatgcacaaactcacaacgtgttccggagctcttctttgtgacatatttcttaagatttgtgtgttcgtgtgcattttcttcatgggtgtggtggtggtagcagagaccagaagaccccatcagatgccctggaactacggttacagaattgtgagctgccatgtgggtgctgagcagtccagggtcctctgcaagagcagcaagcactcttgtactttcaaatgtttccggagccaaagaaccgtaacacactaacatgagatcctcacccattaatttgtttctcagtctagtcttaatccctaaaaagcgctcctccccaggcctcaaagcccaggcccctgtctttaatgcagaaaccataagtcaaca

SEQ ID NO: 25758 - DNA, 1634 bp, Mus musculus
taaatacgtcttttcttccggctgggccccagtggacccatctgtacagtggggtctctgacgccattctgtgagctcctgtgaagaaaagaaggggaggtgaggtatcagccctggcacagtggggttttagccaacctgttaggatctgggaggcacagaggctacttgggctgacccaggctggggctcttggtctctgagcctccctccgtcttcccaccggtgatgtgtgttggtgacagaggcttccccaggaggtcactgtggaagatgcttggcatggcggggagggccgtgttggcagcatgagtggtagcagcagaggcacatggggagaagcagccatgctcagtggcccacatattaggtgtctcttccacagctctggagagtgagttcccgtacagtttcaggtggtccctcccttgtctggaccccagtctcccccgtacagtgaagtgcatgggtgattcctaactgctgagggatctgaaggagtagttggcatccccgagctctgaggatgccgcctttcttctacaggatgagaaaggtgctttcaactttgacaaggagactgtgatcaacccagagactggggaacaggtaagagagcccctgtggagtcaggcagctgggatgggggacacaggcaggccctgattcttgggtcctgggtcatccttctagatccagagctggtaccggagtggagagacgtgggatagcaaattcagcaccattgcctccagctacgaagagtgccgggccgagagtgtgggcctctacctctgtctcaacccccaagtgctggagtagggaaccgtgggctggaggggcggtgggctgagcccccacgctgggccgctctgaaggtaccagagcatggggctaatctcatcatccctgtctccgctccaccaggatctttggctttgagggagctgatgcagaagatgtaatctacgtgaactggctcaacatggttcgggctggcttgttggctttggagttctacaccccagaggcagccaactggcgacaggtgagacaggcgaggagcctgctatgtggccactgtcaggattctgggtgcagggatgggacaagtgcatcccccaaggccagataaacttaaactctaaccccagactccactgtagggaaagctctatcacatcttagctggaagaagagcatcaggattcaaatttatgtagtcttccttccttagccactggactcagccactcagtcacagtttttgttgtttctccaaaccagtcacttcatttctctgggcctcaatgttttgtcatatataaacgtggggtagtggtgcctactcagttccattgttgggcacaaaaaggatgatgagagcgagtcctcagggtctttagtgaggggccccatgagtagctgctgcctgaagcattcagaggtgtggcaagtgatgagggcgaatagggcaccatgttctgcacacagcccgcctcagtgaacactggagaaaggaagaaattgagggcagaggagtgagcagagtggacccccagggtacaggggaataaacagatgatgtcatctgacgattggcatgttgaaaacatcagcaagttgtgcactaa

SEQ ID NO: 25759 - DNA, 1237 bp, Mus musculus
aatgcaggaacagctattcctccctcctgctgctgctgccgtgggttactctataaaccttgctgctcagctgcccttaaagatccacgtgtcccgaatgcatgcaatacctccagcccctagtgagtaagtaacaagtgggcaggcaggcaggctgagatcagcttttgctgacttccagtacaggcaggatagtgacaagtgggggacacatggacagtcaggctctctacctagtggagggtggacagcttcatgtttgtttggatcggggaattctagggcttgggagcagcccttgctgggtttgggaaagtaagaggcttcatggaggtgggtaaaacaggagctcagcctccatggtggcttggaatcttacaggcccacaaggtaaggggtctgtaccctcttcgcgtaggttcagggtaaagaagcaggggtggagaaacagattaaggggagcacggggtgtggctatgcataatggtgaattcagaccctcatttatgggcagctcattgctccccagcaccgtctctgaaacaagggctaccactgctgaatgttcactgcgtgccccacccagcctaacaggaaccacagctgcatccacggcaccagggctctgcttccccaagatgttgttatttaatccagtgatctgggaaaggagattggccctacttgggttcttagagcgagaattataacctagctggaagctgttattgaaagccacaaccgcccctctcagatcatactaaggctgggcaagaccgaggcaaggcaggttagggtctgtttcctgggaaagctgagaaacagagagatagctatccactcaaccagtgcctagggtcataagagccccggcgatgagcaagggcttccggtcagaggagggacctaggggactattgccagactaggattacaacatcctgctggccatctgtacctgctggggttgctgtgcgaatgaatggcagacactgtagagataggatggagtatggagggcagcctgggtgagggaactaacataagacggcagggagaaggcttcacagccaacatgcaggtcagcagaaaaaaggagaagggaccagggttaggctgggacctggtgggccttggtgactatgagagtgaagttagtgatgagtccctccctgtgcctcctgtgtgagccagggcttcctttgagccaagggctaagatggggttttcccctgac

SEQ ID NO: 25760 - DNA, 1193 bp, Mus musculus
tggtctcttggtctgtgggttcgtggctggtagccacgttgcatatggtgaggaagaatccaccactggtcactctgcctctcagctaggagtaacacgggacacagaaacctggagctcacagagatgcacaaaagggcaagttggaaggcagctatgggggaagcaggcgcagggcccttcactgccctcctgactacatttcttcatcagtccatccactgaccccagggagcaaagccagctgtaggtcttgcttaggacaccctgacggtctctacctcggctcagagtgggacctgggaccagctccagagcgtcagcgtccccttctcacccacaggccctgacagggcatgaagtgtcatggaaactgaggggaagagaaagctcaaaggacctctgagcctccaacagggttttctcgaagccaacacccctagaatccagatgggcctgtctgacagaaaggcagttggcctgcatgtgttgtgcactgcactttacagtttgcaaagtttttccagaagcctctgtgaggcctttggaacaagctgggcagggatcatccccaggtgggattcgactgtctatggaagagtaaggcgatggccttcatcgccttccttgtaggtgctgcccctgtcccgccacttgcttcttttcctcaaagttctccaggcaggtgccctcggcacttgctactgtgtttttgccccatttctcctccgaccctgctcctgcatccaattaaaactgttcatttctacgacggattcctggagtgttcacttctaaagtattggcctcagtaaactgggtagggccgagatggctttaaggacgtgacagattgaggtggccagttcttgggggggcagaggtttgcatgctggctctgctggctctctggacctcttgacagctgagcccaccaaatgggtttgcaagaagctgtccttctagattacctgggcttaattcccagcacttacgtggtgactggaaactctaactccagttccaggggatccaacgccctcttacggcaccagggctctgtggacaccaggcacacatatggtgaacatataattgtgtaaattatccagtatttataccaataaagacgcaggaggcataaacggaattaagaacctgctagctcagtgaggtaactttttattgtctga

SEQ ID NO: 25761 - DNA, 1155 bp, Mus musculus
aagggattcaaggaggcattgaagttccatccccaaaaggaggctgaaaaccagcgcaataagatcctttaccgccagttcaaacaggagttgaaggctaggtaccccaactctccccaccgatgctgagtccttgtcttccatggtctgagaattgtcagtatctggctccaggcctgactggggtaagaaacatgcctccactttacagaggtagctatgggtttggaacactggacttgactatggggtgctgggagtcaagtctcagctttaccactaactagctgtgtggccttgagcaaatactattacttctctgagcctccgttacgccgtctgtaaaaagggaggtgaaaatacctacctcacagaactgttggctcagatgagacgctgtatgtgtaaacatcctgtaaacttcgtacaaatgtgaagtattattaatattgctacagtgttattatgatattgttactattaaccatgttgggtggatagcggcagagcaaaaagtttgaatgggctagaggtgggaagcttgagtgtttaataaaatgaggcttttggaaagaaagatgaaaacgtagaatgtagtgctaagaacgtttcccgttctctcatgccttcgccctccgccctccgagatccctgaaggaggaaagagataaaggttaaagtcccagatctgtgccctccagtaggttgggctgctcatttgccttcggatgacattatgtaaataaacgaatgtcacacccacagctggctctgttactctcctaagccgaggggtggtgggccggagcaccgtgttagacggcggtggacccaaggacaccgaccacaatgctaggacaggctgaaggcctgggttactgggggccagttgctatggagacccgtccgccgtatcccggcatgcctggacaccagtggttccattgtaagcgccacaaatgggcgcctcctgatgacgcacacggaagcgtcgacacctcctggagaaagagaatcctgcgcagcactgttccggagatcaacggcggcggcgttcacaccctgggtcggacagctctccgggagtcctggacgtgaggccggaggccccagtgtctgcggtgcgtatggccacgcccggcgctgggttgggct

SEQ ID NO: 25762 - DNA, 1155 bp, Mus musculus; identical to SEQ ID NO: 25761

SEQ ID NO: 25763 - DNA, 1686 bp, Mus musculus
gctattcagtgaggtaaaggagcagggcttcaaggtcaagtgcagtctaccaagggtcttgttgcaagccagtcaggaacttgggtccagtcccattggcagtaggaggcctttcccattatgactcatagccttggtgagcattcccatgcatctcagaattctgtaagaggagcaggttccatcgagcacgttttcagtgtggtgacactagtcacttcccctgtctcgttcgaggcttgtgtttggtcagctccctgtgtggctgctccaaaagtggccagtggccagtaatagcccatgctccctctcccagagcccagatgcccatccagccttcaggcaaagaaacagaagagatggaggcagaaggggattcagcagctgagatgaacggggaggcagatgagagcgaggaggagcggagtggcagccaaactgagtcagaggaggagagctcaggtgagcccctgcaacctctccatctccccctcccgcctccccccgggagcagcagcctgcccctgcagaaccattcctaattgccctctcaccccagagatggatgatgaagactatgagcggcgccgcagtgagtgtgtcagtgagatgctggacctggaaaagcagttctcagagctgaaggagaagtgagcatgggagtgctggcgggcctttgtgcagcaggggtgcgggtgcccgtagtgacgagcagcaagtggggcacaaggggagcaggtatttggtaggcatttacctgagaggacaagtgaccattggagaagccggtgatacgcagctgcctttttacctccaggttgttcagggaacggctcagccagctacgtttacgactggaggaagtgggggctgagagagccccagaatatacggaacctcttggcgggctgcagcagagcctgaagatccgcattcaggtggcaggtctgtagctgccctgctctgctcccaaacagctctctgtcaccttccactttgcccctatccttgtagctcttcctttgggggacactagggcctctggccaaacaggactcctcttccctctgcagggatctacaagggcttctgtctggatgtgatcaggaataagtatgagtgtgaactccagggagccaaacaacacctggaggtgagctggcgtggacgggccccacgggaagttgggtgagactgaggtatggcaggtcccctgctgagcggctgtcccctcccagagtgagaagatgctgctgtatgacacactgcttggggagctgcaggagcggatccagaggctggaggaggaccggcagagccttgacatcagctctggtgaggccagggcccgatcctaaagcgccccacccttttctggacctcagtttcccaggctgcttaaggggagtcaaaaggcccacttcttggggtcaggaaagggtgtagctcagcattccacatatagtgggggctcatgcagagtgggtcccctgcctgaccctattgagaatgcggtacccaactgacacatggatgcatataaaaaaaccattgtcctctccgtggtagggcgtcagtgttcatatgggatccacaaatttccttcatccccatctacaaagcaaatagaagacctaaggcttaagcaaagaagggcagtggtcttccccaggctgcactagtgca

SEQ ID NO: 25764 - DNA, 1193 bp, Mus musculus
gtgtcccctcagaagagaaaagcagacggtaagagccatgacgtgggcctgtcagcttggtagtctgatctcacttggaggcttttgtgggattttgaggataagaaccaggttggagaggctcttggctgagggagcagggacaggtagaggtggaaagtaggctggagatgtagctcagtggtagtgcgcttgccgaacatgggcaagaacccagtcccaatcccaagatcacaagaagataaaagtgcctggagcccccaggcagggtgggtccaagagggcaggaagaagaaaccctgatggacgagggagtaaggcacttcctcactgccgtcaggaaggaagtgctggtggtccttttggttcaactcccttcagaagtttcccatatcccactaggaccctgaccctgcatttactctcgctcggagggtcctgggagcagctggtacctcacgcaggattaacatttctctgcaaaggcagggggttgcctagtagctcttcagtgttgctgctggcccctgaccctctgccaccactggcctggactcctctgctctccttgggatctgcacaactgtggccctgaagccgacctggccaagcaagactgtggtctccatccctgaccagcccactccctcccaaagaataacttcttcagcgtccccccacagagagaccaggcctcatccagagtcacagcagcagtcctcctgaccttgaaccctggccctcagccactgagccaggcccaactgtaggaggaactctcaagcagacatgttgggccttgtccaccctgactgccgctggagaggacggcttcccaggctttctcagggctattcctggtgtctgcctctcagattccaaagactggaataaaatttaacctgggaccttggtgtggctgatgtgtggctgctgtatcttaaaagggaatcaaggctttgtgggagcacctaagacagactttgctggggtccctgtagtttgtgacttagagaaaagcctgggagaggaagttgggaccagagcaggaagcgccgcatggcacaggcaagccagagaagcacatggccttgtgtggtgaagggacttttggacatgcctggaggccaggtcatgtctgcacctgccccagacactcggcagattggcaaggcaggctagctagcagggcc

SEQ ID NO: 25765 - DNA, 1197 bp, Mus musculus
ggcagctccagaccctcctccactcttcgatgatacaagtggtggttattccagccaactgggcggatacccagccccaggagctgatgtagccttcagtgtcaacaacctgcttggagacccagtggccaatatggcaatggcctatggcacctccatagcatcccaagggaaggacatagtgcacaaagaggtgtgccctgggctcccgggaggagggaggcagggcttctggccagggttggggtgtcacaggatcccatcttactccccaggcatcctttaggaaggatcacggtagggctcatccatagcctcttctctttacttccagctgcaccgttttgtgtccgtgaacaaactcaagtatttttttgctgtggacacagcctatgtcgctaagaagctagggctattggtcttcccatacacacatcaggtgagcttcccaccaggagagctggccagcctctccccactcgcggataacctgactgatcatcagatctcaaccctctctctctttctctctgctcctgtttacccgaccacctcgccacggccagaactggaaaatgcaatacagccatgatgtgcctctgcccccgcggaaagatctcaatgcccctgacctctatatccccagtgagtctctgatgtggggcttggccacaaaggggacttgtgccttgagcatagttaggaagacgattctgttaatgacccagcgttcattcctggagctttccacgtgggactgttactagacactaagttgacaggatgaccagtaggaaacttcctgaatgaccttgatttttttttttttttttttttggtttttcgagacagggtttctctgtgtagccctggctgtcctggaatcctggaactcactctgtagaccaggctggcctcgaactcagaaatctgcctgcctctgcctcccgagtgctggggttaaaggcgtgcgccaccacgcccggcactttcctgacttttaaagtggaccctgtctctctccagcctggagctcagggtttcactcggcccagcagttcccagctgtagggcttcagactttggatcctcacagctgcctgcgtccccatggcgcttgtcaggctacctacttgcctctgcacttcactctgtcctgttggctaagaaggttcaggctcagggcacacacaagga

SEQ ID NO: 25766 - DNA, 1247 bp, Mus musculus
acagcggttacaaatatgtggggtgagtgcctgcaggctgagaggagcctgaagggtctcaggctacaggttttgggcctatgtagcaacagccttcactgtgatgctagagacagttctactccgtctcaaccgccagctctacgctgtgagttggtggctgtttctgacagtctccccttggagccagtgactttaaagagactggggatttgttagttaccttggggagcccagagaagggaaggggagtttaggccctgggactgagtcctgaaccttgcaggtctatttggagtctggttctttgtagggaacagcccagtgttgtgggtcatggtactgggtagttgtaggccctggtgggtggggctagtctcaggctccaacctcaggaacctccagttcactcctgcacccccagttcattcccacttcactcctgcacccccaggatgatccttagtgtgctcacggggctgctcttcggcagtgatggctactacgtggccctggcctggacatcatctgcgcttatgtacttcattgtgagtgtggggcggcccctccccctctcctctgggacacattccccttcctagcccactcagctctcctctcttccaggtacgatctttgcggactgcagcttcaggccctgacagcatggggggcccagcccctcggcagcgtctccagctctacctgaccctgggagcagctgccttccagcccctcatcatatactggctgaccttccacctggtccggtgatccctggtccttaggtggcactcatttttccatacattgaagatttggtttccttaacttggcttgaccctggttcctgggacctgaggggaagccataggtatctgctttgcccaggggactaggcttcaggcttctaagagaagggtaagcggattctgggagagcatcctcgaggcatcttttatactgctttgaaaaacagctggaagggtcgcatcggacacagctggaaagggaagatggaagggtggctacaaggagacttccaaggcttcagattcatccgagagggttccagaaaagcccagagcaagtagggcaaggctcacagtgctggggtttagctctgggttgtcacctctagaatattccacctaaccctatgtgttcaagccttccagaagcagaattggggcttgtgtgttttcagtagtttattcatattttgtcacaaatgtcaggggatgggg

SEQ ID NO: 25767 - DNA, 1761 bp, Mus musculus
ccaagaatgccaccaatgttgagcaggcattcatgacaatggctgcagagatcaaaaagcggatggggccaggagcagcgtctgggggtgaacggcccaacctgaagatcgacagcacccctgtgaagcctgctagcggtggctgctgctaggaggggcacttgggggagggcaccttgtccagatgatgcccctggagcgggcaggaagtgcctccctctcctagggcatttgagtctgtagctttggggtgtcctgggctccccatcttcctctggcccatctgccttctgctctgagtcccagtcctgtcagggcccccgtggaggacatgcagagcctgtggctggggtggtcacagggacagctccgctgctgcctctgggtaccttgaaaagatgcccaccacgcacctttctttggaatgagggctccgctgtctgtcactcacccccatgtatgctgcactgggtttctctttcctttcttcccaatagcaagggcctccctgcctctgctgcccctgggtgcaggcagtagccaggggatccagggcctcagatccagggtcctgcatcggacctcaggacaggtgccagggctgcgagagccccatagccaccttttcctcatctctgcctcactccatcgctcccacacagcttgagccgtccagctgcggttaggtcttgagcacatctagggtaggtgggcggatggctgcggggcctgtgtctcaagccgggagggagcctgctcctgcctccccctgccctgcctgagccaggcccatgtgctgcctgcccaccgagcccctttgtccctgaggaaagcggaggcggaaggcccaccttgccaaaggccgggcaccagccttaaccctcactctgccagcaccacctcccttttccgaggcagcacatctggcttgttcttcctccattcctcagagcctgacagggccagacctgcttctctggggaatgtgggtgcagcttggggttgtggggctcttccccctcccaactcagaatcctggcccccaccctctggcacagcttcctgtagaaaacctttggtctttacctaagaagccatgtcctttgtgctgtctcttgccagtctcaccctacaacctgtcctccccctccagtgtgtatttaagtccctgggctgcccctctgggagggagcctcttctcccaggttcccctctgatgtcacatcaggcatcttgcaaggaaaagccacttgggggaagatggaaaaggatgaaaaaataaatttccactggcccttggataagccaagggtttttgcaaggaagcggtggtgactgagtgtggtctatggtcagagtcagctttgagttgctgggtggaactggagtccagagtttggtgtgatgcatggggggtcctggcttggactgtatcttaagcttgctggtaaaagcccttgacccacatactggggctgggaaagcctgctgtgcggctatgggatgtccccaagggcccagcatgaatctgtcagagggaggctggcaggaggccgtcaggtgagccaccaacatccactgggacaggcgttcaaggcatgaagttagaagcaaggagcaggcgttggtccccctgcatttagtcttcccctcctccagtccccgactttagtcccctcttgtggcttgaagccagatgccagctatcctgagctttgacaagcgctgctttacattaggacctcagttgtatccccctga

SEQ ID NO: 25768 - DNA, 1239 bp, Mus musculus
gcctcctacccttcctgtgacctcacctgccgcgcaacttcccagtagggggaatgaggctggcacctgggcatcccggtatttctgggattgaaggggccttcccagtctctcccatgcatgatttcctggcatctcaaatcacttggatgtcctgtgttttgtgtgtgttttagttgtttgggtaacttgtcctgtgcacaggtccttgaggctcctccctctgcctcccagcctcccacctaagattgttctgtggcttcatgaggtaggagacagcaaacccacccctccacatacattatctgtgactcttacccagtcatatgtctcccttttcctgtgtcagcttgcgtccccatccctgctttgtcttcccacttctgtcatggcagggcagcagaaagaggcccatctccaccaggtctccctccagcagcctccttccctctctcagccatggatgggtcccagacctatctcagcctcctcatcagtgtcttcatgagaggctgaggacacgtgacagagctagcccagcctccatgccctctggcacttcagagcttctctgttgccctctcactgcttcctagcagtgtggcacagaactgcactcagaacatagttttggcattcttcacatccaagactccagcccttcctgctgcccagccctactgtccagagtgtctcttgggcctgagaataagtggggtgggaagactggggccatgttgggttttttcattcaataaactggtgatttcttaccaactgccttgggctcctgcccctcactctgtcactacaaccatccgccctcagcagaagtgactccacttggaataagccagaagcacaggtagaacggagtatacacttctgtgttcctctcttgtggaaacaggcttgaaggtggctgcccagaatgaaacaatcaggagggtgggtgctgttcccatgtcagagcctctttttccccagaacccaccatcctcaagcttgcctcccaaggcagggtcatgctcctcccttctgagtccaagtggtctttgctggtcaaggctggtgggtggttaaaacctggatccatggtccgctgcctgaggttctgcaccgtcacagtcttgcttccttccagctccctgcatctcctgcgtcttcctgaaggttgagaacaaaaagaagatgcacctggactttcctcagagccctctgcatttttaaggcatcggg

SEQ ID NO: 25769 - DNA, 1513 bp, Mus musculus
cccctgaattgcaaggtgtggaagtagcgctggcgcctgaggaattggagttggaccccatggccatgacgcagaagtacgaggagcacgttcgggagcagcaggcacaagtagagaaggaagacttcagcgacatggtggctgagcatgctgctaagcagaaggtgggagcaacctgtgggcctaggaggagggctgtcctttctggtggagggagaggcgggtggactcggtgcctgaaggtctccgagatgctccattggtggcagtctcttaagttcaggaagaggaaggaagtcatttagctctcagggggagaggagagtgtggtttcagtgctttttaccttaattttatgtctgggtcaggctgcctcctgtctggggttgtctaacctattgtaacttctctctctctctctcctacagcaaaagaaacggaaagctcagccccaggacagccgtgggggcagcaagaaatacaaggagttcaaattttaggtcctgctcgcatagctggcctgcctttaggctctttgtatgtctgggctttctctgtggctccctaaagctagatctggactccctaggctcgtcacttcctgttcttattttagacttgttttgtaaataaagctgtttcccaaggaaggatgaatacaggcgctcttgaacctctctctcttttagcttctgcaaaagcatctacttcttgcctgtaatcacagatggcccataggactatgggactgtagttctgaactgaacttgtgggtagttcactatccctacccctcctgtgtgtgaaggctctgctgaaggtacctttgggtctggtctgaccttactgctttgtccgtggggaataaaaatagccagcttagcaccgtggctaggctgggaagtaactgtaggctagggaagtaggccaggtcaggccttcctcattgaccttgtggcagaaaggccgatttcttacctattggagaacatctgtctctaaataaaatctcaattgttccagagtactggctaactacttggatttactagtgtgtgtgtgtgttggtgggtgggtgggtttgaagggcttgttttgtcttcgtcactgagttctgagaagttttttgaaaaactagactaggttggagcacaggattccataacatttgctcaagtactggggagaaggtgtgggtgtaggagagtgcaagagctctaggtagggtgggggtgtgtggggatggcagctgatcaggccttgagagaaatagaattctagaaattgagaaagcaccgaggcactctgggacttttgtaaagaaggctgtgtcgggggcgctgtaccaagaaaggctgttggacctagacaaccttagctcaactggctcctgcccacagtcaagctggaacttaagctccttaggtggtggccggcccctggatctctacctactgcttcttttgcagaagtgggcgaaataaccacagaaggggtcgccacagcgggctat

SEQ ID NO: 25770 - DNA, 1232 bp, Mus musculus
acaccagccatttctgaacataaacacggtgtatcacaagttacacttgtaggtataagcaagaagagcgctgagcatttcagaagcaaatttgccaagtctaggttctgggtcagcctctggtttggtacaggtgcgtcctgaggttgcgaaggcaaacttactccgagttctgtcggacactctgactgaatggaagacagaagaaacactgaagtttttatgtggccaggaccacgattctgtgtgcctgaaaccctcttcagcctctgagcctgatgaagaacttgatgaagatgacataagttgtgacccaggtagtcgtggttctgccctgagtcaagctcagaacaccctggacgcaacactgccctttagaggctcagacacagtcactaagccactgccaagttatgagagcttgaaaaaggaaatggagatgctgaacctgagggccagggagatctacagagggcgcggtgttttaaatgaagacactacggagtctcagggctctaaagagcatgtgcttcagcgtgatcccagcttcccactgatagattcaagttcccagaaccagattagaagacggattgttcttgaaaaattgagcaaagtattgcctggacttttgggtcctcttcagattacaatgggagatatttacactgaacttaaaaacctcattcaggccaggcggtggtggcgcacgcctttaatcccagcacttgggaggcagaggcaagtggatttctgagttcgaggccagcctggtctacagaatgagttccaggacagtcagggctacacagagaaaccctgtctcagaaaaacaaacaaacataaatgcaattttgggctggcgagatggctcagtgggtaagagcactgactgcccttccaaagctcctgagttcaattcccagcaaccacatggtggctcacaaccatccataatgagatctgacgccctcttctggtgtgtctgaagacaactactgtgtacttacatataataaataaataaatcttaaaaaaaaaaaaaaactcattcagactttcagattaccaaatagaaacattatacaaacctgtggaatgacctttcatttctgtggtcttgctgttactattgacaccgattcttggcattcagaagcattctccgaaaaatgtggtttttacacagtttatagccaccctgctgacagaatttcatttaaagtgtgaag

SEQ ID NO: 25771 - DNA, 2373 bp, Mus musculus
ggagtggtgctccggctggcgtgcggtggcggcgcgcagaggcgggagggaggggaatccatcgcggaggcgcgcctttgcagcggggcagcccgagtctgcgggaggggcgatgcgcggtgtgtccgggtggcggcgcgtggagggggcggggcgctcggagcggggcggggcctcagggcggggcctgcgggacctgagaggcgtggaagaggccggcagcccgagtgagggcggcgaggctggcgagagccgcgtgctgttcctaccacgtgttagttcccaacggggtcagtgtctgtgtagccagggtcgcgggctgtgagggcttcagggcggaccttgactactgagtctgggagtcgctctgttgccttaggtgcgccaccagctagtgcaagctgatatatccaatatacccaaaaccaggacccacggaaagtggaaatttccgaatagccggggatgggttggggggactcaagggagcagccacagtagctgtggtaggatattgcccttgggacttgtggtcttcagccctaacctacttttcttttttttttttttttttttttggcgggggggattcccaggttaagcctgatcacgatgacaacctcccaaaagcaccgagacttcgtggcagagcccatgggggaaaagccagtggggagcctggccgggattggtgacgtcctgagcaagaggctggaggaaaggggctttgacaaggtgtgggggggctgcaaatgccagggaggggtaggagcgaaggttggcaacaggtggtaccacgcagattgggagtgaggcccacacatgtttggggggtacctggggaggcatggtgcctccttcatttttgtgttttgttgagacagggcttctcagtgctaggattaaaggtgtggctcactgtcccctgcccttttgtgtgttttaaatatcacgaaaatgaaactaggcatagtggattgtgcttatgaccctaacacttgggaagttgagctaagaggattcccgtgggatttaatgccagccctgacaacaaaggaacaaaccctgtctttctttttttttttttttcgagacagggtttctctgtgtagccctggctgtcctggaactcactctgtagaccaggctggcctcgaactcagaaatccgcctgtctctgcctcccaagtgctgggattaaagtcgtgcgccaccactgcctggcaacaaaccctgtcttaatcaaaataaaaatggccttgccctctgaagtatttaccacctaaccctccctagcttcagagatctggcctcttcggagtggtatcagcgtggacagtcctgttgctttagcccatgagacacttagccacatgcccttttctattctgcaggcttatgtggtccttggccagtttctggtgctaaagaaagatgaagacctcttccgagaatggctgaaggatacatgtggtgccaatgccaagcagtcccgggactgctttgggtgccttcgagaatggtgtgatgccttcttgtagtgttctctggggatccctcataccccagccacagcacagtttccagagtctgcagcagggcagggctcctccctgtcctccataaaggaaaagatggctgttgtcaccctcacctcctatgtactccagggtctatggggagttctctcccctcagcgtttcaatctttctgggatcgtttcccttgcatgcctttcccttccacctccccctgcagttccgtggcagcagttaccaactttcctgaatggattcctggcccccttctccctcactatctgttggatgccctttggctcctttcctttttttggcaaaaacagtcactgtccttataaaagatttttaaattaataaaatcagtggccttcatacttggtgttctgtgtcagagagcagataggctggggagttgtgtattcccagggctgaacacgtctacttcattcgttatcagtgcagaccgaaactggtgccttctatttcccctcccaagagggagccaccctagccatgtgggctctgggcaggtgccctgggtgtcccaattcctaaacattgtgggagagagtgtgggttggcttttttctcctgggagccaggtaggctgaaggcttccagatgtcagcagtcagtctaggcagcacctggtggaaagtcagtgggagtcaaaggtaccaggaagcgggtggatgggatgtgggtaagaggtcacctgccagtcatcatagcatgtgctcttagcgtctggcaagaatgaatgggtgggacttttgctgtttgccaagctaccatagaaaaggaaggaaatggttaaacttgaaagccaaat

SEQ ID NO: 25772 - DNA, 1179 bp, Mus musculus
ctgggtcttcttcatacctgctttcgtttagtcgtgattccaatagttaagcttgttgcctaggacctagtactcacttgcctcttaagcacagctgaggacaaacctcttggtgccttgttgtcccttattgcaacagtgcatactacctgctgccatacaaacaacacccatgcaccctgtctctcttcaccttaggcacctgtcatttccagaatgtgtctgtggtcaggataacctccttaccgtctcatgtttttttaatttttccaatttcctcagggtataaatttcctgtaatcttgagatggtctgtaacgtaggtttgcttgggaatcactgtatagcctaggctgaccaactcaatggctgtcctgcccacaggcatgaacctgtggggctcctaaccttttattagaggctattgcaacgcccttaccccttgtacctcagcatcaaaaggctgatcgtggcaactcagacctctgctcatgactgcctccattcatttactcactctcattgccttagttcacagatccttcagtagcccaggtactcactaaacttcgagcttctgtgaactgtgtctgtcctcgcttgttggaaggcttttgcttctggctatacactgctagcattaacccagcccctgctgaataccattgaaattgacctctcagctcagtattgcccctgctggtcatttgctccatcccacagtggaactcttcaaccctgttgcccactcctaatgtgtgtgtgtgtgtgtgtgtgtgtgtgtgtgtgtgtgtgttttccgtgtgcacttgtactaatggaacttctactttggagcctttctgagggattttgtttttctgttgtgggtagttggttgagtgtggaggcatgtattagcttcatatgctatatagaatctcttatttttgaacaaatcttatgatcataccctctctggctttcatttatgtccgtcatgtttgctttttgtgatagtaaatgtatacttgggtatacacatgtataaaatacagatgtatatacatggaaaaataaactagatgggttaaagatgaacctatctttaacttctctgaattttttttatgaagagttttttttttttgtttttgtttttcgagacagggtttttctgttcttttttgtttttgttta

SEQ ID NO: 25773 - DNA, 1182 bp, Mus musculus
ttgggcgtagtactgaagttcccacaggctggctgtcaggaaggttacacctgtgctgactgccacagctgaagccctgtgccctgagtatgcctaccagcatcccctgctgcttcccatctctgtatgctggttccatgtttgctggcattaactccagctcccagaggcaggctcaccctggaccctggattcttttttggtttttcgagacagggtttctctgtatagccctggctgtcctggaactcactctgtagaccaggctggcctcgaactcagaaatccacccgcctctgcctcccgagtgctgggattaaaggcgtgcgcccacatcccggctgcctggcctttctgatgcctctgctcctgctctgtatcccaggcattccggcagctgtcccaccgcttccacggaaagggctcaggcaagatgaagactgagcggcggatgaagaagctggatgaggaggcggtgggtcttgggagggaggtgggggctctgcatttttgggtgatgtgtgatatgctgggcctgctccccctgttctgacctcctgtggccccacagctcctgaagaaaatgagctccagtgacacgcccctgggcaccgtggcactgctccaggagaagcagaaggcccagaagacaccgtatatcgtgctcagtggcagtggcaagagcatgaatgcgtgagtaggagccggaggggtggggaggcactgcatcccctttccagtctcacagcctcatcgcccaccctcttctccctgcaggaacaccatcaccaaatgaagccgccctcctccctggcccagatgtagtgttaaataaagttccctccttatttttcctcttggttgtgctgctgtctaaggttagacctaggcaaggcctctgtcacggtcagttctgccatctggcaagtcgctgagcctcctcgcccttctgtgttgccttccgagtggtcagaacacctgcttcatgcgtgaggcgccggtgagctctttcgttcactctctggttatccaggagcggatgggcctgatccttgaacctgtgtgatttaaagtctgatctctgcctgtaagactggccatttaatgaacagaggaggtgagaaaccagcctggtccctcagaggacattcctctgtgagctgactccattgtaacagaagc

SEQ ID NO: 25774 - DNA, 1173 bp, Mus musculus
tgtctcctgtgtggcactgatgccgtaggcggtagggagccatttgggtttggacagagtgaactacagaggccgagaggaaatggagcccgcttgggagatccattggggctgtgggagttgcttatttattgccacgagggaggatctgtgggttcttgagtctctgtggtatcaccccagaaacttggggtctgcccacagccactgcctcccccaggtgctggagattgtgaagaaactggagtctcgccagcgcggctgggaggaggaggaggaccctgagaggaaggggaccatcgtgttcaatgccacttctgaattctgccgcacgctgggggagatccccacctacgggttggctggcaaccgcgaggagcaggaagagctcatggtacgtcagcagttccctggctgttgtccttaggctgctgacttctgcttctagtgcttgaatgtagcaggtagggttgaggctgcccaccctgacactgacttgtggtcctaggactttgaaagggatgaggagcgctcggccaacggtggctctgaatcagatggggaagagaacattggctggagcaccgtcaacctggatgaggagaagcagcatcaggatgtgagcaccggtgggcgtgggtgtggggacccaggctagttgtccagtgcctgaaagcctccacccatccatagaaggggcactaacccttccagagccagctgggggtcagttaaaactggtcccacagcctagtgcctggtgaggatgaccgctggatagaagagatggggcagcctgctcacacttctcttttctcacctctagttctctgcttcctctaccaccatcctggatgaggagcccatcgtgaacagagggctggctgctgccctgctcctgtgtcagaacaaaggtgtgggctcagggtgggagccttggcagtgtgggtactatagccgggacgggctggatggttgcctgtgagtactgtatggtgtcctgggtttccactcctcttcccctcagtctcggggcttcaagcagctccctagacgcggagcctctcactgcctctcctgctgcggggtgagaggtctgcttctcttccgtgcctcagaagtgggctaaaccggatacactggggccagatcccagctgtgctgcctccttag

SEQ ID NO: 25775 - DNA, 1161 bp, Mus musculus
ccaccaccccttccctggctaccttgacatgtgcctgctcctgacatttcaataaaacccagctcgggtctgtgtcttgagtgttttttacaaacactgtcctgatggttatctgtgttggctctcgaggaaagatggggccggaagagacagctccagcctgagtgggccgccttctcctcctccctcagtggtgaaagtagtgtgctgctgtgcggaggccaggcaccatcgctgagaacctcttcagagctgttcccctctgtaaccatggatcaaaatcagttttttaagtctttccagaaaggcccaaggccttttttggtatattcttttggtcccaaggtatatttgttttacattttattttattaagaaagagtctctctcccagcacttgggaggcagaggcaggcgggtttctgagttcgaggccagcctggtctacaaagtgagttccaggacagccagggctacacagagaaaccctgtctcgaaaagacaaaaaaaaaaaaaaaaaaaaaaaaaaaagtctctcgatgtagccttgactggcctagaacttactatgtaccttaggttggccagtaactctgggaaatgcatttgtgtttgcctcccaaagttctggatttaaaatcctgcaccaccatctccagcttttaggtttttaaaaatttctgttcatagtggtacatgccttccatcccagcacttgggatgcagtggctgttggatctttgtaagttcaaggttagcctgtttaacaaggtgagtttcagggcagccagagctacctacataaaagtgagaccctgtctcaaaaacattcatagcctttggtctcagtacttgtgagacagttggatctctgagttctaggttagtctggactatacagtgagatcctgtctcaaaagagagatggggttggggcaaggaggctgatgatatggttcagcagttaagagcattaattattcttccagaggacctttagtttggttcccagaattcacatggtggtgattagtaacagcctgtgactccagttccaggggataaaatgacctcttctggcctctgtaagaactgcacacatgctgctctgacatgcatacaggcaaaactcccatacatggaaaaaaatctttacaaagt

SEQ ID NO: 25776 - DNA, 1327 bp, Mus musculus
tgatcccagcacttaggaggcaaaggcagcctgatttctaaaagtccaaggttagcctggtctacctaaagagctccagagcatccaaggctccgttgtaaagccctgtgtcaaaaagctaaaaacagataaatagaatgagtttgccaggtagctcagagattaagaacacttgctgttcttccagagaacaaagatttagttcccagcacccaggtctggcagcctctactgcttccttgggtacctatattcatgtgctcaaacccacaggcacaggtacagaacctattttaaaatcaaatagattaaaaaaaaaacattaaaaaggcaatactggccagtcctggtgtctgagtgattcccagggcccagcaaaaggggaccgagtttccagagccctgaagacaaggggtaacacaccaaaatatggactcatttttcattccaccttcattggccgagcagctgcaaagaacaaaggccgtatctcccgatacctagcaaacaaatgcagtattgcctcaagaattgattgcttctctgaggtccccacaagtgtatttggggaaaaactccgagaacaagttgaggaacggctgtctttctatgagactggagagatcccacggaagaacctggatgtcatgaaggaagctgtggttcagaggaagcggctgctgaaatcaccagaaagctggaaaaacaggagaagaagcgcttgaagaaggaaaagaagcgactggctgcactggccctggcctcgtcagaaaacagcagtaccccagaggagtgtgaggaggtaaatgaaaaatctaagaagaaaaagaagttaaaaccccaggaaaatggaatggaagacccacctgtctctctacctaaatccaagaaaaagaaagctcccaaggaggagttggccagtgaccttgaagagatggccactagcagtgctaagagaaagaagtcctcacctaaggaggaggtggccagtgaaccagaagaggcagcaagccccaccacccctaagaagaaaaggaaattttctgaggagcctgaagttgctgctaacttcacaaagagcagcacaaagaaaaagaaaaagtcccagaaagcacaggaggattagaacggacctgcttggtgggaggggcataccttgtggtggcagctcctgcccatgataaaaccccaataaaaacacaaaaccaggaaaaaaaaaaaaaaaaaaaaaaaaaaaaaaggcaatactgaggattccagaggaaaacagagtgacatggtctcgtgtgacttgtaagacccagccagtagggacgagtcacttctt

SEQ ID NO: 25777 - DNA, 1447 bp, Mus musculus
ctaaaagtttcttttcttgagtcattattccctggatgtagctgcagccttttctttgctttgtctttagggcccccgagaatgcacccctcaagagcaaaatgatctatgccagctccaaggatgccatcaagaagaagctgacaggtaaggatccctccttctgcaaaagtcatgggcgcagtctcctgctagctgctaccttcctcctctcatctgctccgccggctccttcccagatagaactccaccccaccccagtgcttcctgctcactgctctcttttcaccctgtaggaatcaagcatgaattacaagctaactgctacgaggaggtcaaggaccgctgcaccctggcagagaaactaggtggcagcgccgtcatttccctggagggcaagcctttgtgagccacctccagccccctgcctggagcatcttaacagccccagacctgctcttgggtgttgcaggctgcccctttcctgccagaccggaggggctggggggatcccagcagggggagggctatcccttcaccccagttgccaaacatccctcccaccccctggaccgtccttctccctccatccctgacggttctggccttcccaaactgcttttgatcttctgattcctcttgggttgacgcagaccaagtcccgtcctaggcacccagtttggggggagcctgtatttttttttttaacgacacccctactccgtatccctccccatcccatgctgccaacttctaaccacaatagtgactctgtgcttgtctgtttagttctgtgtgtaaatgaaatgtggaaatgaccctccctgccccagctggctgccctcccctttcctttgatcttgaccactcatggaagcaggaccagtaagggaccttcaatttaaaacaaaacaaaacaaaaaaacaataaaaaggctaattaacaacatggcttttgggtttgggattttggggaccctgtggtgggagatggatgggtggtttccctgtgcttcacctctagttcagtccctagtaagcggcatctccttcttgagttggggtgcactgttccaaggcagggcagttgggctccgagtgtgtcacacctgaaacttcttacctttatagtggacagtgaggtaccctgagcccctttccacatgtgggctaaatacagtttacttgggtgacactgctttctaaggttctcttcagctctcccctctcttccctctggggcggttggctcaccccactgccacgttcagaggtgctatgagtagctaagttgagcctttggcctcctgtactgtgactggagtccattcagggtgggtcaggtggattctaggacttcagtctggagccccacctactgttaccccagctaaagcctgagcctttgacttagtgtggattctggcctgagggcaggagagctggt

SEQ ID NO: 25778 - DNA, 1159 bp, Mus musculus
aggcgggggtctgttgtagagaaaatggacagtagagagaggcgggggtctgttgtagagaaaatggacagtagagagaggcgggggtctgttgtagagaaaatggacagtagagagaggcgggggtctatcagagagaagacggacagtgaagagaagcggggatccattagagagaaggcgacagagagtagacagaggcgggggtccatcagagagaaggtatcagacagtggagagaggcggggatccatcagagagaagatgtcagacagtggagagaggcgaggatccatcagagagaagatgtcagacagtggagagaggcgaggatccatcagagagaagatttcagacactagagagaggcgggggtccatcagagagaaggtgtcagacagtggagagaggcgggggtccatcagagagaaggtgtcagacagtggagagaggcgggggtccatcagagagaaggcaaagttgagtagagagaaatttagatccagtggagagaagctgagaactggtgataaaaattcaagatccactgaagatctactggagtcaaatattgaggagttggagtcggctgaggtgcaactgaaagagcactcgagaacaggaagtgcctcggaagagactattgaaagagtggtcagtgttactggtggtgaaggtgagatggaaaatctgagtcaggaaattccttctgaaagtgtagaagggatggatggccacggaggagccaagacaggggcagaaactgatagtcatgtcttggatggaatgagagagattgctgatgcatctgtccctaaggaagagcaagacacacttggagaaagccccaaggagtcaggtggatgaaaaagtgaaagtgaaaaaggagattggagtatctcaagtaaaggagaagctggagccaaggactttgttggtcttgaaagagtgaatatgaatgaggagtgtggacctcaagggagcatgggagcccctgggcatggagccaagcccacagtgaagaatggcagagaggacaatggaaacattttaaggagaaagaaacaatattggggcgaatgctaagaaggacactgtttcctgcttgaagaacagtttgagaaatgggtcaagggtggctggattttgacagacatgt

SEQ ID NO: 25779 - DNA, 1195 bp, Mus musculus
gcctggtctttcccctcttattccttgctgtctagcatcctcctccaggatcatctcacggtcgctctttctcttgtgtcttgtccacagaatgggtcagcccgtagggcagtggcagcccagcctggacggaagcggaaatctaattgcttgggcactgatgaggtgggtcttgaggagcagagggagagggaagccgggaaagggggagtgggcttgggcatggtgttcactcggtgaggccttaggcagggagggtggtggctgggagccaagcagatgaacccctgggcctcttctactctcagtttctcagcctcgctttattttggaagtggaggttggtgctttgcccttagctgatgttagacttgcaggaagaagccaatggcagtgtcgtgcgccacgctctgcttaactgctaccatctagtatttgccatctgccttgggcaggattctcaggacagctcagatggaataccgtcagcaccacgaatgactggcagtctggtgtctgaccggagccacgacgacattgtcacccggatgaagaacattgagtgtattgagcttggccggcaccgcctcaagccgtggtacttctccccgtacccacaagagcttaccacgctacccgtcctctacctgtgcgaattttgcctcaaatatggccgtagcctcaagtgtctgcaacgccacttggtatgaggggtcttgggaggctgcctatccagagtaccctcaccagtccccacctgatcctccttttgtccttagaccaaatgtgatcttcggcaccctccaggcaatgaaatttaccgcaagggcaccatctccttttttgagattgatggacggaaaaacaaggttagtggcttgggcacggctgggctggagtgagtcacatgaacaaccttttcctgctcagaacagttgaccattctgcctatgagcaggtcactgtttttattgaattcttgacacggagcagggaatgtacagaaaactgggatttagagaaattttctttcctgagaggtcactgtcacggcagagcagacatgacagctactcaggttccagtaacagagggggttcagcacagttcacaggaagctgtcatcagagcttggaggtgtgtgtgcctataatcccagcactcagaaaactcccgagttcaagagtagtcaggg

SEQ ID NO: 25780 - DNA, 1200 bp, Mus musculus
cctcgggcctttataaggtgcaggtggggaaccactgacacctttgccatgcctaaatgagggactggggcgggggggggcacaaagctcacctctcatttgcctacctttaacccccagctcctgaggaagcgtcatatcggcaacgatattgtgaccatcgtgttccaggagcccggtagcaagcccttctgccctacgacaatccgctctcacttccagcacgttttcttggtggtgcgtgcgcatgctccctgcaccccacacacctcatacaggtgggtgctagggtgaactcaggtcatgggcaccgatgattggacacattcctcgcccccttccgcccctcgttccctcactacagccttcctccacgcagggtggcagtgagccgcacccaggacactcctgccttcggtcctgcgctgccagaaggcggaggcccctttgcagccaatgccgatttccgggcctttctgttggctaaggcactcaatggtgagcaagcggctggtcatgcacgccagttccacgccatggctacacgcacacgccaacagtacctgcaggacctggctactaatgaagtgaccactacttcgctggactcggcttcgcggtttggcctgccatctctggggggtaggcgccgggcaacccctcggagcccaggcgcggagctacaggcggcgggtgcgctgatgtggggcgtacgcgcggctccaggggcgcgggtcgcagcgggagctgaaacgagcggtccggaggacgccgaggtgccctgcttgttgggcatctcagcagagacactggtgctggtggcacctcgcgacggccgcgtggtcttcaattgtgcctgtcgcgacgtattggcctggaccttctcagagcaccaactcgatctgtaccacgggcgcggggaggcgatcacgctgcggctcgacggggccccagggcaagccgtgggcgaagtcgtggcacgtctgcaggtgaggcagtgtcaaaaactaaggtcccctggtcgggtgcgtatcgggggcggagcctattggaaactccgttaggctgctgtggtggggcggggaaaaggtacttgcacaggtgactctcagagtctccaattcgaatacacaactatcaggtaggtcgctagggctcctggggcatgccgggttaaatcgatcgaggcaggggcgggac

SEQ ID NO: 25781 - DNA, 1137 bp, Mus musculus
tcaggtaaggagcctgtggaagaagacgaccccaggagttctcaggtcggtttgtctgctcatctgtctgtcttctctcccataggcccctctagacctcagcctcagtcctgatgtcagctctgaggcctcacctgccagaaccacccaggaccttccttgcttggacagcagtattcctgagggttgcacaccctccggtgccccaggtgactggcctgtccctgctgaggaacgcgagagcccggctgcccagcccttgctggagcatcagtactgaggagtcagcctggcctctgctggatcgcatcccgggactcagtaactcggactctgctggactacagaactgattggctttggctctggtgtctgcaccctgatatctggctacttcagtgtcacaactcagtgacctagacttctctccctgatccgtggcctggatcccaaactgaggcagcagcctcctagccaggccctaagagccaaacccatgggctggtccctcattggagcccatggccaggactgactttgcctctggggcctgcactgcccccaaggctggcctccttagcctggacctggggcccgatatgtggcaagggtgggttcattcgttcttttgtcatttttctttctttttttttctgtgcttcagagacaccaaattaataacactatttttgattttggttggcagttttattttctgtgggacgaggtgaggttggtagaggtgccggaggcagggaggctgaagtcagaagagtgtgagggataaggggtcagactgctgggctccaggcagacatgaggtgggatgggctgccttcctcacctgcctctgcctttctttttttttttttttttttaatggtttaagagctttattatagaaatgcaggggggaagagaaaaggtagagagagagagtgtgtggggacggggaaggctagagaagaagaaagagaaaggagagaaaagacaaagggaagaggagaaagaagtgagaggataaaggagagagctgagcctctgcttttcaagcagtcctctatgcccaggtggctcacacatccatcagccttgatcttgatcaaagactgctcaacctcatttgttccaagctta

SEQ ID NO: 25782 - DNA, 1182 bp, Mus musculus
caccttcctgggtgctttctggccctgtggtgcctagtcctctgggctccagagaggcgccatgttgcaggccccatgctagctgacggcttgccttcctgttccaggcgctgcccaggtgatgtggtttgagaagctctacgctggcctgcagtgtgctgagaagtacctcatctaccctgccgtggtcctcaacgctctcacagtggacgcccacacagtcgtcagccacccagacaaattctgcctctagtgaggacccccgtatcccacccccgctgttgtgtgtgtatatcctcatgtgattgccactgagggatgggtaggacctaagactggcaaaacccaaagctggatgttggcacttaatgagctgtcagttggggcaaatgtgtcacccttcagctcattcagaggtactgtccacccctgacaaaagggctgttctagtagatagcaggtgctgagggtggcatttaaaccattggtgagaggtgtgtgtctgtgcccaccctccctaaagccctgccatgtctgaatgcctgccccacccacagctgccgggccttgctgatgactgtggcggggctgaagctgctgcgctcggccttctgttgcccaccccagcagtacctgaccttggccttcactgtcctcctcttccacttcgactacccgaggctctcacagggcttcctgcttgactacttcctcatgtctctgctctgcagcaaggtaagctgctggttgactcagacccaggctaatgagcaggcagagcagaagtgttcggtcagaaaggaaagtgtgtcctgaacctgcagccttgtagacccggattgctgtaagtgtgggcttttgccgtggcctgagggagcgatccctccagttcccctgcagagagcaggttgaagctttgaaggggaacttgcttcaggccctcctgggagttggtggccagtcagacttcacagccactttcctcaggatcggccggatctcggcctgacctggtcccctgggtgttctgagctctgcctctctgctcgccagtgtcttgaagctgggttccaagctgagagtgtccccagagctgagagtgtccccagagctgagagtgttccccagagctgagagtgtccccagagctgagagtgtccccagagctgagagtgtccccag

SEQ ID NO: 25783 - DNA, 1143 bp, Mus musculus
agccctgtctcttccagagcgtgcagcctgatgcagcatccccaatgcacgtgagtacctgcggggtgatgctctggccaggaggccctgggagggtctgagaccaaattcgagaccatggtgggagaggggcagagttcctcaccacccgctttgctcccatcttccccagttttccagcttggatgtggtcaagtctggggcatgttgaatgtgtgaacatgccccagggaggtcactggggaaggcccaattcctcactggcccacttcctagggccacaactgggtgattgcatacagccggcctgtctacttctgtatctgctgtctactcatctggctgctggatgccctggggaccgctcagcccttcccacctgtctctctgtacggcctcacactcttctctgcctctttcttcttttgtgcccgagatgtggccactggtaagacagggcaagattgacccaagggagtgagtctgaagggtgggcccaggagaggctggcaggctaactggtccttcacttcctactcctggacagtgttcaccttatgctttccgttcgtcttcctcctgggcctcctgccccaggtcaacacctgcctcatgtacctcctggagcagatagacatgcatggctttggaggcacaggtatggtgcccccaggagggtctgcccacaggagggtctgcccacaggagggtctgcccacaggagggtctgcccacaggagggtctgcagctctggttcttacagagccttttcctgcttctggagtctggctgcaggggccccatcctgcctgtcctcttttatcccctctcgttttctttcctctctcttccccagcaatggtttcagcccagaacactagaagctctgaaggccgagtggaggagggtggtgtcatgggaggtcttgtgggaatggaggaacagtgggacagggtgacagggtgagacccatagatcagagctgggcttcacccatttctccctgcttccagctgccaccagcccactcactgcggtcttcagcctcacgcgaagcctgctggctgctgccctgctttatggcttctgccttggggccatcaaggtatgggtagtctacaggagctgggcatgctgagccc

SEQ ID NO: 25784 - DNA, 2210 bp, Mus musculus
aggagctaagcaagagctttctgaccctgacccggcctgaccgggccctagtgaggaccagtagtcggcgggaacaatgtcggggaactggaggctaccagcccctggaccggaggggctcaggtgaccccatgccccagaaagctggctcttcggattcctgcttcagtggcactgacagggagactctgagcagcttcaagagtgagaagactaactctacacacctcgacagtccccctggtgggcatgctcccgagggcagcgacacagaccctccttctgaggctgagctgcctgcctccccagatgctggggtcccctcagatgacacacttcgttcctttgacacagtcattggagcagggacaccaccgggccaaacggagccgctcctggttgtgcggcccaaggacttggccctgcttcggcctagcaagcggcggccccccatgcgaggacattccccacctggtcgtaccccaagacggcccttgcttgagggctcaggcttctttgaagatgaagataccagtgaaggtagtgagctgagtccagcatccagtctccggtctcagcgccgctatagcactgatagctcctcgtctacttcttgctactcccccgagagctcccagggtgcagcagggggtcctcggaagcggcgggcccctcatggggccgaagaaggaactgctgtgccccctaagcgaccctatgggacccagcggacgcccagtactgccagtgccaaaactcatgcccgtgtgttgagcatggatggggcagggggtgatgtcttacgggcacccctggcgggctccaaggctgagctggaggcccagccaggaatggagctggctgctggtgagcctgctgtgttgcctcctgaagcccggaggggacccgctgccaaccagcctggctggcggggggagctgcaggaggaaggtgctgtagggggaggtgagtgttggccgcaggggtgagggtgaggaagacctgggaggcttgagtttgggtaaagggcagactgcggcagacctagtcagcatcagcttctccatctcgggaggagatggacttgtactcgatggttaaggcacgtgggccacgcctcttggctccaggccccatggttagcactgagcctctgttccctgtggacatcatctgcccagcagtggggcagggcagatgattgtcattctcattttcagatgagaaaactgaggcacggatggctagagatgtgctggcagggctcctgagaccaagtgtcgctgcactcagtctaacctttagctccattctggagcacctgtccccagcccagcccaacccagcccagcttgtcacttatgcttggggcttctttctgacagcacctgaggaaacaggtcagcgggaatgcacaagcaatgtgaggagagctcaagctatccggagacgacacaatgcaggcagcaaccctacgcctccagcctctgtcatgggctcaccacctaggtgagcatctgccccagggctgcagtgtagaaggggcgactggctctacctagtgctgacttaggacttcccctgtccagcagcctgcaggaggctcagcggggccgggctgcttcccactccagggcactgactctgccctccgctctgcactttgcctcttccctgttgctcacccgagctggccccaacgtccatgaagccagcaattttgatgacacctctgagggtgctgtgcactatttctacgacgagagtggtgagcccttccccagccagcccagcacctcttgtgtgcttcccagaggcgtctgtggctgcccacccacccacagcactgttgggtcagtgatccccccccccaccttggccctgtagcaagtgctgtccgacgtcatccttgtagcatctctgaggtgtgggtgttgtcatctctgctctgctgatgaggaaagcggggcacccccgagccacaggctgagctagtggtagagcaagccccacccaaagcaggctgaccgctgaccggaaggcccttcctacctaacacttggtccctaggggctgggctgtcacgacccggaacataccacagggctcctccttgttcgttagccttgatgcccttgtagtctcggaccctgacagtgctgctgtccctctgccccaggtgtacgacggtcgtatacctttggcctagc

SEQ ID NO: 25785 - DNA, 1099 bp, Mus musculus
tcctagttctttacagtggtggcaggtacaccctcaagggagcaagggttttgtgagaaaggatccaacttaactgtcatctccaggtcctgccccccagcctgatggtggctggagtgtactgcctggtggtagctgtcatctttgctaccatcaagactgtgaactatcgcctgcatgccatgttcgaccagggcgagattgtggagaaacgcaactctaccatgggggagcaggaagaagaggctgcccagggggagagcagtctcccaaggtgagtggctgtgggctgtgtcagggattgtcctttctctgtgcttgggattgtggctgtgtcttggaggatagagaaggctgaggggacaatggctctaagtacttgctgtagtcagggttaaagcagtcgaagggagtcttgaggaggaaggggtgttacggatggcgagaagaaaccgtaaagagagcacagctgagagcttctgctcagctcttcttcctgtttgcagggaccctggtgtggagatgacggtgttccggaaggtgagctccacgccccctgtacgctgcagttcccagcattctgtgtttggcttcaaccaggtttcggtgagtaggctcccctcgccgctgtcctgggagtcagcccctggtgtgggcctgctcccagcctgctcctgggagtcagcccctggtgtgggcctgctcccagcctgctcctcggagtcagcccctggtgtgggcctgctcccagcctgctcctgggagtcagcccctggtgtgggcctgctcccagcctgctcctgggagtcagcccctggtgtgggcctgctcccagcctgctcctcggagtcagcccctggtgtgggtctgctcccagcctgctcctgggagtcagcccctggtgtgggcctgctcccagcctgctcctgggagtcagcccctggtgtgggcctgctcccagcctgctcctcggagtcagcccctggtgtgggcctgctcccagcctgctcctcgctcgccccgcttgtttattcgttctctctcccctgtcttatcaggagttgctgccccggatggaggattctgggcccctcagagg

SEQ ID NO: 25786 - DNA, 1217 bp, Mus musculus
ctatgcagtgaaggactgtcaggacagctggctggaggtacagaagagagcacctaagagtgtcagctgaaggcccagagacccttccagacctctcttacataggaccacaaacaaacctgataaggcaaggggtctcttgcaagaagtcacagcgactctgatgaagtgagctgttcagcttggaggattgtcttccacatcagcgacttgcaggcattgctcctgacagttgccctgcccccagacccttctgtttaaaggcagaatgcgtgtgatgggaaggttcagcagaccaggaagagctgcttgacagatagagctaaggaagctgcccttgggaagcagaacttggttcttgttctaaagccacgcaggatgctctcctggcagacacgctagcctcactctaactgtgtcactgatactcgcaggtaatcctccaaggcctagccccgagccagaggagccacggagggccgggcccacggagcgaggcaatagctctgggacgcctaaactgatccaacgtgcattgctacgggggaccgctctgctggcttccctaggccttggccgagatctgcaacctccaggaggcctgagccgtgaacgcggggagtccccgacagcaccaccccctgcacagatgccctcaccctgcccacctgagctgccctccaccccgctcatccgcctctcacaaacaacacctgatgcccatagttcacccactcctggacccttattgctagacctaggtgttccctctggccagccatcagccaagagccctcgacgggaagagacacgtggtgagtgacccaaagactgatggggagataagaggccatcagagaagagtggcagggaactcagaggaccacaggcaggtacagagtcttaggctctgtggctgttgctagagctctaggttcagctgtgagatacagagatctccctcatggtgatagactaatacctattgattggtcgggccaggtactataaccattctatgtagaagttattacattaaattataatctgtatatgaagcttttttttttctcaagacagggtttctctctgtagccctggctgtcctggaactcactttgtagaccaggctggcctcaaactcagaaatctgcctgcctctgcctcccgagtgctgggattaaaggcgtgcaccaccacacctggctatatgaagc

SEQ ID NO: 25787 - DNA, 1184 bp, Mus musculus
tgggtgcttgtgcatgttggacaggcattttaccactgaagggcgggcatcccagtttacaggaatagacttgatgcatagatgaggccaggccatctgtcaagcaactggacctcaagtgtaaatcagtggggcagtgtttggcaagcatgtgtaaggagaaagaagagtagagatgagatgggattggcttaggcagaaaacaccagcagctcagggacatcagtaaagagcacatgactcgggagaggcggacggggcaccctcactcttccaccacttttcttgttctagcactgaatgcacaggcggcgctctctcaagctcgggaacaccagctggcctcatctacagagcctgcctcgagctctcggcccccatcccagccaccagtaccccgtccagagcactgtgaaggcgcagcagccgggctcaaggcagcccaggcgcctcctcttccggctgcacctccaaatacggacgcggtggcttccacacagacggccctcctgcagaagctaacctgggcgtcagtcgagctgggctctagcacctccttggagactagtatccagctctgtgggcttatccgggcttgcgccgaggccctaggcagcctgaaacagctggatcactgagacctctatcctgatccctgttcccctgagaaaaaccctccagaaaaacagtttttcctccgcgtggtttgttctttcttggttctgagtgtgcatgtgagccccagttctcctcgatggttttccttgcttttggcatctcacctttccatggtcttttctacctgaatggtgaagttctgcattcaggacaagaagtaaatggcagagggataagtgacaccttattccaaggactgacctcagtcttcccaaaggctgggccactaatcattgtctctgacccagtaccccctttcctccacttgagtgccatttgaagtttcagtccctttggtggcttcctttccttcctttaaccatcctgactctaccatctttctccatcttctggctgctaggatgttgacaaattgtggggaggggcagtgatgcactgtaagagtcaggcacagtcttaccttcctaccccagactcgggcctcccacatccccgtgcttttagaatccttcccttgggagaggacacattgtataggaatgagg

SEQ ID NO: 25788 - DNA, 1099 bp, Mus musculus
gcctctgtcttctgttctgctagtgagtgtgtgatgtgagaccttgcagtgagtttgtttttcctggaatgtggagggagggggggatggggcttacttgttctagctttttttttacagaccacacagaatgcaggtgtcttgacttcaggtcatgtctgttctttggcaagtaatatgtgcagtactgttccaatctgctgctattagaatgcattgtgacgcgactggagtatgattaaagaaagttgtgtttccccaagtgtttggagtagtggttgttggaggaaaagccatgagtaacaggctgagtgttgaggaaatggctctctgcagctttaagtaacccgtgtttgtgattggagccgagtccctttgctgtgctgccttaggtaaatgtttttgttcatttctggtgaggggggttgggagcactgaagcctttagtctcttccagattcaacttaaaatctgacaagaaataaatcagacaagcaacattcttgaagaaattttaactggcaagtggaaatgttttgaacagttccgtggtctttagtgcattatctttgtgtaggtgttctctctcccctcccttggtcttaattcttacatgcaggaacattgacaacagcagacatctatctattcaaggggccagagaatccagacccagtaaggaaaaatagcccatttactttaaatcgataagtgaagcagacatgccattttcagtgtggggattgggaagccctagttctttcagatgtacttcagactgtagaaggagcttccagttgaattgaaattcaccagtggacaaaatgaggacaacaggtgaacgagccttttcttgtttaagattagctactggtaatctagtgttgaatcctctccagcttcatgctggagcagctagcatgtgatgtaatgttggccttggggtggaggggtgaggtgggcgctaagcctttttttaagatttttcaggtacccctcactaaaggcactgaaggcttaatgtaggacagcggagccttcctgtgtggcaagaatcaagcaagcagtattgtatcgagaccaaagtggtatcatggtc

SEQ ID NO: 25789 - DNA, 1940 bp, Mus musculus
tttccacagatgctatagttgtgttgacacactgggttagagaaggcgtgtactgctatgctgttggcacgacaccttcagggactggagctgccttttgtccttggaagagttttcccagttgccgctgaagtcagcacagtgcggctttggttcacagtcacctcaggagaacctcaggagcttggctaggccagaggttgaagttaagttttacagcaccgtgatttaaaatatttcattaaaggggaggggtaaaacttagttggctgtggccttgtgtttgggtgggtgggggtgttaggtaattgtttagtttatgatttcagataatcataccagagaacttaaatatttggaaaaacaggaaatctcagctttcaagttggcaagtaactcccaatccagtttttgcttcttttttcctttttctttttttgaggcgggcagctaaggaaggttggttcctctgccggtccctcgaaagcgtagggcttgggggttggtctggtccactgggatgatgtgatgctacagtggggactcttctgaagctgttggatgaatatagattgtagtgtgtggttctcttttgaaatttttttcaggtgacttaatgtatcttaataactactataggaacaaaggaagtggctttaatgaccctgaaggaatttcttctggtgatagcttttatattatcaagtaagagatactatctcagttttgtataagcaagtctttttcctagtgtaggagaaatgattttccttgtgactaaacaagatgtaaaggtatgctttttttcttcttgtgcattgtatacttgtgtttatttgtaacttataatttaagaattatgataattcagcctgaatgtcttttagagggtgggcttttgttgatgagggaggggaaacctttttttttctgtagacctttttcagataacaccatctgagtcataaccagcctggcagtgtgatgacgtagatgcagagggagcagctccttggtgaatgagtgataagtaaaggcagaaaaaataatgtcatgtctccatggggaatgagcatgagccagagattgttcctactgatgaaaagctgcatatgcaaaaatttaagcaaatgaaagcaaccagtataaagttatggcaatacctttaaaagttatggcttatctaccaagctttatccacaaaagtaaagaattgatgaaaaacagtgaagatcaaatgttcatctcaaaactgcttttacaaaagcagaatagaaatgaagtgaaaatgctgcattaagcctggagtaaaaagaagctgagcttgttgagatgagtgggatcgagcggctgcgaggcggtgcagtgtgccaatgtttcgtttgcctcagacaggtttctcttcataagcagaagagttgcttcattccatctcggagcaggaaacagcagactgctgttgacagataagtgtaacttggatctgcagtattgcatgttagggatagataagtgccttttttctctttttccaaaaagacctgtagagctgttgaatgtttgcagctggcccctcttaggcagttcagaattttgagtagttttcccatccagcctcttaaaaattcctaagccttgcaccgatgggctttcatgatgggatagctaataggcttttgcatcgtaaacttcaacacaaaagcctacatgattaatgcctactttaattacattgcttacaagattaaggaatctttatcttgaagaccccatgaaagggatcattatgtgctgaaaattagatgttcatattgctaaaatttaaatgtgctccaatgtacttgtgcttaaaatcattaaattatacaaattaataaaatacttcactagagaatgtatgtatttagaaggctgtctccttatttaaataaagtcttgtt

SEQ ID NO: 25790 - DNA, 1762 bp, Mus musculus
atctaagaagatcttaagagataacatgaaggcttatttaaacagtttgaaaaaggaaatgaggagaaaagtatttgtactgtataatggaggctgaccagagcagtttaggagattgtaaagggaggttttgtgaagttctaaaaggttctagtttgaaggtcggccttgtagattaaaacgaaggttacctaaatagaatctaagtggcatttaaaacagtaaagttgtagagaatagtttgaaaatgaggtgtagttttaaaagattgagaaaagtaggttaagttgacggccgttataaaaatccttcgactggcgcatgtacgtttgaaggcatgagttggaaacagggaagatggaagtgttaggctagccgggcgatggtggcgcacgcctttaatcctagcacttgggaggcagaggcaggcggatttctgagttcgaggccagcctggtctacagagtgagttccaggacagccagggctacacagagaaaccctgtcttgaaaaaacaaaaaggttaggctagtatttggagaaagaagattagaaaatggaagtgaaagacgaagaagacatacaggaaggtgaagaaaaagctgttagagaagataggaaaatagaagacaaagcatctttagaagacagaaaaggtacttaaaggcacaggtagtaggaagccgaagaatagaagatagaaagaagcaagatagaaaaacaaaatggaagttaagacaactttggatgccagcattcaagataggcaaagaagataagattgaggccaaaaggttggataagatataaagtcagaaggaaattatctttaaagccataagttcaaatttctgatggagcgagcagtttagaagagtctttagacagccacatacaagattgaagctagcaatcaaagctactaggactgaagtaaaaagttaaggcagaatgcctttgaagagttagaagaatattaaaagccttaacttgtagcttaattttgcttgatgacaaaaggacttttgataacagtttcaagattgtcagcattttgcattggacttgagctgaggtgcttttaaaatcctaacgactagcattggcagctgacccaggtctacacagaagtgcattcagtgaactaggaagacaggagcggcagacaggagtcccgaagccagtttggtgaagctaggaaggactgaggagccagcagcagcagtgcatggtgaagatagcccaggaaagagtgcggttcggtggaggaagctaggaagaaggagccatacggatgtggtggtgaagctgggaaagggttccaggatggtggagcgagagcgagttggtgatgaagctagctggcggcttggcttgtcaactgcgcggaggaggcgagcaggcattgtggagaggatagatagcggctcctagaccagcatgccagtgtgcaagaaaggctgcagggagagcatgcggtgcggtaacattccttgaggtcggcaacatggtggtggttttctgtaacttggatggtaacttgtttactttgtcttaatagttatgggggagttgtaggcttctgtgtaaagagatatatctggggctgtatgtaggcctttgcgggtgttgtaggtttttctttttcagggttatgtcctcttgcatcttgtcagaagcttttgagggctgactgccaaggcccagaaagaagaatggtagatggcaagttgtctttaaccgctcagaggggaatgaatg

SEQ ID NO: 25791 - DNA, 1103 bp, Mus musculus
gtgctcttaacagctaaatgatctccacaccaccaccaccccagctgcattttttaaatcctcaacaatgaagtgaggatgagtatattgtaagtgaggggcacgatatggggcaggggagggctgcccacacctttgtgacacttctcttcatcctacagagtacacagctatggtgtcccatgacacccgggtgtttggtgcgcctcactggaggctcagttactctcagaagtcattgttctagggttactggactgtgtgatatttctctctcactgtaagtcataatgtgttaagacttttcaggaaaattactagtgtagaggctttcctgttttttgtttttttgtgggtattttatttttttgttgtttgttttggttttaatataacttgacatcctcattaagaattgcctttcccctggtttaattcctggtttttttctctcgaatagactctgaagacatccagtctgacctttaacaagaagctttagatgacgcaagcagctctctctgggttctgttttgttttggtgctggaatgaaaccctgtacacgaaaggccgaccctctcctgctcagctctgtccccacacctctgctaatgtggagagttagtgccacctgagtttcatgaatctttctccctggtctccttggattctgtgttcttatgttcaacctacttatgcccacccaggttatccactcctgtcagcaggaacaggaggtggcggttggagtcttgctctgcttctgccctttggctacaggcaaggtcctcggttgctgatagcgaagcgtgtttgaggaggccacttgaaacccctgaggagtgagtgttttgcaaagcacgtggggtttccagcaaaggaaaacagtgaactattggccatggtttcaaagcagacccatgaacaaacaaagtgactggccctgtcctgcttttcactggaacaggcctcagaaggtgatggcacaagccaggaggtaactacagaagaatgtagcatagccaggagtgagaatagaaatcactccgaggctcaggaggctgggggcctgccacagcggtgagggcggcaggtgagcagg

SEQ ID NO: 25792 - DNA, 1144 bp, Mus musculus
cataactcaagtcacagccaccaggcagcagctggtatgtttctatgtcacagccaccaggcagcggctggtgggtttctatgtcacagccaccaggcagcggctggtgggtttctatgtcagttccaggccaagtgctgcagttggagctttgctatatggtgagggcggtcctacctcctacctcaactcttctctagtttcctggttactcgtgtgagtattcaactgtcccaagtcgtcttgattttcttcctgtacaacaataaggtatcttattccgttttccaccagtggcttaacctaacctgactgaaatgtttcttacacttgtgcatgtgtgccggcgcaggggaggggcagagggcagtgttgttggattgggtctccttctaccactcggctctggggattattgagctgaggttggcaagcttggcagccagcactttgaccagctgagccatatcagtcagtgccctgagatggtgtgtgaccgggtcaggtgtggtagtgcaagtctttcatcccggtactcaggaggcagaggcaggtagatctctgagttcatgtaaagagactctgtctcaaaaaataaacaagccaggcgtggtggcacacgcctttaatcccagcacttgggagacagaggcaggcggatttctgagttcgaggacagcctggtctacaaagtgagtttcaggacagccagggctacacagagaaatcctgtctcaaacaaacaaacaaaacaagaacaaaaaacaaagaaaaaaccaagtatgtaaagtctgtggtcagtagcgttagcctgtgcagttagaggaccttgaccgacatccagaccacgggacccgactggatgtctcaccctgcccctgcaggccctgtcccttccaaaacaggcacttctgtcacaggatacttttttttttaacttaaatttgcttgggggaggggagcagttctagttccatgaggcacaaatggaggtcaaagagcaacttgccgatgtctcttctctcctcccactgtgtgggtagtaggaattgaatcaggttatcgatcttggggctgagccatctctgtggcccacagagcacttatatgtggttacttgttgctctcacattgtcagtgtaca

SEQ ID NO: 25793 - DNA, 2729 bp, Mus musculus
tcgttccgtttagcagtgtttgggtgacgcgacacaagagtataaaagcaaaagttgtaacctccacctgtaggagttagtgacaaggagggctcgctcttggggctagtggtggggaggcagtggccagttcagggctcagatgagagaggtggcagaattagaggcagccactaggatgggggtgcgaggagaagcggggctaagtataaaggagactagattttgggacagtggacgtgtggaaggcagcttccaaagcgcctttaacaatccacaaagaaccagcagctttcaagaccaggctatccctgctgtctgctggcacttgacgtccaggagggcacaagtttcacaggcctacatgggggcagtgtcctaacttgagtggcagagcagcagttgatggagacgggtggactgggggcccttgaaggccccggaaatcatagaggacaggcagtggggcaggactaggtgcgtagtggaggtcgcctttgatcttgacaaaaccagcagacccctttttttccagataaggggttgtgaacccacctggggatgaggcctggtcttatggaaggtggacttagcttcgctgggcggacagctctggcccagggtggtatgtaatttgggtgtggcctgtctgcacccacttcggggtgcgaggggaggccggaggaggctgcagagacaagttgtttttactgtcaggtctgccaggcggggaccatggagattgaaggcgcaagtcttggggccacattaatcacaactttatttttcagatagcagtgccctctctggactttgcctaggttccgtgcttcctcttctgtggtctcactcttccctactcttgcccctcactctgaggttaaggggtcacttaaaaccttgcccctgggtcgtccggtaagcctgtggaggatgtagagtcggtgctggagtcttgggcacggcattttggtaaaggtggaggacaccctgactgggcggggagggatggtgttgattcacagagggcgggacgtgagtgtggaccctggggtgggctcacagccatgtttccggtcacccaaatgcttcatggacgtggtttatcactatagtgttcaccatggcaagcagatggcaccaggagatatggagcccctgccagtgtgagtcgtagcagtgcaggagggctcaccctggaggagacagcggcctcggttgacgcctacacagtgaattccagaggcttaggaagcgcgtccctgccctgggtccaggcctttctcaggaagccctgtgctcaggaggccatcgttgaagtcagcttgtagggggtgggcaggtgcttccagccggaggggccgtcggctgtgaatgttccagatgaatgtcttgttctgggagcatcattctttgcggatgcatgaatggcagcaggcaccctttttcatgggggtagaggcgttcgactgctgcatcttctaaacaagcctccatccagcctttgtagttctgtgctgcgaacttggcctcgagaagattgcgtaaggtgtaggacactttaacgtctgcgcagcgtgctgcactgtagatcgggaccccagtgacctcgcccaccttccctgcttctgcagcctgcctgcctctgcattggtcagagggattcttaactgaaaacttgtgggtgttggggaaagctgttgggttgtaaatgactggtgtggaggaatcttccttagatggagctggttgtaaaatgggtagggtttgtggtttaacagtgggaaggcgcaagttagccacaaattctgccgacttggtagatgccgtatctaatttgggctttgggacgtcttctggactaaaagggatccgtgggcccgaagtggtccctgggaatggtctctcccagggtgtggatttgatactgggtggttgagtggcaacagtggttctggccccttttgttcattagcttttatgacttagggcctggctgtgtataccaggctggcctgggttcacagccctgctcagatgacagtgtcctgaaacaatggccttccaaggtgaaacctgagttatggatcaagcttgggaataatacttttggcaccagatatgggacttgtgggagaaagcagggctcagcttggcattggtgggttgaaggagtcggggtgcgggtgaggattgtgcctggaaccgtgggttgatgggaataacagtttgggaactaaatagttcacatgaaaatctaaaggctgatggtaaatccctgcaggtggcactactttgagatgcagttgcttggaaaataccaaaatcctacaaggggaagagcaaaattgttttgcttcactgttgaatggggaagggtgacattgaaaagcttttcttagttgctcaatagatggttgtcactaccctgacctaggcaggccacaggggtggagcctggtggggggaagctgattgccaagaagtgaagctggggaggggcttgtaaacgcctcccgttgtgggctctgaaaccatagtatggggaggttggcagactcttctgggtctctattgaaattctgtcatactgtgtgattaagaattccaatgctgctatctaaaggaatttcatatgggagtcatgccttatacaacacatacaggaatttaatgtgtgagccatgccttcaaaacacatcttgaatttctggaattggccagaagac

SEQ ID NO: 25794 - DNA, 1216 bp, Mus musculus
ctgccaccttttcccctaagttatgttggaactggagggcacctctgcaggctaacccctttcttgttggcctttactgatgtctctgtgctgaatggtggctctcctaggaaccggttccatgctgcacataggaaaagcccttacatgtccctgggctggattggctgtcccataccaaccagttcctttgttttcctgtgatctgggtttaagggttagattttgccttgtctcctgtgctctgagctgataaagcctggggcgtggcaactccgaattgcactgcactgtgggattccctgaggccagccacagcggctcaagccacctctctccgaaggacatcgcaaaggcctatctgtccccagctctgcacccctggcagccttgactgctcctgggaagagctagttctgggagtggagctgtcctggcccttaagccctttgtactccctgggaatccccactggatcccagagacatagcttagctttgtcttcttggtggaaagccacagaaatggaaaccatcatctctgaaaatgaaaccagtttgcctgccagtgagctccagaagttttggcagcagagagaaagaaaaggctgacctcactataaggcattgtctgtaagatgatgtcacctgccactgtagttaaccctttaggagccttgtgtgttccctgagctaccagcccactcttggcaacctttaggtcatcttgactgctgttgatggcttcagatcattatgtgaggggcccagatgcgtgtgcacaggtacacaaactctacatttccatttgagcctttgagttttttaattaccacatgtgccttaaccctctaggacagagcactgttttactaaataaatgtcttgagtgttcccagtctttcctatcactggacttaataaaatcatcacctagcacactttggaatggttataatatggaatagccagagtatggtaaccacacgtgtcctgtgtgcccatggtatagcctcaggtcttcaccccagtaaaatctcatctggtagctcctggggaccggtctccaggtctccataggaaccaggtctgggaagacttgggctcacttctgtctgggaggaacctgtacttcccccactgcaagctgtggcagcagcgatgtttggagctttggccctatggaataaagaccagaggttgcaggttcagtctca

SEQ ID NO: 25795 - DNA, 1099 bp, Mus musculus
tgtgttgacataaaactagccagaacgtagagtcgcaccatttgtattattttggatggagaaagttgcattcatttagaaagctcagctgtccagcctcaggggtgctgctctgatacccgctccagccaggctcttcctctgccgcctttttctggcttcccatcccgacccaagcacatcccaggcccctctgccatccccgggtcctgagtgtcggccagacctcatctgatgggaaaggggttctccatagtgcctcgcatgcaccatggtggtgaagattggtcttgatgacactgtctgccctctgcccgcgtggagcactctctgcagggagggaggttttgtgtgtggtgcagcaggagagagcaggatccgagtgcgccttcagtgggaaccctatttggcctttatgtgcgaggtgtccttcccgtcctaggcttgcagagctttactgtgtcttagtgtcagggtgatctgtccctgctctgcagataggtaggtgccccttgctggtctcacggctggctatgacagacagaaggcccgcagaagggctctgatctgaccacacccgggccttctcccctctgctcccccatgtatactctagggtctctctctctctttcaagatttattttttttatgtatatgagtacactgtagctgtcttcagacacaccatctgataccattacagatggttgtgagccaccacgtagtagctgggaattgaacacaggacctcttgaagaacaatcaatgctcttaactgctgagccatctctccagccctctttcttttttgcgagacagggtttctctgtgtaaaagtcctgcctgtgctggaactcgctctgttgaccaggctggccttgaaccctcagagatcacctgtccctgcctcctctgggaacctcatttttctcttaagaggaagaacaccccacccccagctcagtagtgggccttgcatatcaggcagggttggcgctgagccgagcaagccacagctgcttgggggcagtggaaatttgtctgcagtctgtgtttaggacccctgtcaccctccagcgcatacacacacacactca

SEQ ID NO: 25796 - DNA, 1206 bp, Mus musculus
tggggccagagacttggtgctaatgactgtttggagcccagcaaggactgccctgggttcaaagtcccccgaaggcttatagctgagctctctaaggctggtggccatggccatggtatcccggacctcaggatgggcgtgtctggttttcttgggcctgacaagctcagctcgtttgcacaggaggtccccttgctcactcatgtgacatgcaaggccagacagtcagggtgccttggactgcactcagctgtgtcccagaccctgttctccttcttagtcagcccttgtctcgttggccagcacaaggtcagacatggaagcccagtggccggtgtctgcagcaactgtctgttgcagaggagagtcccctcttaccttgcaggcttgctctcatggcacatagcttagtccccaggtccatccagaggttggaagtccagtggctctgcccttgatgggctgcagctcagtctcagggacaccgaatctgcacacacccaaagccgagacaggcttttccatgacaagtggaaactgctgtcaaacacaggacttgggtaggggtgggacacagacggtgaaatgggcacagctgccctgagaagggagggcagccagccctccaagacccctcctgcaccctgtgactcaggctgacaacttcctgcccttcgccttctctccccttgctgcctctcccagcagcctggttgtttaggctccagacaccctagcaggactcctctctggaaaaggtggcaccatgaaggtttaccaagttaacccgaagccaagggccgtgttggggtctctctctctctctctctctctctctctctctctctctgtgcccttgggacttgtggtcctcttgtagacagggcctggatatagacactgactttgaggcctcagacccagaactcctgatgttgtctgttggagtggttgaatccctgccagcagaagcccaggtggcctaaggtagaaagcagtcatgttttagctgagagcccccctgttctccgagtgaatgggccttttcccactcaaaaatggcatgatactccgtgtgagctacttttttttagggtttttaaaaatattttatgtgcgttggtgttctgcctgcgtgtatgtctgtgtgagggtgtcagatcccctgcaactagaattaaagacagttgtgagctgccatgcgag

SEQ ID NO: 25797 - DNA, 1119 bp, Mus musculus
ccacagcagaatcatggctaatagcagcttggaaaaccaagctaaagcacccagttttccggtgcaaaagcacgaggcaccttttatcatcaagagagttaaggagccaatgtgcaagaaaccaatgaacaagaaaccctgtgcagactccaagacacaccccacctcaccagacacttctgtccaggcagcaggggcacgaagtccataaaaatcaccaaggccaccatgccatagccacccctctgaaggagcactcagagaccagccactgtgctggcatcacccagctcttgagttcaaaccactccctgaacaggaggatgacttctgtcttcttcatgtccagaatccttcaggggtttccattaccttcagggaaacccaggtcctaggctcctggctggcctgccccaccaggtggccttctcttggttacttcctggtgtaggccctcaagtcccaggaatgccatgggtggtgtcattgtcctccagtggcccactctcctcaagatccaggcagagctcttcatttaggggtccttccaacctcatctgtgctgattatggggtacccaagcaccccagccctcctgcctacctcagtcatacctctgtgtgcagtgcttcatggttagttttgttttgtttttcctcctttgagtagttagtttgtgccagtcttgtgctcaaggctgtacttctgtcccttgaacagatacatgaaataaagtttcatctgatgcagtactgatgatccctttctgtctctgttcccatccatcacacacagctgtgagccttccaacccccatgtccatgccctggcccctctccaagttgtctcttcctcgatcacatctttccttacatttgtctgattatctatctcaattgctaaattagattttaaaactgcctgaggggctggagagatagctcagtgattaagatcactgactgctcttccagaggaaccaggttcaaatcccaacatccacacggcagcccactcatctgtaactctgagggatctgatgccatcttctggcttatatgggaattgcatgcacgtggaggcaaaaatacccatacacacaaaataatttaaaaaaat

SEQ ID NO: 25798 - DNA, 2026 bp, Mus musculus
tgtctgctcagattgtcctgtgagcccatgggccactgaagtgacaagagggtctggcattgtttggggactgtccttgcactcagtgtgctcatagagaatggttttcatgtgtatttttagtgtatgttaagagtattttgtctacatgtatgtcagtctactgcatgagtagctgatgcctttgggggtcagaggagggatcatcaggtccctgtagatggagttgtgggtggctgtgaaccaccaagtgggtgctgggaaccgaaccacatcttctttgactgctgagccatctctggttcgaattttcatggttttgaagactaagcagttccctcagctcaggagaacaatgaagttgctgctgcagaactccccctgtcctacctggagtgaggtctgaggaggattctgtgggatctaccctgacccctctgcttctctgtaggaagttggagttgccacctgtgtctggatctgctgaaggagaaagcatccatctaccagaaccagaactcctcctgatgtgccacccagctcccctgcatctaaggccgttgctctcctctctaccttggtttccattgcccctctctcctctttcactctgtagtcctgccaacctccgttggcaacagcacagggaggtggcagctctgactgcctctagccccgagccctcagggagtaaggagcagcgtgctgctccagggctgacctgtgggtccaacttctctctgctctccaagaagtgcattcactctgcctgccttgggcctaagaccctggtgattacagggctcaaatggggtcctctgagaaggaatatgagagcagctcacttgtctcaagccttgcccacccctcttcccccaaaccccctttggtttccagggttttgccccagagatgagccaggctgggcctttcctggaagcagctggagtgagctggctgagtggcacttgccaggaccttttcataccctagttctgcttccctttgcctcctgccaaagcagtcccctgtcctctgtcatgctacatggggttctgtgcttgagctagaatgttctcgggcacctcctggctctgccctgtcccacaaagggacgagcagcttcaaacctgtcctccctgtgcttggtggcttgctcacaggtgcgctctggctacccagacatttcctatcctcagaacttcccatcttctgcccccatccttagtccctttgcttttgtagggagagggatagtgtcaggggctgggccagcagcttgggggccacagggagaagttggataatgtgcctgttttttaactcgataaaaaagcctacctccaaaattccctttttgttcttcctgaacctgggcattcagcctcctgtccttaactaaattaggagcctctgcctcctgcctgtgtatcctggctcccaggacacaggatggtcccctttccttgcacgctagctagtagctggtaaggtcttcacaccctgagttttctgtttcctgcttagtggcactgacattaagtaggaggggacagtcctctgcagtactctagagagtgggcttcccccttggctgtgggcaggccctaactgttttctgcaaagttgagggccccccctcgcatatttagttcctgtattcaaaacattagtaaaaataaacatttttacagagtcttctgctggacagtttgtctcttgactccttgttgaaaggttgtttcatttcaaacttacgacaatagggttttttgttggtggtggttggttgttttaaattgaaacaactttttctcccaaaatcaaagtttttgttaaactccaccatgtaaaattattttgttagttttgttatgtaaattcagatttataacaatttagtggtataaaggatgaagctaattaatacaaaaattgggttaaaatcaactttagcattttctctgtatctgtgcttttggctggttggaaagactttactcggtgtgaatatgtaggcggaggt

SEQ ID NO: 25799 - DNA, 1238 bp, Mus musculus
actcacaagtgaacttgtctgcccgagtggttgcctttgtttctattttctagaactcgctgtaagagtctgactatggggggctggtgagatggctcagtgggtaagagcacccgactgctcttccgaaggtccagagttcaaatcccagcaaccacatggtggctcacaaccatccgtacacacagtgtacttacatataataataaataaatctttaaaaaaaaaaaaaaaaaaaaaaaaaaaagagtctgactatgttgcacccacttgagggcctctaaacccagtgtcctttctttcccaggacatctttggctgtgtctgtgtgaatcctgggcggctcaccaaaggacaagtgggcggcacctttggccgcctctacctcaggaggcagcccaaggccatggacggtgggggcaggcagggcctgagcgtggcagcgcaggtggtcagaatctgagtcctcagcctggttgcctggcctcacaaacaccaagagcccaggtatggctctctggtggccaaactgttggagtacctgacaaggatctggccacagggacaggactgtagggctgggccgtccagtcacggcttcccactgtccctcacccccatgcagcgtggctctgatctgaattacgccctgcttctctcctgcttcatgaggtagatgtacagacgtgaaccatctatggacacaaaggcaggaaaactgactttttttgtatgaatcaaatacagcgtgtggagaaataaaaatttttttagtataactgattttaatcttttttttttccccctgagtagtgtcctaggaatgttgtctacttgacctatgtccagagaaggcagagctttggtccagccctttggaactctcccaagccttaccctgcatcctcccaaagtccccaggctacagttgctgaggaggaaactgggctgcagagcgagcagctggcagcctgcctggctctccctgtgccgagtctcatataccaggtctcacattgcatgctgaggtctcagccccacctctccatctggaggaggcagccgtgttgagcccttccatagctgtagtctctggtcaatctgacactctgctgggaccagcggtaacttggacttacctgtagcccagagctctcgtgtaaggtcaggcttcctaggacacacgcacaccgtgtcgatttgttctggtatctggggatagactgcagaattacgtt

SEQ ID NO: 25800 - DNA, 1221 bp, Mus musculus
acattggtcagtgtctcacagagcctgtacctccagctccaggcgatctcacgccctcttctgccctctgtgggtactgcactcgtgtgcacatacccacccctacatgcatcattagaaacaagacaaatgtgtatgtgtgtgtgcatatgtgttcatatgtgccatcatgaccagcctgggtgaatgactggtctaaggcaccagactcaaagtttcttcttgtaaaggcactgagaaaaccaggcactggctactccactagggctcagcttgctgccacaatcccaggtcaactagcttgcttctttttagaacccaggaccttgagcacgccagtgctcattgagttatcataaatctgcacctcctccagcttacttctttgtaattatcctgataattcacctactgccccttctggaagaggcgtctcgtccatctgctttcctgtcttctgacactcacagcgcgtctgtaaccacagtattgaatgaataggagtgaggtgtaagggagggttgagaagccctgccctgcttgcctctgatcgtcctctcctctcctcctgcagctaccttctgggtaaacccccagttcaagatccggttggaggaggtggatgacgcagacgactatgacaaccgggagtcgggctgcagcttcttgctggccctcatgcagaaacaccgccgcagggagcgtcgctttggccgggacatggagaccatcggttttgcagtgtaccaggttagccaggggtggacccacctctgcctacggcagcgagcatccaccaggagatgcccaggtgcatcctgagggcctgaaaggctgacagctgaggctctggtgcaggaaggagctcctaaattagctacagagagggcgaaggagtcggttggctacaggaaaggaaggttccagggaagaggtggctgtagctccgtgtgctacagcctctggggtcagactgtgggctcagctttgtaacaaagtggagtactcgtggagcaagcctgtgaacaggcctctggagcagggggaaggtctgctacccagagagaggctgttcaaggacttagtacttctgcctactgctgctgctgcagctgcttcttcattctccttccttcctcctcctcctcctcctcctcttcctccgggttgagccacaccctagctgtcctgtaattcactctgtagaccaggctggcttca

SEQ ID NO: 25801 - DNA, 1201 bp, Mus musculus
gagcatagtggcccactcctacaatcccagaaaattgggagactgaggcaggaagagcatcataaatctgaggccagcgtacagctatagagtgagatcctatctaaaaaaaaaaaagctgggcgtggtggcgcctacctttaatcccagcactcgggaggcagaggcaggcggatttctgagttcgaggccagcctggtctacagagtgagttctaggacagccagggctacacagagaaaccctgtctcgaaaaacaaaataaggtctcttgctgcagcaacgagagtgggagcacctggagcgcaagcttggaaggagaatccacgagttgtaagaaaatggcagacaagccggacataggggaaatcgccagcttcaataagggcaagctgaagaaaaccgagacgcaggagaacaccctgccgaccaaagagaccactgaacaggaaaagaggagtgaaatctcctaaaagcctaggaagacttccccatcccaccccaccccaccccctcgtgatttggaggaagagccacctgtaagatggacccgagccacaagctgcactgtgaaacctgggcactccgagccgatgccaccggcccacgggtctctgaaggggacccctccgctaatcggtctgccaaatttcaccggtttgccctgggatattatagaaaattatttgtatgattgatgaaaataaaaacacctcgtggcaaaaaaagaaaacaaaacaaaacaaaaaaatcgggggttgggcagtctaatgagaagagcaatcaccaggacccatatggtggaaggagacaactgactcataacaaacttctctggcctctacaacctatttaatcatttctcagctagagggtgctcttcccatatatatgagcagactcgcatacaaatgtaattttaaaaacaatgtcaagaggcaggcggatttctctctctctttctttctttctttctctctctctctcttccttcctttctttctttctttctttctttctttctttctttctttctttttttgggttttggttttctgagacagggtttctctgtatagccctggctgtcctagaactcactctgtagaccaggctggcctcgaactcagacatctgcctgcctctgcttcctaagtgctgggattaaaggcgtgcaccaccacacccggctaagcaggtg

SEQ ID NO: 25802 - DNA, 1134 bp, Mus musculus
agctcctgagtcagtgggcattgtagaggagcttcccgaggatggagagcctgatgctgcagaactccgccggcgtcgcctgcagaagctggagtcccctgttgcccactgacactgcccagacctggccctgttctcttgagtggccctcactggaacacgtcctgccatcaagtgccagctccctctctgcttgcaccagggagtaatagccccagttgagaaagacttggcaggatctctgaggatcaaggagaagtgtctgggcttccagtcgatccatccccagtgcccctggcagccatggagatactggtcagctctaacctccctccacttctgccatgttcaactggggccttcaaagtagaagctgaatctctggtaagccttctcttccatgctttctgggagaaggtgaagcccctccaagccctgcttgtgagtatgggaccatgctgcagtgccgaacagtattagcttctgttcccaactgtggaaacccagaggggctgaagacagaccaggaccttgccccaccctcctgccaagactggtaccagtctctttcctctagcccagtcttcccagaacccctttgtgatggtggctgtgccccccgaagccctgtggcatttccatgtcttactggcaaccacacaactcagggaaaggagtgcctgggggtggggcacaggcgggcagcaccgagggaccctgccctgcccctccccagctctttccccatatcacccagcagccactgcctggtgggcctggctaagggtgtgtgctgctccttaaaccactgctccccagaacccaaggcaggccacctccaacctgtgggatgtcgtcaggattggaactattctgtacctactggctttgggcttaaattttgtcttctgaatttgaatgcttgaccccaggaaggaggagcaggtgtggggctaggtacctggacttcgcagtttagaacaagctctgggccgggccgggccaggccaggcctagggagccaaggcctagctgctgcttccttcttttggttttgtgttacaggagtttctggagagtttcagatgattatttaatttgtaaatattgtataaattttaatagcttaaattg

SEQ ID NO: 25803 - DNA, 1134 bp, Mus musculus
gaggccatagcaacaatcaagctatcaaaagcagatattaactgctgtatagataatctcttgtgcattgtgtggaagcatcccctgtcaatcaaaagctgatggccagtgagctgaggcaggactagaaggcgggacatctgacagggagattcaccctggacttggaggaagcaggatgtagcaaactgaggagaggaaactcaccagccatgtggcaggcgtagtctcgtttaaatgggttaaatgggttatgaactagtgggagcaagtctagtttacggccataagcattgcacatacaaatgcgcctgtaagtcataattcaggaactgggctgagcaccagtggaaaagcctgagattacaaactgctgtcccattataaacttaatacatttcctattgtttgctgttctggaagcgaccacccaaccctgttctggaggcttcacagcatagacccatcaaggaatcaatccttgacctagagctcctgctataggccgggcgtggtggaagctatggaacagaagacagtacagcaaaaagacatggacgggagtggatgagacaagcaatatcttaggttctgagtgctgtactaggtagggttggggaatcaccctgtgacctgtaatcaactatacaggggtgtgaagacaaaatgcagacctttcacttctggcgcccacctcaccagccacatgtccaacccaccattaaactggctaaacaatgttaaacggtgttcagaacctgcctaccctgtgtgacctcagacctaaggtagctagcggtagcaacctcccagtgctctctagttgctgatctcagcaccctcatcccaggaaccacaggccggtccattcttaggtctgtagactaagagcccagccctaccctaggtgacacgttctaccaatcattaatgcaagtttttattgagctgtatatacaatttaagctattaaaatttatacaatatttacaaattaaataatcatctgaaactctccagaaactcctgtaacacaaaaccaaaagaaggaagcagcagctaggccttggctccctaggcctggcctggcccggcccggcccagagcttgttctaaactgcgaagtccaggtac

SEQ ID NO: 25804 - DNA, 1200 bp, Mus musculus
catcccagcactggccagtctgagccgcagcccggcatcgccgctggtgcgcttccagctgcccaacgtgctgttcgcctacgctcatactctcgccctgtatcatggaggggacgacgacgcgctactctctgacttctgtgccaccctgctcgatgtttctggggccctgggagcccagcaagtctttggctctacagaggaagccctgcaggccgcagcccacgtactggaagcgggcgagcacccacctgggcccctgggtacgcggggtgctatgcaagaagttgcccgaatcctgctgggcgagggtccagtcaatcagaaaggctacactctgacagcactggggcacctagctcagaccctgggacgagcccggaagcaggctgtgattggtggagagcgagatcgactttaccgggctcggaagaagtgccagttcctgctggcttggaccaacgaaaacgaggctgccctcacacccctggcgctagactgtgccagagcccaccgagcccatgctgtgacagctgaggagatggcaacgcttactggagagttagaacggctttggggaggcccagtgccacccactccaaggactctcattgaggaactccctggctgaactgggtatccatgtcattaataaagatgtgtctggtctgcccgaatgtcagcagtgccttttccgtaaagatagtgccctgtcctaggcttctcttgaagttactgtgtagttgaggatgaccctggaactttgatctgtcacccacctggacagtgagaggttacaggggttaaccaccttgctaatgtacacagtgctgaatagccgaggcgtcctgtgtgctacacaagcactctataactgaactacatcacatcccccaggcctgaggtgcccagttgtctctcctcgtcagacttttggacccacaaaccacttctaagctttccttagtcaactagtcacccccaagcctcaagtcactggccccaggatagaagaaaaacacaggaaaggttgaaaacatttattcaacagggaaaaatactttccttctggaagcagtggcttcctcttgctttcaacctcttaggtggacctgcttcagtagacatagggtatgattcggtaaggcacacgcttgcagtactcctgccaggcacggccatacttttggaggcactgct

SEQ ID NO: 25805 - DNA, 1455 bp, Mus musculus
cggctagaacgaaggacttggttccagatagtacgaaggacttggttccggctagaacgctccctggaatctctcccccagttgtgaaagagaaacgaaagaagaaggttcctgaaatcctggtgagtggggccagacttctctgactcttggtgggaaggcaatgtctgaggtgtgggtctagtgctctggccaacatggctgctcttccctcccactcatgtgccctcatttctttccaccagaaatcagagctggataagtgggctgtggccatgaatgctgaatttgaagctgccgagcagtttgagcttctgattgaatgagatgaactgggatgcccgtcattaagtggggtgacctggctggctctcccctcttcctgtacatattgccttttgagtagagcaggatatgtggggtccctttcactagccttgttacccagaaaggtattgctggcctcttgttatattgtgtctccttgccctggactgtctacctctacagcgttggggatgagaatccactgctctgaaccggaactgtcagaaacagggttagccatgggctgtctctgctgttgcattcagccaccaaccagcagagaggttttgtgttctgctttggttctgtagagttgagagatctcaaagaccagggagacagttaaatgcttgagggaggatttttacattgagtctctggagtccaggatatgaacgggaggaagcataattggtttttaacacagtgacttatgtaggaactggtccgtgtctgtgctctgctgttgacattggtgaacggggtgctgctgcttacagcaaagtgggtacacttgatagcgtgggcctcggatgcaccagtgtaagctttatagtctctgctttgacctctttcctcgcccacatctgtttctttgaatacaagctgtgtggcctcagccctagacaccatgtcacctcatctctcacctactagacagcttttgctgtgagcttaaaactattgctctcatgtgagaccaaccattcctgggggttgctgggaacaaaagtggatgtatcatggcttctaaggttccttcctgcctgccacctctcaatcatggtaaaagctgtggtttaaaggccattggccttccaacctttacagttcacgagagcagaagctgtggggaatgagagctcaggtaagctcctgctccaccagggtggcttagtggatcactcctgcaggctcagtcctcacccgttcctgaatcatgctgaattgctaccatcactgcagacctacctgcctgtgaggaactagtgtgcagcctaagggcaaggtggcttgatctcaaataaactgtgtagaagtttctacgtttgcagactgctttttatttggttgaaggcagagccactgctgggaggccagccccagacaccatgtgtccgggctgta

SEQ ID NO: 25806 - DNA, 1183 bp, Mus musculus
aaggatcagatggctgggtctttcttagaagaggagagaggaagtggggtagcctctctgagggaacatgactggagctggcaggtgggcagagccaagctctggaaacgagtttgcctggaactagaggtgtatataaatagcttgggcctggagggggtgggatgggaggtatgcctgacccagaaagcatcaagcatccttgtgtctttctgctgcttgcctttgtaggttctgtggaagccctgcaggaggttctacagctgcctgctgccctgcgtgcctgcccaccccttcaggcggcgttggctgttgacgctgccttccgggaagacaaccatgcccgactgtttcgcctgcttcgcaccttaccctacctacagagctgcgcagtgcaggaacacattgggtatgcccgccgcaaagctctagcccgcctgtcccgtgccctgagcactcctaagggacagaccttgcctttggacttcatagaacactttctggccctggatggactccaggaagcacgggacctgtgccaggcccatggactgaccttggataaagacagagttgtattcctgaggggtcaatactctgaggaaggactcccaccccctggtgcctaccacatattagtggggaataagttgcagggacacaccctggaagatgtggtcatggctgaggaaggtgacattcacagacctggctctgcagcttgagagggtctcgtctcccacaaggcctgggtcagagcacctggcttctttttcataattcccaaacaataaaaggaactcattatgatctccaaacaataacaggaacttttagacttcatttatttgagggttaagaggggagagagaaaccgggcgtagtggcgcacgcctttaaatcccagcactcgggaggcagaggcaggtggatttctgagttcgaggccagcctggtctacagagtgagttccaggacagccagggctacacagagaaaccctgtctcgaaaaaccaaaaaaaaaaaagaggggagagagagtgcaggggaagaagaaagcaggctgaacaatgggctagactctacactactttgggccccagtttcacccactaccgtgagcaggtgtccttaactgcagggaccccagctgttgctttaaaagcttgagtgtttgctgat

SEQ ID NO: 25807 - DNA, 1192 bp, Mus musculus
gtgtgggttcacaggtgtcattcttgaccactgtacaataatctcatgagggaggatctgtcaccttacagagggtgcagcagacaagttaggttgcctgcccaatgtcacatagtaggtaaacaagccaggattgcgtgtcatgttgacccagtctgggaaccatggtgtatcttaactgtcactccagcaggcttagaatcttgagttttgattgtttaatacaggtttgatccctcttgcccccctaccccagtgtactactgtattgtaggtgcacccctccacacctggctttatttagagtctcgctgtcacctttttccctgctgtgtgatcggggaggttgtagagcctctggatcaggatgcctttgcaagagatggaattatttctgtggtccctgcaaaatgcctggtcctgtcacacactcagcagcccatgctggttttatgtcactgacggtggcacgagtatgtagcttcagagccacccactgggtgactggaaaggacaagctgaggcctgctggttccaccggtcctttctgtccccaggccctggagctggactccatccgcagccaccactggcgcatccagggctgcagtgctgtcacaggggaagacctgctgcctggcatcgactggctccttgatgacatttccagtcgtgtctttactgccgactgagcttcttcagtgtccccaggtccctgtcctcatcagacaccagccagagggatgagcaccagctggccagactaacactcccaaccccaccatgacctgctgctgctattactgcccattgctgctcccccgggtgagggctgtcaccctgtctcccaaagtggcctgcagctgccatgccaaaaggaaaggctgggctgggagggactacctgctgctgccagggtcctaggtgtcgcctcgcctcggtccagcagtgagaataaagcactcttcacccagttcctggctgagccatttgtgagtcactgactttagcactcacctggaagctgagtccagaggggacagagcagagcggaggaagaactggtttagtcctcccctgctaaggaatgggcagagcatggaagctcagggcagggctcgctgggtccatctgcaagtaaccaagcagccttcctataggaggaggcattgaaagagggagtcaaggagga

SEQ ID NO: 25808 - DNA, 1198 bp, Mus musculus
agggagatgtagccaagcatgaactggtctctggccagagtgttcagaaggacaaggagccacttgctgagatgagagacgcatgtccctgggaagacaccaaccctgactgttgggcaggtaggtagcagccatcagcctagaaacgatcatgggatggcccagctggggagtgctgagacccaggtgtagacgcttgtgtgaagtcagatgagggtaacaggatggggtctgggagagggccaaggaaagagcagcagcgcccggagcagagcagaagctgggccacccggccagtggagagcagtaagggggtcttcggagacctacctggcaaagtgaggcttcaggaagcatcaggagccagtctgctaacagtagacctgtagaaagcaagaggctaagtaaaactggtgcagtggtgaagaaccagggaacaggggttcagtgcccagtacccacttggtgcttcacagccttgtgtaacttcagtcctgaggtcctcgtgtaggcaaaaactcaaaatattctaagcaaacaaaaaatgagcatggtatcgaacacctcgaatgccagcgttcagaaggtaaaggcaggtgaatctacgggcttgagtccaacccggtctacagagcaagttccaggccggccaaggctacatagaccttgtctcaaaaaaaaaaaaaaccaaaatgcaggaaaagtccaacatggtgttacatgcctgtagttctggcactcaagaggcagaggctggagaactttgacaagtttgaggccagtttgcgttacatagagttccagacaaaaaaaacaaaacaaaagaaaacaaacaaacaaacaaaaacaatacaagccaaaagatggaagttggtacaatggagtataacacctgttcccaggatgcaccccagaggaagctgtggccgactcagcagatggtgggggagtgggtggagacaggttctgctgcagtagtgcgcagcactcgaggcgtgaggcgagagtttggtgatgagaggagaagggatggaagagtggatgttgttggattgacaagacaatctgctggctttccaaggtgagagttgggctgcagaaggtggaaggtattcacccgtgcctctcaaaggtgggagtcacagagccagagtcaagtgagtaggaagaggtcctaaatgtagagcctgtcccttct

SEQ ID NO: 25809 - DNA, 1889 bp, Mus musculus
cgctgaccttcctccacatctcattccaccctccaaacggaggcacgagtgacttccatgcctgagataccctacaacccccagggctgctgccactttctacccaccagctccttgtctgcccaggtgggctggggcctggaggggcagaaattgggggagggaaagggtcaccatttttcaaggtccataaagactgagcggtgtttcctcagctcttgaataggaaaaccaccatctttcttttaaagctgttccggggttcagcgggaggcatgggtgatgcttggatatgaacagtgggattttgtgcacaggaaccatgatatttttaatatataacattagaggcagccttctttcttgcctcttctgtctgacagccccacactcatcctctcccctatccaagccaggcacctctccaccccaccctggcacccctgtgcccgatgccccagggctgtgtaagcaggaggtccctgctccttcagcttgtttttagactggggctccctcaagggcagcaggttgtttcctgctagccgtgttctgtgctccagtcctctgctgtgctgtggggtgcacaccttactctgtccacatcccctgacaccccagccagcacagcagccacaggtagaagacccaaccactgttatttgttgtggaggcaggaggagttgcgagacagtccatgacgtctaggaaaatgcataagctacttagtgttctgtagtgacacttgatacttgaccaagactttgagtaacttacatcactcgttcaaaactgtgatttttgtctcctctttcctatactccagccttggagcatttccaccccagagccagcatagagctgacatcctagggcttgagtttgctttctggctgaggggaggtcatcccagcttctgctcagaggggtctgaaatgtagcccccccacccccgccccaaggtcaacctttatggcagcttcctggagcccctctctgccttgggacaggcagtaggccctgtgacctggggtggtctggggctggtaagaggaagcctgtggctctggcctgggtgtagtgtccatgcagcacgacaggggaaaacccagccccttccctcgccctgtcatttccttcctctcctcctctgctgagccaaggaggtctgggtgtcctgagagccccagactgagcagtaagaagcctgagctagcaaatgaccactttagtcaccccactgtagcctggggacccggacacatcctgtggccagtggttggctgtcagggtgggctttccactgagctgggtagggcattgcagcctgctcctctgacactgtaggtgggcttcagggagctgcctgccaaccccccagcactgttctgggccctgctgagggtgagctccagcctggcctgttacctccctgcctcagccctccactccttggctgagggtgagagagatgtcatcctcagctgtagagggagtggccgaatgaagactggttctcgcattaaaggaagtttaattgtgccaaagcctctcatgctcccttgtcttttcctggccaaggaggcacccctggagccttgcaaggggtcccccaagttgtccataaccacccatctcctgtgcattgttggcgagactatctggaaactgaacttgatggtgcacacccatagtctcagcacttgggatgtgggggggaggaccaagctacatgagagcctgtccccaaaaatctaaacaccagtagagattgatatcagaattatgctgggcccacttccacatctgcacatcatcacctccctcaagaccgccacagctgtagacagacaggatgggctcccctccctagtgtcctcagactgggt

SEQ ID NO: 25810 - DNA, 1400 bp, Mus musculus
tctttgagacctctgtcccttttcccatctaacttcctgttcttccctccaggtctcagaacggccccgaagtctccctccagatcctgagtcagagagctccccctgatgccctctggcagtgcccaccccattcccaagacagaaggaatgaggaagcaaagagcttataggatgccatactccggctggtccgggatgtgctgaaattcagactcagggagagcctgggtggaggggtaagagcacggcacgcctgggtccccaggaatagaggtctgactccttgccccattcctgctattcccttgggcttccaacacgggcctacatgggcctctaggagtgccgtggctctggtgcccagggaagattgtgccaaagttgtgcttcacagggccagtcccagggaagctgttaggagtcaggatgaggaatggaggggcaggtccttgggagtatgctggtgtcttgtctgtgcagcctggcccaggctgaggcagacgtggagcatgcaaggtctccgctcagggtcaggctgggatatgggctctgattgacagggaaggatagaaaagggggagcgaggcaagtgagagaggggagaaggcggcgacggagcaaagggagggaagaggaggtgatgtaatcagaagatggatgctaacccgaaaagaggagagaaggacaaaacatgtgatgaggaggatgcctgagaggggaggggaggagggagagtgaggcaggggagaacccaaacccgagaacttttctctggggtggggcttgggattgagagcaggactgttgctagcttatccgtccagaaaaaatggttcctaggcagggaggggatgggagggtatttataaaggcttcttggtgggagatagtcaccctgtggggaccactaaagatctccaggcacactttggctcttcccagcaaggggggtccttttctggaagcttcgatctaccaagtgtattaggggaacatagggggcattttattattgatcacagtcactattattgttattatattgctatttttattaaacctcaccctgctacagggtggggagtgaaagaagtatttatctctttaaacgccatattcctggaagggataggctctgatgctccaagatgtgacaagaaccaataaagccaactttataagctgctggcttccctgcctaggtctgtcttgctgtgcaaaaatgggagtgtggaaggaggaggagtggtggggatcacggacagttgagagctggcctcttgagagcattgtgtgccctcaacaagaccacagggcaactttggatagtctccaggagctgtgattttgggcgggattttttgttctggcttggctcattggttggtgttggttgc

SEQ ID NO: 25811 - DNA, 1198 bp, Mus musculus
gtagttgtaggggagtgaggttacattgcatgtgtatgagtacagatgagaggacactgctagaggggtggccaggagctgagcctagaggtcccacggatgatcctcagcctttcacttggcttgcgcttttgctcaggtgcggcagaaggtgcacatagttagccgggaagcagaggcggccgaggctgaagaaccatggggggatgaagcccgagaaggccgtcggcgtggtccccgaagagagtccaagcctgaggagccaccaccacccaagaagcctgcattggacaagggcccgggctcaggacaaagtgcagggtcgggaccacctaggaaaacgtcagggactgtcccaggtactacccgcggtggccaggaagtcggcaatgctgctcaggctccagcacctgcagcatcgccacccccagagggcccagtgctcactttccagagtgagaagatgaaaggcatgaaggagctactggtggccaccaagatcaactcgagcgccatcaagctgcaactcacggcacagtcgcaagtgcagatgaagaaacagaaagtgtccacacccagcgactacacactctctttcctaaagcggcagcgcaagggcctctgaactctgattctgtggcaaggccccaggcctgccctcactcccagcaggcttcaccctcatcctctaattcaagcctagactccgccctcagtcctaggggacccagagctgtcctgcagtgactaggagccttcatttagcccctcttcaggccccagagccctggctcagttcttagaatgtaggtgtcatccccaccagccggccaattggaacctcattgtaggtccaatcccccgaaattcagtggaccatgacaggagcccaagtcacgcctgaacagtagggcattcctcccacttgggggctagattgaccttagccccagagcacagttgctacctggaaaccaaggaccattcagtccctaggggtagatttccgcactttatatagagttccatcctttgggaatccaaatcccttaccccaaagaacttacatattgctgcccgaatttggaaatcttcctcgtctccctagcccctgagtacaggacatgaagctccgactcttatctgtgaatactgagcctcgcccccttcctgaccaaactggcgcaagaacagagca

SEQ ID NO: 25812 - DNA, 1293 bp, Mus musculus
gtagggaagaatgtaataaatcagagttctgatgacaagtgtccactggtcaggaaaactgatctttccacgagtaagaatggtcatattgaaggatggcatgtttcccacagtaatgtgtagcaagagatttgttgtgtactcttgtagcttgagttccaatgctttgtgggcctcattccagtttcctcttttctgccctttaaggcattcagaattgataatatgtatctgtacacttctgattctgggtttctgtgcattaagtcttggaagcaagggcatgatggttcatgcttttaatcctagcactctggaggcagaggaaggtggggctttgagtttgatgccagtctacatagtttaagactgccagggttctctaaagggacttctgtctcaaaaaacaaacaaaagatccaaagagttggagatatgcatcagtggtagagctcttacccaatatatgcaaaaactctgatgttaacactacaaaagaaatgtgttccttgttacattctctagtattttcgttttaaaagaactaaatgtgaactgttccttaactttcctgacaggaggatctttaaaatggctgcttgttttctctgacctctgagatttctttctttttaaaaatttaggtgatttcagtttagttttaattatcatgaactgcttgccttctggttcatatttctgcctgatgggctctgtctgtctttagacttcccaagtaagaagaggaagaggagccgatggaaccaagacacaatggagcagaagacagtgattccaggcatgcctacagttataccccctggactgactcgggaacaggaaagagcttacataggtaaatacacgttctacatccaggtgcatcttcagattgttactgcagattgttctgagtgatgaacctgttgaaagtcttaagattttagtcatgggaacaaggtgtgatgagctatgctttcatagctgtgtaatccgtgatttgcttggccagtcctgcatttgcagcttcttgtttgggcctgctcttagctcggcagcccccttctcagctgctgttcttgctcattggtgaggtgaatgctatcttcctctctggacaggccccagtggagaacactgcaggtattgtaaaccagttgcttttttgtagcatggcctttcaccataatgtcatggttccctttccctaaaattgtggtttcgtttttttataggtacaaaatagtttaagcaaaaagtggctcggaaagcatttatagtttacccattttg

SEQ ID NO: 25813 - DNA, 2556 bp, Mus musculus
cggtgtacccccgcgcgtgtgaccttgggcttctttactaccccagatacgacgactaccaccacgagcgctggcacagggtccatcccgccatggcaacagcagcaggcggctgccgcagcttctccaggaacccctcagatgcaaggcaaccccactatggtgcccctgccccccggggtccagccgcctctgccgcccggggcccctccccctccgccgcctccgccacctggttccgccggcatgatgtatgccccaccccctcctcctccgcctcccatggacccttctaactttgtcaccatgatgggcatgggggtggcgggcatgccgcccttcgggatgcctccagctcccccaccgcctccaccacagaactagacttgtttttttttttttaagaaaatatatattatatacatagagagttggtctcttataaacacacgccgaacctcaccatatggagccagacattgggatgcacgcatgtgattgtgtgtgcacgcatgtgtgtgtgtgcacgcactgggctgggccaagtgactggactcgcttgggaaacgggcagtggtagtggggcgccagcttgagctttcctggcacctgtagcatcgagtgtcttctttgtcttctctcctcacccaactccctctgcctctccccaaaccgggccgccaggatccctccccgcggcagcgatggcccgagccatgagagtgaggactttccgcgcccattggtgacccttccaggcagacagcctcagcagcgcccctggtggacaggatggttcggcaaagcagcctgagttatttttgtggacggaatcggaacacactggctccatattgtgaaatttttattaatttttatctttttcctttgttatttccttatcttttcctttcttcagactccgtccaaggagatgctctccccggtcttctgctgcagataggatccttcccttgtctccattcctctcctcccaaagggagaggggcaaatggtttaggtacaggctttggctattaatgtcaggcttggtggtgggagtggggggtcctatggttctaattgttgaagggcttcagccacattcaaaataagtaggtggtttatctttgacatcttttaaagagtctggataaatctgactcgttgctcaatagggtttatttggcagtgggattcacatcttcctgcactcctgccagcagtacagggcacagcccaagccaccataggccagcctggagtctttttcatgctctggtcacccaagctgcctcagaacccatttgcttctctccttcctggaaagcttccctttatgttttattttgaccccagatgtccagatgttttgcagtgtctggggcttgtgtcccttgttcttcgttctgctgctttgccccttccttccctcttcatggagtgattatgttgataataatgtgtaatgcgcgttcttttcactggtttatctacagaaatttctctgggcctttttttctgtgtttgattcaacactgcactaagggggaaatgttccattgaataaaagagcagtgtggttttccgggtccgtttcttttcttttaaaacctttttcctgaccatcagcaccaagttttacctacctaccctggccccagctcctgcatgtgaatggcttcagcccctcactttttctagtttctagttgatagaactgaaaagcaggctcactccacatttcaggagtctttgtcattgtgacagccttttcctggggctccgacccccacccacattgatgagctctagataggatttgtgtctcctagctgctgcccgacttaaggacctggacctggggaggcatcagcactaaaggtcacgctaactaatcctgcttgtcgggcacagagctgctaaaattaaaactgccaagtggctttttttctttctctgctggtggctctcagcctgccaggactgcaggtctaggggagtagtagggacaaaacgtggtgccctgtgctgagtggccacgtctacagagtcttctgcagttctcctgtttagggtactaggaaaatcaccccttgtgtctttgtgagagccacgtctttggcagctcatacagctgctgctgctttgtctagaggcttgagggcagttgctgtctacccttaggcttcctaaccaagccctcaactagaggttttccctattgtctttaaccttacagtgtgggggcagggcctggccaccctcttcgaccttggctttacctcattgcttccctcacaatcttggtttccctggtgggctcattgggcggttaattagctctttgaagctctggaagcggcaaagtggcgctgtgtgggttttagaagtaaaatcaataaatgacttaaccatggctcagccatcctctggtcttgccctcctccctgtgcagtgtgctcttaatggcccctctctcaccctgctgccagcctttgttaagagtttccaagagcaagtttgaaggcccagctacaacaagcacctgtgcat

SEQ ID NO: 25814 - DNA, 1097 bp, Mus musculus
tatccaatttaagtgcttatcaacgtcaactaaattttctcattccagcagccatcaccactgctggcctgcgagtcagcagtgacctcctctgctcactgcctgggaggaggggactgccaggcacccagaagtgaggccatgccatcatttcctccccctacccccaccgctctcccttccccccactgcccagagagccagagaaaaccatgagaaaggactttagctcttggctctgcctcgtgacagcactgtgggtctttgctgacagtctctagggttcctcacaggtggtcagcgacccatccaggaacttggggtagctgtttcaaccttcccttgtttttcctgcatccccacaccccagtgctgacaactgaagcctgctcctgctgagccccaccccagattccttcttcctgtttttgtaatttttcagttgtgttttatatgttgctcttgtgccaggcatatgtgtggaggtccgagggcattctgggagctggttctggccttccactttttgagaaaggatctttcttgtttctgctgcttccctctgtagcctgggctagctggcttcttggcgattgcctgtctccatctctcatctgaccatagggagactggggtcttggccccacgctgcacgtcttcttttctgtgggttcaggggatacagcttgggttctctaccttgcatagccagcaccttgcacactggcctgactctggggtcctcccacattgccttgcttttgtttctttttgaaactgtggcaaatcgcacgtcacacacatttctagtcttcgtcattactcatgattagggctctgactacactcaagtctctgcacagccctcaccaacgtccaggtgcagtttccccatcttcccacactgaagtctctgttaaacataagctctcctctccctgtccccagcctctggccaccatctctgtttgaactactctgggactttagatgagtgacgacacacagtactacttcatgtgttcgcgtacatgcttgcgtgtgtgtggaggcacacatatgtgggtgcacacatgcatgtgcagatccaaggctga

SEQ ID NO: 25815 - DNA, 1153 bp, Mus musculus
ccaaaaacaacaaaacagagagcgccaggcagaaaggctctgatgcccctttgcagacagaggaaccagaggactggagagcagcctccacggcagctcagcctctgagcaagccgagagcccaagcaggggagcaggcctctgcctctaggaacgcttgtgtcccctgggctcttgaccctgttgcagtgtggcctgttcctctcccccaggaagtgctgtgatatctccactcagggcacagtctgagccacagggggtcgtccctcatgtagatttccttttccattcagaagctattggtgtccagagatgcccgtctctgaggtggacattcctctcaccaggcccttcctccttagtgtcctcgggccctcctcagagttctccttgctcctcggttctcactggttttgctcttgtgagccttcctcacgtgttaagtcacagggatgcacatgacatctcagagccctttagctcctggggccacgagagctcactgccttcccaccaggggctggacagtgactgtctataggctgggagcctgagtaaagatggcaccagggcaggtgctctgtgcgatgcctcttgagagatggggctgtgttattgagtttccttgagtggatctggaagctctgcctccactccacctccacccctggagaaacagtaaccggaagagttaacagtaacctggaagtgccttggaccaaaccaggaaccataaccattcatttctctctgtagattgcttctccttcccttcccctcgccttgtcctccccctttcccttaccctcccctcctctccccttgcccatcccctccccttcccctcctcccttcttctcccctccctttccctcctctccctgtccccttccctccccctccctgtccccttccctccctctccccctccccttctcctttcccctccccctcccctctcaggctcacgtcatcagccccatctctatgtccagcatcagcatggccacccattctgtgctcccctcccccttcctcttccattccctccctcccccttccctctcaggctcacaccatcagccccatgtctatgtccagcgtcagcatggccacccattttccactctcgaggcatcggctgctggccggg

SEQ ID NO: 25816 - DNA, 1184 bp, Mus musculus
  misc_feature (85)..(184): n is a, c, g, or t
actgtgacccccttacctttaggagctccgatccgggagcctggtgctgccaccagacttttgccagcggctcccactctgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgccagcggctcccactctgatccctaggaattgccctcccctccacacccacttccagacagagcagaagtatttttataagcagagattttttaaaagtgtcttactagataagagttggggacacagagaagcaactgttgtgagcaaagtggagcttggggctccctcgcccgatcccaatgctgccccatcaggaagagagaaggtcctttccaggagcaactctgctaagaaagggcatcctatcctgttcctaagtacccagttgccatggagaagaaatcaggagcccgtatactgtgcttccctgggactttgcccctaggaggggacacccatcaatgtcactttatggaccgtgtgcaatgatgtccaccaaagacctgtgttgggaatgagagagagagagaccctgagggacctctagagcatttctgagatacatcacttttgtcaacggctcccctagtggggttaaggaagaaggcaggtgctccccagggggagcccctttctcactcacccattcctcatgggcacagctgcttctggctgcaggtggagccttagggttctgggctaggcatccacagtcactgcctcagcccctctaggctgtgcctttgactttaaaataaaactccacccagtgctgcatgtggatctgtggtttgtgttcatggagagggtgtctggaaccagagttggagggacaggtagacctttgagagggtgtcaagaagacagtcacttagctgtatgttggtgtgcacctgtgtatgcaggtatgcgcgcgcgcgtgtgtgtgtgtgtgtgtgtgtgtgtgtgtgtgtgtgtgtagccctgaggtcctcatggctcatctttcctccgttgctctccatttttaattaattaattaattaattccaaaactgggttttctctgtgtaggtctggctgtcctagaacttactctgtagagcagcctggccttgaactcacagatttagcg

SEQ ID NO: 25817 - DNA, 1184 bp, Mus musculus; identical to SEQ ID NO: 25816
  misc_feature (85)..(184): n is a, c, g, or t

SEQ ID NO: 25818 - DNA, 1108 bp, Mus musculus
gggtgtggcccagcgctcactgccactgcaggatgagctggcctttgctgaggacctggtcctagatgaagagggggcacgggcagctggcctgggggatctgggggcagccctgctgcagctggttcggcgactgcaagctcttcggctggagcgggaggagtacgtcctgctgaaagctctggcccttgccaattctggtgagtgatcagggaaaacacacacaggtctccccataaggtcctccaactgtcaatgatggtggtatgaccctttgttgtggatgaggacaactgaggcataattattggaaatcaccaagtaagccaaggtcctgaattatacataggattctgagccctagtggtgtgccaaccaggcagtagtgagaggggcagtgtggaggttgggaggtgtccactggtgagaaaggataggccccggctcacaggcagagcagcgagtgtattagcccacccagagtatccaaacagatgagtcctgccctttagtcatctcagccaatggttctctcccttcctagactctgtgcacattgaagatgctgaggctgtggagcagctgcgcgaagccctgcatgaggccctgctggagtatgaagctggccgggctggccctggagggggtgctgagcggaggcgtgcaggcaggctgctgcttacgctgccactcctccgccagacagcaggcaaagtcctggcccatttctatggggtgaagctggagggcaaggtgcccatgcacaagctgtttttggaaatgcttgaggccatgatggactgaggcaaggggtgggacagggtggggtggctggcaggatctgcccagcatagggtgttagccccaaaggggcaaagctggagtctgggcagtgccatagcctgctggcagggccagggcaatgccatccgcccctgggagaaggcttcatgcccttccctccccactttgtgtgtgtgggggattgtcagaagccaggaaagtgaatgcccaggtgtgggcacagtgctgccccttgcaagccataacgtgccccccaagagtgttgggggcctcgcggaagccatagggggctgcaggggatgtg

SEQ ID NO: 25819 - DNA, 1155 bp, Mus musculus
ttctttccccataccttacagagcaccagtcgaatcctcaatgggcaggtttttggctcccgatcctacttctttgaccgggctggccactgtgaggatgagggctgctcctgggagcatagccggagtgagagcaccaggtaggcgcctctaccctgcctgaagtgcctcgagatccagcctgcctccacgaggcaatgggaaccagtctgttctgagtgaaacccctctgaattcccagtgcccacccctgcccacaaaagcagtttgccctttgacctagggctctctgtttctcagcctctcccatctcaagaatgtggccctgggcactgcctgggactcaccttgtttctctgcccgcagcatgtccggcagcctgggctctggcagttggtatggtgccatcggacgtgagccaggctggggaggggccagccagacgaggaccactcctctgctcttctcccaggtgccaggacctggtagtcaccaccacagcctctattctacaccacagacgtgatctgcttttactccccttagaatacccaggccccagctcccctgatccctggcccctgtgccaagtacgtctgctgcttcttgcccaggttgccaggagactgtggctgcttctctcctctggccggctccttgccgctcctattgtagtgagcttgtgccatccccctaaaatggaaacaaggccccaggataccagatgcccacagtgccctggcatgacctgccacctctgcttccacactggagccggctacctctcctgtgcctaccactcaataaacagaggctgtgccctgtcctccctcctgtcactcgtctgttccttctcaccttgacctgtttggcatcgggataatcagacgctggcccgtgacatgggttgccaggctgggcagctgccattcacctttggcgaaggtagtgagccccgagcagcagggacactgcacgtgcctctgctcttaaagctctcctggttcagagtagccttctctgtgctgcccaacctggcccgaaagtcctggcctcaaatgatcctcctgccttaggctcagctcaaatacctgaagcgagaggtttgtcctggttgaaaagtcacttccacaggctggggatgtggcttaactg

SEQ ID NO: 25820 - DNA, 1103 bp, Mus musculus
agagcggcagtactcagccatcttggcctgctgctttgccctgtggggacaaggtcagaggtcaaaggtccgcaggggtcagaggcctataaagtgggtgagtatcttggattagagctgatgacagtatgagaggactgtgttggggtccatcagactgcctctatcagaggtctctctagagattcccagggcagggccactcacgagtcgacatggttctcaaaggagaggatgacagggtagggcgaggtcttgaaggctgcctcagcgatggcctctagcacatcacgcaatggcacctcagtggtcatggtgaaaccatgagtgatgaaaggctcttcctccggtggccgtcccttccatacatccagctccacacagcggcagccccacagcagtgcctggcggtacatctccaccgatgatggtccagccagctggcccgctgaaggtaaggctgtgtcactacctactggccaccccatcctacctggagccaacccaccctaaggacgaagagacccctgacacacccaatcaattccagggcaatactagtctctcactcctccagtcagtgtggatgcagtaccatctcccccagaagccctcaggaaaggacagacatcctgagccccagtccctggtggcatcaggtggcacagagtagcattcagcagcatctgcagacacagctggtccctcctccaaggctcccagcactgccccactcccttgaactatggaatccccagataccgtctagagctccctaggacctaactagtatccaccacagctattcctgctactcatctttcctgcaccagcctcaccacctcctgcctaggggatcacagcccctccctgcctccaacccaatctccacagaactcctaccaggtcacactgctttccctacttcaagccatacacgctttgccactcacattgaatccagaagccttccagaccggggtcggtcctgccttcccttcccagccttctctccccagccctctcctcctgtatacctgccattaggcccatacacacacacacacacacacacacacacacacacacacacacacggtgga

SEQ ID NO: 25821 - DNA, 1311 bp, Mus musculus
ttggcacagacctgatctgttttccttcccagagcagctgtctttgctgggcaaggagggctgggctggttttgagtgaggcagggagccctctccacaccctctcctggctgagacacttgtctgtgcttctccccgcctctaccccaggaggaggagatcccggagctcgagatagatgtggatgaacttttagacatggagagtgatgatacccgggctgctagggtcaaggtaagctgaggtcacctagtggagggttgtctggagacacggccccttggggaggcttggccctagggccataccttctttggtttgggtcatctgcctctggaaaaataaggctcacggaacttaacttagctatgttcctaagtggcctcagtccctggggagggtataggtgaactgagagcccctgtcctcaagaagtcactatgtgctgtgttctcccttgccaggagctgttagttgactgttacaaacccactgaggtaagctattctccttgcccttagggtgggtgtgtatgtgtgcagcttatcatcgggatcctggcctctctaacagccccctcctatctaggccttcatctctggcctgctggacaagatccggggcatgcagaagctgagcacaccccagaagaaatgagggtcctgactcagacggccgtggctcccacaggacaatcgctgccccccaacctcgtagcaacagcaataccgggggaccctgcagccaggcctggtgccatgagcagggatccccgtgcccctgcctaggggtcatttcccttgccctcagttttccacttttggggttttttattgttattaaactgacgggactttttgtgtttttatattgactctgcggcgcaggccctttaaaaataaagctaggatacagcctttggagcagctaacaggcttggctggtcttttacgggggacacactgctctacaattgtcaccagctcgtctactccccaggtgatcctgggccttcttggagcccatgtagccatggtgataactcaggctgactcccagattgctattccaagcagctggggagcagtgttgctacctacagtcttcagagtttttatccgcactgggtaaggtctctaggctgttgaggctaaacctcaacgctctgcaattatcagggaagatatgatatgagattgaagctggttttattttcccttcccccatgctgggggttcaacttggggaccaacccattcacgttacaccagtgccctgccctaacactgatgctaaggtactaatctaagt

SEQ ID NO: 25822 - DNA, 1195 bp, Mus musculus
ccagcccccttcgccacaatttttaaaagaagttacttatttcatatgcaggtaaaaaccactggcattttacctgtatgtacatctgtgtgagggggccagatcccttggaactaggttataggcagttgtgagctgccatgtgggtgctgggaactgaatctgagtcatctgggagagcagccagtgctcttaaccactgagccatctctccagcccatgtaacaaaaatttaaaaataaaaattagtaatctaaaagaagagcttggggtgaagctccagccagcactgacaccccttttccactccccaggtgccggaagccgcgaaagtgacaagctgctttccagactccacgggcccggctgcttttatggccctgcttcacagggagaagagtggagcacaggcgaacctcctcagtctgggaggtcactgccccaggacctggaccttttagagagctctctcgccatcttttatctcccagagctgccatctaacaattgtcaaggaacctcatgtctcacctcaggggccagggtactctctcacttaaccaccctggtcaagtgagcatcttctggctggctgtctcccctcactatgaaaaccccaaacttctaccaataacgggatttgggttctgttatgataactgtgacacacacacacactcacactctgataaaagagatggaagacactatggctgcttctgtcattgtttgctactctccaggctggccagcttgggcaggaaagcgcaacacagcatcatttcagttttgcttcctatcttactgtgccagtgtgcccaaccccgacagcagttcccaggtaaagccacaaccacagattgttacaaaaagtccttgcctcctgctcaccacaaggattctgactaccctggccagaaattaaggagacctagaccataagaactgcttcccagattcacatggcaagaatagataattgccaccaaacggaaccctcttggctctcaactagtgtgaggtttttttttttgtttttgtttttaatatatataataatatatatatataataggaggtatcacccactttctctgttgagtatacacttgcaatattgttccttgtggctgcccctttcatgcctcaatcctgccttcatatgactggaaagccttttttttttctttctttt

SEQ ID NO: 25823 - DNA, 1386 bp, Mus musculus
ccaggctctgagcgagtaagttgagtggggaagtgagagggaattctatcattctttcaatgtatgatttgaggttatgtgcctgagcattttacctacatgtatgtatgaagagggtgtcagaccctctagaactggatatacagagggttgagagccactgtggatgcagtaagtgctccgagttctctctccatcaataaccactgggccatctctagccctgaatcctatcaatcttaacagaaaatactggtggtacagagagcctgtgagcttgctttttctgttagtctaatagcctaagcttctgttgggaaggccaactatgctaggctttcagctgtgcagacaaacagtagcataggcaggttctttctgtcctgtctggtgaaaaggacttttgcatgtgcagggtctttgagaatgctctgcagccgaggaacttgggtggaaggagacttgttcagttaactgtatcttcttctcctagacacttaaagaatcctgtaatagcgcagaagatccagaagctgatggatgtgggtctcatcgcaattcggtgataacttgcttttccccctcttcccttcgccaatgaggaaggcgagctgggaaggtggcgagcagcactgggcagagggggggagaagaaaggcttatctttatatttatacatgcctacaaggaagacagactcatccagcgccacctcgggccctcccagcacacgcatggtctcttcactgctgccctcaatccgagtgtccttccctgcccagtcctagcctccccgtcactgtctcggctgctcccccatagttggttattttttatttggggcagtgggtgcatacggggaggggagggtgttcttcccaacctagggtcccagctgtcttcacctgttcttacccacgtccctcctcaataaagaagccagtcaggcgtggttatatgttgctacggtctccagtgactttcttctcttaagacacagtagtgctgaattggaagccaacacaaagccttttcttgatggccttgaaagaaaggtcgctgaagagtgagctgtttgctttgtcagggtggccactaggtggaagtgtcgctcaacaactgatgacctacctgcattctgatcagctttgggttgatgttctgtgcagtgcagtcttagagtgaacctgctaggtcaacactagaacctaacctagactcaaggtgggtcagaaagcaggcctgagactaatactgacaacagctcctgctgctccaatcctgagctccacaccactatcttcctcccacactgtgaccaacactgaacttcctcatttgctcccaaaagactgcttcctgggctagcaagatgctgagtccagc

SEQ ID NO: 25824 - DNA, 1648 bp, Mus musculus
gctggcctcaaactcagaaatccgcctgcctctgcctcccgagtgctgggattaaaggcgtgtgccaccactgcccagtttagcttataccttcaatcccaacacttggaaagtagagataggtggaatttgaagccaccttagctacatgagaccctgtcttaggataaaaaggagggctggtgagacaaatcctttgggaacaacactggtagctcttccagaggatctgggtataattttttcagcatccacgtggtgtctttaactccagtctcaggcaccccagtgccatcttctggctttgtagacaccatgcatacatatggtacacatacaggagaacacccttgtgcattaaatgaataaaaacaaaaccctaataggctctttgaattgatctgaatttacttctgtgtgacctctattgactgtaattttggggctgttcagggttattcaagaaaagcagcagcccttgaattcctaaaccggtttgaggaagccaaacgaacctatgaagaaggtttaaaacatgaagccaataatctccagcttaaggagggcttgcagaacatggaggccaggttggcaggtgggtattcattcagcattcccttttttatttagtaggattaatttttttttttttttttttttttttgggttttttggtttttcgagacagggtttctctgtatagccctggctgtcctggagctcactttgtagaccaggctggcctcgaactcagaaattcgcctgcctctgcctcccgagtgctgggattaaaggcgtgcgccaccacgcccggctggattaatttttaaaacagtgctgtcctccccaaagtgaaggtatgtggtaggtgggctatgtttgtcatgaagactcaagttaatatttcatactactgtactgtctttcatttggacagagaggaaattcatgaatccattcaacttgcctaatctataccaaaagttggaaaacgaccccaggacaaggtcgctgctcagtgaccccacctacagggagctcatagaacagctgcagaacaagccgtcagacctgggcacgtgagtacaggccgcaggacagaagctctctgatgtgggccactgaggaggataggttttgtaattgcatttgtaaaaaagaaaagttggtcagcttgtaatagcaagacattcaggagtgttacttccaatcttgcccatgctaggcaaatgccatctctgagcttgtactcctgttagtaggtaaggatcatccaggtataggaatctgttaatgagtgccaaggtaaggagcagttgtagcagccagcattagtagtacacatctctaagtccagctacttcgatgattttcttgctttttgttcttatgttttttgagagtttttctgaattaccctggctattctggaactcactatgtatatcagtccagcctcacagccccatcaacctccgcctgaaataaagggatgcaccatcatagctggcttgattaccttttttaaagtttttgtttttgttttcccctatcttacatccggagttagtgtttgaactacctgatatgggtgctaagatctgaactctggcccttatgagagagccacaggattcttttttctttc

SEQ ID NO: 25825 - DNA, 1152 bp, Mus musculus
cacacgcaccagtcacatcacacatgccattaaaacagaactgaaatcagtcctgggcttcacaatgctagatggccagtagaaagacaagggtgaatgtgaggagtagcaggggagggcactggacctcccctctacacacactccctgactcctataccaagggacagagatgcctacaactcagccagagatccttccctttagcttcccacttctcagcataggaataagatccaagtctccccgtcccctcacaggccccctcggaggcccagggggacacagacagacagacagacacacacacacacacacacacacacacagtggaagccctggtggaacttcaagccccaaccactcccagcccaccctgtgcaccacaggctatcatatgcccacaggccaatgctacccttggcttcaaaaataaaaatttaaaaattcccaccccgagataattgctctctcctctcgcctattgtggtggctctgcggtcggcaatgagaagcaattattcacggctaatgattataatcaagtcaaatagaatttaatggacacgcattctcttcctgcttgaaactttacatatgaattaagcacatatgggtttcacgaggctcggacgcagatttatgcagccctgaaaagccccacattgcctgcgacttttatttcactaataaaggctgatttatgggctcctcggaaacgcgatctctgctgcctcctggtgggcgactctgacagggtgaagccagggcccaaaagatcgcagggggttggggagagaacccaggccactgaggactcctctgactaagaccaatacccgcatcaaacactagggacgcaggctctgcgtggaaaaaccaatgtccaacatctgcttcagctactgcttgccattcacttgcctaacaccaagaggtgttaggtccactaaggcaagcgagaggagggatggctggccatctacaggaagcagcgagtccttggcactcggcatgatgctaatggtgtcacagtgcaggtgtcgaacccttggctcccgtgcaggcggtaagtgagtgtcattcccacctcgtgtccccaacaatccgacagatcactctccctcatccccatcgtgcagagacagaagc

SEQ ID NO: 25826 - DNA, 1206 bp, Mus musculus
aggatgtccctggacctgttccctccagcccagctgcctcacacccaggagtaactatagtctcaacactgcctgccagccagtccgtccatcacagccagctgatggtgcctggggctctcttggaatgctcaccagtttttaggcatttaccgattcttttgaagtgtcccaatcatttatgtgaaatatccacattggcttcttttaaaacaactggcaaaatggctccctttctctcctcccgcctttctttttttccctttttctccaccccactcccacccctgatgttttgagtctggcactggacttctgatgccccatgctacctcctttaattttttttttttttttttttgagacagggtctcacataacccaggttggcttcgaaccctttatgtagctaagaataccataaatttctgatcctcctgtctctacctcttttagattttaatgtatttcccccctgattctgggaatttcattgtccctggggctactcctatcatgaggggcttgcagagtgtgccacacgaggaaagggcaccaactctctccatgtctctcttgacccgtgtgcagacagctttctagcctggggctgctcctgctcctggaagccactctgggctctctgaaaccactgtcagaattccttgctgctgagaggtccagcttgtgccaggagggaattgtgggtatgtggtgggcactgtgcctagcaggcgggtggatcagccccggcttcacacagccccactcccaaaacagagtcaccatcaagtcaacttagcagtagtttggtttccctacccacacacctgggaaccgaggaccagcaggggacctggaaccccttaccaccttctcttcccacctgccatctgtctattcatgggaaaggcctgagggctggcagtgagggtccttctgtcctgcacctggctggtggtctggccaggagagggtctcgcctgggaaactcctcccagaagcctctggccctgctttgcttcgggattggtgtatctctagcagatgggaaatgaagattcagtgagatctggcagcaccacagcctgaatgggtgactcagtttcccttctccaagatttgcatcaagtaggtgaggggggttggcagaaaactagagagacccaggagggcggggtataagaaacaagatccaaggcaaca

SEQ ID NO: 25827 - DNA, 1109 bp, Mus musculus
cttaaacagcctgagtggatctcccaggggtttccacaggactctgagagagacacagttgctaaaggcccacatgccgctagttgcatggaggaatctgaccccttaacctgccactatctctacagagagcctctgcccttacagacccctgagccaaagagcagagccattaaagacctgtagcaagtgcacatgcatttacacagcagtccctgttctccaactaaggtccagggagtagttatagcaggccagctataacaggacagaaacactgaggcacacagagggaggactagcaaggtagagtctgatggatggacccccatcagactagctgcatggactaagccaagtcaggctggccatcatctctgcctgtgggcttctgagcctggcctgtctggcttccactcttcaggggaggttttgcctataatctttctgagaaccaaggtgggatgtgtatacctagtttctccactcccccccccccccgacatcccccctccatacactcaaaaagcaagactgtctcacttcccacttcccacctggcctgtagcccagtcgacctcagctctccctaccctcagacctcccagggaccctcatatccaaccacccccccacccccaggcagcatctcttcccaggcactggccctggcagcctgggccatttccattttaaaccttcggaggaagccctgagcaatcgcccacggcaggcaccagctgacaggtgatgtttgtgcctctcctcctggggctggcaggaagacacgcagttggctttcaactccagaaacctgagcctggagcccctgtgtgcagccgccttcccccgtgcttgcagggaggggagccccaacccacatccctctgccaagagagtcagaggtcttaggtcctcctttgcctacacccactctcccacccagacagcctcccccccccaactcctaagctacctagggttgaaaaagggtggggctggtctccatcccccaaaggatgcaagaacggaggtgaagcaaggctggaccttgtcacccctcacctctgttcccttgccttggctttatttattcacatcagacctct

SEQ ID NO: 25828 - DNA, 1099 bp, Mus musculus
tgtccctgggtggggcagttcatggaccttatcgagcaggtggagaagcagacctcagtagctgacctgctggcctccttcaatgaccagagcacctcagactaccttgtggtctacctgcgactgctcacctcaggctacctacagcgggagagcaagttcttcgagcacttcatcgagggtggccggactgttaaggagttctgccagcaggtgccacctcctctctcactctgctttggggccctccttttctcttttgtgtcagggtggggcatgccagggtgagctgtgggacctgggggagggatcctgggacaggcctgacctgcccctgtgccacaggaggtggaacccatgtgcaaggagagcgaccacatccacatcatagccctggcccaggccctcagtgtgtccatccaagtggagtacatggaccgcggcgagggcggcaccaccaacccacacgtcttccccgagggctccgagcccaaggtctaccttctctaccgacctggacactacgatatcctctacaaataggaccggctggcctgttgtgccccgcctgcctcccctgccaggcgctagacatgtacagagggttttctttctttctcttctttttcttttttttttttttttttttttgtgtgtggttgtaaatggtcatatttcactcctcccttctcctgtcatagaaccttccatgttttattaaaggggatgctggtggtgagcccgagtgtgcgcttccctgctctgccgcccttccctacctgcccgctggctgccttgtgtctggctgtccctttcccgaggatgggtccccagctttccaaccatctaccccaagcattcctgccaagagaagttggaagggaccaggcctctgtgggccccttctggttccttggagttctgctcccataggcctgccctttcttccttagcctcccaagggtttctgtgggaacttgaccagaggtctcaagccacccatacaaagcacttacagacttgctgttctggccagggccccagatacaactctctgccaaccttcaagggcctgcatgattgaggagtactggggtga

SEQ ID NO: 25829 - DNA, 1307 bp, Mus musculus
gtttagtaaaaaaaaacctgtctccaaaaaaaaaagaaagaaagaaagaaagaaagaaaagatggagagctgttagatgagatgccagacatcaagctctggccttcacccacatggaaaacagcacacatacacaccagtgagcatagtggcacttgagtgtatttccaggaccagggcatcaggaacaggagaatctcaagtttaagcccaggtctgggtggggtgcatagtaagactcctgcctgcaccctttccccccacagataaatacatctttttaaaaaccaaagacctttatttcaaggctggaaatggacttgacccagtgtcccctccatccttagagtctctctgtgtctgtatctccccctctcctgtgctggggattgaacctcaggcccaagttgctttctttagtgtgggtctgctggattttctgccttggtctttgccactgagggacttcccatgcctaaggactacctgaactgggagtgcctacagaattcttgccctgagggatccttctttcttgtactctgtgtaggatatcaccattgggctcacttcctgcttcgtgtgttgtcttctgcctgcgggctgggtcctgtcacacctggagagctacaagaagcgggagtgaagggagcagtcttccctcatcctttgactagaccacttttgccagcccaccttgatcatgttgcctgcattcctggctggccttccccgggatcatgttattcaattccagtcacctcttctgcaatcatgacctctcgatgtctccatggtgacaactgggaccacatgtattggctctgcttggtggggtccccctttgtaacaataaagtctatttaaaccttgctccagaaatgcatcatgtccttctgcaccaggcttctgcctccacacagaaacgaggatgctggtggcctggggtccacggaggaacatctggccggtccaggccccagtgctaaggtttgttgggtgtctgggaaacaccagttgttattgagcagtctaccttgatgcttatcccttccagttcccttgcctgtgccaagttattggctccctgtaagtgcatgtgtgccatgccttgtagctggaatcctttaccgagcatctttcctggcttggatgtccgtccacgtgcagtatcttgcaagtagaggtgtggtagtaaccatggcattttacgctgggcactgctaccacttcatgtcaaattcaaggcctcttactttgagcacttgtgaatgcttaccgtctgagtggtcttccttatacttcct

SEQ ID NO: 25830 - DNA, 2171 bp, Mus musculus
gaccgggttgcacaccatgccccatatggacaaatggaatgttgttaatacccacgtttgtaaaaggcctggagtctgctggtccccagaaagaactggatgcaaatctgggcatacaacagaccttggacatcttttctctggggacaaagtgctctttcagagaccatgtagcccttgatgtcaaggtgcaaaggtttgcactgtaatcttatagatccacaggtggtgtctcgggaccagccaacttcaggagggagtctgcctccaccactgtcagtaagacaggatcaggaagagctgtctcttacgtgtttgtcatagggatgtggcatctctgggcctttggactttgctgcattttcatgatcttgacttgacctttttattcaagaaggaagtcaaagtcctgcctgttctcacacctctcttctcagcccagatacctctgttcttagtctcaaggggaacaacatcagggagcctctcgtcttccccagaagaacccttccttcctggtatagctgaatccatttcttcctattcttggtgctgatagctctctgaaggtggggtacttccctgccaccctccctgactgaggggccccagccagcagcaggcccctttgcctgttctcccgagccccacccctcaccgcctcaatgaggcactcgtgccactgtcttggcacccctgggatgcctttcagtggcgtaccactgctttcctgtcatgggtgtcaccctacagtgacaggctagagccagaaggccttcctcctcaggggatacaggcttagaacttgaactcgccctgacctctggatcctgttcttcaaggaagcaaaaccaaatccttacctagaaaaacagacttgccacttccccattgctgcccctgagttccgccttgggaggcgtggcagagagcttgcctttgtgcagttgctttcagagactctgctaccgagctgagtctgttcaccttacccagcctgactcagctgtctgttctggcaagtctccccaaaggagtcacctctcgcccagatccttggcttgtgcagtagcctggactcagagagtcctttcttgcttggtctgtccgctgttgaacactctgtgctgttgttagcccttggccttgcctgggagaaggccttgcagctttacactggaataggtctgcttttgtctggcttgctagcttctgggctatacctctggtgagagttggagctgcccagaagggattggcatgctccttccgagaatcatgagacaggagcatgcttgcaggagttattccctaatctctgtctgtcttagatcatgaatctctgatacctcctacttaggggtccagaaggaacccccagtgtaagccccatgtaaggtgaatagagtgtctcgtctccagttactggacacccagcaccaggactcatggtgctcagtgcctgccctgctccccaccctctgcaggccccatcccaaagggcccttcaggatctctcactggaccagcgggatggtggccaagaccagcagattactcctgtgggtgttaagcccagtggttcatcaggcatcgtctaccgccctcttgttttgagaaacagcaggtctaatctactgtaccaggctcttttgctttttgttccaggagtgttaaaatggttttaaaagttttcgttttgttttagtgaacctattccatttcaggttatttttgttgctgttaaatgtttatggttctttttaaccttttctggagggttggggggttatttttgtttttaagaggaaagttggaaggtaattttgttttatattttttttcctagcagttcattatcactggaatcaaagggaaaaaaaccatctctctttgtatccattttatttgtatgtcattaataaacagatactttgtgcagatgctgggatggcatccagatactgggtgccatgggcagtgggtgtcaggcttgggctttgggaggcgcaaggctgttctggccccacacccttcctgcaaaggaagcctcatggagcccaagtgcatgtgtttgtgccatttcccagaagttgttgggtgaggtaagggatgtcagaataccgtctgcttggcatcctggagcaggcctagagccaggcactgtgact

SEQ ID NO: 25831 - DNA, 2133 bp, Mus musculus
cctgtgttgtggatcttggggatccacaaacaggcttagtggcagaagcctttatctgctgagactatttttcttttgtctcgtgtattagtgtttctctatatctttgtaagtgccccacatacatactcgctgctcatggaggccagaagagggcaccagataccctaggttttagatggttgttagtctgctggagctgtcagtgctcctacctgctggaccatctctccatcccctccctcccttttcatatttttagtttagtttaatggttatttatattccttgctttccaggctaataccaagttcaactcccgctggaccactgatgagcaacttctagctgttcaaggtgggtcaggccatggcgagtcccaagaaccctagagacctttaacctttccaggagctgaaggtggaggggaagcaaacagttctgaggtatatttacagtctgatgccttttttttgacctttacagctattcgtagatacggcaaagactttggggctattgcagaggtgattgggaacaagactctgacccaagtgaagaccttctttgtgagctatcgtcgccgcttcaacctggaagaggtgctgcaggaatgggaggctgagcaggatggggcccccgcagctccggtccccacggaagaggccaggcgaggggctcctgtaccagccacagccctagaagaagatgatgaggtgagaagcagggatgagtctccagggaggaggtgagtctctaaggatgagtgtgtgcaggagcagtctcctcacctttttctctcccctcaggtccagattacatctgtctcaacatcagtaccccgatcagtaccccctgcaccgcccccacctccaccgcccacctcgctttcccagccacccccgctgctgaggccacctctgcccacagctcccacattgctccgccagccgcctcccctgcagcagggccgcttcctgcagcctcggctggcccccaaccagcctccaccaccgctcatccgccctgccctggctgcctctcgccacagtgcccgccctggtcctcagcctccacctaccctggttggagctcctttggagccccctgcaccctcactttgagcctgaatcctccattgcccagaggctcctgaacccctttggctggatctctctggcagcactaaggacagaagggactagggctcttgccaggtctttcaaatacccaaagctgccagttggcacagcttggacctgtgggttctgcatgtgttcctggcagctgagcttgtaaacccccagccaggggctagatctcagggcctgcagggactcttgcttcctggctgtgactggaatggctgcctccttgcctgcctgcctgcagagggcttggcctctgggcctaccctttgtgtgggggtaatgactttagcctgggggatgggggagaggacaggatgttagctggcctcattcacctttccttctttttagcaataagtcaggtgcagtggaaggggattggggtggggatggcagaaatctggtgggaagaatgttgggtagctgtgaggagacccactttgtccacccccaaaagtttggagaaagaagggttggggacttacacagacatgggtttatttttcaacatttttaaaaaataaatgcaaccttgaatgtatgagtcttccatgtgtgctgtgggtggaggcaactgaccacccagcattggcctccaccgggacctagacagtaaccaattctcttctgccaggcaggcaaggccacatcttgcccaggggtggggactgggtccccgcccagcagggagaaggaacagtaggcagcagctcagattccaaacattctctttattacgtatttgatccagaggagaaactaagtgcagggtggggggaagggggctaggcagggaggggccaccttgcctgggtgtcctggccccggaccccttatcttgggagccaagccatgccctcctggcccccttggagcacccgggctgttccatagggcaagaggggagaggaggagcccttggtctgagccatagccagtggagcacgggctggagggttgaggttggcaaggttcctggaac

SEQ ID NO: 25832 - DNA, 1321 bp, Mus musculus
gaaaaagaaaaaaaaaaaaatcccagcggccacctttcctccctgccccattgggacagtcaagactggatctgtggggctcctgggagggtggctcagggctggaacactctcaggcaagagtggtggagttccctggcaggccctccgccaggccctctttgggcttctcccctctccccacttcttccccccttcaagcgacccaccagaggtggccttcccctgcccccaagcccttgggcttacaggcctttacactgaggcccagttgggggtactgcacagccctggagagggtgggcggtgggaccctggctccctccacaccatatcctctgtccttccccagagctgggcacttccttccatgagctgctgtggggacatggttccccttctcagaagtctgtgccatcttcaggcaggctaaacccagtactggtagaggggaggggaatgggccatgggctctcagcccccagggggcagcttgggaacagggacacagcttctccgttctgggagtctttgtctgaaagcacagcccctcaccatccccctactgcttccccttccttggcattaatctgggcaccgttctcatctcacagccttgccttttcttcctggcattgccgcccctcctctcaggagactgtccagggcctccatggctgcctggcggaaggctggattgggcggcagggccaggagtctcttgtcctccacagggtggggcaaagtaactcctgcttgctaacctctgaggccagtgtgtgaatgggtggctgtaggcgcttggctggtggtggccactgcatcccttaatttatttctctgctgtttcagttcttgagaaattggggaagtcctacagaggctgcccctgccctcacctgagttgtacattttttttgtgatgggttattttttatttttattattattgttgttttggttttttttttgtttgtttttgatttatgacaattccactcttggccccagttgtcgtcctgtcactccctcccctgtccatcaccctggctcccagaccaggctcagcaacacattgagtcttgggttccaggaaccttgccaacctcaaccctccagcccgtgctccactggctatggctcagaccaagggctcctcctctcccctcttgccctatggaacagcccgggtgctccaagggggccaggagggcatggcttggctcccaagataaggggtccggggccaggacacccaggcaaggtggcccctccctgcctagcccccttccccccaccctgcacttagtttctcctctgg

SEQ ID NO: 25833 - DNA, 1175 bp, Mus musculus
gcctcccttctcccccctgcatgtgcacctgcttcttagagagtcagaaagggtttgcctgggtatttattcaattggaacttttcccccctgagacagggtctcactacatagacctggctacctagaactagaccaggccggccttaaactcggggatccacttgcctttacttcttaagttctgggatttaagattacaggtgagcactaccaccacacctgaacaacttgggactttttagaagctttctgtcactcatatgcttagccttccatctcaccccaaataaaccaaactaacatttcatgtacagagctgggggcagagttaaacagtgcctcacagtcactgaagggctgagtagtgtttggtgtaggtagctggtttggcatttggttagagatttcttttttatatttgagcaaatggtttcttggcaggagccttctgtactgtgctctcagtgcttgccccatgtccaaggtttgcccctctgctcctctcccctcctcttccccgcaggttgttttaatccttttgcttataaacaagtgcagtagaacgtgtctgcccagctcacatgaccttggctatctctttgtggggaaaccagcatcagcattagatgccacagtcatgtgacctcgtgaagccgtccaggtaaaagaggggagattccaggagggaacgtggatctgccaaggaatgtccgtgggattccttggtaaggtcaggtgggaagtgtcagtgtccacattgcatggcttcgcctgggaggagtttccttctgctctgctcttcttacctcagcattccttcttttagcatttcttatattctgttctcacatcttgtctatagggatccaggcatgacatgcagctgttttagggaactgtctgcgacagatgttggtagctcacaggagagcaatactaatacctctgaatcttatcttcctaaatagatatcctgttagtggtgggcaggcggtgataggagcctgtccctttggaaggggcagtcaggaactgaaagtgtagctgagctgagcattcactatcacacatgcacatacacacaagttctcctcttcaaggctgaagggcagcctgagcttttggtaagtattggagtatacccatgcagcagtgtgtgtgtgcacttgtgt

SEQ ID NO: 25834 - DNA, 1192 bp, Mus musculus
gtgtgtcgggcgcggagcagtgcggctgagggcaggggaggagcgaggcaggcggccggctgcggcggttgagagtaggcggagcggcgcggccgggccgaaaggcggcacaacccagccgggggtcgggggggggggtgcggtccggagccgctcggagccggcgaggcctagcccgagcggtgcatcaccgggctggcgtgagccatcgcccggcctccccgcacccccggccggggcccatgcagcgggtgctcctgctgtgagaagccccgcccggccgggctcctagccttcccttccctatcttcctccaagcttctccattccctcccctgagataccggcgccatgtccagcgctcggacccccctacccacgctgaacgaaagggacacggagcaggtaaggagccctcagggctcccctaattctgtgactgggcccctgcaccttacggaggctccctccctcagttctcctcgtgctcctgctttcttctacaagcctaggctgtcatctggccctgggttccagcccttcacatccctcttccgaatcctgacctgggacccacgtcgtcctgactgaactgcacacttgtatttctgccaaacgcccctcgcctctcaccgccctcctgcgctcttccgtgctatctccccagcttccccctctcttcccttttctctcaggggcctttctggtcttcctccacccacgcttaaagcagccaccttcctgctcctcgaataataccccgcgatttgccgcggattgttgcccacctctttctgcatctctctagctttgtaccctctctacccgcaccggctctcacaatcctcggttttctccctcaagagtccgtgtctcgggagtgtgttctcggtccctttcccctttcacttccccagctttttctatcctcctttcccgttccaaattgggctctccctgttgcttgcaacccaccagctccaccctcgtcacctttccaaatcgttcgcctactccttgctcatcactttcccttcttttcggcaggagctcccaggctcctggcactggcatgtgtcgcttccgtgtttcccatacagctgtcatgcgcatagttttcccacaggttgcctttggggttccagtcaccgctcccttcagagtctttggatcactcctgttctcttccccc

SEQ ID NO: 25835 - DNA, 1549 bp, Mus musculus
gtttttgtgtttctaccttggcccagctgtagctttgacattctcagtaccttcaccatgttgctaagatatttgactgtgtgagacctatcaactcaaaggatgtggagcctggatgaaggccgcagaacaaagctgggcactaactcagggtgactgtgtgctatatatgctctaccttctcgctcctgtgctgtgcagccaaagccatggttagacttccttgggctttccctaagctatcacttctctgtgcagtcttgaagttagacgttggagagtgacatcatgggccctgtgaacccatatgctgaatgcccagggcagaagctgcatttagtgcttgctctgtgcctaaggctataggccagaccttcctggttgattgaggtgagccttgtgctttctctggacttctcccagcacaagacactgggctgtggaaaagagaaaagccctgttagtctggtatggtttgcagtttcaaggcccattggaaggtctgactgtgctctctgctcccatcccttcccagcctcccctccggggctccgtgggacactggatctccaggttatccgtgttcggatggaggaaccaccagccgtcagcctcttacaggactggtccaagcacccccagggcaccaagggggtgggaacaggtgacaagccagactggcccacagttctgtcagaatccagtgccactgttaagggacaaccaaaggcagggagtggagtataagttttcagttttctagagagggaggggcgggaagaaggaaaggtgggcgggaggaggtagttatcccccattggcttaaatctcagatctgcctagcttggccacctgatggagattttttaaaaccaggtgccaggacaatgtggagggaggaggggtggcatcactgtcacatcgggctactggaaaatgcctgctcttggccaagccggaggtaggcagaggcggcttaggttgttgggtggtaggtaaggcattgggcctgtggagaacaccttccctaatccttcgctgacctaccctctggccccatatctcctcctccctctcagctccccaccattctcccctggcacagtgccttatgcagaggtggtcatgatggggttggaactgagtcccactacctcgggggacacctttcctcccccacttctggctcctacagcaggaggcctccattacctcttaccgccttgtccctgccgagggctcccgttacaacccctttacctgttgtcctgttgcatctattgtcctgttgtatatattgcctttgttgacaataaattattttttttttattaaaagttctgtgtgggctatcattgggaaaggggcatattcttagagcagattgaggggcaggaaaccgaaaagtggtcctgagtgggagccagagacccctgccagggcagagcagcagtgagcccagaacagaggttgcttggacctcagggtctgttttaacttaatgtcagtcgcctgagagacccattttctttacttgacctactgaccc

SEQ ID NO: 25836 - DNA, 1197 bp, Mus musculus
cctgagcccctctgagaagagcaacatcttagaagcctggagtgaaggggttgcccttctgcaagacatccaagctgaccagccatccctgcccagcctaggtagtaagggtgagggctgagggagaagtggggcctgtgggggccctcgagctcagtgggcttttgccccctcagagtcaggccaggatggccagccagaccccatctccaacccggatcctgtcaggatgccagcagagatagtggtcctcttggattccgaggacaacccatcccttcctaagaggctccggcccagaggactccgcccccttgagctgcccggtcagtcaacagggaagctttggtttagtgggacatcctgtgctaaggggctggggtgggcaggtgttatcaggaacctgaggttaaagagtaaacctcgggtaaagagtgagtggcctgaaagtactaaagttgttttcttttgcagttacccctgtcatagagcaagggaataaaaagccccgtggtcagagatggaaagagtcccctgagaatgaacctgctagaaagaagagaagcaggcatatgaccaaaatcttggaccctgacccaggtgaggggacttagggctgctgagcctggctgtaacactggagcatgaagtccatgaggaagtggacaccagagaacttctgcatgagctcggctgaagcttagggcttgagcctttgggatctgtcctcttctactcatacacacttctgtgtggccttcttccagaccccccgtctcctgagtcacccacagagacattcgcagcaccagctgaagtccgacacttcactgatggcagcttccctcctggcttcgtcctccagctcttctcccacactcagctcaggaccactgactgtaaggactcttctaaggacagcagagcagcagagggcctgccccagccacaaaacccctcttcaggtgagccctgctaggaggggccggtgaggaaagctgagtccctggatcacagccagagcccagatagaggtgctgggtgtttaggccttcaagagaaggccaaggacaggggtttgaatgctgaggaagctggcctctaagtggggcatctctggcagtggtcattaagttttgctaggccttccaacgcttggtgctcagctcagaccatgaggctggagctctggaagag

SEQ ID NO: 25837 - DNA, 1197 bp, Mus musculus
agagataagctgtgaggtggtggaggaagaactgagatgggagtgtggtgaggggattgggatatactaggtatctccatgttcccctggcctttttgcctccaggtccagtgtctgctcttcacaaagagaagtcgctgcaggcactgtgccctccctttaaagtcagggtgcggtggtcagggcgtggggcctgggttctggggccagtgcagcccttgtggtgagaaaacaagaaaagaaatcccttctcaccctccagagccggagctcaaggttcaagtgcctcaggcccagttccctagatcgagatggattttataccacggattttataacattttttataattcaagattgtcagtgggaagggaccctggagctcacaaactgattcctttcaaatctcaactcccaactcccagttcagtgagctttgcactatattgccctgcttccaatctggcaagttactaagatttctttacctattaggcctgttaaagtgggtattgggcactgcaggcccacagcacttgtgtactgcacttacgggaatgaggatgcaggcggctttcagcagtgcaggcttgccagtcagaactccaggtggggcccactttccctgccgctgaggtttccccagcagaattaggctgcttatctgtgcttgttttgaggccatcaggtattctggaacagctgctggctcagtgaaattccagttttgaccggccagggttttggagacagtattaaatcttaagaacagagactatggatagtgccaggctgtgcacttacccttttgctttccacctgcatgttttacgctgagggtgattattctcgcccacctctacataaattggagccacagattgtcgtgattgccagagctcactgcagaagttcaggttagctggggcagatttcagcagtcttcagggtagcatcattttagacgcttgctagagacacattcttgggccctcctgataggcctttcccatacagttgcaactcccaaggtggttgtcaagtacctctgcagtgattctgccataatgacctatggcctcaaggggctgctgggtctcctccctctattctgacatgaacaggtgaagttccttcattgttttgttaatgatatgcttgctattatgacccatatgtaaatgttactctggatac

SEQ ID NO: 25838 - DNA, 2631 bp, Mus musculus
caaagggaaagacatgggcgctcacatcatcatcccaagaccttaatactctgattcttcctggatcccagtgaagggcccagggatcactgtagtgagacagaatcaggccctgcagtaagggcagtgtggtgggacccctcaggcttgttccagacagttgagccttacctgacttcagccatccctgagaaacagacctagaacaaacctatattaaaaacaaatattttcagttttctttttctttcctcaataggatccaagcaaagcttcctggaatcgccaaaaaaaaggcagaataagcacgtgaagcaagaagtgcatcagttactaaaacaccatttaatagttataacatcatcacttgtactatgaaggaacttgctcagtgtcagctagagtttggttccaagttgtttgttcattttaatttggtgttctctcccctcctctccctttaccctcagtaccaagcacaagatgtgttagactgaaaaaagaactgatctcttagaaccgtaaagaataaagattgaatcagattactagaattaatcagaccatagtggggtggagctttacatgtaccataaaaggagaaaaagagaagtgtctctagggtcctctctccagttccaaggactcgtatacagctcccatttataattttgcccttatttttaagttaggaaataatgattaacttatgaataaatagtatggggcaagagtgggatttcttccgttgggtttgtatggccctccagtcccaccttcctgccttacacataagcagctactcttactgctcctcttcttccttaatgaaagaactctcagctctgaataacttacagaactcccagaatgccacctgagaaatgggggttggggggacagtgggtggagcagtcagcaggagggcagccaccaccctctctgcggctgctcctagggaaggaagggctctggggctgggagggccgtgtacagcccttggtctgggatccatgtgttggttgagaaatcattccagagtgtgctttcccctctccctgcccaccttacctcacgtttaataaatatggttgtacttttcttattatgaaataaatgtctgtaactgctgtacactgctataaacttgttaaagaaaaataatctgcatgtgggctcccagccattgagttattgtaatcctatctcagtctgtggaggaggaggtacaagaacatgaaaagccttccttctatttcttccctgctgcttcctcctgtgctttgcagtgctttagcctgaggaccaaagccccactgactgcaagtcatgtatctgttggcgtccagaggcctggctgactgaagaggtccatttctagaagcaggacatgcagctgcttggagtcagtgcagttctaaaaggatctccattttcagacatattgatgaaatagttcataccatgatccacagtgctcatttggatcgtgttttccagaacttttaggttgtgggtggccaagcaagaccaggtggtactgatagatacaacagaacttacagtggcatcagtggaggggtccaggatcttaatttctcagaccttgcatctctccttcagcatggaaatccagtcagcttgaaaactggcatccaagagtccttcatttctcaaaccctgcctgccctattgtgaggaagtaggagctggggatttcaaggtatttgatggtcacaaagttctgtgactgtaaaagtaggaattagtcgtctttccagtccttttgggaaacgactcacagactgcgataggtagaatgccttactccatcttctcaagttcctttgcccctgtacattttgaatctttcatttccactgtagacaacactcccatcaccatgctctgccctcccaggaagtgaacgcacccatggtctatggggtctcctaacaagggacctcgttctgcactggaagcctccacagtttgctcttttctttgttgctgctgctgtgttaaaataattggaaaggtttctgtgttacatgagagggttttttcggttttgtttttttaaacaaagactcgtagagatgaaaaaattactaatgaaattgtgtacgtgtctgtgcgtgcaacataaaaacagtagtaccaagaagctcttttggtccctgtaaaactgcaaattgatgtattaattataaataaaaaacacagtgactgtctcatcagtctgcaactttattctttgtacagtttgggtgaagtaagagcaaaggctttcactcactcccaccctcattccaggaattttgagaaagaactcccaagattgcaaggattcccatggcactgagcacaagctgcactacgtttgttttccaaaatgaagttagagacccggtaaaggatgaccttagaagtgactggggtgaaaggcacctgcctggggatgggaaggaaggttccccacttgccacaggaagcagccgaaagctgaaactgaactggtttcatgcatgtctggtctgacatcagaactcctctgacttgctctgcccccaaactaagttggctgtgactcataaggctggattctagatttattcaacatacctctgg

SEQ ID NO: 25839 - DNA, 1099 bp, Mus musculus
ggttctagtactcacgtggttgctcactgcactgactagcctctcctaatcacaggttctactcataattgagaacaagtgggacattctatacaggacacataaaccaagtggcaagtcttaggcaatgccttgggatgttgcccaccagttctaacatcacatggtatacaaaattaattgaaaatcagtcagtaaacataaaaacttttttaaaaatcttacaaagccagggtggtggctaaggttagataagaggacttgggttcagcccaggctgagtaatgagactgttgcaatggaagagaagaaaaaagaaaaaagtatctacattgtatggggctagacaaagggttcttaggtcattggatgtactaatctcagaataacttaattagactttatcaaaaccaaatttttaatttttttttaaatttttgcataatgaaagacatcactaataagtcactgccttaagaaagttcatgccaaaatgtatttattggactatcagaaattggactaaacaaactaattatacttccctgttaatggctagtttttggctatcccactttgtgctcccagctggtcgcaggcgcacacctgcccaggagctatctcagttccacagatgaaagactcacacacattagctcatttttaagctgccttattatagggtctgtggctgggctcttcaaagccttccagcccttccttcaagcccttaccttttactcctagctcaatatttctaaatctgccctcaacttagttgcccagttaccttctgtgaagcccataggtcttgctgcccaagacactttcaagcttccttccctggacctcttttcttttccgcctacgttttggaagatctcccctacagctctgagtctgtctctcttcccctaaattctcctcctcctcctagcctgcgggaacctggaattcctgcctctttctttccactcagccattggccactggcatctttattgatagatcaaaacccaattgtgggcaaggacctccagcatcagtaaacacagattcccaattaaatcaaagcatcagacccactcctctacattta

SEQ ID NO: 25840 - DNA, 1151 bp, Mus musculus
tcctggggttccttggaggaaaaatagtggagaacagaggaagatacctgatgtctgcttctggccccacaaccttgcctatgggcaggtatacctagaatttgcatatttacacataccaacaccacacacacacacattcaagatcataaagccagaaaagtctgagaagctgtcgtcttctgcaagttaaaggagtgatagcaatatgtgatgatgccctgcatgtctttgaggctggtgaaacgggcactgggtctgggaatgtagctcagttggtaaaacgcttggctaggatgcacaaaaccctgtctgtgttcagtccccagcaccatataaaccagtagttgtgacacattcctagaatcccagcacttgagaggctgagtcaggaggattactagtttgaatctagtcttaacatactgatttccgaactaaaccaagtcccaggctaacctgagatacacagtgagatcctgttctaaaccttgaaagagacagaatataagctatcccttgtgttcattagtggcattgagtccttcaggttttttcttttccttctttgcttcctttcctttttgtttttcctccttctctttctaaacaaggtcacattgtgtcatcctggttggcctcaaacttcacagtgattttcctatttctgctttccaagtgccagaattacaggtgtgtaccattatcatttcctccattatctttattatttctctagtttctagcatccaatcaggagattccaagttgtcttcattctgccttgctaaagtagtgattgttttggattttttgtttttgtttttgttttggtactggaattacaggtatgtactatcttgtgtctgacttatgcaggagatttccaatttagatctgagttcttcttaaaacatgtgtgaaaattgggtatagtgcacatggttgggattccaacactctcagaagatgcatagtgagactctgtctccaaacacatacatgctccccccaaaaaacccatatgtgacagtgtcctctttgtacaatgtatcatttagatatttaaaggcatttggaatctgttcagttccttccttccagaagaatgcttgtctccacttcctcccctggccctggttcacctaata

SEQ ID NO: 25841 - DNA, 4016 bp, Mus musculus
tttttactgaattcctgttagtcctaaaataaggcctcaagcccccttctcctcgttaaacttcaactgccggagtgctgggattacaggcctgtgctgccacacctgatgttttaggatatccaatacaactgaccctagtcaacttgacacacaaatcactgtgaagtcataccctttcctttcttccccaagatcacacattaatataaacatcacaggatgaaacattttacaaacttaaaaagtcccataggctggacagtggtggcagatttctgagttcgaggccagcctggtctacagagtgagttccaggacagccagggctacacagagaaaccctgtctcaaaaaacaaaaaaaaaaaacaaaaaaaaaaaaaagaaaaagtcccacagccttacaaattcactcattaagttttcagtctttaaaaaaaaaaaaaatacccagtctcttttaaaatccaaactctctgtaaaactctaaaatctctttttaaaaacgttttaaagtctctcaactgtgggttcctgtaacatcaaaaataagcactttcatactccaagagggaagagctagggcacatgatccagtctgtcataagaccccactacactggtacaactttgttagggttcctgttgctgcatcaaaacagtgacaaaaacaaaacaaaacaaaacaaaaaacaaaaaacaaacatgggaaggaaaaggtttattctacttacttctgaaggaagtcagaactggaactcaaacagggcaggaacttggaggcaggagctgatgcagaggccgtggagagtgctgtttactggcttgctctctagcttgttcagcctgctttgttatagagcccagaatcttcagcccagggatgctcctacccacaatgggctgggccctttcccattgatcactgattaagaaaaatatcctttaggcttgctcaccacctgatcttatggagtcattttctttttcttttcttttttttttaaagatttatttattttatttatatgagtacactgtaacggtcttcaaacacacaccagaagagtacatcagatcccagtacagatggttgtgagccaccatgtggttgctgggatttgaactcaggacctctggaagagcagtcagtgctcttaaccactgagccatctcaccagccctggagtcatttttttttttttttttccagagacagggtttctctgttgtagccctggctgtcctggaactcactctgtagaccaggatggtcttgaactcagaaatccacctgcctctacctcccaagtgctgggattaaaggtgtgtgccaccactgcctggctggagtcattttcttaatcaaggttccctcttttcagatttcaaggtaacatagaactatccagcatgcctgactttaacatagactttaagaaaaaaatacttaagcattcaccaaaataagtaattggattcctgattactggcatacagttccctttgccatcgttctctggcactcaacagcatcgggggacagtttgctgcactatcaattgatgcctgccgttgagtgacagagtaagatattttccagagtcattttgggaaatatcctggatcgttttcagaacactgcaacaaccaagatgctatctgagctttatttgaccttaaaaaactgtctaggacagatgcggtccacagcttgttccccatctgcagcagcctgcttgcctagcgctccctctgtgagttagcatctttacagaatttgctgaatctgcaattgcactttgggtcatagattgctacttagcaacatcaaatcccacagctttatcatcattatgtacttaaaatttaaaaagaacaaaatttgacataaattgatgtccagtttcaaatgtcattttttgggggactcatcttaggacatgaataaaattcagtattatgagtatctgtgcctcatttttaatacctcatttcatgtccactccattcccccagtcccaaccaagacgttttctcctggttttcctttcctcggcagcttcttttttattttccaaagtatgttttttgtagctcagaacatagctcagagaaaagacaacctgaagcctctttgggaagaaaaacaagataaaaatatgaagccgattctgtgcctgcattgcaatgtgattggaatgagtaatagtttctcattctgtttagcatctttctccacctatcaaacatgggactgtaccatgcctgcctcggtggggcgatattacgacacgaccagataattcaaaaagaacattacagagggggggtctttaaatattgtactctttggagtcacaggctggtacgtatcaggcaaagacatcaattaggatttataataaaaaatttgtagcttatgaaggcataaagaaacataatctgccagctagaaaacattcacataaacaagtggaaggtggggagactgggcacggttaatctgtagcaggggctgcagtggcgggccggttctagagtttagccacgccccttacgtcaggctttcccccattcccccaccccctacccctcacccccgagaggcctgccccacccgcgggcccagtcactgcgtcctttcctgcgggagcgcagagggacagttcttgcgcctgcgcattgcgtcgctgcgcgcctccgaggccgccgcccgcgcgtccaggctctttgtgcgcatgcgcgctcgcactccttctctccctgcggagctcggctgagtcagtcagtctgtcggagtcagtcttccgaacaggcgtcgccgggaacttcggagagccagctgctggattattctgtgtcccctcccactctcccgccctacgtctctcttcacccttctcccgcccttgctcgtacagccatggcggagtcgtcagcggccactcagtccccgtcagtctcctcgtcgtcctccggggccgagccgtcagctctcggcggcggcggcgggagccctggagcctgccccgccctgggggcgaagagctgcggctcctcgtgtgcgggtgaggcgcgcgtggggcttggtccctggggagcgcgagctactgggtctccgggaaggggcgagcgacctgtctgggccgtgggcggctttagtctcttggcgggcatttgaggaacaggctaagggggaggggagcgaaggaccgaggtgaggaaataacggggtgtgaagaaaacaggttgggggcggggtggtgaactagagtgggcgttgacgctgaccccctgcaagggagggcaccgcagtggggtgaaaacggagaaaggctatgtgcacccaatggatcgagtgctggaggcccgagagccctagggtgggtcggggggtgggggtgacttagagcaggattagcgagcctcaggggattgtgacaggtgggacgtaggagaaatgaagtcgctaggattttgagaggggtagtggtggaaaaggtggcgttgcaggtttgcagaccggttgacacaatcttaaatggatgatatagccttccaaaaaaaaatttttttttttttttgttcgccagaaggatcaggaagttctgttactgtttttggctaaactgaatgccagatttttttttttttttttttttttttctgagactctgaggtagatgaggcgtgatgagaatagcatgggaagatttgggagggagctgctgatagtccaagatggatccttggctgcatctgcaacacagccggctcttcaccggtggtgcatcgtgggggtggggacacgcagtcagttgctatattctagaagataataaatacagtcttgccaagccatcaccatgttttgatttcttgttttcgatggcctattctcaatagcagcataacaaaagggaacgattgctgcaggggaaagaattcagacaaagcctgggctgcttgaacccccttctctcttgtgtgtgaaaagactaggagggacgct

SEQ ID NO: 25842 - DNA, 5955 bp, Mus musculus
ccaacaagagcccagtcagcttctggatttctgccaatgccatcacgggtccaattccagaggaatggcagatctgagaccattctggaagatctgagacagggcactgtaataaatgaactgacttctgctctggtttccaactccacttggcttggaagcagttctttttcttgctgttacagactcaaggctactcttttctctgttctctgctttttgcactttaaggggtgggggtggggctaaaaggaaaacagaaatgcagcttttgagtctttgatgtgccacatagtgccttttcagaccagtgcatccctctgcagccatggaggctaaggaacggagggcaacctcatgaaatgtggttttggatcaatgtggttttagttcttttgtacctttgaagatttgtctttttaaaagtttacaccacttgaaaaaggctcagaaagaaaggcccactgaaatgatgctttattatccttcaaaagttttctcccagtactggtgattgaacctgttgcctgagtatgctaagcagttgctctcccctgcagctgcccccagcccacttgactgtgcagactcagggcttgcaattactcgattctccgcggctgagcttcccatcgtcctctctccctaaggtcctgagtagttgaatacagacttgtggtgccatccttgcttcaaaagccatatttatatgagttctctttgctatgcagcatgaaagacgttaagtcacttagtactctgtttcagattgtaaggccttacaccgaggaggctggcagttttgtcgacattgctttcttatttttatttctatagcttctttctagaaaagaggcaaactattcttaaaaagtcagtggttcataataaaaggaactagatactccatggaaattgtagtttgaatgaaccatgagacctctgataaagtcaccttgaatttgtgtcttggttagattcactgtacatttatgtcactgtacatttatgccacaaaaatagtcattttcaacagagaaaaggcatgaccaaatattactccttttaattaatgttcactttcattttgcctagcggtaataccaaatgatctaatctaaagtctctacctaaactctgtgtatgtgtgtgtgtgtatgtgtcgcatggtgtttccctggcgtgtagaccaggctagccttgaactcatagagatatttgtgcctctgtgtaccattgtgcctggccctaaactgctttttattctatatactatctaatgttcataatatcaaagctagactgttaattttatttagtaagttttcccttttttttcctccatcgaagaagaaagtgtactcagtctagccaaactatttaaaatatctcttaagccaggtggcattagcacacacctttagtcccaacacttcagaggcagaggcaggtagatcatctctgtgagtttgaggccaacctggtctacagagttaaattccaggatggccagggctatccagagaaactgtctcaaaaaaccagaaaacaaattccctctcgattcttcttttggttagtctagcagtttgaaaataattggcttaggaaggataattgctaagactctcatatttatttttttacatttaccttgattatgtgataaagttttatctattgctttttttctttgacttgtagtagtgaattattgtggacctaaaccttctgaaggtatagaagccttgattttggagataatgtgagattttgttgcaggaaggagatacagggttttggcaaagcctagtgtaccttttatgtacatggagtatgagaggaaggtaagagaaaaggaagtcttcatttcatttctctttaatgcacaactttcttgttagtaacggctttccagtcaaacatttaatgaatcctgaattaatattaagtattttatatattttcataccatctcatcctgaaaatgttagtagtttttccttttgctgtgacatttgggaatggttccaacttgttttaaaactactcactgctcgtgagtgatggctgactgtaaggggcttgaaactcactcctggcgtagtgcagagtttttaggtaatgtcccctatccgaacgcttgtattgagttaagtactcctgatactgagataaggtcagagagggttttggggacagggttttgttatatagtctaggtcagcctttaacttactttgtagtttagactggctttgaatttgaggttttgctgcctcagactccccaagtgctgagcttgtaggagtgtgtccccatgcccacctctggttctcttaatgatgaggaagacgatgtggggaaactttgccattgcttcagtattacatctgtgtgtgtgtttaaagtgagtgttccattaattagcttactctgctcctgggacatgtatataaagtttctttgagggttggcctgttttctaactttaaattgtggattttctattacaattttcaacacaaaatgcctttttatgactggctggaaatagttctgaggagactcataactggttgaaagagtctcagcctttgctttgtggctctgggacatggtgaaggagtcagatcagtgtccctataggtgttctgtacaggcaatattcgtgcacttctgtcactaagtgtagcacatttatatgatataatggagatttcattaaaaataactcactttaggaaaagctagttgttgccaagatgtccttgtttttgttttgggtgctgggggtgcattcacagggctctgtgtatgccaggggctagctctatgcaccaggtgtagcgctttagtgtgcctcttatcaaatggataaaattacaactttgattctttcactgagaaatctctcatgatttattgcttactgataaattttgagcatctcttttgaagaataccaaaaatctgtctcatagatgcttgtgacatttctgtcctctttccctccctctacccctttctctttttctttttctatgcagctccagccagaggtttgtgtttgatacctgctgtatactgggtcaggcctctgaatgtttatgcttgattcactttctctcactcattaagacagacacgcattgtattttccatgtagtttctttagtaggtcacacacagtggttggtacctggaatatgtgaatgagacaaaaattcagtaggttaatataagcccaagcaaaaggaacccccctcccatctcccaagtgccatggaaatatcaaaaagacctattttgtttgtgtaagttttttggaatatagttgagtatgattttatttattttttttaatcaggtggccaacatctctgtattttgcaacctagcaagtggaaccagtgtgttttttgtcaggagtgaggccataagcaagcctcatttagcaaagtgaaaagtattcttgtctcatgtggcctgccgtagtgtctacggttattttcatcaggagttgtactgtggctccatcttggacactggttcttatctaccttttcatgctttagattaatgtacagggtgtactaaaagaaaatgggactctgctttgtagctagggattgctgaagtggctttgtgctgtggccctgggatcatcatttataaacatcagtaggtgaaaggtgggtgggtgggggtggggtgaatgatggagactgagctgacccatggactggaagtacccagacaggagggctcttcagcatttctagcagctttacctgagctctgcctccaggtctgctccccctagagtttgctatgtttagaaccatcagggtatcctaattcagatgattgtccaagctttttaaagctgtcatagtgccttctcttaatgcctgcctcacacacaaacaggtaattgggaaaacattttaaaatttttgagagtgtcctctttctcactctaaaaaagccccattgggcactgtgacttgaattcctacatcttttgctgttttgttttgagaaagggtctcagtgtaaccttgtctgttctggaactcaccatatatatagaccacgctggccttaagctcacagagatcaacttgtctctgcgaatcccgaaacctttaacacacagaaaaccctaatgtattaaatacctaatgaataaaaaggatgagatcataactatgaaagtcgttacctatgtactccacagcaggaaccagaacgctttcttacaggaaagaatttcatgtgccagagctggtgtaatgctcttacaaagtgaaggtcacattaatgcccaaaccttatagtcaggtgatcaaaattgttatgaatgtaaaccttacaagaggtaaatcttgaatatacacagttgttctcaattttattttaaaaatggtttgttatgctttctgctaggtcatttgcctttgaatggctttaagactatagttttctttaaagcacaatgggaatcaatgatgctgtacatttaatggattaaagatcacaccaccgtgtcacctgtgtgtgttgttactgtactttcttgtggaaggatctatagaacagagtggggattggtcaggggagttggtgacctggtcagagatgggaccacagtgacattgagcctggttagcggtgatctagtaaggctgttgtccaatgccttgaaagcagtgactagacaggagagttgtggactcactatgcagccttgtcactcattggctggactcagagtggagttcaggctggctttgaactcatagcaatcaccagcctctgccttaagagcactgggagtgggcagtggtggcgcatgccttaatcccagcacttgggaggcagaggcaggccgatttctgagtttgaggccagcctggtctacagagtgagttccaggacagccaggctatacagagaaaccttgttttgaaaaaacaaaaacaaaaacacccccccccaccccaccccccccaagaaaaaaggatcactgtgattagaggagtttgccactacactgggctcctttttttttccttgtcagaacgtggtcatggtgcatggtgaacaatgccttggagaactgtgaaagagtctccagtaatacaggcagagagccttttacctcaagtgaattttgttccccttgattgtttacaaacatgattttgtgcctcctgcgacaaaaatttgcaatcaacttttaagacatgtttctttttggatgttggaagatagctgtagagctcaatttggtgaaaggctatgctgaatgctgtcctcagtgtgctctgaatctggatatagtcttcttctgccttgcttttgtgctttcccagacataatctatagtacttgccaggcaattgtgttatatttgttctctcctgagaaaagtttttaaattgggctgttctgagaaagggctgctctgttaatatttagtatgtgcttactggcatttatttacatttttttctgaactcaaccttcgttgaatcattacttttttttttttttttattacatttgtgtataaaatgcactgaaactgaagtaaagttgtctgcagcattgaattgtggtcctcattctttaaagtcttcaaatcccaggtctctgacagatctacataggtcgatgaaggtcagcagttgctcagattgtcctcacactatttatctgatgatacacttgattctgcttccacctgtcttgtctgggattatagactaagttgtgctacatccaattcatgtggtgctggaaatatgaacaaatagaagagtactcgtaacagggcaaggcagtgcagagattcctccatcttatattattgctgaggctattctgtaggtttagctagattttgatcttgatggagaatctgtggaaaataacccaactctattc

SEQ ID NO: 25843 - DNA, 1159 bp, Mus musculus
gaaggcaaatagagtgtgaacaagatgagccccaaatctgtgatcaacacacaccatctacactcaccttttcatctacacttgttttatctacagtcactcactagtttgtgaagcctttgcccaaagtgaacaaaatatcacagctgctttcatggttttggccaaagggaaccagccacatcctaggaaaacacactgattatgggaccttttggtcacccaaccatgtaaacaacaataatctctcataaaattaatctataatatagtctgggtgggccagggattattcagtctatgtttctacagcataccctgcaatatctatacaatggccaaatggtcaaacaatgcatttcccagaatttgtccttgtcatgaaatgatacatgactgtatctagcagagcaggtagaccaggaaaaaggaagctgtagagtgtttgatttgaactattcctggaaatgaagtctgggctcactttaaatctaaagtgacttaagactctgtctcctgggaatgtttctgtaatcccatctacctgcccagagctgtgcccgggtacacactgtagaagatactgatgaaggatttgctgtgttctaacattatactctaagcaaagagccgttttcttcccttgtccatttaccaagattgatcatgtacctttcataaaggaaaaaaaaaccctcaaatttccaaggggaaagtttttactgcaaatatatgtctttattgtaatccagggaaactagaggtcagaaaaagaggtggctgagaggcatcccctagacaccaaagcccggaactctaggaagaatctatgtcaaagaagagatggcaggttggtggttgaggttacttagttaaccttctaatgaaataaactatattgagaatctctaatatatatcttagtatactatactaaatttagggaataaaatttatttggtgttgattaatcttaataaaaatacagtgtacattttatccactgatattatgtatcttatgttcataaattaaattggcttgtcattctacttactcatatgttagtggtttttccattattgtgataaatactgtgaccaaggcagcttagacaaggcaaggtttatctaggtttatagttccagaggtgagtctc

SEQ ID NO: 25844 - DNA, 1566 bp, Mus musculus
aacatgattacaggcacatcccaggctgactgtgctatcctgattgttactgctggtgttggtgaatttgaagctggtatctccaagaacgggcagacccttgagcatgctcttctggcttacaccctgggtgtgaaacagttgattgttggtgtcaacaaaatgaattccaccaagccacaatacagtcagaagagatacgaggaaattcttaaggaagtcagcaccttgaagaaaattggctacaaccctgacacagtagcatttgtgccaatttctggttggaatggtgacaacatgctggagccaagtgctaatatgccttggttcaagggatggaaagtcacacgcaaagatggcagtgccagtggcaccacactgctagaagctttggattgtatcctaccaccaattcgtccaactgacaagcttctgcgactgcccctccaggatgtctataaaattggaggaattggaactgtccccgtgggcccagtagagactggtgttctcaaacctggcatggtggtttgctccagtcaacgtaacaactgaagtcaagtctgttgaaatgcaccatgaagctttgagtgaagctcttcctggggacaatgtgggtttcaatataaagaacgtgttggtcaaagatgttagacgaggcaatgttgctggtgacagaaaaaacgacccaccaatggaagcagctggcttcactgctcaggtgattatcctgaaccatccaggccaaatcagtgctggctatgctcctgttctggattgtcacatagcatgcaagtttgttgagcttaaagaaaagatcgatcattattctggtaagaagctggaagatggccccaatatcctgaagtctggtgatgctgccattgttgatataatccctgtcaagcccatgtgtgttgagagcttctctgactaccctccacttggtcattttgctgttcgtgacatgaggcagacagttgctgtgggtgtcatcaaagctgtggacaagaaggctgcttgagttggcaaagtcaccaagtctgcccagaaaactcaaaaggctaaatgaatattacccctaatacctgccaccccagtcttaatcatttgtggaagaatggtctcagaactgtttgcctcaattggccatttaagtttaatagtaaaagactggttaatgataacaatgcatcataaaaccttcagaaagaaagactgttttgtggaccattgttttgtgtgtggcagttttaagttattagttttcaaaatcagtgcttttttaatggaaacaacttgaccaaaaatctgtcacagaattttgagaccattaaaacaagtttaatgagaaaaatttttttctttgatcattgtatctaaatcttttaatgtatcttctacacctgagattctatcttccatctcatgtattctgttggtattacatcttttctgtaattcctgacttctttcctaggttttccattttaagtgttgcttccatatgttttctttattgtttctacttccacttttaggttttggactgctttgttcaattcc

SEQ ID NO: 25845 - DNA, 1578 bp, Mus musculus
ggacacagagacttcatcaaaaacatgattacaggtacatcccaggctgactgtgctatcctgattgttgctgctggtgttggtgaatttgaacctggtatctccaagaacgggcagaccctcgagcatgctcttctggcttacaccctgggtgtgaaacagttgattgttgatgtcaacaaaatggattccaccgagccaccatacagtcagaagagatacaaggaaatcgttaaggaagtcagcacctacatgaagaaaattggctacaaccctgacacaatagcatttgtgccaatttctggttggaatggtgacaacatgctggagccaagtgctaatatgccttggttcaagggatgggaagtcacacgcaaagatggccgtgccagtggcaccacactgctagaagctttggattgtatcctaccaccaactcgtccaactgacaagcttctgcgactgcccctccagggtgtctataaaattggaagcattggcactgtccccgtgggccgagtggagactggtgttctcaaacctggcatggtgtttacctttgctccagtcaacgtaaaaactgaagtcaagtctgttgaaatgcaccatgaagctttgagtgaagctcttcctggggacaatgtgggtttcaatataaagaacgtgttggtcaaagatgttagacgaggcaatgttgctggtgacagcaaaaatgacccatcaaaggaagcagctggcttcactgctcaggtgattatcctgaaccatccaggccaaatcagtgctggctatgctcctgttctggattgtcacatagcatgcaagtttgttgagcttaaagaaaagatcgatcgtcgttctggtaagaagctggaagatggccccaaattcctgacgtctggtgatgctgccattgttgatataatccctgtcaagcccatgtgtgttgagagcttctctgactaccctccacttggtcattctgctgttcgtgacatgaggcagacagttgctgtgggtgtcatcaaagctgtggacaagaaggctccttgagttggcaaagtcaccaagtcggcccagaaagctcagaaggctaaatgaatattacccctaatacctgccaccccagtcttaatcagctgtggaagaatggtctcagaactgtttgtctcaattggccatttaagtttaatactaaaagacttgttaatgataagaatgcatcataaaaccttcagaaggaaagaatgttttgtggaacattgttttgtgtttggcagttttaagttattagttttcaaaatcagtccttttttaatggaaacaacttgaccaaaaatctgtcacagaattttgagaccattaaaacaagtttaatgagaaaaatttttttctttgatcattgtatctaaatcttttaatgtatcttctacacctgagattctatcttccatctcatgtattctgttggtgttacatcttttctgtaattcctgacttctttcctagtttttccattttaagtgttgcttccatatgttttctttattgtttctacttccacttttaggttttgga

SEQ ID NO: 25846 - DNA, 1102 bp, Mus musculus
acagggaagggggtctacatggtatgttgtgaaggcaaagggggaaacagagtatatcaggaggtgacagcatacaggagggagagaagcatggtggggtgtctagagaggcttcggctactgtatgacattctgtcttaagcttttcaggaaaatttaaagagaagacctgctggttaaatattaaaaataaagtgaactgcaattatactgtaaactgctttcagagatttcatcggtgacaaaactcatcagaagcaaaaaatgtggctgtcactgccctgcagagcagcacaaaccgtggggtgcagatctaagaactacagccattgtgggttgattgggttccctcaaagaatacaccgaagctctagcctcctagaatggaaatgaagttgtttagatgtaagtagctgagttacagtgaggtcatcatactgggcatggtggacccttgtaggaagaaaaggacaggcagggcaggatggaggcagagcttagagtgatggacactcaagccaagtaatgctgaggcttgtcgctagaagagataagggaggattctttgtagagaacatactgatgttgtgggctttggaattctagtctccaaatctgtgagataataaaatctgtgttgttttaagctacccgatctgggggatttttatggaaatgaataaactggttctgctgtgtgtgaaacatctactggcttggtaggcagtgatgagaaaggaattggggatagatgagggaagcaggtgtggagcaaacagggtgggtttttttaaaggcaccccatgtttctgagagaggaagattttagagagcatcctggatgctttctgtgggacttcctgtgcaaagcccctgagagggtcctgctatagcctgtagcagaaggcttgaatattcaagacaccaggaatggtttctgagcagcctttgactgggactccaaaggctggggcagcccttggatttaaccatgttttaccccgagtctataagaacaaatgattcctttgctgttttccatgtgttagaatccccttactcaggaatgttgcctgtcctttgataatcttttctgagtatc

SEQ ID NO: 25847 - DNA, 1527 bp, Mus musculus
gcttttccccattgaatcaactccccagaccccaaagccctattttcaaaggaaatgtctggtatctggtaagatgttcagaacatttctttgttggacggtagtattttacacccattggctagaggctttgagcgctctgggaactgaagcttggtgagagtctggacaagcagaaaggtacatcttgtagtggtgaccagatgaggtcctgtcccggggccatgccacaaaggcatcatacctgcagaaccagcagagaacaacacaaaatgatgaaatggaaagagaatgggaggaaggggaatggacccaccctttttttttttttaagtcccacattctctgtttgttagcctgcgaaggccccactcatgccgtggaatgagtccagcatctttcacatcccaagacctgtaagcctcaacatgacagtgaaggtaagcagttgaggcctgcccctcagggtgggcaggtgctgtacagatggacagagatccccctcattccttccttctgtgtgtgtctatcattttcagggccagaatgaagaccctggctccctccttacccagttccggcggctgagtgaccttcggggtaaggagcgctctctgttgcacggtgacttccatgcactgtcttcctcacctgacctcttctcctacatacgacactgggaccagaatgagcgttacctggtggtgctcaacttccgagattcgggccggtcagccaggctaggggcctccaacctccctgctggcataagcctgccagccagcgctaaacttttgcttagtaccgacagtgcccggcaaagccgtgaggaggacacctccctgaagctggaaaacctgagcctgaatccttatgagggcttgctgttacagttcccctttgtggcctgatccttcctatgcagaacctaccaccctcctttgttctccccaggccttttggattctagtcttcctctccttgtttttaaacttttgcagattacatacgaattcttatactgggtgtttttgtcttcaaataaaaacatcacccctgcctcatgagattgtgactttcatccttccttccttctagaagaactttctcttgctcctgatctcttttgctcctccctgcccctgccatagtcgcagccagttgtagacagctattccagctctctttttttttttttttttttttttttttttggtttttcgagacagggtttctctgtatagccctggctgtcctggaactcactttgtagaccaggctggcctcgaactcagaaatccacctgcctctgcctcccaagtgctgggattaaaggcgtgcgccaccacgcccggccgctattccagctcttaaattaatcatttagagaccaaggctagagaagggcccttccatggttaacagcaaagtgtcttggctggagtaaccacacctcctcgctctggcccaagaatcttgggaattgccaactcttccttatctctcttagcacagtctttaagaaaa

SEQ ID NO: 25848 - DNA, 1149 bp, Mus musculus
cctcaggaaacaaagagaggagcaagtacatttgcctcagggtcctatctgtgctcttccccagttacaatcttggccgcgtcttctctcagccaatttcttcatctccaatttgagggcattttcaccccacatcctaagtgttaagtgttagagctgtgcgtgcatgttttctcttgggtcatttctgtagctgttaaaaatgaaggtatgtgatttgccaaaggcaagacagaaaatagacaaatgctattacacagtaaatgcatgggtggggcaccaagggctaacctttgacactgggagactgaaccctgtttactctaggtcccagggaaatttgaggtaggtgagggcttgcttgtatgttgatcttgcctgttcttttgtcccctgtaggaagctctgagttcttggttgcaggacggtgtggatggtttccaattccgggatgtgggaaagctgatggtgagtgccctttctgcattgagaggcaaaaagctgtggtgagaagagtgggtctcagccacggcgaggtggtgttccctgttctgactctgcttttctctactagaatgcacccttgtacttggctgagtggcagaatatcaccaagaacttaagtgaggacaggtaggtacccagcacccctgcctggctgagcccattgtgagagcctcgagaggcgagtttcctagtctcgagaactcttctcttttattctttatctcctgacattttctaatcacactcctatccttgctttgtgcaggcttttgattgcagggactgagtcctctgacctgcagcaaattgtcaacatacttgaatccaccagcgacctgctgttgaccagctcctacctgtcaaattccactttcactggggagcgtactgaatccctagtcactaggtttttgaatgccactggcagccaatggtgcagctggagtgtaagtagcatgctggtgggtttaggggaaggtgggaagtggtagatgaagggtggacatgctcaaaggtgtatcctcctgcaggtgtcgcaagcaggactcctcgcagactttataccggaccatcttctccgactctaccagctgctgctcttcactctgccagggactcctgtttttagctacggggatgagc

SEQ ID NO: 25849 - DNA, 2056 bp, Mus musculus
cccgaggagaatccaggaactcagctaagtccggagtatgagaagatgtacgtaaagcagaagtgagatgtagtgccaaggtctgtgtgaagttggggagatcagcctgagccgtgcttggggcgaagggatcacgatgtggatggagactggtgtcatcttgtggagagaaaagaggcctcgcagggtaaggggccggaaggtcggaggaggggctttgaaacctggtcaagacaaattcacgtttgttattctaagggtttctgaccacaagctccccttcccagactcttgcaggaataagcgttagggatagacgggagtattcagcgaggctggaggtgcgaaaagacttctctgcatctctttaagaggcggaccggggcggagtcctgggtcacttccccgccgccacacccgcccagcggcagaagcagttaggaagctctgctagcctcacggccacgggacgcctctctgaacggggatccaggcaggattagagctgcctcactgactacaggccgtgtcgtgtcaccgtttctgcaggcaccatgagccaggacaccgaagtggacatgaaagatgtggagctgaacgagctagaaccggagaagcagcccatgaatgcagcggacggggcggcggccggggagaagaacggtctggtgaagatcaaggtggcggaggacgagacggaggccggggtcaagttcaccggcttatccaaggaggagctactgaaggtagcgggcagccctggctgggtgcgcacccgctgggcgctgctgctgctcttctggctcggttggctgggcatgctggcgggcgccgtggttatcatcgttcgggcgccgcgctgccgtgagctgcctgtacagaggtggtggcacaagggcgccctctaccgcatcggcgaccttcaggcctttgtaggccgggatgcgggaggcatagctggtgagtagggtgtgcaccctcatcccttgcccccatgaatccctcgtttaatcgggcattctgctgcttttttccttcctcctcgtcttctctagaacgctggtgattctttactgcaacctattttttttgggacgactccctggcaaaaatccccccccctttctttaaaaaaaaaaaaaaaaaaacgctagccggacccctacttcttcctaagggtgcctgactcagcacatcatctttctcctctcccctcccccaaccacgcggccctgagccagttcaaaccagtttctgaagtaatgtgtgagactccttgcgtcagctactttgtctcatgatccaacccgcgtcagagggagtcgggaagtggtggagagaatgtggaggctggaggcttttcatgccctattggttaacccaaccctctcctcctaggtctgaagagccatctggagtacttgagcaccctgaaggtgaagggcctggtgttaggcccaattcacaagaaccagaaggatgaaatcaatgaaaccgacctgaaacagattaatcccactttgggctcccaggaagattttaaagaccttctacaaagtgccaagaaaaagagtaggtctttctaaggaactagaaagggtttggcattctggcccagaaacaggatagagtttttgtctgatttttctcctaactggctcagtttttttgtgtcaggcacaagggggaatatgttatgatttacactaaaaaatgtgcttcatgcgtgagcgtaatttttatgtatttattttggttttggttctcaggtagggtctcaccatgtaattggttggcctgtacctgactaccatgaccaggccggatgagagtttacagagctcccctggtcccgagtgctagacttaagtgtgtcaccatggctcgataaaataaatggcttttaaatgtataaagtagatcctatatatagaagagattcaaatgctgctttagagttcactatagagggctgacaacgtagctcagtttgtaagagtgcttgtctaggatccatgaagacctgagtttgattcctcagcacaacacaagcagc

SEQ ID NO: 25850 - DNA, 1232 bp, Mus musculus
tcctctcaccagtgtattcctgctgacttgggtattcctgcaccgttgggcttcagttctcattatggcttcacacaatcaacccatcccagcatatctattgtatttaccccagttttgtctttgctgtttgtttttgagtcagggtcttatgtcgcccaggctggcctcaaacttgtcgcgtggttgagggttactttgaacttttcttttttttttctttttttttttttttaagatttatttatttatttatttgttatatgtaagtacactgtagctgtcctcagacactccagaagagggcgtcagatctcgttacagatggttgtgagccaccatgtggttgctgggatttgaactcctgaccttcggaagagcagtcgggtgctcttacccactgagccatctcaccagcccctactttgaacttttcatgcctccacttcctggggttttaggcctgtgcctcctctgtgcctggtttatgtggtgctaaggatagaactcagggctttcaaatgctaagcaagcactggctgagctccacccccagtccttcatccttcactgctttggtgttgcagattgaaccctgggccttgcacatggtaggaaagcaccggtcttctgaactgcatcgtcagtcctttaagtttatatagtcaactgtgttagttattgtgttctatccctggtaagggaaagcaatctacgtagagcattgagagatgctgtcacttgagtcagagcttgaaggaggaagagtaacttagcaggaagatccaaacagcaggacagcatgcacaggaggcattaagaatggaaacaccctgtgtgtcgtgactctggcaggtgctagaaagctgctgtggctgaacagtagtgattaggaagggtgctgctgaaaagactgatgggagctcacgtctcctctctaagatgcttaggaatagatttctgccacttggaggtgggggcggggagatactgtgttaccttaaattttacttactttgtggagggcagtgcgcatgtgtggagggcagtgcgcatgtgtggagggcagaagacagctcctgggaatcagttctcctttcactgatcttcactgatcactgaggagtgagctcaggtttgctggctaggcaccttcaccagaggaacatcttttttctctttttggtctttttttttttaaagatttatttattcattatatgtaagtacac

SEQ ID NO: 25851 - DNA, 1233 bp, Mus musculus
tcatctcaaagccctttacactttggagccaggcctgttcaattttacaaataacacgttttgcttgtagtcaggtaggtattgatggttggtgcttccttagggaacatatttagatggccacttaatgatgaacaatgtaaatgacaagcatatggctgagttgcaatgatgtcatcttactactgaaatgggctgaagaaagaaggtgctgaggtggctgtgattacatttaaaaatgacattgtttctctgtttccagggtgctgtgacaacatgaagagttcgagctacctcccaggatgagtgcaggtaattgtccaagtagagcttagggtttccctagggaaaatagtcaagacagacattgaagcagcacaacacttttttgctgcttactatttgtatttctagaggacacattatgttaaggcctttgttctcttaaaaactcaactgtcagatgatttgaaatgatgacactgaacactccgtgaaggtgtgaatttatagcatgttagagttctgatggcagttagtgctgacagacagattgtaattctgtcctgatggttgaaaataactacttgttactcttccacaggttttcctggtgacaaatctcaggcattcaaaggttagttagattattttggatggggtttgttcactaggtttgctgtttctatgatgaatcaaactagctcactatgactgctaatgaaaacacaggaacacctgagaaaccaaagggtagtgtgggggcaagggccttatatccagccttttcaaggtttgttatttttctccaggttctgttagcagtgccatacttgtgggtttacaggtgagtgattccagtgtgtggtgtggtgtatgtgcatagcattggactggggtggggggacctaactgagaacgtactttgtgtatatatgatgactttcatagaatctcgttcggctgatgattgctgttgagacttggaaatctgatttttctcagaatgatgggttagataggaacaagctgttgcaggatttttaacattgctgatgactgtcttgtttttcagagatggtgtgtctggctgagaacaaaggagccgtaccaggtatatgtcttagtaatgctttttgtagtataaggttgaatatataatacttagacctagtgaattcctgctcaccctgatgaactgaataccgccccagtctgatagctgtggagaaa

SEQ ID NO: 25852 - DNA, 1152 bp, Mus musculus
atggtggtggtgtggtaagtcatttctccagcgccttgaggtacattcgcgacccacttatttatttatttgtttgtttgtttgtttgtttgtttgttttttcgagacagggtttctctgtatagctcaggctgtcctcaaactcactctgtagaccaggctggcctcgaactcagaaatccgcctgcctctgccttccaagtgctgggattaaaggcatgtgttaccactgcctggcctcttgacccttttatttcccaacatttctatagttttccaataacttgttcacgatgtggatgtaataaagaaagttctttgctctggctagggcataggcatctctgtgaaggaacctttatagttcatatctgttttttccaagagtacagagtactagaaactggtgctcacaccaaggtaacttagaccattcatgcatttactaatttctgtgtctgtttccaactccagagcatgatgaccgtgttagtttccctcaaagaagaaagaaaggccgggggcctttccgatggaagtgtggtgaggggaatcgtaggtctggaagaggtggttctggtgtacagtcttcccgatttgaggaagatgatggcgatgtagcaatgaatgatccccaggatggcccccgagtaagatagtaagtgaccaattagtctgctttgaatagtgacccactgaattatgtagccctgatgtctttgttgtgtctggtcttaccttgtaaagtgatacttgacagaaccaatttagtagctgtagtttcactagcaggacaggttcctcttccctagtgtttatggaaatttaattctgcttcccaatagcaatccctataccaaccggcctaatcgtcggggagatggttggcatgatcgagatcgaattcatattactgtacggagagacagagctcctgcagagagaggaggggctggcaccagtcaagatgggaccaccaagaactggttcaagattacagtgagtacttggaagaataggtgattcaggaaacaggactagactcattgaaagtgtttgacacctctctcaagctcctcgaatccattttctcgaacatttactcaacagggaagtagcatgctaatccattctttcctcaaatgagtgtct

SEQ ID NO: 25853 - DNA, 1142 bp, Mus musculus
gaaggcgccaaacctaaagaccctaaatctctccggaaacgaagtaagactgacatctagggtgcttttgtttttaatagttaactgactatggaggtggaggtcagactgtgttgggagttgagtctttccttctacgtgggttcttgggctgtgatgcttatgaggtgagagctcctgcccactaagccatcacactgaccctgctgtgtttctgtgatggtggagccaggagagtgtggctggccatagtgggaagcaagaaacaaaacttaggtaggatttagaagtgtgggaatccagctgctattcttagtaaggtctgtttcttcccttttactctcctcatccttcacagttgaagactgagcgggaattagacaagataaaagggctgaagctggaagagctgtggcttgacagaaaccccatgtgtgacaacttcggagaccagtccagctatatcaggtcagttgtagcctctgtctcccctcctggggacattcacccctgggaggctgagctcatgcaccctgaccagtgcccgtctacaggagaacatgcagccctgagctggaaccacctgttctttgggaggaggatcatgtattcctttctgcctgtctgttgtctcctagctctgtcccagatctcttctttcttctcacctgacttctgttctctagttctggcctttctccttctttcttgaacacagccttttctagaatctccctacctgttattccaggaagagcacctccccttttctgttctgatgtggaggtgtcttatatatgccctacctgtgtgtttgtcttcagcaaaagcctggtgtgcttaggctgtgagaaagtcctttcttactggggctgtctactgagacaggccttcctttgtcctttcatggtccctcttgccgttgtaccaagagggactctttattttcatgatccacttagccaaggctgtggcctggtcctttctgcccatgctgatgttgatgcctcttggaggctggtaccatgctattggtctctcttgcccagtgctgtgaactgggcctttcctggagaagaaatctgggtttccctaagatgtgatcaaagccggggccccgccagcaggcgagggggatccca

SEQ ID NO: 25854 - DNA, 1207 bp, Mus musculus
ccatgtggttgctaggatttgaacccaggaccttcggaagagcagttagtgctattaaccactaagccatctcacgatacccttttttttggggtgggggggttggggggcgatagttcgagacagggtttctctgtgagttaccctggctgccctggaactcactctggagaccaggctggcctcgaactcagaaattcacctgcctctgcctcccaagtgctgggattaaaggcatgtgccatcatgcccagctcagcggaatttctgaatcagggcatgaacatttaacatgataatacgtggatcctaacctagcctccagaatggtggcttttcctttattgaggtggttcctttcaggttgccctccaggacctccagacaaactccaagattgcagcactcctgccttactttgtttatgtggtcagtggggtaagtgatcagttctctagcgatctctatgacccttctctgtttagggctcatagcagattcttcgcaagctcctgtctctccatgccaccacaagccatcctctcctaccaacaggtaaaatctgtaagccacgacctggaacaactgcaccgactactgcaggtggcaaggagcctgatacggaacccacacctgtgcttgggaccctatgtccgatccttggtgggcagcgtgctttactgtgtcttggagccactggccgcctccatcaaccctttgaatgaccactggactctgcgagatggggctgcccttctactcagtcacatattctggtagccactgggttcaggctgagcagagggtgggatagcctacagagttgattgggttgtggtagggagctgtaggaagcctttggcttttaaattaaatgttacatgtggaacttttccttagccccctagctgacatgtcatggtacagttataaagatagcaagatattagtcttttgtcccttggatcctgggccagtcacatctggcagcctgtctcagagatgtctacaaatgtccaactctttatgtgtggtacttcattctccttcctgactgttgcttccacaggacgcatggagaccttgtaagtggcctgtatcagcagattctgctgtccctgcagaaggtcctgacagaccctgttcggcctctctgttctcactatggggcagtggtggggctgcatgctctaggctggaaggtgag

SEQ ID NO: 25855 - DNA, 1219 bp, Mus musculus
gttgttagggtaaccttgaactcacttcctagttgacaaggacagttatacaacccaggaaggcctccctgacagtcaaacagggatctaaggaggtagtaggtgatgggtcactgagtcaaagagatttggagagaacaaagaagggacagtgtcaaacaagaaacagaatggcctgaaataaggaaatagaggtggccgtgggtggaagtctagatcacaagagaagaagataaggttttgcagacagatgctggaaaggcacaggcatagcctgcccatcatgggccagtatctttgtttagtacaaaagcaacaggaatcactgggaggatggctacgtgggctacgtagattgcccacttgttctggagataaagaatgaggaacccagccgggcatggtggcgcaggcctttaatcccagctcttgggaggcagaggcaggcagatttctgagttcaaggccagcctggtctacataagtgagttccaggacagcaagggctacacagagaaaccctgtcttgaaaagcaaaacaaaaaaacaaaaacaaaaaaggaatgaggaacccttgctggagtcctgggagtgtcatcttggactagggtcgtgctgtgctgagcctctgggctctgtctttgtggcttttaaagcaagatgagcaggcatggttgagatggtcttgcctgcctcacccttggaggaatctcagatactgggcgggttttcaacctttcttttccacttgcagttccaccggggccatgtcagaacgagaggagaggaggtttgtggagatccctcgggagtcggtccggctcatggcagagagcacaggtctagagctgagtgacgaggtggccgctctgctcgctgaagatgtgtgctaccgtctccgagaggccacacaggtgtgctgctctccgtccacctctctcctccctatgatctcctgttacctcttccccactgacatgcttggcaacaagtgtatatcaggtaccatgtgctttgaggtcagaagacagtgtaggcctgtgcctttgaaagagtctctttctagccagtcaggtgtctagaaaagaaaacactcgctgggcactttctcataacactttctcacagtgtcctgctgcctaggcggaatagctagatagtgacactctgcccatgagtcactgaggcactcggtgggaacatgacatgcggaaggtgt

SEQ ID NO: 25856 - DNA, 2240 bp, Mus musculus
aaaaggagttcaccctttacctctgacccaggtggatttccattttgtttcctgttctgcacaagttctttgctccttagaccatctgcatcgtttattgtctgtcccctagtgtatttgtatggcttacaatctgagaacattcatcgactgtgggtggaatcaactgtatttgtggcatagatttaatggggtgttattaaatgttctcagacacagaggagagggccggtgaagggtgagagagtaaggacaggcaaacaggaatcttctgtagtatcttcagatgcttttgttttgcttagtgggatttttttttcttttaattataaattgagcccaagtatatttacattaaagatttgaaattagctgggtgtggtggcgcacacgtttagtcccagcacttgggggagtcaggcagatttctgagtttgaggctagtctggtctacagagtgagttccaggacagccagggctacacagagaaaccctgtctggaaaaaccaaaaacaaacaaacaaaaaaagatttgaaattaatcattttagggctaaggctgtagctcagtggtagagtgctcgcctagcacgaataaggccctgggtttaattccccagtgctacaaaaccaaccaacgaaataacaagaaatgaatcaaactgttatttaaattaatttcttatactcctttaatatttcagagacattcagattattttcctccataaaagtatcttctttctaggcagacttggtggtagatgcctgcaatcccagcactttggagtctaaaccatgacaatcacaaattcaaggtcagtcagatcttgtctcagaattaaagggctggagataacagctctgtgggaaaaccctgggtttaattcccctttctggtttttggtttgctttgttccctcctggtaatttctagtccttgctattgcttgcactcagatcactgacaaagtacaacttatttgtcattaatttagtctttttttaaaacttctggagtgaatgcctgggatacatgaaaccctgtttttaccttctctctgaccttgtgccaagaaggaacccaagtgctggtgcactttctctgggtgtgtgtgtatgtatggtgtgggagcttaaacccaccttgcacatgcgaggcaagcaccctgtcatcaagctacacagctagtcccacagaatttggtttgtatttcaaaaagtttctctgcgtagctttggctgtccaagtctgaatatttcatagatacattctaaagtgttcacttttctgaaaggcattacttttgtcttcttgaaagtgtaccgtaggggctggagagatggctcagcggttaagagcactgactgctcttccaaaagtcctgagttcaaatgcagcgaccacttggtggctcacaaccatccctaatgagatctgactccctcttctggagtgtctgaagacagcaacagtgtacttacatataataaaccttaaaaaaaagtgtaccctaataaatcatgacagaacctgtttcctcttcagctgtcactctgtcttgtaggtgctcaggaccttacagaggaaagaaagtacaaggaaagatgtttattgtttagtgtgttggaagcacctgatagaatcctgaagaagctgtgtcactcatgggtgcaaacctagggttgtcttgccttgccttgcctcggtggcattcagctactggtggctggtctgtcattctgtttaccctggatcctctttatgtcatggctgacaattagtagctaagaccatgtagtaggcctccacctttataagcagagataataagcatgtgtcgctagccattatataatcaaaaaccaaatatgtttcttggggtgggaccaactagcttattaataatacctaaaactctcctaatactctgtgcttctatgttcctccccataatttaaataatatatccaacaagataaaaagcttttctaccaaacctaaaaaaatacaaggacagaactaagtagaatattttatcttgcagacttcttaaactgctaaagttagcatatgtctgtgatttcagcactcaagagtgctgaggcagaaggattactataaggccagtctggctatatactgaattccagactagccagacttacctaacaaaatcatgtcttaaaaactcagatggataaaatccctatactggtttggcaaaattttgtcata

SEQ ID NO: 25857 - DNA, 2911 bp, Mus musculus
aggacccgctggatggatgagtgtcgtgcctcttcatcgtcagccagctctggctctaagtgatggggtttccctctcttctagtggcagaattactactaccaccaccaacaggacagagaccgatactacaggaattactacggttaccaagggtatcggtgaagcccctgctgttttcgcctgtcagccatgaagctgaatctttgggggtgccaggcaccccctaaaacacaaccaaggaaaacaggggctgtcggggtggggctgagctgccagggaggggtggttggggggagggtgtgcaagtaggggtgggggaggggggagtggaaacaaaactgtacattttttttaaagtttgttgaaaaaaatattgtcttattctataaaacatttcaaacctagttaggttatttgtaatcaaaaaaaccgtttgcacagaaagcagcacttagagctgcctattctgtaccctgcagctggataggaaaagaactaaaaatgacacctccagcattctaagacaggtggattggtagcccagtaagggagagtgttgtggggagaaggggaacagcatgagggaatctgctagcagttaggagcggaaacagaggagacaggagcaggggcagagggggtgcctgtgaacagggcagtggaaataaacaattggctgttatgaatcacttgcaccaactaaccgtttgtattttctttaccaacctttccttcttgggctattgaggtaatagattgtccacttatattgtgcctttgtgctgtctgcctaaggcacagagactgctagttgggtggttctagtatataggattcccaggccaagggggaacgggggctcttggggactgcagagcataatactttgtccctatctatattatattcagtaaattcctataaagtctggaggagggtgggaacacagcccttagtctgaagatggtgatttgccagtccctagtctctgtcttcctagttgatagaggcaagagatctctggaatcatttactaatattgcctgcctcttacaagtgtgagggaaggaatgattctcagggtttcagctcacagaaacgcagcaagacttttgtttactgcgtcaagatatgtatataggtgaatcctgtggtgtgggctgtcaggcccaggtgctgagaattgcaactattttatacaatgtagggggctctgccctgctgctgttttttgtttttgtttttgttttgatacacaggtagagagtagaaaggggttgtggggttaggaggcagctcagttgggctgcagaaacttggaaagactatgtgaatgtgtgtatgggtgtgtgcaaggaaacaccttttcccaacttgttgaaacaggattccttcaagggtgcttcccttcaagtcctcagagaggcctcttatcaagagacttcatttgggatcatatagtttgtaactttaacaacaccctcccagttcttgacagaatagctacaggttgctgggttcaagaatgtgagcaggatatagcaatgcgctttcaatattgatcttcaatttaaatcatcatcttgcttagctaaaagcttactcagcaacagcatcctacaacacttcctggtgagaaaatctctgggctgagttactaggacatacttcacttccacttccttgcctgagcagttctcttgtttaaacttgtgctgagatttgaatcttccctgtcctgatgtccttcccacgcaggcaaggcttctcagggtgtgcagacctcattctgagtcctggtttgttaggacacaccgttctgctcaaggacctctttccaaggctgcagtgggcctgggaggagagaagcgtgctcatactgtgtcttttctattgcacttgtccctatggtgccacagatgggtttgtgtgtggcagtgggtggaatgattgcatgcatcttttgtaactcgctggtattagaaagggagttcaagaaagcattgtttataatgtcagggcaggaagatagaaactggagcccaaagaaatccccttagaagaagattatgttagaataggaaacttaatttccagaggcagaagctgtcccttcagatgtttagtcctccaacaaataatactttgacggtactctgtgatctggattttaggtggtagagccctcaaaagtgcaaaaacttaacactgaagtttgaggcaacatgggtcagagagtatactcgctgttgattttcaacaccagaaaagtcaaagtccttttttttaaaaaaagctgtttttctagtggaatggagaatgacactgccacatccttgttgggtctgttcaggaggtctcctgcatcaaagtggacgtctgcattttgtttctgtcttgtgtttttattatgaaaagaaatgttattgggacgggtgtggggtgtagattatggtaataagaggaatccctggttttgttttccttaaaagagttgtttagtgttttatcagatgtctgttgtagttgtagatggaaaagcttgtaaacaaacaaacaccacatggagcctgtaaatgtttttgcacaacctgtaaagcattcttggaagtggccagtaaaaaaacgggggaggggggttccatttttaaaaatgtaactgtgtcattgtttacatatgtaactcttaccctgttctcattacaccattctggcaaaaaatgtagacacagtagttccagttttagaataaataaccatttggattgaattttcctatctcctgtggctgcactgactggaatgatcatggaggtgtttatttttaaaatgtattttttcaaaataatttcttttgaggcagaatctccttgtatctcagactggcctggaactcttgatcatcatg

SEQ ID NO: 25858 - DNA, 1114 bp, Mus musculus
ttttttttttttggctttgttctgtttttttttttttcttcaagccaagagtctctatccctgactgtcctggaactggctctgtagaccaggctggcctcaaacttgagatttacctgtctctgccttctgaacactgagaataaaggcgtgcactgctaccacctagcttgtcctctttggtttttcaagatagggtttctttgtatagtcctggctgtcctggaactaactctgtagaccaggctggcctcgaactcagaaatctgcctgcctctgccttccaagtgctgggattaaaggcgtgtgtcaccaggtctggccctgcttgtcctctttatattactgttttggttttgtttcctttcctctgtcttggagcccgtattcccttattttgttaatttctcagtctaaactcaccttcccactccatgtccaactttacctctttcttctctgcaaaacagaatgttggaacttgtggcacaaaagcagcgggaacgtgaagaaagagaggagcgagaagctttagaacgagaaaagcagcggaggagacaagggcaagagctgtcagttgcacgacagaaactgcaggaagatgagatgcgccgggctgcggaggagcgcaggagggaaaaggctgaagagttagctgccaggtctgaagtctcattggtcgctaattgggaaagaaatgaagatttgccttgtccatgtctgacctattttcttcctgtctctattctagacaaagggttcgagaaaaaattgaaagggacaaagcagagagagccaagaaggtgggtgattagaaagtctgggtatagtggagtatgtgggttaatttccttaaagtgtgcttagcatgatttttttgaggcaattttactctagcccagactagtgtcagactcatagtattctcctgcgtcagccttccaagtactctaactaaaagctgtgaactgccaaacctctgtgtgtgtgtgtgtgtgtgtgtgtgtgtgtttggcccatgtactggagggtgaccctttatacatgctagactagtgtgctccctctgaggtagtgttccattttgtctttcagtatggtggtagtgtgggtt

SEQ ID NO: 25859 - DNA, 1087 bp, Mus musculus
agtgctcgtgccaacatcacgctgtctgggaagaagcgcaggaaactcttgcagcagatccgacttgcccagaaagaaaaagcagccatggaaggtaagtcttgggcacagaggctacacaacaagaagtctggattttacctgggttttatcttttttttttttttttttttaggatttatttatttatttatttatttacagtgtgtgcactgtagctgtcttcagacactccagaagagggcatcagatttttgttatggatggttgtgagccagcatatggttgttgggatttgaactcaggacctttggaagagcagtcggcgctcttaaccactgagccatctcaccagcccctgggttttatctttaatgctttctttttcctttccttttgttcagtggaagccccctccaagtcaaccaggactagtcagccacagcccaagcaacaaaagaagataaaagctccccaggacgtagctatggaggatcttgaagataagagctaaaatccctgcctcttctaccagaagatggtcaacagcactgagaaagatttggaggaactttggaaaaaatattagcatatttcactttcctagacacctcttctacagcggaccctgacctcccctggaggtgtatattgggaccgaagaggacacagagaaagactggagggccacctctagcagtcaactccttttgtaataaagctttagtgcgttcaccgtgtgggatgaagtgcagcagggatgagccatgtagaaaggcctttgcgtgtgggtggagacacttcagaagaaggacacattgtgcaacaaaggcgacaagaagctacaaagtgaaggcatggtggcgcatgcctttaatcccaacatttgccaggcagagaggcaggcagatctctgttcaaggcctcacattgagttccagggctttataagaccctatctttttttttcttttttttttctttttttttagtttttggtttttcgagacagggtttctctgtgtagccctggctgtcctggaactctctgtagaccaggctggcctcgaacttcagaaatctgcct

SEQ ID NO: 25860 - DNA, 1131 bp, Mus musculus
ctacatcttgagggcctgtatttcccagtcagcactcagtgagatgccagatctgaggactttgttttgttttcgaagattttccttatataggccaggcttggtttgatcacatggtccttctgcttctgcctccatggtgctggggtgatgggtataaaagacatgtccagccccctttcctaacttttaccattgtaaacagctaaatagatacagggaggctagtgatgtaactcaggggtaagggtacttggcccaagcccaacaatctgagttctatccctgttacccaaatagtggaaagagctgactctactcttgtcctctggcttccacacttgaattgtggcaagcacatgtccccatacacacagcaagtgtcaaaacaaaactcaattagacatgggcttgccacatttaggttttcattccttctcaactaaatatccataactgacaaccttgtggttttgagtcctgtgctcaatgtgtgtgtacactatatatgttgtgtatactatatagtgtacactatatagtgtgtgtacactatgtatgtagtgcatgcctggagtcttcagaggccagaagaggctgttggatcccttggaatcagagttatagatatttgtaaactgccacgtaggtgctgggaactgagcctgagcattttgaaagagcaccaagtattcctaacccctgaactatctttccatcctcattgacaattttttattttattttactttatttttgagacgggagatctttgtagcctggctgccctgggacaccctctataaaactggctggcctcaaacttatagagatccacctacccctgtctcaaatgctgtgattgaatgtgtacaataccactggccttaaacttttctttttagatttatcttatggatatgaatattttgccagcatggatgcatgtgtatcatatgcccatggagaccagaatcagaagccctggaattgcaattacagtttgtgaactagctgccatatgggtactaagaattgaactctagtcctctgcaagaatagcagttaagtgctcttaactgctgagccatctctccatctccagactactttataaatgtcacacaactc

SEQ ID NO: 25861 - DNA, 1174 bp, Mus musculus
tgagcagagccagaagccctgaagagttgagtttggcaacccagctatatgcagggctagtggtcagtctctctggccttcttcccctggccttccgaagctgcctggctcgagtgcatgcagggactttacagcctcccttcacagcccggtttcttcgaaatttggccttgttggtggggtgggagcagcagggtggtgagggcccttcagccttaggggcccggtttggggagtctgcctcagctcacctggctgatctggctcctctcctactacacccagaggaggaagtagctgaagctgctgcctccctccttgcaatatgtccctttccttctgaagccctgtccccttcccaactattgggactagtgagagctggagtacaccacttcttctcttctctaaggctgcatggccctcctggtgtggcttcagcctctcagcttcttacccgcctttctcagacttccccagctgggctcaaggctgtcctacagctgcttgtagagggagccttacatcggggcaacacagaactatttggaggggaaatggatggagacaatgagaccctctcaattgtctcaacccctttggcttctgcctcattgttggacattaaccggaggcatactgcagcagtgccgggtcctggagggatctggtcagttttccatgctggagttatcggccgtggcttaaagccacctaaaattgttcaatctcgaaaccatcaagaagtgatctataacacccagagcctcgttagcctcctagtgcactgctgcagcgcatcagggaacagcgagcgtgagggttgctggggggctcccaccctgagcccagaggcagccaaagcagttgcggtgaccttagtggagagcgtgtgtcctgatgcagctggtgctgagctggcctggcccccagaggatcatgcacgagccaccgtggagcgggatctccgaattggtaggcgcttccgggaacaacctctgctgtttgagcttttgaagctggtagcagctgctcccccagccctgtgctactgctccgtgctgctgcgggggctgctggctgccctcttgagccattgggaagcctctcgacaccctgatacaacccactccccctggcatctggaggcatcctgtatcctggtggctgtcat

SEQ ID NO: 25862 - DNA, 1099 bp, Mus musculus
tgcctctgcctcccaagttctaggattacaggggtagagacttgactcttaaattaaattatagtgaggtgttaggagccagctgtgtgagactcaggagaaagtgctgcttttgtttcaagttggcactgaaaagctgacttccctttgtctccttcacagaccctgtttgggaagatgcttgattacctgcagggctctggggagactccacagacagacattcgttggatgtcagagagtggcattattgatgttttcctaatgcttggcccttcggtttttgatgtctttaggcagtatgctagtctcacaggtaggtgatatttccatttctggctagcaagtgctcttaagttttgctatttcttcagctccagtgaccctttcatttaaacctgcagggacccaggcattgcccccactcttctccctcggctatcaccagagtcgctggaactaccgggatgaggctgatgttttggaagtggatcagggttttgatgatcacaacatgccttgtgatgtcatttggttggacattgaacatgctgatggcaagcggtacttcacttgggaccccacccgatttcctcagcccctcaatatgcttgagcacttggcttccaagaggcggaaggtaagggggtcctgtagctgtgtttggtcttcttgcatagggttgaggcatggtagtctccaccatttctccttctgttctttgttcccagctggtggccattgtggacccccacatcaaggtagactctggctaccgagttcacgaagaattgcgaaaccatgggctgtatgttaaaactcgggatggctctgattacgagggctggtgctggccaggtaggcaggcccataattgaaggggaggctatggagcagccaaagaggtagagatattttgttatgttttggttttgcctctttgggaattcagagttggtgttttctctctcaggctcagctagttaccctgacttcactaatccaaggatgagggcctggtggtctaacatgttcagctttgacaattatgaggtaggaaagactatccatatgccttctgtcttttctacttttcctt

SEQ ID NO: 25863 - DNA, 1323 bp, Mus musculus
gagactagagctgtggcagctgtgtgtgggagtaaatgcctgtaatcctagcacttaaggttgctgagtcaggaatagctttagtcgtagggctgcctaaactgtccaggtagtctaggctaccctgatgtgtttagtatgactctgtctccagggaagagtaagcaaatacagaggtgtaacacaaaattatgaagaccagatcagaggagccatagtatctttggagagctgcacactgcaacctccagctgtatattttgacatatgaatggtatatctaaacctcgcttaagccttctggcagggatggagggggagcactgcctagcttatgcaaggcctttgctaagttcctagtaccaaaaaagagttgtgtttaacttcactctcatcagagtgtcctggacacttgtctagtgacagtggcaggtcagaggatacctagataaaggctgagttccttgctctatatcaggctccttcccctttgacccttttaggagctgtgtggacaggggacaacactgccgaatgggatcatttgaagatctctatccctatgtgtctcagcctggcactggtggggctttccttctgtggaggtaagagaaggagacatttggggttttgattgggataaagtcaaaggacctgggcatgaacaaagaatatttatatgaatggctgccagcgcttcttctttgccattttgcaacctgctccttctcctctcccagcggatgtgggtggcttcttcaagaacccagagccagagctgcttgtgcgctggtaccaaatgggtgcctaccagccgttctttcgggctcatgcccacttggacactgggcggcgagagccatggctgttagcgtctcaataccaagatgcaatccgagatgccttgttccagcgatattctttgctgcccttctggtataccctcttctatcaagctcacaaggaagggtttcctgtcatgaggtaaattagtcagtggggtctgtgtagagtcagatagatgactgggagataatgaggtctggtttgcatctctgggcctatttctttccctttccagggccttgtttgtaaggttttaatatgaatatggaagagaggtctgaggatgtaattcagtagtggagttacttgcctcttaatgtagaaagccatgagttccgtcaagccccaatgtcaccaaaaaaagaaacaggcaaatgaaatgggtaaaagcagttgctatcaaatataggagttcagtctctagaacatgatggaagtagagaattgactcctagaaattgcaagtttttttctgac

SEQ ID NO: 25864 - DNA, 1490 bp, Mus musculus
acctcagtgctgatattgcgtaaacctggtgtcagcgtggcatccgactggagtattcatcttcgataacccaaggaacttgttctgagttgggaggaagggcatgatggtattgagttaccttttcttttgccttggagtttgaccctacctagatttcaccttctaattctacgacccagattctgtcaacatctgggcaagatgacagggctgtcctagggctctgaattccacttgtgacctagtctttccttctgtgtgttaccaagcccttcatactcagtatcctgttgctgtaactggagcacagtcatttgtgaagaccaaggggccttgtcgttctttttctcttccttagggtccctaccttctccttagaccccatctattcaagcctcttgtttgttgatgccatttcttggaagaagatgagggcagtgaacattagggttccttttcttcttccctgttccctcctatccaaaatgcccatcctttcattccttcccctgaatgtccccttctctgttccactgatacactgggaccaccccttacttggtaagggacaaatggatcaagattgaggttcctggagaacgtcctcttccttctcatctcaaccttgtcttcctgtttctttccagagctgctgcatttctcccatcttagagggagacgcttccacacaattaggagggcaaggttattaaacttcttttgcccctctggtccccttgggacactcaagatagagacatgagttgtggtttcactgaatcacggtcacctgtatttattgctgggaagaagactgagggtggggggagacgatcatgtgtacccaggggtggcttcaagccctggtaagcgggttgagggaggactcaggaaccaggagaactatttgtgggaattttttttacttcctctgggttcccaactgtgacaagttttgataaaaaggagaaacaataaaaaacgaaacaaaacataaataataattggatgtctgaattatacttgtaaactgaacaaaatcgctccagtaaatagtggcctaccattttattctgtataagctgcttcatttcagcaaaatgagccaacctgagggcggctttagcttgagatgctagtcctttagaagaacccagcaatgggtctcaggaggtgaactggtcagaaaactgctttgtctcgcaaatataggagcctgagtttgatccacagactcactgtaaagaaagctgagtgtgtaagcctaattctttttttgtttttttttgtttttttcgagatagtttctctgtataaccctggctgtcctggaactcactttgtagaccaggctggcctagaactcagaaatccacctgcctctgcctcccgagtgctgggattaaaggtgtgcgccaccaccgccaggctgtaagcctaattcttgggaggcagagacagttggatccttggggctctggccagct

SEQ ID NO: 25865 - DNA, 1220 bp, Mus musculus
taaaaaggctactgagagtcagagtagagcccctgccatttcatcttacagactaatatgaacccatgtatatatcagagagacaaggaacacagctccattttagaggcagtaaagttctcccaccccaatattttatacattgtataccaacactgaatgtagaagaggtggggtggggtggaatccattttagatcttaacaccccagagccctggttatggctggtcctgaccctaaactctccttcacaggtactggtatggcacacccggacagagaaacctaagatgaagcaggaggagcagctacaacggcagggccagggctcagacccagccattgaggtgtgatggcaacctcaccctgacttctaccttattttaggcacataccttgtgggactgggctccaggccagcccaggatgtggttttttttttaaagacctgacccctgagaaccagaggcagcccctccaaccacagggtgtgtcccagttgcttccctcccttcccccagcctgccatgtggcactgcccacatgttggggacaagcagcttctctagtgagccagatcagccccatctggggcggagcaggacagatggactcagaaaggagggtagctgtgggaaaagggtaacttattggggacaagcatgcagtggggggctagaggagctgggctggaccctccccacctgagcatgcgatccccttcctacctctagaataaagaatctcaacccggaggggcttcatggtttccttcatttggcagacctacccaagagatcaggtacatgttcttacataggctgggttcctcctctgcagagtctttcaggctcccagccaagagagagagacagagacagagagaggaagagagcgggagaacagtgatttctgtccacaaactttattgtagaatctggatgctagaaacattctctagtcctttggttgtcacttccctgtcgccctcatctgttctcaaccttggtggtttccaacgagacagctgggttccaggacacctggacttctcattccagcccagctccgcttgctcttaactcctataaccccagggacctttccttccctgagtctgagtaacgaattgtaagttttccacatttgtccatctttccccttcccacccccacctcttcaggtttctaggcctcagctagaacttccttgggaggtt

SEQ ID NO: 25866 - DNA, 1198 bp, Mus musculus
ctggggaggcagaggcaggtggatttctgagttcaaggccagcctggtctacaaagtgagttccaggacagccagggctatacagagaaaccctgtctcggaaaaccaaaaaccaaaccaaaacaacccccccccccaaaaaaaaaaaaccaaaccaaaacaaaccaaaacaaaggaaaaagccggctgcaccaagaagacagtgctttaggatagctccttagggcaagtgggggaggggcagctgatgagaaactgttagtgctttatccagaggctctaggcatgtctaaggctacattctctgtttctgagacagggttccctctgtcacctgcgtttgtagaccagggtggcccccaactcagagatctgtctgccccactaggactgggattaaggatctgcaccatcatgcaggcctaacttaaagccaagccaagtcagtgagaacttgggaagcacacagtggggttcatagtggacgctatgcctatgatcagttcatgtcgtcaagtgagggaagaatgacggctgagtaggcgatttccacctaggggatgtggctggaggctgcaaactgctgaggaaccgctatgagagcagagaccgggagtgggctacctatacctgtgtgctgggcttccacgtctatggtgagccaggatctggaatccgttaggagggctggggaaacaaggaagaacccattctgccctcagaatcctgggcgtgtgccacctcggggtgggggtcatagtggcaaatccaggctaggaggccccttgggattgtctggagcgcagtggcaacctgaagacctgaaacactgcaactctaggttgtggtagcagcctgactcaggccacctgttgtgttaggtgtgtggcctgatggctctgatgggacagacatcaactccctttgccgctcccacaatgaacgggtggtggctgtggcagacgacttctgcaaagtacacctctttcagtacccatgtgctcgagccaaggtgaggcttcaggggaccattgggcccaggtgggtaggtttggtaccctgccattgctgcaaccagttgttttttttttttttttctctcatctaggcgccaagtcgtatgtactcaggccatggcagccatgtgactagtgtccggttcacgcacgacgactcataccttgtctccttaggtggc

SEQ ID NO: 25867 - DNA, 1217 bp, Mus musculus
caggagtctgatgcccttgcttggccttcacaggcattgcgtgcatgtggtgcagacatatatgcaggcaaaaaagcgaagacgtaaaaggaaagggaaaagtcttaaggtcagtctgagctgtgtgtacaccttgtttctcttgtttgtttgagacagggcttctctatgtagtcctaggtgtcctagaactcactatgtagaccatgctggcctccaactcacagagatccttctgcctcctgaatgctgggatcaaaggcatgtaccaccattgcctggcttcaaaggactgtggagaatgagttacataaatgagttatgtaaggctgcagagtaaagcctgtacatagaaggtgaaggaggaggaagaggaggaggaagaggaggaggaggaggaggaggaggaggaggattcattcccttttatctccattacagccagacccaaaggctccaaaggttccagagacttcatccttggactcagcccttgcttcttccctggatcctcaggcgctggcctgcaccccagcttctcctctagactcactgtctccaacttctgttcaagagtctgagtccctggactttgacaccccatcttctctggcaccacagacacccgactctgctttgggctctgacactgtcacctctcctcagtctctgcctccagtttcaccactgcaggaggacaggaaagaggggaaacaggggaaagagctagaattagcagaagaagcctcaaaggacgagaaggaggaggcagcagcagtgttagagctggtgggatctattctccgtggctgtgtccctggagtgtaccgagtccaaactgtgccctctgcccggcgtcctgtggtcaagttctgtcatcggccttcaggtcttcatggagatgtatccctcagtaaccggtacttttgtgtggggttgaaggctggctctaaggtctggggtatatgaggagggggtcctgatgtggacgagcttatgcctgctgaatttgtttttcttctttggttcagtcctcctttcttccacgaatgtcacctcctacctggcttccatttcagtgtttttttttcctttggaatactttgtgcgtttgagtcagagtcttgctccattgtccagactggcctcaagcctgtgattctcctgccttagcttcctaactcctggggttacaggcatgtgctgctatgcttgac

SEQ ID NO: 25868 - DNA, 1202 bp, Mus musculus
aaggttctgatgtggcatggagaggacagtggacctggaggtaaggggcttttgctgtggtttgaaatctgttcatggcctttccattattgatcttgtttctgccattccctcttggcaggtcttagagccttcttttcgccaggccttccccaataccaaccggtggttccttacctgcattaaccagccccagttcagggctatcttgggggaggtgaagctgtgtgagaagatggctcagtttgatggtaagtctgaagagactgggcatgtgatagggtcagggtccagttggcgcctgtcaaccctttgacttgcatagccttgttcacccagagaacgtgggtgtcacccagtaactgacgtttacatcaaactgcagtgctgtgtgacgatgtgtgttttgcttcttgaggcttcttaggctgtccgagccatcactttccctgcctgctgccgggtttgggagaaaaaagaaagaggctgtatgtttactttcttccatcctttgctagctaagaagtttgcagagagccagcctaaaaaagataccccaaggaaagaaaagggttcacgagaggagaaacagaaaccccaggctgagcggaaggaggaaaaaaaggcagctgccccagctcctgaggaagagatggatgagtgtgagcaggcattggctgctgagcccaaggccaaggaccctttcgctcacctgcccaagaggtaagctggtgctcttctcacatctagggctacgatgttaggttgttacaatactgatgggtgtaagtatagtccaggtctcatgtgtccaggttgtgctgagggtctgaactcagttcctcatgcttgcatagcaagcactttacccactgagccatgtcctcagcctcttggaatttttctaacagaaggacaaaagcctgtttaaagtggagtgtagtgggggttgtttttgtttttttcagatagggtcttcctgtggctcaaaggcagtctatagacctgcctgtgcctcccaagcatgatgcatgccaccatgccttcctttgttattgtgcagaccaggctgccttgaacctggaccttgtgcccttgcacctcaagtactagcattacaggtgtgtccccaaagtctagcatctctgcccttcctaaagccaccttcctgtgcacaataatggtctatttcataatacttt

SEQ ID NO: 25869 - DNA, 1321 bp, Mus musculus
gatggctggtccctgtggtatgccgagtaccgcttccctgaagagctgacccagaccttcatgagttgcaacctcatcactggtgagaagaggagtgggtctgggaggaagaggagccaaggtagtgggtgacatgattccagagactagataagtctccctttccccccctccagggatgtttcagcgattggacaaactgaggaagaatgcctttgctagtgttatcctctttggaaccaacaacagcagctccatttctggtgtttgggtcttccgaggccaagagcttgcctttccggtaaggaagatgttggggggagggaggtaataatatgggaaactaggagtcttgagccatggccagtgggtatgaaggaagaattctggactaaatataggaagtatgctcaaatcagtgggaatcctggcatctgctgtcatgtctgagctagaatttggacagaaatggtgcctcgatgtccagtgtctaaccacatgcctttgtactgttttgttttttaaaaatcctcagctgagtccagattggcaggtggactatgagtcgtatacatggcggaaactggatcctgggagcgaggaaacccagaccctggttcgagagtacttttcctgggaggggaccttccagcatgtgggcaaagccgtcaatcaaggcaagatcttcaagtgaacaagtcttgccagtcgcctagctgcctgcacctacccttcaagggagatgggggtcattaaagaaaactgaacattgaactttttcctgtcctgcctcctttgtgattggtggcttcttcaaagtttttgccgatgcctgagacatccttgtggcagggcagaagttttcagaagagcagaagtagaggcctggcctcagttttgtctttattgccctgcttcctacaatgatgctgttctagctggggaagatgagaaacagactgggtggtgacatagggcttaattattaccaaattcttagaagctgtgtctcccagactgtaaccattgaagaaagtgtctgctgagctaaggggtagctcacagtgtgcagaggtgttttctgtcatagctgctgttctctgtctgtctgggttgggttctggagtaacctcgtatgcagtcctcatgctcaggagtcttcatagggcctgcatctctccagtacagttaagtgctctacagaagatggtgggatagggagggctcatttcctcctagatgccttgcggcataggtaggtgagtggctggatggcactgtccagcttaaatgcttcatactctagaagactagccacttg

SEQ ID NO: 25870 - DNA, 1106 bp, Mus musculus
agggagaatatgatgtcacagtgccaagggcagaaggtgagattaaagttcctgatgttgaacttaaaagtgctaaactggacattgatgttccaaatgtggatgttcaaggtcctgaattgcatatgaagatgcccaagataaaaatgcccaagtttggcatgccaggcttcaaggcagagagcccagaaatggaggtgaatctcccaaagtctgacattgatgtctcaggacccaatgtggatgtcaaagttccagatgtgaacattgaaggacctgaaggaaagctgaagggtcctaagctgaagatgcctgagatgaacatcaaggccccaaagatatccatgcctgatgtggatttgcatatgaaaggccccaaagttaaaggagaatatgatgtcacaatgccaaagctggaaggagacttgaaaggccccaaagtagatgtcagtgttccagatgttgatgttcatggtcccgactggaacttgaaaatgccaaagattaaaatgcccaaattcagcatgcctagtctcaaaggtgaaggcccagagttggatgtgaacatgcccaaggctgatgtggacatttctgtaccaaagctagatattagtgctccagatctgaaccttgagggaccagaagggaagttgaaaggccccaaatttaagatgcctgagatgcacttcaaggctccaaaggtgtctctaccagatgtggatctggatctcaaaggacccaaaatgaaaggaaatctagacatgtctgcaccaaaaatagagggagagatgaaagctccagatgtggacattaaaggtccaaatgtagatattaaagcaccagaagtggatgtgcaaggcccagaatggagcctgaagatgccaaagatgaaaatgcccaagttcagtatgcctactctcaaaggtgagggtccagatgtggatgtgagcttgcctaaggctactattgatgtctcaggacctaaacttgacattgaaacctcagatgtgagccttgagggaccagaaggaaagctgaagggccccaagtttaagatgcctgacatgcacttcaaggcacccaagatctccatgcctgatgtggac

SEQ ID NO: 25871 - DNA, 1099 bp, Mus musculus
tcgttttaagcttcctaaatttaatttttctgggtccaaagttcaaacacctgaagtggatgtcaaacttaaaaagccagatgttgatataacagctccaaaagttgatattaatgctccagaagttgaagtccaaggtaaagtgaaaggatccaagtttaaaatgccctttctgagcatttcatctcccaaagtctccatgcccgatgtggagctaaacttgaagggtcctaaagtcaaaggagacctagatgcagcaggcccaaatttagaaggagacttcaaaggacccaaagtggacattaaagcaccagatgttcaacttaatgcaccagatgtggatgttcatggaccagaatggaatctaaaaatgcccaaaatgaaaatgcccaagtttggtgtgtctggcataaaagcagaagggcctgatgtggctgtggatttaccaaaaggagacattaatatagaaggtcccagtatgaatattgagggcccagaactcaatgtagaatgtccagagggaagcttaaaaggccccaaatttaagatgcctgagatgaacatcaaagcccctaagatctccatgcctgatattgacttaaacctgaaaggtcccaaagtgaagggtgatgtggatgtgtctctacccaaagtggaaggtgagattaaagttcctgaagttgacatcaaaggccccaaagtggacattgatgttccagatgtggatgttcatggcccagactggcacctgaagatgcccaaggtgaaaatgcccaagttcagcatgcctggcttcaaaggagagggcccagaagtggatgtgagcctgcctaaggctaacattgatgtctcaggacccaaggtggacattgatgttccagatgtgaacattgaagggccagatgcaaaactgaagggccccaagttcaagatgcctgagatgaacatcaaggctccaaagatctccatgcctgatattgacttaaacctgaaaggccccaaagtgaagggtgatgtggatgtgtctctgcccaaagtggaaggtgagattaaagttcctgaagttgacatcaaaggccccaaagtggacattgatgtt

SEQ ID NO: 25872 - DNA, 1104 bp, Mus musculus
aaggccccaaagtgaagggtgatgtggatgtgtctctgcccaaagtggaaggtgagattaaagttcctgaagttgacatcaaagaccccaaagtggacattgatgttccagatgtggatgtccatggcccagactggcacctgaagatgcccaaaataaaaatgcccaagttcagcatgcctggcttcaaaggagaaggcccagaagtggatgtaaatctgcccaaggctgaccttgatgtctcaggacccaaggtggacattgatgttcctgatgtgaatattgaaggtccagatgcaaagctgaagggccccaagttcaagatgcctgagatgaacatcaaggctccaaagatctccatgccagatttacatcttaagggtcccaaagtgaagggtgatgtagatgtttccctgcccaaagtggaaggtgacctcaaaggcccagatgttgacatcaaaggtcccaaaatggacatcaatgctccagatatggacgtgcagggcccagactggcacctgaagatgcccaaaatgaaaatgcccaagttcagcatgcctggcttcaaagcagagggcccagaagtggatgtgaacctgcccaaggttgaccttgatgtctcaggacccaaggtggacattgatgttcctgatgtgaatattgaaggaccagatgcaaaactgaagggtcccaagttcaagatgcctgagatgaacatcaaggcccccaagatctccatgcctgacattgacttaaacctgaaaggccccaaagtgaagggtgatgtggatatgtctctgcccaaagtggaaggtgagattaaagtccctgaagttgacatcaaaggccccaaagtggacattgatgttccagatgtggatgttcatggcccagactggcacttgaagatgcccaaggtgaaaatgcccaagttcagcatgcctggcttcaagggagaaggccctgaagtagatgtgaacctgcccaaggctgaccttgatgtctcaggacccaaggtggacattgatgttcctgatgtgaatattgaaggtccagatgcaaagctgaagggtcctaagttcaagatgcctgagatgaacatca

SEQ ID NO: 25873 - DNA, 1128 bp, Mus musculus
ccgactgtcttcctcctctagcaacgacagtgggaccaaggttggtatccagcttcctgaggtagaactgtcagtttccacaaagaaagagtagtgggccttcatgcatgtacatatatatatatataaaacatcagccttgggtgtgtttgtatataaactccaaagagaaacaccccaatagcctaagcaataatgcaaagatcttgcccctgccagtggcaagtgccgacaaaccaagtgcctgtaggctcctgggactctgcagctaggtaaagagttctaagttcatctggcccacgtgcaaagtcaacagtattgccttaagatttcagtttttttttttttttttggtttctgttttcttttctttttcctttttctttctttctttttttttttgcattgaacgctgagagctcgtgtttactaagcaagcttttgtgtttatcttccttatttttactgaacatcttcagtacctgggtaatggaaacccactcttttttcattgtaatgactttgggggcttttgtgagtaagggagggtgggataaaaggtggcagagggagcaaggtcttaattgctctgaaggttggacccgtgaagccctggcatagacctgaagaggtggcagccagtgggtggttgtttctcaatctctgtagcatgactttttaatccccaggtgtgttagtcccagcctagtttggtgctcgaggtgagaggggatttgaatctgtttgcaaattgtccaacccaccaggtcaacgtgaggggcttacattctgggtttgataagaaaagtgttcattcatgactgctatgtcctgagaaaagttccgatttcttttaacaaatgtcatcatgattaaggaaatgtctggcactttaatggcaaattaattgagaatgtatgaaagtcatgaatgtacaagccaaataaagctctttattaaccctgatgtatcgtgctcttgtattctttgttgaagggatgaagccaagggaggctgcacacacagccctcatgggtcagacttgatccacctgatgctattgctacttttgttagtgactttaaggcattacctctgcacaggtaccagaaggaagtctttgcttct

SEQ ID NO: 25874 - DNA, 1144 bp, Mus musculus
catctttatccttatcattagaacacggtacaaccttcatccctggactgcaatgaccagaataaacccaaggaagctatcaacaaagctggggcagcatcagactccaccccagatgcaggtgagtgaagtggtggggactgaaaacatgacagccttcattagagaaggagtgtatgcagagataaggctcaggaaagcaccggcaggtgtgctgacttcctgcgctgtggatatggaatccctggcctgctggacccagaaattcaaaaccttctctcctacctcttttaaaaaatatttttattatttttaattatgtgtgtgtgtgtgtctgatgtctgtatgagtatgtacatttgagcacaagtgctggtggaggtcataggcgagaggcgtaagtgccctggagctggcatgataggtagttctgtcctcagcaggagctgcaaattcttttaactgagccatctctccagcccccatgtttttgtttttgttatttttgattcaaggtcttcctctgtactttagaccacccctagactcacagtaacttgaaatcttcctgccttattttcccaagtgctgggtctacagattggggtcactatgtcttagttacccttccatctcatacgagcagagagagtggttttcatctattgctgtgaggggaatatgctgatagaccttctcttgtgagggtctcttctgtgaataacacagtggggtctgagcaaggtgcaacacacatttaatcccaggatttgggggcagaggcaggtagactctgagtcgaaggccagtctgatctacaggatgagttctgggccaaccaaggttaaatagaatctgttcaaaaacaaaacaaaacaacaaccaaaacataaaccgaagtggccatatcacatactgaggacaggttccacggtagcctctctttccccataagctcacaaatgtaataattcctccacagatttgtggatttatcttcaggttctttccctccctcattatctgggtaaccttggggggcctgctgaatcccaagcccatactcctccaagcacttctgaggtgcccagcactggactccatctcttcctgctctgacccccaccctcctgatttctgtgct

SEQ ID NO: 25875 - DNA, 1110 bp, Mus musculus
atcaattagatgtagacatggaaaacttacgcagtctgtccctccttttgttgccttgatcagtaaatcaatgaatgcttggttgagggtcgggttctgaagcgatgagagatgcctgcctgtattaagaccagggaaaatggaagccttgaggagcctacatctccatcatgtaaggctagaaaggaggtgttagattttgacccacggaactgcctctgagctatagaagtgccatttggattgggagaatggcactttgcagaggctaggctaggggagtgtgggaagaaggactgaaaaaaaaaagtgtaagaaagacccaggtccaggtgaagctcaaaatgttacagagttcattcttagtcacaggaacactggacaagatgttcaagaaggttctctttgtctgtgaggggggagtggatctttatccaaaaagctcaaacttctccaacacatatctgggcacttgaagagtctcccttgctgcccgagctgtagactattggagtttcttaatgtctgggatttttcttggctcccaaaagccagccccacctgaaccagccccagttgtcctcattggggcttgatagggcacatgacatttccagcctctccaacagcgggggtggcagatggctggagagatgacaccgtgagtcactaaggagtagctgccagcgctttaggacagtcccaagcgcagtgaatcaaatgttcagggtggtgagcatgacgcagaaagcagtctcctcggtggagagcactctgtgcacctgtcagcactcaggaaatggcatgtctgccgtgatgtgtctgctcagcttcttagtctagcagggatccccttctctctgggaagaaactgattacctttaacgtgccactaataaaatttattttttgaaagaaaagagtgtggttaggtgtcactttgaccaagaccagaacagatacaagctcccttcttggtcctttagcgcaggcagatataatagttgagaggaccttttgcagaaatgtaagtgtggcagtatatcctgcctcgtggagtttagtagggagtgttttagagcattgaactttctctgagtgtgttaaggc

SEQ ID NO: 25876 - DNA, 2441 bp, Mus musculus
tggagacaggcttgtcttcacacttagctctgccattcacctaccatgtgccgtgagacaagtctctttctacaaaatagggagaataaagtattgcctaagacaactcctgggggcctttgggctcagctgctagaagatggagataaaaggataattgttgggtggaggcgagcaggaggttgctagaggagcagataggataggagcaaggcatgctgtcatgaaaaggatgactgggctctgtgggtaggtgcaggggtcagggaagctcccagagagcaccggacagtgatccaggcctctgttttcttcaggcacccaactcagccaggccattgtccaccagtactaccaccctccaaacattctagagctcttcggatctattctcccactggacttggaggacatctttaagaagaggaagactcgctaccacaagcgcactagctctgctgtttggaactcaccacccctgaaagccaccatggtccccagcagtggggactagactatctagcctgaagagtccatgaggcaggccctcagtcattttggagcacagggcccatgtgtgtctttctgtttgtttctctgtctgttttgatgttgggctggtgcacttctgcctgatatgccattgttcaggtggctatcagtgtcctctgtttgtcaggtattcccagacctgttgggaggatgggcttcatgcctggggaagaaccaggttgagcactgatggctctgtaggcagtactctgtaaataaatagattgttacagttcagttgaatgacttttagtttctagggtttgtgaggtagtttaataaagtgtatagcccaaagtctgctgtggatattgtgaagactagaggcttcattggaatattggtctgcagcagtatgtcttgtgcctttaccttcagtgtgtgcctagaccacttggttgggtcagatggggtcccacccagaggttctaatgacagacatgtcagcatgtcctgatagggcatctgaacgtgcttcctgttggtaaatggagcctattccttgggaaaggcctggcccgtgactcagctctgccacattgtccttcagcctcaccacttctcaagctctgccatggttgctgctggggattggaaggacttgaggaagtcctcgtgctgggagctaatcaggaaaggaatgcactcaggctgactttgggacccgtgcttacaaacgggggggggggggggggggggaggtgcggaggtttaaactgcaaaaccaccagctactccataaacgctcagtgaaggatggccttgcttctgatagctcctgatgccatttttcctggaactggggttagccacctgtggcaggaaggacaaatcaaagtatagttattttggatatagctgtagtaaagccaatttgttttcccattacctccaactccgtacgtgatctgagaagctgacaggcttactatggaaacctgttgagaagatttttgccggttgctttaggtcaaaatacaaatgcagtagtgctttaaacagggaacagcggacacagacgtctgaagtctagactcttcccaccaatacagagttcattcagatgtgtacacacagtgcagcttattccgtgtatcctcacatgtaactgtcagggaaactggaaggcatgtctgtcttaagccacaaaatctaactcacttgttagcacatttatctagtgcttagaaaaccaaaggatggcaaataacatggtgaatgcacaggttcttccatgttcaattcaggacaccaactttttaagtaatggatttgtagccagtaccgtaggacaaaaaggaaaaggtaagaattaaaattctccgggggatggggtgtgcctcagtgatcgaaactgtgcttataatgctttgggttcagtaccagcacggcaatcttgagaagatgatgtagagaattgagtatatctagtaaaacgagtgaacttcctgtacaagcctccccaagtgttaggatcatagaatagtagtgtctggagattttaggaatacacttgacaggagtcggaaactcagggaaactcagtgaaaactaaaaacactgttgagagaaattaacaaagacaagtggggggagtgggggcagataccatactcatgggtggaaatccttatgaaaatctcaggctccgcctccagatgccccaccaagtccaataccttttttctggcttatggtgggggcagggtagaagtttatgaaaaatgggttcaaaaatgttagctgcagcagacttacaaaataagacatcacagttgttgagatattgtcaaagtcagcgtgatttttgcataaagacaagtctggaactctgtcttctagaagtagacctatgcttatctgatcgcttggcttttgacagaggcgga

SEQ ID NO: 25877 - DNA, 1053 bp, Mus musculus
gattgcctgaaagggtctcagtatctccagaagcttcatatcctcccttcttccttcctcccgtcctctgtcctccctcacccccccccccccttttttttaaagacaggatttctgtacgtagcccaggctgttctggaactctctatagaccaggctggttttgaactcaagagaacctcctgcttctgcctcctgagtgcaagaattaaaggcgtgcactaccacctcctagttcccctttggttgtctcatcacattgagtctttcacatcagttcagtctccatccaggctttagcctctttaacttggttgtcgcacatgtccttgtttactgtgtaagattatttgatgctggaaggtaaaaagaccagacagtggctttgttggttttccttaccactgaggctgcggcacctggcccggagcccagtacatagtagcagatgaatgtttgttgagtgaataggctgcttgtgtcggggcccgtgtaatgtcagacatttctctttccaaggtattgattcctagcctagtgaagaggtggagctgtgcctgttacgcaagctacataaagctaatagcttcattgaggttctgagggtgaatgaggaagagagccagggcgcagtgagggctgtgtgtctgtgaaaggagcagtgatcgtgctcctgccacaaacttcctgcacctctggcctggctcctgactggtttctgatggcatcttttgtttttgtttgtccttcaggtcacagttacctggagaggctcctgaatgttgaagtgcctcagaatgttgggtaagttccatgctagagcttttacaggggtgctcagggcacattgcaggacccatctctccatggcactgctgacaaccatgctcccttagcttggtccccatgtaaccaggcagcaagcaacatgactgtcaagtccccaggcaacattccatcagcatcacttgttagcctgagtgtgtgaactccatgcttgtaaagaatgtagaacaaccatttaaaatgaggtgtagtagagtggtagtctgg

SEQ ID NO: 25878 - DNA, 1189 bp, Mus musculus
ggggaccacagccccagggcctatttgccttctggatctatgtgaccagaaactcctggactttgtctgcaatgtggacaacaaggacttcatgtggctcaaggagattgaggaggaggctgagcgcatgtttatcaggtaaaggcaggggcatgctggggtgggtgtctccataggtcagggttccttcctaagtgcctcatgtgctggggccaacctggtgcagtgaccagaagaagaggagactgagtctttttcctggctcactgtggtaagctgtgtctgagtgtatggcctgtggtgtcttgtcttggaacttacttccctgctttaagttcacgaggaagttctctgagggcccagctgctgatttcacagagctttggagagcttttctctagcctgacttgtcattgccgagaatggggtggaatgtagtctaataagagaaggggcagcccagtagttcccagggagcctcatgttcaccctccttgtacttacagagaattcagcaatgagccagagctgatgcccaaaactccttctcagaaaaaccgtcggaagaagaggcgggtgtctaacattcaggatgaaaacagagatcccgtgaggaaaaggtaggaaaggactgggaggctgtgctggaggatgtctggagccttggaagctcctcaatgtgctgataggagcagcagctggaggcaatagtgatttgtggcccacgctgactctgacagttgagatgccatgggtaaaatgaactgttaacccagatgagagtacaggtgtagatttctgtgcattggtgctgcgggtggaggcagggagttaggggtttggaagaggggagaggcaccagagttgtggcccaggttgctggttcttacctctgttattggatttgttattattctctgcaggaatggtggtgactgcagcactcagataaagatgctagtcattctaatcaggcagccctggtacataacatcaaccacagctggctcaacagctgtgtgtccttgggatgaaatccgcatctccattttctcatcttccaagctgagtgaatggtgcctgcctcccagggccattatctcagtcctgtagactgagcatgagtgaagtttgcagaaagtgcttagcacagtgtaacaacagttaagaaggtggtgtgaatttagtc

SEQ ID NO: 25879 - DNA, 1059 bp, Mus musculus
tttgtaagacgaagtcgctgtctggtgtatgtcacgactaacaacacgcactttgcctagagtttagggatatcctgtgagaattgaaaatcatcctcatcggtaccctctgtgcccatctgggacccagatgcctctgcagtacggctagatccaactacgcccgccccgggccacagaaacagcgcgcttgttgccaggcaccgctcttgcagaagctcagagccccttgcgtcgcctcacactcacacaggctcctccccgcccgcgccctgcgggtttgggcaacacgcccacaggaagaggcggggcggcgcggcccgctgcgctgattggccagcgctcgcctgacgcaggatcccgctataagtgcggcccgctgtcccctcctgcgccagacgttctcgcccagagtcgccgcggtttcctgcttcaacagtgcttgaacggaacccggtgctcgacccctccgacccccgccggccgcttcgagcctgagccctttgcaacttcgtcgttccgccgctccagcgtcgccaccgcgcctcgccccgccgccaccatgaccaccgcgtctccctcgcaagtgcgccagaactaccaccaggacgcggaggctgccatcaaccgccagatcaacctggagttgtatgcctcctacgtctatctgtctatggtgagtgcggcctcctcagggccacttggggagccggcggagggtgggtcggggcgtggcctgctgcgggcttccccgccttccagcgcccttctggaaaatggagtttgttcggggttctttcctaaggcaggcagccctgccgtggcaagtctgagcacatagcaccttgtggctcctgcatagatcaggcatgtcattacaccacttttttttgaagccttagggcagtacgactgtcagcctggccaatcaaccctgcagttaggtgcattttctgcacgctcgtcccctccgatcacgtggcctacaagcttctctgtttggttatgcatcctgctccagttcctcctggagtatggcgggtctgcttggtcatggtg

SEQ ID NO: 25880 - DNA, 1818 bp, Mus musculus
agtttctgaaaaacaggtttggggaaggcctggactttgaaacaggtccaacttctgtggctgtcattcctggaatatgaatacactgagtgcttaaaactgaaaatcaaagcttctcctaatatatttgtgctaaaatgcaatgccctcaattgttaacagggcatgatgcattaattttataaatcagtggttgtttgtagagctggaagccttgtgaccttgtgttagctactttttacatgattggtgaaggaggagaaaaatggcctcccaatgcaggatactctagcaccctacctcttagacaagtagatttgggcttggcttaaatttttttctctgcactaataccgagccgtagaacacttgataaagccaagtcccaaggtttgccttcccatccttactgaacttttaaaaggccgagtaggatggctcacagcctttgcatacagccattgcggtgccttgcagtggagatcagtaacatgtaccctttccactttcagtcttgttattttgaccgagatgatgtggctctgaagaactttgccaaatactttctccaccaatctcatgaggagagggagcatgccgagaaactgatgaagctgcagaaccagcgaggtggccgaatcttcctgcaggatataaaggtaagtagatcctaggggtgccctaaatgagcggttagactttattcaggaaatgatggtgcactgaggcttctgtccttgtgttgttggcaaatggcagttgtcgagcatcctgcggtgaaagcttagaggaaattgagggcaatcctttgcccagagcatgatggctcagtgtgaggtgtttcctggcttgggttgattggtagatgacttgacccgatgtttcattcagaaaccagaccgtgatgactgggagagcgggctgaatgcaatggagtgtgcactgcacttggaaaagagtgtgaatcagtcactactggaactgcacaaactggctactgacaagaatgatccccacgtgagtatcggaaacgtgggatgagtggaggagatgatttgccgcaggacttgggagagctgaccagtaactttgtcccatgttctctttcctagttatgtgacttcattgagacgtattatctgagtgaacaggtgaaatccattaaagaactgggtgaccacgtgaccaacttacgcaagatgggtgcccctgaagctggcatggcagaatatctctttgacaagcacaccctgggacacggtgatgagagctaagctgacttccccaaagccacgtgactttactggtcactgaggcagtgcatgcatgtcaggctgccttcatcttttctataagttgcaccaaaacatctgcttaagttctttaatttgtaccatttcttcaaataaagaattttggtacccagcttcttttctttgtgattgaggataagcattccagcttccagttgcttcaccgccagttatactaatcacactgaaacacctaaaagaatattcacgtttattaaactccttagtttgggaaagatcgtaaaatacaggtgttttcaggcaggactattaagtactcttggttctgagttacatgctagactgtcgtgggaacacactcctgggtgtcgctgcttgtgtgcctttgactgggtcagtgccctgctgggcatccttgcaagtcagggccaggctgtgaggcatcactcatagagaacaggtttggtgccagcttcatccctgtgggagagtattcatagcatgagttgactgaggacaaaggtggaagcaggtttaaaacaca

SEQ ID NO: 25881 - DNA, 1171 bp, Mus musculus
cagtggagccactgtgaagtcctgagacactgggcaattttatgtttcatttatctgtgaacccagtctgcctagaaatgcgcagtcctgtcagtcaaaagaacaccagtgtccagatcgtacagcaagtcttttcctccagcccattcgcaggtcaccagatgacctgctgggacccactgctgtgtgatctatctcacagcagcagctgtcctctgaacagtactttccaagccagctgagccgcaagaggcccaaggtatggtttcccaagtggctgtaatctccttctgttccatgaccttcttgcctgaggccttctcctccctcccagtggccccgagggctcctccagctatacacacagacagacacgtacagaaacctctgggcttccagttatacacacagatagacacgcacagatgttcaggctgctccaacagccccagagaagcctctgagtctgctgtctggcataagctcatactacctcaaagatagtaggggttttgttttcaatagcacctcattcctgatcatctctttcacctgaactaactgccccactgcctgcctctacccctggggccagcctcccgtacaatatgacatttggtatgatggggtaaaggggaagagatggcccagccaactggtattccccatgtatgctctgattcttctgctgacactgtgctgcctcagggtgagtatcttcccctctctggtgtcagcttcttggcctgtgagatgttagggtttcattaggctgggcttttaaatattagagaagtccatgacttgttaggggacagaacccaccccacaactttggggatattggccaatagcctcagttgagcactgtaacaagagaggagctattcatgtagagagcagggatgtatgtcttctgctctggaccttaggtagcgctcaaggcagaagctaggagtgtatatgagaaaacacaagctcatggatgtgagcctaaatttaccttcacatctgagacacctatccctgccgggttcccttcagtcaccctcccactccccagatctctgggtgtcagctgccatagaccccacattcacagttggcagggtttggcctgaggcattctgggtattggggggccaggtcctgcccaagcagcaagtggaag

SEQ ID NO: 25882 - DNA, 2029 bp, Mus musculus
ctgtctacccagggctagaagaggacctcccctctctcctttcccaggggtttctctggggtgtattagtcagtagcccacagctcctgtggtatcctgtggtaagtggtgagccctagtcagtagctgagaggaagcacctgccgccccaacatgacttcccacaagtctcactgcctggaggccgaggttccttccatctggttcctgagccctgcccccctctctctatttgcagttcactgaagaagtctggggagctgtggctggatgcttacctccataaatgaagctgccgtcctccgggcaccctcgggaaaggggcactgttgggtgacagccagagggaggggagggcttttgttctgaagggttctcatgagactgaagtgtctgctgcctcacattccccgggcttgcatcctttcttgttattcctcttccctcacccctacctactccattctcatggagttccccctttgtcagccctgaccccatcccctctgcctcccagtcccttctcccagagagccggagaggtggttgtctcaggtggttacgcgtctgcctttaacttctgcacctaaagattcctggtatgagattctgctcctggcagcctagtccccacccccttctgtcccacagacactctgggggcctgtggaacaggagtccaggacttggctctacactccctgtcagcattatggtgtagtcatttgggtgaagacatgcttcgttctgagtgtctttcccatggctgggattggtacttgaggcttctttccagctgccaaggaccaccttagactttgaggaccaaggaaaagttctctcatgcccaccatcacaactccagaccatagggtttgtacaggttctatttcatcatctacccaactccagaaaccaaagggagtgttccttgtgcgggctcaggagaggcagtagccaggttgaaggagggactgaccagcctggaactttaacctctcccactacagtcaggtgcttctgagttaaaaggcccaagattctagaaggatcagatctttttccagatcctctggccagttccagatgcttggtctagagaatgtggaccttgcaggagagcccctgagcagctctccccaggatagagctgccaatctagccagcacttggcttctttttggctcatccctgtctttacagatgtttgtttgcttgtttgttttagctgttgtgttaacatttcctacagaattcttcttaataggagagtagcagagggctggctgggtcttaggacaatccatctttactagatgtcccttgcccttcaggtagagctaggcttcgccttcaaggccacagtatacgctgtggcttgaggttgctgctatcagaaaggcaggaaaaacagggtagggtgtgaggtctcaggagggctgttgggggtacccagtgaggctcaagcaggagtgtagagggaagaggaggctgagggcatgagggaaatgtgagggcaggtgggaggggggacgtcggctatagcaggaggggacccacgctatgtcattctgaggtctaactggactaaccaaccaatatgtaaactggaggaaaaggctgggcctgcacagggcaagccctctaggactccatgagccaagagagaccagttggtattgttccacagaggcagagaacccataggagatggcagtcatttgtatcatcttgttccccgcctctacttttttgggaaataaaaaaaaaaaagtaattttattctcacttgcctgtagttcagcaagatcaatggatggctagtgttcctgtatgctgatgtcacaggtgtggtaatgcagggtctgggaggaagggcggtgctgccccacaagagcagggcctgactgttaaggcgagtggtgaacagaaccctccctggtcctctctctaagaggacggtgacgggtctggagactgaggcttttattttgtgttgctgtgcccatgtggagtctctacagcctag

SEQ ID NO: 25883 - DNA, 1117 bp, Mus musculus
catctcacaggcaaaatgtgttcagtccaacttcaacagtttccattgtcttaacagtttcaatactgttcataagtataagtgcaggagctggttaaaatggactgttgctcttctagaagacctagttcctagctgagttcagatcctagccagccatgttgggcagctcacagctgtctgtaactccagctccagaggatctgacaccctcttctggcctccatgggtatcttcacttacacatgtgcacatatacacatacataaatatgaaaaatgcatccttttctaaagtgtaagtgcactcgtctcatctgagactcgggccgcctcttcactgtgaacacctgtaacatcaaagcccaagttccatgctcctaacataaaccggcacagagcaaatacccacatccccagaggatgggcacagcaacagggcagaactgtgatacccagcatggcaaacaccaaaatctaaagctccgttggtagcatctggggattgtgacagaatcgtctgggcttggaggacttaggtagccttgccactgcagcaatgttgcctggaaacctcccagcctctctcttgagctggctcgccttgtacattcagtttccctctgagggtatcacagctacagtctcagcccctgtcactatcacaacccctgttacagtcacagcccctgtcatagccacaggcacaacccctgtgaacagtcacaaccacagtcacagtccctgtcataatcacagccacagtcacagcccatgtcacagtcacagtcagtcacagtcacagccccggtcacagtcacagcccctgtcatagtcacagccacagtcacagcccctgttatagtcacagtccctgtcataatcacagccacagtcacagcccatgtcacagtcacagtcagtcacagtcacagccccggtcacagtcacagcccctgtcatagtcacagccacagtcacagcccctgtcatagccacaggcacaacccctctgaacagtcacaaccacagtcacagccactgtcacagtcacagcccctgtcatagtcacagccactgtcacagcccatgtcacagtcacagcccctgtcacagcc

SEQ ID NO: 25884 - DNA, 1176 bp, Mus musculus
aagctatgactccaatcctttggccagacctccatttagatataagataaagtaattgaaaatatctaagtgtctcacttgaaaacaagatgaacgccagcgtggatgttgaaaggatcataggtgcatctgctggagtgcatgatgtttctcatgccccaggccatgctatgactgcccagctctgctggctgcagctctgctaaggagacttcttgccaggtgtgctgctgctgcactccgtgacccagtgctaggatatgagaggccaaggcagcctggcccagatagtcacatcctctctcggctcaccaccgtctcccctgggcccagcccagcaggcttggagcagataccattcattcagtcttcattctgagaacacggaaggctgatcgttgctcctccggtagatgaggcaccgttgtgccatggaggaggaattgctgattggtagggctttgcctagtgacgaagacagcataaaccaccaaaatatcctggtgcctagtccaaagtttgtgtcccatctccatgactttcactcctcatctcacaaatatctctaggttggtgggctgtccgctggcttgttaacatcctcgttcctcagtgtcgctgtcggggacttttccttctgatgcttttcttggcaattgtgttccttctggctttcggatgtaaacacatcatttgactccgtaagcctgggacctttcccacactctgacatgctgctctttgctgtgagggattttgaagcctgctgcacacaggggccagaggtcgctgcagagaccacagctgttcctaactatctccatccatgctctccaaaacactccacaagtgagaagcttgttttgagcaaatagacctgctcacagatggtcagagccggccatgggccaccgtttcacctgctgaaggggaagaaaagacctgagtcttgcttggaccacttagcaactttgttgagtgacacacctctggggaaggctttgagaacaagtgatagagtagtagcctgtggcattccaattaatacaaagatccccttttcctgtatcgtgggaccacagtgtcatctaaatattggcttttccctggctatcagaccacatttattggaaggggctcagggcaggcaagaactatatcaactgagatacactc

SEQ ID NO: 25885 - DNA, 1145 bp, Mus musculus
ggcgaacgggctggattttgcaaaattcaggtccgcaggggatctagaaggtgaatctaagactggcttggcaacaggtccatctgcctctggggttactatcggacattcaactcaatggccctctgtttttagatcctgccaggatcacccttcccctcttgcactcatggaggttgttgaagtctctgagacctctgtggaacggaggctatcctatattgcacagtaccccataccgtgcctggccccacccccaaccataaagtgattgtgtagtcaggtgggtaagaggagaaacaaagtcaaagaggaaagccagacctttcttggcacctttcttggtgggctgaaagcagaggaaaagatgtagctggagagagcttgggaaagacgagtgggaggaggctgagaagagggataaacttatcagaccgcactccacatcaaagtccaggatgctgacttgagtgtgggcttttcttgtgcaagtttgatagtttcaattcttaccttccatgtcttttctttttgagatcagcctaggtagccataccctaatcaatggactggaggctttggtgaacaggatgcaatcttactccagattgaggagagaactggccacattcatactgcctaaagactattttccttgcttgtggagcctgcttaattatgcccatggggctggcgatgctaaccagaccttaggagagtgtaagcttttcacattccttgagtgtcctagctctcttggaccgcctcacaaccagagaagaccttggtttcccagggagaaaacttcccagcccctatctgggggatctttccactgtttcgggtgctggtgtgtgcatgaatctgtaggtgaattgcagacgactcctcccctttccaggctcttaccaaaaagtttcctaaaaagtaaaacaacaaatgtgattggtttgatccgattattccatattgtgtgataagtgggttttcttgtgtggaagctcagcccaacaacagccttgaactttatagtttatttaagaagccagacgtatttcatccttgttttggaaattcttagggtttccctgactcagttttctccaaatgtctatgttcagatctaacccagcagatacctggat

SEQ ID NO: 25886 - DNA, 2439 bp, Mus musculus
caggaaagattcctggtcatcagcaatggcaccgccaggccaatggcacggtgtgttggtccatgaccagcccgacttcctctaagcaagtgggtaaagcctctgaggggaaggggacctatctgcaggtgagtggctcagcctccctcactatctgctcctattgtccctatagctccctgaaggagtcagggcaactctggttggacgcttaccttcaccaatagcagcagcagacctccatatggaggaggaagaggacacctggagccaaagcaggagttggagggacaatgccactatgaatctaatgtttaaaaggttagggaacatggatattcgtactcacatctgcgcccctcccccttgccttctgggtaccaaacttgagggaggggagagctgttgaagcaggaattcaaaactgttatttcttctactttggcaggggagggggacaaatggtggtacctacagagctctgcatgaagtagggaccccacactagataacccctcttgtaaagtatgagcccatctcactgggctatctgactctccaccctccttgttagtctctgaggaacagtgcaactccttcgaacatgatttagaaagagggcattcatgcatagaattctgaggcctggcacaactccctgcccaggagcacagcttgctgctgagggctgggtgtgaccgtgtctgcctctggctgctgggagaagctgtttttcagtttcagaagcaggcaggacaaaggccaggactgtggtttgggaggcatttggccctggaaggtcctggcacacgcaattcttgggtctcattccatccaggttccagagagaacattagatcttagctcttgacaaaacggatggcagatactggcctttgaaactctgttgattcatctcttctaatcggtccccaaggagaaagaacataaacaaagagtgaggtcttccctcccactgaacactattcccatagtttccttttgctccccagcctgtaattctaagttcaacaaaacagttgtcaacaaaagtgactgaggcttccaccagagtgccagggctctgtgcagactcagaatccctgttccctatgtcacgttccagcattgtatagcacagttccatgtcacaaacaggaaggttagaaacactaaggtctgtgaacatcactgctgcagcgaggcagctcctctgtctactcgttcaagtgtcttactctactggatgctggatagaaatttagggtaacttctgacaaagtgtgccggtctaacaataaaatagggttttgtaatcttctggttggtaaaagatatgttccggagaatataggaacatgcccggagagacctaacctgtatgtccactttcatgctcttgttccccaaacccctgggcattgttgtctgctcaagagattctactggaagcatgatgacccacctgtctgggaagagaaaacctcaagaaggcaaagtgcagtgcgtgtttgtggtcaagatgagggtgttaagggatgttggagtctggtgtagagacaggcaggttgcagaaaagcacagatctttgccagtggttggccctgattgaaaacctgtttgaaacagactgtgtaggaaaaatcaggattaaagagtgctgcctttatggctccttcttcagaataggtgcagacccctccccgtgcccgttccctgccacccggggtaaggaggtggcactaccagtctgtctaacccactcactggctttgaccttcaactgccagtctgggcaaataccagtgagctctgttgtaccaagaccaggtcttcagagcatctgaaccactgtggccttctcttctcagccttcactgtgacacgggggacattgagtgacaagcctcagaatgttacagaggtaaagtgaggcatctcaaatccactgacagataagaaaaccgcgttagagggaaagtcacctctgctattgtagaaagtggcagaatatccaaacttaactctagcttccatgtctgtctttattaccttcatcttcctacttcctgtcccaccggcatctcacttaattgagcctaatgtcagtatctgtgtgtgccaatgctgttaccacatcctggtgaagctaaaaaataaaatttaatttggaccaaaagaatgttgttattcatttgaaatccgcgctgcttgtctgcacatgcctacccgatgccctggtgcagagaaggggagctgcctcagctggtaaggcacttcctatccaagctggtaaggcacttcctatccaagttccgatccccaggacccatgtaaatgccaggggtggagctctataacccagcattagcagaggtgcatccttggagcttgctggccaaccaccttcggcaaattggtaggcttcaggttcagtaa

SEQ ID NO: 25887 - DNA, 1265 bp, Mus musculus
ccagaaacataagagcatcgaggagatcgtgaggcggctggaccccagcaagtaccccgttccagagaactggctccacaaggaagcccagcagctcttcctggagccagaagtactggacccagagtctgtggagctgaagtggagcgagccaaatgaagaagagttggtcaaatttatgtgtggtgaaaagcagttttctgaagagcgaattcgcagtggggtcaagcggctgagtaagagccgccagggcagcacccagggacgcctcgatgatttcttcaaggtgacaggctcactctcctcagctaagcgcaaggagccagaacccaaggggcctgctaagaagaaagcaaagactgggggagcggggaagttccgaaggggaaaataaacctgtccttcccctccactgtccttgaccccaggctgtctatctgttttgtaccctcggctgcagcacatccctcttgtccctcgtcttgaggagagttcattgcttcccagcgctgcccttcagagctttccctctcttgaccctgtggcaggaaggccgtagctctgctttttctcatttttagctcaggaaagatgtcaggctcaaaccacttctcaggttaatggacactgtagtcattgttctgtgcaactgcgagcaatgtcttaaggaagaagaagataaagccgggagcgaggctggagatagtttcccagctggccagctggtggaggagaggtgactagaacctgactgactactgctccttctaatttcactgtgccctgaaagatgcccatcagcctgggattcgctgatggaagaactgcaaagagacgagcagagagaagtctggctgacaacagatttagtactgaccagctgatttttgtgggcagaaatttgaacttgctgcctgctgagtccagtagttgtgcagggagtgagatggcagtgtttaagttttgatttgtagttttttgtttttgtctctcccctctccagtgttggggattgaccccagggcaaaggcattaagtgtgccactgacctgtgcctccaagtgatgttctgacagcctttctgaggcaatcaattgaattgaggttttgggagaagaaactgttgttcataggctatttctattttaaaagatgtgaagagaaaaaaaaaacaataaaattataaaagtgaccagaatgtgtctgaatgtttgaaaacaccctgagtgccttagtttcctgtagaataaatataatggtttcct

SEQ ID NO: 25888 - DNA, 2283 bp, Mus musculus
gcatttgaacccagctctgccatatatgcattttgaaggaggcaagcgactgcagagggtagcagcacctctgcttgcattgcactgtggtcatgggcaccgtaaatgagacactagcacagcctagagcacaagacaaagggaggccttagctcgggaaggcagtctgcagagggtggctacccttgctctcaaagtgcagcgtgctcacccctgggctgtgatggtcatgtggggaggacaatgctggttaggacaaggctgccctgacctctgtcttccctgtctctctagggcacctctcatcagtggccagtaaccatcctgtccttccgtgaattcacataccacttccgggtgacattgctggtgagcacacaggcccgcagaggctgagggcacgtctatgcagtgtggggcttgggagaggaataagggttttgcaaagcatggtagggcttgggacaaccaccttacccatcctcatttccctttcatatagggtcaggccaactgcagctcagaggccatcgttcagccagccaccgactactacttccacttctaccgcctgtgtgactgagctgcctcctgaggcagtgccacagccgggactggagtccctgggccctcaacactggatgcaaatgtgttacactggagcctgctgcaggccagctctctgctcttcactgcttcccttgactggggagactggaagtccttacactggagttgctgggccaactggtcaccctcacacagcacagagggggctagagggaacagcctcctgggtcttccttctggtcatctccttggggcagcacaggaccacttcatggctgtctagttatggtccctggagggctatttgcccaccttcactctccctgccttcccttctgagttgtggtagagcaaagacccacaggggttggacccagacctcttaaaacctggctggacccccatgagtccacgcagagtcaataactcacctgtcatgctgttcccaggagggacagcttggtaggaactttctggggtttgactgttacactagacatggatttctaagctttaagtgtggttggtttaggagagttttccttgggagagctagccctgaggtagtcagggctagctccggatggctggagaagctgaccttgtgccttaagtctactagtgcctgatggagccaccctcatagggctgaaccagtggggctgacgggccaggtcagccttggacccttgatcctggaggaccctggaaggggtggttccctgtaagctcccaagatctatgttcctgggagtttcccaaactcatgatggagttggtgacaagagcagaggagcaagaatccctgcaagcagtagactggtttccactggagggtgaatgcagataccttttattaacgatatacttactaaatgcacttaaaccaggtaccaaggagtaggacagaactggaaagctgagtgggcctcagtgtggagaggtactagtggacaggactttcatggcttgggtccatgctcctcccacacccaagaggagtggtgggtttgagtttggaggttttactcaagtgacagcttcagcatttcttggtagcacctacagcattctgattacatgcaggttcctggaaggagtgtgtcaatcatttagctgcatgtcatcggctcagcagtgggaaggaaagggtactgctctgaccttgtgtattctgactctttggaaaccaggccctgcttttgccaagcctcccatcctgagctctaaatggaaggcctttctatggggtagctaagtttgggaagcctatgaactgtgggtcctgccaaggttctcaaagcacttatcctcaggatagggaaatagcagggacgccttgtccccaagacttctccccaacttggctccattcctgcattctgccataggaatcacaacttcccacatcaggccatgcttgcctaagacctcgttctgttctcccataaggccgtccttcccacagtaccttaagattgcccagcctccctgctctagtggctggggctcccttaccagaggggcaagtctggcccctcagtccttaactggaaagtgaccctcttctacccctggagtccatctggacagagccagcctgaggcccacgggcagctgcctgtttgcatgcctgggaagaggtcctcagtgtgagttggggtcaaacttgggctccaagctgcttgagggggtcaaccttggaccaaagtt

SEQ ID NO: 25889 - DNA, 1168 bp, Mus musculus
ctccccgtgcctgtctgtgtgagcacgtgtctctgtatgtgtgtgtgtgtggtcctgggggggtgggcttgtatgtacctgctactctgtgcactggtgtgtccgcacctctagggtgttcagggagagggcaggcaggtgggtggacatgttatgccctgtctcagcgcaaggccagggtctcaacagcaggtgtatggtgcacctgatggccggctgtccctgcctttcctgcttctgttttgttctaattcacatgcacactttcgcgtggctgggtctcccccgccctccacctttagggatctaagtatgccctcagctgtgtgtgttaccacagaggtgctggctgcactgtgcctgtcgcctttgctgtcttctccctgtcactctagatatctgttgggcttgtgtgagtttttatgtgtatgtatgtgtgtctgtgtgtgcacgccctgctgttggatcctggtgtcttcccagggcctggcatattctgagcatgtatgtatctgcctgctgtggccgcccatgtacttcaagctggtctgtgccaggggatgtggcttgtatccagcctgtgtggctctgtgctctcaaagctgtttaattttagccttccctaagccctacaccatctcttcctcactgcctgttcccaccttttcctcctcatgagacattccagcctggtccctgggcagggtcttagtcgtcccttcctaagtcccagctgaatggagcctgggctaaccacctgactgttaaaccagaaatcccggccccctgaaccagcatggcatcgggtatggacacggttgcctgctaggtggcagcctgcctttctctaactctgggtgagaatcttatcaaatgtgttgtgtgagtggggaacggggtggggactagggctcacggggttatctcttgccctaaatggctgttaaggctgaatgggcacttcttgtgccatgttagaaatagaacatagggtcttgattaatgttggataagcaagcactttatcatacagctacatcttcagctggtaaaagagcttgtattaaatcagattaaagcgttaatgctcagggctggggtgatggctcagtcagtaaaaacacaaggacctgagcctctagagcccatgtaaaaagaaaagctgtgc

SEQ ID NO: 25890 - DNA, 1503 bp, Mus musculus
gctgggtgtaaccccaggaaagggaccctcccaactccctgcagaggctgtgtgggaacagaagagggtaatgtagaaagtctggaaactcgagagaaatcgctgccatccttccttccatctgcctcagtctcctgagtgcttccaccaaggcatccgaggggcccgagcaacctgcaccagcaggtgtaaagttggcagcgggtttatgcagagcgtgctcctgcacctcttagccagtcagctcagcatccccccacatagctgttctcccctcagactactaggaatagtagtgacccagcctgggtggaggggtgggggggccagccagaccttgcaaacagtgggtggagaacagagtgggtttgcacagggtgcagctggatgacacagaggctgggcataagatgttagggcaactgggggaacatggaaatgggggggagggacttgagggtgaggagggcaccagagctctgccaccactgtcctaggatcttgggcaagtcacccacactccctgggcctcagtttctccatctgtaaaatgatggtaataatacttcacctacctcatgggggaggttgtgaggccaccatcacctgacctagggggtcaaggcaggagggctctgaaggtgctacccagagcaaagttgtcagtgaggcctgaaagcaaggcccacctgccagtccaccctaccccacagagcctctagggaccgccagagccaatctgtctcttcactgtgtccccaccccctttatgagcgtcatctgacatcttgtgggcaccctagacttagttgttacattgtttaggtagcttttcttgtgatcatcttctctgtgtaactgctatacaaattccacctgccccagcacacccctccacctgccctccagcaccagaggccagggaagggacaaaggaaaacagccacaaaagaaaaaaaaaaaaaaaaaaagccaaggggactcccagctcagctggggcccccaggggtgggaactggtggcgctgtttgtattgtgtttgagtccttgagcgcaagtgttttataaaaaataaaacaaaaatccactatcacaaaaaaagaaaaaaaatacagcaaagagaactgaagacaaaagggaaaaagaaccatacaatttttttccaccatatgcaccctctaagccagcaaaattttcctctttgcaaaatcatatttttgtgggaatgggccctgctttttgtggcaaggcctgttctgattaataaaggatcgtgaaaaagtagggccttggctgtttcctctgtgggtcccagccctctctctctcttcttccaggggaagcaacagctgggattggagggactggggagtcttgggggtgtctccactcagcttgtcacctgacacttgacttttcattgtggcttgggcctgctggagctgcccgctcactctcagatcaagactaatccctacaattcaccagctgccccaaagtaga

SEQ ID NO: 25891 - DNA, 1198 bp, Mus musculus
tctgtctagagagaggtgctgcctaatttaggagcatgtatctgtggtgtttgggtgactatcctctctaagccttagatttattggctttccgttccttgactataaagggaccaaaatccgcaggactaagtgagatctaatgcatctagcaccttatgtggtgattaaataacggtaacagtaaccattgtctaacgaggttttttgtgatttgtttgtttcaggcactgtcaaagcacagtctgctgtctcccttgcctagtgtgacatcattcagacgcttctacagaggtgacagcccaacagactctcaaaaagacatgattgaaatccctttgcctccgtggcaggagagaactgatgaatccatagaaaccaaaagagcccgcttactctatgagagcagaaagagggggatgctggagaactgcattctccttaggtagtggggcagaaggctctgggtgtcacttctctttgacaagacagtcttgtcaacctcattttccttctcattttagcctgtttgctaaagagtatctgcacaacatgacagagaagcagctgaacctctatgatcgcctgattaacgagcctagcaatgactgggatatttactactgggccacaggtatgccatatgctgagctgcatcttgggataatacgataacaagcccattagagtctaaagtcatatcttcccaagtgtgttcttcctcttcttgtaaactgggactttctgtataagcctggctgtcctgggactctgtatagaccaggctacccctgaagtcacaaaaatctgctgcctctgcctcccgagtattgggattaaaggcctgtaccactaaggtaggccctgttttcatccttattactcatataatagacaccaaacccaaacactgttcaaatttttccagaaggtgcaaaatttgtttaatcagttgtttcttttaaagattttaaaaattattttctttattttgtattcgtgtttaagtgagcatgcatgtgcatgggagttgaggacagaggacaacttagaggggttggttttctccttttcacccagcgtttgaaccaaggtcatcaggccttgcaccaaggccttttctgccttcttttttttggggggggggtttcgagacagggtttctctgtgtagccctggctgtcctggaactcactct

SEQ ID NO: 25892 - DNA, 1129 bp, Mus musculus
agaagagggagtcagatctcgtgatcggatggttgtgagccaccatgtggttgctgggatttgaactcctgaccttcggaagagcagtcgggtgctcttacccactgagccatctcaccagccctaaaatacatttttattaatatatctaagatgtgatctttgagctaacatcactgatctcatatatcatgagatgtatctcattatttatattggtttgtttgcttatttactatttctttgatcctcacaggaggctaaacttaaacttgcccattacaaatacaatcttgaaaatttcataagtaatgctaagagtttcaaatctgaagtcttccatatcctttttcctagagtgagacagggaggtcttgtacattgctttacaaagcatttaactataggttctaaatcaggtagaatggaacagaagaaacaaactggaaagtttgaagactccattatcaatccctcatcttttaggactcggagttcaacaatacagatcagattgacctatatgatgatgtgttgacggctgcctcacagccctcagatgacagaagcagtagcacggaaccaccccctcctgttcgccaggagccagctcccaaaccaaacaacaagacccctgcaattctgtatacatacagtggcctgcggagtcggcgagcagctgtctatgtaggcagcttctcctgggtaagcaaggataaccaaaaatctcaagggtgggctggagggagagcactgggaggtgatggcattttcagaaaccactgttgcactgttttgtgctctgatggggttggatttctttttcctgggatcaggttggattgatctctgaaagagaactatcctgaggacgtactggtgccgaagaaagcattgattaagtgggtagttgccttttctgccatcttattactgcccctgaccctggggctttatgtctagcagggtcatctatgggacgagatatcagagtgaacaccttgaactcttggtggtcattagatggtcctgtgataatggtgggtgatggggatcaaagaccttgatagctgtagtgtatttgggatatgtgctgacaattctgtaaaagttaacagtgtgagatgtt

SEQ ID NO: 25893 - DNA, 1298 bp, Mus musculus
agaggaaggtactgcctttttggacttagggatgtcatgggacctcagtaacgaggacccctaatttataaagtaccagaaatgtggggaagaaagcaatttgagcagtatgtagcctactcacatgggctctttttcaggtttgatgtaagcataggcttgcatattcccaaggtacatactttgacttaaatgtgggataactcagcactaatgggcaggtaaagtcacaactgtggttattttggttttgttttggtttttggtttttttatccttttactccaatactccccctgtcactttgcctggaggtgcttcaagcctttaacaaggagcagagaagaattggagccagactttagtgaactcagctcagagttgtaaggaccagcacactggtggccattttctgcacaagcaaatggaattgctttttttcagcatcccaattgttataggttgctcctgatagaggtagccacagtcctggagtaccatagggtgatgttccttctgcatgcatctgcagggcctgtgagatctggtgtaaaaagagacatgacatgtggagatgggacttagtgtgtgaggcatagggtcattggagattcttcagactcgggggagactgaattggatgcctctctcatcccagcacacttctaatagaccccttcagtcacggagggagtgccccaaggttggacaggcacattccccttggacagagactgcaagttgtggcttattttcctgttccctaaaccgatccctattccatcaacatggcaccctgcctcattggctaagtgttaagtgatgggcttattcttgaaagcagcttggggtgtctttttaaaatgtagaaaaaaatgtaaagtgacagttaaggaaaaacaacatattaaaatatcagaaaaactgtttacccagagaattattttctccccacttttatttttactcagtgacataatttttagttttattcctcatagcaaaaggaaaaaaaaaatcccaatcctcaaaaggtcaaggccccgtcccctgttgtcggtgatttgtttgtctttctgataggttgaaaattgtgtaataaacttgatgacgatgtcaatcttttatactgcattgtatttttttccttttgtaacaaaatatttttaaataataaatggggtgtgagctgtttacggattctgcattgaatagatttgttgaggtgtctggggcatggatacggactgatagaggtcctatgtgatataggaaaacctcaggttcttaagtgtaat

SEQ ID NO: 25894 - DNA, 1189 bp, Mus musculus
catcccaaaccaaagaacattcatcttgaactcatattttcagctacttaaattcgtgtatttacgtaaatgctaatcatttcagaacaaaagtttcttgttcagagagagctacagagggctgggtggtgttggtagattgcttgggagataaaaggacaacactgaaggctctgggaaattttcttcgctttatctttctggatgggaactcaaggaaacacaggctttctccattagcgtcaattacagtctgctgttgtaatttagaaaggaaaacccaacaaccatccgaagaattttcgtggtcatagtttgttgaaggccaggctgttgttgcccagtcgacagtacatttttaaaagtctgattaagactatagctttgttgagtgtgtgaagcaagacattgaggtgcttcatttggtgaggaggcgaggtccttaggtagatttatttagaggtacctgaaaggcctatcctccagcttccaaagttagaggctctcttctttcaggacactttacttcagcggaagatctgaacctgttgattgctaaaaacacaagattagagatctatgtggtcactgcggagggtcttcggccagtcaaagaggtgggaatgtacgggaagattgcagtcatggagctcttcaggcccaaggtaagggacgggccctgaaggaacccttgggtgcagagtttaaatgggatgggtgaaggcttaagtagaaactctttgggaatggcagtctgtaaccagaatcccagaaggagagagttattagggaagagaacctgaaggagcttgtgggttaatgccgcagaggttgtagtgttaatcctagcttcatttcttagtcatctcatgtaaagcacctttgaaagccttgatttccccgtttacaaatgggcgtaacggtgccctctcccgtagagtactgtgaagataaaatgattgattttcacagagtaagcacatcctgttagcttaacagtttcattactattagaacaattgtaattcaactgtatccaaaacaaaaaaaccccaaaaaaccatgaatgtttttgaggactgttagtaaagatctattgtagctttgcttgttattactacagattactttctctccacatacataggtgaaggagaaacatttcattctcttctcaaatcttgaatag

SEQ ID NO: 25895 - DNA, 1132 bp, Mus musculus
gatagttctttagtaaatatgtctggcagagtgaaggtccctatacatttagtgatgaacaagacctcaagtgggtcatggtctaatgtaatggatagatcccttctgtcataggtaaactttggacattcctcctaaaaaaatgcttctattttaatttaattaatttaaatgcatgtttatttgttttattttttgagacacggtctctctaggctgtcctggaactcgctctgtagaccaggctaccttgaattcagagatctgcctgcctctgcctcccgagtattgggattaaaggcatgtgctaccactgcccggcatacattttaagtttttaaaaatttactgcttctctgcctgtgcatgggattctatgttcaaagctttgtttggcagcagtcctgttctagaagtatcgtttgaagtgcaaaagcaggattgagaggttcttttggataatgtggatctatcagggatgttctaggactaacattgttctttttttcctcttagctcaatgtcgacagcaacgaacaaggctcctatgtagtggccatggaaacctttaccaatttaggacccattgtggatatgtgtgtggtggacctggagaggcagggacagggtcaggtaagagggagtcctgggaataaagtcttgcttgcctcttcagctgtccttgcttgcttatctagaatgaggagtgtgcactgaagagcctctttactgattatagtgtgcctatcttggtgtgccggacactgtatattcatttctgtaatttcattagcaccttgttaggtgtattctttggtcatcccaaaagtggggaaacttaggactgagaaaaatggattaatttgccagaggtcaccttgtaagtagcaagttatgtctgactctagttcttttagtatgctaggttccaggatctaagcaagattcctaggaagagtgattgaaagttcttgctttttggactaggatatcttacctgcttagtaaatttgaggggctctggagatcaacaacttaagtttgcagtcccaaatctgattccacagtatgggtcgtgggatttagagctggcatggtataactgcccaagtctcttgaggggttcttgaga

SEQ ID NO: 25896 - DNA, 1351 bp, Mus musculus
ttactgatacatctgcccaactaaatagtctgtgggtacagaaaattagacagtcatttgcattgcatgtattgtaaaattaaaagccaaatacaatttcacatttgtgtttgctgaaaatacaaatcctatttctctaataaaaacagtctgaacaataactcctgctgatttctaatttgggggataggtcagaagaggtgtaaagtgagacttgatgaatacttgaaagttattgctggatttaactggagcttcatattctaggtaaatgttctaccattgagcttcatttcacagcttgaactataaaattttaactttgagtcatggaagtaatactcttatctagagtcaaggtaaaaatagaaaacttcagtctcaagcaaattctaaaatctgacttctttagagtgtaaatatcaggaaggactagaagggatttccgcccccctcgtggcttagggtgagggcacgtcttgggtgctggctcatggtacactttatgctttactccttgttccaggtttatggcctctgcgctctgaccccggtcgggagacggatgacactttggtgctctcttttgtgggccagacaaggtaagggcaggcctgctccttccttatgggatgacggtgcaaggttgggaagctggtcccaggctaacctgaaccttccttttattctgctacagagttctcatgctaaacggagaggaagtggaagagacagaactgatgggctttgtggacgatcagcagactttcttttgtggcaacgtggctcatcagcaacttatccaggtagaggattagaggggacaaatgagcatgacttcactttgacccagaatgcaagagtagctgctactaggcttttaattaacccatttttatggcactaaaaataatgtaaaagttcttagagggtaggagacagtggtttcttattgtgcagaggtaacttttaactttgaagtagatgcttttagctttattttcctctcatcagcatctggatatcaatttatgtttttctatacactgggattatgataaatataatttatggggctggagagatggttcagcaggtaagagcactcactggctgttcttccagaggtcctgagttcaattcccaacaaccacatagtggttcacaaccatctataatgggatctgatgctctcttttggtgtgtctgaagacagtgacagttaactcatttacaaaaaaaataaatctttaaaaagtcatgggttgctataacactgctcaaatgtttaaaaaatatgtaactttgtggcattaattatatcatgctttttgatatactgtttattcct

SEQ ID NO: 25897 - DNA, 1148 bp, Mus musculus
tgcaaatattataccattatatgaggggtttggggatctgcagattttggtattcttgagggtcctagaaccagaggcttgactgtaatggtagaactgtagtttatctgtgttctaactgggagcgggaacggggagcacttttgaatttctgaaaccatccttgcagttgctttgagacgtctaatctttctgtagatcacctcagcatctgtgaggttggtgtctcaagagcccaaagctttggtcagcgagtggaaagagcctcagggcaagaacatcagtgtggcctcctgtaacagcagccaggtggttgttgccgtgggaagggcactatattaccttcagatccaccctcaggagctccggcaaatcaggtacaggagtgtctttatactctgtgtagtattctttgttctgtggggcatcttgggtccctgggtttcttcctctgctatattcattcctctttgttcagccacacagagatggaacatgaagtggcatgcttggatatcaccccattaggggacagcaatggcctctccccactttgtgccattggactttggacagacatctcagctcgtatcctgaagctcccatcctttgaactactacacaaggagatgctgggtggaggtatgtgctattggtattttgggttaaaattccagtcaggatgtggaacgagactttaaagctcctctttcccacagagatcattcctcgatccatcctgatgaccacttttgagagtagccactacctcctttgtgccttgggagatggggctcttttctactttgggctcaacatcgagacaggtgaggaaaaacattgagtgtgggttctttcagaaatagggagtgttggtggctttgagccttaaccaagcagctgttgtcctgttttctttccttcttctcatgctgttctttctgcaggtttactgagtgaccgtaaaaaggtgactttgggcacccagcccacggtgttgaggacattccgttctctttctaccaccaacgtctttgcttgctctgaccggcccactgtcatctatagcagcaatcacaagttggtcttctccaatgtcaacctcaaggaggtgaactatatgtgtcctctcaactcagatggctatc

SEQ ID NO: 25898 - DNA, 1770 bp, Mus musculus
tccagcagtacggctcctcacgagacctcctttggagaagaagtggaggtgcacaacctcctcatcattgaccagcacacctttgaaggtgcagacaagctcctttgtccttttttgcttacatcgtggcctgaatgctctggagcctgacaggatggtaggctctcctgtgagaaaaagccagattggggttggagcagagaaagcaccgctgatagctgtcagttgcgttaaatctagagcattggccatcttgtccttagcccaggctggtggggacggacagtctgaagcggcaagggcagtgagtggctcgtgttcttacactgcctgccacagcctcacagaagcacgtgatcgaggggtggagacaatatctgtaatccgtcccctctctcctctcctagtgcttcacgcccatcagtttctacaaaacgagtatgccctcagcctggtctcctgcaagttgggtaaagaccccaacacttacttcattgtgggcacagccatggtatatcctgaagaggcagagcccaagcagggtcgtattgtggtcttccagtattcagatggtgagtgaacagtctttggattatgaaggatatgaaatccgggggaagcagttagcctcttaagatctcagagcctgaacaggatgacttagagtaggaggcagatcttggtacccattagaggcattcccatcattgcctggggacctacgcttcatctcagtatttgctgactcttttttttttttaataaagatttatttatttattttatgtatatgagtacactgtagctgtacagatggttgtgagccttcatgtggttgttgggaattgaatatttaggacctctgctcgctctggtcaactcagtccctgctcgctctggcccagagatttattattatacataagtacactgtagctgtgtctcaagagagcattctcatacattatatcctgactgcattttaccctctttccacccctcccagtaccttttgtttttttccagagggttaggggcaaaatttaagtcaatggggcaaccaggggatactcttgactagatgaaatgtgagcttataaaaaagactaaggagtatctctccttctccctcccaggaaaactacagactgtggctgaaaaggaagtaaaaggagctgtgtactctatggtggagtttaatgggaagctgcttgccagcatcaatagcacggtgaggtctatgggttgtacatgtttgtagaatgtctctcccttaatgatggtaggggagtttgttttagggatagcagaatagtgggagtagagaatggactctaagctggaatttggggaactgaagttgagctggactttggatggatttggttttggaacctccaaggtttgcttggttttggatttggttttttgagacagggtctctctgtgtagctcatgctgtcctggaacttactatgtagaccaggctgccttgaactcagagatctgtctgccttctccagagtgtttgaattaaaggcatgtattagattttttgagtgctgtggaggttaagcagagggtacaggctgtggcctctgtagtaaggtatgtccatgttaaaagagtatttcattaaaacaaaatgaaccaacctttattttccttagcattcttttttcctttttggttttttcaagacagggtttctctgtatagccctggctgtcctggaactcactctgtagaccaggctagccttgaactcag

SEQ ID NO: 25899 - DNA, 1067 bp, Mus musculus
tgtggggctgagcgtgtgcagtgctgtgtgggttatgcatgcccctcatgggcagaggtttattttgtaaaattgagaggctttggagactgacctccagatggtcttcccagaacactcagcacatggtgtcttgttgaatgtggtcctgttgttgaggcctccttagggagatgggttcagaaagtgacatctcgtgtctttcagtgctgccaccactgatgaggagcggcagcacctacaggaggttggtctcttccacctgggcgagtttgtcaatgtgttctgccatggctccctagttatgcagaatctgggcgaggcttctacccctacacagggctcggtgctctttggcacagtcaacggcatgataggtaaggtcattcctgtagggcacactcagctgcagcaagctcacccctggcttgtcgaggttttgaagtgctctataagctaactgcccctttccttcttcagggctggtgacctcgctgtcagagagctggtataacctcctgttggacatgcagaaccgactcaataaggtcatcaaaagcgtgggcaagattgagcactccttatatcctttctttccagagcattgtctgttgggaagctctttccagcacatgcagagagctttgcttatcatgtgaagaagctgaaactccaaagcctaaagggtcagccatccattcctgtgcaggagcagttgaagccctcccaggcaaggcctggaaaagctgctgcctatgtgactgtcccaggaagagtactcttgagtgttttgctcacttgcagggctttgggcctggtctctctctaagcattggattatttaggactctgagaccagacttgggtggatggtgatatggacatcagatttgcctggaatattttttcaatctattcatatttttctgggctttgccataaccttttaaaggttaccctaattgagaaccattggattaagcagaactttctttcaattccaaaactgtccaaaagtagtatgggttttagtagaagcctattgtttgctgttttacttccgactg

SEQ ID NO: 25900 - DNA, 1546 bp, Mus musculus
aggaagtaacctttcccaattctgtagtttaggagtccagagtgctcactggggaaggtattcctgggagggaatattgagcagtgacagactcaatgctagcttgactaaccaaatccctaagggctatggccaggtttttgttgaaatcctcttccttgctgcagcagtggtggccagtaggtatctctcagcctgctgaggtgagagtaccttcttgtctccatggcccttctccctgtctcgtttcagtatgatgatggcagtggtatgaagcgggaggcaactgcagatgacctcatcaaagtcgtggaggagctaactcggatccattagccaaggacaggatctcttttcctgaccctccctaaaggcgttgccctcctatcctcccctcccttgcccacccttgttttcttggcatgggaggcttttccctaagccacctgcccctagagccacagctgacctgtgtggaaacagggctttttataactaaaaccagttcactagagacctaggaatgggctgggctgaaagtgaaatattttctccctggatttttaccagccatcaccttggaccaccaagccttgaatggtgttgccagttggctcctcctggggaggacttttgtcactcttcagccaagaagcagctctgtgcacctgtgtgtgatacctcacactcgtgctttgtcctccactgtctatgtaggttgtgggtgtggggaggttgaggtagagggaagagggtcgagagggttccactgtcttgagagcttccttttgctttcttctcttgcctctgagaacatcagcctggaggcctgtcaggctacgggctgcctgagtggaaacctgggatggtggagaattcccaagccacagcccttttgtctcggggaactcccttcttcacagagaaggaggtgggggctgtgaattggttgttagtttctgaattttaccaaataaagtagaatctaagaagaaactcttattggtctctgcttttctcctctgcccactgtccatcattcctcatacactgcattgggtgcaaactgaagtggtggctgcagtcacagatcttgcttctcagatagtagatgttcccctccttagttcatgactaatttgagtgggattctagaagcacagcagctattatggttgtttgtgctagcaatgagacagtctggaagccactcgggctacctttactgtcttccttgtacagaccactttgtataatgcacagccagccccaggtaatatccttttctgacgcagtacctgctgcttcttgttgcatcttgttgagacaggattttactatgtaactagggctggctttgaactcacagcgagccacctgcctttgtctcccaagtgttgctataaaggcatgctctaccacacacagctaagattttattttaacctctgtgtgtatgtgtgtctatatacatatgtctgtccatatgtggacttgtacacattagtgcaggtgtctgtgaaggccaaaagagggtgtcagattc

SEQ ID NO: 25901 - DNA, 1206 bp, Mus musculus
ctccctacccaacacaacctcagctcccgggcttcccaggacagccccagcctcctgtgccccctcaacctccataccctcctgggacaaccccttcctatggcttccaccctccagggcctgcctggcctaggtattagtcctggtctgtgtccaccttcttccttctacctgcaccacagcctttggcctccatttgctgagatttgaggttaacactggacgtggtggtgatgcgccctgaaacgctgggacacacagaagccccgagcctcgagttggaagcacataggcctcctgaaaggccctgaagagtgcagcatgagtccttctgggagctccttctgccagggactgctcagcacatcctgagtggcctgctgggagcccagggctctctggtgtctgcatgaacgggtgtgttcatgtctttgcatagctacctgcgcttgatccctgacagctgaaccaatgtagaataatcttgatgcagggtgaccctgggtctcggaccctgctcatccaggctgtcccttggagcttggtatgtttgatgtggaatcacatgccaagtgatgacagagttctgtctgtccactaaaggatgctctaccttatttaccacggtcgggtcgtaggaaggaacagttacgaaaagtggactttgattcctgaaagccatattttagctgccgtgccaatgtcaggcaagcgtgtcctacgtgctggcagagaccatagcagcagtggtatggtgagagagctggggatgccaagggaaacccaggcctcaaattgtatggttggacgtcctagaggtcaccctggagccccgggctggagtggaggaccagggttacctcccagccacttttcactcctagggccctccacttctggctggctctttctgaggttcacccacccctccactcctttagtgccttgaatcttatttgctagcagccccctttctcttgtttatctccttccttttcccagtgtccccgcagaacagacaccagacagaacacccccatggtgcttcccagacatcatcactacattggggttggtttctctacactctcattctcagaatgtaaagggtagggactgtgagtgcagccccggctctgggtgggctggagcctgcttagtaatgaaagtgactacactagtctacaggggttgcagcaggtgatg

SEQ ID NO: 25902 - DNA, 1363 bp, Mus musculus
ttggtcttggccttgctagggaggatcctggggggtctgaaacttgttctttttgtcgctggctttgtggccctggtgaggtctgtgcccgacccatctacccgggccttgatgctcttggccttgttaactctctttgccttgctgagccggctcactggctccaggagctcagggagccacctggaagccaaggtgagagggctggagcgccagatagaagagcttagagggaggcagaggcgagcagccaagatgcccaggagcatggaagaagagtgacaagggcgtccccaagagacaccctcaccgtaccaaagagctgagctgcttctgggtctcacggacctccttgcagcccccttgccctttccttgccttgtgtccggaaccttcacacctttacccctgcgctagcccctggctgagaggagagaacctgtcctctgccggtgctcagtcaagtgatggctccctgcccttctgtgctcccagcctgcctcccccagggcaggttggagccctcagccctggcttctgctctcagccagcaccactgcccgctgatctccgtgatgattaacctgctgcttccttacacaaggcctgcccaggctgaagctcctgtttgaccactccccccccccccccccagctcttttcttcctgctcccagccacactaccatcccaagtcccttgcggccctctctgtcttcctcattgcactgcaatgggcaggggtaggagattggagataaggatgaagggggaggaaagggtccctggaggcctgtgcatctatgctctgttacaagtgccttagcaggagtcagcagcaccctccaggtgccccttgccacactgaatgtgggaaagtgtgctgtggctacttcgtggtcagagtgagccccttgcagaatccccactccagcaaacaaagcaacggccctgctgggattgtcgaatctcccttgagggtttcagggaccttgaaaagggcaggaggacctgctgtcttgcagttttacccctgtccactctctgccatccagaagcaagcgttggtcagtgttgtgtcccagtagctgggaagggcacggctttgccctgatctgttctgcagggctaggagtgagcctgccactaacccctctccaccacttgctcactcttggccttggccttggcctttaggtccctggtggagggagatgacccatgccaggtccagcacaagatgtgaagattaaatgcctattcttactgaaggtttgatgtggaatcatggctgcagtgatatgtttttatcagcgcttggtggttttaaagtgcatgctattttattatcttcttctgaataa

SEQ ID NO: 25903 - DNA, 1269 bp, Mus musculus
tttctccagagtcagcctttatgacttaggacactcattagtcctgtctatctggattctgtaagaagtagaatacaatggacatatttgctttgtgacatcagggactttttcattactgggctctgcatttgctgagggtagccagtaaataaccacagcagtgtagttattgcctttcagagaggtgatgacattaatacccgtgatgtgctggtgaatagcaaaggtgggggtgggaaggagctatcccactctgtgtttgtccagagtatagtgtgggtaggagcctgaatgccgtacagggcattcagggtcactcagagttggcttgggtctctgaatagttcaggttggtttcagtgtagaataggaggtggtgtcctcttctctagggttggccgaattctccggctctcccccagtcctcacagtggcctaccctctcccaggatgcagtcatgctgcacagcttcactcttcgccagcaactgcagacaacccgccaggagctgtcccatgctctgtaccaacacgatgctgcctgccgagtcattgcccggctcaccaaagaggtcactgctgctcgagaaggtctcttgtattccctgctgctccccatcttctggccctgctttgtaatgtcccttttctaacatcatcttttctctcagctctggctactctgaaaccacaggctgggcttattgtacctcaggctgtgccaagctcacagcccagtgttgtggtaagtgttcccttccgggccccagtagctgtcccttcacagaagtttttggtgttgtgagcccctcccactctccctttcttttctgcagggtgcaggagagcccatggatttgggtgagctggtgggaatgacccctgagattatccagaaggtgagtcatgtgcacctctgatgggactgcagtccccccattagtaccacaggcattgggggcccttaagaatctctcacgatgggcaatgtgggagcctgcactgccaatcgagagctttctgatgaagcttactttagtctggctttctatgtctcatttccctggcttctgagtagaatgaggtgtgtgtacttcacaggcttgttgtgggaaagatttcattactgattagggcagtttttagctcttgcggtgattacgatctttgttgatattaagccattttgttacagattttgaaggttttgccttagaataagagttatcttcagatgaggagtcagaagtggcaagtcaagacagc

SEQ ID NO: 25904 - DNA, 1164 bp, Mus musculus
caagatgagggaggaggggggggggggacagggggagggttggtgagttcacagagaaactcttgggaaggaagacctgagaagtgagctatcgcctaaaaggctatggggaagctagggggtcctgataacacaacagaacaactgggtatgttctgtcaggctgtcctgtgggcaaggagattggaatttaccctatctgtgattactatgtagcccactgctccctagaagtgtatccggtaaacctacaggggctggggagacagctccgttagtaaagtgctttctaggtcaccatgagctgaatttaatccccagcacctaatgtagaaaagccaagcatggtgagcccttcctctcagtgctggggaggcagagacacaaggagcccaggagttcacacacaaattgaactgacctaactagtgggccctagactaaaaccctgtttcaaaacaactcctaaggatgatatccaaagtaatcaagcctctgccctctacatgcatatgtacgtatctgtattccccgtacgaatacacaggattacaaagggccaagagatgactgagtgatcatgttcactgtgatggagcttgctctagactgttgtaagcagcagtgagcatgccagggtcggtgggcatcctgggccatgacgctcagtgggttgctgagttgtggtaggtgaccatagaagctggagcggtgaggcagtcagtgctggagtgcgttctcacaagttcctcacactgacatccattctggactgaagaagctgtggcttctcgtgggattgctctagttgaacatgccctcaagcagttttatttcctttttctttgaaggctgggtttctctttatagccctggctgtcctagaactcactctgtctcctgagtgctgggattaaaggcatgtgccaccattgcccagtgaagtgtggtctttaaaaaattgtgtcttacagttcttcggtaacagggtaaatgtgaaatccgtttcaacaactaagtaagagatgggctgatgtctgcaggtgtctgcaggtgctagtgcagtgccagtgaagggagaggggaggttgagggcatggcctgggacatcctgggcataaactggtccccaaagctggccagtacaaagccattgagtggttg

SEQ ID NO: 25905 - DNA, 1192 bp, Mus musculus
tcatggtactccctacttttactctaatggctcttctaggtcgcattcttaaccaaccacatgtctgcttcctctttcagggtccaagaatagtttttaattcatagattgtttaaggataggcactatgcctatctcgaatactaccatgtcccttctcttagcacacagtgcctgccactttcagatgtctgcttacttatagtcaagctttgatttcattcatggatgagtctttgagcttggcttttaactctttaaggtaccattgggaacatgattttttattaatcagaggcacatagaaaaatatggcaacacccctattaccataccatacctgtcacagtgttctgttttgagggatggtgcttatgtagaagctggctttgtattgatggtataaatttctattagtactctcatttgtcagagatgatagttggtctcaggatggaggttcattcaataaattcattcctccaacaaaagaaagaagtttatactatgacccagctcccaaacaagcacaccatgttatctggaacaatggaaggaagccaaggggataaagtgggacgaggctgctgcttcagcctcaccatgtctgtggtagaataggctgcaggtcagtgaaatgtgcaagaaactggtccaaacacatttctaactcaagtgtcactgtgttccactttaaaaataatttactttgagactattacattttacattcattaaaaataaatgaaaatctgcgtctaacttttgaaagtaagtgttaacttacttgaatgctggttcccccagaaaaactgattactcttgttacggacaaatgaagctggcaccatgaagttttggatcacatgggaccctcaattatccagcagtgtgtgtgtgctctacatacactagctcctaaagggacagagagccaagatgcccctccttagctagcttcagatctaggaagggtttcaacttttgttaaagttcttttgctaaattccttgtcatattccatgttttcccttctgagactgacagaagatgggcagctgggcattaataaatatctgttgaacccactagttgttgggtactagttgtactgttgtttttatccttgaattactccaaaaaatacatttgtaataagcaaaatgtcctagactaggtagtgtacatatta

SEQ ID NO: 25906 - DNA, 1153 bp, Mus musculus
ccctgttgagttgggcatgttgtaatgcctgcctcttcaccaccatcctggccttcaggctgtgtgtgtgttgtgctctaaacagggacccgttcgttatgtctctctaccatgcaggccagacctttaagggccatctaaaccaactgtatattgccgtgctccctgttccttcatccctatctctttcaattctacattttcattaatttgttcatttaataaacagttgattggtgccctgtgttgtgagtttcctagtgaaaagagacatagctgaggaagactgaggggagacatgatggcaccacagaggtggaagattgcagatgcccgttgagatcccatctgtaaaagcagaacgaagtaagagaaaatggaaagaaaaatcatattttacacagcacggtgttcatggccaggataccacctcttctctgcaggggtgtgaaactactctcaaaactgtactagcttgtactaaccttgggagcaggggattttaaggcaagtccgatgcaaaaattaattctattaccatttccaggtacaagggctcaagattttacaacagggatggccatccctcactgttgagaaacatgatactgccaggctccgtcacgaggcagactgcgaccttgcctcactaaccacctactcccaatagttctccacctacttctctccaaaacatcccttttccttggttttctccaaaattcagctattcctatacccagccctcaccccctccttattgtgcatcctgctgacacccagagcacccagaatacaagtgtgtcaagtaagtgacagcagagctggccctccccagaaagcttacctttttcaggcaaatatgcccccaatggtagaagccaagatgatggcaaggataatacagcagatcatgatcatgatcttcttctgctcatcacaaggagagagaaatacatgagaatcgacatcactgtgcagatacacactttgacaaaaaggagacagatggggccagacgtggagggacagaagggacagggaatgcagaaggaaaacggatggatctggcttgtgtagagaatgtttccaggttagacacttagaatcagaccatgatgtgagtgtcctctctgccttctgaatagcattc

SEQ ID NO: 25907 - DNA, 1691 bp, Mus musculus
ggcctccctgagaatgagggggtacctgttactttatttccttataaccatccttggacctggctcagcaaacaatctacccccagaagaatctaacctacctgatgcagtcctgagttctcatcaaaaccacctcccatcctagcagctgaagtaccctcttctggactctgtgaagcaaccctgtgtgttggtgtgtaggttatgctttgtgccttggacaatccccgtgagacaagccaaggcactgtatttctacctcatggagtattctcctggaatatactttgtaggggaataactaacaaagtagaggaattctaagtttagtagtaaatgtggcttggaacagagtccctagctggcaggatgccaatccttagtttgttgtttgctgtcctgaaaacatgaaagactaatagatgccattttggtcttacaagttggcttatttgaaatttaccttttaattaagctctaacttcattgtgggtcacattggtttttctctatattcactcttgtttatttagagagaccagggtgacaggtcttctgaagctaccattggcaaagagtaaggttatagaatttgctggctagtcactgttagataattgctctttgtgaagacattactttgaggccaaccagaaccagggatttaaaactggtccagggacaaggtgctacagtctcaggctctggaaatgtcagtcatttgtgtgttccaggtgtacttttgtaattatgtatgtgagagatatgtacataattgtctgcctctcaggaagtaggaaaactagaagatactatgacctcaaaaaaaaaaaaaaaaaaaaagacaaaggtaagcagcagctaaaatcagctagggaatatatgcttacctcaagtgaatcactgtagaaatgtgattttttccccccttgccatcaagcttgttttctggatggctgctgatatgggaatcaaatgagacctttggagtaaggactaaattggttcccatcgaagttttctgcatagcagatagtgtgtaatatttacctccatctgttgcttacaagagggttgtccagagaacctctcacacccgtctgatgttatttacactatccatgtgatgtttctgtctggcggaagaattgggaggctctagagcagttcttcctgctttcttttgtctcctgtaattcttatcatggaggcaatagcctggaaatcgttagtgataagcctcagacctttggtggtccctgccagtatcccggattttgggtatataaccccccaatttaatgtttctatgggatagatgagtagtaatctagtctaggcactgcctatgagctttctttgtaaaggtacctcctcagtcacccagcattcaagatggagcctcagggatgccttcctccctttggctgtgatgtctggcaggactgactccggctaggaggggaaacaacccttagtgcaggccttttctctcctccttcaggccagctgaaagtttgaaatgccacatatgaagggcttttgttgtttgtaattttttaaatgtaaacttgattattttattgctaatttaaaaataaatgactttatactgattgtaaaacagctctggggccatctctctgcaatgttttggtgatttggcgccaccatgtggtaacttttggtgc

SEQ ID NO: 25908 - DNA, 1147 bp, Mus musculus
gtattgtgtgtgacaatacctcagaaaacaacacaagctgagaggcatctaaggtcttgtattatgagaattcttgtaaagaccataacttgaatgcaaaagattgatcctgttttaacttactcatacaaacaagtcgtctttctcttcatatccttaggctggttcaggggatacggtaaaagatctccagagtatcctgtacctcctgttggctgccacctgcactgctgccatcaccaatggagtgtttttaatgagggaggggaggtagcttatgacccaaagcaaagtcttgtgggatccattcctgttttcagaagttagctctgaatgccaggtattcccgctgctctgatacttctgctgggtggtacttctgctggtttcttttaccttctgcgttacacttttgcatgtcctacttttactcaattcttctcaattttgcattttctttgccctagagacacaacaaacgtccctttatcccatcaccactattacaattcaaagtaggttgtagtataccaaaggactccttcccgctttgaagtctttttttcatctccccttattaatatgattataggagagtcaaaattaagtagaagtcaagatataggtaaatatataaacaccctacacaaacattcgtatgatctccagagggtccttaaagaataagtttgtttgaaaaatatttagttaacatatacctctaaaaataaaccagccgatatatttttaatctgtttctgttccatcttgtcatttggtggattctacttttttaatatataaatacagggtatacagcatattacattaaatcaaacttgttagttggctgatgcccagttctaggctgagaggacttttctttctcctaacctgtatttcctttgtttctgacaaccataatagaaacagcacacacacggttaagccttttcctgtgatgactacagcgtgcttgagagtctgtccctcaagtgcattcaagagtacccaagatgagcctcacgtagagcctgcttctgcagtgtagcttttgtgcgcctgcactgtcttcctgacgtgacttctgtaagccatgcttctgctcctcttccccattttcatttagtgtcttgggtagaaacct

SEQ ID NO: 25909 - DNA, 1101 bp, Mus musculus
gggctgctctacactcggatgtggtagtggccccacgattctctccacctttcaaaattcagtcagttgtatttaattaactgctgaattaatagttcatgcaattctagctcagtaaagactgtatttttaaaagctaatagtaagaggaacagtggggcaataaactctgactcacaaacagtgcttacaagctctgaaagcgatttctcattgcttaaatttccaagagttgtttgaaggaaataaaacaagaatttgtttcctaagactacttaattttcaacggcccagagttaataagaggaactaaaggcagagcagggcagatgtctgttacctttctgtttagccttttttgtcttgttatggcaggtccaaggcagagatgagacacacctgccgaggtaccatcaacctcgccacagccaacatcactgtggaggactcttgcaacttcatcatctccaatggcggtgctcagacctaccacttgaaggccagctccgaagtagagcgtcagcgctgggtgacagccttagaactggccaaggccaaggctgtgaagatgctggccgaatcaggtatggaacaaaggaacactgacctgggaaacacaattttttacaaccctgactgcagtgtacattttgattatgttccatgtcttagatatcccaagcttcttgttgtatgttatttcccttgagtagtgattgtgaactgagttcagtcctgcatatacacatatgacatttgataatgtctggagatatttttagttaaaaataaaaagctggggtgttactggcatatagagacgagaagccaaagatagtgctcagtgccctgtgaggtacagaatagcatctccacccttcagctggctgaagttgaaaaaccttggtcctaaagatatgacataccacttatgcttaaaaaaattttgttgtaaattttttgcttcatggtcttactagtagccttggatggcctgtaaccctatcctcctgcctctgcctcctgagtgctaggactaaagacattctctactgtgcctagtgcttgacccgtgcttttatttttaatatcagttaactt

SEQ ID NO: 25910 - DNA, 1451 bp, Mus musculus
taactcaaaggaagagggctgatcggagaagacggcagaggatgtgcgggaaggctggcagttgggactcttaccgagtgctttcctcaaatttgtctgtcttaaccaatcactttttccaaatcaatcaccagaagcagacacccgtggtggtgattggctggttgccttagctgattgacgctgaaatcgacgtagtagatgcccatgtttgtaagggagtggtttagtggctggaagttagtgttcctctacatctcaaaggcaagtaagtgtgcttccctctcggcctcattgagatgatgtcattgaccctcacctgtgtcctgctcagccaagatctgcataagattgggattcaggagcattttggtgctgttcagagcaagaactgattttaaagttcctttaaaaagaaacacataagatttacccagcagaggcatcacgcctaggtctcagtgtatgaagtgtactcacacgtgggattgctgtaacaggtcgtcgcgtgtagataactaaggctttggagcatctgcaggagagagtgttctctagggcttgaatattgaattatgttcttggagattttatcttcacttgcatacaattcccctctgcggttttgtctactttgacagcaaccaggggcctccttggtcgttgataagagggtcacacgctcctcataaaggggttttatggactccctcaggtggagaacctctgcaaacacaggcagggtgggagaagactgctagccacttgtaccttcccagtccctcctcatccgtctttcgttgcctttctggcttctgtttcctggcacagtaccattttgagtttgtgccacagtctggagcaaaacattgcctgacccattctgtatacttcagaatcttagagaagttcctctgcaacaaatgttttcatcttgaaagtcccagtagaatggagccacttctgaaataatgtgttaaatcatctgtatattatatatatatatatatatatgtagagaaaatctaattttttccccctttcccatgaagaatcttggtttttttatatcacctgtctccctgggactctctcaagtgcgcgttaatatgggttggtgcctctgctttccatgtttgagggacattgcaaccccaagcagggtcatgtgtggcagttgctgagcagggacaaggaggaaggtttttgtgcctaccctgcggctgcctcagctcggctttgccgatcacacgtggctcttggaaaggaagtcctggtctttttcctgcctcagtttccttccctaggaggcgtacgggtagaaagtcaagagggtgatttctagcttccttatgtcccagctcaggctaaatcccaaaaacgtttccttccaaggatgagagctaagagcgctcgtgctctgtgggagctgctcctgctggcactggcac

SEQ ID NO: 25911 - DNA, 1156 bp, Mus musculus
tagaaaactttgattaaaaactagtctggtaacaacgaaaagtttgtaatctgcccttaaagaagtatttcaaaataaacacagatttttctaaacgccgaaaacaaacgggtgctttcaaaaggagacttcaaagtaccgtttagatgcgtcagaaacaaaattagataacctagacaggctacagcaataactacctgaaaaaaattaactagcacaccacgtggttccactggggctcgaacccaggaccttctgcgtgtaaagcagacgtgataaccgctacactatggaaccgggcggaggagtcgcatgccatatcaactaactacatgtagaactgtggtgacgctgggacttggaatcaagatgtttttgtaccttgcgcagagaacttccaacaggacctggggtttctagtggcgccgctccgctcgctcccggctgctcgcttccggctgcacactccacggttaatggaggaagagagagctcgtccccccgagtcgacgctcctgctctgatgtagacagtacggagacagaaacacacctggctctgtggcgcaatggatagcgcattggacttctagacaaatggaggcattcaaaggttgtgggttcgagtcccaccagagtcgcttttattttaataagagagttataacgcaagaacaaaagaccggagttaggaagaaggaaaagtgtaccgaagtccatgagtattaaaacatcctgcctgacatgcccattaaaataaaaaaggaaagttatcgccgtcgtttcaagtgtccgtcaccatagaagaatcagtaatcttggtactaccaccagcgagctttctcagtcactttccagcgtcaatcacattgctattgtatgcggaaatgaagtaatgagcgaggtataatcagggttacgaacctccctcccctgtgactttgtttttcattgttttgttttatatgagtaaaaaatattattttacggttctttgaaaacttttaaatcttgcagtattgctccagttgctggtaaataaaatctagctctttcaggtaccagaatggccgagtggttaaggcgttggacttaagatccaatggatttatatccgcgtgggttcgaaccccacttctggtaaatgtgtttttcct

SEQ ID NO: 25912 - DNA, 1227 bp, Mus musculus
atttggagttttctaaatacataaacatagaatatgtagatatgttgagttctaattttttgtgaatgttttaaattcttttttcttgcctaattactttggctagtttcacttactaagggaactagaaggaagagtcatcctcctgtgtcactcctgattttaatgagatgctttcgacgtatttttcaatttttattattttatttatttatattcccatcattgtcccccaccttagtccccctctcacagttcctcatcctatttctcttccccttgcctcagagagggtagccctcccctaccacacctccccttccctgaggcctcaagtttctcaagaattaagtgaatcttctcgcactaaggcctgaccagcagacctttgctgtatttgtgccagaccttggactggccagtgtatgctcctggctgttggctcagtctctgggagctccctggggtctgggtaagttgagactgctggccttcttgtgggattgatctccacttcatcttcttcaatccttcccctaatcaaacataggggtcttcaacttcagttcaacagttggatgtaagtatctgcttctggctcagtcagctgctggtagggactgtcaggggccagccatgtcaggctcccttctgtaaacacgtcatagcatcagtaatagtgtcaggctttggtgctctcccattagatgggtcccatgctgggcttgtcattgcttttccttcagtctcttctccatttttgtccttgtagttcttttagacaggatcacttctgggtcagaaattttgactgtgggttagtaatgctgaccctgtgcttggggccctgtctatctactggaggtggaccattcaagttccctctcctcaatgttgagcattttggctaaggtcacccccaatgggtccttagagtctctcacctcccaggtctcgatacttttgagagggtccctcctcatgctgcttatctccattcattcttttggtcctcttggcttctttcctgtccccgctcaatacctgatcctattccccctttctcttccccctcccctctcccaccaggtccctccctccctttgcctcctgtgattattttgttccctcttctaagtggaattgaaacaacctcacttggacctttctacttgttacacttcttacagcctgggttatatcctagtatcctgtactttttggcta

SEQ ID NO: 25913 - DNA, 1218 bp, Mus musculus
gtgtgggtcaagcagtagctggtaccttactccttctcttgtgccaacccccaaatatacagaattcatttcaatgagattaggccctggacacaagcgactttgacccagagtgcttccccagagaagccctggtgtgctctactgggccaagcagggagcccccatgccctttcttttacagtctcagcaccagcagccatgttcttccttcatgagactcccggggtgaacaaatgggattggagacacagctatgagatgcttatcccttgaaaagctatgtggtatatctgtggttgtctgtgcctttgtgcttccattcccctgtcctttttgtaagatttagacttctgtgtgattttatacttcagtcaaaagtacttgtcctggcatcgcattgctgtgtgcatgagaggattgggagaaggctgctgtggcccaagaaataaccactgccccacccccccttgcttgttcgttggtcacttatatctcagtgggggtttctgggagagggctggtgaatgtccagatgtcaggtgttctgttagtaactgctgtgatttgaagttgttggtgttgttctgtgggaggacatcgccccctggtgctcatgaggtgtacgtgcagaacaataaactgcaaatgaacaagcacaaattgtcgttactcctaagggcctgcttttgtagaagtgctttggcagctggctcagaagcatgaggattacttcctttatctgcgggcaacctcagtccaactagttcgataaagggaaactcttctttctttattttctaaaacttcccacatctcttctactcccacatttcacctgacttaactctgggtttcccctcaaagaaacgggccataaagcaacagaaatgaatatgtgaacttggggggaaagggtcatctttaaaaacatggaaactggcttcttgcatgttgggggatgcatgtgtgtgcggggatgtatgtgtgtgcggggatgtatgtgtgtggaggtgcatatgtgcgaggcgatgcatgcttgtataaagggacacgtgtggggggtgcagtatgtgtgtgtgtgtgtgtgtgtgtgtgtgtgtgtgaaggtctgctgaagctaaaggttgacattagttatctcctctgcagtcttctaccttatcctttgaagcagggttctctcagtgaacctggaaattaccattttggctagga

SEQ ID NO: 25914 - DNA, 1165 bp, Mus musculus
aaccaccccctttctcaggatccccaatgcctcacagggttggtggagttccttatgttctctcatcagcctacttgggatgattgtcaacagctgttgcagatgctcttaacaaccgaagagcgagagagaattctgttagaggctaggaaaatagcccggaagccaacgggtggtctacacagctacaaaatgagatcaacatgggattccctttgactcaccccagttgggactgcaacatggctaaaggtagggagggcttaaaaatctcgccaggctctgatttccaaggtgcctcaagatggcccactaatttggctaaggtaagaggtaatgcaggggccgatcgaacctcccttggtgttccttgaaagacttatggaagccttcaggcggttcactccctttgatcttacctcagaagcccagaaggcctcagtggcctggccttcataaggcagtcagctccagatatcagaaagaaacttcagagattggaaggtgtattacaagagggagacagttactcgatctagtgaaagaggcagagaaagtgtgtgtgagagagagagaggcaggaggcaaaagaaagagaaaacaggagggatcatagacaagagagaaatttgactagaatcttggccgcagtgataggagaaaaagaaaaagacaagatctagacaggaaatctagacaacagaagacagagcctcagctaaaaaggctcagctatgtcagactaaagttatctatttgggatacacccttcgagacgggaagcagtgcctaaagaaagccaggaaaaagactgtaactcagatccccaccccaactacaccaaggcaagtaagagaattcttgggtactgctggcttctacagactctagacacctgggttggcgaccttagctgccctgttgtaccccctaaccaaggaaggggaggtgttttgtggatgtaaaagggagagcaggggtcaccagaggagtccttactcagactttgagaccttgaaaaaggctagtggcttacctatccaagaagttacaccctgttgccagcgggtggttttcttgcctgaaagctattgctgccataacactgcttgtcaaggatgctaataagctcactctgggacagcaaatagctgtagtggcaccc

SEQ ID NO: 25915 - DNA, 1126 bp, Mus musculus
ccatcaattgaactatttatgtaaggtaacatggaaaagaaaattaagtgctaatgtggtctcggagatcctagtgtcaggaaatgctacgatgtgagaaagttcagagcatagaaactggagttgttggccaaaagattcatggaaaaaaagaagcctaccatgcttctggaaacttgaaccaatttcaaacatactcatttggttctacgcttatctcccttctctgctgaccagagctcagccaggacactggatcacagagttttcagccctaagatgcccctgatcatagatgcccttcttccactttggctttcttacttaagacttggatctgaaattaaccttcaaggaatggttttggaaatcattgagcaggcaaggaactggtctctgccatagaatttgtgcacctgagagttcctggtcttgagttatggagagcaagcactggtttctacttcataggattcacaatggagagggctaggaagatactggacaattttcagcagtgtgacactcaagtcctggtcccttggagagaaaggacgcggtgttcaagaagtaatctcatcaaaatcagagtcaatgagaccttacatacagaagacatgaggtcttagattattggagggaaagtggaacgagtagttgagatgctgagggaaggttgctaagagatctggcattgcttcaattcttcccttatcagaacgaaatatgtcctgtgttagagctagcatgatcgcaagccacaactccccttattttccagacacctcctagtcctattgtgagatattttgtgtcccctgcccaatgtattgttcccaaatcaaatacagatgaatcaccattaaacatagtgaattttgagatacaaattaaaaaaattatttgtatggaattccctttgtttttggtccaaatattcattctcaatattataaagtaataaatgttgttttcacagctgttttctttagttatttattttttgtttgtttgtttgtttataacttataagttactcttaccagccaaaagatcctcattatttttaagttctgttgggagtagagggggttccgaccctgcaagtattatgactgacaacgaa

SEQ ID NO: 25916 - DNA, 1198 bp, Mus musculus
cctctgtatagtataagctacttttattttagtactacatattagactacttgtgactaaatagatctgccaaaaagtcttgagaaaaatgtcaaattaaccacagttctgggcttgttttctcataaaaggccactgtctaaaagacctgctgtggtaatatcccaggcctctgatcaaagttataaatttaagttctctaagaattgaaaacttttgaaaagccttgccagttatgagactcagtgtccaaagagatggacataaaagccagctgtattctaaaggattgatttcaccttgagagtggacagtgggcatagggaaattcaggcagtgctgtgggatcaggactccccatatgaagggtttccattctaagcattttcttaacaacttggatcactgactatgaaagtcaaggaaattgtatttgtgattgaagaaggaaattgagatgatatggaacatatgttttgctatatccttggccaggtaaaacatcaaggcctgaataaaaatatcagccttgactcagtggatggtgtaccagtggcaagcactgatcgctggagtgagatgactgaggcagagcgactccaagagaacctccaggcttaccgtaccttccaagggatgttaaccaagcttttagaagaccagagagtgcatttcaccccgactgaaggtgacttccatcaggcaatacatactcttacgctccaagtttctgccttcgcctaccagctagaggagttaatggcgcttctggaacagaaggtccctgaaaaagaggctgatgggatgcctgtcacaattggagatggtggcctctttgagaagaagctgtggggcttgaaggtccttcaagagctttcacagtggactgtgaggtctatccatgacctccgtgtcatttcttctcatcacatgggaatctcagcacatgagagccattatggggccaagcaaatgtagctcttaactcttgcctctgtctccctctttgatctaatgggatatcagtagttccccaggggcctagttttctcagcatcaattttggaaaaccttagaccacaggcatatttcgtcaagtagggttgacccacgtatgaacagaagataaacatggttattctggctgtgcatatgtgtgtacatgattttgtttgtattggtggtataataaagtata

SEQ ID NO: 25917 - DNA, 1198 bp, Mus musculus; identical to SEQ ID NO: 25916

SEQ ID NO: 25918 - DNA, 2367 bp, Mus musculus
ttgttgtttcttaaacataaaaaaaaaaattaatttttttagttagatttcctaatccttcctaagtattgtatggatatgtaagtttttcagttctcacctggcccttaagatcctctgattgatgatttacttttggatttcctttagatgtgagatctgtggatttacttgtcgacaaaaagcatctcttaattggcacatgaagaaacatgatgcagactccttctaccagttttcttgcaatatctgtggcaaaaaatttgagaagaaggacagtgtagtggcacacaaagcaaaaagccaccctgaggtgctgattgcagaagctctggcagccaatgcgggcgccctcatcaccagcacagatatcttgggcactaacccagagcccctgacacagcctgcagatggtcaggggcttcctcttcttcctgagcccttgggaaactcaacagctggagagtgcctactgctagaagctgaagggatgtcaaagtcatactgcagtgggacagaacgggtgagccttatggctgacgggaagatctttgtgggaagtggcagcagtgggggcactgaagggctggtcatgaactcggatatactcggtgctaccacagaggttctgattgaagatacagactctactggaccctagtgcaaaggaagactttgggcactgggacagtgcagactttgtatttaaaagataaaaaggacaaaaaaaatttaaagcatttaaaaatctagtaaaataactgaagggcctgctctttgcattgtggatcacaacacacacacacaccatccccattccctgaactccccttcctcatccttaaaatattgatgtagcctttaccagaaaggttgatgaaaaagcagcaacatgctaggttccagccagcagcagacttcctgctcattggcaaatctcctttttctcagcctataactctgatgtgctctggatcagctttgaactcataatagtatattactatcatctaaatcttttctcctctactactgccctatggctctggcttcttcccactgcaacaaccaacacttaccctcaaatattatataattctattttccggaggctggcagcttgacttggcactttagggctccttggcaggatgctgttaaaacagcacacatctctcacccctcttccattactcactgggtttggggaaggaaggatacatggggaccacctccctccctttcaatggatcccagcacctcagttccccccactcctgaacctccataatgctcttaatggtgctcacttgcttggaagcaggctcccaagagaggggactgacctctgtttctggctgaaagatagggctctgtgtcagtgagaaaagtcccaggctaatggcagaaatttgcactttgaacatgtgtgttttgtgttgtggaacctgagattccttatttattaatggaaagtctgattttttgggggggagggtctttgttgctatgttttgtggggctgggagagtagattattctgacatgggatccttcctacaagaggtactttgaaggcaaggcttagagttgaagaagcacagccagcctctaaaatcatagttctccagtggcctttaaagtaagctggtccccagcactaacagaatcactacaatagcctagtgcttttttggaagccttagggaagtttgataggtttgtggtaactagtgtgctctttgagatttttaagagcatttgagatacaagaattttgaggggatgaggaatgttggtcaaggtctaaatcacacataaaaaattttcttctgtgaatttatcttctttgcatatatatccctgctggccccttgttttgattttgttattggtcattccagctctcagtggaagaccggaccctgtcattcatgaaggaacacaatctaaaagttctagagatttggttaagagtaaactcttctgtcttatctcctctttagaagagacaaagcttcaatagacaaaaacaaaagtaaaaatctatacgataatgttttttggctttccccagaattatctgttttcctctgagtagagattttaatgccctgtggcattaaaattactgtcactgggagacacggatcatatttttacatgcttctacctctcaaaagactaaaaccctaattcagctcattttttgaaaattaggagtgcagttcttccctgtgtacttcagaatcagccattgaagactgggccagttgttgtcagcaacacatgatgactattgggaaaaataagagtttgagaacaaaataaggaacagcttgtttttcacaaacactaaaactgtgg

SEQ ID NO: 25919 - DNA, 2367 bp, Mus musculus; identical to SEQ ID NO: 25918

SEQ ID NO: 25920 - DNA, 1375 bp, Mus musculus
ttaaaagttttttttttcctttacattctgataattgtaaagagttttgcttctagtgagctataatcaagaagtcaagagtttgaatcttttagtgtatattgttttctaagtgaaaagtattttattagctaatgcctctcaagagaagtttacttaaaaccttagctgtcattaagctgaccctaagcagagctgctttatccttactgtaaacatttatatggttcctgttaatccttttgaagtcattcctttgtttccagtcaggtaacttctaagttctttgccttctgtgacttcctacccccttttattttctgtattctttggcaagaaaaaacattattcttatcctctgggccagtggttgcttactgctatggggcggggcctttggacatacagttttttgtttttgtttttttccccgaagccaagtaattggaatgagtccactttaaattctttaacgacaatccattggagggcaagtctggtgccagcacctgcggtaattccagctccagtagcgtatattaaagttgctgcagttaaaaagctcctagttagatcttgggagcgggcaagtggtccacctcgaggcgagtcaccgcctgtccccaccccttgcctctcggcaccccctcgatgctcttagctgagtgtcccgaggagcccaaagcgtttactttgaaagaattagagtgttcaaaacaggcccgagccgcttagatactgcagttaagaataatggaataggaccatggttctattttgttggttttcagaactgaggccatgattaagagaaaggccaaggtggtggttgcagtggcagaagcggctgtggggggcagggggaggaggctgtgtgcagaggtactgcttggcattgcagtggtgcactatcaatggcagcgggtgcatcaggggtgcactgcctatgctttagagatgtggggctcagcagcgggttaaaatccagagtccttttcagagtggctccacaggccatggtggcaagtggccaaagttcggcttaggcggggccgagaaggacaaggacaaatgggccccccaaggtaccctgtaggtgtggggccagagacctcagagccgtgacaaggcaggtgggcgggtctgaggtggcactcaactcaaaagcacagtttcatcaacctattaaaactactgtggtgctaataatgaattgtaagatatattcgtgtattttggaaaacctataacaaaaattgtgtcttaggaacctgacaaaatgtctgttccttgttccaaacagcaattaatttggttattacagaatacgaataattgatctattacatataatcattttaaataaaattgacac

SEQ ID NO: 25921 - DNA, 1173 bp, Mus musculus
ttttttttttggtgtttaagttctagattgtttttgtggattggccacaacagaaacgtgggtattttctttctttcatttgttcttcttcttcaaaagttttttttttcttccagatcagtttcttctgtctcttttcctcccagttcctcctccccacctctgcctttcccatccactccttctctgtttctcttcagaaaaggaaagacctcccgtgaatattaaccaaatatcacaattcaagttttgtaagacgagacacttccacaacttagaaattactcagccaaaaaatagataaagaaaatgtgctacatttacaccatggagtattattcacctgttaaaaacatacatcatgaaatttccagacatgtatattttcaattgaagatataaaatctagttttcttgttctacttctcaaagctactaggactgttgtgtaatctgttttgagtctttaaggtgatcctctagctggttaaaatcaagggtcaaatttaaaaattccacaactctgacttattataaaatcatagaacttactggggtctggacattaaagcttttgcacttaccagtgcagaggtagaaatgaaagcatctatccttggctgcttagaactagactcagagttaatgtagtcatggaatcacagtggctcacatgggatatcgtcctcttcccagctccttggagacaatatccccacggtgcttttctcaagagaaacaattatttttacattgttgtctgggaggcaacaaggaatagagaggtaactatcttttctttgcactttcttcggcactgttcctactctgtgacctttttcttgtgacttagtttgctattactgttccaaggaagtggactatttgctgtgtgtgtgtgtgtgtgtgtgtgtgtgtgtgtgtgtgtgtgtgtgatattcctgggaagtggaggaacataaagagttaaacttctatattttcttcttatgctgattagagtatttggtaaatttgtagaatattgagatggactcccctgccaccaaacgaaaaagattccatctgtagaagaacacagatattgaccactatacttttcattggctgccagagtagaaaacagtctataaaaccaatgatttattacacaggacttctaaatggaaagca

SEQ ID NO: 25922 - DNA, 2332 bp, Mus musculus
ctctctttgatgcctcaggacaggaatccttagcctaagctaaggatgatgtcctcctgccatgtctaggaatgttggtgctgccctctatctgcagatgtacttggtgctctggggagcactttggttgtacatctgctcagccacacccaccagtcctgctgctcagttcctctatgtgacattcttgatatgtttcttccctagtccaaagaatcctcatcggtgcttagctgtgacatctctgtggatgacaagtacattgtcactggctctggggacaagaaagctacggtttatgaagttatttattaaggacaaatcttcgtgcaaactggactcctcctcatagcactttgcgctgttgtacttttctgttcacccctctcccattctaaaaccaaggatttccaatactcattgcagttgtggagtttaatcccttcccatagccccacttcctccttgctattgaattgtgaatactcattaagaacctgtgataccaaatcttcagctatcgtcttggaagaacatggaatacctaacagtgaatggaatctttaattatgtattatatctgtaatatatttattttgtttaaagaaggctttctaacaatgactgactaaataaagctgtccgctcctgcattgataatgaaggtgcattgtatttgatgctccacccctcccttttggtgagggaggggaaaggaaggtttaaaataactgatttaaatgtcactaaatgtagactattgactgtatagagatgtgaaatgtataattacacacggaagcaatatgttgctgtgttgttatgaggttgttttgttttattttctacttatattaaaaacatttggaaatttggctgtttgaacaagtagaatataacaggccaagtactattcctttgagtctatttgggcaactttaaccaatatgtctataactttagattacattcaacaaaaataattagatgtttttcttttttattttttacttgttgacaagtatctttgtaatattttttaattcctttttttattgtattatagacagatcaaaaattaaattgggcctcaaagagagaacttaatttcttctaaatatttttgccaaatttcctggcagaggaagctgtgtgtctctgggcagttgtgatgctgtgagacatggcaggctgttttgtgtcatgctctttaggagctgtaggtacaggaggactgcttgcctaccgctgtgcaaagcaagtctttcccacacaaaggccagcagaggagggtttgcagagcccaccctctgaaagccacaaagaagagcctctcccgggatggtggcttgctttatttacctctggttctttccatgtcttagttggatgtccctgaaatggacacaggctgtgccattgtgccagaaacattgtgttatcttttatgttgttgttgttgttgctgttaaaactataacatgtgactccttttttattattattttttgtttgaatgctttaaaaagatcttttaagtctgtggatctgctgatgtacagtgcctttgctgctatggatcaaaatcaagaactgtgtagataaactttattgtataagtagaaaaatcacttaatttcatactagaaatggatggatgctgcaagctgaaatggactgtcattgacgttctttgtgtggtagcaaaaaaaatggtgtcttaagtgcttagtgtttgatgtcattaacagtttcataaaactctacagtgtagaaagattttgatactaaactgtgcattgtacatagttctaacgcattgtgttggccaccagtacttctatgatggtagattgtttgtgcattcagacttttaagcattaaacataaataacttctagaatgattattttctaattatttttgctaattgctttgtctatgccactccctatattaaaatcactagttatattcaagtcagattgttaagtactatgggttttgaactgtttctttttttttttttttttttttaatttttcttttgagataacccagaaagcatgaaagaagttatggaaggcaggtggttgccaagtatttactgagcctctcattttgttgacagtctttcatctagaagcagtccaaaactctcaaacttgaaccatttagatttttactgtcattctggtaaactagccacttaaagctacttaaacttaactcttggaactaattaatattagaaacctttttttgccagtaatacagactaaatttcaagtgctcaatagctccacaggagctaacagctattgtactggac

SEQ ID NO: 25923 - DNA, 1219 bp, Mus musculus
acagtgatggtgagaagagtgatgacaacttggtagttgatgtgtccaatgaggtatgttagtagctagccctacttctgctgctctgcagctatggcagaggcaagtgtccaaagcacttaggagaaactattaccaactttatacattgctgggtctttcaaaatgctgctccttcctttcagatgtcactgtccttcccaccactagaaataacaggtgtcagtggtcaccctactgattttatgttccttacaggctcatggagtttttgatatttgcttttgttttgggatgtcctctcaataccagatgtttccttcagtaatttcagttaatgttaattgattaaagtccagttaattccagacattttgtactactaagtgcttttagttagaagtgcccccagtaaaggacttgtgctatgagtcagttgtcagtcttcttattattatttttaatttactctgtgtatttcgtcttcgaaaaggcggcgcagttgacagtcttacttgtttgtcattgtaggatccatcttccccccgaggaagcccagcacattccccaagggagaatggcctggacaagacacgactcctcaagaaagatgcccccatcagccccgcttctgttgcatcttccagcagtactccttcctccaaatccaaagagcttagccttgtaagctgctccctaaccagaactgccacttccaagatagttattgggtttggggttttcagtttttgtgtatttcccatttatctctggggcttagatttccagtttaattaaaaatatgtttgaaccagaaaggtttactaacttgatggtatttgcttcctgagtttgtatgcttaagagagacataggtggatgaaaatgagagaaaaacatcatagtaaagttgaaaagtacagataagagttagtgtgatgttctcattgcctgtggtttgtggtgaactcgctcaggagtttagctgtcattttattaggtgcttcatttgaattgccacgctagacacagctgcaatagttttgcttctgcctaagtactctctcactaatacgaggctgcttggactcaacacgaatgcctgactgaatttgccagcaagctgcatctttccctacgccgtctcctgtatagggctgtatagggctgtatagggcgttggttgcatttgtgtgtcgtaaatccccttttctcttca

SEQ ID NO: 25924 - DNA, 1146 bp, Mus musculus
cactgtactacttactgattgatttgcagctcctttttcttcaggctgagttaacgtaggattctcttgaggcattaagaatcagtttggtgttgtacatgtgcagggaaggggccttttgcagcgtttagggtgcttgggggcagcagactttgatccaacagggaagactaaaggctatgccccatccttgtctgaatcatgactccttccttcagagtattatcccaggcaacctcagtagcatccaacttcacttttctgttataaatctatgtgtgtgtgtgggggggggggggaacatgtgggtttagagagggagttttgtgcatttttgaggggtcagcattttgttggttcattttggcgtgtgctccctttagttatcattgttgtcctatgaagctgtgtccacaggtacagaatgagggagaccatctatcagatacagaataaccagaatgtaaaataatattgataaaaccaatagggatatagcctgttccatgattcttaatagaagtgccaaagatgccagaacttttgaaaacaaaatgttggacggagggtggtatttgcctttggcagataggagagctaggactgcaggttaatgtaattgaattttccagtgtggtcaaactctcagaggcttcttaattgtgaggtttttgtcttcccacatgagccaggactattctagcaaagatctgttgtctagaaacttgcctcatccgtaagtggaaagcctttttcatgggtaatctgggtgaggcttggaatcatcaggtcacccttggggcagcctcttctcaccggtcactagacccttgtcttttgaaaagtaggtccaccaaagcacccagtaaaagacatctttgtgttttgtacttgccctgctttctacctacctggagtgctaatttacgtgcttagctaacattcggaattttattaagtaagaggggctcatatttctatagttatcgaagtaggtacccattttgtttctttgagagtttgttttatgtaaaaatcataactttgctagctcagaaaatactaagaggaaggactggattaagtggaaatattatataaccttacagttttagcggcggcggggggcggggggggggtgtgtgt

SEQ ID NO: 25925 - DNA, 1623 bp, Mus musculus
tagctaaaggacggaaaaagtggtagacatgtcttaagacttgttttccttcagtagtcagtaatctaaagaaaaactacccagtcagaaaataccatttggctttctggtttccttttagccacacccactctgtctacaaagctgtttcttcaaatctagaaaaaaaatgtgggtgagttcccctgagtccccaattaacttctttcatgtctttgaagacaccaccatcttgtatattgagatcctacttataggtgtcacttgtaaaagcaactttcctattgcataccctaggaaagagttagtgctgggaaggccctgccaagctctttgcaatttagtcttatattttgtgttaaaaattagaaactgttactagaaacaaaaaattagccctttctttcactgaagtatcttcaagcagattatagctaacatgcatttggcccttggggagaaggcacacacatttttttttaaaagatttgttttattcttgtatttatgtattgaagactggatatgcacatgacttttagggttgtcaaccatctgatgtggctgctgggaatggaactctgatcagttctcttaactgagccctccccatgccattgaacacttttaggataaccataatgtcttccattgtttaaaaaataatatgtttattattagataagcaattttgataatcataaatagagttctatttgtggttttgtgtctacacaattacataatcagtaaatgaacttgtaattattcacaaaattcattttcttgaaatataatctaaataggattcattattcttcttgtgataactcttaaacctttcttcatctaaaagatttcccttctaatttttttctaatgacactgtacaatttttttaattgttgattttcatgtgaatgtgtatgtgactgaatttatttgtgtcctacatttgtacacctggctcccacaacagccagaagatggcattgggtcctctggattggacttagaggctgttgtgaaccacatgtgatatgggtgctaggaaccaaacccaggccctctgcaagagtagcaatcagtcttaacatttgagctatctctccatccccacaaagaaagcccaggctggccttgaattcatgattctcctgtccctactcttcagcatgtcctaccaatgttcaccatcacaactagctacatttatgttgtgtgtgtgtgcacatatgtgttccatggcatgtgtgtggacgccagaggtcagatttcagatggttgttttctcctattatgtaggtctcaggacttgaactcaggaggtcattaggcttggtgacaggtacctttaccagctgatcagttctgctggacctggttaacttaaaatacccttctcaaacagcctttgatttccccccctccccccatctcattgcctcacagattagattctctcaatatcctaaaaatttagtgagagagaactttgtagtattatggagaaacagatgtatttaatgtattcttaaaatcctattaaaatgaaattctagtttacattaaacatattaaaatatactttaggttaaccaatacttcatttggaatgtagat

SEQ ID NO: 25926 - DNA, 1175 bp, Mus musculus
tttctttctttctttctttctttctttcaagacagggtttctctgtgtagccttggctgtcctggaactcactctgtagaccaggcttgcctcgaactcagaaatcctcctgcctctgcctcccaagtgctgggattaaaggtgtttggacagtagctgtcttctaactacgaaagtaatttgtagctgtaggatacaatcgtataaatattgtcagtatatccattttcaagaatcatgaattggagacattgacatcataaagtaaaacaaactccacatacgtctttcttacaatgtgattacctctttttcactccagctagactacttttcccactcttgtctcgcctttgtatgacttgattggaagaatatttttcagagatgagaacgtgggaatacagtttgctctgtgtgctatctttaacaagatattcctttttattttagttaaaacagagtataactgacatagatgaataacctgcattacattaatatttttttttttaattttagacaaaattttttattagatattttctttatttacatttcatatactatcccaaaagtcccctataccttccccccgccctgctctctaacccacccactccttcctggccctggcattcccctgtactggggcatataatctttgcaagaccaagggcctctcctcccaatgatggccaactaggccatcctctgctacatatgcagctagagacacgagctctgggggtactggttagttcatattgttgttccacctatagggttgcagaccccttcagctccttgggtgctttctctagctcctccattggggccctgtgttccacccaatagctgactgtgagcatccacttctgtatttgccaggcactggcatagccgcacaagagacagttgtatcagggtcctgtcaggaaaatcttgctggaatatgcaatagtgtctgcgtttggtggctggttatgggatggatcctcaggttgggcagtcttccttcttcttgaatttcatgcgtttagcaagttgtatcttatatcttgggtatcctgagtttctgggctaatatccacttatcagtgagtacatattgtgcgagttcctttgtgattgggttacctcactcaggatgatgccctccaggtccatccatt

SEQ ID NO: 25927 - DNA, 1201 bp, Mus musculus
tcatctctcattggctatgctaatcttaaatttcatgttattttcaatgtctcatagtagtattcagtaagaaaattctatttataatttgtggttaatccccagattagtaggcaagatctaggaagacttctaaatgactatagactagtggttcccaacttgtggactgtatatcagaagcattatgattcaaaacagtagcaaaaaaagttatgaagtagcaatgaaatatgttatggttggggtcaccacgacacgagtagctgtattaaagggttgcagcattaggaaggttgagaagcactgctctaggccttcactcccatagttcccaagagatggtatagctatggccatttagctcctctaagccaggaaagaaggtaagaaatgttttctttcttggaactgtgttggagaagcttgctgccttggagaaacatcaactaaacagtttggggattacagctgttactgtggagtagggttacccatggtctgtggactggggcagctatgtgaacttttgataaaattgggcaatgagataaggagcttgtactagaatataagtcaacacccagcttcttttgtggatagtgtctttatctttgaaacaaaacaagagagatccacccacctgaataaactaattgatttacctcctgaccaaaattgctttgctgtcctgctgattggtgataatctggggggtggacagctttttagaatttgtagtcaatcaaaaaattgtcagttatctataaggtgaatatgagtggatatatgagtatatagactgactgaaataaagtgattttttaaattgtcatcttaaatacttaaaagcaagttagtcaaagatttgatcaaatttggcatggatatgcatagcatgaccaagacatttgacatgttcacaagttggcagctttggtgggcattgcaggttgtccttctgggaatgtaaaacttgtttaaattcttctaaatccttctaaattcttcttttagaggattcccctttcccttactttttaccatgaactcaatgaaaagaatgtttctatataaatctcacataacttttattctgcagtcctaaaatttaggacgtcatcatcaaagaagctttaaaatcaatcccaattgtctctcctgcacccggaagctgctgtgcataagttatactgcaccc

SEQ ID NO: 25928 - DNA, 1149 bp, Mus musculus
tgtcagcggtgaaatgatgggcagtaacacagaaccgcgattaatgttcagccatctccgattggttgatgcggcgccctcgcgccgcgggagggcggggctcctggagagcgccgcggagagcgcgcggggctagccggagactgtagtcaatctggaggcatccttggccacagtagccgcgcgaggactacatctcccgggatgctccttgggccctccgcggatggtcgtgaatatgtatcagaatgttaatgattagctgctgctaaatttggtcaaagaagtcacctacacagagcgcgttgttagagctgttccgagcgggcgttcggctgttggctgccttcttccccctcttacacactcgtgtattattttgaggtggtgttcgcagagtttgaaagagaattttaaaaagccgcaagcgtttcgctcttttatttttataatccccttcaatttggggctaaaaaaacaggaaggaagaaaaggaaatgaaatgtggtaaaagaagctaaaaggtgccttttaaaagatcgttgctgtgaagtgaaaaaaaatctccagagaacccccaagcgccgcgagacctcttccgaaccaaaggagtttgcgctcgctctcagggaagaagcgaccattcattccgaggaatagcagccaattaaaagacaaataaaaaaagtttggagtggggcgcgagcaggcgggcggcgctcggcgggcgcggggctcggcgggcgcaggacggacggtgcccgccgccctcagtgacgcccgcggggaatgcggagccggccgcccgcgcccagccgccgcgcctgcctgccgcccgcgtcacgcgagacccgcaggcccgggacgccgccgcggggccctcgaagcggatgagccgcgcgcctctgcctggcgcagccaactaaagcggcgtggatgattcgcgacctgagcaagatgtacccgcagacgcgccacccggtgagtggcgccgcgcccgcagccctgtccgcggccggccgctccgagggtgcgggaggcgaccgacttgtagccattttcttattgttgtctctgaagccccgggaagcagcgcgccgccgctctccgcccgcgcggctctcccgaggggggcgagccgggcggcgc

SEQ ID NO: 25929 - DNA, 1155 bp, Mus musculus
tgacctttccgctcggccgttctcctgtataggaggcagtcatggcgcccagccggaatggcatgatactgaagccccacttccacaaggattggcagcagcgagtggacacttggttcaaccagctggcgcgcaagatccgcaggcgcaaggcccggcaggcgaaagtgcgtcgcatcgcccctcgccctgcgtccagccccatcaggcccatcgtgaggtgccctacagtgagataccacaccaaggtctgggctggcaggggcttcagcctggaggagctcagggtggctggcatccacaagaaaatggctcgcaccatcggcatctctgtggacccgaggaggcgaaacaagtccacggagtcactgcaggccaacgtgcagcgctgttgaggagtaccgctccaagctcatcctgttccccaggaagccttctgctccgaagaagggagatagttctgctgaagaacttaagctggccacccagctgacaggacccgtgatgcccatctggaatgtgtacaaaaaggaaaaggccagagttatcacagaagaagagaagaactttaaggcttttgccagtctctgaatggcccgtgccaatgcccgactctttggcatccgagcaaaaagggcgaaggaagctgcagagcaagatgttgaaaagaaaaaataattctgtgttagagagttgcaataaattttccatgaagcggaaaaaaaattcaggtgatagcagatgctggtgagggtatcgagaaagagggacactcctccattgctggtgggattgcaagctggtacaaacactctggaaatcagtctggcagttcctcagaaaattggacatagtactacaggaaggtccagctttacctctcctgggcctatacccagaagatgctctaatttgtaagaaggacacacgctctactatgttaatagcagtcttatttataatagccagaagctggaaagaacccagatgtccctcaaccgaagaatggatacagaaaatatggtacatttatacaatggagcactaatcagctattaaaaacaatgaatttatgaacttcttaggcaaatagatggatctggaggatatcatcctgagttaaataacctagtcacaaaagaacacacatatgca

SEQ ID NO: 25930 - DNA, 1942 bp, Mus musculus
caagggatttcctaatgactgaagcttcatgctgcctgctggggatgctttcgggtgcaaacttgagcacccgggctgggagctgccgctctccggaggggtagctagtgaagggtgtgttgtgctcaagcagacgccttttgcattgcacgtttttctatgttgttgaggttcaaacctggagccctacgtatgtgagggctttaacccagatttgctctcttccattttcttggtctcactggacgggcctctgttgttctaggtcagtgggaggcattcgtgcctctctgtataacgctgtcacaaccgaagacgttgagaagctggcggccttcatgaagaatttcttggagatgcatcagctgtgaacatgaccagccacgctctgcctgtgagcagcacgcagcgtcgtttagagtaacttgggattgactacagaaacttaacagacatggatttttttttcccaaatacatgcttattacagattcctttctcaaagaataacgactaaacatcagggcactgcagagctgaggaaactcccagctaacagccaccttcattctcatgtgacctggaagcattttgaaagctttctttcctgttgctcttctaaatgaattcagcctgtcagccatctttgctgcccccttctctaggtggactgccttgggctttgccctgctggttccaactggttattattaggaggttggaggccctgtgggctggattgacagcagtgagtttgctgggttctgcagcagttggttcaagtcaacagcgactcacgagcgttttggatctgtgtactgcaattcccataaagagataggtgtgttatgctgtgtttatgtagtgggtattgttttaaacaccgtacggtttatgcctatgcctttatatttctaatgaaacagttttgttcagcccatgactttgtgcatgactgtcgtccgttctagtcacctgtgctctccatctactgccttttaaagctgcgtcatgagaaggatctacacgttccaccatgactctcgtttcttgccacaagtagaagaaatggttgattctttgcttttcggttaggccgttaaacaaaactcagtcacacccctgccttccaccctcaaactgtgatcacgtggctgttcttgtagtttaaccagggcaacactatatattccaggtctatacattgctgaggtctttttctggttgttcatgtatcagtgttttcaatcgactgcatggaaaacattaaagtcctaagtcatctaagccattcattgcctgtgaattattctgcttgcttttttagtcaggtgctgcttttaaacattctgatggggagcctagggtttaaaattagcctgtgatagggtagtgtagtctagacaaaggtgtcaggcttcgttcttgtgcaactcagtgtggttgcttgccttttactttggaacaaacactgtcagcagagtcccttccagcacagctcccagggaagagttttgtgaactctgtcccagttagcccagaaaaaaaaggcagcagaacagctttgcgctcatcctgttgcattcgattgcacaaggggaagacactgattgcttggtttctccggtcaggttccaccagctcattggtgaagagttgaaataagacccaacattgcaggatgtttgcatttaaaacaagctcttactttgtatgccccagtacaggggaacaccagggccaaaaggtggagtgggtgggtaggggagtgggggtgggtgggtatgggggacttttggtatagcattggaaatgtaaatgagctaaatacctaataaaaaatggaaaaaaacaaaaaaacaaaaaaacaagctcttttcctctgtcaatgccaagagcccagtttgatcattctgggtcacaaacagcactagtgctcaga

SEQ ID NO: 25931 - DNA, 1204 bp, Mus musculus
tttccccacaagaagagatttttttttattgaatggggcgaggaatggaggaagaaaagaaagagcatccttatttcttattatatgtatattagtgtatgtatatacaggtgccacatatgatctttgagtcctcagaggtcagaagagggtgttagaacccctggaactagagttacagatgtttgtgaaccactgtgtgggtgcagggaccctctgtaagagcaagagccacctctccagttctgaggggcccatttggaagcagaacaaggattgcaagagcataagtgtgtctcggggcttgacagttctcggtgtgggagacctcggggcaaagaccaggccttgggtctcggaagtgctgacttgctgttttgggtagagatttctatagtatggcatgttcctaggcagaaatgggtcacttcattaaaatggttgtttaggggagagctagcccttggcatgcatggcttagggatgattacagctgcttctaagatagccaacgtttctttcttcttttttaaaagtttggtgtgattttcgctggtgctcagaagaatgttggctctgccggggtgacggtggtgattgtccgggatgacctgctggggttctcgctcagagagtgcccatcagtccttgactacaaagtgcaggctgggaacaactctttgtataacacacctccgtgcttcaggtaactgtgggactctagtcttctgtccaagcagaagttaaggagagcacgcttcattagctggtgacccaagcaccccagagacactcaacgatctttgtccagctctcctctaggcgctgtttggtcagtttttcttgttgcccttttttggtaaaggtgacaatcttggtctttgcttgattttgatgttgaccgttaacccacaagctttctctctatagacaaagttccatggactgtgtctcggacaaacagggtcgctttccagaaggaagagggtcaggctagggcaagtgtgcagggttcttttcttccccgctggagaaaatcattcccccgacacacatacacacacacacacacacacacacacacacacacacacacaagaaagggaagagtttggagttaaaatccaactgtcccttcccccaacccctacccactctttcctttgagtagagtgttctggggttaactctcccggtcattcct

SEQ ID NO: 25932 - DNA, 2367 bp, Mus musculus
tttatttttttttaaagatttatttatttattatatgtaagtacactgtagctgttttcagacaccccagaagagggcatcagatctcattacggttggttgtgagccactatgtggctgggatttgaactcaggacctttgtttggaagatgagtcagtgctcttaaccgctgagccatctctccagtccccttctttttcttttaaggtttattttggatgtgtgtgtatttgtatatgtgtgtgtactcacagaggccagaagctaactccggggctggagttatagacatttgtcagctgcttggatgtgggtgctgggaactgaacccaagttctctgcaagagcagactgtgtacttaaccactgagccacctccgcagcctctagaggaagagtgaaagtttgcatttagtggggcagccctcattctccatatttgacatgttagtttatgttatttatggtcactcgttttttatgcccagagctgttcccaacaactacaaggtgatctttgtacaaggaggtgggtctggccagttcagtgctgtccccttaaatctgattggcctgaaagctggaaggagtgctgactacgtggtgaccggagcttggtcagctaaggctgcggaagaagccaagaagtttggaacggtgaacattgtccaccctaaacttggaagttacacaagtaagttctgggaactgaagatgcacggtgaggtggtggctggccattgcccttactattctattgctgctcttcttccgtcagtaatgatctcagttagatgtgtggtgatggtgctctactgactactccttttgagtgatgagagccttgtttacctaaaagcccaggagcaggttggtggttttatggggagagcaagggctccagggatgctgcccctgtctaagtcactccttatctcctctagtagactgtagtctggaaattggtcccttttctaggaagatggctgcagttgctcttcagctcttcagcttcttatattcgaagttttaatgcccttgctagagcgtcccaatgataatatcacattccctgctgtgaggcagtcactgactctgcctgagtcacccttcacctctaggggtatagatttgattggccctgctggaactacgtgttcccagagtgggtaagcactgtggtcctaagaggaagcgattagacaccaacaggagtgcagggtagatggatgcttgatgacaggaaaacctaaacacccattccttttgttggttcgtttggtctttcgagacagagtctttcgagacagtctttctacctctgtcttacctggtagttttgatgtagcacaggctggccttgaactctgagtagtctttttttccttaacctttcaagtgccggattacatgtttgcaccaggacacttggcccctctgagcttcattggcatgttatttgtgcccagtaagagggtgatgggtcatccccagctgttagtggtaattgcaagagtgagtgagtgggtcggcccgtgctcttgtcaagtgctttggagttagtctttccctcaggaagctaaccagtctcctggctgacatcgtcttcgtatggaaaagggaggttttcaaatttgccctttgtgacagaaattccagacccaagcacctggaacctcaacccggacgcctcctatgtatacttctgtgcaaacgagactgtgcacggggtggagtttgacttcgtacctgacgtcaagggagcggtgctggtctgtgacatgtcctcaaacttcttatccaggccggtggatgtttccaaggtaaagaatgaaaggttggtttggggaaccagtgaacgtttctttgagctgttttgatatatgaacttggttctttaccttctgggccaccttactgggcccattttgactccttttaggcgttgcagctcagtgatgtgaagcctgttaccattgctctgcagccttcacctctgtccagctccaagaactttcagattttgtactgtaactttgtcccattaaaatttcacaccccagcctttgccaaccagtgtccggctttatgaatttgtactcaagggaccttccataaatgggatcatgatatttgtccaccagtgccttcagcatttatgttgtagcatatatatatatgtcccccatctccttttgtgcacatgtttgactacaccaaaccatgtcacttgttttgttttgttttcgagacagggtttctctgtatagcccaggctgttctggaactcactttgtagaccaggctggcctagaactcagaaatccgcctgcctctgcctcccgagtgctgggattaaaggcgt

SEQ ID NO: 25933 - DNA, 1154 bp, Mus musculus
gaaaccctgtctcgaaaaaccaaaaaaaaaaaaaaaaaaaaaaaaaaaaagagttgaacatattctcctctgtcaaatctttctctgattcatcactttgtctgccactcagcactttcaaacatggctgcttccttctataaaccagcttttagttttaattttactttactttttggtttgctaacttttagttttaactttactcccttccttgttttgggattaaaagtgtatactaagggatgaaccacaccacactggaaacaagttatttcagtaaataatacaaactccggggttcacagtgagatccaatatcctgcaacaacttggtctttaaaaacaagaaaagaagggctggagagatggctcagtggttaagagcactgactgctcttccaaggtcctgagttcaattcccagcaatcacatggtagctcacaaccatctgtgctgggatctgatgtcctcttctgatgtgtctgaagagagtgacagtttactcacatacataaaacaaataaatcttaaacaacaataaaaacaagaaaagaaaagaattttgaaaagaggaaaagaaaattgcataaatgaacagtttcattcccaggccttaaaccagataaatagattcaacaatacccactgttttatgtaatatagtggttttaaacaatcagagagagagagtgtgtgtgagttaatctactagaacagtgtttgctttctctgagctctaaacccaagtccagtcccagagagtgaatggggatgaggcaggatagaaggacagggaagaaaatcaagtttcccacactgcatgcggtttgcttaatgaggatcaagaaactgaatatagagctggagagccgagtcagtggttaagagaactggagaactgtctgctcttccaaagacccgaatttaattcccaggacccactacatggcagttcagaaccatctctaattccagtcccaggagacttgacacccacctctgacttcagggcaaacaaaacacccatatgcataaaataaaaataataaaagttgtaaaaataatccatcacagctgacaaggccaaaattgtcaacagagatgatgtgtgttttcccaaacacttcccaaataaggatattaaaaacaac

SEQ ID NO: 25934 - DNA, 1161 bp, Mus musculus
caacttgacacagctggagttatcaaagagaaaggagcttcggttgaggaaatgcctccatgagatccaactgtaaggcattttctcaattagtgatcaagggggaaaggcccctgtgggtgggaccatctcagggctggtagtcttggttctataagaaagcaggctgagcaagccaggagaggcaagccagtaatgaacatccctccatggcctctgtctgcatcagctcctgcttcctgacctgcttgagttccagtcctgacttccttggtgatgaacagcagtatggaagtgtaagccgaataaaccctttcctccccaacttgcttcttggtcatgatgtttgtgcaggaatagaaaccctgactaagacacctccctaactaaaaataataaaagtaaacaagaaaaaaaaaatcacagttctacagtgaggttttcacctctgtagtggctcactttgttctcaaagctttgttgttttccttgtagtttcagaagattaccagcgatgctctgattcctttacctctgaacaccgtccaggatccggcttctgcacaagaggcagtgggagcgtctagagaccatctgggagttgtaggcctggagcagcaggagggatctgcagcaggattcattgctaaaacaggctctcctttagcaggtggcattcctggaggcaggagtcaaagagaagaggaggtgttgtctaaacacagcaggtcttcttcagagaaggggagcacggcaagtgagccctccagaaggccgtctgctgagagacaccccaggaaggacctgctgtccgatgctgaccctcctgggaactctgaaagcaaaggacctggggatagaaggtctctgcttaatgagccaattaaaagtgaatctttgaaaaaatgcatttctatcaagaaagaaaacagaatagtgactgtctcatctaagactatcaaaagtaaacccaaccttctagaacattctgaaagtgatactcttggatctgattttgaacttcaggaacgtgtccattcgtcagcacacctaacctgacataggtctaaccttttgaaattatgatttttgccttcaaattttaataaattttcttatgtttttattatattgagtgataaaatacagggctagaaatac

SEQ ID NO: 25935 - DNA, 4537 bp, Mus musculus
gcgccacagataccgagaacatccgcttcgtctttgcagccgtcaaggacaccatcctgcagctgaacctgaaggagtacaatctggtctaaccgtgcctcccagaaaccgttcttccctcccctgtgggttgttgaagataaacaagagggactgtatttctgtggaaaacaatttgcataatactaatttattgccgtcctggactctgtgagcgtgtccacagagctgtagtaaatattatgattttatttaaactattcagaggaaacaggatgctgaagtacagtcccagcacatttcctctttttttttttttaggcaaaccttgatgtattttaaattttcagtcattcactcacagtataaaagcactcctgtcattcgtgttctctctctctctctctctctctctctctctctctctctctctctctctctctctctcattcctttccttcttcctcctcccctttccttttgaccaaaacgaagctgatttttcttcttcctgctccttccctccctgctgattttattctccctcactaccatggccttgcccccaatcccattcttggccagtttcccccaatcccattcttgggcagtttctcccatcgagtgacgtagtcaggacggtgttattcgactgaagccgccttacgtcagcttcctttacccgtgggtctgctgaaggcaggagcataggtgttcgtactatggttttaaatggttctctggatgcacatcacatctagcatttctttttcaatacatacatacatacatacatacatatatatgtatactatatatattgtcttgtctcacttgcactaggacagtgggtacccattgatgatcaagagtcgtatcttttgggtgcagaccttcagccacagcaggattgttaagagaaatggatggaggtcagggtgtgagggcacaggctgggaagaagtccttgcttctcaaggccacgtaccggccgcgtccttccacccttgccctttaaaccacagatgccaaatgatacgccaacagacactacattccccagcagctgctgccagagccctcttgtagcttctttattttctgtttctttccagctttcctaccctcctatccccccttgtgtttgggccacaattttgaaataatttttattataggtatgtgctgccaaagccagatttttataaggtaaaataaattaagaatttaaacagtaaaagccagtgtctcaaaatgtcagcattaaaatgtgaaggggacagcagggtgtgaaccggaaacacacattgccaaacagttgccaactgaactgctgcttctcatggtccgttcttttctttgcccttaaggtcaatgccagtgtccagacgagcagtgtagaaaagctccctgtgtggtttgtcgtgaggtctgcttgtatctcttcactggcgttagtttcattagctctttattctccttacgttcgagtgaatctgccaagaacactggtggatagtattatcctaacacttttggtttgggggcggggagggggcagggaatagtgagctggctttaccaccttcaggatctcgaattgggcgcttgaacctaagaaagattgtggacttatcaaaagtcaccgctcagtgttccgtcaagcatgtatttatgtgacgatcatactaggagggatgtttggaattctccatgtgcaatttgtccgcagatgcaaactgtgccgaacgtgtgtgagtgagcctgtcaagcagcctgcatcagtgtgtgatttaagtagatggcgagcgctctaaggctgccgggaagtcagacctcgatgctggtctcattagcgcttggcactaatctcaactccatagacatcacttttcttgaatagcaaagctgggagagtgaccagctcactgtatgaacacggacattgctgactggtaatgaagtgctctcatgtgttactctcctggctctttcatcccttgctctagaaagcccctgtaatttaattaacagactgcctgtaggtatagtgcaattatgaatgctctgatcgttgtacatacatctctcttgatattgcaacatccatactggctttgtaatcattaattttttggcagattgaatgtgctgtattgatatgtatctatgtaattgtatgtcttatagctaattcacattttgaataatgttattttatttacttttttaagagaggagaatgtaaatttgtcagtttatttctgactagggatatttttttccatttagaaaagaagaaaaaaaaaaaaacccttactattgtacagagcggtactagcatcgtgctgtctaaaatcatttgcacattcctgagtagaggtgtgctgacctaagacccaaaggtaatttcatagcaaacacacaccatccgtcagagcttttatacaaacacggagaccaactttgtagaccttttgccatttgacctggggttggaatatgagcttttatacgattcatattcttatttggcaaatgcacagtttagcattacctctctggtggcctttattagaaaggcagttttagaagctatttgtgatccactaaggaaatgttttatcagctagagaccactgcttgcctgaaagggcaaccttaaatttggtgcagcaaaaaacaaaaaaacaaaaaaaacaaaaacaaaaacaaaacaaacaaaacaaaaaataaaaacaaaaaaatttaaaaacacaaaaagacaaaaaagaagaaaaaagtaacatttgatggcctgcagtgtatagagaaaacctcatcccaggatcataagtgttaaccgtcctaaggaagcgagctgttctgtctaatagagctgtagtggatggagctgagccgtgctgataccaagctcagagctgctgagtaaggcagggagaggtggccacgttgtctttatgaattgagggtgcagcttgctgctgcacagagttgaagtctggcctcactgcacatcctggggtgcatgacagagtcccttcttctgagaagggaaaacattgatcaccctagctgcagtggtgcctgcacaccttactctatccacactagtcaatgaagctaaaactaattttgttgttgtttctcgtttggggttttattgaaggggtgaggggcgggaagggcttcttagttttgtacaaaaacaaagtttactcatatgctttctcttctattgtgattgcaagtgttcctgttgtcgatgctctaggtaatggaggcttgtgatgagcgttatggtgacttgggcatgtcttattcagaagcaaaacacagaccacagaaacctttcctcagcataccaaggcaagcagccatctcatgagtcactcagcacatgagtgtgccgtttacagatgatgtcgcccttttgtgtgtgatacggcagttcccacccacagagaattcctatttgtaaattggaggtttatactatgccttacagagcttaaattcagaagtctgtgcctcatgtctgaaacaaagggaaaacacacgcccatgcagaagtcagttaagtcttacagagcctgttgggttttccttatcgtttccttaggaagagctctgttgaatgtcctgagtagctgggaaattcttcttaggagcctgcgtatattgtttactggcaggtggcatccacggcgatatttaaagaacacctggaacttgggggcttgggggctttgttttgttttgtttttgtttagattacattagcaggcctaatcattttaaagggtaattcagccaaagggcaatttactttttgtacttcagacttctattgattgtcaagttgtacgaattgtaatttaaaaatttatactgccacatgattgtaaattttagttgtcttaagtaggaattggtgaaaagctgtttatgctggatttgggtcaaaatgacttgattatttgcaaaaaataaaactaataatgggaagaaagggctgcataacaagacaccgcaagactcagattccctcagatgaccccagcgcccctttgttctcagtttctcaaaagaacgaatgaagtgaaacatagcagaatgttaacccatataaaataaagtgtacccaaatattgtaatgtatatcgctgctcttcttaaaattacgtaaggctttcaagccactcacatggtaactaacagcatctcgattgatacaactaaggtgtacttggacatactttaatatttgattcaaaagagaaacctttggttagaaacacatacaaaagtggaagctaataatgtgtgtttatctgtctccgcactcttccaatataggcagcattcctagatgtcctggcacttgtgtctttgagatcccattgtggttctctcgacaggagaaacgaatgcttacttctgtgtgattaggccaacgtttgggaagccgggcacctgccatcccacagataacctgctggacgtccacactctgttcttctcgcagttgtcctgt

SEQ ID NO: 25936 - DNA, 1231 bp, Mus musculus
atgtggacgttgttttaggcctgttaaattaaaagtattatattcacagttacaacatgagccacagatgaaaactctgctttcaaattaacgccttaacatttcataactttaacatcttttcctgctacttaactaacctttatgcttctttttcctttaccatgcttacagaacattcaggcctacagggaatggattctgactcacagtagcagtagtgaggaggaggaggaggaggaggaagagacttagtcagaacttaattgagaaagtgtgtatggtcctttgcatttccctggattgtttgtgtatctgctgtcagtccatccatgtgtccattgttagggacaaaagttagcactgtttccttagaacatgtttttctgaccatcatgataaagcaaagtaatttctttatttacatacaggaaaatgtatttatcagtcagagtgtagagtatatcatacattataaatttgcttttatatatcctagctttgtatcccacagtttgtcattaagatcggaagtgagatttaaatgtagttttaatgttcatgagctctactctaaatcatctgcatatttgttagatgtcaaaacatcttttttaaaataaaaatattgtgtgaaattttgggctgtaatgtaatatcattgtttaaagaaaagagagggcgggagaaagcctaggaataccattgaatgttttatatgtatttagcacttaaaggcattttgtcaaatttcttttcataataaacttgcataacttgatgttgtgtggatttttttttctattccaaaatcatctctaagttgaactactatataaaaatacatgaattgtcatagaagattagttatacatagaatccaaagtctttgctagtcattctgttactacttgttttctcatacacttctgagacggttaacaagttgattgggcagtcatatttattagctaactaacatatcaatatattatatccctatcaaaatagtattacttaattcaagataatagaatttatataataaattgtaaatttatatatatttttctaaaagttatgaagaaaagctatcgttgtctctgagttttacaagcaagtttgttttatattttggcactgaattttttttaacttcagacagacaattctctcgtcctactttgctagtatattggatgttgtaaaatcagcaaaaaccaaataccct

SEQ ID NO: 25937 - DNA, 1226 bp, Mus musculus
gaaaaattataaaatcttaagcatatgttatttctattgctgactaaaacaaaatatttcatgaaatttagactcagaggaagaattttttgatgcaccatgtagtcccttggaggagtgtcctcaagtgtcatgtagagataaatgtactcgacagaaaaaattacaaaagaaagattgtgtgatgaatcttattcaacttaggatgagatttgaagtagcagaggtaagttacattcaatgtgggctatgtgaattgtcatttatactttgtaccgtttactcaaatagtcttcttgctaatagacattgcccaaggcatatggagactcggtctatggttttcttccttttttttttttttttaagatctatcttacttaagaattagtgtttaagtggtatattgtgggcagtttttcagtacatgtttttgatgttgattctacactgtaagtatatgctttatatgtgtgtggaaatataaaatcaatattaaattttgtaatatactacataatacatcgtctgtatttacatattgttatcagatatggacctgtgtactttgcctttcttctgcaggtgtccattcagttttatcacctggtgggagactgtgaactacctgtgctggaaatgggtgctttaggattgggaacagaagctgagtttagaacatttgacttgaaaggaagtgcctttttgaaagaattatggctaaaatgtccagaatatttaggtaagactattaaaatatgtacattattttcataatttgattagcttctgtattagtcagggttttactgctgtgaacagacaccatgaccaaggcaagtgttattaaaaaaaacaacatttgattggggctggcttacaggttcagaggttcagtccattatcatcaaagtgggagcatggcagcatccaggctgtcatggctcaggcagaactgagagttctgtgtcttcatccaaaggctgctagtggaagactgacttccaggcaactggggtgagagttttaagcccacacccacagtgacacacctattccaaccaggtcacacctattccatcaaggccacacctccagatggtaccactccctggtccaagaatatacaaaccatcactcctgctaaggaattttctgttccttcgactttgaatcaatatatttatattttgaaagtctaaaaagtccaaggatattacttttct

SEQ ID NO: 25938 - DNA, 1170 bp, Mus musculus
ctatgcttttcacttttatctttgtagctacatataatacaattcagatttactccagttcagtattgcattttctatttagtttttttgtatagattttgtttgtttgtttgtttgtttgtttgtttttttaaacatggttctgcaggtaaaaaagaaaagatcaggagttaagggacagacccagatattactaggtaacagtggatgttgtctgttgtcactgctgctgacagattgaaaaatatagggaattgctagttacatttagtaggacaaaaattattgctacataacaacagtagttttatttattgaaaagagttttatgtgtatttgtgtgtgcctgagtttattttatgtgcaccatatgcacatgacaggggcccacagaagtcagaagtgggaatgttggactgtgtgtaactggaggaacaggtcattgtgagtcacagtgtcagtgctgggaactgaaccctggtcctctgcaacagtcatcctcactctaaccactgaatcatctctgcagccccacagacagtgcctttcattattaactttggaggttccgggaaacttgtctgccagacgagactcatactgttacagacgcttggcttggtgttctgatatggcttacctgtatgttcattaccactagtggttgcagtgatggggcttggcaggttagataagcagtctaccactaagccaattctttagtctgaaatctatgctttaaaagtcacctctgataatcataattcatgctaaagtttgggtccattcttctagtcagttcttcacatagcagcgggcccatctctctaatatcaaagatctagcaaggtgttagccaacactctggaagctgaagcagcatcatgagctcaaggccatctgggctccataaccgaaccctgttttgaaagaaaaaaatcctatacaaataaagatttgattactgtatctcccatttcttatttctaaaacttttaattgttttggtttgaacctggggccttctgcagcattccttgataaggattcttcaggcacctggccctgtcctcagtgactgattattttgagtttaaaatctggagtcttgtctttagtgtgtataaaatctttgaaatctgacccttagtaacatttggattttcactt

SEQ ID NO: 25939 - DNA, 1152 bp, Mus musculus
ttttttttttttgctaattcgatagaaaaacctcagaatcatctaggctcccacagcctgccctgccctttggaagcccacctcaaacatcatggtgataggaatatagttacccaatatcctgattcgctcacctgcttaacatattaactcctttatattccattctggaagatgaatttcacatttcccctagccatgttaaacttatgttgttgtgagaactgcagagtttggctcagcagatctgtagacatgggactcttttcataaccaaccagacatggcaacaggcaaacaggcacaccattcacactttctctgagtctgtgtatggaaaatgactcactcgtgtggcatggcaaagtaaatttaatgtgagcagtttcacgtcaatgatatttggaaaatcctatgggctgtaataccattacaatatttaagcacatgttatcttactatcttcaaaaaacaagttactttaattgcatgtgctagagaaaagctatcatgctcatcaaatgaataggcttctagggaattctgggaaaatagcccataaacaggtagatgtaactctcacgtcgctcagctgtagcgcctgcaccctgggcattcttgctttggtctggactgccaggacctgctttgcactttttcctgtagatttgtagttaagggaacaccgaggggtcattgaggcaggagtggtgttcactctgagttccagctagtacttagctggattttgactaaggctgaaacaaaaaccttcacagaaggtagttgttgaagagtgagaacaactgggggtggaggaagaccccaaagttcctattgaagccatacagtgttatataaggttcctccctagggcatactgatgagcaaagaggccaccctccctagcacacatccttaggatgtaactttgagagtcccttcatggttctgcacaacccttgtcttatcactatgccccagtggtctgctactttaggaatatctaggtgtgcacaaacttaaccttttctatatctaaagagttttctacgtgtatcggattgctcagaataaagtatatattagacgagttttggtaaagaaataaattctatctggatagtatggtttaaaaatatgaaaatatgt

SEQ ID NO: 25940 - DNA, 1122 bp, Mus musculus
ccatttgattttaaataagaatcgttaccatgtacctttatttttaaaacatagctaactttaataatacacacacacacaaaatcataatatcagacagttttaagacattcaaagacggaagtatgttttctgtctcaaagctataaaatattttttctagtgacaagtcttattagaaaagctgagaatcagtagacgagctggggtttgttttggaccaatagaaatgtgttggccatgggccaccagcaatgatggtgatgcagctgataccctctatactggcttctgatttctttcttttgtccagtggatttgtccaatggttcttttagtagaaaggcttttacttatgagacagggcatcttttaaatctaaaaccagtggttcctggtgacatagcatttgtgtaaaccgctgtgacctaagcagtttttctttttctttttccatcttgcaaaacacacggctaaggcagtagtctagggatccagcaagcaggaaccccagcctggggtcaccggtggtcaacatatctgtcccagtttgctttatactggaggaacgcttgaactttgcaaaactggaaattaattttttctaactacaagtacttttttttttaatcaactgtttgatgttattcatcttaaacactcttgttgtagtggggctccatttcagttaaatggcaagtttgaggattttttatttttattttttattattttttttcttttgccccactataggagtaaaactaggctctaggattccagagcctcgagtcaatgctgtgaagccccatgctttgtgttacctcaccttcgcaccattgcacttgttgaaccatgtctgatgctgtagtggcccagtgcctgacacagggcttgtacagtgtctgtttaccgtgtctcactggattttatttttagagtttttcaatatgacttaaaacaagagaaattcacacagtgggataaataattcaaaaaactaaaaagggaacctggaaatgaaaccttcagacactcgagaagagtacagttccagttcacgtggagagaggcaggctttgtttatgttggagtcatgtttgttaataaacactaatttta

SEQ ID NO: 25941 - DNA, 2516 bp, Mus musculus
ttccctggagaaaaagacggttccaacattgactgaatctctgtcctttcccagggctgtggctagggtgcttagtcagtgtttttaggaggggctgagcaaaggaatagtaacatggattattagaagtttctttttttctttttttccagagtcacttatttctgcaattcaaggtgatattgaagaagctaaaaagcaactggatttacccgaacatttgaaactcaaagatgataatttcttccaagtttctaaaggcaaaattatgaatggccactaatgaaaagtcccttacctgcctaccactagtgtcacgcatagtgtcacagtgcttctgatacactctcatcttgatcatattttaaatcaagcgttttcctgtagctgtcaagtggtctccagcagttcactccatcatgttgcacagtactaagagactcattcagaaatcaagactttagatgtaatatgttgattaaaatgtagcactagaaagcttgtactgaaaataaagtctgtgagtgtgggtggaaaagcaagttcctgaggaaaatgaggactgaccatagttcttgtgactgagtgtgctggcactggtgagcccagccagcctgtgctgaacagaggcttttcaggaagtgcaccacacacacacacacacacacacacacacacagagcttacccatgaaggaaaaattagagttacttttctcattttgtgcattgatatatttttacaatcctgcaaacttccttgagtcactcacgactccccctgaggtcacttcctggtagtgtcccaatgctctgtgtgcagttacttcaggttgaagttgccttgatcgcctgcccctcatcagggcttttgcttttcttcaaagtactgaggatccaacccagtgccttacacgccaggcaagtgtgaccactgagctaggctcccgccccctttactttttgaagccatacaatggatgtctatatgttgcctttttgaagattaggtggttttgctctttaacatttttgtgactttggtttattttcttcccatgtcgcccagagattacttgtgtgtgtgccattctgctcaaaactaaatggtggtcaggttcaagtaaagaaaaataaaacaagctgcatttatagacttgcttggaattgaaatgaacatagccagttcctacccaaccctgccctgcctttttttttttttttaaagtgtggtcctgtgctttcaaagtaagtacagttctctatgaccaggcacttaaacataatttaaaagtccttgtagcttcagaaccggataagttccagttgcatatctctatatctcctggtttccctcttggttttcccctggttcctcccctttccctcttggtggcctgagttgtttatgttggcagaaggttgacattggatgctcgattgcttcagcctcaccggggcattgaatcatcatttgttgaatggcaacaggtttgctggggcagaggcactgcctaagtgggagcatgcacgtgaaaatagaaaggtaatttaacaacacacagacacccagagacttggtctctgcatgtgtgtagaagtagtggtgtggggagggatgggactcactcagccctgtgaatgtgttctatggctgagcaacatccctagccttcagaatagaatttttgatgttggaaatcctgtatttaaaggaaaccttaattatcaatggatttatgaaggaaagttaaaaacaaatatgcacagtacaaaatagatctgtggctttttttttttaaagtaagaatagcttgttagtatatcaatgttcatggctaatgttatctcattttgttagtcgttattttggaattacatgatgtgtgatttagggcttagttaattctctagaattcaaaaactattattgatgtattaaaagaaattacggtaccacgttgattagtctgaatgtttgcaggcattggaataaaatttgacttattttttccctcttcccctgtcaacctgaatcctgtatctgtttggggtatactggctgtttgttactatacacctgtatttacaatcctgagtagacctatcaagtaagggtgctcatgtgactaagagctttattttcaaggaccctccccctcccagtccccccatctcaggggtctttcctccttttaaaagaccttacaaggtctctatatctggctatccttgaaagtacagagatccatgtgtgtcttccttctgaatgctgggattaaaagtgtgcatcaagcctggccaagacacacacaccaccaccaccaccacccacccaccctttaaaattcctgtagcaaggtgactttacatggaaaggattcagaggatatcattactcaaaaagtcaactctttaagaataaaggttcctattgggagctaaaggagccagacaagtctaactcctgtataatcctcaagattgttttgtaaccatggatgtgccacaacccca

SEQ ID NO: 25942 - DNA, 1141 bp, Mus musculus
gaggaagtcaaagtgtctgcctgaaggagaccttggcaaggagattgagcagaagtatgactgtggagaagagatcctgatcacagtgctgtctgccatgacagaggaggcagctgctgcgatcaaggccatggcaaaataaccagcttccagggtggtgatggtggcagcagcgatccatgagcctacacaggcccctccccaagccaggttctgctctggctgggcccttggctggactcctatttgcatttatttgacgttttattttgattttcctcaccccctcaaactatcagggagaccctgcccttcacctagctcccttggccaggaatgagggagccatggccttggtgaaactccctgcctcttctctcgcagccctgatgggggagagggagccgggtactgctcgtggtttaggttcccctctcctttttttttctttttaattcaatttggaatcagaaagctggattctggcaaatggtcttgtgccctttatcctactcatccccaatctagtcccctgttctccatagtccttcacccccaagcaccactgtacagactggggaccagccccttccctgcctgtgtctcttcccaaacccctgtaggagtggtgagaagagggggcagaggacacgatccctcctcaggcatctgggaaggccttgcccccacgggctttaccctttcctgtgggctctctccctgacacatttgttaaaaatcaaacctgaatcaaactacaagtttaatatgaaaaaaaaaagaaagctattacctgtaactttctttattataggaagatatggataccttcatgagaagatgcgtgttcacagatctgtgctgggtatatttaggaatgagactttcattactttacaatctataaacaaatttaaaagattggtacattaagggtagtgtagctttattatggcattcatactgaatcaactgttaatgagtcataaggcaagacaaaaacccaattgttctgatgcttggccatcttatgttaaagcatttccttctagtactctacattcttgtttctatggaagagttctagaaaacatagtagttctgaacagtgatctcagggatggaaaatcctaatgacaaa

SEQ ID NO: 25943 - DNA, 1359 bp, Mus musculus
gcgtggtatcactattgacatctccctgtggaaattcgagaccagcaaatactatgtgaccatcattgatgccccaggacacagagacttcataaaaaaacatgattacaggcacttcccgggctgactgtgctgtcctgattgttgctgctggtgttggagaatttgaagctggtatctccaagaacgggcagacccgtgagcatgttcttctggcttacaccctgggtgtgaaacagctgattgttggtgtcagcaaaatggattccaccaagccaccatacagtcagaagagatacgaggaaatcgttaaggaagtcagcacctacatgaagaaaattggctacaaccctgacacagtagcatttgtgccaatttctggttggaatggtgacaacatgctggagccaagtgctaatatgccttgattcaagggatggaaagtcacccgtaaagatggcagtgccagtggcaccacgctgctggaagctttggattgtatcctaccaccaactcgtccaactgacaagcctctgcgactgcccatccaggatgtctataaaattggaggcattggcactgtccccgtgggccgagtggagactggtgttctcaaacctggcatggtggttacctttgctccagtcaatgtaacaactgaagtcaagtctgttgaaatgcaccatgaagctttgagtgaagctcttcctggggacaatgtgggcttcaatgtaaagaacgtgtcggtcaaagatgttagatgaggcaatgttgctggtgacagcaaaaacgacccaccaatggaagcagctggcttcactgctcaggtgattatcctgaaccatccaggccaaatccgtgctggctttgctcctgttctggattgtcacacagcccacaaagcatgcaagtttgctgagcttaaagaaaagatcgatagtcgttcttgtaagaagctggaagatggccccaaattcctgaagtctggtgatgctgccattgttgatatggtccctggcaagcccatgtgtgttgagagcttctctgactatcctccacttggtcgtttggctgttcgtgacatgaggcagacagttgctgtgggtgtcatcaaagttgtggacaagaaggctgctggagatggcaaagtcaccaagtctgcccagaaagctcagaaggctaaatgagtattacccctaacacctgccaccccaatcttaatcagtggtggaagaacggtctcagaactgtttgcctcaattggccatttatgtttaatagtaaaagactggttaatgataacaatacgttgtaaaaccttcagaaggaaagaatgctgtatggacctttgtgtgtgtg

SEQ ID NO: 25944 - DNA, 1231 bp, Mus musculus
tgagtagctgtctgcctgtccagggcctgggtgaactggttaatggcaggagggactttgagccgcttgtagaggatggctctttgccgctgcagcctgatgtagcgggcccatttgacaaagtgcgatagatgtcttttgggctggatgtcctgtccaatgccgaagttcttaggcctcttctcgaacagagggttgaccaccttcttggtctcctgcttcttgacgacggcggggtccggggccaccttctttcccctggccttcttccctttgggcatcttgctctgctgctggagagaagaggatcgtgttttcaatcaccaaaagcaccgatggtgcacaacagtctcaaccgtgtgtaaatcctttgtttgtaattttcttccttcctgtcttctccttagatggggctcgaacgttaagcaacgccgaggactacctcgatgacgaagactcagactgattccccccggggccgctttgattgttgcctaaacttcttttgcttttgccattccggagcctgggttgtttgccagaagagtattgataactgttgcttttaaagtctgtatgagcgcgacactgctgcactgtgatctgtgaggagtcgttgtgagggtgggtcattctcacccacgccttgccaataagtgaagagatactttgttgtataaaatacatatatgctcaccagggtaaaataaacgaaaaaaaattatttctatttatcaagctaaaggaattgtaatagttttttttcttttaaaaaaaatcatttttttaagttctttacctcaaggaatgagatgttttgagtgggtttttcaagggggaaatggttattataacaatagaccaaaactctcaacagaaaattgtcagctcttctgacaaaaataaacatttaaagagattttattatctgtttttgtgctatcactcattgctggtaaataaagctttctatactcaggtaagaaccgattcgatgttacttttagatcacatttgatattgattagcacagaagaatcacaatgctgtgttcctctcacagcttcctagttttgttttgttttttttccgagacaatgtttctctgtgtagccctggctgtcctggaactcactctgtagaccaggctggcctcgaactcagaaatccacctgcctctgcctcccaagtgctgggtttaaaggcgtgggccaccaccgcctggctcaca

SEQ ID NO: 25945 - DNA, 1881 bp, Mus musculus
agaggaaaggaagggcttagacaatgacatagaacacttctttgtcaaggagctacttaggctattagcctgaattctttaaataagtgggtatactttagcatagagcagtggctatgagcagcttagttagtataagatactgtatcttttatttccagggcctgaaaatgcctttaaatgtgagtagggagagtttctgtttgtagttaggttttgtgttacaccctgcctttcaggattaatacatctccccccccaccccaagcagaaatacctttaaacctatctttggcaactcctattaaaaatggatgttactgctgcttctcagtgacccagggtgcaaatgcaccgtactaagtgcattagtgggcaggtcttgttttaagatttgctgattaatccatcacaaatgggagcttacaaaggatgaaattgatttaaaagcagaacaaagggaggaaaaagaaagccttctccttgtgttttttataagtgtaaaattctttcaggcaacctgagctggttgagggagtgcttggacaaccgggtgggtgtgaacggcctggacaaagctggaagcacagccctgtactgggcctgccacggtggccataaaggtactgaactcgctggttatatgattccgtgctcttcaacatctcctccacctaagggagcctgccttctttagtgacaaaagcagtgcagcaaaggctgtgttcttggtaagggcagagcagtggtggtgggtgtggctggtgagccccactgtgagaccccatgaactgctgggaacttcgccttctctctggctttcgaaggcaccagaacataccagtaacaggatagcaagccatggtcacctgccacagagggaaagcagagctggtacctgtagcctttcactagctatgcttttggacccacattaagtttaatacaaaatttgaagtaccacactgatttaagcctgcagatctgttgcagtcattaataacaggttggatttttctaagtattttattctagccctatcccactatccactcttttctaccaactgagataaatctttgggtctgaaatttttcttttgtaatctaacttttagagtttttttttttttctgaagataaaattcgaaaatcttataagaattttctagaaattctcctaacaagctttgtactttgctattttgttgcctgcttttacaaagttcactgtttctatcttaagttccattttctgtttgaattgcagacatagtggaggttctgtttactcagccgaatgtggagctgaaccagcaggtgaggccgcatggtgggcgccacattcaacattcccaccgctctcttgtttgcacacgacagcttgcgcgcatacacaatattttaattcaggtgctccaagcagatggagttttgttgttgttcctgtgtttccttgctgtggcactgtggttggaagccaagccctcatacatgctgttcaagtacatggtccagatagtcagcttacaaagagaaagctttacctcagtcccagtttgggaggtggtgatcaagtggcctcatggctcttgggctagtaccaacgtgagtgagcacgtggtggtactggtcggctcactgtatctatctacagtgagcagagtctcaccacccactttgagcacacactccagggcatgaaggctccttcccactcgtctctcttcccaaggttccatcaattccctttggatcgcagcatttcctttttttttttttttttttttaaagatttatttatttatttattatatgtaagtacactgtagctgtcttcagacactccagaagaggcagtcagatctcattatgggtggtt

SEQ ID NO: 25946 - DNA, 1229 bp, Mus musculus
gggcagttctagaagcctgcagaaaggggaagcaggatgttctctggtgtgcatattgagcccgagctattttgacagtcaaaacatgactgtgtgtcctgacagtgtctgtattttgaagttttggtatccagttcagtgacctctctctctccgtcctttgcttcttttgctgtgaggccagggtctctctcaaacctgtgatttcacctgcaaaacaaaacatggtctgtggaagtgagtgttttccccaagcagtaaatattgttttaaatagccttttttaaaaacatcgtttaacaatagtccatgttccctaatgtcttcttggacctggtggtttttcttggctcagtgtgacaaacggagggaagacgacactggctaagagcttgcagaagcaccttcccaactgcagcgtcatatctcaggatgacttcttcaaggtatctatgaaggttcttagataacttgttgaacacacacaaacaaaaagctttcacgacaaagttaagtaaattatagccaaaagctatttggggagaatatactgggtgccatagtgttacctgcccactagagggcaccatctgtcagtgaccacctctgagcttggtcctcctattccaagacatttcttaaagtcttaacttcttaattgtataattgcaccatttcttcactccatagtgtcttgatggatttttttaaatttttttccagccagagtctgagatagacatagatgaaaatggttttttgcagtatgatggtaagtacagccacatgttgaataatatgaggttatattcattttctttttcaaatccaaacaacttctctctctgttaacataatgttaaatgtttaaatagggagggcagaaggcgccatgggtagaagcacttgtcacgcaagcctgacaacctgagtttgatttcctagaacctttggaaaggtggaaggagacactgactccacaaagttacccctggtctccataaggatgctgtggccgtgcacacacacatatcctaacacattatacacgtgctttcttctgtcctctgtggacactgcacccacgtgcacccacatacatgcaggcaaaacatccataaacatagaaaatgaagagcttttcatttaataatattaaaaatagtaactactttccaaatacagtatatgttatttatctttcaaatgtatctatagacattctgtgt

SEQ ID NO: 25947 - DNA, 1164 bp, Mus musculus
caggacagtggcagctcgtctgtatgttcacttttgtgccattgtccccaacatccagagccatgtgttgccatgccgtcagacagaaacccctcctgaaagcaagaatggcttgacctcaccctgcaggaggcacagcacagttcatgcacagagggtcagttcctctataggaacaaaagccaagagctcctgactgttacctagcaccaaaagaccattgtcgtctaggccaacaatgggtgctatgctgtgtatgcttctgcgtttgtgtgtatagttgtgtgtccaagtttgtatgtatatttctgtatgtatacatatactccaagactacaaaatgaaccttgtatactacacagaatgtttttttccagttttcattttgtttgtattgattataatatataatttgaaaaattgtctcatagtaatgccgccacacacacacacacacacacacacacacacacacacctgcaaccagcaacattacctgaagtaatggtctcacattgactgagtcagcagtttactgcagagcctggagactttgtgcttgtagccataaattcacttgtaattgttaaatactgtgtgtctctgtgagatttttttatatcaatagaagtgtttggtagggggctggtgagatggctcagcggttaagagtgccgactgctcttccaaaggtcctgagttcaaatcccagcaaccacatggtggctcacaaccatctgtaatgagatctgatgccctcttctggagtgtctgaagacagctacagtgtacttacaaataataaatgaataaatattaaataaaagagaaagatgttatctaaaaaaaaagaagtgtttggtaggttttacttggttttctgaagctaacactctgaatacagaatcatatagtttcttcaatcatataggaaaccagggcctttcttagaaaagtacaggcagatgtgagctggggaatttcttagtacctcgttcaatgtgggagttaaaattatgaatatatctagagcagccctaattcaaatatgaagattgtttattaataataaaaataattgaccatgatcttctcaattcatacaaaatatactgttacattgcctcatttggtcagttgtcattatttgtttatttctaacac

SEQ ID NO: 25948 - DNA, 1141 bp, Mus musculus
atctgttcttttatttttttgagttagcatacaacataatgggtttcattatggcattcatatatgtcaaacatggctcttgtttatctacttctccgctgagccacggagtttatttctcaggaaaataaataccgtaaaagtcatgacatatatgcttatgacttttggacattttgagctatactttctgaataggatctacctttcttatagatgatttttggaggtatttcccatatgttagatcatatcatgcaaaaagttttaatttcttcctttccaacatgaatgcctttattccttatttttattcttaggggaaagctttttcttttcacccctgagtataatgttaactgtggggttctctctctctctctctctctctctctctctgtctctctctttctctgtgtctgtctgtctgtctgtctctctcttttaaagatttcacttatttattttatatatatgatgagtacactgtatacactgcagctgtcttcagacacaccagaaaagggcattggatcccattacagatggttgtgagccaccatgtggttgctggggattgaactcaggacgtctggaagagcagtctgtgctcttaaccgatgagtcatctctccagccccctgtggggttttcttaatgccccttttcttgttggatatttttccacctttctttgaaaggatgttggatattgttaaataccttttgattctattgggataaacttgttgaggtcttcttccaccctgtcttattaaaatctcattttcatgtgttaaatcaaatcacccttgccttcttaggagaggtcacatttggctatggtaaataattttctaagaacattgttgggttagatttgctaatgtcttgtttgggatttctatactcattcattgtaagggatcgtggcctatggttttcatttgctaagactaagccttgccttttacccattgagaggacaacaaattgttttttattcttctctggaagataagcagtaatcttcattaagaatgattttgaagactttgaatcagaatagtacagattgccattcttaaaggctgcttgtgttcagccagcagtgctactacaagtaatctgtgtacctgtt

SEQ ID NO: 25949 - DNA, 1537 bp, Mus musculus
agaaatgtattttaaaagtcatccagtgaacagcgaggaatgcatgctttttaagttgttatttaggaatgcttttattcatcgagtgttttttgtttttttacaaaggtaagagcagtctgacaccagagggttggttttgttacctaacgatttttttttctgttatgttttactctttaatgttactacttacatttctaaattatgtattttacttaactctgaaatcagttatttcacttatttttttcttcatatcatgaacgttctaaaaatattccttataaatttgcatcactttttctcttgtggcttttgaagttactatattctaaacttgagaagatggtataaatcaataatagaagagtcactggggagctggtgagatggctcagtgggtaagagcactgacttcttttccaaaggtactgaattcaaatcccagcaaccacatggtggctcacagcctcccatagtgagatctgatgccctattctgatgtgtttgaagacagctacggtgaacttataataataaataaatcttaaaaaaaaaaaaaaagaggtgtcactggaggagtttaattttgtattttttatatttaggtccagctattaaagtgtgtaagtctgggaaatttaattttttttcttaaattagtgctatatacaaatgttctcagttttataaggtgatcatgtgctttctgtttttaaatttacattttctgaggtggtgaagacttaggttctgatcaataagcatgatagggcatgtagactatacgggaaggctcctgagcccacagtatatagtgagcatgatagggcatgtagactatacgggaaggctcccgagctcacagtatgcactggtcacgccggggaactgtagagtgtatgggctctgtgtgtaattcacgttctgacatcgccagaaagacgggactgggagcttcatgtctgcatgaaacttcctatatctttaatgtgtgtatagacttactttttctttaaatattaaagtctaccaattgctacaacagttcttggttgtttccctcaatgtaatgatggccatagtgggaatgttatttgagcacatttctcaattcttcattagccttttttttttttttttttgtacgcttctaggaactcaatgagcatttgagctttgagtttgccgaggtgtatagtatctattttcactttgtttcattcatgttcagtataatgaacttggaatcttccaagggaaaaagattagtcttgatccttaattttgttaaatgatagaataaactacaaaggctaacagcagaaaaagtttcaagaagagcagttttatcatctggggtcgcttctctgaactcttctcaactgggcgggtagtgtctctgaggacttctgccaggtgactccacagtgcctcagcaggtggctactgggtgaggacttcactctgcattctgacctggtattttctcctcccctagtgctttctctctgtattgtcaactttttatttc

SEQ ID NO: 25950 - DNA, 1128 bp, Mus musculus
agttactttttgctttttaccaaaaaaaaaaaaaaaaaaaaaagtacggacttatttctgccacggtttacatttttctgccaagacaccacccactggagaggtcctggaacctgcaggccgctgcgggctaagcagacacttccgccgccccaggatcgcagcacagaggaaagggccccagcgcacttgccgctgggacctctgaggccgcggagtctttcggccgctcctgcccgagtcctcgcttggggaccgagaggcgcacacacaggggaatgcgaacaaccgtgcaagtcaaaagaaggccgccagggggtagcggcctccttccatccacatccccatgccccgccccctcagagggcgcacttccggccgcaagggcgctcgggaacgcgaaccgcgagcctccaccaaccagcggctgtgctggatgggcgcaggtgcgcgcgcatcacggcgcaggttcgaaactccggcgctgcgcggtggctcccccacaacgtctcgtccgccctcgggacagccgagctctgcgctgcccttcgccctccgcccgccgcccgcgcgaccctcgtccctggcccatggccaagcggcgtgcggctgagccgctcacgttccgcgtgccttggaagcggctcctgctcagcgacttccccgaggagccgccgctctgggtcccgccgtctgggacggctcggcccctcaagcgccagggggacgcggggatcatggcggagcctgcgtctgcgccccgcaagcgacgcggcggcggggacgacagacaggagctgcagggctgtagccgggagcccggagagccacctcctggcgagcaggaggaaccccgggccgcgggcggcggcgacagagtagaaagcgcgggcagcccgcaggtagccgacggggtgcacagccaggtaggtccgctactcactagcccggagctcggtgccaggccgcggaagtcgggccatcgagtgggccagacgggctggaccctagagggtcagctcagtgaccaacgggagagaggcgtttaatttgatggggaatgctgtagaacttctagcatgctttccagtagcattcatcagaggacctgttaactcctaatgttca

SEQ ID NO: 25951 - DNA, 1571 bp, Mus musculus
aaatcggtgtgataaatcagtgtaactgggaaaatgtgtaggtagcccagcctggctttaagcttacagctcccccacttggccttctgagtgctctgactgggcatgtcagtctgctcccctgaaacaaagcagttatttcctggtgtttgcgtgtgtgtgtgtgtgtgtgtgtgtgtgtgtgtgtgtgtgtgtgcgtgcaatggggggagtgccattttctaagccagtgatatctttatctttttcctttcctaaagcagcctgaagagttttggcagtataatacattccagtattggaggaaccctctgccacctcttgatctggcagctcttgaagatgtgagtgcaaacagcctgacagagacacttgaggacaagaatgaaggagttgagattgacatggagtcctgacagaagcatctgaagaaatgggattctctgaatttgaggcgacctgaaggaaaagttcttttccatacttgacatgatccttttttcaaacctgaaaactaggaagggttttgggataaataactaatgactactgaatctcctaatggagagctgtcgagggtgtgggacagctgcagacaaaatacttgtgtttgcatttttaatgaaaaagttttgttcacgctcttgactttgaagatgcttatcttggaaaaggaggttttggcagtttcagaggaagccctcaggtctaccgcacttgttctgtcaaatgtccctttgcaccacaaagcttatttgtggtacacggaatgaatacatttatacagctgatgctcataaatactcgctagtacatcttattggatccccttggttgaacaaataggagacttgagtatctatgcaaaattaaaatgtgagattgtttttgaaagctaaccttgttttacaagagtgtaaacttaaactagtgagaacttccatttgggtagcgtgttttacctttcgctatttgctgtttattaacagcataggcgatgaatctagccaaacaatggatagagaacagtaggaagcagacacctgcccctcctgccttttctgaggtgaaagaaatgatctggtcagcttactgattttgttctgaggacattttttatatagtttatattactttagacctgtagttctcaacactgatatagcactttagccatttctgctcgagccctggtcctagagagatctcagtcaattatttgaaggtggttttacacataggtttttgttttattttggttttttgcaccgattctttatccctgtgttgtgcagatggggccagaaccactagactagcagcctttcctgtttaaaggagatcactagtgagagctgaagcaatgcctcttcattccttttgtcggtatcttgttatgttacttgatttgtcattactaagttattgtgttacaattttatttttaataaagtatactgtttatgtttgagctatgtatcagtgactaattttgtattggattcttgacggtgtttctgtacctcattctttatctgctgatagacactgaggcccattccatttgctcc

SEQ ID NO: 25952 - DNA, 1178 bp, Mus musculus
taaggcagtacatttgataactaaacatatgtgtatagaaatgagctttaaataactgcacatatacacaaacaaatgccattgaatatataatatacatatcaaatatcaatactagccaatgttcaagcaaatactacctatttttctttttcaatgctggtctattcattctagcaaataaatggcaacatattatgtttcaaagtgatttggtaatttatgtttaacaattcattcttgttagaagctatttgtgactctgagttttcatacacagcattgctcctttttcttttattggtctgtaggcaagtgttttatagtcttaacattttagctgtactcatttttccattctcataaaacacatgcaacctgagttacatgtaatatgatcagagtcaccagaaatatgtaacatgagtcattcaactttgtaactgatactctgggacaaatgtttaagatattagttatttgcatcattatttttttagaataatttactacaaagttatttttcttgtctcctagagctgaaaagagatctggccaaagacatcacttcagatacatctggagactttcggaaagccttgcttgctcttgccaaggtataacataaatgctctggaaatgtgtttgctattatgctgaataaaaacttaagagttgtgataattttctaggaatgagaaactttctctttcttcaaactaatgctgcttaattgatgaactatacttgtatgtatttgagggaacagtgtgatattttggtatataggatgtcaattaatggcataaaataatgtcttcctgttataacttcctaccatttttttttagttgagatttaaagtttatcttcaggtcacttaaagatatcaactatgatacagattacatttctcttactgtatagtaacgccacagtgtacccctgcttattagcgactgtgtcctttcattggcatcttccagacctgtgtttcataccctactatcgctgcttatcaccaatgaactatgtgcttctgtgggttccagtgttttaggaagcagacctacgtgagctcatgctctgctttgtctggcttgtgctcctcagtgcaacattgctggagaggatagaccctgttttatgctctttttcctcagtggttattgtctgat

SEQ ID NO: 25953 - DNA, 1154 bp, Mus musculus
tatttttatagcacaaccagaggttccctaatgtcacaagaagactgaattgttctttgttcacatgacttactcaaatcagttttatttgtttatggtagagaagagacagtgaagtagaaaatcattgtgggggaaaatgttgggtattttagtctgtcttaaacttaatgatgtaccagtttggggggttttgttttctcccttactatatcagtttcatcaagtcagattattgggtcatgaaatggaaggtgaatctgtatttaaaatgagttctactttggaaaaactgaccaaattttgttttatacatacacacaaattacttggaagtagatcagctaataatataattgttgttacttgatataaatctgtgatttcctatttgtcttcctcttatttttctatcctccccttcctttgtatgtctgaggagcttttgaatgttttaggtgtgggcaaagaaatggctaacgtacaacattctcaagactcatacattaaggaaaattgtattaatgtatcatagtagcttgagaaagtaggcggaatattttcgttggtctaccacaagactcttgatcccattatatattgctaattgagaagttgacataaacgcaatctgcttgtcctaggaatttgataatactgagagctttgaaattggcgtattatttaggcaatggttttagtattgtatgtgcctaaatgtgctattcttagtgtttggattaatcctaaggatttacagtttacagttaggtttaatataagtactcacagttaagtttatacataaatacagttaggttttatacaagtataagtttttttttttgtcttctgaagaactagtaggatgacgctttaatatagcagtctgcagtttttcattatgaccacaaatcctaatagaaattaccaaaaggattttttttaaagttgcatggtgatggctttttatatgtctctttcttagtcaaagtgaaaaagtaagttaggtcttcaaaaaaattcctgttctaaagcccagtttggtagtgatctgtaatcctagcacacttatgtattagacagaatggtggcctccagttcaaggacagcctggcctagacaagactatgtgtcaaaataatagaaacaaa

SEQ ID NO: 25954 - DNA, 1219 bp, Mus musculus
ttatgtgcctgtacttaaaaaaaaaaaaatggtacaccagaaaaggactggcagtctactaccatagtcaaacttcaccttaatttcgacatgacttttggaagcaggaagaaagctacaaaactggtatttggtaccatgtgtgagcctggttaaattggtcttctaaaagctgtcaattaggacattctgcgaaaggtaacatcacaactggttctaagtcaaaccatcaagtcaacagcagggtgcctgagataatcttggaagcttattgtgctggcctgcaccagaagatatctgcattctcattactaaaattgtagcacagaactgcactaggatttgtttacaaggagaaattaaactctgtttggttttcacatatagcagctctgttaaataacatgcatctgaattttaagttgcaaaggtatctgaacagttaatttttcatgtgcatcttttgttgaatgttttggttcaagaaagaatgtttaaagctttttaaagacttcagttcttaatgtaactgtacccttctgcatggaaaatcataaccaacatggctgcagtagacttctttagtggtatccagcaccacttgcagagggctgctttatcatattgtacttgggtgtaggactctagtgttcttgggtgtattgcatgggctgcattatctacagcattgtacaataacaactagaaaaggcggtatacttcactgatgcttgtctggtaatatcacttctgtgttaaaatggaaggttttttgtgatgtatgaaacttgtgttttttatatataaatgagtatagttagattagtgttgtggtaatgcctgttttcatctgtaaatagttaagtatgtacacaacaaggcactacttctgatttttgcagtgttcagtcctagtttttctttattaaaacattgagttttgcttcaattttatgtaccttagttctaagttagatttgcagatgtgtacagatagttcatatttatgtattgcacataatcatgctattcagcattgatgctatattgtattatgtaaataataaaagcagtgtacagagggagacttcttgtttattgggtttttaagtcttagacacctaaatagggaaaataggaaagttttcatattcaaatttatttcatatagctttgtattgcagttgttttgcatgatcattcttgagttcagtcatgg

SEQ ID NO: 25955 - DNA, 1175 bp, Mus musculus
accttgtcttccttttcttccatttaggtttaataaagaaccagacgctccagaaaacactgaaaatgaaggttctggccatagaagacgctgcggacggaaggaagacagtgatgaggacttagacgctgagtctgactcggatggcgaggatggagacactcaggcctgacaacaccaagtcaattgcagagggagtcagaagaggctcatgagcaacattggttatttataacatttgagtaacagaatcttaaaggttttcacagtaacacttaagctgtatatacagaatatgtgtgggcacaccatggcatgttgtataaaacctatagaaattgtttagaaaaacattatgtcaaattattcagtgttgagagttggtgactgcatcagcactatccatggaaaactaagatgactagctcagcgtacatgtctgtaacctgacctcgggtatgtgactcattagcaagagcccccttacatcgcacaaagcaaaacagcttatttttatacacactacacacacgtacaatcatgtgtaatgattttccttcaaaaatgtttttatatgcttcattccatttttttaaccttctcctagtttggaaatatacacttagaaaaatgtgtagactgtatagttactgtctagaaaggaaaacccaaccttcatactggagtggagatacttacagtatcagaagctcctgtgaagttctccctcgaaaggttatccttcccagaattccatcctccggaattatcactttattgccagtgttttcacctgtaaacagtgtaagttagtgtcacgtgattattgaagtctgtgtccttgggtttaaaaccctagagccacagaatagtggccaggtgatatgatgggcttttccacactctagctagagtcataatttcaatgttttactgtgttttctgtgtgtcttaatctctacaaatgtatatattacacacatgtgcatgtacatatgtgtgtgtatatttgctgagccattgaaataaatgggaagctgtggttttgcacttgtgtgtcttgttgttgttataaaaacttggagactgattttcctgatccacacaatacctatgtaaaatgaaccagaagtagagattttattgaagatattttagtttaggcttaaactcaa

SEQ ID NO: 25956 - DNA, 1223 bp, Mus musculus
atcggtgcagcctttaagttacaggaaagagtaaagacgttcccgccccagattgagactaaggacagtgacccggaagaagttcttctactctttccgtcccagccccaggtcggcccacgtgactcattagggaggtcacgctcggctctgccttgccgcacatcctcgactaccggcttcacggaaagccttcctcggacccaaggtgcaagtccggctttcttcgaatctagaactcccccattggctcgaacgcggctgtccatcacggcggagggacggagattccccgttcctattggctcttcttttccgcaatccccgcctcctgccgaacgctcccaacctgtctcccggctccgtagcgtagcgactccgctgcgcagtttgtgattggtggaaggtgggcgaggccggtgccctgatcgcctgcagcccggagcccgggtcagcttcggcgccctcctccagtcactgagcagctcgaaccgggccgctcgcccccccgccccccgccgccctcccagctcccgcccgccgcggccgcgcgctccgccgcctggcggccttcggaggtgccaaggaaggcgggctgcggagaaggcagcaccggccctgcgctgcggacggcgaccacggccgcgcgggacctcgggccggagagccccggcggcggccgcccctcgcggcggagccgttagtcagcagaacgcgaacgcgcgtggaggggccccacgaagcgcgcccgggcaccgcagctctctttcgcgtcctcgccgggccgggccgcgggcgcagagtcggcgggcggcgccccgcggaggacagcgcgttggcggccgcggccgcccagctgcaggtgcgtggggctgggctgctgggccgtcggggggtcgccgctctgagctggggaccaggccgggtggcttcggagcggagctaccgagcggagagccgtgcgtcccgggcctcctcgcccgcagggaggaccgcaagatggggtcgggccgccgctcccctccctggatctgggccacttcgggccctcgctctcggctcggtgtccgggtcccgccagcctcgattttagatggagtccgcccggagcttgagctgggtatcccgctccgcttgtcgcgggagctgctttccatggcttgaacttgtatcatctctgattgagaactcaaggagggagaggttggatttgaattgaaagt

SEQ ID NO: 25957 - DNA, 1165 bp, Mus musculus
attaaacctatttgggagggttcttgaaattatagttaatagtccttgactaccaataatacttacatatgtctttgttattgtaggagagtgcaatgtccacattaagctattaaaatatttgatgtctcttcttctttttcagaagatgaataatctgtcatttagtgagctatgttgcctcttctgctgtccaccttgcccagggaaaattgcttcaaaactagcattcttgccacctgatccaacttacacactgatgtgtgatgaaagtggaagccgctggaccttacacctgtcagagcgagcagactggcagtactcgtcccgagaaaaagatgctattgagtgtttcatgacaagaaccagtaaaggcaacagaattgcttgtatgtttgtgcgttgttcaccaaatgctaagtataccttactcttctcacatggaaatgctgttgatcttggtcagatgagcagtttttatataggtctgggttcccgcattaattgtaacatattctcctatgactactccggatatggtgctagttctggaaagccaacagagaagaacctgtatgcagatgtggaagctgcctggctggctcttcggacaaggtaatggtttttacccttatgctgcataagttatactgtggaacagcgaaacagaaagcatttttaacacggatgctttgaaatgcagtgtgaagatatttgcataattgtattacattaagatagtaaaattttatataatagccaaagtagtcttgacaaacagctcgcattgtgtgtgtaaatgcctgtgtgggcgtgtgtttcaggatcttttttatttaaatctaggaatatttaaagtttctctctcaagctttcttattaggatataatacacacatccttattctgtgatttcactatttgtttgctctggcattgataatgtaagaagccttttgtttgacttttattaaataagacatgttggcattttactttacatcttagtctactaaaatttggaaagatcatcttaattttctttgaagtaatatgacaaaattaatgaagatgtgtctcacttatgtcattctttaacgaggacagattgtatttgggaagtagaaacccattaacttttctgggtgcaagttttatagattcc

SEQ ID NO: 25958 - DNA, 2120 bp, Mus musculus
tagcttcaaactattttttatgttttcctctctgtttttaaccttaaaccagaacaaacccaaaggattttgcttgagttttaataactgatagaataaaataagtgcagtagggaatgaagttagcccaggcaggcatggtccttgggttaagaagcctaggggaaattcagcatcgaggcagcgcttccatgtaagggtggcagtgtccaagcagagcaactgtgcagaggtaacttcctgcagcaccgtagaggtcatggaaaggatggacggcctttggatcttactgaagttgacttccatccctaaagctgagttactgtacagttctaatgtttgaattttctgttctaacacaggaaacttccttttttctacagttcattgagcttttttcctttctcttattctctctagcattgacaaaatctctaagataacctctccagtattaataattcacgggactgaagatgaagtcattgacttttcccatggcctcgcattgtttgagcgctgccaaagacctgtggagcccctgtgggttgaaggggcaggacacaatgacgtggagctttatggacaataccttgagaggttaaaacagttcgtgtcacaggaactggtaaatttgtaaactactctgtaaatttgcagactgggttttcttttcttgctgaactgcactccttggtaaataacataaaacctgaaggttttgtttacaaatcatgtaagttgccttcataactgtacaggtaatgatttgttaacagacttaatgaaggttttaattaccataacttgaaactggaaatagcagtatcatgcagtcaggctgtgtaatttatattttttctgtgaattttttttaaacatcaagatgagtactgtatgaaattttaattctataaaatcaaatgctgtaaaagtattgtcaaatgcttttgcatatcaaaagcaaatttataaatatttttaaacatctcaatgtactaaatatcctggtatacaaatgtaatattctttcaaaaagctgtatatctaaagcaattcaagtactcagaataaactgtaaaaaacaaaacggtttgaaaacatccaaattgagttgatatatactccactgtacagggatagaggcttaaatggttattttattgttaaaaaaaatgcattgacttttctgtattctccaattatagtacatttatcctttaaaaaaatgaagtcttaatttttatgccatctgttaacttagcagctcttcatcctgtcactgagaagtcctgatggcgctggattttaactagttctgacttatgtttggtactgtgagacaactacttaacattttcattcagttatttaaaggacagttagggcttcaagaatgattttgtatgcaatgttgttttaaatttgactaattattagaactgtagtagtcttccttatatgaatacttgaaactccgttagttgatcttcaagaccacagagagactggctgtttggttcctttccacctctgctgtttttaagagtagggcctgttcttttggagtagtatctgagaatgtcatgggttccctcctgaatgcaggggataagaaaacatgccatacattttatattaaccagtatagtaaaaaaaataaaataaataaataaagctcacacacaaaaactaagttgcctttccttgaatgaatcctgcctgaaaaatgaaagaaaaataaaaaataaactaatggtatatagtcttaatttgtaatgaatgagaatcaaaataatacacactgtggatatgtttttaaggccttatgtaattttaattgttctgcttgttctgtggttatgtctaagattatagtacacgatcttcaaagtatatcaaatattgtgaatcctttggttcagctatgtcaaattcacagtaaaacaacaaatgtaccactcggctgtgcttgtgtgccttcttctgaactcctcacccccacagaaagaggaaaagtcacaacaccttcctgaagttttctgtatctttaaaattttgttttaacattctaagtatacatttaagaaggttgctttgatatttccacatatgtgaat

SEQ ID NO: 25959 - DNA, 1101 bp, Mus musculus
gacagcactgtctccatactattgattagtaactaatcaagaaaaccccagtaatttgctgaggtccgggtatctcattacagacggagagttgctggctgcttacacaatctatttcagaccctgatgcctgaattctgccgggaagtaccctctgagttcggaaacctatgcgccaccatggacagaagatgggattgaaagacagatgaatctgactcttgtgtcatgtagagttaagatatgtttctattctgcaatcttgtgagtggaattctaggaatgcgccctaggcttctgaactggcctagggaaacttgagtcactttcccagccgtagcattcagaagctgtcttttgagagacagcatctctcaaacactaaagtgcataagaacccctctggggttttgataaagtgtcagatctgcctctgaggggtaggacactaagtttctgcatttttaaagctctcaggagatgcccattctgttggtgtgtccttaagaacatggcctctgcctcccccccccccccccaaggccagctcggaatgtcagagcagatcaaaacttcacaaagtagatttgggcagaggacccaaaaaccatccgagcgaaatgtaattgtgagtgtgaaacatggcttactttccttgtgattaagggctttgcccatggaggatcgtgagctagtcgtatagcacatgtaaccacttctctgattggacattcacacatgatcacctctctggctgggctttgggctgagtgagcgtgtacagggagtgtgtgacctccttattgactcagcccaaggaagcactaagaaaatgaccaattccagtagagcttactccagtcttcatttatatcacactgtgagattcattaaatatcacttaaagggcagcgcaatacacggtcctcacttgaatatatcatatcatagacactgtcttcttgtggtggtaaaattccttcacaaacgaagcataaatacaaagtgttgacttttagctcacagtcccaaaggaatacagtccgtcatggcagggaatacatggcaggaggcagggaaggcgtggtactatggataggg

SEQ ID NO: 25960 - DNA, 2219 bp, Mus musculus
atttataattatatatatatatacacacatataaatataaaaaatcctgtctttgttttgttcaactctgactcatttccctcgttatcttgtaggaaatagctatacactttaacttttctctccctctctttttataggtagtgtcgtatttttgggattcagcggaaacttcgcaccgtcatggacgaagctgttcaccagtcccgatgagcagggcctcggagtgcttgagcagtttctcccgttgcagatggaggaatatgggtgctcccggaccggcagtgtccacagaagagaccttgacctgttacagcaggctttgaaagtgctttagagacttggttgtaatttaagtgctgggaaagaaaaaaaaaatgtgaactaacttatttaatttatggcattttaagacaacactgttaacccgatggaaccattttcctgtttgatagaaaagggagagaaggaatccaagcagttacctgagtgtcagcttgcaggccttggcactgtgcaggtggtagagcccttttgtcttcctgaggctgctgcgttcagagagcagttggtctcgtggcccttgctttgacaagcacatcgggggtgctttgctttttgtatagtggggtgcagggagtccaagggctccttgaacttgctccttcgaggactggctgctctagcatttcagatacttgaagtccaatgctcagtcctgcgctaactccagtcgctgccctgttcagtgatgtctggggctcatttctgtacagcccacgagggttttatgtgatgctagatatggttttaagtggcaactcaggcccagcacatgtcctttttgcctggtcatgtgctctttttattcacttgtatactgattacttttgagggttcacctttcaaagagggaaccttattgggacaaaagggcttttgaaattttttagatctgtaaccattgaggaaaaaaaaagaaagaaagaaacaacaacataaacctattacttgcatccaggtggaactttttctgcagctttaatccttaacctgtcttgacctttaaaacgcagagcggaactgaattaattttctttaaaagcagcaagccacttcctaaactgtaaaactcttgtcatttgaacttgcaaaagaaagccaggtgtggtggtgcacgcctttgatcacagcactccaggagcaggtggatctctgagagtttgaggctagcctggtctacgtagtgatccaggacagccagggctacgtagagaaaccctgtctcaaaagaaacaaaacaaaacaaaacaaaacaaaatcactctgtcaacaaaagctaacttgcaaaagggaaacctgtccttggttttggtcttgtacctgtgctttgttgtcttgttgtgtggattttttttttttccaagcggctctgctcattgtcctaccagaaaatcccagagagtttcccgcttgctcctccataaatattgtattcaaggaaagaaaggagatgccttcttagggtggaatcatggaggcaatggacatgatcttctttgtagcctttaaaagagggagtctcttagtgaatgtagctttcaaagacaagaagaaaggactctgggtctcccagtgctgcttctactggccctttcttcagccagtggggacacatgtggcaaaggatgctggctctgcagccaagagggaagatggcatcagaatgctgctgtgctgcccaaaggcgggtggctgaatagccaggctgacggtagcaattgagtgcagaaaagttcatcttcctccgtggagggccgaggctgatgcctgtatgttgtgtccaggagacattctaggacagctctgtgacttgtgtaactttacagaacatgctacctcaaagtgctgtgacaaaccatttggactgtagtgctcacaggatgggcacgtgtcttaatcaaagtttggttacttgtttatccgggttttttggatgtggggttttttgtttgtatttttttttctttttctttcattctttttttttttcttttttttttgtacagtgagatcttacctattaaatatatttagtgggtcatggttcctgaaggtgagtgaattgattgtgtgtgcagatgtgtgtgtgttatgacttaaatatatttgttttgtgctgttttagagttccttttttatatatatttggagaaagt

SEQ ID NO: 25961 - DNA, 1125 bp, Mus musculus
gtgactttaagacaagctctatgaatggcaaagaaaagtctacactgacaacatgtatgcttttgccactgtacggggcaatatacaaagagggctgttgacatctgaagaaaaagacctaagatgctgtggctaaaaaaaatcaggtggcagatctaaccgccaatcaggtggcccaaggagcaatgatcctggcagtcaaggagcctaaagatgattataacatcagagagaccagctttagatacaccgctgagcactatcaagctatggacagtatttgacttggcctgggggccaagaaattcaaaggtgtggttaggtcctttgacaactatgttacaggactctctgacttggcagaagaaatagtcaaaagctgcaaggactgtgctatgacgaggtagaatttctaaaagaaaccttcccaaggtaatggacctgcctttgttgcccaggtaaatcagggactggccaagatattagagatcggttaagagttacattgtacatgcaggccccaaagctcaggacaggtagagagaacgaatagaaccattaagagacccttaccaaattgacagcggagactggcgctatgattggatagctctcctaccctttatgctcttcagggatagaaacacccctggacagtttagactgacccccctataaattactctacaggggccccctccactggtaaaaatagcctctgtacatagtgctgacatgctgctttcccagcctttgttctctaggctcaaggtgctccagtgagtgagacagcgagcaaaaagcagctccagaaggcctactcaagaaaagaagacctgggctggtgagatggctcagtgggtaagagcacccgactgctcttccgaaggtccgaagttcaaatcccagcaaccacatggtggctcacaaccacccataatgcgatctgatgccctcttctggtagctctcttcagacagtgtacttacatataataaataaataaataaataaataaatctttaaaaaaaaaaaaaaagagaagaagacctgctacattagacgtctccacgcagaaaaccttgagactccggtggaaaggcccttatcttgtactcttaacca

SEQ ID NO: 25962 - DNA, 1769 bp, Mus musculus
ttttagagttcatttttaaagaaaatagattgtttacactgttaaaattgggttttgcttctcaaaattgtggttgtgctctcatgttacaagagaaattgaaggcttctcctgaattggagccaccagctaaatcggctcctctaaaatctataaagcctcctgagtggcctagtccacaaccttccccttatccacagcctcgaccccagccgccaagggaaccccaaacccctcggggcgttgagaggtggaccgctgtgagtacatggagccacagggacccgcagagcagagtccgggcggactctggtggacccgcccaaactttaaacccttcagtactggtcattttcctctgctggtatttataactggaaaactaaccaccccctttctcaggatccccaacgcctcacagggttggcggagttccttatgttctcttatcagcctacttgggattactgtcaacagcggttacagatgcttttaacaaccgaagagcaagagagaattctgttagaggctagaaaaatagcctgggagccaacgggcggtctacacagctacaaaatgagatcgacatgggattccctttgactcgccccagttgaaactgcaacacggctaaaggtagggagagcttaaaaatctatcaccaggctccggtctccaaggtgcctcaaaacgggcccactaatttggctaaggtaagaggtaatgcaggggccgatcgaaccttcctctgtgttccttgaaaggcttatggaagccttcaggcggttcactccctttgatcttacctcggaagcccagcaggcctcagtggccatggcctttcataaggcagtcagctcccgagatcagaaagaaacttcagagattaaaaggtgtattacaagaaagagacagttatgcgatctagtaaaagaggcagagaaagtgtgtgtgtgagagagagagaggcaggaggcaaaagaaagagaaaacaggagggatagtagacaagaaagaaatttgccacagtggtaggaaaaaaagaaaagacaggatctagacaggaaacctgggcaactgaagaccgagcctcagctaaagaggctcagctgtgtcagactgaagtgacttatttgggatacacccttcgaggtggaaagcagtggctaaaagaagccagaaaaagactgtaactcagatcccctccccaactacaccaaggcaagtaagaaaattcttaggtactgctggcttctacagactctagatacctgggttggcgaccttagctgcccagttgtaccccctaaccaaggaagcgaggtgtttgtgtggaccccagatcaccagaaagcctttaaagagattaaaaaggccctactgatggccagcctatgcctgacctaaccaagcctttcactctttatgtaaaagagagagcaggggtcaccagaggagtccttactcagactttgagactttgaaaaaggccagtgacttacctatccaagaagttacaccctgttgccagcgggtggttttcttgcctgaaagctattgctgccataatctgcttgtcaaggatgctgataagctcactctgggacagcaaataactgtagtggcatcccacactcttgaaagcattaccaacgctcctgtgacacatcagagctttttgttgtctaaatgagtgatcttcgcttcattccacctgctgtcccactgcgtgagactgcacctactcatcactgcgctgacattctggc

SEQ ID NO: 25963 - DNA, 1236 bp, Mus musculus
ttatttctctttacatccgtcagcagttcctaggactggagagttgcagtgtgtcataggcctgtcctggtgccagctactgcattagggactccacaaatgctaattgactttccctttcctcagtcaggccagaagaatccaacagagtccctgaccctgtctttgtcacgcacttaacggagaacaggggaatttagatagtcagtataatctgattaggcataactgctgtccacttggcaaaagggagtgagatattttgatacttgctagggtttggaatcttaaatctgctgaaaagaatccagtctttttgtgtttgccctgcttggtacaggagtcccctgccctgtatattcaattacttcctgtataatagaaccacatgcatcatacagcgttctttctgaaggtgaacattttgttcctcaggtggcctgagtgactttgaagtgcttgtcagcagctggctttcctgtgcagtactgtaaccattcagttcacagtggcattttacttcggatgccctcattcacaatattaaaaagggcatgcagcagccttgcctctttgcttcaggaactgtgcttttgggcagctgaggcccatgggctgctcaggcaagtcactggtctgtgtttaagaactgtttcaagtttagttggctggcattgactagtaactataactactgagccccatcaaggcggtgtggtcctctttcatgtctcgttccaagtgaagcactgcgttgacagagctggattcccgaggttattctatcactctctttaccagtggcaccatagcgctttcccaccaggcatgcaaactgactgaggtctctcacaaagtcagggaaagaaacattgaaggcaacttcatctagcttgaccaaatgcttatggcttctgactgataggctagggatcctaggctctcctcattcttctacagcaatgatatctggatttattttttatcaaaatggctgccagaaaccaggagatgcgtgagaccttctgtgatttgccaagaacagttcatcctttggctatctagacaccatctctgtctgatctcctaactcagccaagcaaagagagggatggtccaaaatgttgcaagaagggtgacaatggagacacagaattctccaggtccagcttcagtttcttaggtttttgggcccttttataatttccttttaggcctttctagatcatgaggcaa

SEQ ID NO: 25964 - DNA, 1167 bp, Mus musculus
acctcattggacaacacagcagagctgatcctgatggtgggggctcaggccagccagtcccgagggaggccgagagcatgggagagctggtgtgggtgcaggcattatgcctcctctcacctgtggcagtcgggagaactggctctggggtcatgagagcaggtgagatagccctacaccctcactgtctgccgcacttgggagagtgggccctgcgtttctcctggacaacacggtggagctgaccctgttggtaaaggcaccgttgagccagtcccgagggtatgagtgggagagctgacccagtcccttgaaggctgcagcacttggggtgggggtggggggtagtccccgtggcttgactggcagtgcagtggagctggctctggcataagagcaggagaactgaccctgcctcctgcagatggaggcactggtggcctagcaggaacagtgctagagagctcaccctggtggtgtggataagggagagccagcaggctgaccagctcagctaccaccaggctcagactcagggctctgagttggcccactccaaaatctgtatcaactactaactgttcggatgtgtaaaagggccagccccacaagcccaaagctgcaagatctccataacacagggcatcaacaggatagcttggagtcccagcgagggaggatccaatattcatggtgccacagaagcctcaaaccagacctacgactcattgcaatacaatataattgttcactgcgttgaacttttgcaactgaagatgtgtggacagagggacatactatgggacacactatagctttcacaatgagagtttttctatgcttttttgcttgttgtgtgtgtgtgtgtgtgtgtgtgtgtgtgtgtatgtgtgtgtgtgtgtgtgtgtgtgtgtgtgtgtgtgtgtatgtgtgtgtgtgtgtgtgtgtgtgtgtgtgtgtatgtgcgtgtgtgtgtgttttattttgaggagagattgaaatagtgaaaggctgatatgaagggaccagaagatgagtgggactgggatacatgtcatgatattcacaaagaatcaataaaaagttaaaaaaaaattaaaagatcgagttccacataaggtgacataaaaccaacgtccagtgacgtgaccatgtaagctatctggg

SEQ ID NO: 25965 - DNA, 1201 bp, Mus musculus
ctggcttctattcatgagagaaatggcccccgtgctggccagtaagaaagctgttgttctctggctacaccgtctagttgaaacctgagggtatatttgcagccagaccaatgagagacggccctgaattcttgctggaactacctgtagctgctaagctggtggctgtaatggagcttcagggaactgtcccaccatcaccttcggaaggcttgtctgatgagggggctgcaccaaggacatttgagaccgcagtagattctgtgtaacaccgttgaggattcccatccagccaatattgtacctggtagagcatcaattgtctttgctttaggtcgattttcctgagcttcttcagctcatgactcagagctccaactctcagcggcctccttcataatctataccgtgctcatgcttaactgcagatgaataatagctcaaagcacactcttctggcatctgtcccgaaacagaccccctaatctaattggcctagatggatccctcgtctaaccctcgttgcgttgcattgaaagtcaagattaaagtgagctgatgccttcctatggttcagggtatggatgagtgggtgattcctgtctattcctgcctggaaacctgtccgccgtacttcgccttttgatgacaccctgaagtgttctcagcagaactcagtgcttcccagctggctctgttagtttattggtacatgaagtttgcttagcatctctcctgaaaggagatgtgatccttatgctgaggcatggtttagagtaatgtgctgatgagcctgtagtggacttcagaaccgtagagctggctaggggctaggtggcaacagggaaggagaagtgtcaccttcattttaataatgcctctgtgtgagtggtggcctcaattgcatgctttgtcctctgacaaattcttactagtgcatcagtccatcaatcaatgacatatacttaataagcatcaactggagacccaaaccttttattaatattgcatagctctaagccagtagtagcttaataaatacttccagtgactaataaggtgttgcagctttgaagtcactttgagatgaaaatcaaactaatagacaaaaattcttggcttctaatatgggactcatctttacctctgattcaagaaatgaccaaatgtttctcagctagggtaggaatgttttcgcccc

SEQ ID NO: 25966 - DNA, 1239 bp, Mus musculus
ttcttcttcttcttcttcttcttcttcttctttctctctcttcctcttcctccctcttcctccctcttcctcttcctcttcttcttcttctttctccctcagactaatgtatttgatatcattcttattctagtttgcttttctgttgctatgataaaacactcaaccgaaagcaatttaggggaagagaggatttatttcatctgtacttccagttcgtagtcctatgttgaggagagtcaggacagggaattgaaccaaaaccatggaggagtgttgcttgctgtctcactcactggctcatactaagctagatttcttttacagcccgatcctcctgcctaggaatggtgctgcccacagtgggcttaatcctcccacattaatcatcagtcaagacaatctcttgtggacaattcctcagtagttcagatttcctcttcccaggtaactctagattgtgtcaagttgacaatacaaactaactagtacaatttttttaatctgtatttttattttttatttaaactagtaacttcttttttttttctcaagtagcaaataattgctcagaaagataaacagttgacggagattcctctggcccaagaattctaccatgttgcccagaaaagggaggcctggagactatatcaggttagtacagatgtaatttaaggacagaagagcatgtgtattcatatctgagtcctgggagcctgggaagacagggagatgaagctgctctgagtgataggatttattacagaggacgacagcactatttgctcacttctgttatgagctcagcaaaatgtgacagttctgagaaataaaaatatatatcgctctatttatatgtgtgtttgtctcgggagacttggcagtgagtggtgggaagggtttcctgaagatagagtgggcagagcgaactgggcaaagtgaagcctgtcctaggcctgttgatgcctagtgataaacacccatgacaggaactaatattgattgaacacttaagtactatgtcaggtccctggctcagctccttacacgcacagtttaattccacatgaattcacctgctatgtagcaattggctcttctgcataaccttgcatccttttgtcatcttcctgcatgcagtggactgcccttaaacttcctgcagcctacatagatctctgatggaatacagaaacaatggaagcattctgtatcttagcctggacaggaagaaaa

SEQ ID NO: 25967 - DNA, 1181 bp, Mus musculus
tgctctaactctggatagaaaacccatcttctggttatatccctgctttcattttctttgtaaaattcgcagggatgaatcaccagtgagtcagaagcgagggattccaccttttgtagaagcatagagtctcctggttagaaagctgggggtggtggcacatgcctgtgattccagaactcagaaggctgagacaggaggtttgagaatttgaaggtagtctgacctacatgtgagctggaggtcagcctgggctatatgaagttatctcagaggatcgaaagaggggagacaagccaaataaacaaaaagatgtctgaaaaagtcagctggcttactctttcttcaaagaaaaattcctgaaggaattaataagaatagagattctagagccccacctccatgtacaggaatgaaaaagaccaaaaaaaaacaaaacaaaaaacaggaatctgtgttttaaaagtccccttgtgtgccccttttaggtttaaaaactatggtttatatggaaatgttccaagttcaagagacagaatattcatggcagctgatgagggccagaagtacggtgtaaattaataggtgatggactcagaaatctaactcccttcaaagagtgaatgggaaatggtgaatgttgttgttgcaaacccctgtatctcttggattggtcattgagtcttagaatagaagctagaaagaagccggtggagagtgaagctcttgtctaaccgactgtcctgagctaggtgtctccccacttctgggcctctgtttacttatctgttgcaagataaactttctttctttttgatacagggcttgatatgtagccctagcttgcctggaactctctgtgtagcctgggctggtctcaaacgcaaggagatccttctgcctctgctggaattaaaggtgtgtgctaccaagccccgaataaggcagactttatctcttgagttactttcatgtagttttgatgcaaatgtagtatcctcagaaagagtggggagtttttgtttgtttgttttgttttggctttttgttttttcttccttccttcctttttttaaaatcatgttttgtcgaacctagtattttcctgctgactcagttttcaatcttaggccaccctcagcagtgaggatgttgggccttattctccaagtcagtgtagg

SEQ ID NO: 25968 - DNA, 1182 bp, Mus musculus
gaaagaacttttaaacatctaagtgctgcattccaaacaagaacgaattgatgctgtctcatccgagtctgtccttggacaacgtggcctgccatatcgagggtttaaaatttgactcacacttagtttattaagcaccccgtccttccatctatattttagagttagcaccagcaacacaaatatgaaaagatctgtccgattcacttctgctccgcaggtttacaagtgtcgggcgcttccttttggaacgcccttctgattggctgagccaatgccagtgacatcaaccaacttacttttgattggaagcctggttgctgggactgtagcgtttgcaggaagtcacttaactgtttgagggctgggaacccgaagttgaagttctgtttcgtccctagggatgggcgtaactgcctaggggagaagcgttcccaagccacgccagctggcacgtgggccgggaggcgtaggcgcgcgcgcggtctgggcggcatctgcggggatgcgcagccgctggttgccgggctccgagcagtttcccttttaaatgtcagcgttcggggctggaggggcagcacgcggcggcggaacggaacggtcggattggccgcgcgccgtagttctagacgcacctctccaccgaagggcccttctgactggcagggggagaaagtaaacagagttgaatcaccctccccactggccaattggagggggcctggattgtgacgtgatgggattctgcgaaattgttactgagctggagaatgccggagaggcgcggcgcggcaggaccaggggctcagcggccgtcggcggacgcgggaagaagtgtctcgtaggcgcggagccccactcagccccggcccccctcgtccgcgtactcggctgatgccccggggcgtcagctcggcggagaggcggtcgaggacgtgcgcctggctcgcagttggctttctctgggactccgacacgtttgcagtcgaataaacttgcgaccgccacgtgtggcatctctccgaggagggcgcgcccatcgtgggatcgcgcggggcgccgggcagggcggcggcgacagcggcggagccggccgcggctgctgcgtgcggaggcgctgccggttacgtaaagatgaggggctgaggtcgcctcggcgctcccgcgagtcgcaagctcccg

SEQ ID NO: 25969 - DNA, 1151 bp, Mus musculus
gtggctgaagtgttgtcaccttctctttttgtaagtacaaggaaaccctgtgttctccttcttaaggaggtgtgtgctctttgccacagtggtttttcgtttgtttgtttttgtttttttaaagatttatttatttatttatttaatgtatatgagtacactgttgctgtctccagacacaccagaagacggcatcagatcccattacagatggttgtgagccaccatgtggttgctgggaattgaactcaggacctctggaagaacagacagtgctcttaaccgctgagccatctctccagcccttgccacggtgttaatggggtagatttcataaactgcttccttcctcccagatgcgtttccagctaaacccgactgagtcgggaggggttgacttgccaatggaggtatgtctccactgttttcccattataggtcccctaaggagacttgagatttgtttttctaacaaatgcccaccctatacctaccctatggtgtcttaacactgagagcatgaattctagagctacttagggactgtgcccctttagaaggccacagatcattctaatacctacctaagattgtttccatctatcagaaccaatttttgcccacctggggatgatgctaaccacacacacacacacacacacccgtgggaatgtctagccccattttcaagtgtcttgagtggatcgtagcgaggtgagtgcagagccatgttcagcttcctgttgagaagataggttcctgagtttgttgggttcttggggtttgcttgtgaattgcagaccaggtatacgtctcttgagtctttgggttatttggcctagcagaaaaatcccttcgagatggagacccaccctggtggtgcttatttgtccctagtctggaagagaaggagccctccttcatctcttggctgccccatctttgtgcctcagcactgacaaagcagggtggccttgggagcttcagaagctggcgaggatccctgcttcacagcatgaaatgcaaatggggtacaattatgaaaaccacgtggttgttgtttccctggtttccctctcatggagtgtgagtgggcctagggttggaggagggaggagctgaggaaagcagagccctctggatggtagcat

SEQ ID NO: 25970 - DNA, 3155 bp, Mus musculus
atatggaccccatggttaggcaggacaactatacagtcacattctgagatgtgtgtattgggggttaggatgtcaactgagagtgtgggggatctggggtggggtgggggaatacaacagagtccgtaaaactcatgacagagtttatccttagtgtcctagggactgtcacccataggtggtcttcagaatgcttttgacataccctttcagcagtgctatgtcttgatttccttctcctaggtgaacggccctttccctgcacgtggccagactgccttaaaaagttctcgcgctcggatgagctgacccgccactaccggacccacactggggaaaagcagttccgttgcccactgtgtgagaagagattcatgaggagtgaccatctcaccaagcatgcccggcgtcacaccgagttccatcccagcatgatcaagagatcaaaaaaggctcttgccagccccttgtgaggtgctccccatggcagccaggcagagatgggtccccggaaggacagagctcccaggaaacagactgacacatggaaatctgccacagcagaggcgcgctggccacaggaggtcactgcttctttggccaatattctgatatctccctgcactgtttccaaaaagcacatggtagccctaaggtcaaagtcaacatttggtccccttgcagaggcaactctgaaccgtctctgactgttggagggcaggcaaataaatgcttttggtattttctcctttgtttttgggggaggggggagggggcaaggccaagacgaggggtaggattctgaagattcagactggtggtgtacatacgtctgactgggtgagttgacccctggcctcccacagtgactctggatccttgatgcttgctgactctcagaattgttttttcttctcatttaatgtaacgaccggtgtgcttcagtttgtttagcagaaccactctcttgaatcacattaacttttgagatttaaaaaaaacaaaacaaaaaaaaaaaaaacaacaaaaaaaaaccaaccctccatagcacagctgtcttttatgcaagcaagagcacacctactccagcatgatttgtcatctaaagacttgaaaacaaaacaacaacaacaaaaagttacttatagtcaatggataagcagagtccgaatttacactaatcaagacagaccttcgaggggtcacgataagtccggaactttcaaaccttgcttcgtatgaattgtactatctgaacataaactgcacttttattttctaataccgagggtgaatacggtaaatacatgctttgagggtagaagccgacggtctgtttggcaccacgttataatctgcttattttaacagtatacacatttccctgagaacctatggcaaagatgggagggcagaacatatgaaacacatgctgacgagggggaggaggaggggagtgcttttaaagataacaaaaaatgagcaaacaattttaacttcatgaatttgtttgaattcccccatgctttctgataacgccgtctcgttccacgctcgggactaggacagagcgagagcggtcggctggctctctgtagcgttggttgataaatgggtatatagccatcaccaggcctggaagtgccccccctttggtgggggggtgcttcttggtctccttatgttctatgaaattcccactatgaggtgcaagagttatatcaaaggaagctgaaatacgaaaaaaaaaaagtttgcccctgtaagtagtaagtgtctagggaaggaagacgccacaatgaatgacttcagaggccactctgcagaacagtcccttctggtgaacataggtcaaagaaacgcacgtgaatggcatcacatcactgtctgcatcagtatccctaccactacttagcttgtatctaggtgtctacacaatggcctgaaccactatatccatcctttgccatttactgaaaaacttagttttggcttttacatggccagaaaaacaaactcagttttcatagttaaaaaacaaaaaaagaaaacaacaaaaaaaaagaaaacaaaaacctcatttgaggggagtcagcagtgatcatggggaaatgtttacattttttccttcagaaataccactttctgatgattttatctgatatttaaaacagggagctatggtgcactctagtttgcacatggtgtgtaaactcggggttcccacctgcagtgagctccacatttcacccagcgcatgctcacccccatctcagcgtggttgctcctgcagtgggcacagggcacagctgactccgacttccaatacgacagccatcactagcgcagtgttttctgtttaaccaatgtagttgtatcagtagttctctcagaactgcttttaacattagggactgggagcagtccacgagctaaaaaggaaagtgttttctcatgagaaaacatgtcaggaaaaataaagaacactttctacctctgtttcagattttgaaacgcttattttaaaccaaattttaatttctgtgtccaaaataagttttaaggacatctgttcttccatatgaaataggttaggctgcccatttctcccgagctcatgggaaggctgtgcatagggtactctgagcgctgccttttagtgagtgaggagtttggggttgcctagcaacttgctaacttgtataaactcagctttccctcaacagaaagaaatgaaggaaaaccaagtcagtgaaagacaatctttattgtttcaggagtaaatctgtatgtggcttttgtcaaacacttaaatggatataaacgcagcaacttgtttgaaaagatgcacaattaacctcccggaagagttgctacttgccttttcaagttgtcaaccgacacacatttgatattctcttagatgttatagtaacgtaacgtataaactcaaggctttttattctttgtgataagtcctgttttacgacgtcagaaaacaggaaccagcattctaattagatttactacatggagatatggttcaaataggactattagagttcattgaacactaaaactatgaaacaattactttttatattaaaaagaccatggatttaacttacaaaaatccaaatgcaggatagtaattt

SEQ ID NO: 25971 - DNA, 1274 bp, Mus musculus
aactccttggtttagaaaccaaacctccctcacacgtttcaaactagcagtctgtcacagcacagttcttagccataggagtttgagaggtgttttcagtgcacactcttccacagtgtacctaggaagtatatagtcctagctgacttgtaaatagagaggatttccgggcaactggatatttcaggtcagtaattaggccaggcttcagatatgcttattggagagctgtcaatctggcaagttgatgaattggaacatatgtaaggctgaaaatctgtttgtcggtatatacttgaattatatggcaatttgtttcaatccatacagcttctacagaatcttccttattctgaaaagatgacagtgttgtttgtctacaatggtcctcatatgctggagccaaaccgatggaatttaaaggcttttcaaaggcgtcggcgaaggataacctttactcaacctcagtgaaaggaaagaacaggaggggcctttggaggtttttttcctttaactgtttatatgtgtcgctcgctcaagtgaataaaagttagcagatttattgaaagagaaagattggttatttttggaaacctgcttttaaaaacaaataggttgatgaagtagagaccacagtgactctgggacattttctagtgaaaactgagtcttcacttttggtggacattgcctcgttagttctctgtgagcacgggattgttgtgtgcagctttgtgctgcccctcaggtgtggtggcccacatctagcccagcgtttaggagtaggaggcaggaaggttatcagtttttgagtggtttcatgtgtcataacagaaaaggctatttcctgttgcaaatcgaaggtatggcagcgtgggatttcagtcagagtgtttactaactacaacagtgctgagtgcagaacattgactgagagaataaaggcaacccaggattagaaatcccacttttcttccagtattatatctagttcttacaaactagtatgggaatggctgcttaatagatagtgattgacagcagatctgttcatttctttgtttaaaaaaaataaaggttcccttattttcatagaaaatatgttataggtaacatgttataggttacttcaaagaattgggaaaacatatgcatgaggcttcaaaatgacaggaggactttgagaggtcacaaggtaaagatgatacagaatgtggctcagacactggcagggtgagatcaggtgacaggagttagcgtataagtgttgtcgt

SEQ ID NO: 25972 - DNA, 1134 bp, Mus musculus
tttgatatagtctcccaaaagaagctaaatggtttcaaacttgggttgtcgcttgacagaatctctcactatgtagccctgactggccccaaactcacaggtttattttaaccaggtttttaaagccctgcctcctgaatgctagaattaaagccttgtgccaccatgctgagctcctgtggtcttattttacatctgcattgttacttttccattgtaagagttttccctctagaagttgattatttcaagtttacagggttgagtatagagttaggtgataaagcacctacctagcataggaaagaccctggcatggctcttcagtcctcgtgctcctaaatatatgaataaccttacattcataatggtagctggcttttaaatgaattataaaagggttgtggacactgataatgcaaagtaacaagaagattcatttacaaagaaaagggttttctcttacttctgcttaatgatattgctcctttacaattcagaacatatgacatctgtgaagtgtctcctgggccccatctgaacatgatcattggagccaatggaacagggaagtcaagcatcgtgtgtgccatttgcctcggactcgcaggcaaacctgctttcatgggacgtgcagataaggtcagttaacagagtttcctctttgctttttggaatttcaagacagggtttctctttgaagcggctctgactgtgactgccctggaactacatctgtagaccaggctggtctcgagcttagagatctgcctgcctctgcctcccgaatgctgggattaaagttatgtaccaccatgcctggtttatttaaattacataattttaaagaaaattcagaaccatttgtttctagaaacaagttaatttctgtattttaggttcttacgtataccaaatgagctttcttttacctaaaacttctagacgggcactgatagtctcgggagaaagttctggttacttctaatattgctctaaaacaaagaactgataacagcaatcacagacagagaaagtttcttcactaaaaaagaattttcaaataatcctgatgccttaatagggaaatctgtcagggttgttagatacctggttagatgaaacttggttgaa

SEQ ID NO: 25973 - DNA, 1101 bp, Mus musculus
acacttgtgcataaacaaacaaacgaacaagtgcaatagagatatcctcagaaaggaccaggtcgaggtcatgaaccccatccatctgtagtccggaggaactgtctaccttgttttttaattacttgtaagagtctaaatcacgttggtattttgttttatataataatttatggtgaatattgagccttgactgtttctacttcatgttagagttagaaccgcaactcaatgatccaagtaaatgcttattgaaatgcccttagagcagtgcggtttcctcacacaccagcctgggcaaggggtgaagtcctgagatctctgtcagtttcttttccagcacacagttgtgggttatgagatgggtgtgagctaatactgtttattagtaatcacctcctttcacctgagaattttgagttttgtcatgattttctttctcccaccccaaccccattgcaggcggcacgttttctaccttcagcatcacttaaatggcaggctccctcccaacctgactcacctgtcacctgcagactgccctgggggcgctttgaatgactcgctccagattccaacaagccctcaactatctcaggcaatggaagtggacggactgagtgactctagcaagcaaggctattcccaggaaaccaagcgcctgaagcggaccccagctccagactccctaggcctggagatggagcacaggtttattgatcaagtattgtccacttgtcggaacgtagagcaagtcaggtatgccaatgcatacaggaaatggctggtgactctgagtcagtgaaaggggtggattcatcctaagaaattccctttagtgcaatattgcttttctttctcagtgccatagttgcatggactgactggctaactgtattcttcatctgtagcttaaaagtctataagaaaccttttgttttatttattttgttaagagccggcattcctttgggtatgagataatcgtatagttccttcctactaaatagagtcttaattctttttttttttttcctctttgacccatggctctctaggtccatccttgggcttctcatttgtctcttgagattggcttac

SEQ ID NO: 25974 - DNA, 2091 bp, Mus musculus
ttggctgggtgacacttaggaaaccatgaagaaatttttctactggccccaggagatagatcttactctttgggggcaaagttgtttttactacctttattatttagatgataatatatttgccattgtgaacataattccataaccttctatatacaaagcatattttgaatcattaaatacctcaggttctacatgaacctctataggaaaaaccattacatgatgtgtaggtcctctgagattgagaagtgacacaaatgacatgcagctcctgtagccggaccctatctcgactcagtcttaccttctcttctcagcatccgtcttatgtcccaagtaatagggcttacctttgatatagtatgtgtcagaacatgaacataggctatgccttatgaacatcagctaaatttttatagtgcttcatgcctttttatatctcctattcagcatcttgatcatctaggtgtcagctgccttcttctaaggctcggcccacaccttcccaaagccgtagagtcctctaatataccgtgattgcatcttcctagtaaagttggaagtaggtagtaaaaatgcaaatagcgaaaagatcctgtttctgtgtgggttttgtatgctacattatttctgaaattagcatttttgagtgttcattcacaggacttaggatttctctggaactttcccctacgcgtttggcattcacctttactagcaagctactgtgtctttgaccaaatgaattcatgcagtagaaaaggaaaatatgtctaatttaggggcttgtttagtcatattcctcaacacatatcttactgttagaaggaaaagatagtttgattggcacattgcatctggttttactcctgtggatcaagaaaaccactgacacacaacaagcagtaagatctatgatcttcaccataaccccgccctacatgtctttgtttttaaagtctattctggtaattgtcttgcccaattatattcatatgccttgcatatcaaaaggacttagtaactatctattaatgattaattagctctttgaagaagggaaagattgttcttgttcataaatgatggaataatgatcaggaaattaatgagttataagtgagtgatgtgggctagctctgctgttcttaaggagagctcccatgtgtaaaaatcagtgagatttagatttgctgtcttcattaccttgcttagatttgttaccactcagctgtgaggtggagcgctagaattctcctagctgttctttatctacactaaaaatcctcagtcaataaaatccacttgataggattattgttttctttcactagacagtgttggagagcagatcttgcatatagcaccagaggcacatctgatcagctgggataattcttggcctttagggacttgttgatgtgcatttgtgcaggaatcatcctgatccccaacttgaactgtggaccttgtagggactccttgaacctgtctgtgtgagtcgttttgtaaacctaaggcttttataccttcctgtagaagctttgggcccagactttcatcaccttttcttactcgtatggcacagctctaacttaagttatgcatgccattagtactttcctctttgtttttgtggtgctgaggctcaagctgagatttattatcagtcatagaagtaaatgtgtacagattatcaccagaagccacttatagtttcaaataagggctatgtaacatacaatgcagaagcgagcttttgagtttatgtgcagtggtctgtagaatgcatatgtggtagacaatgttagttcagtaatgttcagctcctcccagttcacactctctgtgtgtgtgtgtgtgtgtgtgtgtatacaaatagtcagtcctgcagttttatttagcacaagatggtgtgtgacatgagccaaatgcaacttgagagtagacccaccagggaggagcctctcccttggctccctaatggggttagggaagactcagctgtaaaatgaagagtgaaaaatccgtcccctttttcttcctccgaaaagctttttgggtttactgttattttcctactcaaaa

SEQ ID NO: 25975 - DNA, 1152 bp, Mus musculus
cttagctattgctctagcatcagactaacttagctctcaccaaggagacagttgccatctcttctctgaggaatatatctgtagtgtgatacgttacacagtgataaatgctattacatgacatgaattattacacttgtttttttaggctggctttagaaacataataaagatattatttaacagaaccatggcatgaaaacaagagttagaagaagtttgagcagtatctccctgtaagaggcacatttaataaatgtctcaaggtgtcagcagatgcagaaccatgctgctctttatatattggcatattcaggactttatactttatttcatttctctctaattctagttgctttgcattgtcttaaaggtgataatgataacatgggaacttaggctgagtaacttcatataattttctcagaatatatttgacatgaggaagaatttttttatcagtggtattgtagtttagtttgggtgcctattctgagttgacctgatgtagaagattagacagttttgaaacagacattcctacctgacccgtgaggaaccaagtgtagtgcaagtgtgattaggctttggcctctggtgagctccctggtgcatggtcctgtattggctgtagtcactttgtacttttgctgtattttgttctagaagagtaatggggtgtacactagactagatcacattactgtttctgagctggaaacaataaaaaataaggtgtctaagtatgccaaatatttatatactgctataaaagctaagaggaagacttttcaaaagtacagaaattactttttctaaactccagtctttgtatgctagttaattgcttagttcaacattataaaactatgggactttcactgaagagaaagatctcagatactatatattctattatcagaattcaccatctgtgttagtttacattgcttgtagattttccaaaaagagccttcagtgggctatagttaacattgggcacattagtgtaatcacggtacactgtagatcccagacattagtgtgactggcttgttctcctgggaatagctgtcctcactgacagataccactttgcctggtatggcagtctgtatcgaagttcctttagctcttagtatagcaacccac

SEQ ID NO: 25976 - DNA, 1256 bp, Mus musculus
ttgtacaaaggtatgtgcaaagtacacttgtggtattttggggtttagtaccccaggatgattaaattatgctaaattctaagattatcacttggacttttggctaagattaaatgtaaattctaagattaacatatcatgtattgtctataactgggtgttcaatggaaatgtaatgtgagccccaaaggtattacaattttctagtagcaatgtttaagacatataattaacttttaataacatatcttatttaacttaatctagtaaaacacgctttcaatattcatcaatgtaacaaaattaaggagccatctagcgccttttctccctttatattagtcttcacaattcaatgtgtggtttgcactcacgctgcccctccactgcagccatgtttcatgccctcaggctccacgtgtggccaggggctgctgctgcagacacaatgcagatttataggctacaaagtatgaatctgtttaaatttggaggtgacagatggacatgaaatttcgatcctttaaggattgtttagaaagaaatctaatgaagttttccttcattttaagttaactttgttctagaaattggatcaacctgatctaatttgccaagcattatttgaagaagaaatcctgtgccatgcaaaatacctctaggattgttgtaaagtactgacggtagaatagtgacagtcttcggtcttcactaaagtctgtcctgtttcttcaaagcataccagcttgagttgcatgcttagtgcatatccggacttgtttgcttcccattattcttgttatataatgatgtatattaaccagcagccctaggattctaatctatgcagctgtctgccagaacataatgatgtacctattaaatcatggtaaatagaagagaaataagttgaaccatttctttccccattagaattgttttttaacatgtggccatgtaccaaaccagctgtaaattagtgtatttctgtagaatatggaaacggtgttgtctttgatgatgtctgagtaaacgttacctctcctaaagcaagcgctatgtgtgtttcatctccatgcatgttaaacttggctgcggttatctgtcaagatgcccagctgactgctttgattgtgttagatggatgaactattgtctgaaaaaaaaaactgacaactgactatcatatatatacaaagcatagaacattaaaaatcaaactcagagaaactacattgttgtttttaaaatatatt

SEQ ID NO: 25977 - DNA, 1314 bp, Mus musculus
tccatcctgggaagggtgagaggcctccacattttcctgggagttagaacggggcatccgcctgcgggccatcagcacgacgatgttgccaatgtctgcgatgtaggaaatggtcctcagagggtggtccatcataggttcctagaggtgaagggcagaggaggtgagtctgcacacagaaccttaaaacttctcagatgcttatcttcttccctcataccagctgaggtgggccagggacaagcttcaccgccagacctctgagtcctacccccaaggcctgaggaagtgtccttggttaatgaagagcaagagctatgtgcaggagaaaagcaaatatcaaacattttacactgtgtagagtctccagtggtgaagctggaaagataaaatctaaatttcagtgtgcttgtgtatgtgtgcatacatgtatgcacatgtaggcatgtgtgtgctgtacaattttaaagagacttccttaaggcaaatgagtcctccccagagaacccatggagtgacttgagtgagatacaacacacacattctgagttttcctttgtacttaaagaatgaatgtgacctttgagcccaccatagccttgagtttcactggaaaccagtgtgtgtgtgtgtgtgtgtgtgtgtctgtgtatgaagtcctaactgaatgcgtgtcattgacatgaacacagttacatcaaggatcccaatgtctcagactcacggggatggctaagcttttccctggcccatttgtagataaagaaaaattgcaaaccccagttttgtcatccccagtgtttaaagcctgagactgctctcctagagagaaatcctactgtgagagtagctaaacccacctccttgttcagagttatgcacactgagttttgaggctgctgctggtacacctccatgagatctggtagagcatgtggcctatcagatctcagctactgtctgtgtgtctgtcctttcttcattccctcatcaccccctgtcagtttccaggacccagcatgcaagttgtggcaccccaatgcctggggacgggcacttcacaggcagagaacctatgttagaattcctttggctttcgtccctgagaaaagtgggaaccagctggtacctgtgtatccgcattcagtactttgatcctctgggtagagatgaacaggtccacctcagtcattggctgagattcgccttcaggagcctaagaagaaagggcaccaagaagaggttttactgtattgtcttcacctggaggcacgggaaaggttagctcacacactgggttaccaagacacagtc

SEQ ID NO: 25978 - DNA, 1452 bp, Mus musculus
ttttagttctagacccccagagccccagaaagctccttccagactttaccaggacaccagaggaagctacggcagtgaccccgaggaggaggagtaccgccagcagttggcagcacactcgaagcgtggttactacagccagccctcccggtaccgagacacggagttatagagcttgtatgcgtggactcctgcgaggccacctggagatcttctccagttaaaacgcactgcagagatacggtggggacccaggcaacagatggcatgagttatcaactgaaggctctgtttgtgggactggagtgaagttgattctgactttcttgaatgaagagaaacagtctgataactgttacttgctttggtgtggaccaagatctgtattaacctctctgtattttttaatatgtatatcgagcaataactatctttcctcactcgtggctgccttcctgcacagcttcagtgtgaagcagatgtgaagagggagttaaaaaaaaaaaaaaaaaaaggactccgtctcagactaagttcagaagtattttatcacgactctctaagtgcctttgacaaaatgtgtctcacgtttgcctccctccctgacgcttcatgcaaacccataatggactaaaactttattttgactaaatttttataccagtttagcagctgtgactgcccctgcaccatgccaccttttcagggcattgtctgtagtattttccacaaattctgactgtacataggacagcgaccctcgggagtgtgtctgcctatcaattctgcgtagctcggaggccaagattttagagtgtttgtccgttgtctggaaccacatattccacaaaggcagagacttgagaaaagggtattttgtttcctctctatcagagtatgtactgacatcgggtggttttgtaatttaataaaaaggagtacaagaatgagtttagtgctgagtctctacacaccttccttctgggcagtgtggggggaacccaaggtcctcatgcattcagagtgctgcttcaccactgaactacaccccactcttcctgatttattttaattaaaaaaatttttaaaaagacataaaaatgtgtgtatgaatgtttttcctgcatgcatctgtgtgtgtcacatgtgtgcccagtgcctgcagaggtcaaagagggcatcggattccccccaaaactggagttacattggttgtgctctaccatgtgggtgccaggactcaaacctgggtcctctggaagaaccaaaggttttctaaagctctgagccggttatctggttcctccttcctgtagtcacacaagtgagaacttacacaacagggaatggaaacatgggaagaagaagaagaaaataaccccttcacaggtctgatctttctccagtcccttattcatgagtgtctgttgtgtgtctattgcgtgtctgtgg

SEQ ID NO: 25979 - DNA, 1179 bp, Mus musculus
cagatctctgtgagttctaggttagcctgggcaacataataagatcctgtctcaaaataaacacaaacagaaaaccaccaccaccaccaaaacctacccaataattctcttcgacaggaattaaattctatcttttttattagcttcttggatgggacatattctgtttttcagttgttatacattaatatcgagtgaggagtggaagccaaagccagtcagcattcccacttatttgaaggttgggtagcttaggatgaaacaaaaataaatgtgaagtaaaaccgcattaagatttgtgaacttttcatggtaagtcagtagtagactgtacaaattgaaagcatgaaggctattgctctctgagccttgggtgtcactgtgtaaagcacatgtgacttggttcaggagagctctcgagtatataccttcccagccccaccataccttcatgagcagcacatgcagagacatcctgggagagcagaagtgttgagcacatggcctctgtcttgagcctgtggacaaccccactcccccacccccatcccccatttctgcaattcttctgactgtttgcccatggtgtgtctgtggggctcttttaacatctggctggattcccttcctttttctgctttctccgagtaggtgatacatcgaaagttgcatggccaaatgctgttcattcttttgtgataaagtggtggggcggggaggaggtactcccgcccttccagggaatagcactttgttttcaagtgcggcctgaagaatgcagatcaccaaatagcttgccacgcgtaaaggttttaacttctcagggtctttacagaatgtgttgtgtggcgggattcttggttttcgttaatgaattagctttatggtgctgcggatggaacctacttatatacttctggtgcatacatggagctataaagggggctctgacaaggatgctgtaggaaccgcaaagtttgaggtagaaaaacaaccccttgctttgacttaaggaggacagttgaggtgcacgctgatgtgaaggaaaaggaaaaggagacactctgaattatagccgttctctagttgtgtgcctgtggcgccatttgtgaagtgtccgaagcctctggctggtgacttgtatttagtcatttcatagcaggacatgctatttgatga

SEQ ID NO: 25980 - DNA, 1101 bp, Mus musculus
ctctgtctgaccttagacctttccgctggaagtctctctgagggagtctgagaatggatgtctctaacaagcccctcctcagagcagatggtgctgacacggcaggggaagcttccaggctgagagctgatatgatggtttgtgggcatttgacagcagggctggattgtgtgaggtggaaaggatggagcggggttgggctcctggcactcgggtgtttggtagagtcaggggtgtgatgggggtaggggacagccaggagtcaatcactgactgcagggatgttatagggagtggggtggggtggggtggggtacaggctggaaggagaactggagcctccaagggattagaggtagctgacagagggtggggacatgaccagggtagccagggcctactagctctccctaaaaaaggagagtaaggacctgggaggtactggtttcaggggagggtctgagctgccatcagggggcaggctggaggaatcggaggaatctaggtcctgctttcccagggtttctggaaggcacactttgccaagggtccagttgtgcagcttacagtcccaggacgggtgtggactttcctttaagatatcaggaccctcttttgtccttcaggccacagtcccaggacttaggatggtctcatccctcttctcgcccagcatcgctaattggcctagaaccaaggtgaacgctgggattctttcttgtacacagagcccacatcactaaaactcactcccctccttggccgtacagcttaatagctttaaagatttgtgcagccctgggcccagtgttcttagcataactggatataagccgattctgagagtgggtgctgacatgcgcgagtgtttgtgacagtcctcatcgtgaaggtcagaaggtttgctacagggaagaattcccggcagggtggtggcctgtcactcaaagccatcaggccttctacccttcctgcggggtgcacaagtccaggttcacatcctcttatttgcttgcctattccaattggaaggaatgtttagtacatctgaagatgtaaaagattctcttaggtttggggaagaggcactcgtttgtccta

SEQ ID NO: 25981 - DNA, 1239 bp, Mus musculus
ggactgaagaagggaggaaactttggaggcaggagctctggctcttatggtggtggaggccagtactttgctaaaccacgaaaccaaggtggctatggcggttccagcagcagcagtagctatggcagtggcaggaggttctaattacgtacagccaggaaacaaagcttagcaggagaggagagccagagaagtgacagggaagctacaggttacaacagatttgtgaactcagccaagcacagtggtgacagggcctagctgctacaaagaagacatgctttagacaatactcatgtgtgtgggcaaaaactccaggactgtatttgtgactaattgtataacaggttatttttagtttctgttctgtggaaagtgtaaagcattccaacaaaaggttttactgtagacctttttcacccaggatgttgattgctaaatgtaatagtctgatcatgacgctgaataaatgtgtctttttttttttaaatgtgctgtgtaaagttagtctattctgaagtcatcttggtaaacttccccaacagtgtgaagttagaattccttcagggtggtgccaagttccatttggaatttatttatggttgcttgggtggagaagccattgtcttcaaaaaccttgatgtcgttaaactgccagttactattgtaacttttaatgagtttcaccattgaaagggtcatccaagcaaggtcacaatttggttataaaatggttgttggcacacgctatgcaatatcaaaattgaataatggtatcagataaaataacagatgggaatgaaacttatgtatccattatcatgtgtactcaataaacgatttaattctcttgaaaaaaaaaaaaaaagaacacaggctcccccctaaaccgagtgcttggcctgtttcaacccaagaggaatcaaagtatcaagatctgtttgggaaggccagaccaccagggatggagggaggacagtccagagggtgggagtgaagagattgcccccacccctgctgagaatcccctacccctaaggtctggcaggaaaggggcagccctgctatacttcagagcaagtttagggctgccagatggctgctagatgctaggggggccggaggtggctcacataggcatcccctcagggagatgatagggctgccacttagtttttctaccagagttcaggggtccttaacctcctcagaagcagtttccttttaattcatgcttga

SEQ ID NO: 25982 - DNA, 1191 bp, Mus musculus
tgtttcttaccggaagaactgacgagaaaaacaaagatgtatttaaatcctggatccactaccgctgttgtgatttgggagtatacgtataatagtatttattttataaaaacacataacattgtagtaaattattataaaaaatatctgatattcataaaatatatcctctggaggttttttttgaggcaagtatttcacaaaagttccagaattttctttgaagtttaagtatgactgctgacaacttatccatcattatttgtaaaaatgatggcaaacattttcattttctcttaaaaacttcaggttattgctgagatacaatgaatacagtgatagtaacaaaaaattgctatcattatatttaaaaccagcttaacctttatttttatgctatgtgtgtgagtattttgcctgcatgtatgtctgtgtactttgcacattcagtgtctgaagtccagaaggcaccagatctcctggagctgaagtcacagacggttgtaagtcttcatgtgggtgctgtgaactaaacccaggtcctctggaagaacagccagcactcttaactactgagccatccatctcttcaactctctcactgtgtttttaggagaatgagtttttaatgttcctaaagagtcaaagaaattaaaccatctcttacaatcagtaatagtgtgatggtactttggctcttttttttttttttttttttttcaaaacagggtttctctgtgtagccctggctgtcctggaactcactctgtagaccaggctggccttgaactcagaaatccacttgccctgcctcccgagtgctggcatcaaaggcgtgcaccaccacgcccggctggtacttcggctctttgttctgttttacacctagaagattataattgttgaactttaaatttttagtcttattgctggcattaaattcttcctgcctattttgaactgtgttaattttctgtataatatgagaaataatgaggtacactcctttactaaccataactaaggatagctatctgtgtgtgtgcatatcatagtgcgtgtgtgtgtgtgtgcatgtgtgtgtgtgtgtgtgtgtgcgcgtgtgtgtgcgcgtgcgcgcgtgtgagtgtttgcacacatgtcagcttctgaatttctagccagttctcatgtctctgcctcccatctcac

SEQ ID NO: 25983 - DNA, 1149 bp, Mus musculus
gtggatatgtgtttgtgtgggtatgtgcttgtgcatgtgtgtgtttgtatgtgtgtgaatatgtgtgcttgtgagcatgtctgtatgtgtgtgtgcatgtttgtgtgtgtgtgaatgtgtgtatgtctgtgtgtgtgtatgtgagcatgtctgtatatgtgtgcttgtgtgtgtatatatctgtatttgtgtatgggggggagatcaatactgggtgtcttccttgagtgttgtttatgtatttactttttagtgtgagtgttttccatgcatttatgtggatcacctgtgtgcctggtgacctcagaggtcagaagatggtgtcagatatcctggattgggagtcatagttggttatgagtcatcttgtgggtgctgggaattgaacccgtgtcctctgcaagagcaatagatgctcttacccaatgagccgtctctccagccccagtctatttttttgtgacagggtctctcactgatttgacaagactgttccgcaagctccagcgctcctcttctctctccctctccagagctggagttagagctgcaccaccatgttggctttttaacatgtgtgctagggctccgaactctgatctttatgcttgtatggcagattattgactgagctggttctccaggtcccaagtggtagattcttacgaaactgttttgggctggttttttttttttttaaaagatgtatttatttatttatttatttatttcatgtaagtgagcgcattgttactgccttcagatacaccagaagagggtatcagaccccattacagatagttgtgagctaccatatggttgctgggaattgaactcaggacctctggaagagcagtcggtgctcttaactactgagccatctttcccccccgccaccatccccccccctcaccccctttaatacctttggatgctatttatcctgtgaatagcttataactttatggggtggtggaacagtagctcagtaagagcattaactgtgcaagtgtgaggatctgggttcaaatcccagaacctacataaaatgccaggtatggctgactgtgccttcatcccagccttggggaataaacatgaggatcctgagggctagtaggccagccagcctggagcgcttgtgtgtgt

SEQ ID NO: 25984 - DNA, 1116 bp, Mus musculus
catgaccgactctgtcttttcccctcttgttttgtagttttacgtattaactatatggacatgtttttgtaacaaagtagcttttttaagcctatttgaaagcacgcagatagcacagggaaagttatttccaagtgctgggttaggtcgtgatttgtaaagatcttatggtttgaaagggggaaaaaattaaaaatgtattatatattgataatgatagtttacatatttcaagatgaaagttttgatccaagaatgtggtgaggtgttggatatgtggtggtacttctctggctcttccatctttcgttgaaatctcatttagatgtttttggtatggtgtgtatatgtgtgtgtgtgatatgatatatatatatgcacacacatatctatccatgtatacacacacacacacacatacattttctaataagatttatgatataccctttctgatactgccttaaaatatttaatggcttgtcatgtatcctttgctaaattataactttctgtgataataattaaatccacgctgcttctgtagaaaaagattggattttctgttctgttttgtttttaattgtatggtcttgtttgcttgattttttttttcctcctaaaatattggtccaaactttcagtctcttccattagaatttgagtgaaagcaaatgatttttttaaattgtgattacttttattttgtgtgtgtgtgtgtgtcaggtgttttatctgtgtgcttgtctgtgcactacatgcatttctggtgccttaggaggtcagaaggaggaggcacagagaattgtgagccaccatgcagatggatgctaggactccatctcaggtcttcgggaagagcatccagtactcctaacttctcagccatctatccagtccacagagaatctttttacctttgattggctttgcctgtgagaccaggtggctgctggcgtgggctgtgcttatcactgtgtagcacgtatctccttccaccatctccctagttattccccatggagagtctgtggtgagagccctcagcctctataacagggaagtggagcagaggggactctggccttgtaggcctgaagatatcatttcctggga

SEQ ID NO: 25985 - DNA, 2196 bp, Mus musculus
cagcggatccaggagttccgacagctcacggccgacatgcaggcgctggagcggaagattcaggatagcagctgcgaggtggcatcagagctcagggagaatgggcagtgcccgtctcgggagtgcaagtctgtggccgtgggtagtgatgagaacatgaacgatgtcgttgtataccacagagacttaaggccctgcaaggatacggctgtggggacggtcaccgagacgaggaatgttggcatcagcgtgacagaagctatgcttggggttatcactgaagctgacaaagagattgagctgcagcagcagaccatagaggccttgaaggagaagatttaccgcctagaagtacagcttaaagaaaccacccatgaccgcgagatgactaagctcaagcaagaactacaggctgccggatccaggaagaaagttgacaaggccacaatggcccagccacttgtcttcagcaagttggtggaggcactggtgccaaccagagatcaaatggttggcagtcatgtggacacaagggagtcatgtgttgggacctctgtgcaaactagtagcgtaggcacctcctgccatcctgactgcaagaaccaagtcgtgggatccgagctgcccatgaattggtgggtcgtgaaggagagggtggcaatgcatgaccaatgcgtagggaggtctgttgagacttgtgaccggagtgtgggtgtggaagtcagtgtctgtgaaacaggcagcaacacagaggcttctgggagcgacctgacactccttaagacaaacttgaacctcaaagacgtgcggtccatcggctgtggagattgttccgtggatgtgattgtctgcttccccaaggagtgcacctcccgaagcatgaacacggaggctgtaggccaggaggaagcagctgtcatggcggtgccccataccacagaccagcacaccagcacgaatctggagcgggtggaccagtgcactaacacagaggcagccaccctggtggagtcctgcaccaacactctcctcagcactatggacaagcagaccagcacccagactgtggagatgcgaacggtggccatcggagaaggccgcgtcagagacatcaacccctccactaagactcggtccgttggtgtcgggacagtgctgtctggcaattctgagtttgacaggccatgtgctgtgaagaccaaagagtcgggtgtgggacagataaatattcaggacaactatctagttggtctcaaaatgcggaccatagcgtgcgggcctccacagttgactgtggggctgatgggcagcaggaggagcgtgggtgttgggaacgagcccgtaggagagctcccggaggagtctcctcagcctcgggtggcgtctggaatggtgactggcttggatcactacattgagcgcgtgcagaggctgctggcagagcaacagacgttgctggctgagaactacagtgagctggcggaggcttttggggagcctcattcacagattggctccctcaactcgcagctcatcagcaccctgtcgtccatcaattccgtcatgaagtctgcaagcaccgaggagctcaggaactctgacttccagaaagccagtctgggtaaaactacaggtaagcggtaccctcaccccacaccccgggacctgagaataaagactcggggagacataaaaggaataaggatttgcgtagctcaaggctctgaagactaggaagcgccaagcatggcaccagcttccagcaaggtctatttttctctgtcatagcaaagaatatggtgagatggagcaagaatgcacccatccccaggatagcgacatcagtctattcctgagggcagagggataacattttccatcatgaattgttggggacacatcaaaccctaagagagaaggcagggagaatgtccttctaggaagaaaggctttcctttcctttcctttcctttcctttccgctgctggagccattttttagagtcatagagagagctttgggatgatgaggtgaatgcaaaccgagaccaagactcataagcagccttgctgaccctactgtctccctagctcctttggcctcttgcttcaggctaacacaaggaagcatgtccacgagacccggcttccctggcgatgacctctgaggcgttaatgtgatgcttcatgtctgtct

SEQ ID NO: 25986 - DNA, 1099 bp, Mus musculus
gtccgtaaacagaatcagtcaaagtttttttccaaccaagtaggtacaagttaaatatcccatatttaaaatacttggtgtccaaagtgttcagaggggcatggattttgaagtttttgcatacataagaagtttgaacacaaaatccatttgttttatatacactttacatgacattttgatgtatgttcattttgaccacaaccaataatataaggttagatgtagaatttttcttttgtagtgtcatggtgatactcagaagatttcagacttggaatccccttttgaattttagattttcagcttggggtacataaaaaaaataataatgttatgtttctgacctccaactcttttggtctttaaatggcctactcaaaagcaaagtccactccgtagagtaaccgccaagctcacctgaacctttgtcttctctgcagatatcagttgtaagcacagatgatgatctggcttgagttctgaacaaatcttggtctatgaggtctacaccaataacaccctactctggaatggtaacagagccagcgctgaagtctcctttcttcctcccatctggaagaacatcaagatatctttttgtggatcaagtttgagtacttgatcatttttatattacttttgtaaatattcttggccacattctacttcagctctggatgtggttaccaagtatctgtaacccttgagcccctagacagtattgccatctctggccaaatatgcactttccctagaaagccatattccagcaatgaaccttgtgctatagtgactcccacctgtacatacattgtataggccacctgtacatatcccagagaacaatcactattcttaagcactttgaagatatttctatgtaaattattgtaaactttttcaatggttgggacaatggcaataggataaaacgggttactaagatgaaattgccaaaaaaaaaaaaaaatttgtaactaattttgtacgtatgaatgaaatctttgacctctgtcgaggtttgcaaagactgacttcaaactactgtacgtttttttcaagtgctaaaaaaaaaattaaaccaagcagcttaacc

SEQ ID NO: 25987 - DNA, 1194 bp, Mus musculus
ggtgtaactgtaatgtattcaaaattgtcagtgtggtggcatcaaatatgtagagatggtctttctgtggagaatttgtggaactttagtgtggagaacaaagaaggagttggagatgaaaaagtggtactgtgtcaagggaagatttttgtgagttttccatcatgttggccatcacatcctgactgaagtctcaagattcctggaagtgaaggaagacacaaagcttaaaactcagatgagatgctctgactccatcgtgaagtggtcactgaaaaaaatgttgctggtttcttgggatgaaagaactgagccagcatctgaaaaagatcatttcatttaaaaacaaaaacaaaaaaccttgtctcttctgtaaaaatccaacattaggtagaacttgctgtaatttaaaagtcacaaagtcatttataaaaaatgaagtgattaaatattgaccgagtattgttgagtattgctagagtagctagttatctggtgagactgctaattgattcagtgtatgatagttcacacgggatgagaaccttggcctttatcacccaaacaagaactctctatgagattggttgacgtgagttggttgagtctctggagcatcagttttcaacttctggatcgcaacccctttgggggtgggtaggtcacataacagatatgctgactaacagagattgccattatgatttataacaatatcaaatgtatagttatgaactagttatgaaataatcttatggttgagggtcaccacaacatgaggaactatattaaagactcgtggcattaggaaggttgagaaccacttctctagggctcaatgtattagataactcactaaggggtaaaatatgaaatatcaaatcctaaaaaggatatttataattaaaacagcctgtcatgaggcaactgtgagtggaacatctgggaatttgagaagtatctgcaaagtatagaaaaatcaacagatttgtggaccctggtaaagaagttcagccaagtctcagtgaaaaatgttaagaagttgatgcaagctgcatgctccttgttaagatgcaggctttgcatatcaccaggtcacttagaatattctaacagttactctgaagatgtgtcatgatttgtgagcctttggatctgggtaaatagaggacaaaactaattctttgaggcttt

SEQ ID NO: 25988 - DNA, 1185 bp, Mus musculus
agtgtgtatagtggagcaggaaagtggtctgaactccgggaagcctgtggccagggcagcctgcactggggacagctgcttcctcagctgccgtgcagactgagttccatcaggtttgtttggaagctgctctggtcagtccagcacatggagggaagtgtgctagaggaatcaggagatgatgggtcctcgcttgaagtcagcgttgctgggaaagtctgatctttgtatttgggccttcagggtaaataccttccaaggagaatgaggacattgtcccatgaacaatccctaaaatagtcagagcccatagtgtgactaaaagggggaactgtagaggattgagtgtaggtagtatgtttggactttaaaaatacagctggctttcagcggcaaaactggagatctgtagaccatgagaacttgtgtagcaggcgtttttagtacagaggcctgtccttgctgctctgcatgtctgatatatactaaggcggccatctgaccctctgaggaattgtctgtgccttacctgtcccaacttaaggttccaggactactaatgcagcttctaggactctcctgccctctcgtgctggggtgtagtaagccctttcccaggcatgacacctgccactgttggctggatcctctaggcatggagtgaggaggagagtggggaaagacagtttgatttgcttctgtgtggctaacataccatgactcgagttttcgttctccgtataaaggaccgtttagagagatgagagtcgggtgctaacatgtttaatctttaaaagtgaaaaacacgtacataacttgaaaggtgcttttgtgcagcttgtagaaaaagcagctgtttcctctgtagttctaattcacgctctccataatgacttgagttcttagctctggtgaatttctaaacatgtagtatgaagtcccgagtacctaaaacgtatatattcaaatacacaataaagagcatgtttattttttgttttttaaggcaggatcttgctatgtagctctgactgttttgaaatttattgtgtagaccaaactggcctcaaactcacagagatctgcctgcctctgtctccctggtgctgcgattaaagatgtgggccaccacatccagctgaggacacagtttctatttgtttgtttgtttgtttattataagta

SEQ ID NO: 25989 - DNA, 1156 bp, Mus musculus
acactgtgtgcgtggttgcttgtgtgcacgcctgtgtgtgcatgccttgtgtttacacgttgaaagccgtgatttatctgcttctcagagtcattgtgttgtgtgtactttgtttattgtagatttaggggcatttgtttctttgttttggaacttgtgattttttttcctgtttgtttacatggcttggatttttgttttgtttttggtatttgtacttaaatatagttattatcaaagaaactagacaatataaaatacagttgaacataaatacaatataaatagtttatagttctttgacccagaggtgactatgttttgctttctagaattttctgtgcacatgtttatgtgaatgtatgtatataatcatgcctgaggatactcatttctattttggtgatttgaatagtttctatatgaggctaatattttgtttaattatctcattaaaatttttttcgaatagccattcattaattcatgaactgagtgcttgcttagatgttggattctggtacttgggctgtttgatgacttggttctctctctttttaaattaatcttatctttgatatataattagctagttcatttgagtggctttgatttaccttgcttacctggggttggtgctgactctatggggagactgtataagaaggaaccttttttcattttttttttaaagactgattctcactataataataatgtagatctcaaagagatctatgtacctgctcctcagatgctgagattaaatgcatatgctatcaggtctaggtttctggggtttattcttattctgtcttgtgaaattttttattacatatatatgttgggggatatgtggcctgcacatgcatagaggtcagaggacaacatgggagagtctcttctcttcttctaccacatgggttttagaagattagactcaggtcatcaggcttggcagcaagtgcctttacccacaagaatggttttgccagctctgtgtgaaatcttttaaccttttctgtctcccctttcttatagggccagtactctcacttggttctcctggcagcgtttgactgtattgatgatactaagcttgtgaagcagataatcatatcagtaagtaacttggatgggatgagtgctggcgttg

SEQ ID NO: 25990 - DNA, 1187 bp, Mus musculus
attctccttttgtttaaagggattggtgatacgtcgtcgttctaaaagaaatgtttggtctcttctatttggttctgatgtttgaatcttttccccctctttcctttgttctttttattttttctttctttccttctctctttctttctttctttctttctttccttctttctttctttctttctttctttctttctttctaaataaagtatgatgttgggattggaagccctgagtaatgaaatatttggtaaggatcatttcatgtagctcaataatcatgacagcaaacctctgtgagaaggttgattctggggaggaaagcaaaactacaaaaactctgattgacttttgatgaccaagtaaattttccttgaataaattagcatttctgaacaaatggttgccttgctttatcctacatacacaattttataggacccaatgaggaaggtattaaattgtattcgtttgaaaagcatcttttgtaccaaagcaaattcttttccctgctcatctccatcatcgatttggacctttggtggcgaccaatgagtcggttccagaaacttaagtgagtgccttgagaacgcttgggaactgtgcctgaggtggtaaactcttaattaggttaactgtagcgcttaccaatcagtaactacactatcactcagggctttcgtaccttctaggtaaaactcctttcattgtggtttttttttttttttaatactgtatttttttttaagtgccatcatttaaaattcacttagtaagtggcagattacattattcagtcccacaagcacacaaacatagtaacactaggagatatttgagcatttattttacaatcgactgaatatataatgtaaatgaggtaagtaacttttgtagagattgtatgtgtgagataatgtaatgttcttttccagtttttggactacagttgaataaactttttaattatttaaaaacatctttgccgaataacatgtgatgggttttttgtataatgtatttgattttgtaaatacgtatttcctgatgtgatttttgtgagaaacgctaaatcttttagtataccatgtcctctgaagattggcaggagctaaatactagtttgtgggcgatttgtattgtgtactgtacaataactggggaacttttataattataaaaatata

SEQ ID NO: 25991 - DNA, 1694 bp, Mus musculus
acggttcatgcacctctctttagatggtgtactttaaaaacagaagtaaaatacacaaatggttttctcgctgcatacctaaagttagtagtgtgcaacattagctgcctttaatttgtagtaggtgagcgagaatgagcacattcttgcagaatgctgtagacgtcagtcaggagtgagcacagctcccatgctgtggtcctgggcctttttacatggacacactctctacaagtgctaaatgcattttcagtttggaaagattattatcacattattatcattaatattattatttaaaatgtctaagataatgctgtgcttgaaacatctgtgtgaaagaaaacacgtgtgtcgctgtgatggtcctcgttgcatggacatagtagaaagtcaaaagcttgacgtgttacgcttgcacacgagttaaggcagtggttatagacaacatactgactttgtcataacctcccctcctcaagttcttttgaacaaatcacgatcatccagaaactaaaatcaggacttttctgatctccgtggatcacagcagagtttgggggaggaaggttgtcaatgcagtgttgttcaacatcgggctgtgactggatcagagcaacaacctccatgtacatggtagaacaaactcattaacagaaccctagtatttctgtgagtctggtgattttaaaagactgggactgaagcattgattcagcgcttagttctagtattagaaaagccctttgctgtaatgccttgtattaaccctttgagcattgtaagatatacaatgggggatgaaagcctttcagatcatttatttagacttaaaaaagtaaaatagcctctatatccaaatgtctaattacactgttttttaaagggggggtcggaaaagaaagtgtctccatgccgaacacttgcattttatatacaactcttaattttccttcaagagggctggatagatttattcccaaatattcactgccatctaagtaagtgtactgtttacagaagataaaatcaacttttctagcatcacatgactctctagaaaaggaggacgcatacatgggcctatgctggcctatgtagtaactgatttctgcacactggaggtacctgtttgcctttaaaaggtatgataaaataaagggttatgttttgtcttttttcccaaaacaaaagatctcatttatttagctttagaaagtacaaatgaagccttagaaggagtgagttccactacacacagctggactctgaggtacttaggctctttggagttgcatctatcatgaaatattgtttggaaatcatgcggggcataattttatctatgctccagaacattaatactttgtcataagatatagagaggcagagtggcgagcaagacactcacttgctctaagctcttctgccaggagatgctgtgactactgcttcagctatctctgaatgtcattctgcttacaacatttgctgatttctttgagggaatttctggacagttgatctggtcctcccctatgtgacagaacacggagcagtgttgtgctcagatacgtccacactgccctcgctgagcacagacaggagcatgacctactccgcggcgtctgccaacatccatagcatagtgcaagtgtccgtacgttgctttctaggcagttgaggaagtcaga

SEQ ID NO: 25992 - DNA, 1289 bp, Mus musculus
agagggttgggaaggtcatctatttttctctgaaaaaaattgagctgtgcatttatcagttcaggataaatgacagaattgcaagagattatgctaatatgtacataatttgtgtacataattattaaaccacgttaacaatgcaagcttccgttagacattgacttttaactattatttgtgtaccaattcctctgtttaaagactactgattctgtattggaaccactgtacagatgcattctgctgttaagtggggctgttatagttagatactgcagctgaaaaaatgacttgactttttttttaagtgtacatgctacttatactgagctggacatacaggaaaccattccatttggatgactttcttttattccaggtcttttttctaatagtagttcaatatgctgctattataaaagaaaatgtatagaatgcaaggaatgtagcgacctgcatattgttatttcctggtttctaaaatacatggatttaaattttacacagaacctgaaggcagtgtgactggcacacctcactgttgctgaccccgactctgtaggatttggataggtggctggatggaccattgccattggagaacgtacatcagggatcatcgtacctcggctattacatggtgccttaaaacagaactgagctaaggtttagtaaggtttattttgtttgtgtgaataactcttcaatccattcggtaacgtgtgcctgtcatgctcagattcctgaagtaaagacaggtcacatgttcttcaaggggaatttaggggaaattaagcaaaacaaagagacaaaaacttcagtttctctctgagggactgtgagtggacttgtctaggttttatccttggagctgaatatcactttataacaaatcagattgctaagggtgtggactagcagttttcatccaaacatgttacataaagatcatgtgttgtagaccattcttatttagctataattctagaaagttaacaggattagcaggtacttattgaagtgcatcttttcagtctaaatgtctgtctgtgtgtctgggtgtctctgtgtacacacaaacacacacatacatacacacacacacacacacacacacacacacacacacgtggaactggagtctgctacagtcagaaggtgagatcctaaagagcacagctcatcccattttactttgcatgaaaagccaaggttcttttaactcaagctgtcaacagcagcaacaacatggggcatagcctttcatttaagtaattataaaatta

SEQ ID NO: 25993 - DNA, 1227 bp, Mus musculus
gcaaccatggggctagctcagagtagccgcttcctcccgatggagtaccattatcatggtcttaaagccaagcagctgtcatgacccacttgtgttcctcatggtatcaggatatgcatgaggaccagtagacataaggagaacctcttcgggagaacttctctatgcatctcccatccccctgacactgcagttgctgctgtttaagacatgacacttctccactgcagctgcttggagccattcataccccagaacctgacaggctcacccagacatacttaaacagaatctctctctctctctctctctctctctctctctctctctctctctctctctctctctcagtgctgtctgtatttagggtgacttagatttctctatgtttcctctagaagagtcacccaacagcacatttgttgcattcgtgtcttagtaagctgaggctctaatggttacaggagactaggcttcttgtctgtgtgagaacacacactgagcagagaaacaggacaaccatgaggagacacctgcaggggaacacacaacaggagacactagttcacaaaccacacatctgataagtgattagtctatggccataccaccctgaacgtgcccgatctcatttgataagtgcttaatataaaaaccctaaggaactcaactatgtgattatagcattaacggtgctcatttcctcctatgattttgtaatggaactcacatcttatgtatctcttcctgctgtcatacttctttaaaatttgcttcattttattattcatctctatgattgtttgtaagtgtgcatgcatgtgcatgcacacgatggtgcatatatagtaatcagaagacaccttgcttgcattggttctctaccatgtgggctccaggaatcaaagtcaagttgttggctttggtgacaagaacctttacctactgagccacttaccagtcctgcctcacctcctgacaactatctaaccagttgaaataatttttaatatatttataacttatcagaatgtgtcatctattgtggtatttatttccagcatgcttcatatcaatccttagcattaggaatactgtaggaagaatattgcatggaaaaccaacttgttggcattaggaagttgtcactgaactattgggaggtgaaccttgattgagaaacaataggtccattttgttttgatgtctcccataagtaaacacact

SEQ ID NO: 25994 - DNA, 1164 bp, Mus musculus
tacattcttttatgaagtctccttttagaaagtcttcaagaacaggaaagataataacaaaaagatggattggtgtcttctgttcacccatccccacccatccccacccatctccacccatccctacccatccccacccatccccacacagcatccatctacccagtgggctttgaattgtacattcattcacagtgtaccaactccattaagtctcaagggtactactaaagcttttgagttttcattgatttcatgatttttgttttaagtctaggtaaactttctaagaaagagatcagtttaccctaaacatgttctacctaactattaattatactaatacccactttcgacgaacaaaattgagtttctcagaactttctgacttctagactggaagatagactgatacactgacaaaagaagtgactgtgaactagtctgaaagtggacagcagcctctttattcatcttgggaaacagtgtcactcagacaagcctgacagaaggcccctggcctcaccagctttgttctgaccatagggagcaaacttgactgtgacctgtctgtctatgtattgccccaccactctgaggattaccctggggttgaattttggtgcctgacatttatcccccttctccttgtttattatcaatttaatttgtcccctactactttaacaggaactaccaatgcttcctctactcttagatatttcatatgcacgtgtttctgtaagtgttgatgaaagccaagacctaagagacagaggaagagagacttctttgctaaaataattccatagtaggataattttttgctgttgttgttgaggactgcagaatcttttctgtcaaatgtagatggcgagtctacttatgataggcacccatctctcccttccccttctctatatggagaagacaccctccctttcccacggcatgtgtgtgtattctacacacctagagctccccatctttattagggtctccctcccagtggagatgaactttctcttttattccctgttacgaaaaactaccccagtcctcctcctgttttgtgacattgctaggatactggtccatctcctctctcctctctgctgctttaacttcctctccagtctctcactgtttgattgattgagctgc

SEQ ID NO: 25995 - DNA, 1195 bp, Mus musculus
gaggagcaggcactcattccatacctatcaattgaaaataaactgcatttgaaatagaagtaaaactgccctgtgccgcaggtttgtagaagatgaatggtcacacctgccaggctgactttgctcagaatggctcaggggaaggaagttgcacagagacatcctgatctggcaaatggtacccagccacatggtcggtggattcttctcgggggatattttcagtcaggtttatggtactgttgactagttataaatcttcaaagtttgagagatggcgtgagaacacaggaaaggcaaaagccctttcctccacgatcttgtagcccggaaaatccccaacatctggctcacgtgtgaagccaggaaagatacggtttaccctggcagctgtccttgctgagggatggagctgctggcttaatgtcacacagggaaaacactctgtaagagtttgcaaaggagttttttttcccaagtggaaaaacgttcacacacatcatactaaacgagagattttttttttcaagcctcctcctatgggataaaaatatttgaccttatcagaattggtcaacgtcaagactgctggagggagcgatgtctacccttgctgttcactgtacaaacgcaagcctatgcactagcgtacacagctttactcaggcggtaaaagcactgttgataggttttgttttgttttgttttaaataaaacattaaaaataactttattaaaggaatccacaaaaatcaaaaacagaaacaagaggtaacgctgatttgctggttaatagaacaaacaagcatctttattcctgatgagctcgtaggctaatatccttaccacctcccgttctccagagtctcttcttctcgggaatttgatttaggaaaaccaagggtaattttgtttctttgaactttttccagccacaccttgaagaaggaaatagatttcattgttgtcacttctcccaaaagaaactattatcattaaaagaaatagattcctcatttcattaatttattctctttcattttgaacttctatattttaaatagttaagattaagaaaaaaaatggcttcctactcctgaaatcactcttggggatgcatatagacaaatctgccttaagttttcaaagtcgagtcctttttttttttttttatttcatcagctatacacactat

SEQ ID NO: 25996 - DNA, 1769 bp, Mus musculus
ctatcatagtccaagaatttgtgtttagtggagaacgtaattaggggaaatacttaagtgattgttggttggtacagtgttctcttagttcttaagcaatccacgtcttgctgaaaaaaaaatttttttttcctcccttctctctggctgctgccccaggtccgttattttgcaagagtctctggtgtccacgactttgagtctgacagagagtcaatcagccttgagtgtgaagcaagagtggtctcagagctacagggctttcccttcactttcatccagccacagttcccagaatggcacggacctaggggaccttcttagcttgcctccaggcacgccagtgtctggcaacagcgtctccaactcgttgccaccctaccttttcggcatggaaaatagccactctccttaccctagccctcggcactcagcaaccagggcccactccacccgctctaagaagagagcattgtccttgtcgccactgtcagatggcatcgggatcgacttcaacactatcatccgtacttcacccacatccttggtcgcctacatcaacggaccaagagcctccccagccaacctgtccccacagtcagaggtctatgggcatttcctgggtgttcgtggcagctgcatcccccagtcttgtgcagtggccagcgggcagaaaggcatattggttgccagtggagggcatacgctgccgggctatggagaggacggtacactggagtatgaacgcatgcagcagcttgagcatggtggcctgcaacccggacctgtaaacaacatggtgttgcagcctggcctaccgggccaggatggccagacagccaacatgctcaaaacagagcgcctggaggagttccccgccagtgccttggacctgccctctgctctgcctctccctcttcctccgcctcagggtcccccacccccataccatgcccatccacaccttcatcacccagagctcctgcctcacacccaatcgctgtccctggcccagactggcctggaagaggatggggagatggaagactcaggggggaagcactgctgccgttggatagactgcagtgccctttatgaccagcaggaggaactggtgaggcacatcgagaaggtccacatagaccaacgcaagggggaagacttcacgtgcttctggactggctgccctagaagatacaagcctttcaacgcacggtataaactgctgatccacatgagggtccactctggggagaagcccaacaagtgtacggtgagttggagtttccgaggtcctgggccacctctctggaaggtccagcttactgtcatgcatgcattttatcaaacaggacagaaaaggcaggtaagagtttctatttctgtgggacttggatgtgtgatggtcaaggtacctattaggtttctctcctcttcctctaactggtgcaaggggaaggattctttgatagctggtgactgctggtttctctccagttctagctcggttcccatgccccagaagtagtggaggccagtctgctttagtttgggattgtgagaatgacacagacgtggtgttctcttaactgcatggctgttcaagtggaggggaccattcactgagccacaagcaagcttttgctctttccaaagtaaatgttcaggtttgtgtttgtttgtttgtttgtttgttttttcctttgaaaatttaggtgagtcttggggtctgggagattgacatttaagaatggaattctccacttagg

SEQ ID NO: 25997 - DNA, 1193 bp, Mus musculus
aaggaaacgtgagaagatggaatagacacaggtgagattaaagaggaaaacacaaaagagccagccttgccagcaagcaggcagttttatattggtggttatgcgaggagcctcaggcaatgaaggtgaatgatcagtgatgacatcacagtcccaggttcaatccccgaggctgagactttacccagtgacacagcctccgtgaatacgtcatattatttctctggtccttgcttcacttactgggagcctctcaagttcattcagcaggtatatttgggcaccttaactgttggagtactctgccgggcactggcactctcctaaggcaactcatacaattgtgaggacatgggagaacatgtctgctcatttttcagagtgtcgggcacatagtagcagtctgtgcatttatttctgtttcctgcttgacttcttagtcttcagggaaaatgggggatccagacattcctaaagggtataatgatactggtctttattaattccctaccaaacagcacactctctttatcaggacttgtcacaatctggattgtgaccgttctgtagaatctgcactgggttgagtcaccacacatgagctttgtcagtaaccatctgctcttgaacggttcacatgatccctgtgggagtcagattgctcagtggcacaagaagttcattgggtgagctctctacttatctgatcctattgatcctctattgtattaggtgatgtcatatagtgtgtgtgtgtgtgtgtgtgtgtgtgtgtgtgtgtgtgtatgcacttgtgcgttctgtgtaggtaggtaggcccatctgtatgtgtgcatgtgtaggttagagatgacatcgggtctcttcttctgttgctctccaacttgctttttggagacaaggtccctcaatgaatctggaacgcaacatttgaactagaagccagtccctgggatttgcttccaggttacagtcatcacaaacagataacactgggcctagctttcacatgggtgctgggaagccagactcgtgattgtcggctttatgctctgagcgtcttccgaacctgtgaccgcaattctggtttcccttcttaggtcagtgttaggcatatggttatcccatttccgtcttctgtctgcctctatgagaatgatttggctttgatttttgaaaacttgatttggttg

SEQ ID NO: 25998 - DNA, 1168 bp, Mus musculus
gttttgtgtctactaactcataagtgattaataaaatgtgaacatatagattatttaatatttagccatcatcaaacttttgccctctgtcttttgcactcagtattttccaattctgtcctcccttctaaatttattagttttattccaaattctaactttgcaggttttttttttttcacactgtaatggtacatcgctagcgacatttgttttgttactggaaaagctttgccaacccactgagcctacttcttagtaaatgagatcaaactcaggagccttaaactattacatgaatgtttgcaactcagtcacttttctttcacctgtgctgaaagcaggtgaaacaaaacactagctactgatctgacattagtaggcattctctgctttagccatattgcagcagaacacgtggatggattttttttttgaaggaagacaaggagtgccaatcagatgagggaggtagagagccttgcctgccatttgtgcagttgaccagtagcgagtaaagcaagggtgaggacttgctcagtgcacctgctgtcttggagagattagggcccaggagagctcacatagcaaggaaacaaagaaaatgagcaaaccaaatcggaatagaagcagagttcttgctgtcggggggaagaagatagtgtggcagacagatgtaaaacgagaataaaacgcagggaggttggaatagagatggaggtcctcacgcagttcctgtattttagggtctctgtgcaggtagatacaggtacgatagatacatgggtctgcgtgtgtgtaatgtgcatggtaatggttttaaattatttgccaggcgtccttcctgagagagccaaggagcagtgacacttctgtcacagtgagtatgtctagcacttgttttctaaataccactgcacatggaaagatctggttctctgtagatacgactgattccagaactaaagcaaacgaacctaaaatagcttacaataccagaaagcaagacatctctcaccaaacaacaggaacactttagaaggatccaggaagcagcttacaagggaccttgctcctgaccaaattggggacatttgagcacaggactattgagccctgtcccacatactcctctgtagtcatcactgccttgcagttactcaagtta

SEQ ID NO: 25999 - DNA, 1197 bp, Mus musculus
ctctgctactaaaggaacaagtagatggacttggaagaaaaggatgaccaattagatctctgaaaagtctacatttttttgtttcttacatcagttgattagggaacagaggggtagccttagacttatgagaaccaacctcctgattgttccttggtcagagtgggttagataaagtgagaaatggagagggaacccaagataagcactctgtacaagagcccctgtcacaggaccatgggcatagtgacactgctgccaccacaggggaactgtgtgaagggggacactgagttactttatttggtcaaaggcttttcaacctgaagtctaaggttacaaggatttgtgtagctgaaccacaacagagctactacatcttggagcagaagtctgtggaaatgacccttggaacattattccatctactttgctgatttcattgtcctggaattgctgaagagattgaaggaaggtctagattcttagataggattcagaagtgttgggtggtacttgagcagtcccaagaggggttggctctattagagagcgtggtctcctaagagagagtacttggtgaactcccaaagtgggggttactgtggtgacaataggtggtggaatctcacacctaagagaagtttaagagtcagaggtaacttttggttaaatatggcttctctcacacagtggtcgaggtcatcagggaatctcatctacagtgtttgaagatcgaagactacagaagtctttctctttgaaaaacagtggcacttgtgtgcttatgtcactgcttccaagttcatgtgatttgtcattggcgctcaccatctttattgatagaagctatactgttgtgtggctgtggcggtgcccctggaagtagagtagtcaataatattctgtagtaggcaaaaagctggtccaagccaaaaaaaaaatgtcccaatttgattcacaccaaaatgttcaggattactaatctcttctttgggatggccaaagtttcctgcctaattttatcaatgacttacttagagttgaaggcttgaatatgacttggtaaatgacaagattagaagaggaaataaaagaccaggaattaatttttttagattgattgattttatgtctataagtgttttgccttctctctctctctctctctctctctctctctctctctctctcaca

SEQ ID NO: 26000 - DNA, 2076 bp, Mus musculus
tctctagacagccccactctctaaagaactgctataactttctgctagctcatctcatgcaaaccaaaagcccaggtttttatttacataccaattcagttatttattccaggttccctcttgaccctcccaagaatcaacattctgtgaccttagacccttgactcttagtaagagacagcaagctccccccccccaacgggtttgccgtcagaacgcaggtgttgtgaaagccaccgataattcaaagcaaaaatgggaaaggaaaagactcgcatcaacatcgtcgtaatcggactcgtagattcctgcaagtccaccacaaccggccacctgatctacaaatgtggtggaattgacaagcgaaccatcaaaaagtttgagaaggaggctgctgagatgggaaagggctccttcaagtacgccgggtcttggacaaactgaaagctgagcgggagtgtggtatcactactgacatctccctgtggaaattcaagaccagcgaatactacgtgaccatcattgatgccccaggacaaagagacttcatcaaaaacatgactacaggcacatcccaggctgactgtgctgtcctgattgttgctgctggtgttggtgaatttgaagctggtatctccaagaacgggcagacccctgagcatgttcttctggcttacaccctgggtgtggaacagctaactgtcagcgtcaatgaaatggattctccaagccaccatacagtcagaagagatacgaggaaatcgttaaggaagtcagcacctacatgaagaaaattggctacaaccctgacacagtggcatttgtgccaatttctggttggagtggtgacaacatgctggagccaggtgctaatatgccttggttcaagggatggaaagtcacccgcaaagatggcagtgccagtggcaccacgcagctggaagctttgggttatatcccgccaccaactcgtccaactgacaagcctctgcgactgcccctccaggatgtctataaaattgggggcattggcactgtccccgtgggccgagtgttctcaaacctggcatggtggttacctttgctccagtcaatgtaacaactgaagtcaagtctgttgaaatgcgctatgaagctttgagtgaagctcttcctggggacaatgtgggcttcaatataaagaacgtgtcggtcaaagatgttagacgaagcaatgttgctggtgacagcaaaaaacgacccaccaatggaagcagctggcttcactgctcaggtgattatcctgaaccatccaggccaaatcagtgctggctatgctcctgttctggattgtcacacagcccacaaagcatgcaagtttgctgagcttaaagaaaagatcaatagtcgttcttgtaagaagctggaagacggccccaaattcctgaagtctggtgatgctgccattgttgatatggtccctggcaagcccatgtgtgttgaatgcttctctgactattctccacttggtcgttttgctgttcgtgtcatgaggcagacagttgctgtgggtgtcatcaaagctgtggacaagaaggctgctggagatggcaaagtcaccaagtctgcccagaaatctcagaaggctaaatgaatattacccctaacacctgccaccccagtcttaatcagtggtggaagaatggtctcagaactgtttgtctcaattggccatttacgtttaatagtaaaagactggttaatgataacaatgcatcgtaaaaccttcagaaggaaagaatgttatgtggacctttgtgtgtgtgtgtgtgtgtgtgtgtgtgtgtgtgtgtgtgtgtgtgtcgcgcagttttaagttattagttttcaaaatcagtactttttaatggaaacaacttgaccaaaaatctgtcacagaattttgagaccattaaaataagtttaatgaaaagaaagaaaggaagaaagatagaaaggaaggaagggacggagggagggcgggagggagggaggaaggaagaaaggaaaagaaggaaggaaggaaggaaggaaggaaggaaggaaggaaggaaggaa

SEQ ID NO: 26001 - DNA, 1315 bp, Mus musculus
tttatttttgtttggttttatgggagggaaagagtactgaaatgttttgcaactttttttatgtgctgctagggtttttgttgttgttgttttgtttctgaagggaggagtggtaaccatatgtggcaggaagtcaaactggacagactctcccccacccctcagttactaaatttgcctttaactattcttatttttggaatcaaagtatgaaaatctgcacaacacaatgtttacaagactggttgactgaggagatgtctgctacacggtctttttcttacatggatatacatgtcctacttcgaggaaggaattcaagataaaagtatgctgtgtcccactgcaaagttcagctgtcaaatctggtattcatcacattaaaagcaataaatccgcagtggtgacctactttactaattagtaagctgggtggcacaaattgctattttaagacatttacgtttgtattttcggcaccaccagttaactccttggctagtataaatttgatattaaaaacattacatttatccctaaagtagtctcaaaactgttcagaagttgactttgtcctgatgactgtttaaatattaagcaggcagtgagtgtagaaaatgatagttttctgtttttccaagaagataaaatgcaagcttactctaatctacttgacatagtccgggacctctcagggagtaagttttaaaagaatagtaacggcctgtaagaacaaacaggaagagtaaggtccttgttaaatcacagccactgtgttccatgtggtgaagccttgagaagtgggagctgagctgccagccatgcctaaggattgctaacagccccttcaaaggcggtgacgggtctcactatctgctactcgcttctagctcagttactagaggatgcctctgagttttactgcttcctgtgtaattcattgcagatccaccaggatgtttgatgattcttttatttagaattagatgacagtgccaattatgatatccttattatttgaggattaatcttccagcatacaggagcgctagctttggttatttttgagtgtgatttttggctcagtacccacttcaatttgtagcaaatatttggaaagtgggtacccagggtttggaaatgcaggtctcagtttgagttaagaaatcatgctaaggggccatgggggctcagagctgtggcctccgcctcagctgtccttttcagccgatggggcacctaaccctgtggaaatggactggaattgttgaatcatacttctgtaatgtcacactcttcctagttcccagaataa

SEQ ID NO: 26002 - DNA, 2400 bp, Mus musculus
atttaagttaaccacacaaatgttacaaggtgtcaataaagggacccctttgtccaagtgaaagcccagtgagaaaggcgcagagccatcacagcctggttttggaaagtcataaatcaagcattctttatctggcccatggatgacttgcgaaccagtgtgcacgcccaagaaacgtgtgtgggttaggggtgttcagaaccttaaggtggttctgagaagcaaatcccgggattctgagggccactcttcatccgtttccctattgagcactggaacaaaaataaatattcaaccattggtccgtatagtgatgagccagacaacccgcaagaataaacggagaaccctgacagaaaaaacaagtcagggaggtagaacagtggagaaaagggaactcggtcaaagataggataatgagtgttagagacttctgtggacaaagcaaggctaaggtgatgtcctggaggctgatggccccgttttgaatccgccaacctggggactgaggctgagtacctacccagaagacaagtgtatctgccaggaggaggagcatctggacttttggcatgctgtaaagtgttagtataggcttaaccaacaacaaagtctcagtatgacagctgacagccttttaaagagcccctttctttatgccagaagacaaaacatgaactgcagtctacagtttgcattgtccagtcaagtttcttgcccctggatcagagacctaaatacacatcaggacttctaaactcacatgaactttacaaactgtttggaaaaagcgcattaggacattcagatctgtataatctacctacctattttgtttttcatctttaggaaaaaaggggtgttggaaacattctctggaacagaaaccaacaagatctggccccacgtatactccttcctacagacgaaagttccagaaactacccaaaaggcctctgttactccctgaagagggcagcaactggcaggatgaggcagggcctcctctcctcttcttgcctctgtatctcaaagctcttttcctaagacttctctaaaaattatgatttattcctaatggctaagccaaatgagtcagatacttagcctgatctgttaaaatagcctcacatgtttaatctaggacctggttgtcttctgtggacgtgcaattggaaaacgtcagagatgttgaaacaaactaactcggagagcaactggtgaccatctaaccttctgttcagttagtcaaagtggttgatcacattttcatgtttttctggaaaagttcaaaaaaaatttaccattcaaggcagataaataatctcattcgaggcttttcaataagccaatgcccactgcaattcaggaagatgttttctggcctgaagggatgtggtattagaagacactgtctatagatttcagaaagcaagcaacaggctttacagatgttaaatgtaaactcactgctaccttaacaggaaaagccaagggaacaggccaccatgctgtgtgtcctctacttatccaatctgctgtgaaaatgcagccactggcacgtagggacgtgtgacttggatatggaccaaggtgtatgacttaggttctgactgaagttctaggagcagcactggcactgacaatggcattaagtcctaagttctcccgtgtcactcagggtgaggaccaagttttaggacctacccgtttgtttccctctttgatccaagcggactgcctgccttgatgagcaagacagtaaacagaaaactaaagggtgacaccacacccatgggaatttgccactctgcaagtagacgggacatgctggggacagccccccagcagaaagactgactaattccactacacaacaggtgtagtaataggattttgcatggtgggttcaaaagcactgtaagggagttcccttaagaacattatacctgtgttgaagttctaaattaaagatcctcttgtctcggcctctctcaagtgctgggatcactgtgtgctaccacttcccaccctaatttaaagggaagcaattcttctggtaccatctaagcagcctcctcttctacttacagcagtgggatccaaccagcctgagtgctgggcaggcatcctatactgtggtttatcttcagccccttctgttgctgatgctggtggtggtggctcagttctgttgctctgacaggatctcactgtagttgactgccctgaactctgtagtcaggctggcttcaaactcagagccatcacctgtttctgcctcccaagtgctgaagttaaaggtgcgcaccaccaccacactcaggctggctttggattattatatagtccaaactggcctcacattcaatcctcttggtttagtctcctgagtgctta

SEQ ID NO: 26003 - DNA, 1105 bp, Mus musculus
tgttgctgtctcccacctggaaaagtgtgcccttatcagtttcttatctttctttcctcctgccctaatcttcagctgctaaactcctctgaccacccacctgaaggaacagcctatgtggccactccaccttgagatcttacatggttgcccagttctcctcttcccaaggcatagctaactttgttctctctcttgtgtctttcttcctgccttctgggatccagaagtcccgcatgtcccttccgcccaacaattggctcatggctttctttactgatggatcaagaaccaactggggaacaggaccttcccctcagaaccaccccttacagggaagcaggataactggggcttgttatagggaaacaggataactgggactgttaccctgcccaccaattctagctgaggggctcaggtttaatgagagtctggccagttcccagtagtgctttgtggatgagagtggggtggctggtgttcctcaggctatcctcttggactccacgggtatgagcacacacatgagcactgttacagaaacacaaacaagagaggtcgttcatgatttgagcatttctatacgttagaaaaagaatttgggagaacaggagtctgaagcaaagtggcgagatcattgagatctcagtggtgggacttactgggtccactgcgcactgctgctctctgatgtgctggttgactcttgtcaccaggcctgttggtccactgaatgggctgtaatgaagttagctgagtacatgtgcagtgtgagcactagaaggtgtaggtaggccagtggtagatggtatctcctgttactcagcatatgttcacagttacaggcaagcggtaaggttgattcaacgtagaactttgtggggtgagtagaaagggttgggatgggtttgaaagttgagatgaatcggaggtaaagagaggggcagggttggggaaaggcatggcaggaatggcagctgtgtgccggcacagcgttgcatcgtgactgaagacaataaaagtcctggggtcatgaggtcaagggctcagaagaagttggaatttttccatggtagcaagcaggagagaaggcctgtgtcct

SEQ ID NO: 26004 - DNA, 1192 bp, Mus musculus
agctaaagagctcgcctgtgttcgagtatcaagcagtttagaattaactagttgaatgggttcattgaactagtccatgaacaagtctgctctactgggacacagaagatatagcttttcatggggacggaggagaggagggagtgagggttcaaaataaagcaaccagggaaggctaagatgatggctggcgcactggcctgaccaaaaggagtgtcccccacttctaccaccacccctctttcatctgcctctgtctgtctctgtccctccctccctccctctctctcactctctctctctcacacacacacatacacacacacacacacacacacacacacacacacctctccccatctgttttgatttttctgtgtgtttgcctgcatgaatatatgtgcaccacatacatacttggtgcctgggaaggccagaagaggttgtcagatcccctgcagtacgtggctacgagccagtctgtgagtgctgtggtgaatctgagtgctcttcgtgagcagcaagtgggcttaactccaagccatttctttagtcccaggactacagcctctcagctgccccagctgctgctctgtggagatagggactcaccttcagatttatcaaggtagaaatctggatttgtgtgtggatagagttgtgccgtttattctagggcattgaagactgtttggggaaggccagactgtcacagcgtggtggaggctctgggaagtgtgagaacttggcattgttaaagatagactttagccagttactacgtgtgtctgtggttgtgtgggtaggatgcaggtcaggcaggtgacctgacttcttcatggctacaaactgttgatcacatgtgcagcaggcacaaaagtgagcacacacttgactttcccacggctgaggtgtctgacaggaaggaggagatcgtgagggaagagaagatgctggcaagaggaaagtgtgttcctaagcgagcccattatggatacagttcctgcacagttgaagactgcttacaattgtagtctgctcccctgtccaagctgatccaagccggccttgaaccctgcgcactagtcatgtgatgaacgtcatcattctacctaattaaagataggagcccctcctgatacagctgaagagcaaggcgtagccattgtgcttgctgctaggagcagtggag

SEQ ID NO: 26005 - DNA, 1355 bp, Mus musculus
aatagagactcgcagaaaatactgttgagtaagtagaaggcagttgctggcgttcaggataagaaattgtctttgttcatctttttttaccccatggtgctctgactaaggggagaaatgtaatatgcaccactcaaaattacctccatatttgtgactgtaataagtatgtgggacgggaaggctgagtgtcttacactaacctctagcctgtctccagccgaacttaccttgctgaggtgtgtgtgcgcgcgcgcgtgtctccacaggctgctccaggcctcttgggaagctgacaggctataaatattaaagcctttttgattagacagttttaatttcaatgtttttagtctcagaaattaaaatttggggtcttaggaggacagagtttcttttaaaatgaacgttctcactatttctttttaggatagaatttttgcggcatctgaagagctttttccaggttatgtttaaagttgaaaccaagccatgtggtgaagaactgaagggcggggacaaagtgctaatgacctgcgttggtattggcttctctaacctgagcaagaccctcaagtgatcctgtacaacgtcaggctctgctgtgcatggatgaagcagaaagatgcgaaggaccacagggaccaagtccaggcatgtccatccaggacaggcggcctcttaacattacagactttcttttccactgaaaatactgatttgcaaatacaagctgtctctcccacgtgacttccagctgcttctccaatgacattcctcggaggcccaggctgtgggcttccagactcacctggaggaggggccctccgtgagtggccacgctgctagacagtatcccagcagctcttcttcatctttggattgtggctctgtgtagggtttatgtgacaacgtgacagtgtgtgtagaagacctccagtctgttgtgccagaagttggggcactggttccctctctcgtcttaggaataatttgcttgcatgggcacatgctatacctcacatggtaacttgtgtttgtgtgggcctggtggttgggatggggagggcagacatgtcttaaatgttttctgtatcccaggtatggcataaaattttgtttttattcttctaattgcactgtagtgtaaatcagagtatttatttttcatttgatgtttataattcagaaacattagatctgatttaaagatgtaacagaatctgggattttatctacatataagctaatattccaatttcatggatgctaatagaagacatcaaagtcccaggacagagacacagaactttgtagcctggcaggcagcataaacatatttaaactgatgtctc

SEQ ID NO: 26006 - DNA, 1162 bp, Mus musculus
cctgatgcagcgaaaaagggggtggtcaaggctgaaaagagcaagaaaaagaaggaggaggaagatgacgaggaggatgaagaggatgaggaagaggaggaagaagaggaagatgaagatgaagaagaagatgatgatgatgaataagttggttctagcgcagtttttttttcttgtctataaagcatttaacccccctgtacacaactcactccttttaaagaaaaaaattgaaatgtaaggctgtgtaagatttgtttttaaactgtacagtgtctttttttgtatagttaacacactacagaatgtgtctttagatagccctgtcctggtggtattttcaatagccactaaccttgcctggtacagtctgggggttgtaaattggcatggaaatttaaagcaggtacttgttggtgcacagcacaaattagttatatatggggacagtagtttggttttttgttttgtttttttttttcttttggttttctttttgggttttctttttttcatcttcagttgtctctgatgcagcttatacgaagataattgttgttctgttaactgaataccactctgtaattgcaaaaaaaattgcggctgttttgttgacattctgaatgcttctaagtaaatacaattttttttattaaaaaaaaaaaagagtcagttcaagattttggtgaataactcagccacttggggaagaaatctaacagcttcaatgagaaagtcagacaaaaattaattgaaaaaagaaagagaaaggaagaaagaaagaaagagagaaagaaagaaaataaaagcaaattatgtaaataaaaaggccaacaaataaaataaaaactcaatgggcagcaccaacaatagatcaggttagagaaagaatatcacagattgaaaacaaagttaggaaattactatattcagatagcaattaagaataaaattaagagagaaaaaaaagaataaaagtaagcagtcatagctacaacatctaagacagacctctagaacaaaacctaagagccaaccctatgaatatgtagtgttggagaagagactaagatataaacaaatggtatataatgtttggattaaattaaggtagaaaatttcccaaataaaaggaaagagtgtgcattcaagttctggaggc

SEQ ID NO: 26007 - DNA, 1103 bp, Mus musculus
atcctattacttattactccaaggtgggctgtgtgctttgagtttagagttacttacgttccacctgctgctgctcttgcttgatgctgtgtttgtttgttgtttatggaaacaaagtattattctaggtagcccaggatagtctcaaactcagcttctcttgctccagctccctgggttttggggttacagatgtgctccaggatgctacactctgtttcttgtgttttctgctgacattataatcatgttatcatgcacaaagccttttgtttcacaacctgcattcagcactgctctctgtgttttatagcacagccctggtaacttttagtgtgctgagggtggctgaacttagtgctctgtgcttgaactctggaggctgatagactgtctcgttgtcttacaggttctacttccctcattggtactgtagtggcagcagcagaacctacagatacggagtgtcccgtggggctgaagctcctctgcttgatgactttgtcatgtcttacctttttgctcaggtataattataatatagttaacattaatcctctttatgtgtgtattaaaccagaaatttcttcctatttagtatgcatcttaagtagagtaactttcacgtgggaaaatgcagctctccctgaggcaccaggtatgaagagataagggggtagtctgtgtgataatcggtttccatctcatgatttacagatgtattttataacgattccatgaattgacccttccaaagtcactttttttttcttttaaaatctaagtcattttaaggattttttttttaaggtagcataaatttaacagcagaattcatgtggccattgggtggtaaaattctatagagtttttaataaataaattttggatactttcgtgtttacatggtaggcagtaaaatgtaacaagattcctctacaacaaacagagtgagctgtgatagttggtaggcccctcaagggaggctggccacgtttgatgcttagagtgggagctgtgttcagctatttgtccactagtactataatgatacacttctgtagtgttatttgaacacctcgtaatgcattcttttctattat

SEQ ID NO: 26008 - DNA, 1197 bp, Mus musculus
tgtgtttagcttccaagaaaacaagtctggtctttctgatggattaagaccaccttctatgtttctttatagaccacacaaactctagtacaatgccttcaatatgaagtccgtgtacatttgattaattaacatttattttggtttaggcatttttaaaatgattttaagataaagctttacggctgggcagtggtggtgcattcctttaatcccagcagttcggaggcagaggcaagtggatctctgtgagttctagcctgtgtagctagcctggtctacagagcaagtttgaggacagtcaggactacacagagaaaccctgtctggaaaaacaaacaaaacaaaaaaaagaaaaaagaaagaaaagagaaagaaagataggctatgaacccaatttaaatcagtttctatttgtatatgaaccttggttaattctttgtggtataattctttgtggtataatgataaaagcagaacttggtttattacttttaaatgcgtattttaggagctaacttatagcatataacataaatgtgatagtaaaacctgagccatggccttatcgtttctgtttttcagtggcggcatgattttgttcacggatggataaaagtacctgtgactcatgaaactcaggaagagtgtcttgggatggcggtgttagacatgatgagaatagctaaggagaaagaccagactccactggctgtctataactctgtcaggtaatttcctctcacaaagcattacatactttgtatcgtttgcttgtatttcctgtgtttgctcacacatttgattttataataaaaatggaggggttatggagatggcccagtgggtgaagtacttactgcactgtggttcatatccctgaaccacataaataccgggatgacactgtacacctgtaactgtaggtgggtaggtcaaggcagacagctctcagggtgtggctgaccaccgttcgacacagtcaacacagtgagacgggtccaggctccgtaagagactgcctcataaaataaggtcgagggggctagagaggtgcttgctacaccggcttgctggcctgagtttgatccgtgaagcccacaggaaggtagaaggagagcactgacctaagagatttatctctgacctccaggcaagtgctgtggcagtgtgcccccaaacatgtcatgggcatac

SEQ ID NO: 26009 - DNA, 1145 bp, Mus musculus
tcttccatatcttcttcagtcacaccacactgacaccccatttgtctttaatttgttgcctcaatatttgtactttctagcctagattaaattatactaaagttgtagacaggtagtgttctgtaaggatatgatgattggctctgctaaagcattttccttctgtcatttttgttgttttgttttagaagacagagtctcattgtctgactcctgaccagcctagaccagagtgtgtacaccaggcggacttgcagagttttaaggcctcctgccttactgatgctcagccttgcttacagaacttctccctctccttctccctctccccacccccccaagccatgtgtgtgtgtgtgcgtgcacccacctgcctctgcctcctgagtgctagaattaaaggtgtgcaccacaatagctagcttgcagaagcaatttttgaaagccattatatttatactcattgctttcccagtatgctgtcttgcaaggtaattgacttgagttgcttgcttccgtccagtttgcagtctgtgctggaagatctccttgttgcaacttctgatggacttcttcatcttattcattgggaaggaatgacaaatggaagaaaagccatcaatctgtctacagtaccattttcagtagacctccagtcatccagaggtagttatactttgtatatgagatagaaccagttgtttaatattgggtgtatggtagtactacccaaatatgtgatacaatagcttattataaccctactctatttatgtgtttttcatcagttggttcattcctcggctttgcagatgtgcacattaaagatatggaatactgtgccacacttgatggatttgctgttgtgtttaatgatggtaaagttggatttattacaccagtatccagtagatttacggcagaggtgtgtattgtacattttaaattattttattttgcatatattaattttgctttgttttcaaatcctatgctctcttagttcacataatttttattcctactatatagacagttgcagggttattgactttatcctatggaaaatgaccatttgcttcaatcttcttcaaccccaacacactcataaatcttttcaataaggttattattgtaatgagatt

SEQ ID NO: 26010 - DNA, 1208 bp, Mus musculus
tctttcactggtgtgtacacaccacctcttcctggtctggcttcttttgtctcctgtttattcttattccctacattcaattctacaaattggtcttacgaggcaactttgtgccttgcatggtggtgtattcctgtaatccagcaattgagaagcagaggcaggaggatgtttgagtttgaggccatcctggtctgtatatcgaactccaggactacacagagagacgctgttttaaaactgaaaggggtgtgggcaaagttaactctgtgctgcatgtttactaggctgtggtgtgatgtgggaaggccccggagcttttccttcctattcagacacaattagatatggaactcttgcttccttttcaactttatcaatgctacctaaaagtggggttctccaggggggttattctttcgctttcttctgtttcttacagatggagcaaagacagtgaatgtgctgagaacatgtatattgacatgatgctgtggagacatgcgcggcgcctcctagaagaggtgcgcttaaaggaccttggctgctttgcagcccagctaggctttgaactgatcagttggctttgcaaagaacgtacccgagctgcccgtgtagacaactttgtagtagccctgaagagacttcacaaggatttcctgtggccacttcccattatcccagcctcttccataagttcccctttcaaaaatgggaaatgccgagcaggtaatgtagacttgagacgtgtttacaaaattatttattttagatatttggacatgttatcattggttgacattcaaggagctcttttcattgcaaatgtaagcagataaaagccaatttgtggtacaccagttagaatagctcccagttgaccaaagatataaatgaagtcgaaactaatctttcttaagtctttttggcttgaagtttagctcacaaatctaatcataataaattgtaaacaggttgaaaatgaatgtagaaactcctacatttaccttattgtggtaacaaatttagcatgagttagtcaggagccgccaataaagtgtgctgtcgtcatttaccatcaccttgacatctgtgtcctttcctaaacttggagaggacaaagccaaactgagttaaaaacaatccgatatttaattaagattctagttgttcaaacaaaaccattttattatggtgtttaggaactt

SEQ ID NO: 26011 - DNA, 3216 bp, Mus musculus
ttcaggatggggcttatgactgttctgtgtcctgacagcagtgagcacggcacagcgggcagtattagtcacagcagcttgcaactgagtcattgtggcctgccgaatgacttaacaggtaaaagaacttgggtcagaactctttcgtaaagtattataatttaatgaactcttcctctaaatctctttgactccttaaaaaaaagtgtggtatcaaagcatctttcataagaaaaatttaagctgcaatagaaagtagtgaacagtatatagatgcacacatggaatattttgattttatttacaacagattggtagttgtagggattattcttaacaggagggattattttgccccaagcgagcttactttttcactacttacagcttatatattttctggtttagtgtgtgtctagactggttttgtttttgtggggtgggttgtttgtttttaactttcttttaaatatgtgttaaggtgctgtagctcatcaggtaactgagctacttgtttgcttccttgtatagagtcagcgggactctgattggtcctttgaatcctactcttgcacagtgtgggtcagtggacagagaccctttggctttggtactctgttgactagcagtcctgaatgacggaagctatttacctgtgagttaatgtgcctgttttagcaagcttaatttcctactagatcaatgtgggcagagggtgagggggttcttatcaattatgctgacaccactaaattttgtatcaaagaactgtatctttttgtgaatattcatgtaaatatactcaaaggcactgtccatatttttaatgcgtgtattataatgtgtaaggttttacgctggattctgcatgactatactcactcttggaataaagacaagactttttcttctttccaaaatgagcagttgtcatagaggaagacaggtttgttggcccagctgtaaagtagtggtcatcccactgatcatgaggcggaacaggttttgtgcaaattaatgtagtttcttatttattgcttttgtaaattgaataaaaacgggcttttatgtaaatagactgtgggatcctgtattatcagctactaaaaattagtttgtaaattctttattataaagtttaaaaatattttatgtatttctagatgtgacttaaattttagtttttcatacattatgaaagcagaactacatattcagttgcttcagactaaacacatacctatcacatgtaattctaattattaataacagtattactttagatagcttatttgtactgtgcaatttgaacaaggaatgcaatgttattttttataaaatcttgtttatttttataacaacaatgtatttgatgtggaccaaattcgtaccaccatgtaaaacagcctctcttctaatgcagatatagcttagaagtggagttcagccctctatccctgccttttaaactagagagatagacgaggtcctcttaggcagtatcttttagaggaaacctcagcattattttgaaattatttcaaatttcaccaactagttaaaattattgaatttagtaattactgttatttactttctacattagaagtgcaataattttacataataaaattactggatgggtgaaatatgttattggtacctggtccttctggtgctatttttatttaagttgtatcaaaccaccaccttgttctgaattttaaaatagagaataaggtttcctatatacgtagatgcagtgttgcaaaataaatgaataaataaataaagcaagctgaaatttcttctgtcccattccattagggaaaaaaaagccagcaattcttttgtatgtagtcagtttctaatgtaagtatttagttattaaaacagtgtagcatagtaagcagcagtggtctttccgatgtctcacctgagtgccactgagctcatctgactctgtggtaggtgcagtattaaggatgagcagggggccgctcagctaagcaggtgtcccacgagtaagttagagcccacaacccccaccccaccccaccccaccccacccctgtcctttttttttttttttttttttttttttttgaggcatagccttgcctaagctgaacagctatttgtaacccttcctcagctgtcccagtaggtggagtttacagcatgtgccatgtgcggccatacccagtcatctgactacacctcacaatctaaagccgggtctgaggtagctgatgttactcctgtggtttgagctgggaacgactcacggataaaaatatatagtgtgtaactagtagaactaggaaacaccaaggcaagacatttggcaagtttaataaaaactattctttggttgttgtatatttttttaaaacttgtattttgctgcattgtttggtttgaaacatatcacctgtgtaagccatatcttgaatgaacttaaatgttcgccataactatttgaaagttaatatatatggttaaatttcttgctgataccaaaagagatcatttggagataaaaacaacctttgcttgtaattaaagttgctgctgcttctgtatgtgtactccctcctccccgccccccttggtaaagggtaataaaacgactacacaaaagtaaacttttgtttacttatctcaggttaacagcaaaaaaaaaagggtatgtattaaatgccacaaaaataagtcctccttcttatattctcctgaatgaaatacctcaaagttgaaacattgatttagagtatttagacagagtgggaacatccaagtgcctgatgacagaatattgggaccactcgtcacatgctcacgacatagtgaagaaatgatagaaaatcatgcccaccatgtgatcaccaagcaaacagatgtgtacaagagactaggcgtcctctctagtaggtagaattatacattatttgcacagttccccatgtcccttatatgctttgtggatcatctagagtagggcatttattaccttggcatcatgctttgaacatttttcctatatctacttgactttttttaaagctgaatgatgctgttttgtgaatgtgtttactgtcagtttaaaggttacagtctgggtgtttgactttaggtaactctataaacattccacacagtaattctccctcaccctgccttgctctcgagggcttcagtttcccagtttcccag

SEQ ID NO: 26012 - DNA, 2402 bp, Mus musculus
gcatgcctcttgagcagctttcctgtgaggatcaagaaagatgtaggctcttagaccactgctaatgaaataggcaagtccacttgccagtggaggtgggtaagatgcctctctgtgcgctacaactgtagtactgggaagtaaatgccacaaaggtggaagccgctgcagcaccttagatgttcgagcgctgtttcttcaggcagccgttcagattttttttgtctgtttggaagcctaagccctgatgcagaggcctgactcctgagtagcattcagtgtctgcttttccctcaaacacattcctgtcatttacctggggaagagaacatttttttcagctacattttcttcttacatttcatgggttgctttatttgtgcaagcacagaacttaaaacttcttccccagagcactgaattgccagcatagctgctgaggtggaagaggaggagggctgggaggactggggattttataatatttattctgttatatataagattaatcctttagcacaagttctttattgctgcattgggttttctgttttctagcaggtgactaagttgttgtaacttgccgtcagtgagaaccggctgtcctgatgttgaggttgtagcttacacaggagacaactatacctgtatttgttaatttttagatcccgcataagggcagcagtcagacttaatggtgcttttcattttgaagacagggatgtagcttgtgaggtatgtcacggcagtggctcttgtggcgtctctaggttccatcagtgacagaggatgagatgaacagtaaattattctaattttacagtagtaaatatacaaagacaaaatttgagttagctaacaagcatgacacaaaatgtagttgaaagaaaagccatagtaaggcaaaaccaaaccaaaccaaaccaaacaatatccttgtcaggtgagaacaggaaggcgcctctcagagtggccctcagaactgtctgaatgtcaacaagagcactgttacgtgtgcaccgcagaagaggagcctctggaaattgctcgtgtggtacgtgtcagtttcttaatcgtgttccttgtattgcctgcctaatctataacgccttaaaaacgctgcggctggagctgatagtaacatgctgactgtcacaagtggtgacacttaaagtggagtcagtgttttgctggactcacagaaatcttatctcactagtgcttcaagtgtctggctcctgctgtgtgtgtattctctgtcaggtcgtacttaaagggttgagggtttatgtctagcttgtagagaaccacagctgagtaacagtactgatagctcaatgaatttcaaaatacgggcttatgttctgtgcccgggttaatctgaaactgattactagaaattatgggggaggagagcaacatgtcatgctgaggaagttcactaggacaaggatgctctctgacttccttccctttggcaggcaccttttcagtgtaatcaatcatggttttctttctgtctttgggttgtttctctatgcaaacgattttcattttctctaacactattatgcaaccactaacaagatgttcagtttcaggcatgcttaacggccagaaatggtcaggcaattacatgcagtattcatggcttttaaaaagcacactctgtagttatcactagcctcctacctttaaaggttatctgatcacttgtgtaattcacttctcaaaagatagtttcaaggtctaagtaatgcatcccccagaagagtataaacagaagcagcacactagggacaagtatgaagaactgaaagattgttctacacagcgtttccagcttagcagctataactaaatgtctgagatttcccccaaccctgattttgctgtgaaagagattagaccacaagccagcctaggtgactcaggaagctgttggaagaacatgtctgtccatctcattttcacttatttgctgacttgttgagggttaatcgttgccttacaatgttactgaaataaactttttaacacactggttggaaaaaatggatcttttacaactgctttttattctatctccatattttaaggctattttttatccctagtgtctgtctgtctccgtctctctctctctctctctctctctctctctctctctctctctctcgtgtgtgtgtgtgtgtgtgtactatctttaaaatgctctatatagcttgagaattactgctattttaataagtggtataagcaaagaactcgatagaaatggtcacttcatctggaatcttttttccctggaatgaaactgtgcatctgaatttcagagaaataaaaagaacctgtttagcaaatgggaagatccggagtatatttaggtttaaatcttctcc

SEQ ID NO: 26013 - DNA, 1164 bp, Mus musculus
tttgtagccctggttggcctggaactctctacgtagaccaggcaggcctctaatttgtgtaaatcctgagtgctgggattacaaatgcttttttttttttttccaaaaaaattttttttaaaagacaggatctttgttatgtattccactctaggcacaaaatagggatcctcctgtggccatccttcctagtgccaggattacacctttgtccagtcctggttgtgaagtcttacttattgatttggtaggcagaatcctccttttcccagtattcatcagcccagcgcaggataaatgcctcgtgtattctgttaaagcggccttgcacttctctcttgcttagggctgctcatttctaggtttatgggtgtttttccctttgacagtctgctggcaccaggctgggtgtcagcctgtgccaccaaagatctcagactcaggcaccagggaacagcgaggcggaccagccaatcagaagaaatttggccctctgcagtttccgtccgctcactaggaggcgctgcggaggccgcggtggcccggactgtcgcaggctggggcggttggtggtggcagttgccgccatggagtggagctcggagtcagcggctgtgcggcggcaccgcggcaccgcggagcgtcgggagggagaggcggccgcgtcgcaccggcagagagaggcctcagcgcaggaggatgcgaagggcgtcgggaggatgtgggggaagacggagaacggcggcgggagccgggttgcgaagaccgcgctgtccgaggcgcgcacggcgctggcgctcgcactctacctgctcgcgctgcgggcgctcgtgcagctctcgctgcagcggctggtgctgagccggacctcggggctccagggcgagttcgacgcgcgccaagccaggtacggccgatcggcccggccgcgagtcctctgcggccccggggtgggggagcgcctggtgggtgagtcccgcgcgggtgagcccggcgccactgtgccccaggcggaggaggccggcgctgctgtatgcagagtcccggggtccttgggcgcacctcggtgggaagtgggatgatcctgcgcgtcctccgggggtctgaattgcgggtactccgggcttcctcggctccctctttcgctttcttggggtggccaga

SEQ ID NO: 26014 - DNA, 1144 bp, Mus musculus
taggcagctgatttccttgggccttataattccttattctcagcccatataattgctatatattataataccccgcttgttaattattttcccaaagtatttacgtatcaaaaatcttctttctcaagatgtttttagatcattgtacattttctcatacattaataaacaatatgagaactattttaaataaaactgtctattaaacaattagtgtttcagtccttagtttgaatgcttcaagcttgtatttttaaaggtagaagaggtactgtccctcagtggattttatatgaaagagttagaatcttgtatggaaaagataaaactcaaacatggcaaagaaaggtttgagtaaatattttgtatgtggacagcaaaagaagttctactgaggtactagttggaagggtgcgttgcctatccagaaggtttgaccttgtgaattgacttattcttctccaaggcacttgagagaaaagacaacgatagcagttacatctagaggctactatggattggaggaggagaagggaactgcatgtccttcaacaaggcgtcggtcaacacctcgaagtttggcaggtttgacaagtggagtttttgaatctataatggttcaagttttgagacaggaagaacagctgagagcaaaagaagaaaaaaggtaaatgttaacatgttaactgttcagatttacaaaaattactttaaaaaagaatagctccattacatgccaatagcacagttttggtcccattttaacaggattccgtatttagtagtagtgcactgtcaacaaaatatgaattgttaatggatcacagtgaaatttgttttaaagtatattttaaattataaaacaattattttgactctatacaaaaataatttttagaaaagattttctaattttctagaaatcttctcaggggaacttaaaatcacagcaatttttttgtttgtttgtttgttttgattttttggagacaaggtttctctgtgtagccctggctgtcctggaactcactttgttcaccaggctggcctcgaactcagaaatcctcctgcctcagcctcccaagtgctgggattaaaggcgtgcgccaccaccggctagcaatttttatatagacttgtagtt

SEQ ID NO: 26015 - DNA, 1104 bp, Mus musculus
gtgatgcacagacatacatgtagcccaacatacacatccatacacataaagtaatataacaataatagtagtaataaagaaaattgtaaaggagaaggtaacaacaaacaacttggtagaaactcattttcaggatatctgcaagcaacgatagacacctttaatctttcttttctgacccttgtagtttgggctagcttaccaacactacttatctcaaatgaatcataatcctactttgttcatagtccttggtaatagaaccaacagtgagaacacacaaaatgagaatggccttggctaggactagtactggtggcatggtgttagtgtaggagggtctggagccagggcatcgtgatgatgagtagtccctggatttaatgaacgctgtggctgagagcatgaagacatgttactagcgttatagacttacagacttgacttagctattgccaacaagtaatgtttaagttcttgaaagagtcttatcttaataaaaaaaaaacaatgtatatggatgttttgcctatatgtatacgcaaaccacttgtgtgcctggtgcccacgttggccagaagagtgtatccttggaaatggaggtttagagacaagtagttgtgagctgtagtgttggtgctggggatcaaacccagattcctagaagagcatcaagtgctcttaatcactgagtcaccctccagccttgaggttcatctttagatacactggaaaaatagttaggaaaactgctacctgaggttttattctgtccaggaagtattatcatttggcaaaaagtatgatacaaaatagcacaaataagaattggagctttaaatacaaagtaagccagtgcttattcaattttacaattttagaagtcattgaagatggtttagaaataacactacccaaaggatagggcctgtacttttattttggtgttagaacatagaacaaaactttcgtatttatttagctgagttaggttttttggttttttttttttttttaatgttgaaaactttcttgattagaatcaatgctggaaatgagatagatcagttgttctcaacctgagttgtgaccctttgggcttga

SEQ ID NO: 26016 - DNA, 1106 bp, Mus musculus
caaataatttgcagcacagtggtagttcatgaggaaaccaactctactacataatttttcaaaggttatattcatgaaattgtatgtctccagagcctaagtgttatccagtaggaggtcagatcctctggagttggagttagaagtagttgtgagccacccaaaagggtgctggaaactgagctttggtcctctggaagaagaaagagtgctcttaaccactggttgattatcttcagcctgttttacatcattagggtctcatgtagctcagagtggccttgaacttgcttttgtagctgagatagacttacattcccagtctatctcccaggtgctggggttagaaacatgcactgcatctaggttcaagttctttatctttacaataatgtttaatgtatgtctatttaccaaaataactagcaccaggtattctttttgtgggcagatggtaatgggtaaagtggtcatactgaaaatggggcttgggtacttggatccatagaaatgtcatagtcagtagagggtctatcactgtagcctgtgtgttttggaaacttggaggtccacctgctcaagcctcatgagtcctggtatcacaggtatgtgcatccaccttagggcaaaacatgctgtgggtaaggagagtggaagaattagtattggaggttaattataaacatgttaagaggagttgaaatggtgtttgcaattgattactcagtgttaaccatatctgaagctattctcagcctgtggtacatgtctctgagtagtcctagttatagctactgcagatagaatctagagaggcagttgtgaacgaaccgttggtgttttttgatggaagtaatttttctaaaaacaaaatgggtgtttttgagagtattgatgtgttgtgatttttttttaattaaatcttttcaagtataatgatttctagatttcgatagaaaggtttttcttaagtaatggttgtcatgttgatcttgagtatagggagctggaatcaatcttgctgcaatgactaattgtcccgtttctcgtttgtgactaatgtgttaaccgtatttcaagtgttcgatggattacaaggttctgag

SEQ ID NO: 26017 - DNA, 1155 bp, Mus musculus
tcccaaagcctaagaaatataaagaacgtatattatattatgcaataaactgagtattttgtttgagttgcaagtcttttgtctattagattttagttttaattaattgaaatttctgtgcatgcatgtgccttgatacaagccacattccattccattcctacaacttctcttccctatctgtgccacatttccctcccaacttcatgtgttctttctctctcttaaagctctgagcccagtgctgcctatatatgcatcggtataggaccatcttctggagaatgagtagccacatccctttcctctcccagcacccatcagttaacaatagtccttattcaggggtgggacttcctggcttcttctgtctctctcactgggctgtttgccagactgatctcatgcaggtgttacgtatgcattcacagctgctctgagtttagttatgtaacaggcctgtcacgttcagtcagtatatactgttttgctatggatatcttacttacagctctttatatcatctttacatcctctcttccgtgatgacccctgtgccttgggatgaggttttggtagataacatccatgtagaactgggtagtaggacagtcttactctttaccactcatccagctgcgagtgtctgtattaatcaccatgtgccaaaagatatttctctaatgagggatgggagatgcacacatttatgtgcataaaaaggagaaattggggtagtttaatattatgtataagatttgcttgttttaaacttaagcttttctgatttaatttcttcctgtgaacatctatttgatgtgttcttttttattataacattgaaaaatacctaacaatggaatgctctgccttttaaaagtgttgaataaactcaggttatttcggtaagtatttttaaaatgctgtattttgggcttagatatttttaacccagttgtgtttctaccgttataaaaccagtaattcatcattgctaatgtgtttgaaaatgagatgtattttcatataatttgtaaaatccccatataagcagttctgagtaacctgtttgtaagttctaaattttaggtggcataggatgtcataatattttctgttagaatatgaaatgttttctttttgcatgcagcttga

SEQ ID NO: 26018 - DNA, 1420 bp, Mus musculus
gcaagagtagtatgtgctctaaccactgagccatctctctagcctttagcatttccttctgatcccaaaggcataaagtcaagactccaaagttgaaattgtgaaaaatggtgggttttggcatgtgttgggccaccggtgccttgggctgtgggaacatccaaaacccactgtctcgatttacccccaaaggactcggaacatccccaaatgtcctccttttccctttcagccctttgtgaaaccagagaacaaattctggccaaccattgcccggatcgatgacatctacggagatcagcacttggtctgcacctgcccgcccatggaggtctatgagtctccattttctgaacagaagagggcttcttcttagtcctccctcctacgttcaaagggctgacccgatgtctcttgctggagcatttgacaagcaaggatatttcttctcctttacgtggctcacacatgagttttatacgctgtatatttttataatctttcaaggtaatgtaagcacaattagcatggtgagtggcggccacctgctgtacggcaaggcagtggctgttcgtgttgccttgattgggagccatttagtttgccggatagaaaatgtggggtgcgctagcaattttaacattttaattcaagaagtttgcagcagtcagagcctatgctgggaattcaatagacattctttttgttccaaataagtcctcgtggactgtgccctctgtgggaaaccccagggcaaatgtttacattttatacactgaagaattctcctcactaatgtgcctgatctgtcacagcataagtgtcctcctttcactgtgcggacttttttttttatctgcttttattagtgtcctaataaaactgagtttgagtaatgcgaatttcccatttgattttacacccatgatacacactcaggacgctgaagggtagcgggatctctcggcccaacagccacgttttcacggacagtcacccttgcttttgactggctaaggacaatctgtacagcctacttattagagaaggccactctggcgctttttatcttgggccataggtaacttaacctcaacttacggaagattaagtagcagtttctttgaagcccagagataacaagccaaggggaggggcagaatccttgaatgaacatggaagaagtggatcttgtcctaagtaaacctgctactgacaaggaccagtgcctccgactcaagggaacaggcaaagccttacccatgtcaaggtgaggaaccgggccgagtcctgatccatgtgcagatgttggtagtgtgtatagaaactagcaatcatagctccctccgtctggatgaatgtaacctgagaatgtccctacacagtcagtccccctattgagacaacctaactccttctc

SEQ ID NO: 26019 - DNA, 1126 bp, Mus musculus
agcctcaatgttctttctctttctacaggaattagttgctgaaggcatgggagaggagcggagaggtcttctagggtcttcattcaagagaaccagcccgttcctcactcatcaggtgttcaacaggtttgtgtggcttcagcaaatcctgcattttgtgttctggtggtggatcagggagccctggggaggatgcagtttctgatgctgaccacgctaggacctgggttattgccactcaggcgagctcactgatagtcatgccagcaagaccccatccctgatgggagccaagcatactttgtctcctgggagctctgctgtgctggggagaatttacagatgaagttcatctcaggaaccccgtgtcctcttctcagtggccccttgttgctaggggtgctctgagatccattagagtctctcccctccatatccatgagtgaatgggtctttggagtcaggactccttattttgtatgaggaccggcctgactctaatttaatggctccacccttgtgtcttatgttcacagctatcactcagaaactaatcttgtccggtatatgaagaaactggagaacaaagacatctccctcgttcacagcatgatcccactggtagctgtttgtggcctttctccttacttctagccctatccggattccccctgtgggtcatatccgatacactgcaagaggggagcaacagggcctcgaggggggtgggaaggttcatagatggggcatagccaagcactaatggatgttccttatatatgtgcttcttcaagggatcctgcaccatgaagctcaatagctcctccgaacttgcagtaagttggtcacgtctatattattaagggggtatttatgggccagttttccagttggtacagaagcaaatgacaaaaacctacctagactgtgactccgtgccttaatgatcctttactttgtcattctccaatcgtggcagagaccctgatatttctcacaacttgatcagttaaatttatggataaagctgagtgtagctgtgttcatgctctttctcatacacgcaaatatatatacacatatataattacagaccctgccaggtatggtggcatatgccattaat

SEQ ID NO: 26020 - DNA, 1166 bp, Mus musculus
ctctgatgcagacctctatccagggaggaattccagctccggggccaataccagctgcagttcctggacctggacctggttccttaactccaggaggagcaatgcagccacaagttggcatgccagtggttggtccagtgcccctggagcgaggacagatgcagatatcagatcctagacctccgatgcctcgtggacccatgccttctggtggcatacctcctcgaggactactgggagatgctccaaatgacccacgtggagggactttgctctcagtgactggagaagtagagcccaggggctatatgggaccaccccatcagggtcctccaatgcatcatggtcatgacaaccgtggccctgcctcacatgatatgagaggaggaccattggcagcagatcccagaatgctaattggagagcccagaggtcccatgatagatcagagaggtctacctatggatggtagaggaggtagagaatctcgagggatggagactcggcccatggaaactgaggtcttggagccacgaggaatggagagaaggatggagacctgcgcgatggaaaccagaggcatggatgcaagaggactagagatgaggggccctggccctagttccagaggtccgatgactggtggaatccagggtcctggccctattaatatgggggcaggtggccctcagggacctagacaggttccaaatattgcaggagtgggaaatcctggaggtaccatgcagggggcaggtatacaaggaggagggatgcagggagcaggtatgcaaggaggagggatgcaaggagcaggcatgcaaggaggagggatgcagggagctggcatgcaagcagggatgcagggagctagcatgcaaggagggatgcagggagctggcatgcaaggagccagtaagcaaggtggaggccagcctagcagttttagccctgggcaaagccaggtaactccacaagatcaagaaaaagcagctttgatcatgcaggttctccagctgactgcggatcagattgccatgctgcctcccgaacaaaggcagagcattttgattttaaaggaacaaatccagaaatccactggggcttcttgaatggttttcaactaagaagcacttagttactccttcagagtttattctgtggca

SEQ ID NO: 26021 - DNA, 1659 bp, Mus musculus
ctgggaactacataaaaattgaaagtgacttgttacagtattgatatactaagatggtttaaaggtttttggttgtatattaactgaatgtcagcatcttaagatacactttttggtaaaccaaaatactgtagagtaataagattaatgtttagttattttggaattattttgaaatattggagctaacagtctgtggtgtagatgtagggttttttttgtttttgtttttttttttttaagcattgttatctgtaaaaaggtaattttcatttacctgacttttttgagacaactaatattcttgcctggtcccacctggtgattttgcagaatagttgtagtgtcagctgaattatataaagccgcctctgaggagactcaagtgatttcctaatacatttctctaaaaaaattcttaagcaccaagtctggttgtaagtagttttttcatgtcatctgaaaatagcagttagacatggggtcggactttcttgagtaatggagggtttttcagtaaagctcccacccaggttcttgataaaccactatccatacgcagatggaatccatttggtcagcaggaatcagaagttaaaaaatcttagtcttcgaattttgacgtgtcttacagtttgataactttcacaaagtactttcctgccatcagcttaactagaactgaggcccaagtgatctgacagctctgctcaacttagtattttatttcttagaactctcaagagccatttggtcataacatacattcctatcagatgtgttttaaaataaggagtgtggaatttaatacatttcctttagagctaccatactattttttgacattaagtgtgtggcacctagacaccatgtcatatctagttaatgagcagaaacaagcacaagttcccacttgaccaagtgatagtcctctgtaggaaactaactacccagctacagagggaagagtagccttagggagagagctgacccaagggtctactttgtccttggaaagtttgagcattttcagtgtacagagttttcattcctaggctattttccatcgacttagttttttgtgctagtgttaaactctctgtggtttcctctgcttctcctttgctgaagttggtttgtgttttgtacttttgtgctagttctggctaattccaattgcttgctttcgaaattgcggttgctagcccaaaacttcttatagtctttgttataagaaaatctctgcattgtttaatgaaaattaaataaaaaggttgtataattaaggtattttgtatgtttcattttatttaatacaccaggaactttttaagagatacatgaatacgtacgtagaaaaaggtgaaactaaggaaactggtgaaaatacctttaattattctttatgtagttcaacagctggaatactacaaagacactgccagtccattgtgatacctcccacgtcagacatgctgtgtcctttggaatactgtgttccaggttcttaagcactgagagcatttgtactgggaaggattgtgttcactttactcacagcccccaagttgtacttgtaatagaaaacaggggacctgggaagcaccttactcatttgagtatacactatagtaaaagatgaaaaggaagggtaaaaca

SEQ ID NO: 26022 - DNA, 1154 bp, Mus musculus
attctggggaagtcctggctgccccagaactgtgcgctgaagatatgaagattgaatttggtgttgatgtaaccacatgtaaccaccaaaaagattgttcttgctgatgtcattggtcatgattcctagaggctatggccatcaggagatcggagccagcagaaagacaaacagtcttaacattgatctcaaagaagtaactccggaaggactccagatggtaaagaaaaactttgagtgggttgcagactgagtggagttacttctcaagtcagacagtcagtgcagggtggtagtgctgatgggctccacctctgaccttggtcactgtgaaaaaaattaagaaggcttgtggaaattttgggattccatgtaacatcctctcataaaggaccagatgaaacgttgagggttgaaacacaatgtgaaggggatggtgtacctgctgcatttgtagcagtggcaggcagaagcaatggtctaggcccagtgatgtctggtaatactgcatatccggttatcagctgtcccccgatcacaccagactggggcgctcaggatgcgtggtcatctcttcgactgcccagtggtcttggctgttcaactatactttccccagaaggatcagctcagtttgctgctcagatatttgggttaaacaatcatttggggtgggccaaaaacttcgagtgagtatattgaacacctggatatccttaaagcaggctgataagaaaatcagacaatgcaatttgtgaaagagcaatttaatttttaggagaaaagttacttagtcctagtttggatttaaagaaaaacatcaggcaaaatcatttcacataagagaaaacaattcagtttactaatgaacaactggtactcagtgtttatgagttggcacattgtcagtggatattactaatattttctagctctacaaagtgatatgtccctgtaaccttagcactccagagcctgaggcagcaggatctctaagttagggccaccctgaactgtgtattgagactctacttgcaggggagggaatctttatagttagtaaagttggcatgacattactaaatttattctcaccctatgtatggtcattgttgggtaaatatgtaattatggaactggagcaatgtgtctgc

SEQ ID NO: 26023 - DNA, 1185 bp, Mus musculus
ctgaaacagcgggaaatacctgagcctggagtcttgtcatgcgtggagattggggctttagttttatctttgttggtggattggctctcttggtggcactgttttttgatgtgaaggatttggggttctgtttatggggtctagctatgtcatcaagcccatttcctgtttctgtcgaaggctgaagcaggaagcgtgtcctcagctttacagtgcggccttcatgttttaaaactattatacgtagaagacgacagaagtttgttttttctcctcttccagacaaaagtaaatgtgcttatcagagagagtttaaaatagtgggaggaaaaaaagcagaccattattttataattctgttatcctgagacaacaggaacttaacaaataatgcctggactttcatcccattgtatttatcatgcatttatattagcaaaattgatgttttatagctgatgtccccatcataaaactctaaatatcactataaatatagaaatgggatacaatcttgactaggtacttagtcagctgtttaatgttttgttttggttttggtttggggttttttttttttttttttttttttggtttttcgagacagggtttctctgtatcgccctggctgttctggaactcactctgtagaccagactggccttgaactcagaaatccccttgcctcttcctcccaagtgctggaattaaaggtgtgagccaccgctgcccagccctgtttaatgaatttttaatgtatttctaatttttgtgataaatgatgtcttggaatctctgattactgaatatttatggaaataccctttcatgaaatgtctgggttggggtaggctctgctagcattgggattctctgaagtaaagggaaccattgttcatagtacacggctgcatgactgctttcttgccattatatcctttaattttgccaaccaaaagtcgctcccccctggtacattgagggctgctacatttcagggtcattcaagcatctatgggagcagagagttcaaaagagagaccattagataaactgtaggactgtagggcagccaagagaaagaacactctacagatagtgtgaaatctaagcattaaacactattaaataaacaaggtcaagtggagactggaagatgtcaccaaatgcaaaacttctcagagc

SEQ ID NO: 26024 - DNA, 1165 bp, Mus musculus
cccatatgattcacccactcctctcccatcctataggttctgctttcacttttgtgaatgttacacttgtcatataaaagcctttttaattagacaccattttatttacctacttatttttttgtgcatttgatgtcatacttgatttccttgaagttattgtttgaaatctcatgttcaaaacttgaatcctttttttgaagcaagttaaaatttatgaagaaaatgttttaatatagttttaagtgggcagaaagagagagaagagagaggaggtggggaggagggataggctcaagaaaaaggcatagtatatatggaagggggttagagcaaagatgtaggtggcagtgtgtgtgtgtgtacacgcttgcttgcttgcttgcttgcttgcttgctaagcctcgtacatgccaggcaagtgttctatgactgagtcacatacacagcctatgtctattctgaataatttttgtgtatgatggatctacttggattcttttaatatcagagccactgattgaagaaactagtttttcttcattgtacattcttggcgccctttctgaatatgaattgactgtgtgtgtgtgtgtgtgtggctttattctctggcctttggattctgtgccaacaatctgccctataccagcacaatcctgttttgattacggtaactctgcaatgtgtttgaaatcaagtgtgatgcttccaacttactttattttcctttatgaaagctgctttagggctggtgagatggctcagcggttaagagcaccaactgctcttccaaaggtcctgagttcaaatcccagcaaccacatggtggctcacaaccatccgtaatgagatctgatgccctcttttggggtgtctgaagacagctacagtgtacacataataaataaataaataaataaataaataaataaaataactcttcaatacacaaatatctcaacacggtccaaaaaaaaaaaaaagaaaagaaaagaaaaagaaagaaagctgctttatctacttggggtcttgtaattccacatgtattgttagatttctttttctatttttgtaaaagatttggttgagattttgataggaagtgcatcacgtctgtgggtttattggcagtgagaacatttaacagcgtcaatttttgtat

SEQ ID NO: 26025 - DNA, 1500 bp, Mus musculus
aatacagttgactggggaggaaggtaatttatcattttatttggctgatgaataatccatgatcataatttttctaaaattaaatctgaatatatagagattcagaacaccttaatgcctagtcttatcacgtgggtaagtctgtttcatcaaagtaaaactctaaaattacctcgattctttatcctaattatctaacatatcaatggcttcttctgctaacagtttcataattcttccataaagaaatgttaggctctttgccccatctactgcgaggatgaagaccattctcagcaatcagactgtggacattccagagaatgtcgaaatcactctgaaggggcgcacagtcattgtgaagggccccagggggactctgcggagggacttcaatcacatcaacgtggagctgagtcttcttgggaagaagaagaaaaggctccgggttgacaaatggtggggtaacagaaaggaactggccaccgtcaggaccatctgcagtcatgttcagaacatgatcaagggtgtcacgctgggcttccaatacaagatgcggtctgtgtacgctcacttccccatcaacgtcgtcatccaggagaatggctctttggttgaaatccgaaatttcttgggtgaaaaatacatccgcagggttcggatgaggacaggtgtggcttgttctgtctctcaagcccagaaggatgagttaatccttgaaggaaatgacattgaacttgtttcaaattcagctgccctgattcagcaagccacaacagttaaaaacaaggatatcaggaagtttttggacggcatctatgtgtctgagaagggaactgtgcagcaggctgacgagtgaggaggcctcagttcctggccccagaaacgagatcctgaccacatgaacaatttgggctcttttgggagaataaaagacttatatattgaaaaaaaaaaaaaaaaaaaagaaatgttagtaaaaatgtgtagcataaaggcaagtaagaaagcctgattgttcttgcctgtaagctcagtactcaggagacggaggcaggggattcactgagttcagagtcagcctgagctacatagtgagaccctatctcagagcaaccacagcaacaacaacaacaaaaaaaaacgagtcaaacataaagacaaaggaaaatactatgttttgtgggatgaatcctcagtgagcatgtgctgtgatatgagcacagccacatcaaggctctcagtgcttcacacccacgggggtggcaaagccttctttgggtcaggcttcagtggcagagcctcctggtccacggatgttaaggaggattgacatttagctaaagtggcatatgcagaaactatcacccacagcctctgatgactgcagcctgaaactgctcctcctactgagataagctggcccacatcctccccattcagctgtacatataacctcacctctttgttcaaccttgtactgtaaacccacctccagga

SEQ ID NO: 26026 - DNA, 2083 bp, Mus musculus
ccgtgctagtgagcctcccctaacttacacactggatgtaatagttttaaataaataaagatgagattacattttaaaatgagagaatcagttactgttaagtatagtaggtattatattttatggcacagatctctaaatttcccctccaatttcttgttgaaggtctcagccagtctcctctccagtcatcctccagtttggacacgcggagacgctcctgccgctcctctccctcatgggctacttcaaggacaaggagcctctgaccgcttacaatttcgaggagcaagttaatcgcaagttccgaagtggtcacatcgtaccttatgcctcaaacctaatcttcgtgctttaccactgtgacaacgcgcagagccccgaagaacaattccagatacagctgctgctgaatgagaaggtgctgcccctggctcactcgcagagacccgtcgggttgtatgaggagctcaagacccactaccgggacattcttcagagctgccaaaccagtaaggagtgcagcccgcccaaagcgaacatcacgtccgatgagctctgaggaccttcggctgtgccatactgaggggtggttgtgtttgcaggaggtagccactctagaggccgcggcagaaggagctctgtgagtccaaggccagcctgttctacatagtgagttccaggccagccaagactacatagagcaataaagcctggtctttctgtcttttcacagaaaataatagttccttttaggatctagacatacgggtaagacatgactctccctggagcagctctctgcagaacaaaaactaattcaatgaagcagctgtccctcccagtgtttgcagagctgagattttcctaatgacctaagaagatactgacgtagaacggtattagaaaatgacacttcaaaaatgttggataccaaagcacggtagctgccgggtgagcggcagtgattggcagagatggggacttgagtgaccatgttgggttcccttcttctccttcttgcaggacacaaatgatatcgcttagtcataagtgtggtagactggatcctgaccagaaggaggtctgatataatatccatccagacaagaaatcaacatgctatcaagaaccaggttgaagcaaaactgaaagtgtgtgatatttttgttgacgttatttataaaaatatttcaacgctgtcaataattgtctttaacctccaagtaggtcttgcagaatcgtcttcatttcatcagacctattgggggtgaacagtaattaataggaggcccagcctggcagacgcttgctgacgctccttggctcttgcctgcttgtctttttcattccatcatggcttcccttttcatagctggatcttccgtgaagtgttccttttggtggtttggattttttttttttttaaataaagaccttatctgccgaatttaattgtagagatttgaacccgatcaaagaaattttgagttctctcaaataccataaaagtgtttgctacaataaataaaattcttgtgactttactaccaagtcatctctgcactcattgaaattcagtcattggtagtggagggctggaattgtaagtgtttggcttgactaagcaacctagggcacgcttcccttgtttcttcccgagaatgggctattttagtgcatcttattctgatttgaattcccttcagagatgatgccttttaaagagagggtttggttttgggttgaaactgtatgcttaatcaagccatgtcagtaaaatcccaatataatctgcatgagttttacagtttacttgtgaggaaggggtcttatgaaaagaaatctatagtcaggctatgcatatgtctggacagacattgtgtaatgtgcatgcggatattttcagccaaattttcattggttaaaaaatgaattttaggccttaaaggaaagctaaaatgcttaccattttgataccagctaaaatgcttcctagttactttaatgtttaatcagataaatggtctggtcagtaaaactgctctaatttagggattttagggatacagccaagagattt

SEQ ID NO: 26027 - DNA, 2154 bp, Mus musculus
accacctagaatgggttcattgcgttgccattctctttgggctcttgaaggaggaagaaactgttgttactctcttgtgtaattaaaaacaaaatcatttttcaacacatgcatcttttgaatcttggtaaaatattttaggtaggtatactctataaagagatttggcaatttgattgttttgtttgcattttagtcacgatgaagatgaaatccggcctgtgcaacagcaggacctgcatcgggcaattgaaaagatgaagaagtcaaaggatgcagcctttcagaatgttctaactcacgtttgtttagattaggagttgaggatcatttgtgctgtccagtgctcccgtctgcacagcagtgagggaaatccaggcttgggtcatattctcagatctttgctctgttatataaacggtgttattgcttgtcagaaatcatgcggaggaaactgagtgcagcctgagtgtgggtgcttgtctgacctttttagccatatgctgttatagccttatagagtctaagctggtcttaatggagtaaatgatttgtcattagtgaggaatggggtgtggttaggtgctggtttctagacacgtgagtatgaatgtgagtgtgtgtgtatgagtgtatatcaaatgtatatatccactttttttaaatattctgtagataggtttgaattcagaagcttttttccccccaactactgaatccaaaagcaccagatagtctgtagcaaaactgggatttaaggcaggatttgacaggtccagggagattcagccattcctaggtgtcactaggtgtttgggcagtttttttaagttgaacatttttctctgcggttggttgaatcaactacatctgaatatgcacgtgtctcaagtatagtggttgtcaggagaatcagatgacaaacacagtttgctcagtgatcagcagggattattccacctcatcctgctgtgacaccgagtagactttttgaagttttacactgaattacattaagaaggattaaaaacctttcaaaagaatgggtttaagaaacctcagtcctctttaatacgtgtacataattctcagtgtaacaggtctgtaactgtattaatgttgtttgaaagttatatgttctttaattatgttcaaatttcatttggtcacccaaacaaaatgatagtttatataaatagtcactactaaatgtgctaaaaaatactcactttgtaacttaaatttaaaatttttctcatttataaatgtgttcaaataatacacatcaaaattcttgtgttgtatctgtagtcacttgatgctatgtgaaccacatataaaactcttcttttttcaaacctccagtagccagacttctgattcaggcaccttgacatgtgacagaactagagtacagtgccacagcacagtcctaaggtgcctctgagtcaccagagagattaaacgacgacgggttttattatttgttttatttctttgaaaactaaattttcctatgtttactgagttaatttctctagtaatgtgtctcacaagaaccttctagacactttcttcctccatttgtgttttggggttatagattgcgggagactacttaggataacaaaaagcaagctgggcaagattgtaaagatgatgggaaatgaatgctaatacaagacgccaagaaacatatcctgtttttataatttacaataaaagtcctttccttttgattcttttttccccacttagttcttgattgttttcagttgcttggattgcggattttgttgtttataagatttgtgtttgggcagtttttatattgcagttgacatttcacatttttatagcagacattttaatattgatttattctgtttaaatatgagttttagtaatttaattttaatgtaatggcatgttcagaaatgattgatgtgtatatttctttgtgtctttttcatcttctattaaattcaatagaatttatccaattacagcactgaatttttatggttctaaccagatgaagagaaatacactaatcccaacaaccatgactcctgtaggcatattaagccatcaagtcagagaaactatttccatataacttaggcagcttttgagtgtttgtaatttccattc

SEQ ID NO: 26028 - DNA, 1417 bp, Mus musculus
acattcattctgttacataattttgtcctttttgctggccagtctggtagataacctcttgccctgtagaatttttctttcccttctacacatttgaagctatttattctttttcttctattgaaacaatttacatacctgcttattttaaaaagcctaagttccccaggcatggtggctcaccacagtaatcccagtacttaagaagccgagactcagtttgtgtgaattcaaggctgtcctgggctacagaaggagagagactctatcttaaaatgaaaccaaaatcttgggtatgtacacacacatacacccacactctgcttaattaccatctacaggacttctcggtcaagtattcagaccttccccccttttaaagttaagttagcttagttttgggttcaagtgcacatttgtttagaattgaagtccagttaggtacatgttttgcaaatacgttttctagtatagtttttcttttcattttcttaacagtaccttcttatttatttatttacttacttatttatgagacaagttttctctatgtagccctgtccctggttcgttctctctctctctctctctgtagaccaggctgaccttgaacttgaactcatgcacattgtattctaacttgctcaataactgaccaggattgtcctcatcaggataatacctgaaactgcataaataatccccaactctctttgttgttttacgaacttcacagcctttttaatagtcttaaattatacaatgaataaattatccatcattcgttactaaggttaaggacccttttcttttagactctttcctacgaaatcgttccagttctgaccacgaagctacagcgatgatgaaagctcagtttatgagtctctgggatggactggacactgatcacagctgccaggtattgtaacaaacgcttccataaacatgtaaggttttgttatcagtaggagctttatagggcttcttactatacttttgaacaaaaaatcttatttatttttatatttagtgctaagtgataaggaaccaaaaggacatagtttttataaacttcactcattttaattactaccatcaggtttatataagtagaagagctcacactccgtgtatagttgctgctgtgtgactctgaacctcagagtacatatattgaataatgatatgtatctgcctctaatcactgcttcatcaatggtcataataaaaaataatgttctgccgggcggtggtggcgcacgcctttaatcccagcacttgacttgggaggcagaggcaggcggatttcttttaaatatttatttatttattataagtacactgtagctgtcttcagacactccagaagagagcatcagatttcattacggatggttgtgagccaccatgtggt

SEQ ID NO: 26029 - DNA, 1159 bp, Mus musculus
ccgagtgtttggggacactggctgttctcacaactgcctgccaatctagtctgagggtacccgatagcctcttctaaactcgggtggcaggcactacatgctagtggcatgcaagtggtgcacagacatacattcaggcaaaatactaaatacacaaaatcataataaattaaagatcttttaggcttgggctttttttctaggtatagggaatgacttcctaaattttttttgtatgtgtaattaatctcagttgttattatctttaaatgttgggttctttgaaagatccaaaggaaggaaaaagaagtgggcagggcgagtagatttaaaatcccttgatgtcttcagttggtgggcgacagcttcctccatctacgtatgcgtgttcaaaagcagcaattagtgaccagcacacagatttaaaatattggaacgtacggcatttattattaactttggcttttgaaagttgtttgtaagtctctatagaggtatatcaatgactgtatgagaagtccttgttgtataagagctaaaatcagggctgtggagatggctcccttagtaaagttcttgctattctgagttcccattgttctttttttttttttaatagaagaaaaggtttattttactcacagttccatataacagttcattatcaaaagtaatgaggacaggaactgaaacagggcaggaacctggaggcaggagccaatgcagagagcatgaaggggcactcctgactggcttgctcagcatgctttcttttcttttctcttcttttcttttcttttcttttcttttcttttcttttcttttcttttaatattttttattattacgtattttcctcaattacatttagaatgctatctcaaaaatcccccataccctccccccaccaccacttccctacccacccattcccatttttttggccctggcgttcccctgtactggggcatataaagtttgcgtgtccaatgggcctctctttccagtgatggctgactaggccatcttttgatacatatgcagctagagtcaagagctccagggtactggttagttcataatgttgcacctacagggttgcagatccctttagctccttggatactttctctggctcctccattgggggccctgtgct

SEQ ID NO: 26030 - DNA, 2513 bp, Mus musculus
caaatccagaggctagcagttcaacttctgtgactccagatgttagtgacaatgaacctgatcattatagatattctgacaccactgactctgatccagagaatgaaccttttgatgaagatcagcattcacaaattacaaaagtctgattttttttttcttatcaagagggataaaataccatgaaaaaaaaaaaacttgaataaactgaaatggaccttttttttttttttttttttttaaatggcaataggacattgtgtcagattgcagttataggaacaattctcttctcctgaccaatcttgttttaccctatacatccacagggttttgacacttgttgtccagttaaaaaaaggttgtgtagctgtgtcatgtatatacctttttgtgtcaaaaggacatttaaaattcaattaggataaataaaagatggcactttcccattttattccagttttataaaaagtggagacaggctgatgtgtatacgcaggagtttttcctttattttctgtcaccagctgaagtggctgaagagctctgattcccgggttcacgtcctacccctttgcacttgtggcaacagataagtttgcagttggctaaggaagtttctgcagggttttgttagattctaatgcatgcacttgggttgggaatggagggaatgctcagaaaggaatgtttctacctgggctctggaccatacaccatctccagctccttagatgcacctttctttagcatgctccacttactaatctggacatccgagagattggctgctgtcctgctgtttgtttgtgcattttaaagagcatattggtgctagacaaggcagctagagtgagtatatttgtagtggggtacaggaatgaaccatctacagcatcttaagaatccacaaaggaagggatataaaaaaagtggtcatagatagataaaagacacagcagcaatgacttaaccatacaaatgtggaggctttcaacaaaggatgggctggaaacagaaaatttgacaatgatttattcagtatgctttctcagttgtaatgactgctccatctcctatgtaatcaaggccagtgctaagagtcagatgctattagtccctacatcagtcaacaccttacctttatttttattaattttcaatcatatacctactgtggatgcttcatgtgctggctgccagtttgtttttctccttaaatattttataattcttcacaggaaatttcaacttgagattcaacagtaagcaggttttgttttttttttttcctagagattgatgatgcgcgtcctcagtccagtggctgtcagacgttcagcccctttgaccttacacattctattacaatgagttttgcagttttgcacattttttttaaatgtcattaactgttagggaattttacttgaatactgaatacatataatgtgtatattaaaaaagtcattgtttgtgttaaaaaagaaattagagttgcagtaaatttacagcactgcacgaataataaggcattgaagtttttcagtagaaattgtcctacagatgctttatcgacttgctattggaagaatagatcttcttaaatgtgcagtgttgagtcacttcgttatagtggtagagttgggattagggcttcaattttacttcttaaatatcattctatgtttgatatgcccagactgcatacaatttaaagcaagagtacaactactatcgtaatggtaatgtgaagatgctattacaaaggatctcctcccaacccctcgggaatttggtgtctttcaaattatatcttgaccttgacatttgaatatccagccattattagatttcttaatggtgtgaagtcccattttcaataacttattggtgctgaaattgttcactagctgtggtctgacctagttaatttacaagtacagattgcataggacccactagagaagcatttatagtttgatggtaagtagattaggcagaacgccatctaaaatattcttagaaaataatgttgatgtattttccatacctcatcagtttcactcaaccaataaagtttttaaaattgtaacaaagctcttaggatttacacatttatatttaaacattgatacatgaatattgactgactgttgataaagtcagagacaacttttcctgagatctcaccatggaaatctgtacacccccttgtctttcctaaaagctgaaagtggctgactaaaatgcaaagcagctgttgatgttttgaagatagtgataaacactgttctttgttagttttgggcacagcatgctaaactataacttgtattgttccaatatgtaacacagagggccaggtcatgaataatgacattacaatgggctgttgcactgttaatatttttcctttggaatgtgaaggtctgaatgagggttttgattttgaatgtttcagtgtttttgagaagccttgcttacattttatggtgtagtcattggaaatg

SEQ ID NO: 26031 - DNA, 1121 bp, Mus musculus
tcaaatatactatctcctttctaatattcttaaaggctaaggagtcctttcaatataacagtaagataacttgtgatgttttagaagtaagcagaccattaatgtcaatgtggagtcttaatgttacatgaagttgatagtttctctgtgacccatttaaaaatacaaaccgagtagcatgcaattatgtaaagaaatatgaagattatatgtagtcacacattttctttagaattcttagtttggtgaaaacttgaatataaaggtattttgatttatatgacattttgatgatatttgaaaaaaaggaatttcctgacattttgcttttagatcatgtcccccattgtgctgtaatttaagccaacttggttcagtgaatgccatcaccatttccattgagaatttaaaactcaccagtgtttaacatgcaggcttctgagggctcccggagaatcagaccttaagcccagttgatttacttctaacgtgaaacttcgagttcctgtatactttgctagataatttgtggtacatctaaagcttagtcttaagtggcttgtgtgtggattttattcaacattcttgttgctagggtagagagaaatgttgctgagtagaaacaagagtacccagttcaatgtggtacagagagcagtccctaaaatctgtacacagtgtaatggaccactttaggagtcaagaggctgatttttcctatgaaattacattgcaacaggaagccttctagtatagttccttttactgttagaatatgtttttatgcatacgctatagctgctttcccatcttccaacaacaggtatcaggatgtaagcaagctttaaacagtgtgaagatggcaggatagtgtcatcggtaacagtcctctgactctaaatgtagttgctctgtaacactttgtgaatataacatcacaattctcatgtccttggggggggggggcatacccagtattagtatgttttagtgactaagcaatcatttttctgtttactcatgtacattttctctttaaaactaaaacctgtactgtgtatgtctccaaagccttttagcttagtttttaggaaatgaacactgaatggatcactttttag

SEQ ID NO: 26032 - DNA, 1158 bp, Mus musculus
gcaactgctataagatttattaaatgttttacttatgaaaagcaatagtaaatgaagtcagagttgtagaaacatttaatccttgaccaattgtcataaacaaatttctttttcatggtttttaaactgaaatgctaaataaactaaatacatgtgtttgacatgtaacaaactttggagttctaaaaataaaacgtaaataaaattgcatcttctgaggtgatagtagaaaacaaacaaacaaaaaaacttagaattttggaaatgctgaatcaaaaatcatcaaaaggaatgaaagaaattcacaatccaagtaaggtgttagaaatcagttcagtgtaatcaggacggagtcaccacttaaaaacagaccctttgccaaatatcatcagtcgctcttgtaaacaacctgtgataaaggtacaatactttatgtcagatgcaattggagacttttccttcaaatagagtctttactcttagttctgtcatatatggtttcgttgggtttcccttagtgccacagaccctctgggcccctttgtctgtgtggaacgggtctctggtcgtaggtgggcaaagcgtcggatggaatgacagacagatgcacacaggagaggttgtgtagaatctgaatgtaatttgtcaaattgagcatcaaactttatacagaagaaaatagggaagttgggtgacacatcagcaaggtacaaatgaggttaccggatgcttaatgactcttacacaaaacagaggaatgtaagcacaaagactggcaggaactgggcaataaaataactgagacaaagtcagccctacctaaggtcagctatagtcttagaagccaggtgtgaggtctttacactccaggggcaagggctttcacacccaagtcatggttctaattagggaattctgttctagctaaccatctcatgaataatgcaatactctaaaaccacagcccgatctacttcctaaaccattgtaaattcctgtatatgggagcaacttggcttttattctaagtgatagtgtaataccagaggcaattctgaatgtcactgaacaggcaacattcttcctgaattccaagcccatggtcagctcaaggactttctaggacattggaacactggtgaaggcttagctatgtca

SEQ ID NO: 26033 - DNA, 1188 bp, Mus musculus
gtcctgtgcatgctgcctcaatctcaatgagttcatatgagctcagttgatttagagagaactaataaattttttatgaaaggaagctatgacatagtacaaatcatagtcttgagattagtaattatagcagtattttataattgtttcctttataaaaacatttattgaaggcccaagcgttcaagtggtagatggaagaattactactgaattgggaagattagattagattagattagaattagaggcggatgctagtacagaagctaaggttgaggagcctttgttcacttggatgggttcaggttgacatttcatttcttccttattctcatggaaaatcctgacaacaggagccttcttttgcctttggagcaggtgcagaagtctccctcaagcactgtgtgactcagatccacctgaaagataacaagtgggaagtctccacagacactggctctgctgagcagtttgaccttgtcatcctcaccatgccagctcctcagattctggaacttcaaggtgacattgtgaactgtgagtagctttgctgttaccctactcagggcgggatgaagggacactgactggcttttctctttgagtggaagatctgttctcaactgtacagatgttatgttttaaaactgcttgtggcctactttctgaagttagtctgtgtcatgaagctcagagaatggtttgtaactaattaaaattgaatgagtttcttggtttttaaaatggtcagtgttgtttctgatgtgcagtagtgtggcccaaaagagcagtatctttgtggccatcctgaaaaaagtcattcctcatggcttcctactggattgcttcatttcctgtcttcttctctgggttactactaagtgtttactgttattggatgagtaggtgagtgtcatagagcataaattatcctgacagagctaaaatcatgttaaaagagctaaatttataaaagaaaaaaaatgataaggaaatttctttgttcgaataaagaaaaggtgaatattttttcttactaaaatgaacatattttaaggaggaatacggtgagctatagataaacagaatgtcctatctgtataaagaaatccaatattgtttttatattctcttttcctatgcagagaaactattaaagcattataaagattttactgactaaag

SEQ ID NO: 26034 - DNA, 1213 bp, Mus musculus
aacattcacttgattaaatcaaagtctaatgactttgtaaattaagtgactttataatcaaagtccagtggcttctgtgagtagcctttacccatctattgatgttcccatgattactgtctttgtccatttatgggatgttgtattactttattggcttggaatatgacaaatcttccctgtactatttctggaataaagccaacttattaatgttaagcagttttctgtttcttaaaagtatttttttttattcttccttaacacattacaaagtaattgcagttttcactctccactcttccagttccatgctcccatctcccttctcccccagatccacttctcttccattgtccttcagaaacgtacaggcctcccaaggcttcacaattgacagtgagattagacacaaaaatcatcctgaggtaacccaaacccagaaagacaagcatggtgtattcatttataagtagatattagatcttcattaaagaaaatccatgctataatccacagagccagagagactaagcaagaaaaaaggggtcaaacatggtacatagatcttcttcagaatgggaaatagaatgaatttggtggctggacttggggtaggtggaaatgagaagaagaaggatcaagtgaggaggagattggagggattaagcactgggagagacaactggaattagagcaactgaggagatgaggtagaaacttagtgcagtgggaatccactggaatctacaaggatgtccctagcaaagaatactgacactggaagagatggagccagacccttccaacttcggtaaccagtcaagccttttggtagttagataggaagccaggcacaaaaccttcaactttcttttatttaagaattgggagtgggtgtgggtgggtaggggagtagggggagggtctgggggacttttgggatagcatttgaaatgtaaatgaagaaaatacctaattaaaaatcacagttatttttttaaaaatttacaatgtattttattatatgtatttttcctaattaaatttgtttaaatatacataagatgtatttttacattattttatttatttacattctaaaaatgctcccttcccagtttctctttgcatagtttttacctcatctctcctctccttttcctcttagacagtgctccccaccaaccacccacatccacctcattctact

SEQ ID NO: 26035 - DNA, 1186 bp, Mus musculus
atttttttaaaagaaactgcatattaatctttggatatttagtcattagtattcctgtatatttgcctcttggattttataaggtatggaccatcccttttaaataactacaaactataaaatctaaaagacatgcagatgtactaagggaatttatgcttgatgagggtgaggtaggaggaagaccaagatcctgtagaaataactctacttttgcacagttccatattgtttgacattcactgatgtaagtgaaatgaaatcttacaacatccctgtgtgctagtttcagaatcttttggctccatcatgcatatttgaagttgttgcttacattgtcagtcgatgctaatatggtaaaccatttgcatgattgattttgcatgattgattttgcagccccaaagatggtagtattttgtcagcatggcttgcttgcaacacctggtgcatgggtttccaatccgcctgtcaacagcctggccttcatcctagcagatgctgggtatgatgtgtggatgggaagcagcagaggaagtacctgggcaaagaaacacgtggccctcaacccagattctaaagaattctgggattttaggtagggaacaattccatgtgatttctacttttagtttaatggttaaataattttgtcaaataggattaaaggcatttcgcttagagtgactttagaagactgacttgggtaacctggtttgggactttgtgttcctgctaaaacatataataattatagtataattatcattatagcgtatattgtactattgaaatactaataactcttttaatcaatgtacttactttaaaaacttatacatatttactttaattactgtgtgtgtgtctgtctgactgtctttttgtgtatctctgcacataaatgctttactatatgtttggaggtcaggaaacaacttaaggggattggctatctccttaatccatgtgggtcctggaaatgaaacttagggcaacaggcctggaaacacttgcctttggtctctgagtcttcttacagacctcacccatgtctgtataaaattacttcattaaagtaaatttgatatatttaaagcaatgattttgtaattgtagacatttgcatacagacatcctcccgtatccttcactttaagcatgtattctcatttgtgtgtgtata

SEQ ID NO: 26036 - DNA, 2032 bp, Mus musculus
aaggtgtacattgctctctggttaataagaagcacgctagctgtcttatgcttcattgtgactgactagcaagcgtccacaaccagtgatgccttttaagtgtctctgtgatccttttgtttaccttttacagttgttttcggtgcatatgtgctgtgcatatatgtgcctaagtgtgtgtgggctgtgttctggcccttgtgtggaggtaatggctcacatcaaggtgtcttcctcagttacttcccatcttactttttgaaacagggtctcttgctgaacagggagcctgctatttcagttacactggttggcccatgagcctccaggatctgcctgtctctaccttccccctcaccaatgcggtggaatggggtgtctgtcccagccggcatttttaccctgattctagggacaggaactcaggttctcatgcttgtgtagcaagcccttcactcaccgaatcattgcctcaaaccttctgcagtagaccaagctactcagttgcttttatattcctgcccaacacaagtgagcacacacaggacatttcaagctgttgtttgctagcaaaaataagtctgccagtgacctgaacacacgatgaaaagctccttgctctgagcttcatgtggcagtgcaaacctacaatcctagttctccagaggttgagacaggaaggctgctgtaggacttagggttcatctagaaagcgagactttgtctctagaaaaccaaagacaaaggaggaaaaaaaaaacccaaagtactcagttctcatccctttgccttagaggactgtctagcccagagttcctgtgtttacctatccaaacaacattttcatgttttaatgcattagcttcctagtgaaatccagtgtaatcccagcttctccaggaataaatatcctctcttcagtttcatcagacctcaataacaaaatttttcaggccaagccccccccccccccccaaataagcgtagactcttgaaaagcagtttgcactgattaaaaaaattaaaaaaaaaaaacttgaagattaatacaatgagctctgttggttccgaatgtgtagtctggtcacttttctgtggagaaacattctgtggagggacaaaccactgatttgccagaagcgaatatggctgccgtgacggtgcctgcatgaagctaaagctggttgtggtggcaagtggtccgattccctttcacacaaatgatgttttcagacagagctcggctcaggaatttcgctttgagaatcagtgttgtatgcacaatgttttactgagcctgctttgctcctgcgtacaggaagcccacatctgttcacttggcttgctggcgatggctgtcaccactagacagttgataagttttctgatattctgatattaggtaccacggatgcaggaatattacttgatattggctcatacagacaggcagaatgatacaactttgtaacaatttaaaggtttgtatttaaacttttcaataaatctcagcctcataggcctgaacatcggtgtggtgtttgctttacagtggctaatctatacattttcttttagcaggataaaagattttctttctctactctccccaagtcccaaaacttcgatcacacagtccatgaacaattggagagaaaggaaggggaggctgggctgtcttagtcagggtttctattcctgcacaaacatcatgaccaagaagcaagttggggtgaaaagggtttattcgacttacacttccatactgctcttcatcaccaaggaagtcaggactggaactcaagcaggtcaagaagcaggagctgatgcagaggctatagagggatgttgtttactggcttgcttcccctggcttgctcagcctgctctcttatagaagacaagactgtcagcccagagatggtcccacccacaaggggcctttcccccttgatcactaattgaggaaatgccttacatttggatctcatggaggcatttcctcaattgaagctcctttctctgtgataac

SEQ ID NO: 26037 - DNA, 1271 bp, Mus musculus
ttagtactgaaacaaaagaaaaattttcatagatgcctttttgttcccaaatcagtctgtcttgtctcttctctctcctctcctcccttttctccccgccccccccccccccacctttttctttgagacagtctcactcgtggcccaaactggccttcaactcagagttctgcctcagctcctgtgtgctgaggtgtgtaccaccctttgggtaaggtttctataaagtaccatgtagcgcatgatctatgccacacatgtctctaaaccctggaatagcactggtgaggtacttgagtctcaaaagcacgactgaggctggattctgcggaatcctgcactggctcacttcattctgagtgcctgtgaacagctgtactgtaggaacctccatctctctgcaccttcctttagatctgtgtactcgacggaaagggaatttagtgcgggatgcctgcttttcgtatgtcacatcctgtggcctcatccttttctcttctgttccccagcattcccgtggtttggtatggatatcggtggaaccctggttaagctggtttactttgaaccgaaggatatcacggcagaggaagaacaggaagaagtggagaacctgaagagcatccggaagtatttaacttctaacactgcctacggcaaaactgggatccgggacgtccatctggaactgaaaaacctgaccatgtgtgggcgcaaagggaacctgcacttcatccgcttcccgacctgtgccatgcacttgttcatccagatgggcagcgagaagaacttctccagcctccacaccaccctctgtgccacgggaggtggggctttcaagtttgaggaggacttccgaatggtaggttgggcttgcccatcttcgaacagccagctctctcatgtgatcatagtgtgctcatctcatgctaagacctggaccattaaccttgggacctgggcatgtctgtgccgtgggttcctcttccatatgataataaatatatgaccctttcatagtgttgtttcaagaaaggttaagtgaggaactatgcccctactcttactgagtactcaacgtccgttattatcatcactctgtagcacaggctggccctgaactcagtatgtagcgaaagataaccaaaactaacggttctctctccaagacctggtgtgacagtcatatgttgccatgtgagtgtttatatggtgctgggattggacagttactcctatgtcatatgtagagacaagatgatatatatcac

SEQ ID NO: 26038 - DNA, 1195 bp, Mus musculus
aggcatgggaggcatgggaaagaaaagaaaatgtgtttcttcatgctcttagaccttgtgcctgtgtgtcccaggaaaatcataactttggatttatttatacccatttcacgatttactgttgttgcttttgaatggcttgaattgttttgaggtccttgttcattgtggtttaggaaacagcaagggtttttgcctttcaatagttgtaaaggaggcatccattgggcccatcaaccatcctgaggtgagttttggtttagttgaagcagggtcatatgcaggcgagccccagacttgtgatatagcagattgacctcaagagtcatgcacgattcttttacctctgctttccaagtattggggccagacctgtgtcacccgttacaatggattaattgctctccaattagatggccgcgccatctttatttagtccgtgttttttgtcgtggcaggtaagctgaagtgtgttagctgaagtgtgttgtagccaagtgcaaaggagatgttcctgtttgtttctataaatagaattcaggaggcaaaataggcacaacccaggccaagaaccattcagagtttgtctcagaggtgacgtgttgtaacttctttgtcttgagagccatttgggcagtgctggggtttcagaaacttttctcatttaggaaaaacataaccattactcagaatccgagagcagagtgttagggactggcaggttctctacactcagcttttgtgactatatctcacttgaaatctttttttttcttcccttaccagctcagcttcttctctttgcaccctgcatgttaggaaagcaaatcccagcgatcctttcgtttcagttactgtgtttttgcctatttttctgaaagataacctctttaaaagtgcaacgtgttatttccttaaaattagtgatatgttatacaatgtgtaactagatacatgagtttaagttatttaatcacagtaaaacttgtgcaactattacaagccaaggaataaaagtctggctgcttattgctgtcttctgagagcccctttgtttgcaagtgcctgttgttatttgtatgtgattaatttttaaccgtttgttcatggtctgagatcagcaacctcattcttggaattaaatactattgtgacaaagctgctttgggttagctcccgaatcacgagactagaa

SEQ ID NO: 26039 - DNA, 1225 bp, Mus musculus
taatctagaaatcaagtcaggagactggagaaatagctcagtaacagaagatggaggcgaggcatccatccttcaaaactccctgggtttaatctcccagcaccatccaaaagtcaaatcagttgtgtgttggttttactaagcaaggaaaggagaaagttgtcaacttaatgtccatctaagtgtcatttccccttatgtactccctagaggccttccctaagactaacttcttcagatttcctctattattttgcccgccccctactacctggctgtcatgatctggtgtcagtgctcttgaaatgctagagttaaactaggtgttgttcctgatacctgcagaactccgtgatgatacctgcagaactccatgatgagactaatcttcctatgtgatctttacactagttatctagcctgtcacaggagtgagcattttgttatgttttcatggcgcgcgcgtgtgtgtgtgtgtgtgtgtgtgtgtgtgtgcgcacgcgcgcgctcacacacacacacacacacacacacacatgctggctatggaaactagagcctcccattgcccaaagcaaactctcccacggagctgctcctatgccctgcctgtcccccacccctacctttgctgaccgccttttgttacttcctttctcattaagttggaagtctgattagaaatgatgttttctcatgtactttgaaatggaggaacacacacacctgtgattgatgttgaagcagaaaaagtgattcgggtggcgtcaccacttcatggatagctgtctctatttctgtagctgattttggtcccaagagtttcaatggttcccagggaagcatcagtagagagggtcctttgatctattccgttgtgtgaattttattttattttaccttttgcctgatagctctctattttattttggttaacaggtagttaatacttgtcagccattttatttccaacattaaattaaaaataaccccgatgatttattttacatatattcataaatggatcaaaaagttcacttggaaaagctggctcaaaaacccaaagcaggtttcagtgagtttaggttttctggggtgctactcctcataccagggagcaagtctggcagctcggctgtgctgatgctgatgctgctgatgctgatgctgatgctgctgatgctgatgctgatgctgatgctgaggaaccgaagaagtagcacag

SEQ ID NO: 26040 - DNA, 1189 bp, Mus musculus
ctgcggaggaggatggactccgggaggaagaacaggccgcgtaagtcctgccggcagggaagcgccggtgcccgcggtcgaggggggcgacagagtgccgctctggactgcgtcctccctagaggcgtcgggcgtccaaggtggcggcccgcggtggcgcctgtctagtccgatccgcctactgggtcggtcagacactagctggagctgctccctcggtcaccgtagcggctgggagaacgcactgcccgctgttattggtggccgtggggcaaacaacccgactgatcttgggtctgggactaggaggagggcgggctggcacagcccggggctcactgctcccttctccgagcacatcttttggggcgtgcatctcaggctaccagtttgccctttgaatcgcagagtaaccgccagtatctagggcccattggcaagcttaaggaggcgtggagtttgacaatcccccaaatcacagcctattaaacagtgtttccacacagccagtgagacggctggtgtagagggaaacacccactgacaccatgtgggccggaacggtgtggaccaatgaggattgcaggtggattccccccctccccttggagtgggtcgagttgagtgtttgtaattgtacaactccaaaaagtgcgttgtttcacaacctgagacttgtatatataatggtagactgtaaagggtaccttccccacctgacattctgggatgtcagtttgtaggtagagattacgagttgttttgttttgttttgttttgttgttgttgttttttttccttatctgagcctaactccattcaactggttacctctttgtgggtgtctttaatgaagcttgtaaatggcagaaagcaaagtaagtagagtccacggtagtgagcgatcggattcaaacgggtacctgttgcatatcaattaactgttctgggttgggaaatgattaaattgggcttcaatttctgtaaaaggttgatgtttggaaaacagcataactccttcgcctgtctttgcttataatttttatctttctgttcatagttttcatagcctttctgcaatgcattcgtttctaaaacgttgggaaccgctttaacacgtctgggtgaatccagtgcttacattttgcaatgttaatgttgtgtggagtttgggaattgcccagcagat

SEQ ID NO: 26041 - DNA, 1177 bp, Mus musculus
attattttgcttttaacaaaaagtgtttttaaactctactctttcttttttaggttaccatacataatgacagttatgacgttctttgtggtaaggattcttttctcacttatgttcatttacttgtcttgaaatatatttgaaaggttttattttcagaatcactcttagtgttgatcttttgatcatgtagtgcctacagtacctacaaaatgtttcaaagctatatgaactgtgagtagttgtaaggtttcatttatacttagtatcatgaatgtattttctctgactttaatatataattagagaattgttcttatttttcttggtcatttgcattaatttgtatttgatttcttcttacttcaaaacaagtaagattaaaagaaactaagctttgattgcaacaaatattagttcctttgctccctaaaatgtttcagtgtagatgataaagagattaaggattttaagagtcatgatctatatattttctgtttcttatttagtcaaggtcttaattttatgccttttgttgttgttataggacacttaacaaactctttgactatcccagaatttgaagaatccgtgaacagttgtgaccagtccagtctgaatgtggataatataaagtattctgtgtgggtttctttctttgaaatttacaatgaaagtatttacgatttgtttgttcctgtgtcctctaagtttcaaaagagaaaaatgttacgactttcccaagatataaagggctattcttttataaaaggtatgttagcgaccattttaatattgttccaaaattactattaggttttgtgatgagtataggaaataaacagggaattttttaaattaattttttaaaatccatttttagcagaaaaaaagaagtttgtgctttggaagtatattttgtgtttcttgtaactgagtagaagcgggtctggcccggttgatttgcttgagtgttagctatattgctggtgaaagtgcaggatcttctctacactcttttgctttgtattggaactgttaaatgttaagtcctccatgtgtgcttgcggaacttaaatacagggtgtcttatagtctatctttacatgtcttgtggaataaggagtagttttagttggtgttctaggatgtgtgaccagaagaaagattttatgtg

SEQ ID NO: 26042 - DNA, 1199 bp, Mus musculus
atgaaaaggaggaaaaagcagaattaaataaacaggttgtgagtttgcagcagcaacttcgtttctttgaagaaaagaactcatccctgagggcagatgtagagcaaatccaggccagttacaacagtgcagttgccgagctgcaaacacagaaagccgtgaaccaggagcagagggacaggatcctgaaattatcacaggagatggagactgctgcaagaagtatcgagagcaatgtttcacagataaaacaaatgcaaacaaaaatagatgaattgcggtcacttgattcaccttctcatatttcaaaaatagatttacttaatctccaggatctatcaagtggtgctaaaggggataattgtctgaacacatcacagcagcttccaggtggtgacttctcaagtacgtgggttaaagaatatcacactcaggagatcagcagggaaaattccttccacgcgagtattgaagccatctgggaagaatgtaaagagattgtgaaggcttcctccaaaaagtctcatcagattcagggactagaagaacaaattgaaaaattacaggtggaagtaaaaggatacagggaggagaacagtgacctccgagcacaggagagccagggtaagaatagagatcaccagctgaaggagaaagaaagtctcatccagcagctcagagaagaactgcaagaaaaaagtgtcagtctccgtgttcaagtacagcttgtagcggaaagagagcaagctctttcagagctttcccaggatgttacctgctacaaggcaaaaataaaggaccttgaggtgatagtagagacccagaaagatgagtgtaagcgcttagttgagttagagcaaagcattttagagaaggaatctgccatcttaaaactggaagcaaatctaaaggaatgtgaagcaaagcatcaggatcacatcagaaccaacgatctaagtgcaaaggaagtcaagttcagagaagaagtcacacggttggcgaataatttgcatgatacgaaacagttacttcagtcaaaggaagaagaaaatgaaattagcagacaagagacagaaaagtgagctaagtcttatttaaattaaacattttatattgtgtgtttgtgcatacccacatgtttgtgggagtcaaagaacaacttgtaggagtttgtccattttcctgtaacatgtggggcc

SEQ ID NO: 26043 - DNA, 1088 bp, Mus musculus
gaaaaataatctttggatacatgagaaatccctgtagtttttgtttactggggatttggtaacagcagctagagagatgactcagagattaagagcatttttgtccttaaagtggacccaggtttgggtcccaacactcacatgttagcttataaccatcagtaactccaggtccagggatctgataccttcttctgacttccttgtataccaggctcatgtgtgatgcatgcataaatacatgcgatgcacatacatacgtacaaacaaagtagtcttaaagaattttgtgagactccgtacagttcagctgttggaataattttagtcccatcttagtctatattttgggctccgctgattttttttcttgtttttggcctgttatatcgctacatatcataacatttgtctgcactttaaatcagaattgctacctatcataacatttgtctgcactttaaatcagaattggataaatggaaagaaaaattcaaagatctggaaaccagaagtaatcagaggttaaacacaggaaccatggatgacctagacgtgcttaccaggaagttcagcaagcttcaggacgagctgcaggtatcatcctctccctccctccctccctccctccctccttccctccctccctccctccctccctccctccctccctccctccctccctccctcccttattctcctccctcctccctcctagcagcttgctgtatctgttggtaagattgtatttctggtaagagaattcagcattttgtattttataactagttttatgggtaaaatattacatgggcattagtaatatagagaaaaaactttgcattttgaaaaatatcctggggaaaatttccaagacataacttatgatcagctaatgaaaccatgttggttgtgtcctcaactttatgttttatgtgtgtaattgatgtgtgagtgtaggtcagaagacatttttcaggagttgttgacaggaactcttgtttatgctgtgaagcagcatcttccaggccagcgggttcaatggttcagggtaattctatctctgcctcctgttttgttgtaggagt

SEQ ID NO: 26044 - DNA, 1109 bp, Mus musculus
ccctctcctggaagctgcgtggggagcccctcgggctccgggagtgagcacctctgccgggcggccctggcagcgcgcgccccgcttccgtttggatcggctggggctattatataagatgccacggagagcagaggggcgatcgggagcgcggcggcgaggacggtggggacccacctgtgcgccaccgcacgcctcgggggtcgcgtcggagccaaccttgctctccgcgcccctgcctgccccgggacgctcgctccctgccacctagcccggctctccgcgtctctcgctgcaggcgtctgtactttgaaacatttgtttaatattaaggaagctgcgtgtgcggccgtcatagtacgccgggaacgtgtggccgggagctccggagcggtgaatgaatcatcgccccggtggaccgcgctccgatgattcacgcgggctccacacgcgcgcgcgtactcgctgtgggccgcccttctgcgagggctgacgcccggaggggcggggggagttcatgcgagagggcggcgggttttttttttttttttttttttttttttttttttaatttaaacctgccacagtaactttcggggtgtagggctaacccaccttccccagtcttgcttctcgttttctggaagggtaatgagattccacctggctgggttaatgaagcagaggaggcgctgattcgctgcagggcccggtccagtcccattcagaatttgaatggtgtcaagtgagggaggtctgcagcatggttggaattcgagtaattgtgtctacttcagcagttgccaagtaattagcagaatccttaaaagtgagtcgatcttaaacaactggtccctcaagtagatgatataaagattagctttatttttttaagttttaaaaggccatctcgtttttcattcatgaatacagaatgtttcctactgtcattattcctgaacaccaacttgacgttcccatcccaccccacacttgaaggactacagagcaaattttcttgtcatctggggctcacctccagtgtcaggcccccacaaatactcttgatcaccatacttcttagttcttggtcctcctaaactacttca

SEQ ID NO: 26045 - DNA, 1286 bp, Mus musculus
caagccatacagggtgtcacacaggtaattggagctccttgttctgctgaggcgatgagataaggaaggtcctcagcttagcatcgatcccatctgtgctgttaaaccagcagagttcagaacaaaacagatgggggactaaggacagctagtccagcggtagaacacttgtctgccgtctctagaagaaatgccgacacttgaatcttaccttttagatgtagcatttttcatcctatcagtaatggctttttcaaaactacaggacaaaatttaaccagaatatttagtagcatattatttgatctgtaggattttcctgccgtgccagaatttgtagttactacagattctctccaatagaaaatacttcaagagcaaatttactgtgtttattatccttgattggaagcacaaatattcttaaagtgaaaaccgttctctatggtacttgattaatgctgcaatttgaattatttagcattgtgctgctgcatctccatatcccaaaagaaagcagatatgtgaactgctgctcagaaagggagcaaacaccaacgaaaagactaaagagtaagtacacttttaactagtgggtattgccttttatttatttcttttttcttttttttttttggtacagaaaacatacttactgtgtggctggctttttgtctttaagattcttgactcctctgcacgtggcttctgagaacgctcacaatgatgttgttgaagtagtggtgaaacatgaagcaaaggtataccccatttctggtcatctttggtaatccagtgagttaatttctgtgtagtggatatttagctccttaaactattcactgtaccaaaaaaaaatctttttttctcttagtttacaattcaaaatagtcctaggctggggagtaaagcacttgccatgcagttgtaaggacccgaattcagatccccagaacccacgaagcaggaggtgataacactcctgtgacagacagctggcctgctgtgtgcagcactgaacctgtctcaagtcaggaagaggggggagccacaccccaggctgttgactttcaagcatgcacacacaccttggtgcacagagacagactaaaaaattcctgtggaccaaatctagtttttgttactgttagaaaatgtatgcatttattcatatgtacattatttctgttatgtctcttcttctccattccacttctgatccactgatgaaagttatccttgactttttcttattattatacactcaggcacctcttatctcagca

SEQ ID NO: 26046 - DNA, 1131 bp, Mus musculus
tatggcttagaatgcagattctgacttatagataggggtattggactttgaatttttcccctctctgctgctgagatctagctggctgctactactatgtttaccaccaaatggaagttacacttagtacttgaaggaagggtatcagtgtgtaaatagtaaagtttactacctttcaaaaaagtagaaaatatagatgagaccagaagaaatctcagtaaatgaaacactagtataagaatagtttctgagccgggcgtggtggcgcacgcctttaatcccagcactcaggaggcagaggcaggcggatttctgagttcgaggccagcctggtctacagagtgagttccaggacagccagggctacacagagaaaccctgcctcgaaaaaaccaaaaaaaaaaaaaaaaaaaaaaaaaagaatagtttctgaaatacttatttaataagaaaataaggcagacatttgaaatttctgttaaattgtgttaaaacatgagaaatgaatgtgtgtgctgtgttcaatcctacagaaactctgtactgttcagagtgtcaactgcagagacattgaaggacgccagtcaaccccactccactttgcagctgggtacaacagagtgtctgtggtagaatatctgctgcaacatggagctgatgttcatgctaaagacaaagggtgagaaagagatcctgccttgcttccatcacacctttataggaccatttcggggaaatacaagaagacttctatgataaattataagctacttctgttttttaacatataatttacttcctaaaattggttcagtgatagcttataaattccgttaatagttgacgctcagcgtggtggtgcatacctaaaccccaagcactcgggcactgaggagtttgagacattcagctcagtatgagggagaccctttcttttaaaaaacaaaaaacatgcagatggctcggatttacgttaaaattaacttgtataatgtcttgttattttataattgccaaggaaaattcatttttgtgattttcatactgattaataaagttttcagtgttcattgaggatatgctaaattttttgtttattttgaaattacttttgtttaaaatgcacagtgc

SEQ ID NO: 26047 - DNA, 1215 bp, Mus musculus
gttcagttcccactaaccacatggggctcaccataagtaattggatctgatgctctgttctgacgtgtctgaggacagctatactaatcaattaattaattaattaattttaaaggatcttaaaaaattagtgtgcagaggggagagttgcaaatggcttagtgtttacgagtgcttgttgcacaactctgagaccagagttcagctgtcagacccatagaacaatgaaagctggatgagagcctccagctcagctctgagggtctgatgataaccctctgcttttgtgcacacaggcacacgcacacacactagtagtctgaatagcataggtttgatcctgatagagaaaggacattgactgagaaaactcgtgcggtccagatgaagcctatgttaataagttctgacagttgtagtatctgttagagtcctgaggaaagttgggtggtgtgtgtgcctgcactgtctgcactttgcattcctataaatctaaatccttaagaagttaagattgggggggggggggctgatttattggcggcttttttacttgtaaatttcatttcataggtcttaatccatatttaactctaaacaactctggtagtggaacaattctcatagatctgtctcctgatgataaagaatttcagtctgtggaagaagaggtatgttcatcacacttaaataaatggataggtagatctggccaccatattgttgactcagttgctgtgtcctagaattttgcagatatatttgaacgtgaattttgtttttgtttttttaaatttcttttcaccaccttgataatttgtaaatatttataatgcagctctcagttaacgttatttatttaggtacttaaattgccatttcagttcatattgaattagaattctgttggaaagaaggttgctgtcatttgaaaatatgctagtgttcactccctctgaaggcaactgtagcatgaggaatctcagacaggattcaacatttagataatatttatatgggaaattttattctgactttctttccaaagaattctttaatccactgaaatctttgaagagtactttcctatccagggtccctattacctcaccccccaacctctcgtgtttggtttggttttgttttgttgttgttgttgttttggttttttgagacatggtttttctgtatagccctggctgtcctggaactcac

SEQ ID NO: 26048 - DNA, 2746 bp, Mus musculus
tttttttttttttttctgtaaaatatagcaatgatgtgtaatttttcctgcaataattgacaaagacctaataaaaagccagtgtaaatcagcattctaagtcaaagtatgtggcagaattccctctgttactgataacagacaaaaacatgtatttacatctcaccctagacctacctgcttctgagggttggaagagaactgggaagataggagtcagtcggggaacagtggttgggttgtgtaggactcaaggccatcttgacatacaataaaacacacttgctaacatttgaactaatctttcttttccaggcttatcctgaatatctaattacttaccagattgtaaggcctgaaggtatggttgatggctgaaaccagttcccccagacgaaatgtcctgaagcagctgacggcctcttaagtttcactccttggcaggaaaacaattcatgctgactacaggcctgtggcacaaatgataaaatgtgaacgaagcccagcgttgtgacttgatgaagctttaacagtgtacagtgtttctgagtgtttcctgttctcagcactttaacagatgccattccaggttcaactgggtttgtctgtcctaaattataaacagttaacttgaatcttttatacgtcgtgcattggttctaacaaaaatggtaatccctcaacagaactcattttactaatcagtactgtgttctttaaaacacagcatttacactgaatacaatttcatttgtaaaatgtaaataagagcttttgtactagcccgatatttatttacatcgctttgtactataaactgttctagagctgcagcggttcacagagtattttcatatgtgttgctcatccgtgtttcatctgtcgtcgcctgactgatcgctacgtttgattccagaggctgctcggttgctaatagagagttagtggggaaacattgacttaacaaatttaatttactgatggaagcatttctctattaatagaaatctttctaatttaagaattttatgaatactcttggaatttaattggtgatgcctttgtgtctagaaggcacacatcccagagagctctggtgtgacgtgatggggacttgtggctagagaagatcttcaatggccttaagctctgggtcttgctctagagaggtctctgatgtcctcgacctcagagcagaactctcttcaagttttgaagatgctaagccccagcttctgaactcttagtgctctgatcgtgaactgtaagtggacacggggaaggcaatggtggataatttcccaatcaggtctaattaccttaaatctaaaacggaggaataacaagtggaaatggataggttttttaaatttaagtttttcttgatcttatggatatattatagccagtgtatttatcatgagtaaatacaacctaaaaccataggtgtgagtgtctgtgtctgtggcagcctctggaatgggcaagcctagtgcttcctacttctgtcaaggcattctgcccagttggaaaaacactgtcacaggctcaagttcagtatggcagctgtggaagaaattactttccatgaaaggctatttttactattctctaatgtaagccttacacttagcatcttgcattgcacagagacctgccgtactgcatggcggtacactcagaaatcaaggagagatttttatccacctaagtttttgtaaatgaggatgtcctcttcactctctgtacactttctctttgttttacattttatttggtctcttaattacctacctggtcctttatagaatcttgtacatagagttgcttgaaagttaagtttcccatcctgtgagttaagagaaatgtatgtctggagttgttcctaagatgtgaattgtggtcaagggttaagaggtcaaatcctgacctagaaatgcttttatacagctctctgctaactacaaatatcctaaaatcatttcttgaacataaaaggagtatgccaaattttatataaatttttcaggttctgtaagcttctgggttttatagttaaaagataatgaagttaattagtggggtttatatttacgtacttttcaaagtttggcctatgttactctgtgtggatctggaattgtttttcatgtagaatcatggtctggttatgacccgtgttacctcctaacccattgcttatgtgtgttcccattgtggtcaatacgctggcatggcaatgtttattgggagctgggagtttgggggtgtggtttagtgctttgcatgaaatacctttataataatggaattgctttttcttttgccttgtgatttttttttgaggtgaaatttaatttgtgtatgtgtgtgtgtgtagtgttctgcccatctgagtgtctacttgtatcacattccatgcctcacttaattcttaataaactgtttacttgttttctgggtagcatggtaattcattgaaattacagtaaatcgtaattgcaagagaacagtgtagttttgagtctaatcgtgacagggtgcagcataaatgtaagatgtagaatgtggtggccatacttgctcagatgcttcatgatgaaggtaagatgtgtttggcgtccacaccatccagtatgactttggtagtccttaaaattcattcacgaaaatcagtctgcttaacttacaaagagaaatatatttttgttttctatgtcataaaaacattcttgataagtttcca

SEQ ID NO: 26049 - DNA, 1161 bp, Mus musculus
aataggaactatgaatataagaattttgacgtagggcttctgaatataattatcaaagatgacatgattacatttaaagatggtatatagaattcttacgtggtttggtaacttctttctactaagataatatgtcctaatattgtgtgtgtacgtgttgtgtgtatttttccctccatttttggactgaacagctcactctctccctagtacagagttgatttttacctattgttaaaaatgattgtattttaatagatgattcagcagcatcaagagtggttggaagacttagtcattagactcctttgtgtttttgcgttggacagatttggagacttcgtttctgatgaagtaagtaccatctgagtgaagctttgtccagactgtaaattctacatcagtaaatttcctgcatatgtaactcctttctattctgaaggttgtagcgccagttcgtgagacttgtgctcaaacgttaggtgtggttttaaagcacatgaacgaaacaggagttcataagacagtggatgtgctgctgaaattattgacacaagaacagtgggaagttagacatggtggtcttctgggaataaaatatgctttggcagttcgtcaggtaactaactcagtttttgaaagggatttttcccttttggatgtcttgtttgttgtgatgttgggatgggtatgcttgatcgcttgtttgttcctttgttttatgatttccctatttatctccagctagcctggaacttgctatacctcagaattgcagagatttttctgcctctgccttttctttttcctcgtggattctaagattgtgtatgtcatcatgccaggctcaagcttgccttcttgagaaagtgtcacaaaattggcgatgttcatagattttacagagaagtccaaagatggttatttacattgttgcaactcattcagtgtatttcatagttctttaattgtttgaactcatttaaatattgaatacatggtcttaggatgtgagataagttatacaggagatacatattcagatgatatagacaggaaacatacagcacggatcaaagcaggcagtctatacagtcatgtactttttatattattcaccaatgtttttctttgtttatattttataagaagcctgagaaa

SEQ ID NO: 26050 - DNA, 1134 bp, Mus musculus
gttgttgttgttaatttccttcctcttcctcttcctcttcctcttcctcttcctcttcctctctctctctctctctctctctctctctctctctctctctctctctctctctctctctctcttctttttcttttcccttttcccttctcccttctcccttttacttttccctttttccttttcttttcttctgttgagacagggtgtccctgagtagcttttgctgccctggaattcactctgtagaccaggctgttctagaactcagacctgcctgtctgcctcctgagtgcagggtttagaggtgtgtgctatctccccaccctgaccaccctctctcccgcctctccagcccccgccactccaccctgcctttcttctttttcattgtagattctgggtatcaaactggtttgggtgctttcaagataaacattttgctgactgagctgtctcctcagcagtttgatttttgttttatattcattcattcatgtatctagttttaagtatgtgggcgtggcacacacaggaaggtcagggggaaacttgtaggagttgactctttccttttgccaggtggattctagggattcaactctaatcatcaagcacatttacctgataaattatctcactgtgaccccctttaaatctaaactgttgtttggacaaaatagctatgtagtgaaaactttattataaatcttatgttcccagtaacatcaagaaactgtcagagtaatctccatttgatgtcatttaaaaattgtattcttcatagattacctgggagttacttaaaactatacttacagttttgtgaaaactccatgatcccttgcctgaatttttaaaaaattttgcttgcttgcagttttgaaatgtaaagctttttgtaaattttgtgaattttgtaatcatttggcagcaagccattctgaaaagctatttatagtcttttattccatgtatgtacctattcataaaaacaacctttaagtgtttctttagagtctataagggttatgtaatgtacaatgcatgtaaccagcctctttagtatactaaagttaggaatgttctgagcacattttgctccaagataactagatgtgacaataaagcctacaa

SEQ ID NO: 26051 - DNA, 1608 bp, Mus musculus
cctctgggacgccgagcagtatgattcggagtacaacctggagaccttcatgcgctctctcgagtgactgctgcgtgccgtgccgtgcccggtgcaactgctgctagctcagttaccttctgctgatattcagcagactaagtctatgcgaactttaactgaatgtataaatagatctgaaactactcagcttagtgctggctcttgcttcattggggaacaagttattctcaagtatttgcactgtattaaatacgatgttaatgtgaaaaggtttaaattttacatgctgaatagctgcagacaggaagcagccaggtttccatgtgctaccaggaggtgcttctgcagggacagcctcctctacagtcactttctccaccgtgagatccaccagtgctgtgctgtttgtatgcgtttgtgttctttaaaatagtacttgtttttataattgattacaaatagggcttcttttgtataaaagccttaatgagccatacttttcagaatttcagagtgactttaatattaaccctaggacctgaaaatgttaagcaatgaattgaaccaggccctgtggcaacctttgtatatttaatgcagatgcatatggtgttttcaaatcctttaacatcattttgttcacttttaaagtatactaaataataaatgcaggtactggtatttaaggctacaataacatcctattagaggatgggtttctgtttaatttatctaatggctaggatatagccagattcaaagaacatatatgtactcagtaagtttcaatcatatatatatattttgtaactatgaacacagttttccagacatagattttacactgcttaaaccctgaaccctgtggtaaagactgtttactgtagcagggcctgaagcgggaggagcgctctttatacacagcacacaaggatacttgtatctatatgacagtgcccaccctacactggaaaatgtgtctggctttggcactaaaatcatgtagttctaccagacagcaataataactgagcagagagctaatgagctagtgttcaaacagctcaatggtgagggtgggcagctgtatatagatatgcatgtatgtgtatgtatatataattttataactttcccacataaattaatacatgccatgtatacacatatgtggaatatatttgtatatattcatgtacaggcaataagcatccctaaggtttgtgtctggtcctacacccagacatcaacttaaaaccatcagacctcaattgtacaataacaagggttttgtttaaaataattaaaaactccacagcacttagatacgacgtttgtcacacttgagtagccttgacaaccatcctgtaatcctgaacctagcattccacaagagaataaacatcaaattgtaaagtctgtgcaattgtgtgttgtttacagtaaagactgacaagcagctcagatgcacaggttgtgggaagccacaccttttgtatgtaaagtttatattcaaatatagaggaccaaaaggaaaactccagatttcatgtagaagatgcagtgtacttgtctgctttcataaactatttatttgctatttcc

SEQ ID NO: 26052 - DNA, 1216 bp, Mus musculus
cctacctagatattttgagtattgtgacatctcagcttgccaggtttgaatgaaagggtagtcacagattagtgataacaaaaaaaagtgtctttttgttaaaactggcttatgtgtatggacaatcctctctcgctggtttgtatgctgtgtctgctaacatttctcttttcttttctaatatccaaacttgtcaaactcagctgccatagtttccatcccaccagagtattttataattgataccgttgactttataccccagagtgggtcaggaagtggatccaggaatgttatgttgactttgtaagattacaatagttcattgggactcagagagtttgggtgctcacgagaatgcctgctcctggacattagtgctgttgggggtataaagtagtaggtgtttgtattttcgccgtggcaatgatggacatgattttagatgttcacagctcagatctctgtatttgattttcaactaacgactaattttaaatgtactgtatcttttcctacctgttctcttggattgtttttttgctggtaacccttcctcggcttctgccctggggcttggactaacactgcttgtatggattcgctactgtgactgaacgtggagcgctcgcagctaccgcttaactgcttaaactttgtagtttggactttttttttctgtaataacaacttattaaatctagttgtacgaagcactgacacgtgtcatcttttgctcaggacgatctccgtctgtttacatccatcaggaaatcctaacttgcaccatacaaaacaaaaaccccaggtcttcaaacagctcacatattccaccagagttcactctctcagagcccacactttcaaacgcacaaggaaatttgaaacagaaaggtacttgtgggttcaagtgatacacatggggggtggggggcggtgctgttgatggctttctaggcctccggcaaggtaaatttaagccctgcccctgagctattcacacacacacacacacacacacacacacacacacacacacacacacacacacacacacaccccacctgatgccttatgttttcattgccagtccattgccatttgaggcctaattccttaaccagaactgttgtgaaagagtatcatcatcttatgttttcacaaggataccaacgtctcctaaggtttttcagaaaatggggctttggaaaaaaat

SEQ ID NO: 26053 - DNA, 1153 bp, Mus musculus
aacaagccttttcctttattacagtgttcagtgtaagactagggatgtcacagtacaggtctctaaggatgtcacagtgggtttatacaacaccagatgcagccaagcagccaaatccgtggccagataacgaagtcacccctcctgaaatagcattgggtgtgaagcctagctcggccagcagtgtccagtgctttccctaaaatgtgcttcgtgtgtgtgtgtgtgtgtgtgtgtgtgtgtgtgtgtgtgcgtgcgagtgagagagagagagagagacagagagagacagagagagagagagagagagagagagagagagagaatgagaatccaccacctactgctgtcagtgtatgtatgagctggtgccttccgccttccgccccagatctttcactctcatgcacagtggtgacatgtgtgagaagactccaccttgtatgcggcaggacttgaatgcctcacctgatgtgtccccaggcagggctggcagcaggcctggggaagcacagggtcaccactgtctgtgttagctgcatctttctcactccccatctgttctctgtaatggggccccttgcttgcctttccttggggtgacattgggccactctgtgcatgatctgtctgccttcctgctgctgcttcttcagtcccccccccacaccgtctgcccccccccccccccgtgtgcactgtggaaggcagctgttgccaaggcactgcagttactgcagagacatctgagtgcagagccggtgttgtgtaaacagaacatccagggacttgctctacatagatggtgcatttctgctagttgttggtggcctcttctagttctgttgaagtggagagaggtcaatcaataacagataagcgtgtgtccagaggtggctcttgggttcgctctatgtattcagttttgtaaataatatatagattagatcaagttgtgatgtaaaattttaactcaaattgggtcctattggttggaattttacattaactacaaataaatgattagggacaggagaaattggggaaattattgtttagtggtatagattatgcgtaggtctctgcctatatcttgtgttttatcgcttgttagtgaggcatgggctaatgcagtgtactgcatttatgcaat

SEQ ID NO: 26054 - DNA, 1100 bp, Mus musculus
cttttaggctttttaaaaaaacctttgtttctgtgttttgaaactaaatgtgtcttacaaaatggactatgtacttaaatatgtacccctgctttacctgagaaagtaactgtaggaaatgctgtctgcttcccaggttgtaggccataaagaagggctggatgttatggagcgagctgaccctttatttcttttgattggacttcctactattcctgtcatgctgatactaggcaaaatgattcgctgggaggactatgtgcttagactatggcgcaaatactcaaataaactacaaatcttgaacagtatatttccaggtaaggtcctgagttgtggctatataaagtgcatgttggattgatgtttagaagaaccaacgcaggatttaaaaaaatatatctaaagctttttttttaagctattcctaagatttaagatttagttctaacataatgcttttcccctctagggattggttgtcctgttcctcgaattccagctgaagctaaccctttagcagaccacgtctctgctaccagaattttgtgtggagcccttgtctttcctactattgcgacaatagttggtaaactgatgttcagtagtgttaactcaaatttacaaaggacaatcttggtaagatggatttaatgttacttgtttcaagtagtatacagatgagagctaactatttgtgtttaaagggagagatgttatgtaggggctctgtctgctccctccatcaacccccactgtcagcatagcttgagagaaattaaaaaaagaaagcaggtcctgtgccagctgcctcctggaccctccctgtgggtaccttctcttctggactgcgctctgggttcagtccccagtaccagcatcataaataaacaactgagatgaaactggctcatactgtttcctgtcatcctgtttgccctccttggttgcagcccacatagtgcctggcattctcctctctctcagtgtgtaagaactccatgggaagaaagctacacaagtgatgtaggaacagggcctcttcctttgctacttgaagcctgctctttcccaacttctgccctcacagaagagaatgt

SEQ ID NO: 26055 - DNA, 1337 bp, Mus musculus
tcctaactacaggtgagcaccacaacacctgcttttctaacttaatgctgtggattgaacctagggccttacacatgctaggtatacactacatcaccagccctccttttagattttagttgtcatattaagggggcgatctccttactagtcattgtttaactagttttatattcattgttcaaaagcaattatttaggtcatgtttaatagtgaccattacaatgttcagcaatctgattagaatgaaaaattttttttaaagatttatttatttattatatgtaagtacactgtagctgtcttcagacactccagaagagggagtcagatctcattatgggtggttgtgagccaccatgtggttgctgggatttgaactccggaccttcggaagaacagtcgggtgctcttacccgctgagccatctcaccagcccctagaatgaaaatttttaaagtttaaaaaataatgctgttcacagtatatgatgcatgataatgctccccctttctgcgaaatggatacttctctttagaagtgtaacaaatatagattgagctgtgttagattgtaaataaatattttagtaaagactggtatctttctctaggttggttatctcagttttgagttttacggtgtctgtgggaatgactcttttgaacatccagagttgtaattatctagggtataaggggcaatttgactgagttaaccttaacactgctgttattctgtagagaaaatgtgaaccctgattatatataaaaataactaagatctacagctgtaattatgaaattggcttccatcattgccagtgtgaaaatatatatattctgacatttcctggatactcctgttaagttgagcagcttttacacagccacaagccctcagctccctgtgtactactttaatttccggggtggtggtggggggtggggagctgcttggatcgatctattggcatcaaggcccgtgaaggcagaggtttatagagctatggggagggagccacacttgtctgcagtccagagtgaacactagccctgctgcatttgaacaccacatgacaggcctccctggaaccacaaatcaaaagacatgggcagactgaaagctgaataggttacgttgagctcccatcaagttttagtagctgtagtgtataaccttggccaggtggctattcagccacagttacgttcatctctaaaatgcaagtcacacctagacactttctaggatttggttgagaaaagacaggtactttcggcctcagtagctcctaaaggtggtcgtcccatctaggacagggcagtaaccaaggg

SEQ ID NO: 26056 - DNA, 2192 bp, Mus musculus
ggcattattatgtagaaatgttaaaaacccaaagtaataaacttataaaatcttatagatgtagaatatttttaaaatctcttaaatctcttaatttttttcctttttattcctaagagaaattcccttatattaactgcttaatctgaagaaagatatcccaatacagtctttcttccttattctgtaaaatagtcacttgtcttgaaaaaaaaaaaaaagagctttttttcttaaaggcttcaaaacatttagagaggattacatttacctttttaaaaaccgatcttcacatctgctttctatttgatggtttcctgtaaaccaacagaaaacattacatttgacagatgatgcacaaagcaatgccatgttcctttattagtgaacttgctgattttataaaatttgggtatgttttttaatcttcttagtcaaatgctggaagccccagaattcccagtgctagaaacgcagactgaccttacacccagttcagaatttctcaggattcctgtgggctctcgctcatcagattctgttgacatttctgtttctcgtagttggtttgctgtgttctgtcagcagacgtgctgtgctaagatcagctgttgtaactccccacaactcctagggtgaaattgtgatccgtgtgtgaactaaaacatttgcccctctagggacttaaaaggaagcaaatacagagccacctccttggagatacaaaacggttgcgttctgaaatagccagtctccgtaagactctaaactccccgctgcttccggtctcatcttgccttaagtgttatttttttgaatatatgaatataaacatacagatgatgactggagtggacttttaaaaaactatttttttcacaagatactattttaggtgaaaatgttcctgtagatttaacagctgttttaaagtatttgctattaaaacttgcttcaagaacaagcgtggctatgtttccacacacaggcaatagcaacagaaagcaaagcgctcctgttcgtccaccagctgaggccgagagtggcgtttccaggtgacatcttcctgccccatgttacttgattggccaggattttctgctgtagaatctctcggcttttcacaggttaagtttcacattttccaaatacggtgaacttgggcggctgtggaggccgctctccctgtggtgctgcgcccgtcttctatccacatgttctaagagtctcccggtgagaagcctgtctctgtccatcccttcagaagacacgagtcaacactgccttctcctctgcgcaactggcccagtagccaaggtcgactttgaactccttgatcctcctgcctccacctctcaagtgccgggattaggcttgcgccaccccgcccagtgtgactatgcagcttttcatcgaactgcaaaatctatacaaagatgaatctaaacttagtcctgagtgttcgaatccatcgttgtaaacacaaacaacagtctgctaccttttctgtaaatgctcacctgccgttgagtaacttagctcttaaaaaaaaaatgggtacagttaaaagtttgtcatttgtatgagaaaagacacctgaagagattggaaacaatcccatgtcgtcttccatgaacctgcatgtggtgttcagtgtgttcccaagctcctgtgtgtcacttggcatcccaaccggttcatctcagtgggtccaggttgtggtccatgaacaagaacatactgtccagagaccgcatgtacgtactcaggcttccgcaagtgagatgtgtgaaaaagtcacgagttgccagagacttaaaaagtctttttagtcagtcagtgtggcggggtcctgaggttatcctgtttacaataaatctgacctggaactcggtctgcgctttgtgttgtgtgactttgtagtttcgatgaaatacttgagcttccctgtcaacattcacacttgacaggatttcattcttctgttagtctgttgaaggaagcagtgggcatgggtgtgcttgtgtgcacacacataggtgcatttgttggtactcagtaacagttcggaaacagctccatcttctagtcttctaaataacgtgtaaaataggagcctccatgttggaggccagactcttgctaagcagtgtctcccacactcagataaagaaattaacactggggctgga

SEQ ID NO: 26057 - DNA, 1173 bp, Mus musculus
ctgggaggttttggttaagatgaggtctcacaatgtgaccttgtcctccaactcatagagatgagctgtgctgtgctgggaggaaaggcatgtaccacaatgccaggctcgctgctcttcttacccagcccaggcttacctacccgggcgtggcactgcccacagtgggctccagtggactctactcttcccctatacattacttgttaagaaaatgccccatagacatgtccacaatcaatctgatggaggcagttcccgaaccgaaatttcttcttcctaagtatatctagacttgcgtcaaattgatgaatactaaccagcacaataagttatgtaatagcaagttcaaggccagcctcagctacatggtgagactttgtctcaaaaaaaccactaagacaaaaaaataaagtaagcaaatatgtcactgactttattaaaactgcagataatttttgagcctgttttctttttgaaacttcttaggaggatggtttgtttatcagcagaggaatgaagttcacaataactgcggcatcgagatctactaccagacagacatgcagagcacctcggagaacatgttcctggagctgttttgccagattatctcggagccttgcttcaataccctgcgcaccaaggagcagcttggtgagaggaacatggggatcgcaggctaccggagacgaatgaacagcttttaggctcgaagacatttcccacttgtagagccgcatggcgcggtgtctcaagcctgatatatttagatgtgaaaaccgtgtttgtagggaaaccgtgcgcaaaccttgtctatgtggaggggcttctaagagatgatcagttagcatcttgcagaaacaggagctgctgttcttcttcctcttctccctttcctctcatggtgaggagactggactcagcctcctcttaggatgcgaggcaggcaagtcccctgccactgcagtgtatccttagccctgctgttaaagcggttctcaacgagatgatagtgaatctctatctcatgccataaaaaggacgccttacattctccatagggaaggaaggatgctaagggccggcctgtaggtagtgccgcgggaagcacatcctatggtcctatggggcagcttagttttacaagctctgagcatctcaagtgcttcc

SEQ ID NO: 26058 - DNA, 1243 bp, Mus musculus
catgatcctgatgcagttatcttatgccatctttgataaatcttgttttctactcagaaagctgaacccactagttatacacctgactgtcagcttcaaatctaccatggctgcagttctggatctgggggaaactccagtgagagactccttacagttttcctcccagccttcatctcagacagagggctgcctgctggaagaattttagttggacattcagtagctactacccctgttacttgctaatggagactttttgatgctgtgcagtatctgaggatccctgcagactggggcttactttctaaggcacgcaaggtgtcccttagtggaggcatgcagatgtatgttagaggggaagatgtggcctgggcgatgaaaatgcatggcctttagtttaagaaccagagaagggtagaaactctatagaagagaaaaacgcagatatcgttgcgttccagtgatatagcttatgtaaaagaaattggattgtagctgattttcccagtcgactttgaaaattaatgaacctgtgttctccctccctagtatatgcgatctcttaataacttccgggctgagcagcctcaccagcatgccatgtactacctccgcttgctgatgactgaagtggcctggactaaagatgagctaaaagaagcccttgacggtgagcctcttctacttcattttctaccgtagtcatttcattgtctgaggtgggtggtaagagcctcacagctcagtatggtccatttaccaactgtacacacacccagccctgcctatagataaagcagtggtcagttagaggatttctgggtcagggccatggttgagaagcacaagtcaaaagttcatttcgatggagacagagcaggtgagggttagagaagagatccccaaggcaacacagtgggagtggaccatgttccagttctgcagtgacttgcagctcagtggctttaagtaagactttagacttagataagactccaagggtgcgggtgcgtgcgtgcatgcatgtgtgtgtaacctttaaaattaagatagttgcacatacttttggattgaaaaacagtatctataaaatgcctgacctattaggtttttaattaattaacttaataagttcctaaagaaggaccaatatgtgaaaaaggaatgggagtggtagagaacttactgttgggatactgtaataacaattgccacagcagtgccacctacagatgctaaa

SEQ ID NO: 26059 - DNA, 1124 bp, Mus musculus
ttcatacactctcacataaatgttttcctattgtaattttttttctaattctagctgcagttctatgatgaactttataaatattccagttgagttgtagcttgattaggggtaagctaatacctccacagttctctgcagtctttctcttttaaggccatgcagttagcgtgcacaggcttcccagtctcacatttctgtactccgagaggacatgctgatgctgggtcaccttagcgtcatcaagcctcctcgcggcagctgaaggacagccctgcggttttccgttccacactccctgcctctcctttctgatttgtcagtcctacaccagttgagatcatcagctcctacttccctgcctccagtgcgcacacacacagattcctgacaccctctctcttaggcctttttctcctcatgacagaaagaaacagattcaagaattcagccttgttcttgggaaattatataaactattattgagtttctgcacccaccccaaaggccacacagcacactgggaagtaataaatcagctctttatgtcaacgttttcttgcagcccgtttgcttatgtggaccccttgcactgtaacatggcctatttgtaccttgagctcctcaaagactcactcaacgagtatgcatatgcagcagagctagcaggcctgagctatgacctccaaaataccatctatgggatgtatgtaagtacccatgtcttagagccttccactcatcaacatttttatattgatttgatggaagcattttaaattgtgggtatgagtttgatttcttaaaaaaaaaaatgtttatcgcttaccgtattttctcttcatttaatttttaagttagcttttactctaacattccactgtgtaccattcatagtatgcagagtttccttgattctttttttttaacatctttcatcagaatgtcatatttttcccctcaatcaaaactgtgcccgatttaggtttagctcttacccattctgtatctgaaatcttgagcttcagaatagcagaatggagtcctctctcggtaaaccgcgaggctggcctaccctcttccttagaagtcagatcacgaggctgcatatccatactcttcgg

SEQ ID NO: 26060 - DNA, 1137 bp, Mus musculus
aggtcagttttgaccttttgatgttaagatattgctattttcactaattttagcatctctggagagatcaacacctctggatttacatttgcccaatactgtacttttcttttattgttagtacctctttaatatttttttttcttagaacactggtactctctcccaatcccccattaaagtgagacaaggtctcactatgtccttgggctatcctagaattcaatgtgtagatcaggctggtctctaactcagtgtctgcccactgaatgctgggattagaggtttgtactatcgcaccctaccctaattattcccccttggccttatgcattctagcacgcattgtatccctgagctatgtcctcaaccctactttcttcagatcttatgtaattcatattaaagtttcattataaatgctgttgttttaaagtcacagttttcaagttagcaattctgttttgtttttaggtttgcgcagtttttcctgtgccccttgtttgatgcaagttgtaaagacagagaggtgaacgctgtcgattcagaacatgagaagaatgtgatgaacgatgcctggagactcttccagctggaaaaggctacggggaaccccaaacaccccttcagcaaatttgggacaggtttgtcagcttcctgcatcagctgctgctccttgatctccttgactctcactcctgcacagcattttcataatttcttgttccagcttgaatcctattcaaataggattccacatatttcaggattggaacaggtaggagccgtgtgtggttactaccggggcttcaaacgtactgtgcacacattctcaactaagcaacaccctgactctttgtccttgtttttttgaaactggctttttttgccctgtaatctgagctagcctccaacttcaaatcctcctgctttagcttccccactgctgggattacaagccgttaaccagaaaggttattgtgctttttaaaatactttagttacaagccgggcgtggtggcgcacgtctttaattccagcacttgggaggcagaggcaggcggatttctgagttcgaggccagcctggtatacagagtgagttccaggacagacagggctacacagagaaaccctg

SEQ ID NO: 26061 - DNA, 1149 bp, Mus musculus
ctggcctcgaactcagaaattcacctgcctctacctcccaagtgctgcctcttcctcccaagtgcttgggattaaaggcatgcgccaccactgcctggtggaaagtaacatttctaaattgtgattctatattgaactcaaagtttttaaaacaaggtactgaaggcatttgctacttttaaacaaatttgtcttttgagaatgaagtacccagacttgttaccaaacacatctgtgtgcccttatctggagtcttaagcacacgtctttgctatcctgaggcatgtgttttgtaacaaatactgagctttagactttgatattcatcttccttattaattcttgcattatggctacagatataggaaacagttgttagtaatggcatgtcactggggcatggtggaacatgttggtgatgcttggaatcccagcacttgggaggtagatcaggaactcagtatcatcagcagttacatattctagtataaggcctgtctgggttacaacacatacaacatacaaccccattccctaaacaggtgtctcacttccaaattctctctctctctctctctctctctgtgtgtgtgtgtttgtgtgtatatgtgtgtagaagctgaggctgatgtgatgtgcagtatattccttagtcattgcccaccttactttgtttgttttatttctgcacatgtgagtggatacgtgtgagctgtggtgcacaggtagagtcagaaggcggcatgcagggcttggtgtgctccttgggttccagggtggagcttaggttggtttggtggcaagcacccttatctactgaaccatctcaccagccccagcttattcactgaggcaaggtctcccagtcaaacccagagttcccagtctgattaggcttgctggctagcttgctttggagatctgctgactccaccttagagcctggaattagagccagaagtacttgggctctgaggacccgaactcaggtcctcaagcttatttagccagtgttgaatcacagccatcccctagacccttgtcttgaggtgttaatacagtgttttatccagagtaatagctgctggttgagctctaggtaccagcttgtctccctaccccggtactggggttagagtgagctgaagc

SEQ ID NO: 26062 - DNA, 1168 bp, Mus musculus
ggttctagggaccaaatccagagtctcttgtgtgtgctgaaaagcatcctgttaccgcgttacttcctagctccttagcatatcaagttggatttgtacacacatgcctttccttcatagataaaggttcccagtttcaaagaggtcaaatcaggaatgttccatttataggacagggaggggctggagagatggcttagttgctgttccagatgaccctggttcaattcccagcactggcttggtggctcacactgactgtaactccagttgcaaaggatccccaagggcaccaggcatgcaaatggtacacagacataactgtaggcaaacactgatacataaactaaacacaggtaagtctttccccaaagaggcttcatttgcttattgccatttgccactacttagttatcgtcatgagactgaagagtgtggagatgagcttctgtagcagccaggattttgttgtattatgttgtattttgcaattagactaaaattttgtagaatttagaacaaaacattaactattaaatttgtgttaacttttagagccatgaatggaaaggtaactgttcaggaggaacaaattgttgagttggttgaaaaaatcgctgttcttgaggaggagctcagtaaggtaggctctggggccaccaaggctgggtgacagggactgctaaaaggaggagaatgtgtagggactcttttctttttttaaagagttttttttgattcttatattcaaggtaagttgtattttatttttacctctgttagtaatgaaaagccttctattttgacactttagaagaaatcacagtcagacatttgcttaatgactgggttatatttttgagaaatgtgttataagtgattttattattatgtaaacactatagagtttacttgtacaaacctccaaaatctgctagaatcctagaatttatggtatacttcattgttttttaaagatttatttattttatgtatatgagggcaccagaccccattacagatggctgtgagccaccatgtggttgctgggaattgaactcaggacctctgggagagcagtcggtgctcttaaccactgagccatctcccatgcgccctccccccacccccccaactcagtttttattttgagacaatgatcacataa

SEQ ID NO: 26063 - DNA, 2408 bp, Mus musculus
tatgttttagaaacaatgcaaaaaaagtaatatttcatgccaggtggtggtggcacacgcctttaatcccagcactcaggagacagaggcaggtgtatttctgtgagttcaaggccagcctgttctatagagcaagttccaggacaggcagggctacacacagagaaacccggtctccaaacaaaaaacaaacaaaaaagaaaagtaattctttcttcttccattactggtaaagtaaagaagaccctaccttttgtgttttgtggttttcaaatttaaactttagtccataatgcatagaactttcataataaaatgttgcaatgtctagtaaatgttacataattgtgacttcatttctcccctttaaacccacagcgaaaaaagccacatggaaaagacaaagaaaacagaggccttaacccggtggagaagtataaagtggaagaggcctcggatctctccatctccaagagcagactgccgcttcacacctccataaacctctagctgatctgaggcttagggtgtcatctttaaaatacaacctgaaactccagagtctgaagctatgtacagatgaaaaggggactgctgtgtgagggccccacagtaactgtagttgaactgaaagtcttttttataatccctgtagtccaaggatgtagtaagctgggtatcatttgggatttacattgaatatgtgtgtgtgtttctagctttttatataaagaagctcttctgtaacaagtaagtatttttcttgtatataattaaataccaaatatatggaaatcattgttccaggtttagacttgtattggtgaatgccatctcctttgctgtctggccaaggctgtttccctacctctaaccagccttttctagtttgtcttcgactcctgtctcccttttcctgtcacttaaccttttgtagcctacagaaaggtttctttagtatgagaaacgcagggttttacctggaactcttctatctcactgattacccttacaatcactgtcaaaacacctgaccctggaaggacccttccttttgggtccttcatttgttctcgctgatatgcacacatctcattccttcctgaggtctgacacatcaccagcctccctgtagtgtcggctcctaatgcaggagaccttgaggccccacttaaaaggtctttaagtctcttagaaatgataagattgttttcaaactaccaattatgactataacttctattttgtttatcttttaaaactttattccttgtatataataaaaatgtatatatacattccctctgttgaaatattaaccctcgctctttcgctttgacaacgctgtttctggaagttggccattttaagatgaaccagagcacctacctaaaagtgtatgcagagagtaagtgtggtcacgtcaagttcatgtatacggttcagagtgatgtggttttggcacagtctcactatggagctcaggctggctttggactcactatgcagcaggacagtcatccttccaaggcctgggaatacagacatcatcactgtgcctgtttcagaaatagaactttggccaggcgtggtggcgcacgcctttaatcccagcactcgggaggcagaggcaggcggatttctgagttcgaggccagcctgatctacaaagtgagtgccaggacagctagggctacagagaaaccctgtctcaaaaaaacaaaagaaatagaactttgtaacaaagagctaacccctaatagaaaattagaaaaaaatgctactttaagaaatttattttcttgtactatttctccaactcattgtagaaatagaaacgttattttaataaaaataatgcataaatttctctgcaaacagatgccaacctaatctgtggatattatctaatttgcttttggtaaatctttaattggtaattgtttttgaattttttaaattaaattattttaattttttgttcgtgctgcctgtacatttgtgcgctgcttcccgtgcgtgctgtgcgtatgcagagatgccctgaagctggggctagggccactctgggtcagcatgtgtgcaccagagcccttactctccctcctagcatctctccagccctgaaatttgtttcttttacttgcttgcccataatttcttatttagcagtggtatttattgtggtgaaactcctaaaacagacttcagcaaaggtcctaccaaggaagacaccaggcttccagtagactccaagcacatataccttggacatatgatgtgtatgtggggaaaagaccctacacagcccgaagtacagcttatgtcatcctgcctctgtcattgttctcccaaatggttctgcagcagggttaacgcctgacaagccacagaatagcaaaagtaat

SEQ ID NO: 26064 - DNA, 1218 bp, Mus musculus
actactaataatttcatagtttaagccagttgtggtggcacatgcttttaatcccagttcttgggacgcagaggcagatagatctctccatttgaggtcagcctgatctaccgagtgagttccaggacagccagagcaacacagagtctcataaaacaaacaaacaataaaatcattacaataatactttcatagtttaaagttctaattggtaccgatcacggggtacttatgttctacccttcgctttgacctgtttggactaatgcatcctaaattcttcagttacttcggaataacttcagtgttctttggttaaaaaacaaacaaacagacctccattttctctgctatgttaagaattctatgaggaactattatagttgcaaattaaaaaaaaagttatatgaactcaaggaccttaacacatgggacaatactgtcagtcagaggagagacacattttgttgttgctgctgttgttattcatattctgaaagcacaaggaagtgggatttcccagagaaggctggattcccttgtaccaaagagacagtggaagagggaggaggcttccgtggctttactctgacttgtagtggcactgatccctggtgggacgcgcagtccggtgtagtggattctctggctctccaagccagcaggcactgaagtttctgggactcaggtgtgcgaagtaaataaaacttggctggggagagatggcttagctgttaggagcatctgctgctttagcagaagacctggctttgattcctagcacttacatgatgggtaaaaactgtctgtaattccagttgcggacaccctcttctagccttactgaactctgtttgttgtgtgtgtgtgtgtgtgtgtgtgtgtgtgtatacacacacacatatataggcaaaacactagtacacataaagtaaatttattttatgtatatgtgtacacagtagctgtgcagatggctgtgagccatcatgtggttgctgggaattgaactcaggacctctactcgctccagccccgacaatgtagctgtcttcagacataccagaagagggcatcagatctcattacaggtggttgtgagccaccatatgttgctgggatttgaactcaagaccttccgcagagcagtcagtgctcttaaccactgagccatctttccagccccaaaaacttttattaaaagggggccggatatga

SEQ ID NO: 26065 - DNA, 1204 bp, Mus musculus
atgccaaagacttccccccactccacccaccaaactcacttccactaccctattgactctatacattctgagtttggaggcatggtcatacagccatctatacacatgtcttctattttctcctgtgtgacattttcacaattgacaattcacaatttctacttttattgactattttttttaaaaaagatccatatagttgtttcttcatgactcagatcccacccatatgaagcgctgtctctcatttgagaacatgatgtcagccaaggatgtttatcagtgttcagagacaccggagctctatgggcgcccagaaggaatggccaggaatggctttgactgtccagtggctcacaggactgcccagccgagctaaatggcaccatggccatctgagaagccatatccatggactgacaccgtttctgtttccctttcagaactatttatcaatgaagattgtgaggccgaatgcatagtgaaagcagcgccttcaatcacgcaagcaatgaagaactcctgcctcacacactgatgtgtgatttcaagttcaagacgatctcaggagacttcaccaaggcacataaattcctagaggggctgaatcccagaaagtcagacaacaggcaacattttttatcatgttatctttaagtattaaaacatttattttctaaactttaagcctattttccgagtatttctaaggtggctggttccatttataaatcttcttttgaatgtgctctgcattctatgactcgtttgggcagttagtgaaatgaatttgaaatgtcttgtatcttaacgtcatatatcctatttgtaatcaagaggaaagactacattaagaagatagggtgcatagttagagcagttcttattggtgcccacaaccattgttgtggtattttgtatggacaaatgtcatgagactctttgcaacttgagtgtaaataaaattatctcacttgtacacatggatgtttgtcctctattctgagtaagttgggagggaggcaggttcagtttctctggtcctagtaggcagaatgctacagcattccagttgaccacaagccctttacaaccataagccctttatgagtgtgctgccaacatgatcccgtgggtccagtaataaagctaacacttatgaatagtgttgtaacaaccttttacatcttcatgtgtcttactc

SEQ ID NO: 26066 - DNA, 1177 bp, Mus musculus
atgtgtgtatacatgtatatatatgtatgtgtgtatatattacatactacatatactatatttactatatataatatatatgtgtgtgtgtgttctttgtttcatgcacattagaagagggcatcagatcccattacagatggttgtgagttaccacctggttgctgggaattgaactcaggacctctggaagagcagccagtgctcttaactgctgagccatctctccagtctgtaatatgcattgttatgatcatttcacagagaagaaaacagaaggactaaataaatggcataactagggtttgaacacaggtattcacccaggcttttctcctgagcaagcgtgcattccctcgtcgtcttattactagcgtctactgtttataatgtctccctacccacatagctgtcctcaatcagtcgtcttcccccaacatcgccaacacttggcaattctttgtctgagtcttggtttctggagcagcccagaaggcccctgactgctctgtatgtgcattcctttacttagaatgtacgaactgagctgctacttgcctcaagagaaagacctgaagatctctgtctatgactacgataccttcacccgagatgagaaggtgggagagacaaccattgacctggagaaccgcttcctttcccggttcgggtctcactgcggaatccctgagcagtactgtgtgtaagttgcttccccacaagtggaggtggtctgctgcatggatgctcagacctgggaaggctggagggctctgcctccatcagtgtgctgtggtcttttggtccatccagtgtcatttttgacaggatcatctagggacaaacaaggcaagcacactgcctcaattaccccatagtctgttgaaatggcagtacctggacagtcccctctcctgttcttgaactcctggggttagcggctgttatgacaaggattctctagcctttaggaatagggattgattcatgactatcaattatccacctcccccaaggattctatgatgcctagcatcccctgatgctaaccagtggctctctaagccttcagtgagacagcatgccacttctggtatttgaatttgcctctatgattgtgataatcccagattcctcatttttgttgaggagggaactgcacacacacacaaaatag

SEQ ID NO: 26067 - DNA, 1137 bp, Mus musculus
ggtaattgtcaccttctttctttctgggcgtctgttatctcacaaggagaaagatactctatcaaaacaatgtgaacagaaggattgtccccatggggttttacccaagagctttggctggggctgtgggggtggtggtgcttagggctctctagttcatccttctcgtgttactgatgtgacccaggacaagatttgctccagtcacaggaccagcatgtgcagagttaggtcatccctacctccaccccatcccaccttttcacccacacagatgctttgaaggcacgctggcccactgccacccaaaggagaaccttgcactgaactcgtctgaggtcctcaggtgccccagaggccacctttgtcatcacttgggagtatagaagcaagccaagtctatccccgaaattgacttcagtttgcacccgggatgatataacatcttacctgtcttgtctccacagtgtgatccttacataaaaataaccttgggcaagaaagtaattgaagaccgagaccactacattcccaacactctcaacccagtgtttggcaggtaacatacagttcaaaatattccttctacatgaaatgtgccctgctctggttgagatcctaacgccaggaatatgtacagatacctttgtcagagaaatgggtagaagggctggaaggtccatgagggaagaatgtcccccaagagccttgacaaagcattgttctcttcgtggtcacagccttgacttgtttctggtctagaatatgggtattgttaacacatttttattcatgccacttgtgaacacctgtgtgcatgtggcagtgaacacctgtgtgcatgtggcagtcagagacaacctggttctctccttctaccatgtgggccccagggattcatctcaggtcctcagggttgacctcagtagcctttgcccgtgtgtgagtcatgttatataagtcttatcagagctgtttctagttaccaacatgatcactaagtaaagccagtgttattcagctgagagcacctttcatatttagtaacaacatttgctgagcagtcagagtgagcaagtcctctctctcctgagccattttgtagaagacatgtcagaaatctcacagaactctgac

SEQ ID NO: 26068 - DNA, 1158 bp, Mus musculus
gagccaatgacaagcttactaacgtcctttattacatgtagcatgcgtacatgtaatggacacatatgaccgctaacttgattttagactttttacctggataaaccgaatgggcccacactaactgctgttgctgagggctggaggccgagtctttccacgagggcatcacgctctgtgatgtctgtgggaactcgtgacggatgagcttagcactctccgaagaagagcaggagatgagggcgtggggcagattggtcaagtgccaggcagacagcgcagaccttctttcatggccgactcaacagttgccttccaattccagtgcttaagcagcatgtcaacagcactcagcaaaatggcttctccaaggacagtgcatgtatgtatatgatacgatgcatgaggccgcatgggactggggcagcttggtctaagcacttgaattcctccgggttctactagtagattttggagtgaaaggtgatatttagatgaataatgtcattttaagccaaagggaagactggcccggggccatgtagtgctttgagttgaattttcaagttcatttattagattggagaaaaaaagaaagtcaacgagttgctgtccttccttttccacagaggacgatgagcgatcaggcatgaaggaatccttctgggctaaccctgaaatttaaagtcagcaatttgtcttggatactctttaaacatggcctgttcttgtccctaaatcagttcgttataactgaaagtaagcgtgaagaagcagactaaatatctgaattcaaaactattgagactgtcaaaagatgtttttttttttttaattcctctctccaaaatcgcacttaaactatgatcgcttaaccctaatcttgcttgggaatggagctaacaaaacaaattgatacgtctctttttctctctgcctccgttggcacttctgctgcaacaagggtcagtctagatagaaatactgaggaccttaagaagccgggtggcacacaacacaggaggcacaaacgtgctgtagggagagatcaggatttcagaaaggggaactgtgttctctaattagcccagggggctagcttatcagtgtcccaagagaaaactcaagctcctgcaaactcctggacagtccctggta

SEQ ID NO: 26069 - DNA, 1131 bp, Mus musculus
gagctttgttatcataactcttttgagttttaatgtaaacccaagtcaacgtttagtagaaactttgctcaacctcacatgatcagtctctggtagcgttttctgaacttgaacacatgcattttaacacttgatctggtctcttttggtttgttttgttttttggttatgcttgtttgtttcctgaataagctctcataaagatgagtggcaccatccaacagtattaaatgaagccatatgaaattgctaatatttgatcattttggcttacaaaaccaagaatttcacatggttcaacttaaaactattctttaatagtaaaaaaaaaaaaaaaaagaaggtactggagacgtgcttttaatgtaggatttgtatgtaagtaaaaaatagaggttttctaaataaaattgatctccacggggtatctataaagatacacagattctttagttaagtatcaggaaactttcctcacctgtggttctcattccatctgtctgtgtgtctgtgtatctgtctgtctctcagaatggagataaggcggcatcacccagtgagatgacctgccctccaggttgggagtgggaggatgacgcatggatatatgacataaatcgagcagtggatgagaaaggtacgtacatctgcttgcctgagtgtgagtctgcagaaaggcctcggttaaccagagcaaaggttccgtgggaggaaggaccccggctccacctaggtcatgtggtgtaatccgcacctattcaaatgagtatctgactcaaacagatggacagatgctgggtgaggagatgtccggagtggaaaatggaggttctaggaccagccagcaggactttgggggtacttggaattcctgaatagaaatataggagagatctagagcttggattttctctttcctaactactccataatctacttgagatgatcaaccttagaggtcccagaactcaggtaggagaatggcaaaatgtcttgcatgtcatcccaccggtgaccatgtgatcaacattgcttttaggtacagtaatgcttacctttctctatagacggtcaggtcaaatgaacttgccgtttggaactatcaaaaggaaaagtaacattgatttgttc

SEQ ID NO: 26070 - DNA, 1176 bp, Mus musculus
ttggatatagcccattatacttgttaggccattttaagcaccataaaaattactgtagatatgctaagatatatctgactattttacataatatagttacagtccactaataaatttgtaactaatgtaacatattactagtccgttcctttttatgacaatgatgttaactgtagccatttgaaaatcccttgacttttctgctaatctcagtctcatgacttcagaatgcatggcttgactgaatcagggtttctagagtggctagagactcattggcattagactggcaggcgtagctgttgtgtgtatactcctggcctctagctaagctttcatgaattgagcttgggcagatgaaggtgggaagctcccacataatccttaagtgcaggaaagtctgaggccactagactcgacagtttctgaggtctagaatcttctaactctccagttaatattattgaattaaagctataacttcataggcaggagatgtaacctcttgttttacacagggaccggcttactaaaaatgatgtagttgggaccacgtacctgtacctctctaaaattgctgcctctgggggagaagtggaaggtaagtcacctgaggaccagagctaagcaggactcaatgcttctagaaaagacaatgtcgattgcaacgctccggtagtgcaatggtcagcgagtagaacttacatagaacgcatgaaatgtggcagtcgcttaggaacaggctcgatgccttaaaagcaaatgtatctgggactgatgatgcaggactgcgaccccagctgcagaggagactaagacgggagaatcacaaattggggcctatctgggctacataggtagtttccctctagcctaagcaacttacaagaccccatatcaaaataggaatgagaaacaaggctggtaatgccgtcaatcattagagtgtgttatctacagaataaaaagtactgggttcaatttctaatacacacacacacacacacacacacacacacacacacgcgcgcgcacagtgagcccagtgagcctggccaatgatgttttggtgataaacagcacaataactaacgacagaaacaaataagaagttatacattttcatctctcttgctcccatccaaaacctttttgccaggagctgtttatgataga

SEQ ID NO: 26071 - DNA, 1105 bp, Mus musculus
atatattatcttatcatatttgtactgttgaattacacattatagcatttttattgacctatctgtggtacttttaatattctagggcttcagttccatgtctctatgctcttacatcttcacgagccatgtcagatgtggctattcaatcacagaacttttcccccaggactatactcagtgttcaatactcagccgtcacgagtctgtctatctcattccttctttgccaactgtattccttacctctagtcatttatctgagttgtagctacattagtataacaaagattctttgtctgcttgtgtgtgctttgctagagtgtgtgtgtgtctatgtgtgtgtatgtgtgtgtgtgtgtgtgtatgtgtggtgtgtgtatgtgtgtatgtatgtttatgtgtgtgtgtgtggtgtgtgtatgtgtatgtgtggtgtgtgtgagtatgtgtgtgtgtgtggtgtgtatgtgtgtgtgtatatatgtgatgtgtgtatatatgtggtatgtgtgtatgtgtgtgtgtatgtggtgtgtgtgtgtgtgtatatgtggtctgtatgtgtgtatatatatgggtgtctgtgtgtgtatgtggtatgtatgtgtgtgtgtatatatgtggtctgtatgtgtgtatatatatgggtgtgtgtgtgtggtgtgtatatgtatgtgtgtgtgtgtatatatatgtgatgtgtgtatatatgtgttatgtgtgtatgtttgtgtgtgtgtgtgtgtatgtgtgtgtggtgtatgccataactcatggaaaggcatgttatttctcaccataattataaggttgtcgttgttgggtgtactgctacagtaataacagatttgggagaaaaagagagtctaatgctcaaatccatgtgagttataagaaacaccttggctttcagtgttagtgcatgtaaagttgcaagtcttgccttcagcacactcggcacaatcagaaggctgcaatgggaggattagggagttgagagttagaccacgtgccctggtttgcttggctgcctccccacacagtgcttggtttgctgtcagtgggggcttggtttagacagtaagttctatggtcaacataa

SEQ ID NO: 26072 - DNA, 1151 bp, Mus musculus
agtgcacctgcagatcacttaccttcttattgtttggttttgtttttagttgagtccctcttccataagtaaaaatagttcatttggttccctgcactccccacacagtgttcctcccagatgaatagtcagaagacagtctgtgctgtagctacaataatcgagattttgctgagattttatttcaatagtttgcactacataaacgttatgttgacgtttttgattcgttttcatatttgagataaacagttatcccaatgtgtttttttctaactgcacatacatttttttctttccctcttgtctgagaggaacaatgtctcaggaagtacaaggatctgtgtaaaaatcgtctgggtttaaatcttgattctgccacttgatagcatgtaactctgagcagacaaaccccttgcttctctggctggagtttgtcagtcttccttttataagccttgccttcatatcagtaaagctgggccaagagcactgatgattaattatgataatgatggcaagctgccttgcagaaagcttggaatatactaagtgcttagttaatgatcaaacctccggttcttttgacatctgaatattactaacaattagtaatagtacccatagaaaaataagttcagttgtgatttctcagtggtgtgatgcggtatgggttacttttcctgtggctgtgttaaaatactctgatgagagcagtttaagggaggaagggtttgttctggtttctagtccttggggatcattccatcttggctgggaaggaggcctggcagcaagaacaagatggtcacattgctctggcactcagcaaccaaagggagaacaagtgaagccctgcctataaagcttcaaggcctgaccccagtgacccccttcctccagcaagactccatccctacaggttctgtagacttcccaaacaaccctagtatccacacaagcctttccttacagatacaccaagatcacccaaccctgaaaagtaggcttttcagtttgctggctagcctgtgatgatagccacctggttttctctatgtgagaatgaagaaaggaaagccattatggaattattttttgaattctgtgaaaactatacaaatagtgttactatttagtattgttatagt

SEQ ID NO: 26073 - DNA, 1131 bp, Mus musculus
ggtgtggtggctgttgtcctgacaggttgctcttcagtggctgtagttcctacttctagcctaacaggatctttttctaggccagctcgtaagttcaagcagagcagacaccatctattctcacaatgtagacagaaattcttaatatatttcaaaccagggaatagccatctttcccctcttttccacacccaccaaaaatgccaagaacgtgaaggaataaccccaaccagcaacttcttaagctgccttctgctcatccataccttaggccttggctttgctggttcataaagcagtgtttgagccataaacgtcacttactaacaatctcactgtgctcacatgagctcttgataagaaggcccggcaagtgttcttgtgctgacaaagatggtaaacatatagtgaagagaactgggcaccatctgccagctctaactgtctcgtcctaacatattccagatgcaggcatgtactctagactttgaaaatgaaaaactcgaccgccagaatatgcagcatcaactctatgtgattcttaaggaactccgaaaagcaaaaagtcaaataacacagttggaatccttggtaagctttgaatggctactgtaaaccttattcttcatgcatggatttggatttatggcaggctcatctccctgggcctctcatagtgtcccatgctagagcaaattgtggctcctaaccattgcccagcctccgtgctggcactgaaatgggtcacactgtgagaaggaaaaaaagaaaaaaggaaaaacttattcttcattctttttttgctaccttcccatttgtgtcagctcagtttccaaaccagttacatagcttaacctaaccttacagcatcaattcagaactcggaaggagtggtgccgcggccctcttactcataggtactttactgatgtctgggaccatccctacccaggttgggtgccaccattctagtagttgtttgcagagaggtgagaaggtagaaaagaggacagcatgacattcttttttttgtatttctaatgaatctatgtgcatctatgtccccacatgccccgttagtgcacattcatgtcttgtcttagaactacagaatatttgaaagtagagaaa

SEQ ID NO: 26074 - DNA, 1707 bp, Mus musculus
cagtggtggcacatgcttttaatcccagcccttgggaggcagagataggcagatctctgagttggaggccagcctggtctacaaagtgtattcaagatagccagggctccacagagaaactcttgttttaaaaaacaaaacaacgataacaacaaaaatattgatgagcagaaatccaacacaaactgtctgtagggctgaagcacgcacgcagaggatgtgggagcagttcacactgctgagtgctcaggcttatgttcaaatggtgttcatttgccgtttgttttgcagaagcagctacatgggtttaccatcacagagcagccattcccactccagagagaacctgaaagcagagtgaaagctacctcacccaaaagtcccagtgctgcactcaatgacagcctagtggaatgtcccaagtgcagcgtacagtacccagccaccgagcatcgagacctgcttgtccatgtcgaatactgcatgaagtagcagaaccattcttgcctttgtgctgaaaaagtccacactgtattctatgtttctttataggcactttaaaccacagatgacatcttttatacaagaaactccatctgcccttggcactctggcatatgagggcatccttgtatttttctggccactttgcatttccttggtagccattcctccctgagttggttcgtcatcaggctgcagtgacagattgtggtgagcagtggctatccaaacttgtagcacttcacgctgttgtaatgactagcatttcacacggttcttctacttgataaacagagctatttgggtttttggttatggcttaaagctactgagcagtaagcaaacattttatgctttgggggttttaagagaatcagaaggtaattaaccatggatcttactgttttgttttttttaaataagtgctttgtatactgacacttccatttgatacctcttgctattgtagaacggttactagcaaagttgggaagttttgtaatgttgagtgctgttaactgttctaagcacaaagcaggttttgtttgaagaatgcctttaagtggctgtatatttttactcctattacctggccataactttgacttaaatttcattagtacaggtcagtttcctaaaatgccaaaatgaacaaaactttagcaaaactatcttgcctcatttgatttgcagggattttattatatcattttgttttgttttgttttttagcactcttaaagatggttgggcagtgtaattatcagatgtttgttttctaaatagatatttttatatatgctttatgtaaaccaaaatgtgttttattccttcagattttctaacatgcttacacttgggctactatttagcaatatgaaggaggaaataataaaattatttaataagttttactgtgtctagtatgtgtgtgtatacatatatagtcttaagagctctagtcacagagtggtgttgggagtctaggttgacacacatcataaggtgacaggaactgaggagagaggaggtaaaggagtggaggctttttggtatctctgctgaatagatagcaactcttgatcaataaatatttttctgagttgtttgttacaaaggcaaagcaacaagcctgtgcaggtatatgtaattttggcttttgtaatttgggagcataaaaaaatacagttctgttattgtaaa

SEQ ID NO: 26075 - DNA, 1194 bp, Mus musculus
ttttctgctgtaaaatggttttcaatacattacctgtaatgatacagtcaaaatccttgggggagaggctattgattttccgtttcttatattccggtgggccttcacagtagatgtcttccacagttgcattggtatggccgagccattccaccagccacttcaacttacagtcacaattaaatgcgttccctcttaggtccctgaaacagaaacctctgctgcatttgcagtgcatgggtcctgtcgtgacccacgcgtgaccagcattaacctgcacatgctccgttatctgtgtcgaacttgactgcctattcagcttgggctcagaaggtgatcacagagcacccctaaagccacccagatcctagtaacctatttttgtctggattcaatgctgtcttagactagaagagtagctagagtcaatggaaatagtgcatgagccatatacataagttgcatttttttaaaaacaggggcactaaggaaatgtaaaaatgaacaggtattaataattttaaagttttatttattctaatacattcaaaatgtcatcctctagatgtataatcaatataaacgttatgagatagcctactgattaatcaatactctgttctctctctcactctttctctctgtattatctttgagattctctgattagtttatgcttacatctcaattgtgatgctaaattcgcatcagaaatatattatctgtgtttagagttcataaagtttatagctcaaaaatagatttatattccttaagttgttccaaatgtaattattttctaatataataaaatgagaaaaaaactgcaatctaaaccttaaaaaaattaaggatcttgagtgtagccatgcatgcttagcctgttcaaagatcaaggctcagcctcttggacataaattaataaatagataaataaatgtaaaacgtaaaatgcagtgcctcatttgttctagcagcacaccatcccccatagctaagagtgtccagcaggtaccttactgggtctaaaggacagaattcggtgattgctgtatgattatttaattaaatccagtgagccactggcttttcttcttcatagacatagttaatcctgaccctgttctgtggtctacaaattccactttaataagaaatgacttcagcatagctgagttaaggcagacataattc

SEQ ID NO: 26076 - DNA, 3224 bp, Mus musculus
tcttcctcttcctcagaggggtctttggttccagtgccatgatcctcatgtattatgcgttccagacaacgtccctcgcagacgccacagttattgcgtttagctgtcccgtgtttacgtccatatttgcttggatatttctcaaggaaaagtatagcctctgggatgctttcttcaccttgtttgcaatcgctggagtgatacttatcgtgagaccaccatttatatttggttccgacacttcagggatgagagaaagctattcagagcacattaaggggacgtttgctgcgatcggacacgctgtgctagctgcgatcactctggttattctgaggaaaatgggaaaatctgtggactactttctgagcatctggtactatgtcatacttggccttcccgaagccatcatcatcctctttgtcataggagagtggagtctgccctactgtgggctggacaggctgtttctcatactcattggactcctaggtttggggggtcagatatttatcactaaagcagttcaaatagaaaaagcaggactcgtagcgataatgaagaccatggatatagtctttgctttcatctttcagattgctttctttgataatgtaccaacttggtggacggtgggtggggccctctgtgtggtggtcagcaccactggagcaaccattcgtcgatggctgcagggttccaaatgaagtgtcactgctgaaacctggtttttattttcaagtgtgctgtcacctagctcagacatcttgcacacccacacacatacctggagaatcttcatcactcattggctttctttaatacctttcataaagtgccatttttaaacatagtgcgtttttagttaagagtagctagctagccgggcgtgttggcgcacgcctttaatcccagcactcgggaggcagaggcaggcggatttctgagtttgaggccagcctggtctacaaagtgagttccaggacagccaaggctacacagagaagccctgtctcgaaaaacaaaaacaaaaaagagtagctagctaggctagcctcacagtctggatagcttttatctttgctttggctccttggttgggttaccattgatgagaagggagctcatttgaggaatttcagaaatttttatgagtacaatttttaaaatttatttctgacccgggatgtggatgggagatcctctattttagcagtgcacataagaagctcaacgttgacaatgctgctctagttagtactgtgctaatctgttgattgcaatatcatcccacttaggatgccaaagctgcaacttggtctaggtgcctacctacccataggagtataagcgaaccagccttattctcaaggatcttagagatgattactacacttttaactcatgtgtgccttttcgttttgatgctgggactttttatatgtactctgaacagagccttcagcttgccacatgtggttagcagttctctctttcagaatattaacaactctggctatcattttgaatttcagttgtctcctgttttattgaaattgcactttttttttaacattccgagatttccaaccttgaaatcatgagagcaaaatcttggcgtgatcagtgtgtacattcccatcctgaggtgatttcacttcagatgcggtggtttttctacaaattctctttgaattcatagtgtgatgccaaatacaatttttttctcaggattgtactaggctgggccattatcagattgcccagattctaccgttttcattttcaaaacccacagttctagaaggttcatcccgcaggctcccttcgcattaaaccaaatatttatacctttacagtacatgtctgttaataaacgtacagtctttttccatcttggaatggtatgttataatgcttgtggcatacgaaaaatgtaaagacttgttactccatagttgattggttttcccagtcttttgcatatacggaaagaacacaggtacaagccagtctttgacacacaatcctagtgtgaacttagacagtagattctatctgtggagcaccagcaggccagtactcctctgtgaaagaggaaaacttggtagattgggagtaaatgaccatgcgtctttggggcgctttggatgcctttatggtgaggccattgtggctgccacctcttactttgtcagacactgtctactgttatcattagctgcagacttgaggggctattgctctctcccacactcctcacagctcttctggaggaagggactggtctcctggatcttacatttagctatgaaaggatcttctccagtagttcctaagaggaactttgagtttggtggttttaaatcaccttagccacctgacatcctacatatgtacttagctgaatcacctcagttgcatttgaccccgcatagatctgccaatggtgccgttctaccaacatcctagaaaacacagagtcagcagactcttagtactctggaggggtcttagagggcatcctgagggatgacgggagggagggctgcaatagctggtttccatagcagcctcctcttactgagttccactcctggagtaccaccaaacttacacaatagaagagtgtctgggatagtggaagataacccctttggaaatacattatatttcaactgtgtcttaagtacatggatgtcaggatatgtggctgacattggagacaatgtttcttataccaacctttacagggtatgatttttaaacaatgttcaagtggtatacaaggctatgtattgtaacaattacgggggtttatgtattttccaaagattgtagtttctatatcttgcaaagggaaatatttttttcctaatgtgtttttattttgtaagtaataaaatcataaaagaaagatgttgggttttacaactatagaaagtgtctcacgactcgtttctcttctcgaccgggcgcttcaaaactcattttctatagaagactcgcctctagccgttttgtaggctgtgatcttaaattttcaaactttatctgttcctcatacacaacaaatacaacatctccaaaataaatagtaatctgttaagagaccttcacttttctaaacccacagagctcagagcagcttgaagttgtgttgtcttctacagctaggttctgtagtgccctaggaattctttctaccctcacaatgtctgtcc

SEQ ID NO: 26077 - DNA, 1141 bp, Mus musculus
gcctgggcacaggagcatgacttggtcgcctctctttgcaaagtcatgcctttacgacgagcttgttactgctttcatttacaaggtcctgaggcaggaaaagggttggtcctgcatgtgttctcccgcatctggcaagcactagcaaagtctctctgcaaggataactttgttcctttcgcttcatgcagagtgtggcacaatggaagacaggaacacagaactaccccagaggcatggaatcgaagcagctacaggatgtttgtctttcataatgccgtaagcccagagtcaaccctgcctcccaagcccgattctggggttctcttttcatgacactggcatgaatgaatagcttcaatttccgtttgagattagagaacctttatcatctatgcttatttgggtctcgaccctatacttcaataaggaatcactttgcaagcaggccatgctgagtagcttaagcttcagagagatttagcatcaaattataaatggtgacactttaatagtgagctcaatgtgcctcgagagccagcatgtaggagtctggcagctggaaagccccgtggcttcagattttccagattgtgaacccttccatcaagtaggaactccttcgctttgaaaatttctcctctagagcaagggaaaagttcatctgagtcctaaagtgtttcatagaaaatgcattattcttctctttagtgagacttaggtttttggctcagggtggaccctttagttctttttttaatggccacaaacccaacgagggcgccataatgggattgtagctgttttgtgtggtgtgtgtgtgtgtatgtgtgtgtgtgtgtggtgtgtgtgtgtatgtgtgtgtgtgtgtgtgtgtggtgtgtgtgtgtgtgtgtgtgtgtgtgtgtatgtgtgtgtgtgtgtgtggtgtgtgtgtgtgtgtatgtgtgtgtgtgtgtgtgtgtgtgtgtggtgtgtgtgtgtatgtgtgtgtgtgtgtgtgtgtgtgtgtgtgtatgtgtgtgaagcaaatgtcattaaggagactatattttccattttttttaaaggggatggggaacttcttatttcggaggaaaggaaaaagaatatttgaaattaagaatgacctaggaaatcc

SEQ ID NO: 26078 - DNA, 1182 bp, Mus musculus
cttcatggttttttttttttatttgatttaatttgatttgaattttttatgaatttatttacttattcactttacatccccatcgtagatccctttccttccagtccccctccccccatgactcctccctcccaccccctccctgtcatttctaaaggaatgaaggttcccccctgggtatctacccaccctggcacctcaagtcactacaggactaggtacatcctcttttagtgagttcagacaagacagcccaggtaggagaacagggtccacgggcaggcaacagagtcagggtaggaccagctccggttgttgggggatccgatgaagaccagcctgtacatctgctacatatggggggagggctaggttcagccctctgtgctctttggttggtggttcagtctctgggagcccccaattttgtgaattttttgataaataagttaaagttatactcttgttcattggctcttgttgaatgacacaaggaatgaccaaatctgacctttaaggaggaatgagtgctctcattgctagtgtgagagagagtatgagtcagaatctagagtctttgaagttgggttaacttattacctgagagtgataggggaaaattgctcagtaagatgaaaggtccaagatttccattgtgccataggaatatcggttcctgtccaaccaggaaagtgtttttctcttaaattctttgttgttgttgttttgttttgttttcttttttgagacagggttttgtagaccaggctgaccttgaactcagaaatccacctgcctctgcctcccaagtgctgggattaaagacgtgcgccaccaccgcccaccttaaattcttacagataaaaactgtatatgtttataaatagttataaagaactattttatataatagctattatcattgtagaaatgacttacaaatacaaaatgtgtatgtaaatactttctgctattaactgaataaagtagcttcgatttttacttcctagtcttacgaggttttgtttgttttttattttagtgaaaagcagctcagctaaatagacttagttcagtgccatagaaaccagtcattctgggactcaagagttctttcctcataaaaatgtgaaagcagaaaatccctccacccagaagcgtcagggatggtgacattttttt

SEQ ID NO: 26079 - DNA, 1152 bp, Mus musculus
cttctggccttgctgggttccaggtacaaatatggtacgcagtcacacatgtagacaaaacacctatacatattacaaaaaacaattttaagagaaagaacatagccgggcatggtggcccatgcctttaatcccagcactcgggaggcagaggcaggcggatttctgagttcgaggccagcctggtctacaaagtgagtttcaggacagccagggcagagaaatcctgtctcaaaaagagagatcgagagagagtgagagagcgagtgagagagagagagagagagagagagaacatatgttaaaggtgacttcctaatgtgaatacaactgagctttatcctagaaagggaagaaaataacttttccttttgaactgtttgttttgcttttgctttttccagacagggttactctgtataaccctgtctgtcctgaaacttgctctggagaccaggctggctttgagatccacctgcctctacttcccaagtgctgggataaaggtgtttgccaccaccaccctgactcttttggaatgtttaaagagggcattttagcaatgtgtaagatggaaaaaatggggaatgaagtgagtgtctagcatcttgatagttggatggagcacaggaacaagattagcgtaatttgaaacaaactttcacaaatacttattaggtgtgatcatggcaagtgacagtatcggagtcatcagcgcccctggaaagtggtgaggtcattgagtatgagacttacaggcacctgcagttagctgcctgagaaagatgcttacaagtgcaccgttgcctcgaagtgtgcatttcccctgagaagccttgtggccttccacattcctgtaagcacattgaccatggaagtatcttacctggatgtattcactgtacacagtggtgggtttcataaagacgctgtagtgtgttttatcctctcctctgcatcctttcccttcactcaggcttgaggaagaactttatgtccatttgtgtgtctttgtatactggagaagaccagaacagctacagtggagttggagttagaggcagttgtaagctgcccaatgtgagctgggaatttgagtcttctggaagagtaggaagcactgtcaaagtctgagtcatctttccagtccca

SEQ ID NO: 26080 - DNA, 1134 bp, Mus musculus
ccctctatttttctgttgggtttgtttttgagacagtattatgctggccttcatatcctagggtccccctgcctagcttcccagtgctggctgggattactggagtgtgcatatcattcccttctcctaaggatttcttagcaatttattactgtttgctgcctaagtaatcaatttgttttagttttctacaagtaaggttctttagctaaaattgaggtgtatgttttcatggtaagttacagtatttgtacatttctttaaaaaacagaatcttttaaaacgtagtgaaagcagcttttaacatttggcaagtttagttcttgattagtactatgaagtgccaccaccctgctgcttagttgttgcatatgcaagaaaaggtgatataatcatgggaagttcttaactccatcttagtttttttttttccttgcatttatttcattctgtcaatagagtatgaacactctttgggatttttaatcttcaattttgtagcccatgctgggctggaactcacagtaggtctccttttctgaagtgtgtgtgtgagtgtgagatgtccatttgagtttggagtagctgcaggtgagtttggagctagactaagcaggttgtgagccgtctgacatagcaggaccgctgggaaacaaacctggtacctctgcaagagcagttgtgctttaccagctgagccagttggtcataaagtaaatgtgccagagtccagcttcagcagggttcaggtcccaaagaggtgtagagtcagcaagggaaggagactgacactatctaaagacaaatcaggcaagatcgcaggtttattgaaggctttgcaccttttatactctatgtttgcatatatggtagctgaatcacaggtaatgctgaaagtggacttagtagatgtatgatcttctcacagaatacattcagttcaacttactttgaactatctaaccataaatagaaacccacttagtttaggaaataatccatcctgaaacaagtgatcagtcatatagttcacggtatgtattttgtatgtcagtgttcttcagtatttatttgtgttcgtggtgcacatggaggatggacagaatttgatgttatcacactagttgttttgta

SEQ ID NO: 26081 - DNA, 1235 bp, Mus musculus
gcagagggcaacatagatcacaggttttgttttttttttctgaggttttgttttgttttgttttgttttgagatagcatcttatgtaacccagattggcttggaattcccctatataacaatgactattgaactcttgattctttcatctgtctcctgagtactgggattaaaggcctaggcactgtgcctaggtaacagcaattttaaagttataaaaagatgtagtccctggccagtgagagttttgtttagtttgattagcctaaaagggatttcatatggtatttttcatacatgtcattatacttagttgttaattcctcccctcctattctacctcacccttgttttagtggtttgcgttctttgggttttgtctttggggtttttttttttgtttgtttgttttgttttgtttttttttagacagggtttctctgtgtagccctggctgtcctggaacttactcgtgtagttaggctgctgcctgacttgctgtgtagcatgactttgaatatttgtatctctttaatttagtatggaatatttttctttggataggctcaaaagtcttgggacagagagtccactgaaattcggtaccgcagacttcagcatttgcttgaaaaaagcaatatctactcaaaatttttgttgactaaaatggaacaacagcaattggaggtatgtatgtatgattaactagaaaataggttagaagcattttggaaacagctttttgaggtatagattagtacagttaaatgtagatatttcaattttattctttgagttttaaaaatttattttttgttaatgattttttgtctgcatatttgtatgtgtatataccatgggcatgccagaagaaggtattgggtccccttggatgagttacagatgcttgtgggctaccatttgggtgctgggaattgaacctgggtcctggaagaccagctagagctcttgatagctgagccatgtctccagacttgttttaaccagtcagtgtatagactggtgtaatcaccatcacaattgaaataatgtatgtttccattccaaaaatgtactcttgtgacatcagcaaactctcactattgattactgtactatagtattttatacatagatctttggtttcattttgtttttctatcatgaaactcctaaagccctgggatctccgcagtggtatccttttgaatgctgacatattgacacgtggctggg

SEQ ID NO: 26082 - DNA, 1135 bp, Mus musculus
ggcatgtgtataggattaagaacatgcagtcttggtggctcagtttgtcaaatacactatcaagtataactgtggtagttttcatatgaattacttgttctagtatcttagtggttcttcatgtgtgctctgagtaacttactggtctatatattgtaaatatcttctttctctttcttacctttcctgagacaaggtttctttgtagaccaggttggcttctaactcagatctccctgcctctgccactggaatactaaaagtaaaggcatgtgcagcccacctagtgtagctatttgtttaaagtagtaatggcatctttgggtatatatgtttttgttttaaaattatcaagtgctggtctggtatgagaacatctcaaggcgatacattagtctttttaaactcaataggaacaaaggggaaggcgtgtttagagtgtccctaaggagagaaaaagataactaatgttcatatttatttgttcatgtttaaatcttagattttaacgcctttcctactgagaagactgaagtctgatgttgctcttgaagtcccccctaagcgagaagtagttgtttatgcaccactttgcaataaacaagagatcttctatacagctattgtgaaccgcacaattgcaaacatgtttggatcctgtgaggtaattgtgaatttgaagtaactgttaatgagatgacataacttttttttttttttttttttttttttttttttgtggtttttcgggacagtgtttctctgtatagccctggctgtcctggaactcactttgtagaccaggctggcctcgaactcagaaatccccctacctctgcctcccaagtgctgggattaaaggcgtgcaccaccaccgttcggccatggcataacattttatgactaatttttagtgttttgtctcctcacccattctcagaactttgtgagtaagtaagaccccaaaagcagaaggtactttctgttacttatggttctgctaaacttactggtcatctgtatatcagttgttttgtggtctttggaaataaatgcgtgtttaaaatttacatatctatatgttcaacagcctgggttcatgatcctttatgctacagacaacaagtcagacata

SEQ ID NO: 26083 - DNA, 1151 bp, Mus musculus
ttgtttttgcacagactggccacaaccattttatataagtgaagctggccttggacttcattcagatccttctgcctctgcctcctcagtgcttagatttcagacatgtgctaccacacctctctatacaaaacttttaagagagttgtaggaaatgtgaatcatgttttgtggttaagttcatagttatatttgaacttaatttttggctttttcttgaaaagttaattatatcaatttaaaaatataaataatttgtaatttataacttgtcattgaaagttgaactgttaaggttgggtgtggtaacacatgccttttataccagcactcctattgggaaatagaggcgggaggatctctcagattaaaaaccagaaagaaaaaaaattgagctattaaaatggcacatgattggaaattatattaacattttttttctttcctttttcttgtctacatttaagattgatgaagagttggtaacaaattctgggaagttcttaattttggatcgaatgctgcccgaacttaaaaaaagaggtcacaaggtacttctgactagaattttaggtctttagtttcttatgaatcagtatagttattaacatagatgtgttaaaattctaggttctggtgttttcacaaatgacaagcatgttggacatcttgatggattattgccatcttagaaacttcatctttagcagacttgatgggtccatgtcttattcggaaagagaaaaaaatgtaagacctcacatgaatttcttttttgtgatttctgtcttcatctttgaaataatatgaccaaaaactttgtagtaagattgattaaggataagcattttgagtactaacagactttagttttgagttccatacctatgtatgcacaggcaaccttctgttgcagtctttgtataatagtatcctacttaaccactgctgtgagaataatggcacaataggggttgtattctgctttttatcctagttttcatcttttcatcatgaaaattgtaagcatgtggcaattagtttcctagttggctattattccacccagaacctgccagttaacatctcattgtttctttttatcacacttgtgatgtagcagtaggccattgtatcacttgacaatgttt

SEQ ID NO: 26084 - DNA, 4210 bp, Mus musculus
tgtttatacctttgtatacatagatttggatcagcaaaataaggcttcatattgtttcctctctgttgattggagctgaaataaggcattattaaagtgagctctgtgggtaagggaaagaatatcccacaattctctgtgtctttatataaaattttagagagaggacttgtgacatctcaacattatattagaaatattttacaatatactttggatttaatatgcatttaaaaatgtatgtgttctgatatttctctcttagatcaaatgaaggcttcaagaccaattaaagggaagacagggatattcaaaatactagaaaattctgaagattccagtgctgaatgtttattttaatgtagaactaaatggcttttaaaaactttggtttacatccattctggtaatttgcctgttggctttgaaatccatattgttcactttacttttataatatatcagtttttataatgtaactagtattgcatacttgatgaaaattttgtggattttacttagtataaaattcctataaatttaaatttttcagttagtttttgggactgggtagtacttctgagtttgttattatgtacttaaccattgccaagtttatcagtcttcctgtggaagtttagtgtctcccccaccccctttagtaatgtaattcatgggatttggacttcagttatggagtaggcgtctgatagggggagattgattgaaactgtactttctgttgctgaagtaaagtttttgatttttgggtcaataatttgacttaccaaataaatgtttattataatatgatctggtcacattattttttcaggaaactagtaatttatttaaattagtaagccttatttaatattaggattcaacaatattgtctgaactgacttcgttcttttgtaaggatgtcatataaagattttagcaggaaggcgcaaagaaaatgtaagatattgatgaaaaaacagaatttaggagtgatatattgtactaaggaagaatggaggttgaatggagaatttatagaagggatgcggatacaaccagagcgatatgcataagaaactcaggatacaaattaagggagcataccagccacaaagagaacaatcaaggccctgcccaggagattatatgacagtgaagaagaaatcctgagtttaccttacctaggagaggggatatattcaacaacccatttatttatttatttcctttaaaaaatatttttatgtgtacatgtattgtttgattcccctggagctagagttatagtaggttattagcttcctgacattgttgctgagaaacaaacacaagtcctttggaagagcactgctgagctgtctttttagcccctgaaacatttatctgcttactgattgtcctgtgggaaattgttctactttatgactggggggatcaagacaggtttctctgtagtccttgaactcattctgtagatcaggctgggttaggacttttcaagatctatttgcttctgccttccaagtgctgacagtaaatgcgtgcaccactaccaccaggctaatcttgaacagagtcatcctttcctttctggggtaacagctcttgggaggcatccatatttagtgttaaggaacccagagccttgtacctgctagacaagtacttgactgttcttagacttctttaactcgttttgagagagtgttttaggttgcccaggttgtcctttgttaatatctccttgtctttgtctacttagctaggatcatagtacataccatactcagcttgtttagtttaatagttactctctggagtcaatagaagatttgcatgtcagaaaagtgtatcacaggaactaatataattttgtgattgttaacatgggctctgtagtcagttctgggatcatattttaatgtgatctttgggaaatgaatgacctagtagctatagtttcctgcaaactgtagaaaccataagtctaggcattggtgtaaggattaagttatatgtaatacagctgcaaaataaaattttctttcatctcagaagggggatagtaaatatatatctatctcttaggatgctgccctttaacatgtcagctggagtcttttgaagagattgtatgcttaaagttttcttttctttcttacactgtagctgtctttagacaccagaagagggcatcagatctcattacagatggctgtgagccaccatgtggttgctgggaattgaactcaggacctctggaagagcagtcagtgctcagaacctctgagccatctctccagcccattttggtttttcatttggttagtcttgctgtagttttgcctatataatctacaccagaatcagcttcaagttttgttatttctatgatcatattccattgtttcatgtattcattttattattttctttaaactatgttagataatataaataactgagttttcagtgttgattatttacatatttaaagatgttattttctctattcctttagacattccataaactttgtgggttatattttcacagttatttatctgtttcctaaattttcctgttaaaccaaggatttcttagatacttatcttgcaggtatattacttttaaaagttattgttaccatttacctacattgtgttattttcagaaaacattattagtgtgatgctcagtgcattgtattgcttgcttgtttattgcttctgtgacagggtctcctgggctggcttcacatttgccaagaatgaccctgaactaccgaccctcctgcctccacccatcaagtgcaggcattgcaggcttgctccaccacacatgtatggtgttaacttttagatgattcactttctttttgacttagtacatgatcagttttgtgaatgtcttcatttatacttgaaaaaatatactttttttgattattgctttacaaattgttttattctttaataaatatccataattgcttaatttgttaattttctttttgagaagcttatttgttaaaaatttttagttgtctgttatattctccgtagaattacactactagtttaaagccgccagatacagttgtaggaacagaactgtgatatttcgcaagagttacaagcattctgaaccacgtttcttcagctgaattttctccagtggttttctttatgttgtttgctctgaagaaaattttttttgtttgttttagcaaacttgtatatagacacagaatttgcaagggtatgtacacaccatggctatggttagtcttattaccatacttttattgctttacagtcatttaatttctagccctataaaaagaactacttcacctcaatggtagaggctacagtgagcgcgcacttaggatatcctagatggtctcatcttgcttgctcctggagattacatcacctcagatgacgtcatcccagcctaaaacataccattagcggtaacttcaatccttaattagagatgacttcatcccttccttagtcagaaatgaccttgtttggatagtccttttgttattccccatagaaagaaaagaaaaaaagatgacttcatcccagatattgaaatctccatgccacacacatatggactctgctccgttttacagggcagtgggcgttaattggcatctgttgctttatttcttcatcggatattagggattttgttcagtttctgagcctgctgtgtacttacacacatgacaatggttggcttcttgtactctaagaatacatacatacctaaaattctatgcctaaaagtgatttgctgttgaatgaatatgtcttccccaatgcatgttgaaacctaatctcaatgatgacgttttggaagtgcagtaagagtttgtaaaccaaggtgtaagtagattgccgaaatgcagtgtcggtgggacatatttgcctcttttaccatgtgaggatacaataaaaaatgcttataaatcaagatgtaagtatattgtcaattgcctgacacgtctccaatgctgcataaatgaatttctggcccttaaaagctatctataatttttttctattgtaagagcccaaatggactaagaaagaaattaatgctatcattctaaaaatcagtgtttatcattgcttttcccagggttctcttgattcatataaaccctttcatccacttcagtgaa

SEQ ID NO: 26085 - DNA, 1134 bp, Mus musculus
gagagtggacaaaccatgaaagtgtgggagttgctgggtgttgcgtagcttgggggtaaagtcaacaaatcgatcagaatacgatcagaacttttatcttgacatgatagaggcttttagaatgacgagtcttcccattcacaatccagaggcctgctgtagggcctctgaagaaaccccagacctcacctcagaaagaacagtacagagccctggtgtgactaatggagacccattcttcctttctcctgcagtggtgtgtttgtgaagctgagggatcaccatcgccaccctgaatgctatgtgtgcaccgactgtggcatcaacctgaaacagaagggccatttctttgtagaggatcagatctactgtgaaaagcatgcccgggagcgggtcactccgcctgagggctacgatgtggtcacagtgttccgcgagtgatggagaggacctgccctgtctactgccctccagccagcctgctgcacctggttctcggaatattctggctctctcctccctgacagtcctgtgcttacttagtgttagtcatgcgcaataaacattgggtttcgtctgggctgactgactcccactggcagggtgacatctgcttttatattattgggagatggttttgtccctgtcccttcacccacacctcaatgcaccttcttcacttggagtcttctctgctgcaaatggacattggtccattggaactaagccaaatgtagtatctctgatgttacttggttttacttaataaatttagactttaaagcaatgtgtgacctcttagttgactctgcctgtgttctatgtcttgtttcatgaaatatggagtctctattaggtttggtttctaaagttgtgagagatgtaaggcttttcccaggcatgagaaagctactatgaacaagctgtgtttcttttcatctttgtgacttgctgtaagcatcattgagaacagcaaatattcttagttatttttctgttgctgtggtaaaacatgatgaaggcaacttatagaagaactagttcatttgggcttacagtcttggtagagaggcatgacagcaagtggcgtagcaccaccaactggggaccaagtgttcactgcctgtgtgtgtg

SEQ ID NO: 26086 - DNA, 1113 bp, Mus musculus
gccttaattctctgcccatccctgtgtagtctatagtttacttattagtttgtcctacccacattcctaagcgctagtttcaagacctgacgggtttttatcttgcaaacagctcactgcggtgttccccgcctagaataatctcatgatggatgtaatacattagccaaccttaggaccactgaccccctcgtggttttcctggttcccattcattcgggaagctggacacaggttgaatggatttgtgaaaagtgcagctcctcgcgaccccccgcggtcctggccaatcttttgcgggtctctgcacagatttacatatgaaaggatcatcttgtccctcacccaacacaaaggcctgtgacggccaatgaattgctcatttttagaaatcaaggtcattcctgttttctagaacttttaaaaccccttcttgggctggagagatggctcagcgggtaagagcactgactgcctattccaaaggtcacgagttcaaatcccagcaaccacatggtggctcacaaccatctggaatgggacctgatgtgtgtctgaagagagcaatggtgtactcagatacatcaaataaataaataaataaataaataaaccttttataaaaaggattggggccataactcagtcactaaggtgtttgacttaaatgagcaggaacctgaatttgaccccaaaactcctgtggaagactgagctcaggggcaggcatctgaaattccagctactgcaggatcagaggtcatcaggtcagctggtttagtttgcttggtaaagtcctggggcagtaaaagaccctgcctcagacaaaaggtgggagatacctgaggaatgacactaaggttgtcctctgacctccacacacgtgttcatgcacacacgtacatactgcacccacacacaggaacatacacacacacacacacacacacacaaaacctttttaaaactgctctttggtaaacacataattttactacctcttaacgacaaaagcaaatttacctgctactcatgaattagatatgtttgtctttattgttacataaagaattaagtcctgactgaatatttgatatggtaggacataagagt

SEQ ID NO: 26087 - DNA, 1179 bp, Mus musculus
gcagctcgttttgatatattagccatgcttgcagataaaggcaagccccaaactactcaccttttgcagtctctctgggatcaggaaaagaaaaagcaatcacatgtttgagaagtgggactgtaaatatgtaatgtatatttaactttgtgtagcccatgtacctaccttgtatagaaaaataatttttaaaacctgagcagaaaaggagtaaaatgagggagtcatgaagggtccccccccacacttttatttaaatgaaggaatttcaaataattcacctgcagacttttagcacaaaaatagtccttggaaattgttaacatattcggttgttctttggggaagagaagaccactataataccatttacttttcttttcgaggttctatttatctgcagtagtattaagtcatattgctggaataggttactacccccccaaaagatattattgagaaaaaataaaaatggtctatgtaacctatgaaagtattgcatttaaattgcacaccaagcgcatgtactacgcagacacaggtttttctgttcatctaatttttttccttattgcagtggattgatttgatagacatgttgagttactactttgctgtacatattatttaataaactttattcggaattgcgtggcacctctgtgttctcttccttcattggttcgttcttcccgtgagcccccacccctgttcctgccctctttgtcctaagtcagtggccacctggtttcctccctcgctgctttctcagtagcctagctgtgttcttcggtgaaactaattaaagtgtatcacttgttctgataacaaaagtaatgattctgtgtcttcaggagccaaaaggaaacattatgaaatatgaataagtctcagtctgtgcctcaaagcatggggaaacatggtatttagtatttgaagaccaagagggactgtgtgttttctgctgtggtgagatgcttgggtgttctccccacatcaagtatatcagaacactcagctcacatcccagtccctgcctcccaccaccaccacctcccctgcagccatcctatggctgtgagctgacatctcattcaggtggagcctgctgtgtatatacaggaggtcctcgaagagaaaaaactcaaacctctccccgcttggtctgtcctcctccga

SEQ ID NO: 26088 - DNA, 1903 bp, Mus musculus
cttctgggagctgctctagcccccgctgcttggggaatctgatctggagcatgtccatgagcaacattagccaaaaaaaaaaaaaaaaaatgtgcccagtctttacccactcccattttaaagaggtcccttggggctagataagtcagtccccatccgtgttccacaggtcatagcctgagcatcactgacaactcctgcctctgttcctgagtatcccagagccagcagacctcaagtgctgctagaggctggtctggttttgaagttttccttcagcaccatgacttgatgaagtctaggggaagaaatggtggcagaccaggtgccctagcactcagccttctgggtgatattgcctcttactgccctgatactcagacagaaagccatgccatgtgtgtcccgagcttgggagcaggtggcctggcagatgggctacatttgtgtctccacatgattaagccacaccttggggctctggaagtcacttggagtgtgttcttctcctggtcactaccactggctagccagggttagctgtgcctttcttctctggcttagtatgggcttgatacacttgagcccatagaatacagcctggtttccaggagctctcttagcatgtatagatgcaagctggctgcttgggcaccgtgagtaagatactcgctcgcagacctaggagggactctgcctcctgggttgtccgtggagtctgaacgccacccagaatattgtgttctctggtccttccccctcctcctctccacctcaggccagggtgtcctggtgcacatggtgaggcctccattcagagctcaggtattgctcactggcctgggtatgaggcagcaatcctccttttggtggcagctgtgagtctgtcttctgtgagccccagttatgaggagggggccctttgacacctgggtatccctagttgacatgaagataagtgtggccctgttcccagagctgagcctgccagggtctcagctgagtggacaacataggagaagccaatctagagagaccatgatacgtgcagagggtgtgagaggaagggacgcatttctcctacgagggactctagaaagcagtcagggttccctctcccttggctcacttctgaacaaccggggtgctgggagaccctttgtctgagggcagtttatgtctggaaatattgagattttttttcttttccagattctggtattcttcttctacccaaaattacatgcactaggccacaaataccagggattgtaggtgatatggggtatatactgaaaccctggctctctgcatagagttcagaatcaccccaaccactatactgtcccaaagtctggagtctttacaagtccattcttccgtgaccgcctgctgtcttagatagcatgggaccctaactccccctgccccccaaccaccaccagtcagccacaattctccgaggaggctctcggggaaactgccacaggttgattcacactgaaatataaatggctgatggggaaataaatgtgttgcctcttcccggagacatcctttttaactgagacagagcagagcctttaatcccaagggaaaatggtagaagcttcctgggcagaaagacccggcgagtctatgacctgttgctttgcaagctcagcttccccagccagctgcactgcttgcttttttgactttgtccctctcgaagggaacataggacaaataaataaaagtgcatatgtgcgtttttttacttttctggaatgcagcctttgctctctccgagatgccagccacggctagtgcgattgtatctaaatttcctgaggggtgttttttgattaagtaggtaatgtcaaacacccctttaactacagctagaaaataaaaccatttt

SEQ ID NO: 26089 - DNA, 1131 bp, Mus musculus
tgcatttgtgcacttgatgcatcagtgtgcttttggctggcaagccagaagaccagcagcagcctttgccaataatctgtaaactgcattgcttttcctatgggctggagctttgacaagctgcattgtggctgacttaaatttactccacaccccagttgtggtttggtcttgctgtatattaagtgtgggcccccaagacctggagtctgcctgtaggccacatccccaggttatttttaattgataaacaaagatgccaacagccagtagctgggcagaagagacataggtgcggtttagacataggattctctggcttgaggttggaggagaatgacccagggagtaggggatggaggagggatggaggagaaatcgccatgggttaagtgagaacgtgggttagggctggccaattggagtgaagagcagcccacagaaaacatagtaagtaataacgcagggttattgataagagatacattttaatagcatggagggtagatatctgcccagttcttatgcttttaaagacttagagtgaatataaaggttgtgtctgtcttttattggggaactaagtagtcaaaggtgggataaaaaccctggattgggattaaaattttttatgacacatacccttcagatttcttttcctgccatgattatgttatcccagagggataaactgaagacccactgtgtgtgtgaaacatgtctgaaaattagttaatttccacagaaagatactataaaattctatgaaaaggggttggaggggtggcttaaggccagtgccaggggaatctgacacctctgacctcttaatgcacccacacacctgcacacgactccacacagacacacacctatacacataattaaaaagaagtatccagcaaagagtaacaggcagcacagtgacatttaggacatcctcaaaatgtcccagcttaaagaccagagtaactataactgcaacgcctatgtgtggggcttattcgtcatccatatcccccaaacaccgaggactcgtgggaggggacccgttttgaatcgcatacattttcatcttatttctgtggttctggcatgaagtgcagctgctctgtgctggtttcattcatc

SEQ ID NO: 26090 - DNA, 1199 bp, Mus musculus
ttaaaaagtagtaaaataagacagcaataaagacttcaaaccagaatgggaacaaagaagtaaagagccaaagaaaaaacacaagaaagtcagacagacacagacacagagacacaacacgtttccaacagaaattatataaagacacaaagttagaaaccataatatataagcaaaagacctataaaggtttaaaaaacaaaaaagctcagacaaagcatcatgagaccaaaacttcccaaaaatcccagtgacttcactttgtattgtccatctattgctgggcaaagggcctgcccttaagtatggcttagatactcagtaagactcagttggaggtaactaatttttcctttgcgtaactctgtgtgtggtttaagacaactaccctcacccctggaggagctgggtgggtgctagggttggctggaagaaaggacatttagtcaggacaatcaggcctaggactagggacccaactcacccacagaagctgtgtttttgttttgttttttaatctgctttgggggaacatgttggtcattctgggtcccatcttaaatcccatcaggtagaaagagggatatacagtggagtcttcagggacgcaggtggacatttaatctatccagcaagcatgtggttatgtatactctataaaaagacttggggatttgctgtccacaaggtgggctgtgtgtctactcatccttggagctcagccttgagcgatgaccacagataagaacatgaactccaaggggggttgagatctctgcttatctctccctgtgtcttgatgtggtctctccacttcttaggctccttgaacctgatgaatcttaactatgtgtatggttatacatggagcaaacacataagccaagtgaaaaaaatgcaatttctgggaataataaatgctatgaaagaaattaaaaagaaaagagagagccggagaaagagagtgagggaaagtgaaaaggggcgagagagaccgatttcctatagagatctgaatggaggaaaggaatcagggaggggtggtctcaggaaacagcaagggaaggcagagcctttgaggcaggctgctttggcatggtggagggacaggaagtggggtggtttggctgaccttgggctgggggtggcttagggagggagggatgtgaaatgagatggtagtgtagatgggaaccaga

SEQ ID NO: 26091 - DNA, 1234 bp, Mus musculus
aagcagtttatgtctttgactatatatgtattttacacgcaaaacaaaaagcaaacccaattaaactgctttttatttctgtgtggccttccattgattttcccctccccctttttgtctgaggtcagtactgactctttctagaaaaaaataaaacaacaaaaaaaaccctttttttctaaagtctctgtcatgtggttattgttttaaaaacaaaaccagctataacagcagaacacgtttccacccttatattgtgagccaccagggacgccctgtcccaagaagtgtatcctgtttcttccttcaatggaagaagcattgttaatgtgtttcataagaaggcttaaactgtccaagggctagtggtagatatgggtcttgtcagtgagtctggtgggaagcaggcaggctactgccatccagggagaatttagtgtgatggttgtgtttcctaggctagactaacccaactatctgtagctggacacacaaccctttagaaaagagatacttaccacttttccaatgaatgttgggttgaactcaggcctatcctgtgcccactttaggcagaaccagggtttctctgtgtagtgcttttctgacagcaggctgattcaaacgctacccttcagccttacttactggctttcccaggtcctcagaggcaggcccctcccacagaaaggttggggcctttgcctctttgcagtgcctcctactttcagactccctcgaggtgtcttccttcctctgctcacctgtttctgttagtcttgttgacttccttgttttcttctagtcttcttccaccatattgggagttctggaaagagagaggattctatacctgttacacacacacacacacacacacacacacacacacacacacacacacacacacacacacacacacacacacacacacacacacacacacacacacacacacacacacacacacacacacacacacacacacacacacacacacacacacacacacacacacacacacacacacacacacacacacacacccacacacacacacacacacacacacacacacacccacacacacacacacacacacacacacacacccacacacacacacacacacacacacacacacacccacacccacacacccacacacacacacacacacacacacacacacacacccacacacacacacacacacacacacacacacacacac

SEQ ID NO: 26092 - DNA, 1324 bp, Mus musculus
agcctcaagtatcttcacgagaatctccctgttccccagagaaatttcagctgagaggtgccaggcagtcgggaccgttgtgcgccgtctggcacatggaggctactccaggatctccagagagaacctgatctcgtccctcacttcttggaagggtctgtcttctggacagttcacctatgcttctggctctcctcagcgtttccaaccttagctaatgttcacactccattttggccttcttgggtgtgtctgtctccgtaactggggttgaatctagggccttgcacatggtaggcaaatgctccactgccaggctgtctccctggccctgcagtccagtcctaggaagagaatcgctgttggagacagagaggcttggcttttcccagtctgttcacatcagaggtagaccctaagggacgcatctaccatcagagacaatggaaagtcctggctgccggaacgcctcagtgaggtaaagtctcttggcgttttgactgggaccagcccagccattctcagcctctcgacatgtaatttcatttcttttacgaaagctcgtcttaaggagggctaactccttaaaacctttaacattttcattggaaacggtgactgagacagactgactgtatccactggggagatgaccttggtgtgtctgtgaagttatgggcgcacatcctagacatctgcagtctgtctccggcctggggacacatggtaccttcaaagtagttggaatctgagcatcacgctggagggatgaatttcaggatgttcctacaagtgggaggaagatctacaatcatgcttgacctttttatacaaattattttgacatcctattctcgacctccaggacaaagactagagattattttaatactttagattctccccccccccctttttgagaaataaaattcttataaaagcccatgtgcacagttcgttttctcccttatttgtccttgccgtcatctccactctccctccctggtgacccttcctgccctgctctcagcatgttcctggaagttggcttggtgggtgggaacggtcatgggggagcagtttcaatggaaatggcgaagggaaaccttccagggagggactccggtcttgagaggaaaagaaaacagaacagtgggcaccaagagtttgtagtctgcttatatgatgatttggggctgtgcaagacatgaacatatttgtttctgtcacgtcctccccagcatctgctccaccatgtcaccagcccacatctttggttcactgtggctataactcaattcactctcctgacctgccaagtgtc

SEQ ID NO: 26093 - DNA, 1172 bp, Mus musculus
gatcatttcccactgtggacggttcctaagccacgtgaactggagagagagtttccgtgactcaggtgggcggttctggaaagtgcagttggcatgcgcagatgatgtttttaggtactttcgtgggttttttgtttttttcctttgttttttaaacagcttcaaggaaatagtcacacaccacataattcatctatttaaaaatttcaactcagtgatctctggagtattcatacacttgtacaaccatctccataaacaattatatgttatgttcctcatgacaagaaatctcacacctaagccgggcgtggtggcacacgcctttaatcccagcacttgggaggcagagccaggcggatttctgagttcgaggccagcctggtctacaaagtgagttccaggacagccagggctatacagagaaaccctgtctcgaaaaagaaaagaaaaaagaaacctcacacctattagtagccactgcctgcttgcatccaaatccccatccgtatacaacctccagtctagtttctgtctctgtgggtctccttattagaggtcttatgcgaatggaatcatgaactctgtggtcctcggtaactggcttcgttcacttagtctaatgtgttcaggcttcgtctgctttagaggatacaccaatgctctgtttctttgtattgccaaataatagttctctttgaacataccacattttacttattcggtcatcaattgatgggcatctgtgctatgaattatagtgctgccgggagcctacttttgtatgagtggggttttgttttggttggtttgtttgggttttttgttgttgctgttgttgttttgttgtgttcgtttccatctaagaatgtgaatgttgagcttcacgagagaatgtttacctagcaagaatgggaccctaagccagcctccaaccctgcagttaggagaaagatgtgaggaagagtgggaggagagaagacgtgttgactcgtgtggtaacctggtattaaaaaccaccgtgtttccccacggccgctgtgctgttcggtgttaccacccacagagtatgagggttctaatttgtctgacccttgacgatacccacttgttaacggtgtgtctttctgtgttgcgactgtcttaatgagaagtttttattcctttccttt

SEQ ID NO: 26094 - DNA, 1081 bp, Mus musculus
agtagtgataaaatcttcaaaagacttccaaatgcaagacgacatcccagttccttctgccagtgtaggtgttaatgtgcctgcaaatgatctgaattcaaaatgtaatggacaagaaaaacaaggattgtcagtattacaagatgtgagagattcagaggtgaccactaaaattccaaatatcatcacattacttaagactcaatcagatgcaataataacacaacaacttgtaaaagacaaactccgaaccacaacacaaaattcaggtcctgtatatgttcagaatccatttctaacctcagagcagaaaaatcctgtttttgttcaaactccaaaaggttttattataccactgcatgttgctaacaagcctggattgcacgttttttctggaagaccagttcctttggttaatactcggagtgtgcctgctactctccttgtaaacaagaaacctggaatgcttttggcaactaataatgggaaacctgaaagtgttcccacggtgaagactgagaatgttcatagttacggaactgtgactaaggaaccttgcaaaacaccttttctgaaggcagaacacaataacagttgtcttacacctggactttgttccagcattggaaattgtgtgaacatgaaaacttgctcagagaatacattgccattgaaaggttcttacattattaaaacatcagtaaattcttcagtgaaagctgttcctaacattctacctgagcagcagggccctaagatgaatatcttggatacagtaaagcaacagaatgaaaatttaccaaaagcatctctctacaccctcatgcctgacggtaaacaagctgtattttttaagtgtgtgatgccaaataacactaaactgcttaagcctaagttagtccaaagtagtacctaccaacatattcagccaaagagacctgcaggagcaccacagaaaatactcgtaaagatttttaatcctgttttaagtatgagtgcttttaataatctttcagctagcaactctgcatcctcattccagaaagagattgtaccatctaaaccaactgtacatggagag

SEQ ID NO: 26095 - DNA, 1197 bp, Mus musculus
gccatggacagagacatttagtggaagctactcgggattggaatatgttagaataatatactgtgattaccaaggaaaagatatctcagaaggaaaaaaatgggttggtataattcaggcattttctacattggtatagttttgaacatttctaagagttggttatatttctgtggaagaacaaaagctttatgtgtggtacttggaaataccacagttaacgtatgttttgaaagaaagtaattagcacagaccttgatttagttgtgtaaagatgcatatgtgggacagaagggtaaggaaatttttgacaaaagagttttcccatttgaatttagagactgagtagaagataatggtggacagccctttcttctcccaccagccttaccgacctgacaagagtttctctggaggtgaagaaccttctcacaaatggttccctgctacatataaagatggactgagcttagataaagttactttctgttatagttcatttgaaaggtattaattttctttgaagctacatcttgctggactgtagttaaacttgaaataatgcttgaagagtttagggcaagtcaatgctgttgttgttgctctgccctgtgtcagattggaatgccagttaattgtcttttcctgtggctgtcttccgtcactgcggtaactggggcaatctccagaggagaaacaaacttttttctaaaattcacttgaacgtcaacattttcttgaatttggtcctattttccagtgatccccttgcacagaactatgcttatctgattggaagtgtccataaccaaatgacttttttatctcccttggttggcatcccctcaaaacgaacagaaagaacatagaagcacttcaaagggaatgcttttcttgaaaattaaaactatttttacagagataatattttgaagcaaggttaacaaagcagattatatttttgcttgtgtttaattactgttcttacctaaacatgtccacattaggatagaccattttcaggatgaccaacaacccaaaatagtgttaatagttggtatttgaaaacagagaagcaagcattaacgatggactcagtagcagttcattaaacttgaaaaattcctaagagacatgcccaacaatttcaaaatggattattttcataacaatgcatttaccatatacatttgcatc

SEQ ID NO: 26096 - DNA, 1191 bp, Mus musculus
tttttttgtcttattggataatgaagttatattagaagatgatactctatgtaattttttgttttgttattactatacatgttaatgacattttcattgattagatcaatttcagggcttttttgtatataacaaaaatgtacatatttttgtattgattatgtaaatttgcacaagaagtttatgacacaaaaagtattttctttttagttctctgcatgcattaataaaagtgggtgatttaaaaataagaaaaaaggactgtacccatgttattttattggtttttattggtttttatttctgaccttttttgtttgttttttgttttggttggggacatactttttttttcagggattaaacactattattagcaagtgcctaaaaatgatgtgaaccgtttacacatgccaactgtaacagtaggtcctaaatgggcccattcccctaatagttttgatttaaacaaagccataaatagatgcttcaagctatattgctatgcacattatacttgtactgtttttgtgcagtttatctactttcttagtggaatattttttgtataaaacctgttataattgtgtttcttgaattgagtctgagtggaattgattgaaaatgcacagtatatattgataatgtacatgatgtttaaagaacggtaagcattaatttccttgttcattgttaatgaaggttttcttcaattaaacttaagcttgtgtttacatgagagtttcttcttttttttaactgagctaatggaaattctaatgggaaatcttttcctccccttctgtctatttaatgtctgagaaggctacagaataaacatgggactttcctttttcttcagaaattaatatttgaactttgagaaaggtcatatttagcataacatgtccttggctttgttggggaaagcttttgatctttaggaactttgttgttatgaataggtccataataaagtaggttccctctgtgtctaggagagagaaaaggctatcccagcgtccaaatatatgccaggggctggagagaggctctggttgagagcacttgctgcttttacagaggacccagcttcagatcccaacacccacgtgttgcctcacagtcccttgtaactccagttcaatgggttctgactcttattctccaaggacactacatgcatgtgta

SEQ ID NO: 26097 - DNA, 1093 bp, Mus musculus
tctgctaggtttaggttgagctctggagttgtttgaagtctgcgatgaaaaataatttttaaaagtattaagaacactaaaatggattagaattatcttaaaagatcctttataaaatgacttgtattgattggtttataacttcacacaggggtgacataaatgtatatcttgaaaaagatataggtcacaggtggcttaactctccctagttctcagtagaatagttcaaacaatattacttatgttaattagaaggggcttttgtactccattaatgctgtatttagtttactaatagctgctcagtttgtcagctgatagtctgaatactatcaaaaactaagaacatagttgaagcatgcttcctgaaaattaactacattagaaactgacatccttatactggtctcccaagtacaaaagtaggaagaagccgttaggagctggctagagagactctcgagtgtgctggtgtgctgtgtaggctcccgggccacagtggctgtggagaagcccaggcccttagaagaatcactgtatttgccacctgtacctcacggctgctatgcttgcgtgtttccactgacgatggggcctctttctaaaggcagttgctgcaaattccagttcttccaaaagtcacttgatttaagggttatccacaagttgtgcttattttgatatagcatttgtttcctaaatgtttactaatcactttatgccaaatgtcttgcagatgttatttttaaacttaactgaatttttacaaatataaaaaggaaaaagtatattagtgtaatttgtttaggaatagctacataccgaagggcttctatacatgaattctaggggcaaaagccttttgtagaaacctgcacactgcattccatctgggttttaagttcagatgtgaacattttttagtgcttctttttcttttacttaatgaacatgtgatatgagtagtgatgtgcaaaagcacagacgttcatgttttctatcatgtaaaatcctgtagttaagctgtatattagcagtgaaggtgttagagagatgagatgatggtttgaaagtgtgttgaagactagac

SEQ ID NO: 26098 - DNA, 2221 bp, Mus musculus
tcaagttactctttcctttgtgagctgttaatccacaattactgaccatactaatagtaagtgtgatttgattctaaataatagggtaggtttggctataacagatgcttttaaagcaaatgataccatttaagaaattcagagaggcattacttagaatgctgacataaagacatgaccttgaagaaaagaatagaattctctagagcagagtattttagtatttgtaactggcagactctggttccattgtatttgtttcaaaatgtgtttttgtttgtttgtttgtttcaggagcaatcggttacatgggaacaagtgcctttgttcgaaaaatctatactaatgtgaaaattgactagatatctgagacaacatggaacttcggatcagtttctctttcatgagggtggaacttgcacagaaaagaagaataatcgcaagaagagatttgggcttaacactgggtactttgtgggtctcttttgtggatggcttcaagtaacatctatttccattgatcctaggttcttactgactgctttctccagctgttcacagcagatgcttggattttatgcagtaggctttactacagtacatggctaatcttccccaaactagctcattaaagatgaaatagaccagctctcttcagtgaagaggacaaatagtttatttaaagcatttgttccaataaaataactagagggaaacttggatgctaaaattccataagtagaaaaatcttcctggcacttggtgtttctatgttattgaaaaatgatgttccagaaagattactttttcttttatttttactgccattgttgatgtgttgtgggacatttttatatattgaacctgggttcttttttgatctgttttggtcgtccctccattcaactgcatcttttttttttttaaaaacaaaattaaaagctattcaattctgcatggaatatatctgctgtcatcttaatcttagtttggatcaacctcatttatttatcttaaaattaaccagctttctcagttccatccaaagaagatacagtatgaaagtagaggtgcactctctataatacaatctactgtacagttagcaagcgaagtgttaaatggagaagatgcttgtttttattaaacatttggagatttagataatttacattttaactgaatgtctaaagtgattatcttcccctccctcccccaagttaatcttccatctttgtttttgggtttcaatgaaggctttacataagaaattattaaacaaaacaaggggggcaataaatgtatataacattaataatgtcgcgtaggtgtaggttcctggatgcatttggatgtacagactgactgggggactgtattgcgatgatgattggtgtagaaacgtatgggtctgggtggccttttacatcttgcctaccattgcatgaaacattggggtttcttcaaaatgtgtgtgtcatacttcttttgggagggggttgttttcttcttttatgaaactcctactggagctcaatttgtaatttagaaacatttaattttgttaatcctgtctgggacatttaggtaacatctaaagcattattgctttagaatgttcaaataaaatttcctgaccaaattgttttgtgacagtagatgtgtttataatttgaagatacctgctcagaaggccatattatagaatgtcatttttaaaaaataaaatataaagcatactttcgaaatacaaaggacactcattacaacccccaaactcagatccaggtatgatagtttatgcctataatcccagcaccagggaagctaaggtggaaggttgtttgagtttggaactgggctagagagtgagttattgctcactctgagttctgcgctactctgggggactctgtttcaaggggaaaaaaagaacagagtctgactgcttggctacgtacagtataagtatttcctttctgtgacattgtgacatacaatttaaacactcattgggctgctgtgctgtgtaaagaaagagggactgcagtgtagctcctttagtggtgagacatgaaggctgtggcaatctcaagaaatcattttaatttgtacatatattttcaggttctgcccacactgtgaggtttttctagaatcactgagtttctgatttagtagtttgttctgtagatccccaaagctgtgctgtgtattggtg

SEQ ID NO: 26099 - DNA, 1151 bp, Mus musculus
ctggaagtcaacaaaagcaaagtcctagtttgtaaaataataattacagaggcttgaacaatttatttacgagacaaggtctttctaggtagccaagaatgacctagaacttggtatggagcctgcgctggctctgacttccttgcctccacatcagctttcaaaggctgtgattacaggtgtgctccaccatgcctgacttgaacaaattacttagcatctctcttgttttccctttgaatctgtaaacgtggtgaaataacacggcctagcagttttgagaagactccatgtttacagaaagactttaggcccgcgcctagctcctggagtgtagttataaagtggcagctagcgtcgagctgtcatggaagccgtgcaaggatggtcagctaaagcttcacccgcggagttaagtaaggggcagtaggcatatctgaagggcaagtaggatttgactaattgcagaaaagaagggcattgtggatttcagggaaagagaagaaaagaggtgaagtacatttggaaaggaagagagtgctaaggcattttgactggagcgggcagtgcagaccagtgttgcagtgaaattctgaaggcgggagtaactaggtgaagaacgcaggaagagatcctgactgctctttcagaggtcttgaattcaattcccagcaatcacatggtggctcacaaccatctgtgatgggatcatatgctctcttctggtgtgtctgaagacagctacaatgtactcatacaaataaaataagtaactcttaaaaaataaaaagaaagaaaagaaaaaaggaaagtacccagcacctcttgcagagggccagagtttggatcctagcaccatgtacctcacagctccctgtgccttcagctctaggtagatcccatgcctctggcttccatacacacaaacacataaacataatttaaaaataagtctgatggtgtctgattaatattactatgaattttaaatttatagagaaattaaaaaaaaaaaccctccgtaggttctactgctgggtcacaaaaaggtgatgttggctgccccagacctacatatggctgtatatcatattcaccgatggttagaggtataattcaaagacacagggatgcagggtgagtctttcatg

SEQ ID NO: 26100 - DNA, 1164 bp, Mus musculus
gatgtcctcttccgtctaatgtggaggcctttctgccacaagccactggatccagatggtgtgttgtccatggcaggcagctccctgcagataagaaaggttgggttcgcctgcaatttcttgctggacagacctgggttccagacactccccaaaggatgaattttctcttcctgttaccggcctgtattatcccagaaccaggagtggaagataatttgctatgtcctgaatgtgttcacagcaacaagaagatcctaagaaactttaaaataagaagccgtgcaaagaaaaatgccctacccccaaatatgccgccgtagacaagattttactctgatctaaagggaatggaagaatattctgtgatccctataatggctaaaaacaaacaaacaaaacaaaacaaacaaacaaaaacctggctgtcagtcatcagaagcccctcctcctgtctcccagcagagtggagactctgttgacaaatcagcatccatctctctaacaacagcccgctgcattttaacatctctgactgacagctcctcatggcctcgtgctggattggctaaatgcttagctacctgagaaatgattcggttttactgggtttgttttgctgtactttttttatataaattttcttggcggggggagatggggagcagtttcatattagcaaagcagaaagtacttttttaaaaaaatatataattttttttgagtatggctttatcatgtagcaactccagtggacctggaaattctaggtagaccagacacgtgttgggttttacatgcctgtacaataccacctagccagtactgatgtatgtttgactagtatagagttcattgcttgtgctaaacaacctgggtgttgacaagtgtttatagagtgccatacatttgaaattatatagtatgctaccgttcagattggcttttacctagcaatatgcatgtgagaaatatccatgtcctcgattgatttttcttaatgttgagattccattgtccaagatgtaccttatgaattgatgctattacatgtggatatctggttggtttttatatatccaagacagggtcttttgcagcacaaaaaaaaaaaaagttagtaactgtaaagaataggagagttattaccaaaatctagggaga

SEQ ID NO: 26101 - DNA, 1168 bp, Mus musculus
ggaggacatgtgagcacaggacttaaaagatccttagaaggtgtactgtggatcctctcagtatcttctgtggtgcccatcattgttctagactcctgtttaattgtgagaggcaaggataaaaataagtgcagggcactatcacatgcagcattggaaatgtttattctctatcttactccatgtatgtatgtatgtatgtatgtatgtaggtacgtatgtatgtatgtatgcatgtgttcaagcacggacacactgtaactaaaaatactgaagtgtactggaacaggagggttgtggtttcagttcactctagagtgccagctttgacttacttattaacaatccagtaaaaatctgagagccaccattacaatacagttatctagaaacagaatttaagttttaagtatttaaaccaatttttaaaaattaaatattctaattgtattatactaatttgttctgttggcttataacagttgcctttatgcatctgtgctttggaattttgaatggggagagatttctgtacaaacatttcacacaatatttttgcagggacatttagtcggtctggatgaaccagcttccggagctgggcaagaagctttgcttaagcaagagcacgcaaaaatcattcgactccagagacaagcagaagagttcctcaatgcagtcttttatagaaaaggttggtttcagtggcaaacgacacagctgtctgcttgtcatatattaatttccttaatatagatgtcattttaagttactcttcaaatatttctgtattcctttatcacattaaatttggaataacgttaagacaacccattgtcctctttaattttaaactggggatgagtcttagttaaatagttcagacagaaatgtattgtgaaactttgtagctcattagataagttttagacatataaaatgctacttaataactataaaaattaaatccttaataactataaaaccagctcagtaaattgaaaatctaacctgaaattttgtttgaagtgaaaatgtagttaagtcttacagttgtatttgtaaacatttttgtaagcattgatatcttttaaaatatattttattttgtgtgtgtattttgcttgcatgtatgtatgtgcaccatgtatccagttcactgcaactg

SEQ ID NO: 26102 - DNA, 2279 bp, Mus musculus
ttggagatccttcctcttctgacaggtacccaggaagccagggtttggattcatccgctgcttgctctgaaatcaaggtttctaaaaatcctgctgtaaagcattctaaaagagaaggggactctggtagggtgacatccgagggaccagtgattgacagcatccatccagacaatctggaagaccctgaagactctggtgttagtgagcattcctctgatgaagagaccaagcaggagactgaaggagttggtgtcattacaaggcagactgttaaaaatatgctggcaaaggaaattaaaagggaagagggagggacttacccaaacagtgacccagccactgttggccagccattgcctggggacaatctggaaacccatgtctggtccaagatagatgagagagatgcccatgtgccctcagaaagcattccttgcaagagggatccagagcaggtaaaagagaacccgggacaccttgccatacaggacacagaggctgccgctatgagtgaggtagaccctgaggatacccaccataaagatgatgctggcctcgctccatgtagctcatctgggatatcagccagtcatagtgacggtgctgatgggccaccaaaatcagtaacaaggcctaagagactgccttcttctacctacaacctgagacatgctcattgttcgaatgccttggacactgcaaaaatgacttcagaaaagcaaggcacacaggtaaacccagcagccaaggaaggcggagcttccgagagtgcagagcccttagatgaggaagatgaggactcggtggtggaggagcagcccaagttcataggatggtgtgcagaggaggagaaccaggagctgatcgccagcttcaacgcccactacctgcgggtccagaagggctggatccagttggagaaggaagctcagccaacggcaagagcaaggagcaagtctgacaagctgaaggagatttggaagagcaagaagcgggcacggaagtgtagggggtcgttggaggtgcaaaagttttctcccgttcagatgctgtttatgaccaactttaagctgtctaacatctgtaagtggttcttagagacaacagaaactcgatctctggtcattgtgaagaaactcaatactcgtcttccaggagacatcccccttgttaaacaccctcttcagaagtttcctccttccaccatgtaccctagttcactacaggcagaacgcttgaaaaaacatttaaagaaattccctggagccattcctgctaggaataattggaagacacagaagctatgggctaaactacgagagaatcctgacctgatagagtcagaggatggcagtgacatcagctttggccctagcagtgaagacagcgtggaggaagtcagggaaggcagacatagccatcctcccaccaacttgcctactccagccagcacccggatccttagaaagtattccaatattcgaggaaagctcagagcacagcgcctggacagctcactgtgtggggcttctgaaatgaagcagggccgcaagagcgtgtgcattaacccgctcatgtccccaaagctcgccctccaggtgggtgcagatgggtttcccgtcaaccccaagagggctgaaagaagcaaggggagaagagggaagcagatgccggaaactttgcttaaagtggaaggtcagaacaagcgcaagagagcagaaggctctggtactcaagatggtaaggacaaggggccggcaacaaaagtcagcagaggcctttctgccaagaagctagctgcaaaggacagagccaaccaactctccaagaagatgaccttgaaagcgaataaagtgagagtctgtagaaagggtcctggaaggagctgcctgtcatccaggaaagaaaaagagaatgccaacagaagacctggccatcctgcggcagcctccgaagcgctgacaaagccttcaaaacaaaggggcgcaagagaagcctcttcaaagcccccaaaagtgaggaggagaaaccggaagctgagcagtggtaggggccatgccagacccttagcaaaaagcccagagaaccggactgccccaagaaaaagaaagctcaaggccaaactggactcttcccagggcaaacggaggcggttagaagccaagtgatagtggatagccactgagagcaacgggcccatgagagcaacctttcattttgcattaacagaatctggttttctgagcctctcaagcctttcacggtgtagttacggg

SEQ ID NO: 26103 - DNA, 1111 bp, Mus musculus
gcttgtcacaatatcagaaacaaactgaatcatccaagaagctgcccagtagccaggtagccacctccgtccctgtggcttcagatcagtcagctcaggcctcctcttagcttaaacaagcagtcacagccatgcagaatggactgtgtaaattacactcctgtgtaaattttatgggcacacaacctcgcccttttgcttaccgattgtccatgaagtagattaaatacttagagaaacccacaaagcctaaaataactaaatttacatctttgaagaaacccgctgacccctgcttgagaaaataaccacttttaggaattaatcctctccattccccttctgcctcgtgcctcccatctcagttctgtcctgtgcacacattcgtgtgctcttgctgtaagaggcatgccattgagacagctcctatgtaggctttgaacaagaagtgcatctccctttaaatactttaccccagcccctccatgaaggcactacatcctgtagaccagacttgggagcaaggtgtctttggattctaaaattctgtggcctgacccctgtcccgttcccatagtttgtgatcatagaactgcctctggctgtacttgtttactgaaataagccaagacctctctgatgagcttagctgggggtgcttctggggggcatttagttgtgggaaagtcaaacagcacggaaacaaaagcctagtggcaaccaaagcactgtttataatgtgttcccattgatctgtttttaatcgcacaccttcaaaataattttattaaaggcaagctaacaataaaatggcagtttgtacatcacacttacacaagttccaggctgtgagtcctccctgggcccccaactcaaataagtttctatttattctgcattccagaaagaggttgtcgtgtcagacattttcaaaatggggaccttgtcccctaatgagtggacagtgctgaagaccgaactccaggcctcatggtagacaaggcaggctttctaccactgcacaacgtcccctgcccaaattattttggaccttgcctattctggttatccactgaaacaggaagtgtctatacccaaagcagtcctcata

SEQ ID NO: 26104 - DNA, 1137 bp, Mus musculus
gaggagaaaccacggtggttgccggtatgagcttctcatctggctctcgggatttatgagagtcgcccttcgacacacctgtcaccttctgcacattgacaaaacttggggacaccttgtctttcctcctctccccttctcatcaagcaccctgtgcagatgcagcccctcccactcatctgtaacccatggttctaaaatgcatttagctttgcttctcaggagtcctggtctgcaatccagagcacccttgatatcatggaaccagtgctctgcggtcatgcatggccccctttcccctgtgcttcacccatggacaccccatctgtcacttagtcactcttctgggatggctgggttggcctgcagctccaggactctagggtccttggaggccaggtatgtaggaattacagtcatttatttgaactctagtttgcatatttccttatggcctccctttgtcttttctgaacaaggaaggcacgtgaatggtgatgctggagaaagtttttataagatgctgtttgtaagcaaatctgattctgagatgaaatgtgaatgggtaactaggtgccagggactttagcactgaactagacagtcaaaactttttaacctttgcagaaagtagattctgttctcatctaaatgttcacaagacgtgatgctgtaaatagttttctaaaaaaaaatatttattacatgttctgtatacaaactcatgttctgagtgatgttggtttgcattgtattgtagaagattatattttgaatagtggacttctttcataatacagttcactcatggagaaagaaacaaaaccagcaggttgagagctgtttggggcatttgatctgtaatggaccacccaatccaagctttaaccgcccccctcttctcccctggttgtgttatatatattatatatatatatatatatatatatatatatatacaggtgtacagtacaggtcagtgcttgggtctgcagagcagatttccaggtgtcctttctgatgtgttcccatagcaatatgaccccgggtgctgaccagtcctgtggtctcagaggatcaggttgggggacagctcttgcaatgcctcttgcctttcctaaggggttgctttacttg

SEQ ID NO: 26105 - DNA, 1144 bp, Mus musculus
tgtagggcaggggctacggatccggctccagattcagggagctgagtctccactgttccttaagtttttactggtccctcccggtggcgttgccaaggtcaatcttgtaggtgtttggatgtgctccttttttgctgtcttgtgagtcgtagccagtgctccaggagcccaagggcggggcctctggagggtccaccctcccttaccccagcgcctttcagactagtggagcgaaaagactctgcaaatggccactggccggacagcacgtgcctctgggcctggattccactgttagtgagtgtaggaaaatactgtgtctttaatggatgaaattcaatgtatgctgtgaatttgttggtttgaaacattgaaaaattttcattagacaatgtttacatacctcacctgaagaacctttgagagtgtatatatgaaatttaaaaatatattaagttgctttaaaacagtatgtatagctataaaagttggagttattttaactttgagtatgtaccaagtctcttaaatattggaatctcgtagactttctggcttctgtgttttgctttcctatggaccacatagataactgtgtttttgttcttgataaagggggcccacaccgacgtccaggcttggaaggattttctggtttggttttgaggggaggggtgtggaactagagggtgtgtgggagggatttctctaaccttgacatctgtgagctttttcaaggcgcttattttattgcagcatattaaagttctttgatattaaagtgtgtttgtgtagtcactgcagatggggaggggacagtacagcacagtcccctgcctcactagtgtgtggctgaaagcagactgtcagccatggggctgggcactaccctaaacgattaatgaccctctgagctataccttactcaggggacggatataaatataatggaagcatcgtgggagtcactggacggggcaggaaaggtggatgtgcaacctgaagggaggggacaagccagccagccaagtgctgtccacttctgtgaccccagcaggaatgtgacagaaaacaaacctcgcacttgccagaacgacttctgcgatctgacttgttggatctgctggaagtgagtctgttcaaa

SEQ ID NO: 26106 - DNA, 3129 bp, Mus musculus
tgtggttgttaccttggtgatgtgagatggctgtgtggttgttaccttggtgatgtgagatggctgtgtggttgttaccttggtgatgtgagatggctgtgtgtttgttaccttggtgatgtgagatggctgtgtggttgttaccttggtgatgtgagatggctgtgtggttgttacctttgtgatgtgagatggctgtgtggttgttaccttgcttctttcattatcatcctctcacctagaacatggctggtgccactgatacactctgtgcctggttactgtcactttggaaatgtcatgatctgctacttagaggagcttgctgcagtgtgcatgtggtgaaaacagaagcaggccgaggggctggttggcttgggtaggatgctgtcactcattcctagggatcaaatgtgctgctcacctgtctcctgagagcaggttggcatcaggaaaggcacgagtggcagtctctgcagggtccccagagggagcagttgttatgtgtccccgtagtctagaacagttgcttcctgcccatctccttgtctggatgggtacaggaagtggtggagcgtggagagccactgtctcctgagccgcaggtggcagttgcggatgctgaggtatgggcctggctctgtggaactaactgtgaaaccatgctcaccctactgtggggaaccagatacccagcaaaatacggttccacactgatgatagacagttgaacttgtgttattgttgagatgaaggctgatgttgtctatctgtcggccctctcttccatcctacactgtttcattgctgtaacagcagtgctgaaggaaatgtgatgttttcccttctagctggatagtttgggagcatggaggtgtgtgatctatagtggattttaagttccattctctaaagcagttttaggtcatccttaaggatctttattagcaaattcatttgtctaggtttctgactctttctggtgatgttgttactaagaaaaaggttcttttctttttgaaatatatttcttatgccaggtatatagtgaggtcaaacagaaacctcctttgtgttagcaaatcagagatgttctcctcagcatggagcctgctttcagtgtaccccaccatgctggaatgtagcactatgcagggatgcaagccaagcagtgccttgatgcagccaggagttacacactctgtgagcaagaaagagagagcgcgggactgaggagcctagtgtgggtagagggaagcgatgcccagggatggtctgggtgagagagaggtgccccatgcgcttgctctctgtggctggcctcttgggcagtgagttaccacgtgcatttgggaatgtggatttcatttatttattggatagtcattacttgctgtaagggtattttaggtcattttttcttgtagaagctgtgatccagtgcagaatagacttgaggaaaagcataaccttttgagtcttgtaacatgtggctttgtaacctgtggtatcttcttggaaacgcagacagaagctccatcgtcgtcacagaaggttgctgccgtccttctgacaaggcgtacagttgctgttttgagccagtatttaactaatgtttttaactaatgtttgtttgagacagggtttctctgtggtcctggctgtcctggaactcactctgtagaccaggctggcctcgaactcagagttttcctgcctctgcctccccagggctgggattaaaggcgtgagtgtagtcactgcctagctgacctgtgtcttaagggtttttattatatttattttccatgttggcgtagtctttgtgacagaacctttcttttctttctgggttaatcgtcataggctttgatgttgtgtcaaagtgtcatctggtggttattgttgccaactatgaagagacagatcctatctgatctgtatctgcactaggtaaatgaatagaggctgtgggccctttctctgacgttccacagaagtggattttctcactgagaccagtgatcaggtttgaacccgcccccgccctgtccccccattccccatgtcacatgcactgtgtagggcacaggtgggagacagtattggttagaaccaagtgctggaacattctagaagcacagctgatggggcctgagggaacccacagtggtccctccacacagcatgtgctatactctgaaggtcctcccagagtcagtcaggagtgatgaggaaacaccctgggggatgaggcagcacaggatgctgactggcaggttgtgtgctgaggtctcttttctgtgacatcctttcctctggagacagcatcatccctgctctcctacactctaaagtcttcagactgaagtgagggtccagatctaaaccagcaggactgtcccagagtttgcagagaatctggcttcctaagatgaaggttttgagtgaccttagtcctggtagcctgatgtcagactccctgtcaaaaagctggctttactaggcagccagtgctgaaagctgtgtggaggtagggcagtgaggagatggaggataaataataacctgagtgctttgtcaccatggaaactggagttcctgaggccacagcccatgctgaagagcttttgagcatgcccctgacatgcttggtccagaggctatagagaaggagtgctctcacccaaggcctttcagcaaggcgtgcctgtgcacgctctgtgtgctcgctcgctcatttgcttgctcactcgacccccaaaaggtttcttaggagaaggttgtacctatttgttattttttattattttgcatatatatatgtaattgtaaagaaacaatcatatatattgtcttttatattcatgtaatattctgaattaaattttttctgtttcatatctgtgggttctgactggtctcttggctcacgttgctttgaagagaggtagcttcctgtcctaaggaacttgatactctacaaagggctcgtcctgggttttctaatggagggaggggatgtgggtgggttcaggatgagtgaggctttggctgatggaaatttacttagatgaggtagcacacatctctaatcctagtacgtgggaggcagaatactagggacga

SEQ ID NO: 26107 - DNA, 1129 bp, Mus musculus
atgcagggtctcagatctgtcattgaacttgccttcctcagtcttccacaagctgggctcacagtcctgcacctccatgtatcaacactataaggagagagaactgcctgttctcagtgagacacagcccttttgttcttgtcttcccgcaggaagaaggtgaagctccaggggcagtttaaaggtctggtgaaagccacccagcggggatcccaggcgggacacaaactccgcagaaaggatcggcggcggccctgaatccctctggggaatggagctgttctctgctgtggtccagggcccctttctaactcccatgatgtttaacaccaactccaggtgtgagccttgctaaacctggacagagaatgactcattggaagcaggactcatttctaagagagatagatgcctaggattttggaaactattgtcctttggagacattgccaacatctaggagtggaaatgtgacgtcgctacctctgagaaggccttaagtggtgctctgctttctgtccaatgtggccatgagagcagagtgatgactgtggtctgcgtgtgtaagatctgctctaaccaggcgtagaataaatgtgcatgaccatgtttcagccctgatgagtggcttggccccttcctatccaattcccagtagtctgtctagcctgtagccttcacctgtgtcaggaggactccctgaatcagaagtggcagtaggaggtggaaggcgcagagggtactccatggctggttgctagatcacagggtagagcgccagggccccggaccaggcagacggagaccatgctgaccgctctcagagctgcatcttgcgctgcccctgttcataagcctctgtcaacatctctgtccattgactcagcagagctactgagcccttcctggcttcagcaatcatcaaaggaaccaaagcagagaacgtagaggaatgcggctctcgtgtttgctcacaaggcttgttctcttatacctcccaggaccacctcccacatcagtcagtaattgagaaaatgccctcccgagtgcaggccgtcctcctgatgactcaagctatgtcaagtagacacaaaactggccggcacacccatcttccctcactcttttt
